United States Patent 7,745,391 (HUMAN THROMBOSPONDIN POLYPEPTIDE) - sequence listing, part 113

SEQ ID NO: 329195 - DNA, 740 bp, Homo sapiens
tggatctgggaagggggatagggatggatgggttcatttgagagccacggcttaaagcggttgcgatcaggatgggacacaggtttgtttggggacaacaaagatggcatttgtgagtgttttgaagcaacccgtactgattacatctttctcccttgtgttccttttatcccaggtttgaattttctcggagaaagacaggccggccacgaggaaaacagaaacaagccgcagcaacatctaagcccttgaaaggatcctgagagaggggggaaagggaaaacagcagccaccagcccaaccacttgtgtcttctgccccttcccacctatcttgcccaccccaccagcccacgctgcttgggacttgaaatctgtggccgaaggaccgtcactacataacttcaaaaataatcaaccaccctcccttcccaaaccacccaaattcactcatccagcgtttacttttttgaatccactcagaacttttttctgcgacccccctccctaaatggagttgggtgggggggaaatgaatactgagttggcctttattttttaaaagactttttgatccaatgaggccccctaaataattgagttttgggtcctggttggttgttttattttttttcctccaaaattttaccccctcccccctgagcccgaggtgctgacgtcgcaaaaaaattggatagtaagtgtcgaattttcaaaaaccagccttgcaacaagaaatca

SEQ ID NO: 329196 - DNA, 826 bp, Homo sapiens
agccatcctaggaaggatgctgctgggagggagggacaggtgtgctgccctactcctccaatcgaattgctttcctgttcagtcacatatgctccccatgcttaacttgccagggctattttctcagtagtggcaagtggtctgtgtcgatttttcatatctaaaaaatagcatagttgaataattagtcattatactttgtcaaatatagagatgtggtttattagagggcctactcgggtagtccttgccacccatttattctgtgggtttgtttgttttgtcctcttaccatagaaaccaccatcatgggttcgggtcccatagaccccaaagaacttctcaagggcctggacagcttccttaaccgagatggggaagtcaaaagtgtggatgggatttccaagatcttcaggtgagtctttacccctttttgtattcactgtgagtagagaatattgtgtgttaaaacatggctgcagttgaggcacactggaatgatcctggaaaggaaagggaaagatagtcagtgcaataggattaaaatgtaacaattttaggataagggataggaaaagatgatcacttgtttctgaccataatggaaactggagatttggacgtccacggtcccaagggagtcatgctttggaatgagagcagggtagcctggtaacagaattctagattgttttggttcgtgttccacctacccataatgttattttccttcagggattctcaggtttttcaggggagagtaaataactaagccagtcttgaacagactattagggacagttgttgagggatagccttatcacct

SEQ ID NO: 329197 - DNA, 4535 bp, Homo sapiens
atgcgtgggagttcgtctgcgagagtttgaagttctgtctcgagagaatagactggccggtcctatacaaagaacagccgcaacatctaagcccttgaaaggatcctgagagaggggggaaagggaaaacagcagccaccagcccaaccacttgtgtcttctgccccttcccacctatcttgcccaccccaccagcccacgctgcttgggacttgaaatctgtggccgaaggaccgtcactacataacttcaaaaataatcaaccaccctcccttcccaaaccacccaaattcactcatccagcgtttacttttttgaatccactcagaacttttttctgcgacccccctccctaaatggagttgggtgggggggaaatgaatactgagttggcctttattttttaaaagactttttgatccaatgaggccccctaaataattgagttttgggtcctggttggttgttttattttttttcctccaaaattttaccccctcccccctgagcccgaggtgctgacgtcgcaaaaaaattggataaaaccaccatcatgggttcgggtcccatagaccccaaagaacttctcaagggcctggacagcttccttaaccgagatggggaagtcaaaagtgtggatgggatttccaagatcttcagtttgatgaaggaagcacgaaagatggtgagtcgatgcacttacttgaacattctcctgcagacccgttcaccagaaatattggtcaaatttattgacgttggcggctacaaacttcttaacaattggctgacgtattcaaagacaaccaacaacattcccctcctccagcaaattctactgaccctgcagcatctaccgctcactgtagaccatctcaagcagaacaacacagctaaactggtgaagcagctgagcaagtcaagtgaggatgaagagctccggaaattggcctcagtccttgtcagcgactggatggctgtcatccgctctcagagcagtacccagcctgctgagaaagataagaagaaacgtaaagatgaaggaaaaagtcgaactacccttcctgagcgacctttgacagaggtgaaggctgagacccgggctgaggaggccccagagaagaagagggagaagcccaagtctcttcgcaccacagcacccagtcatgccaagttccgttccactggactagagctggagacaccatccttggtgcctgtgaagaagaatgccagcacagtggtggtttctgacaagtacaaccttaaacccatccccctcaaacgtcagagcaacgtagctgctccaggagatgccactccccctgcagagaagaaatacaagccactcaacacaacacctaatgccaccaaagagatcaaagtgaagatcatcccgccacagcctatggagggcctgggctttctggatgctcttaattcagcccctgttccaggcatcaaaattaagaagaaaaaaaaagtactgtcacctacggctgccaagccaagcccctttgaagggaaaacgagcacagaaccaagcacagccaaaccttcttccccagaaccagcaccaccttctgaggcaatggacgcagaccgtccaggcaccccggttccccctgttgaagtcccggagctcatggatacagcctctttggagccaggagctctggatgccaagccagtggagagtcctggagatcctaaccaactgacccggaaaggcaggaagaggaaaagtgtgacatggcctgaggaaggcaaactgagagaatatttctattttgaattggatgaaactgaacgagtaaatgtgaataagatcaaggactttggtgaggcggctaagcgagagatactgtcagaccgacatgcatttgagacagcgcggcgtctgagccatgataacatggaggagaaggtgccctgggtgtgcccccggcccctggttctgccctcacctcttgtcacccctggaagcaatagtcaggagcgatatatccaggctgagcgggagaagggaatccttcaggagctcttcctgaacaaggagagtcctcatgagcctgatcctgagccctacgagcccataccccctaaactcatccccctagatgaggagtgttccatggatgagactccgtatgttgagactctggaacctggggggtcaggtggctcacctgatggggcaggaggctccaagttgcctccagttctggccaatcttatgggaagcatgggtgctggaaagggcccccaaggccctggaggaggaggcattaatgtccaagagatcctcacctccatcatgggtagcccaaacagtcatccttcagaggaactactgaaacaaccagactattcggacaagatcaagcagatgctggtgccacatggactcctaggccctggcccaatagccaatggtttcccaccagggggtcctgggggccccaagggcatgcagcactttccccctggacctgggggacctatgccaggtccccatggaggccctggtgggccagtgggtccacgtcttctgggtcctccaccccctccccggggaggtgatcccttctgggatggcccgggcgaccctatgcggggtggcccaatgcgggggggtccaggaccaggtcctggaccataccatagaggccgaggtggccgaggaggaaacgaacctcctcctcctcctcctccattccgaggcgccagaggaggtcgctctggaggaggacccccaaatggacgagggggccctggtgggggcatggttggaggtggtgggcatcgtcctcacgaaggccctggtgggggcatgggcaacagcagtggacatcgtccccacgaaggccctggcggtggcatgggaagtgggcatcgcccccatgaaggccctggtggtagcatgggtgggggtggaggacatcgtccccacgaaggccctggcggtggcatcagtggtggcagtggccatcgtccccatgaaggccctggcggaggaatgggtgccggtggtggacatcgcccccacgaaggccctggcggaagcatgggtggaagtggtggacatcgtccccatgaaggccctggacacggggggccccatggccaccggcctcatgatgtccctggtcaccgaggccatgaccatcgagggccgccacctcatgagcaccgtggccatgatggtcctggccacgggggagggggccaccgagggcacgatggaggccacagccatggaggagacatgtcaaaccgccctgtctgccgacatttcatgatgaagggcaactgccgctatgagaacaactgtgccttctaccacccgggtgtcaatgggccccccctgccctagggaccatttgcctgccctgttcacacaacccctgtggactgcagcctcgctctttccaccctgttatggcttctgtgaggcccattttcccttttccccagctgatgaggagccggccccctcagttcccacttgcttgggttcctgggggttttctgatcactggtgcgcattgatgtacatattttcctccagtctggggaggagagagactggaaacgttcctggactgctgaagaggagacccagttggcttcactttttgagaagattcgccctgtaccccaaacccctttccagtattacccttaatgcttgagaacctaaagctggttatcctggcgaacacccctacccttctattgcgggtccccacatgcacacagaactctgacacaggatcagctgcacttaagaaatcatcccagctaagttcattattcctcatggggtggggagatgctgaaaggggtattgtatatcccactgcactgagagggctcaatcagctggatttgagttctggaacacacatcatccccacccctcccccagcgtgggctcaccattcttagtcctttctcaagtgggaccttcaactttctgtgaacacccagtctgcgtcctgggtctgctaggttcgatgatggcgaactcgtatctgcatccggtgcaagttttagctggcagaggtgagaccggtggtgctggtctgcctttgccaactatagccagtctggagacttgataaaatacttcagtgagaccagcttctcatcaacttgggcccggcgtgctgggcctgaaagtcacactacatgcactgcctttgggagtcagctcactccctgctcccacctggaaccttgccagcgtgaaggaggcttccaggtacttcaccctgtcaaccacctctgaatccccaccaggcgccttcctgggtggattcaacaagatgattttgccctttcccagttctctccttcactttggcatcagttgttttctatgaaaacagtggattggttgggttttgtgcagggtcttgggttagagccaaaatggatttgaggatgagtatttttttttttggttttgtatattttgtacattaataataaacagtggaaagagaaagcagcttatttaaaaaaaaaag

SEQ ID NO: 329198 - DNA, 4791 bp, Homo sapiens
tggatctgggaagggggatagggatggatgggttcatttgagagccacggcttaaagcggttgcgatcaggatgggacacaggtttgtttggggacaacaaagatggcatttgtgagtgttttgaagcaacccgtactgattacatctttctcccttgtgttccttttatcccaggtttgaattttctcggagaaagacaggccggccacgaggaaaacagaaacaagccgcagcaacatctaagcccttgaaaggatcctgagagaggggggaaagggaaaacagcagccaccagcccaaccacttgtgtcttctgccccttcccacctatcttgcccaccccaccagcccacgctgcttgggacttgaaatctgtggccgaaggaccgtcactacataacttcaaaaataatcaaccaccctcccttcccaaaccacccaaattcactcatccagcgtttacttttttgaatccactcagaacttttttctgcgacccccctccctaaatggagttgggtgggggggaaatgaatactgagttggcctttattttttaaaagactttttgatccaatgaggccccctaaataattgagttttgggtcctggttggttgttttattttttttcctccaaaattttaccccctcccccctgagcccgaggtgctgacgtcgcaaaaaaattggataaaaccaccatcatgggttcgggtcccatagaccccaaagaacttctcaagggcctggacagcttccttaaccgagatggggaagtcaaaagtgtggatgggatttccaagatcttcagtttgatgaaggaagcacgaaagatggtgagtcgatgcacttacttgaacattctcctgcagacccgttcaccagaaatattggtcaaatttattgacgttggcggctacaaacttcttaacaattggctgacgtattcaaagacaaccaacaacattcccctcctccagcaaattctactgaccctgcagcatctaccgctcactgtagaccatctcaagcagaacaacacagctaaactggtgaagcagctgagcaagtcaagtgaggatgaagagctccggaaattggcctcagtccttgtcagcgactggatggctgtcatccgctctcagagcagtacccagcctgctgagaaagataagaagaaacgtaaagatgaaggaaaaagtcgaactacccttcctgagcgacctttgacagaggtgaaggctgagacccgggctgaggaggccccagagaagaagagggagaagcccaagtctcttcgcaccacagcacccagtcatgccaagttccgttccactggactagagctggagacaccatccttggtgcctgtgaagaagaatgccagcacagtggtggtttctgacaagtacaaccttaaacccatccccctcaaacgtcagaggtatggaccatattctcaggctctgaatggggtggatctgtggacacaagggagcaggagggggtgagtcggagatgttgatgacagttcctcttctgacagcaacgtagctgctccaggagatgccactccccctgcagagaagaaatacaagccactcaacacaacacctaatgccaccaaagagatcaaagtgaagatcatcccgccacagcctatggagggcctgggctttctggatgctcttaattcagcccctgttccaggcatcaaaattaagaagaaaaaaaaagtactgtcacctacggctgccaagccaagcccctttgaagggaaaacgagcacagaaccaagcacagccaaaccttcttccccagaaccagcaccaccttctgaggcaatggacgcagaccgtccaggcaccccggttccccctgttgaagtcccggagctcatggatacagcctctttggagccaggagctctggatgccaagccagtggagagtcctggagatcctaaccaactgacccggaaaggcaggaagaggaaaagtgtgacatggcctgaggaaggcaaactgagagaatatttctattttgaattggatgaaactgaacgagtaaatgtgaataagatcaaggactttggtgaggcggctaagcgagagatactgtcagaccgacatgcatttgagacagcgcggcgtctgagccatgataacatggaggagaaggtgccctgggtgtgcccccggcccctggttctgccctcacctcttgtcacccctggaagcaatagtcaggagcgatatatccaggctgagcgggagaagggaatccttcaggagctcttcctgaacaaggagagtcctcatgagcctgatcctgagccctacgagcccataccccctaaactcatccccctagatgaggagtgttccatggatgagactccgtatgttgagactctggaacctggggggtcaggtggctcacctgatggggcaggaggctccaagttgcctccagttctggccaatcttatgggaagcatgggtgctggaaagggcccccaaggccctggaggaggaggcattaatgtccaagagatcctcacctccatcatgggtagcccaaacagtcatccttcagaggaactactgaaacaaccagactattcggacaagatcaagcagatgctggtgccacatggactcctaggccctggcccaatagccaatggtttcccaccagggggtcctgggggccccaagggcatgcagcactttccccctggacctgggggacctatgccaggtccccatggaggccctggtgggccagtgggtccacgtcttctgggtcctccaccccctccccggggaggtgatcccttctgggatggcccgggcgaccctatgcggggtggcccaatgcgggggggtccaggaccaggtcctggaccataccatagaggccgaggtggccgaggaggaaacgaacctcctcctcctcctcctccattccgaggcgccagaggaggtcgctctggaggaggacccccaaatggacgagggggccctggtgggggcatggttggaggtggtgggcatcgtcctcacgaaggccctggtgggggcatgggcaacagcagtggacatcgtccccacgaaggccctggcggtggcatgggaagtgggcatcgcccccatgaaggccctggtggtagcatgggtgggggtggaggacatcgtccccacgaaggccctggcggtggcatcagtggtggcagtggccatcgtccccatgaaggccctggcggaggaatgggtgccggtggtggacatcgcccccacgaaggccctggcggaagcatgggtggaagtggtggacatcgtccccatgaaggccctggacacggggggccccatggccaccggcctcatgatgtccctggtcaccgaggccatgaccatcgagggccgccacctcatgagcaccgtggccatgatggtcctggccacgggggagggggccaccgagggcacgatggaggccacagccatggaggagacatgtcaaaccgccctgtctgccgacatttcatgatgaagggcaactgccgctatgagaacaactgtgccttctaccacccgggtgtcaatgggccccccctgccctagggaccatttgcctgccctgttcacacaacccctgtggactgcagcctcgctctttccaccctgttatggcttctgtgaggcccattttcccttttccccagctgatgaggagccggccccctcagttcccacttgcttgggttcctgggggttttctgatcactggtgcgcattgatgtacatattttcctccagtctggggaggagagagactggaaacgttcctggactgctgaagaggagacccagttggcttcactttttgagaagattcgccctgtaccccaaacccctttccagtattacccttaatgcttgagaacctaaagctggttatcctggcgaacacccctacccttctattgcgggtccccacatgcacacagaactctgacacaggatcagctgcacttaagaaatcatcccagctaagttcattattcctcatggggtggggagatgctgaaaggggtattgtatatcccactgcactgagagggctcaatcagctggatttgagttctggaacacacatcatccccacccctcccccagcgtgggctcaccattcttagtcctttctcaagtgggaccttcaactttctgtgaacacccagtctgcgtcctgggtctgctaggttcgatgatggcgaactcgtatctgcatccggtgcaagttttagctggcagaggtgagaccggtggtgctggtctgcctttgccaactatagccagtctggagacttgataaaatacttcagtgagaccagcttctcatcaacttgggcccggcgtgctgggcctgaaagtcacactacatgcactgcctttgggagtcagctcactccctgctcccacctggaaccttgccagcgtgaaggaggcttccaggtacttcaccctgtcaaccacctctgaatccccaccaggcgccttcctgggtggattcaacaagatgattttgccctttcccagttctctccttcactttggcatcagttgttttctatgaaaacagtggattggttgggttttgtgcagggtcttgggttagagccaaaatggatttgaggatgagtatttttttttttggttttgtatattttgtacattaataataaacagtggaaagagaaagcagcttatttaaaaaaaaaag

SEQ ID NO: 329199 - DNA, 5150 bp, Homo sapiens
tggatctgggaagggggatagggatggatgggttcatttgagagccacggcttaaagcggttgcgatcaggatgggacacaggtttgtttggggacaacaaagatggcatttgtgagtgttttgaagcaacccgtactgattacatctttctcccttgtgttccttttatcccaggtttgaattttctcggagaaagacaggccggccacgaggaaaacagaaacaagccgcagcaacatctaagcccttgaaaggatcctgagagaggggggaaagggaaaacagcagccaccagcccaaccacttgtgtcttctgccccttcccacctatcttgcccaccccaccagcccacgctgcttgggacttgaaatctgtggccgaaggaccgtcactacataacttcaaaaataatcaaccaccctcccttcccaaaccacccaaattcactcatccagcgtttacttttttgaatccactcagaacttttttctgcgacccccctccctaaatggagttgggtgggggggaaatgaatactgagttggcctttattttttaaaagactttttgatccaatgaggccccctaaataattgagttttgggtcctggttggttgttttattttttttcctccaaaattttaccccctcccccctgagcccgaggtgctgacgtcgcaaaaaaattggataaaaccaccatcatgggttcgggtcccatagaccccaaagaacttctcaagggcctggacagcttccttaaccgagatggggaagtcaaaagtgtggatgggatttccaagatcttcagtttgatgaaggaagcacgaaagatggtgagtcgatgcacttacttgaacattctcctgcagacccgttcaccagaaatattggtcaaatttattgacgttggcggctacaaacttcttaacaattggctgacgtattcaaagacaaccaacaacattcccctcctccagcaaattctactgaccctgcagcatctaccgctcactgtagaccatctcaagcagaacaacacagctaaactggtgaagcagctgagcaagtcaagtgaggatgaagagctccggaaattggcctcagtccttgtcagcgactggatggctgtcatccgctctcagagcagtacccagcctgctggtaagctccttagtcctttatcctgggagttatttctttcctatgggatgtggcctttaggtgctgccagtttgcttcacctctgacagtgttcatctaaataaaatccttttctgctttgttttttcccaccagagaaagataagaagaaacgtaaagatgaaggaaaaagtcgaactacccttcctgagcgacctttgacagaggtgaaggctgagacccgggctgaggaggccccagagaagaagagggagaagcccaagtctcttcgcaccacagcacccagtcatgccaagttccgttccactggtaagactggcggctggcctctggagggttcatgggcatgtgcacacccagagccttatgggggaatcatttgatgtgtggtatgttaatcgtaaggaagagggaagactagcagaggaagctttggttacaaggctagaagaacatttgcgggtgagaacgggaggaaaattcgggggtctggggtttgagttcagctgcccacaccgtgcttctttccccaggactagagctggagacaccatccttggtgcctgtgaagaagaatgccagcacagtggtggtttctgacaagtacaaccttaaacccatccccctcaaacgtcagaggtatggaccatattctcaggctctgaatggggtggatctgtggacacaagggagcaggagggggtgagtcggagatgttgatgacagttcctcttctgacagcaacgtagctgctccaggagatgccactccccctgcagagaagaaatacaagccactcaacacaacacctaatgccaccaaagagatcaaagtgaagatcatcccgccacagcctatggagggcctgggctttctggatgctcttaattcagcccctgttccaggcatcaaaattaagaagaaaaaaaaagtactgtcacctacggctgccaagccaagcccctttgaagggaaaacgagcacagaaccaagcacagccaaaccttcttccccagaaccagcaccaccttctgaggcaatggacgcagaccgtccaggcaccccggttccccctgttgaagtcccggagctcatggatacagcctctttggagccaggagctctggatgccaagccagtggagagtcctggagatcctaaccaactgacccggaaaggcaggaagaggaaaagtgtgacatggcctgaggaaggcaaactgagagaatatttctattttgaattggatgaaactgaacgagtaaatgtgaataagatcaaggactttggtgaggcggctaagcgagagatactgtcagaccgacatgcatttgagacagcgcggcgtctgagccatgataacatggaggagaaggtgccctgggtgtgcccccggcccctggttctgccctcacctcttgtcacccctggaagcaatagtcaggagcgatatatccaggctgagcgggagaagggaatccttcaggagctcttcctgaacaaggagagtcctcatgagcctgatcctgagccctacgagcccataccccctaaactcatccccctagatgaggagtgttccatggatgagactccgtatgttgagactctggaacctggggggtcaggtggctcacctgatggggcaggaggctccaagttgcctccagttctggccaatcttatgggaagcatgggtgctggaaagggcccccaaggccctggaggaggaggcattaatgtccaagagatcctcacctccatcatgggtagcccaaacagtcatccttcagaggaactactgaaacaaccagactattcggacaagatcaagcagatgctggtgccacatggactcctaggccctggcccaatagccaatggtttcccaccagggggtcctgggggccccaagggcatgcagcactttccccctggacctgggggacctatgccaggtccccatggaggccctggtgggccagtgggtccacgtcttctgggtcctccaccccctccccggggaggtgatcccttctgggatggcccgggcgaccctatgcggggtggcccaatgcgggggggtccaggaccaggtcctggaccataccatagaggccgaggtggccgaggaggaaacgaacctcctcctcctcctcctccattccgaggcgccagaggaggtcgctctggaggaggacccccaaatggacgagggggccctggtgggggcatggttggaggtggtgggcatcgtcctcacgaaggccctggtgggggcatgggcaacagcagtggacatcgtccccacgaaggccctggcggtggcatgggaagtgggcatcgcccccatgaaggccctggtggtagcatgggtgggggtggaggacatcgtccccacgaaggccctggcggtggcatcagtggtggcagtggccatcgtccccatgaaggccctggcggaggaatgggtgccggtggtggacatcgcccccacgaaggccctggcggaagcatgggtggaagtggtggacatcgtccccatgaaggccctggacacggggggccccatggccaccggcctcatgatgtccctggtcaccgaggccatgaccatcgagggccgccacctcatgagcaccgtggccatgatggtcctggccacgggggagggggccaccgagggcacgatggaggccacagccatggaggagacatgtcaaaccgccctgtctgccgacatttcatgatgaagggcaactgccgctatgagaacaactgtgccttctaccacccgggtgtcaatgggccccccctgccctagggaccatttgcctgccctgttcacacaacccctgtggactgcagcctcgctctttccaccctgttatggcttctgtgaggcccattttcccttttccccagctgatgaggagccggccccctcagttcccacttgcttgggttcctgggggttttctgatcactggtgcgcattgatgtacatattttcctccagtctggggaggagagagactggaaacgttcctggactgctgaagaggagacccagttggcttcactttttgagaagattcgccctgtaccccaaacccctttccagtattacccttaatgcttgagaacctaaagctggttatcctggcgaacacccctacccttctattgcgggtccccacatgcacacagaactctgacacaggatcagctgcacttaagaaatcatcccagctaagttcattattcctcatggggtggggagatgctgaaaggggtattgtatatcccactgcactgagagggctcaatcagctggatttgagttctggaacacacatcatccccacccctcccccagcgtgggctcaccattcttagtcctttctcaagtgggaccttcaactttctgtgaacacccagtctgcgtcctgggtctgctaggttcgatgatggcgaactcgtatctgcatccggtgcaagttttagctggcagaggtgagaccggtggtgctggtctgcctttgccaactatagccagtctggagacttgataaaatacttcagtgagaccagcttctcatcaacttgggcccggcgtgctgggcctgaaagtcacactacatgcactgcctttgggagtcagctcactccctgctcccacctggaaccttgccagcgtgaaggaggcttccaggtacttcaccctgtcaaccacctctgaatccccaccaggcgccttcctgggtggattcaacaagatgattttgccctttcccagttctctccttcactttggcatcagttgttttctatgaaaacagtggattggttgggttttgtgcagggtcttgggttagagccaaaatggatttgaggatgagtatttttttttttggttttgtatattttgtacattaataataaacagtggaaagagaaagcagcttatttaaaaaaaaaag

SEQ ID NO: 329200 - DNA, 4453 bp, Homo sapiens
actggtggattttggttacatgtataagttctttaatggtgatttctgagattttggtacactcatcacccaagcagtgtacactgcacccaacgtgtagtcttttactaatgtagattttaaccacatattctgaaatattaggtctttttactccagagtggtgtgatgacatcagagttgaaagttatccaagtagaacacaactctaattcattgttccattttttaagggtttggtttttaagcatatctcatgttcttcttaaaactttgggttactttctccgttacataaattttcacaatattttctcaaacctcccattttctgttcctggaagaatgttactttacattatttaggcatttcccctttctgtcacctgcagagctccggaaattggcctcagtccttgtcagcgactggatggctgtcatccgctctcagagcagtacccagcctgctggtaagctccttagtcctttatcctgggagttatttctttcctatgggatgtggcctttaggtgctgccagtttgcttcacctctgacagtgttcatctaaataaaatccttttctgctttgttttttcccaccagagaaagataagaagaaacgtaaagatgaaggaaaaagtcgaactacccttcctgagcgacctttgacagaggtgaaggctgagacccgggctgaggaggccccagagaagaagagggagaagcccaagtctcttcgcaccacagcacccagtcatgccaagttccgttccactggtaagactggcggctggcctctggagggttcatgggcatgtgcacacccagagccttatgggggaatcatttgatgtgtggtatgttaatcgtaaggaagagggaagactagcagaggaagctttggttacaaggctagaagaacatttgcgggtgagaacgggaggaaaattcgggggtctggggtttgagttcagctgcccacaccgtgcttctttccccaggactagagctggagacaccatccttggtgcctgtgaagaagaatgccagcacagtggtggtttctgacaagtacaaccttaaacccatccccctcaaacgtcagaggtatggaccatattctcaggctctgaatggggtggatctgtggacacaagggagcaggagggggtgagtcggagatgttgatgacagttcctcttctgacagcaacgtagctgctccaggagatgccactccccctgcagagaagaaatacaagccactcaacacaacacctaatgccaccaaagagatcaaagtgaagatcatcccgccacagcctatggagggcctgggctttctggatgctcttaattcagcccctgttccaggcatcaaaattaagaagaaaaaaaaagtactgtcacctacggctgccaagccaagcccctttgaagggaaaacgagcacagaaccaagcacagccaaaccttcttccccagaaccagcaccaccttctgaggcaatggacgcagaccgtccaggcaccccggttccccctgttgaagtcccggagctcatggatacagcctctttggagccaggagctctggatgccaagccagtggagagtcctggagatcctaaccaactgacccggaaaggcaggaagaggaaaagtgtgacatggcctgaggaaggcaaactgagagaatatttctattttgaattggatgaaactgaacgagtaaatgtgaataagatcaaggactttggtgaggcggctaagcgagagatactgtcagaccgacatgcatttgagacagcgcggcgtctgagccatgataacatggaggagaaggtgccctgggtgtgcccccggcccctggttctgccctcacctcttgtcacccctggaagcaatagtcaggagcgatatatccaggctgagcgggagaagggaatccttcaggagctcttcctgaacaaggagagtcctcatgagcctgatcctgagccctacgagcccataccccctaaactcatccccctagatgaggagtgttccatggatgagactccgtatgttgagactctggaacctggggggtcaggtggctcacctgatggggcaggaggctccaagttgcctccagttctggccaatcttatgggaagcatgggtgctggaaagggcccccaaggccctggaggaggaggcattaatgtccaagagatcctcacctccatcatgggtagcccaaacagtcatccttcagaggaactactgaaacaaccagactattcggacaagatcaagcagatgctggtgccacatggactcctaggccctggcccaatagccaatggtttcccaccagggggtcctgggggccccaagggcatgcagcactttccccctggacctgggggacctatgccaggtccccatggaggccctggtgggccagtgggtccacgtcttctgggtcctccaccccctccccggggaggtgatcccttctgggatggcccgggcgaccctatgcggggtggcccaatgcgggggggtccaggaccaggtcctggaccataccatagaggccgaggtggccgaggaggaaacgaacctcctcctcctcctcctccattccgaggcgccagaggaggtcgctctggaggaggacccccaaatggacgagggggccctggtgggggcatggttggaggtggtgggcatcgtcctcacgaaggccctggtgggggcatgggcaacagcagtggacatcgtccccacgaaggccctggcggtggcatgggaagtgggcatcgcccccatgaaggccctggtggtagcatgggtgggggtggaggacatcgtccccacgaaggccctggcggtggcatcagtggtggcagtggccatcgtccccatgaaggccctggcggaggaatgggtgccggtggtggacatcgcccccacgaaggccctggcggaagcatgggtggaagtggtggacatcgtccccatgaaggccctggacacggggggccccatggccaccggcctcatgatgtccctggtcaccgaggccatgaccatcgagggccgccacctcatgagcaccgtggccatgatggtcctggccacgggggagggggccaccgagggcacgatggaggccacagccatggaggagacatgtcaaaccgccctgtctgccgacatttcatgatgaagggcaactgccgctatgagaacaactgtgccttctaccacccgggtgtcaatgggccccccctgccctagggaccatttgcctgccctgttcacacaacccctgtggactgcagcctcgctctttccaccctgttatggcttctgtgaggcccattttcccttttccccagctgatgaggagccggccccctcagttcccacttgcttgggttcctgggggttttctgatcactggtgcgcattgatgtacatattttcctccagtctggggaggagagagactggaaacgttcctggactgctgaagaggagacccagttggcttcactttttgagaagattcgccctgtaccccaaacccctttccagtattacccttaatgcttgagaacctaaagctggttatcctggcgaacacccctacccttctattgcgggtccccacatgcacacagaactctgacacaggatcagctgcacttaagaaatcatcccagctaagttcattattcctcatggggtggggagatgctgaaaggggtattgtatatcccactgcactgagagggctcaatcagctggatttgagttctggaacacacatcatccccacccctcccccagcgtgggctcaccattcttagtcctttctcaagtgggaccttcaactttctgtgaacacccagtctgcgtcctgggtctgctaggttcgatgatggcgaactcgtatctgcatccggtgcaagttttagctggcagaggtgagaccggtggtgctggtctgcctttgccaactatagccagtctggagacttgataaaatacttcagtgagaccagcttctcatcaacttgggcccggcgtgctgggcctgaaagtcacactacatgcactgcctttgggagtcagctcactccctgctcccacctggaaccttgccagcgtgaaggaggcttccaggtacttcaccctgtcaaccacctctgaatccccaccaggcgccttcctgggtggattcaacaagatgattttgccctttcccagttctctccttcactttggcatcagttgttttctatgaaaacagtggattggttgggttttgtgcagggtcttgggttagagccaaaatggatttgaggatgagtatttttttttttggttttgtatattttgtacattaataataaacagtggaaagagaaagcagcttatttaaaaaaaaaag

SEQ ID NO: 329201 - DNA, 4006 bp, Homo sapiens
tggatctgggaagggggatagggatggatgggttcatttgagagccacggcttaaagcggttgcgatcaggatgggacacaggtttgtttggggacaacaaagatggcatttgtgagtgttttgaagcaacccgtactgattacatctttctcccttgtgttccttttatcccaggtttgaattttctcggagaaagacaggccggccacgaggaaaacagaaacaagccgcagcaacatctaagcccttgaaaggatcctgagagaggggggaaagggaaaacagcagccaccagcccaaccacttgtgtcttctgccccttcccacctatcttgcccaccccaccagcccacgctgcttgggacttgaaatctgtggccgaaggaccgtcactacataacttcaaaaataatcaaccaccctcccttcccaaaccacccaaattcactcatccagcgtttacttttttgaatccactcagaacttttttctgcgacccccctccctaaatggagttgggtgggggggaaatgaatactgagttggcctttattttttaaaagactttttgatccaatgaggccccagagaagaagagggagaagcccaagtctcttcgcaccacagcacccagtcatgccaagttccgttccactggactagagctggagacaccatccttggtgcctgtgaagaagaatgccagcacagtggtggtttctgacaagtacaaccttaaacccatccccctcaaacgtcagagcaacgtagctgctccaggagatgccactccccctgcagagaagaaatacaagccactcaacacaacacctaatgccaccaaagagatcaaagtgaagatcatcccgccacagcctatggagggcctgggctttctggatgctcttaattcagcccctgttccaggcatcaaaattaagaagaaaaaaaaagtactgtcacctacggctgccaagccaagcccctttgaagggaaaacgagcacagaaccaagcacagccaaaccttcttccccagaaccagcaccaccttctgaggcaatggacgcagaccgtccaggcaccccggttccccctgttgaagtcccggagctcatggatacagcctctttggagccaggagctctggatgccaagccagtggagagtcctggagatcctaaccaactgacccggaaaggcaggaagaggaaaagtgtgacatggcctgaggaaggcaaactgagagaatatttctattttgaattggatgaaactgaacgagtaaatgtgaataagatcaaggactttggtgaggcggctaagcgagagatactgtcagaccgacatgcatttgagacagcgcggcgtctgagccatgataacatggaggagaaggtgccctgggtgtgcccccggcccctggttctgccctcacctcttgtcacccctggaagcaatagtcaggagcgatatatccaggctgagcgggagaagggaatccttcaggagctcttcctgaacaaggagagtcctcatgagcctgatcctgagccctacgagcccataccccctaaactcatccccctagatgaggagtgttccatggatgagactccgtatgttgagactctggaacctggggggtcaggtggctcacctgatggggcaggaggctccaagttgcctccagttctggccaatcttatgggaagcatgggtgctggaaagggcccccaaggccctggaggaggaggcattaatgtccaagagatcctcacctccatcatgggtagcccaaacagtcatccttcagaggaactactgaaacaaccagactattcggacaagatcaagcagatgctggtgccacatggactcctaggccctggcccaatagccaatggtttcccaccagggggtcctgggggccccaagggcatgcagcactttccccctggacctgggggacctatgccaggtccccatggaggccctggtgggccagtgggtccacgtcttctgggtcctccaccccctccccggggaggtgatcccttctgggatggcccgggcgaccctatgcggggtggcccaatgcgggggggtccaggaccaggtcctggaccataccatagaggccgaggtggccgaggaggaaacgaacctcctcctcctcctcctccattccgaggcgccagaggaggtcgctctggaggaggacccccaaatggacgagggggccctggtgggggcatggttggaggtggtgggcatcgtcctcacgaaggccctggtgggggcatgggcaacagcagtggacatcgtccccacgaaggccctggcggtggcatgggaagtgggcatcgcccccatgaaggccctggtggtagcatgggtgggggtggaggacatcgtccccacgaaggccctggcggtggcatcagtggtggcagtggccatcgtccccatgaaggccctggcggaggaatgggtgccggtggtggacatcgcccccacgaaggccctggcggaagcatgggtggaagtggtggacatcgtccccatgaaggccctggacacggggggccccatggccaccggcctcatgatgtccctggtcaccgaggccatgaccatcgagggccgccacctcatgagcaccgtggccatgatggtcctggccacgggggagggggccaccgagggcacgatggaggccacagccatggaggagacatgtcaaaccgccctgtctgccgacatttcatgatgaagggcaactgccgctatgagaacaactgtgccttctaccacccgggtgtcaatgggccccccctgccctagggaccatttgcctgccctgttcacacaacccctgtggactgcagcctcgctctttccaccctgttatggcttctgtgaggcccattttcccttttccccagctgatgaggagccggccccctcagttcccacttgcttgggttcctgggggttttctgatcactggtgcgcattgatgtacatattttcctccagtctggggaggagagagactggaaacgttcctggactgctgaagaggagacccagttggcttcactttttgagaagattcgccctgtaccccaaacccctttccagtattacccttaatgcttgagaacctaaagctggttatcctggcgaacacccctacccttctattgcgggtccccacatgcacacagaactctgacacaggatcagctgcacttaagaaatcatcccagctaagttcattattcctcatggggtggggagatgctgaaaggggtattgtatatcccactgcactgagagggctcaatcagctggatttgagttctggaacacacatcatccccacccctcccccagcgtgggctcaccattcttagtcctttctcaagtgggaccttcaactttctgtgaacacccagtctgcgtcctgggtctgctaggttcgatgatggcgaactcgtatctgcatccggtgcaagttttagctggcagaggtgagaccggtggtgctggtctgcctttgccaactatagccagtctggagacttgataaaatacttcagtgagaccagcttctcatcaacttgggcccggcgtgctgggcctgaaagtcacactacatgcactgcctttgggagtcagctcactccctgctcccacctggaaccttgccagcgtgaaggaggcttccaggtacttcaccctgtcaaccacctctgaatccccaccaggcgccttcctgggtggattcaacaagatgattttgccctttcccagttctctccttcactttggcatcagttgttttctatgaaaacagtggattggttgggttttgtgcagggtcttgggttagagccaaaatggatttgaggatgagtatttttttttttggttttgtatattttgtacattaataataaacagtggaaagagaaagcagcttatttaaaaaaaaaag

SEQ ID NO: 329202 - DNA, 1593 bp, Homo sapiens
  misc_feature (23)..(23): n is a, c, g, or t
  misc_feature (25)..(25): n is a, c, g, or t
ggcccccattcctccgccaggcntncatggggacatggcactgcaccactgatgccaccgccagccctggcggaggaatgggtgccggtggtggacatcgcccccacgaaggccctggcggaagcatgggtggaagtggtggacatcgtccccatgaaggccctggacacggggggccccatggccaccggcctcatgatgtccctggtcaccgaggccatgaccatcgagggccgccacctcatgagcaccgtggccatgatggtcctggccacgggggagggggccaccgagggcacgatggaggccacagccatggaggagacatgtcaaaccgccctgtctgccgacatttcatgatgaagggcaactgccgctatgagaacaactgtgccttctaccacccgggtgtcaatgggccccccctgccctagggaccatttgcctgccctgttcacacaacccctgtggactgcagcctcgctctttccaccctgttatggcttctgtgaggcccattttcccttttccccagctgatgaggagccggccccctcagttcccacttgcttgggttcctgggggttttctgatcactggtgcgcattgatgtacatattttcctccagtctggggaggagagagactggaaacgttcctggactgctgaagaggagacccagttggcttcactttttgagaagattcgccctgtaccccaaacccctttccagtattacccttaatgcttgagaacctaaagctggttatcctggcgaacacccctacccttctattgcgggtccccacatgcacacagaactctgacacaggatcagctgcacttaagaaatcatcccagctaagttcattattcctcatggggtggggagatgctgaaaggggtattgtatatcccactgcactgagagggctcaatcagctggatttgagttctggaacacacatcatccccacccctcccccagcgtgggctcaccattcttagtcctttctcaagtgggaccttcaactttctgtgaacacccagtctgcgtcctgggtctgctaggttcgatgatggcgaactcgtatctgcatccggtgcaagttttagctggcagaggtgagaccggtggtgctggtctgcctttgccaactatagccagtctggagacttgataaaatacttcagtgagaccagcttctcatcaacttgggcccggcgtgctgggcctgaaagtcacactacatgcactgcctttgggagtcagctcactccctgctcccacctggaaccttgccagcgtgaaggaggcttccaggtacttcaccctgtcaaccacctctgaatccccaccaggcgccttcctgggtggattcaacaagatgattttgccctttcccagttctctccttcactttggcatcagttgttttctatgaaaacagtggattggttgggttttgtgcagggtcttgggttagagccaaaatggatttgaggatgagtatttttttttttggttttgtatattttgtacattaataataaacagtggaaagagaaagcagcttatttaaaaaaaaaag

SEQ ID NO: 329203 - DNA, 1464 bp, Homo sapiens
tatactgctaaggtactctagacatcccattatctggaaaaggggggccccatggccaccggcctcatgatgtccctggtcaccgaggccatgaccatcgagggccgccacctcatgagcaccgtggccatgatggtcctggccacgggggagggggccaccgagggcacgatggaggccacagccatggaggagacatgtcaaaccgccctgtctgccgacatttcatgatgaagggcaactgccgctatgagaacaactgtgccttctaccacccgggtgtcaatgggccccccctgccctagggaccatttgcctgccctgttcacacaacccctgtggactgcagcctcgctctttccaccctgttatggcttctgtgaggcccattttcccttttccccagctgatgaggagccggccccctcagttcccacttgcttgggttcctgggggttttctgatcactggtgcgcattgatgtacatattttcctccagtctggggaggagagagactggaaacgttcctggactgctgaagaggagacccagttggcttcactttttgagaagattcgccctgtaccccaaacccctttccagtattacccttaatgcttgagaacctaaagctggttatcctggcgaacacccctacccttctattgcgggtccccacatgcacacagaactctgacacaggatcagctgcacttaagaaatcatcccagctaagttcattattcctcatggggtggggagatgctgaaaggggtattgtatatcccactgcactgagagggctcaatcagctggatttgagttctggaacacacatcatccccacccctcccccagcgtgggctcaccattcttagtcctttctcaagtgggaccttcaactttctgtgaacacccagtctgcgtcctgggtctgctaggttcgatgatggcgaactcgtatctgcatccggtgcaagttttagctggcagaggtgagaccggtggtgctggtctgcctttgccaactatagccagtctggagacttgataaaatacttcagtgagaccagcttctcatcaacttgggcccggcgtgctgggcctgaaagtcacactacatgcactgcctttgggagtcagctcactccctgctcccacctggaaccttgccagcgtgaaggaggcttccaggtacttcaccctgtcaaccacctctgaatccccaccaggcgccttcctgggtggattcaacaagatgattttgccctttcccagttctctccttcactttggcatcagttgttttctatgaaaacagtggattggttgggttttgtgcagggtcttgggttagagccaaaatggatttgaggatgagtatttttttttttggttttgtatattttgtacattaataataaacagtggaaagagaaagcagcttatttaaaaaaaaaag

SEQ ID NO: 329204 - DNA, 865 bp, Homo sapiens
gtgacacaggattagctgggatgatttcttaagtgcagctgatcctgtgtcagagttctgtgtgcatgtggggacccgcaatagaagggtaggggtgttcgccaggatcagctgcacttaagaaatcatcccagctaagttcattattcctcatggggtggggagatgctgaaaggggtattgtatatcccactgcactgagagggctcaatcagctggatttgagttctggaacacacatcatccccacccctcccccagcgtgggctcaccattcttagtcctttctcaagtgggaccttcaactttctgtgaacacccagtctgcgtcctgggtctgctaggttcgatgatggcgaactcgtatctgcatccggtgcaagttttagctggcagaggtgagaccggtggtgctggtctgcctttgccaactatagccagtctggagacttgataaaatacttcagtgagaccagcttctcatcaacttgggcccggcgtgctgggcctgaaagtcacactacatgcactgcctttgggagtcagctcactccctgctcccacctggaaccttgccagcgtgaaggaggcttccaggtacttcaccctgtcaaccacctctgaatccccaccaggcgccttcctgggtggattcaacaagatgattttgccctttcccagttctctccttcactttggcatcagttgttttctatgaaaacagtggattggttgggttttgtgcagggtcttgggttagagccaaaatggatttgaggatgagtatttttttttttggttttgtatattttgtacattaataataaacagtggaaagagaaagcagcttatttaaaaaaaaaag

SEQ ID NO: 329205 - DNA, 2068 bp, Homo sapiens
tggatctgggaagggggatagggatggatgggttcatttgagagccacggcttaaagcggttgcgatcaggatgggacacaggtttgtttggggacaacaaagatggcatttgtgagtgttttgaagcaacccgtactgattacatctttctcccttgtgttccttttatcccaggtttgaattttctcggagaaagacaggccggccacgaggaaaacagaaacaagccgcagcaacatctaagcccttgaaaggatcctgagagaggggggaaagggaaaacagcagccaccagcccaaccacttgtgtcttctgccccttcccacctatcttgcccaccccaccagcccacgctgcttgggacttgaaatctgtggccgaaggaccgtcactacataacttcaaaaataatcaaccaccctcccttcccaaaccacccaaattcactcatccagcgtttacttttttgaatccactcagaacttttttctgcgacccccctccctaaatggagttgggtgggggggaaatgaatactgagttggcctttattttttaaaagactttttgatccaatgaggccccctaaataattgagttttgggtcctggttggttgttttattttttttcctccaaaattttaccccctcccccctgagcccgaggtgctgacgtcgcaaaaaaattggataaaaccaccatcatgggttcgggtcccatagaccccaaagaacttctcaagggcctggacagcttccttaaccgagatggggaagtcaaaagtgtggatgggatttccaagatcttcagtttgatgaaggaagcacgaaagatggtgagtcgatgcacttacttgaacattctcctgcagacccgttcaccagaaatattggtcaaatttattgacgttggcggctacaaacttcttaacaattggctgacgtattcaaagacaaccaacaacattcccctcctccagcaaattctactgaccctgcagcatctaccgctcactgtagaccatctcaagcagaacaacacagctaaactggtgaagcagctgagcaagtcaagtgaggatgaagagctccggaaattggcctcagtccttgtcagcgactggatggctgtcatccgctctcagagcagtacccagcctgctggtaagctccttagtcctttatcctgggagttatttctttcctatgggatgtggcctttaggtgctgccagtttgcttcacctctgacagtgttcatctaaataaaatccttttctgctttgttttttcccaccagagaaagataagaagaaacgtaaagatgaaggaaaaagtcgaactacccttcctgagcgacctttgacagaggtgaaggctgagacccgggctgaggaggccccagagaagaagagggagaagcccaagtctcttcgcaccacagcacccagtcatgccaagttccgttccactggtaagactggcggctggcctctggagggttcatgggcatgtgcacacccagagccttatgggggaatcatttgatgtgtggtatgttaatcgtaaggaagagggaagactagcagaggaagctttggttacaaggctagaagaacatttgcgggtgagaacgggaggaaaattcgggggtctggggtttgagttcagctgcccacaccgtgcttctttccccaggactagagctggagacaccatccttggtgcctgtgaagaagaatgccagcacagtggtggtttctgacaagtacaaccttaaacccatccccctcaaacgtcagaggtatggaccatattctcaggctctgaatggggtggatctgtggacacaagggagcaggagggggtgagtcggagatgttgatgacagttcctcttctgacagcaacgtagctgctccaggagatgccactccccctgcatagtcccagctacttgggaggctgaggcaggggaatcgcttgaatccaggaggcagaggttgcagtgagccgagataacgctactggatccaggatggacgacagagcgagagtccgtctagg

SEQ ID NO: 329206 - DNA, 1902 bp, Homo sapiens
tggatctgggaagggggatagggatggatgggttcatttgagagccacggcttaaagcggttgcgatcaggatgggacacaggtttgtttggggacaacaaagatggcatttgtgagtgttttgaagcaacccgtactgattacatctttctcccttgtgttccttttatcccaggtttgaattttctcggagaaagacaggccggccacgaggaaaacagaaacaagccgcagcaacatctaagcccttgaaaggatcctgagagaggggggaaagggaaaacagcagccaccagcccaaccacttgtgtcttctgccccttcccacctatcttgcccaccccaccagcccacgctgcttgggacttgaaatctgtggccgaaggaccgtcactacataacttcaaaaataatcaaccaccctcccttcccaaaccacccaaattcactcatccagcgtttacttttttgaatccactcagaacttttttctgcgacccccctccctaaatggagttgggtgggggggaaatgaatactgagttggcctttattttttaaaagactttttgatccaatgaggccccctaaataattgagttttgggtcctggttggttgttttattttttttcctccaaaattttaccccctcccccctgagcccgaggtgctgacgtcgcaaaaaaattggataaaaccaccatcatgggttcgggtcccatagaccccaaagaacttctcaagggcctggacagcttccttaaccgagatggggaagtcaaaagtgtggatgggatttccaagatcttcagtttgatgaaggaagcacgaaagatggtgagtcgatgcacttacttgaacattctcctgcagacccgttcaccagaaatattggtcaaatttattgacgttggcggctacaaacttcttaacaattggctgacgtattcaaagacaaccaacaacattcccctcctccagcaaattctactgaccctgcagcatctaccgctcactgtagaccatctcaagcagaacaacacagctaaactggtgaagcagctgagcaagtcaagtgaggatgaagagctccggaaattggcctcagtccttgtcagcgactggatggctgtcatccgctctcagagcagtacccagcctgctgagaaagataagaagaaacgtaaagatgaaggaaaaagtcgaactacccttcctgagcgacctttgacagaggtgaaggctgagacccgggctgaggaggccccagagaagaagagggagaagcccaagtctcttcgcaccacagcacccagtcatgccaagttccgttccactggtaagactggcggctggcctctggagggttcatgggcatgtgcacacccagagccttatgggggaatcatttgatgtgtggtatgttaatcgtaaggaagagggaagactagcagaggaagctttggttacaaggctagaagaacatttgcgggtgagaacgggaggaaaattcgggggtctggggtttgagttcagctgcccacaccgtgcttctttccccaggactagagctggagacaccatccttggtgcctgtgaagaagaatgccagcacagtggtggtttctgacaagtacaaccttaaacccatccccctcaaacgtcagagcaacgtagctgctccaggagatgccactccccctgcagagaagaaatacaagccactcaacacaacacctaatgccaccaaagagatcaaagtgaagatcatcccgccacagcgtgagtctaaagtggggaagatgtactttgaattaggagcaaacttttttttttttttttttggagacagagtctcactctgtcacccaggctggagtgcagtggcacggtcttggct

SEQ ID NO: 329207 - DNA, 252 bp, Homo sapiens
acgagcccataccccctaaactcatccccctagatgaggtaagtcaatgttctgtgatgatggaagttgtgatggtcattgaattcggtgcatctttcatatgagaatgtctctgttctgtcagtcctgattttttttgttcttctttcaggagtgttccatggatgagactccgtatgttgagactctggaacctggggggtcaggtggctcacctgatggggcaggaggctccaagttgcctccagttct

SEQ ID NO: 329208 - DNA, 128 bp, Homo sapiens
tgtcatggacaaggggtggtgagggtggcattgccctcagctatttcctgtctaactgttttgccatcgttcccacagacatgtcaaaccgccctgtctgccgacatttcatgatgaagggcaactgc

SEQ ID NO: 329209 - DNA, 4290 bp, Homo sapiens
agccatcctaggaaggatgctgctgggagggagggacaggtgtgctgccctactcctccaatcgaattgctttcctgttcagtcacatatgctccccatgcttaacttgccagggctattttctcagtagtggcaagtggtctgtgtcgatttttcatatctaaaaaatagcatagttgaataattagtcattatactttgtcaaatatagagatgtggtttattagagggcctactcgggtagtccttgccacccatttattctgtgggtttgtttgttttgtcctcttaccatagaaaccaccatcatgggttcgggtcccatagaccccaaagaacttctcaagggcctggacagcttccttaaccgagatggggaagtcaaaagtgtggatgggatttccaagatcttcagtttgatgaaggaagcacgaaagatggtgagtcgatgcacttacttgaacattctcctgcagacccgttcaccagaaatattggtcaaatttattgacgttggcggctacaaacttcttaacaattggctgacgtattcaaagacaaccaacaacattcccctcctccagcaaattctactgaccctgcagcatctaccgctcactgtagaccatctcaagcagaacaacacagctaaactggtgaagcagctgagcaagtcaagtgaggatgaagagctccggaaattggcctcagtccttgtcagcgactggatggctgtcatccgctctcagagcagtacccagcctgctgagaaagataagaagaaacgtaaagatgaaggaaaaagtcgaactacccttcctgagcgacctttgacagaggtgaaggctgagacccgggctgaggaggccccagagaagaagagggagaagcccaagtctcttcgcaccacagcacccagtcatgccaagttccgttccactggactagagctggagacaccatccttggtgcctgtgaagaagaatgccagcacagtggtggtttctgacaagtacaaccttaaacccatccccctcaaacgtcagagcaacgtagctgctccaggagatgccactccccctgcagagaagaaatacaagccactcaacacaacacctaatgccaccaaagagatcaaagtgaagatcatcccgccacagcctatggagggcctgggctttctggatgctcttaattcagcccctgttccaggcatcaaaattaagaagaaaaaaaaagtactgtcacctacggctgccaagccaagcccctttgaagggaaaacgagcacagaaccaagcacagccaaaccttcttccccagaaccagcaccaccttctgaggcaatggacgcagaccgtccaggcaccccggttccccctgttgaagtcccggagctcatggatacagcctctttggagccaggagctctggatgccaagccagtggagagtcctggagatcctaaccaactgacccggaaaggcaggaagaggaaaagtgtgacatggcctgaggaaggcaaactgagagaatatttctattttgaattggatgaaactgaacgagtaaatgtgaataagatcaaggactttggtgaggcggctaagcgagagatactgtcagaccgacatgcatttgagacagcgcggcgtctgagccatgataacatggaggagaaggtgccctgggtgtgcccccggcccctggttctgccctcacctcttgtcacccctggaagcaatagtcaggagcgatatatccaggctgagcgggagaagggaatccttcaggagctcttcctgaacaaggagagtcctcatgagcctgatcctgagccctacgagcccataccccctaaactcatccccctagatgaggagtgttccatggatgagactccgtatgttgagactctggaacctggggggtcaggtggctcacctgatggggcaggaggctccaagttgcctccagttctggccaatcttatgggaagcatgggtgctggaaagggcccccaaggccctggaggaggaggcattaatgtccaagagatcctcacctccatcatgggtagcccaaacagtcatccttcagaggaactactgaaacaaccagactattcggacaagatcaagcagatgctggtgccacatggactcctaggccctggcccaatagccaatggtttcccaccagggggtcctgggggccccaagggcatgcagcactttccccctggacctgggggacctatgccaggtccccatggaggccctggtgggccagtgggtccacgtcttctgggtcctccaccccctccccggggaggtgatcccttctgggatggcccgggcgaccctatgcggggtggcccaatgcgggggggtccaggaccaggtcctggaccataccatagaggccgaggtggccgaggaggaaacgaacctcctcctcctcctcctccattccgaggcgccagaggaggtcgctctggaggaggacccccaaatggacgagggggccctggtgggggcatggttggaggtggtgggcatcgtcctcacgaaggccctggtgggggcatgggcaacagcagtggacatcgtccccacgaaggccctggcggtggcatgggaagtgggcatcgcccccatgaaggccctggtggtagcatgggtgggggtggaggacatcgtccccacgaaggccctggcggtggcatcagtggtggcagtggccatcgtccccatgaaggccctggcggaggaatgggtgccggtggtggacatcgcccccacgaaggccctggcggaagcatgggtggaagtggtggacatcgtccccatgaaggccctggacacggggggccccatggccaccggcctcatgatgtccctggtcaccgaggccatgaccatcgagggccgccacctcatgagcaccgtggccatgatggtcctggccacgggggagggggccaccgagggcacgatggaggccacagccatggaggagacatgtcaaaccgccctgtctgccgacatttcatgatgaagggcaactgccgctatgagaacaactgtgccttctaccacccgggtgtcaatgggccccccctgccctagggaccatttgcctgccctgttcacacaacccctgtggactgcagcctcgctctttccaccctgttatggcttctgtgaggcccattttcccttttccccagctgatgaggagccggccccctcagttcccacttgcttgggttcctgggggttttctgatcactggtgcgcattgatgtacatattttcctccagtctggggaggagagagactggaaacgttcctggactgctgaagaggagacccagttggcttcactttttgagaagattcgccctgtaccccaaacccctttccagtattacccttaatgcttgagaacctaaagctggttatcctggcgaacacccctacccttctattgcgggtccccacatgcacacagaactctgacacaggatcagctgcacttaagaaatcatcccagctaagttcattattcctcatggggtggggagatgctgaaaggggtattgtatatcccactgcactgagagggctcaatcagctggatttgagttctggaacacacatcatccccacccctcccccagcgtgggctcaccattcttagtcctttctcaagtgggaccttcaactttctgtgaacacccagtctgcgtcctgggtctgctaggttcgatgatggcgaactcgtatctgcatccggtgcaagttttagctggcagaggtgagaccggtggtgctggtctgcctttgccaactatagccagtctggagacttgataaaatacttcagtgagaccagcttctcatcaacttgggcccggcgtgctgggcctgaaagtcacactacatgcactgcctttgggagtcagctcactccctgctcccacctggaaccttgccagcgtgaaggaggcttccaggtacttcaccctgtcaaccacctctgaatccccaccaggcgccttcctgggtggattcaacaagatgattttgccctttcccagttctctccttcactttggcatcagttgttttctatgaaaacagtggattggttgggttttgtgcagggtcttgggttagagccaaaatggatttgaggatgagtatttttttttttggttttgtatattttgtacattaataataaacagtggaaagagaaagcagcttatttaaaaaaaaaag

SEQ ID NO: 329210 - DNA, 4913 bp, Homo sapiens
tggatctgggaagggggatagggatggatgggttcatttgagagccacggcttaaagcggttgcgatcaggatgggacacaggtttgtttggggacaacaaagatggcatttgtgagtgttttgaagcaacccgtactgattacatctttctcccttgtgttccttttatcccaggtttgaattttctcggagaaagacaggccggccacgaggaaaacagaaacaagccgcagcaacatctaagcccttgaaaggatcctgagagaggggggaaagggaaaacagcagccaccagcccaaccacttgtgtcttctgccccttcccacctatcttgcccaccccaccagcccacgctgcttgggacttgaaatctgtggccgaaggaccgtcactacataacttcaaaaataatcaaccaccctcccttcccaaaccacccaaattcactcatccagcgtttacttttttgaatccactcagaacttttttctgcgacccccctccctaaatggagttgggtgggggggaaatgaatactgagttggcctttattttttaaaagactttttgatccaatgaggccccctaaataattgagttttgggtcctggttggttgttttattttttttcctccaaaattttaccccctcccccctgagcccgaggtgctgacgtcgcaaaaaaattggataaaaccaccatcatgggttcgggtcccatagaccccaaagaacttctcaagggcctggacagcttccttaaccgagatggggaagtcaaaagtgtggatgggatttccaagatcttcagtttgatgaaggaagcacgaaagatggtgagtcgatgcacttacttgaacattctcctgcagacccgttcaccagaaatattggtcaaatttattgacgttggcggctacaaacttcttaacaattggctgacgtattcaaagacaaccaacaacattcccctcctccagcaaattctactgaccctgcagcatctaccgctcactgtagaccatctcaagcagaacaacacagctaaactggtgaagcagctgagcaagtcaagtgaggatgaagagctccggaaattggcctcagtccttgtcagcgactggatggctgtcatccgctctcagagcagtacccagcctgctgagaaagataagaagaaacgtaaagatgaaggaaaaagtcgaactacccttcctgagcgacctttgacagaggtgaaggctgagacccgggctgaggaggccccagagaagaagagggagaagcccaagtctcttcgcaccacagcacccagtcatgccaagttccgttccactggtaagactggcggctggcctctggagggttcatgggcatgtgcacacccagagccttatgggggaatcatttgatgtgtggtatgttaatcgtaaggaagagggaagactagcagaggaagctttggttacaaggctagaagaacatttgcgggtgagaacgggaggaaaattcgggggtctggggtttgagttcagctgcccacaccgtgcttctttccccaggactagagctggagacaccatccttggtgcctgtgaagaagaatgccagcacagtggtggtttctgacaagtacaaccttaaacccatccccctcaaacgtcagagcaacgtagctgctccaggagatgccactccccctgcagagaagaaatacaagccactcaacacaacacctaatgccaccaaagagatcaaagtgaagatcatcccgccacagcctatggagggcctgggctttctggatgctcttaattcagcccctgttccaggcatcaaaattaagaagaaaaaaaaagtactgtcacctacggctgccaagccaagcccctttgaagggaaaacgagcacagaaccaagcacagccaaaccttcttccccagaaccagcaccaccttctgaggcaatggacgcagaccgtccaggcaccccggttccccctgttgaagtcccggagctcatggatacagcctctttggagccaggagctctggatgccaagccagtggagagtcctggagatcctaaccaactgacccggaaaggcaggaagaggaaaagtgtgacatggcctgaggaaggcaaactgagagaatatttctattttgaattggatgaaactgaacgagtaaatgtgaataagatcaaggactttggtgaggcggctaagcgagagatactgtcagaccgacatgcatttgagacagcgcggcgtctgagccatgataacatggaggagaaggtgccctgggtgtgcccccggcccctggttctgccctcacctcttgtcacccctggaagcaatagtcaggagcgatatatccaggctgagcgggagaagggaatccttcaggagctcttcctgaacaaggagagtcctcatgagcctgatcctgagccctacgagcccataccccctaaactcatccccctagatgaggagtgttccatggatgagactccgtatgttgagactctggaacctggggggtcaggtggctcacctgatggggcaggaggctccaagttgcctccagttctggccaatcttatgggaagcatgggtgctggaaagggcccccaaggccctggaggaggaggcattaatgtccaagagatcctcacctccatcatgggtagcccaaacagtcatccttcagaggaactactgaaacaaccagactattcggacaagatcaagcagatgctggtgccacatggactcctaggccctggcccaatagccaatggtttcccaccagggggtcctgggggccccaagggcatgcagcactttccccctggacctgggggacctatgccaggtccccatggaggccctggtgggccagtgggtccacgtcttctgggtcctccaccccctccccggggaggtgatcccttctgggatggcccgggcgaccctatgcggggtggcccaatgcgggggggtccaggaccaggtcctggaccataccatagaggccgaggtggccgaggaggaaacgaacctcctcctcctcctcctccattccgaggcgccagaggaggtcgctctggaggaggacccccaaatggacgagggggccctggtgggggcatggttggaggtggtgggcatcgtcctcacgaaggccctggtgggggcatgggcaacagcagtggacatcgtccccacgaaggccctggcggtggcatgggaagtgggcatcgcccccatgaaggccctggtggtagcatgggtgggggtggaggacatcgtccccacgaaggccctggcggtggcatcagtggtggcagtggccatcgtccccatgaaggccctggcggaggaatgggtgccggtggtggacatcgcccccacgaaggccctggcggaagcatgggtggaagtggtggacatcgtccccatgaaggccctggacacggggggccccatggccaccggcctcatgatgtccctggtcaccgaggccatgaccatcgagggccgccacctcatgagcaccgtggccatgatggtcctggccacgggggagggggccaccgagggcacgatggaggccacagccatggaggagacatgtcaaaccgccctgtctgccgacatttcatgatgaagggcaactgccgctatgagaacaactgtgccttctaccacccgggtgtcaatgggccccccctgccctagggaccatttgcctgccctgttcacacaacccctgtggactgcagcctcgctctttccaccctgttatggcttctgtgaggcccattttcccttttccccagctgatgaggagccggccccctcagttcccacttgcttgggttcctgggggttttctgatcactggtgcgcattgatgtacatattttcctccagtctggggaggagagagactggaaacgttcctggactgctgaagaggagacccagttggcttcactttttgagaagattcgccctgtaccccaaacccctttccagtattacccttaatgcttgagaacctaaagctggttatcctggcgaacacccctacccttctattgcgggtccccacatgcacacagaactctgacacaggatcagctgcacttaagaaatcatcccagctaagttcattattcctcatggggtggggagatgctgaaaggggtattgtatatcccactgcactgagagggctcaatcagctggatttgagttctggaacacacatcatccccacccctcccccagcgtgggctcaccattcttagtcctttctcaagtgggaccttcaactttctgtgaacacccagtctgcgtcctgggtctgctaggttcgatgatggcgaactcgtatctgcatccggtgcaagttttagctggcagaggtgagaccggtggtgctggtctgcctttgccaactatagccagtctggagacttgataaaatacttcagtgagaccagcttctcatcaacttgggcccggcgtgctgggcctgaaagtcacactacatgcactgcctttgggagtcagctcactccctgctcccacctggaaccttgccagcgtgaaggaggcttccaggtacttcaccctgtcaaccacctctgaatccccaccaggcgccttcctgggtggattcaacaagatgattttgccctttcccagttctctccttcactttggcatcagttgttttctatgaaaacagtggattggttgggttttgtgcagggtcttgggttagagccaaaatggatttgaggatgagtatttttttttttggttttgtatattttgtacattaataataaacagtggaaagagaaagcagcttatttaaaaaaaaaag

SEQ ID NO: 329211 - DNA, 3992 bp, Homo sapiens
actggtggattttggttacatgtataagttctttaatggtgatttctgagattttggtacactcatcacccaagcagtgtacactgcacccaacgtgtagtcttttactaatgtagattttaaccacatattctgaaatattaggtctttttactccagagtggtgtgatgacatcagagttgaaagttatccaagtagaacacaactctaattcattgttccattttttaagggtttggtttttaagcatatctcatgttcttcttaaaactttgggttactttctccgttacataaattttcacaatattttctcaaacctcccattttctgttcctggaagaatgttactttacattatttaggcatttcccctttctgtcacctgcagagctccggaaattggcctcagtccttgtcagcgactggatggctgtcatccgctctcagagcagtacccagcctgctgagaaagataagaagaaacgtaaagatgaaggaaaaagtcgaactacccttcctgagcgacctttgacagaggtgaaggctgagacccgggctgaggaggccccagagaagaagagggagaagcccaagtctcttcgcaccacagcacccagtcatgccaagttccgttccactggactagagctggagacaccatccttggtgcctgtgaagaagaatgccagcacagtggtggtttctgacaagtacaaccttaaacccatccccctcaaacgtcagagcaacgtagctgctccaggagatgccactccccctgcagagaagaaatacaagccactcaacacaacacctaatgccaccaaagagatcaaagtgaagatcatcccgccacagcctatggagggcctgggctttctggatgctcttaattcagcccctgttccaggcatcaaaattaagaagaaaaaaaaagtactgtcacctacggctgccaagccaagcccctttgaagggaaaacgagcacagaaccaagcacagccaaaccttcttccccagaaccagcaccaccttctgaggcaatggacgcagaccgtccaggcaccccggttccccctgttgaagtcccggagctcatggatacagcctctttggagccaggagctctggatgccaagccagtggagagtcctggagatcctaaccaactgacccggaaaggcaggaagaggaaaagtgtgacatggcctgaggaaggcaaactgagagaatatttctattttgaattggatgaaactgaacgagtaaatgtgaataagatcaaggactttggtgaggcggctaagcgagagatactgtcagaccgacatgcatttgagacagcgcggcgtctgagccatgataacatggaggagaaggtgccctgggtgtgcccccggcccctggttctgccctcacctcttgtcacccctggaagcaatagtcaggagcgatatatccaggctgagcgggagaagggaatccttcaggagctcttcctgaacaaggagagtcctcatgagcctgatcctgagccctacgagcccataccccctaaactcatccccctagatgaggagtgttccatggatgagactccgtatgttgagactctggaacctggggggtcaggtggctcacctgatggggcaggaggctccaagttgcctccagttctggccaatcttatgggaagcatgggtgctggaaagggcccccaaggccctggaggaggaggcattaatgtccaagagatcctcacctccatcatgggtagcccaaacagtcatccttcagaggaactactgaaacaaccagactattcggacaagatcaagcagatgctggtgccacatggactcctaggccctggcccaatagccaatggtttcccaccagggggtcctgggggccccaagggcatgcagcactttccccctggacctgggggacctatgccaggtccccatggaggccctggtgggccagtgggtccacgtcttctgggtcctccaccccctccccggggaggtgatcccttctgggatggcccgggcgaccctatgcggggtggcccaatgcgggggggtccaggaccaggtcctggaccataccatagaggccgaggtggccgaggaggaaacgaacctcctcctcctcctcctccattccgaggcgccagaggaggtcgctctggaggaggacccccaaatggacgagggggccctggtgggggcatggttggaggtggtgggcatcgtcctcacgaaggccctggtgggggcatgggcaacagcagtggacatcgtccccacgaaggccctggcggtggcatgggaagtgggcatcgcccccatgaaggccctggtggtagcatgggtgggggtggaggacatcgtccccacgaaggccctggcggtggcatcagtggtggcagtggccatcgtccccatgaaggccctggcggaggaatgggtgccggtggtggacatcgcccccacgaaggccctggcggaagcatgggtggaagtggtggacatcgtccccatgaaggccctggacacggggggccccatggccaccggcctcatgatgtccctggtcaccgaggccatgaccatcgagggccgccacctcatgagcaccgtggccatgatggtcctggccacgggggagggggccaccgagggcacgatggaggccacagccatggaggagacatgtcaaaccgccctgtctgccgacatttcatgatgaagggcaactgccgctatgagaacaactgtgccttctaccacccgggtgtcaatgggccccccctgccctagggaccatttgcctgccctgttcacacaacccctgtggactgcagcctcgctctttccaccctgttatggcttctgtgaggcccattttcccttttccccagctgatgaggagccggccccctcagttcccacttgcttgggttcctgggggttttctgatcactggtgcgcattgatgtacatattttcctccagtctggggaggagagagactggaaacgttcctggactgctgaagaggagacccagttggcttcactttttgagaagattcgccctgtaccccaaacccctttccagtattacccttaatgcttgagaacctaaagctggttatcctggcgaacacccctacccttctattgcgggtccccacatgcacacagaactctgacacaggatcagctgcacttaagaaatcatcccagctaagttcattattcctcatggggtggggagatgctgaaaggggtattgtatatcccactgcactgagagggctcaatcagctggatttgagttctggaacacacatcatccccacccctcccccagcgtgggctcaccattcttagtcctttctcaagtgggaccttcaactttctgtgaacacccagtctgcgtcctgggtctgctaggttcgatgatggcgaactcgtatctgcatccggtgcaagttttagctggcagaggtgagaccggtggtgctggtctgcctttgccaactatagccagtctggagacttgataaaatacttcagtgagaccagcttctcatcaacttgggcccggcgtgctgggcctgaaagtcacactacatgcactgcctttgggagtcagctcactccctgctcccacctggaaccttgccagcgtgaaggaggcttccaggtacttcaccctgtcaaccacctctgaatccccaccaggcgccttcctgggtggattcaacaagatgattttgccctttcccagttctctccttcactttggcatcagttgttttctatgaaaacagtggattggttgggttttgtgcagggtcttgggttagagccaaaatggatttgaggatgagtatttttttttttggttttgtatattttgtacattaataataaacagtggaaagagaaagcagcttatttaaaaaaaaaag

SEQ ID NO: 329212 - DNA, 2843 bp, Homo sapiens
  misc_feature (2533)..(2537): n is a, c, g, or t
  misc_feature (2728)..(2728): n is a, c, g, or t
tggatctgggaagggggatagggatggatgggttcatttgagagccacggcttaaagcggttgcgatcaggatgggacacaggtttgtttggggacaacaaagatggcatttgtgagtgttttgaagcaacccgtactgattacatctttctcccttgtgttccttttatcccaggtttgaattttctcggagaaagacaggccggccacgaggaaaacagaaacaagccgcagcaacatctaagcccttgaaaggatcctgagagaggggggaaagggaaaacagcagccaccagcccaaccacttgtgtcttctgccccttcccacctatcttgcccaccccaccagcccacgctgcttgggacttgaaatctgtggccgaaggaccgtcactacataacttcaaaaataatcaaccaccctcccttcccaaaccacccaaattcactcatccagcgtttacttttttgaatccactcagaacttttttctgcgacccccctccctaaatggagttgggtgggggggaaatgaatactgagttggcctttattttttaaaagactttttgatccaatgaggccccctaaataattgagttttgggtcctggttggttgttttattttttttcctccaaaattttaccccctcccccctgagcccgaggtgctgacgtcgcaaaaaaattggataaaaccaccatcatgggttcgggtcccatagaccccaaagaacttctcaagggcctggacagcttccttaaccgagatggggaagtcaaaagtgtggatgggatttccaagatcttcagtttgatgaaggaagcacgaaagatggtgagtcgatgcacttacttgaacattctcctgcagacccgttcaccagaaatattggtcaaatttattgacgttggcggctacaaacttcttaacaattggctgacgtattcaaagacaaccaacaacattcccctcctccagcaaattctactgaccctgcagcatctaccgctcactgtagaccatctcaagcagaacaacacagctaaactggtgaagcagctgagcaagtcaagtgaggatgaagagctccggaaattggcctcagtccttgtcagcgactggatggctgtcatccgctctcagagcagtacccagcctgctgagaaagataagaagaaacgtaaagatgaaggaaaaagtcgaactacccttcctgagcgacctttgacagaggtgaaggctgagacccgggctgaggaggccccagagaagaagagggagaagcccaagtctcttcgcaccacagcacccagtcatgccaagttccgttccactggactagagctggagacaccatccttggtgcctgtgaagaagaatgccagcacagtggtggtttctgacaagtacaaccttaaacccatccccctcaaacgtcagagcaacgtagctgctccaggagatgccactccccctgcagagaagaaatacaagccactcaacacaacacctaatgccaccaaagagatcaaagtgaagatcatcccgccacagcctatggagggcctgggctttctggatgctcttaattcagcccctgttccaggcatcaaaattaagaagaaaaaaaaagtactgtcacctacggctgccaagccaagcccctttgaagggaaaacgagcacagaaccaagcacagccaaaccttcttccccagaaccagcaccaccttctgaggcaatggacgcagaccgtccaggcaccccggttccccctgttgaagtcccggagctcatggatacagcctctttggagccaggagctctggatgccaagccagtggagagtcctggagatcctaaccaactgacccggaaaggcaggaagaggaaaagtgtgacatggcctgaggaaggcaaactgagagaatatttctattttgaattggatgaaactgaacgagtaaatgtgaataagatcaaggactttggtgaggcggctaagcgagagatactgtcagaccgacatgcatttgagacagcgcggcgtctgagccatgataacatggaggagaaggtgccctgggtgtgcccccggcccctggttctgccctcacctcttgtcacccctggaagcaatagtcaggagcgatatatccaggctgagcgggagaagggaatccttcaggagctcttcctgaacaaggagagtcctcatgagcctgatcctgagccctacgagcccataccccctaaactcatccccctagatgaggagtgttccatggatgagactccgtatgttgagactctggaacctggggggtcaggtggctcacctgatggggcaggaggctccaagttgcctccagttctggccaatcttatgggaagcatgggtgctggaaagggcccccaaggccctggaggaggaggcattaatgtccaagagatcctcacctccatcatgggtagcccaaacagtcatccttcagaggaactactgaaacaaccagactattcggacannnnngccatagcggtcgtaaatctcccgcttgtgcttgtcagacagcacttcatatgcctcggccacctccttaaatttcttctcagcaaactctttattatctgggtttttgtctgggtgccactggagagccttgcgccgatacgccttcttgatgtcatcagcggacgcacttagcggaacgtctgggatcncgtagtaggatcccatggcaactggtcagtcgtcaggcgggcctccttggggctcctccgccaggagtcccggcctcctgcggcgcaccgcccctgcccccaccgggaaccgtcg

SEQ ID NO: 329213 - DNA, 1815 bp, Homo sapiens
tggatctgggaagggggatagggatggatgggttcatttgagagccacggcttaaagcggttgcgatcaggatgggacacaggtttgtttggggacaacaaagatggcatttgtgagtgttttgaagcaacccgtactgattacatctttctcccttgtgttccttttatcccaggtttgaattttctcggagaaagacaggccggccacgaggaaaacagaaacaagccgcagcaacatctaagcccttgaaaggatcctgagagaggggggaaagggaaaacagcagccaccagcccaaccacttgtgtcttctgccccttcccacctatcttgcccaccccaccagcccacgctgcttgggacttgaaatctgtggccgaaggaccgtcactacataacttcaaaaataatcaaccaccctcccttcccaaaccacccaaattcactcatccagcgtttacttttttgaatccactcagaacttttttctgcgacccccctccctaaatggagttgggtgggggggaaatgaatactgagttggcctttattttttaaaagactttttgatccaatgaggccccctaaataattgagttttgggtcctggttggttgttttattttttttcctccaaaattttaccccctcccccctgagcccgaggtgctgacgtcgcaaaaaaattggataaaaccaccatcatgggttcgggtcccatagaccccaaagaacttctcaagggcctggacagcttccttaaccgagatggggaagtcaaaagtgtggatgggatttccaagatcttcagtttgatgaaggaagcacgaaagatggtgagtcgatgcacttacttgaacattctcctgcagacccgttcaccagaaatattggtcaaatttattgacgttggcggctacaaacttcttaacaattggctgacgtattcaaagacaaccaacaacattcccctcctccagcaaattctactgaccctgcagcatctaccgctcactgtagaccatctcaagcagaacaacacagctaaactggtgaagcagctgagcaagtcaagtgaggatgaagagctccggaaattggcctcagtccttgtcagcgactggatggctgtcatccgctctcagagcagtacccagcctgctgagaaagataagaagaaacgtaaagatgaaggaaaaagtcgaactacccttcctgagcgacctttgacagaggtgaaggctgagacccgggctgaggaggccccagagaagaagagggagaagcccaagtctcttcgcaccacagcacccagtcatgccaagttccgttccactggactagagctggagacaccatccttggtgcctgtgaagaagaatgccagcacagtggtggtttctgacaagtacaaccttaaacccatccccctcaaacgtcagagcaacgtagctgctccaggagatgccactccccctgcagagaagaaatacaagccactcaacacaacacctaatgccaccaaagagatcaaagtgaagatcatcccgccacagcctatggagggcctgggctttctggatgctcttaattcagcccctgttccaggcatcaaaattaagaagaaaaaaaaagtactgtcacctacggctgccaagccaagcccctttgaagggaaaacgagcacagaaccaagcacagccaaacctgtgtctgtgcaattgaagtggcacctctgaatcgtcttcattctctgtaaagggagagataggaaagaaggaatgaggaatgtaggctttttgctgtccctgc

SEQ ID NO: 329214 - DNA, 955 bp, Homo sapiens
  misc_feature (50)..(50): n is a, c, g, or t
  misc_feature (56)..(56): n is a, c, g, or t
  misc_feature (63)..(63): n is a, c, g, or t
gagagagagagagagagagagagagagagagagagagagagagagagagngagagngagaganagagagagaggggcgacgagaacccctttccagtattacccttaatgcttgagaacctaaagctggttatcctggcgaacacccctacccttctattgcgggtccccacatgcacacagaactctgacacaggatcagctgcacttaagaaatcatcccagctaagttcattattcctcatggggtggggagatgctgaaaggggtattgtatatcccactgcactgagagggctcaatcagctggatttgagttctggaacacacatcatccccacccctcccccagcgtgggctcaccattcttagtcctttctcaagtgggaccttcaactttctgtgaacacccagtctgcgtcctgggtctgctaggttcgatgatggcgaactcgtatctgcatccggtgcaagttttagctggcagaggtgagaccggtggtgctggtctgcctttgccaactatagccagtctggagacttgataaaatacttcagtgagaccagcttctcatcaacttgggcccggcgtgctgggcctgaaagtcacactacatgcactgcctttgggagtcagctcactccctgctcccacctggaaccttgccagcgtgaaggaggcttccaggtacttcaccctgtcaaccacctctgaatccccaccaggcgccttcctgggtggattcaacaagatgattttgccctttcccagttctctccttcactttggcatcagttgttttctatgaaaacagtggattggttgggttttgtgcagggtcttgggttagagccaaaatggatttgaggatgagtatttttttttttggttttgtatattttgtacattaataataaacagtggaaagagaaagcagcttatttaaaaaaaaaag

SEQ ID NO: 329215 - DNA, 800 bp, Homo sapiens
gtagtagtttgatgaataatttaaagaaaaacacctacatatacaagctatccaagaatgcaaacaaggtgacattgagatgggtagtggctgcattcttggatagcttgtatatgtagtagtttgatgaataatttaaagaaaaacacctaaaatttgaaaaatgattgtaggatcaaaaaaggcagatgaaattacttaatactcagtgttttggagagtattccttttagtttgttggttggctggtttgaacgatagaaatatgcagcatgcaatatatgcttatatttcattttaatttctgatatataatgaacttcttgggagaggtactgaatctttgatgttttttgtcattgttctcaagtgcaatataacaatgtaaccaaatctagataatttcaaagttgtcattaatttagtaagcctaatataaacaaatatttgtattatttttgttagcaggaaagagtgattaagtgaggttatttacccctaaatggtccattctgcattgtatttcaggctggaaatgaattattctttaccagttttgaaacactttgaaatatcctaaggtaacttggaagctgtgtagtatatcaaattaatttgctacctaataacatagaaagtaaatatctttgtggtcacccacattgggtgagacagaaaatgaatctgttctaaaatttgtaatttgctaacttgatttgagttagtgaaaactggtacagtgttctgcttgatttacaacatgtaacttgtgactgtacaataaacataagcatatggta

SEQ ID NO: 329216 - DNA, 7452 bp, Homo sapiens
gataaaaagctttcctcatttttaaacaacagtcgcacggaagttcccggcgggacaagggaacgtgggtgcccttgctactcccgtggacgcgggtagattgggacgctggaccgtatctccccgcccccgcccccacgcctcctcaggtgctcagcctgaggccttcgtccaggagcgctgccgctgacccaggctcaggagctgggggcccctgcacagacgcccaggtctcgggacaggcggcgactgcactcacggaagtacgctgagctctcccctgtagaagggcgcctctcctcccccacttcctcctccagctccacagcagcctcccgggccggctcctcctccttccaggtctcctcccagtgccgccgcggctctcaggcctgaggtgcggcgctcaccccggcagtccccagcctcagacgctgcgtggagcggcggagccggagggaagcaaaggaccgtctgcgctgctgtccccgccccgcgcgctctgcgcccctcgtccctggcggtcgctccgaagctcagccctcttgcctgccccggagctgtcccgggctagccgagaagagagcggccggcaagtttgggcgcgcgcaggcggcgggccgcgggcactgggcgcctcgctggggcggggggaggtggctaccgctcccggcttggcgtcccgcgcgcacttcggcgatggcttttccgccgcggcgacggctgcgcctcggtccccgcggcctcccgcttcttctctcgggactcctgctacctctgtgccgcgccttcaacctagacgtggacagtcctgccgagtactctggccccgagggaagttacttcggcttcgccgtggatttcttcgtgcccagcgcgtcttcccggatgtttcttctcgtgggagctcccaaagcaaacaccacccagcctgggattgtggaaggagggcaggtcctcaaatgtgactggtcttctacccgccggtgccagccaattgaatttgatgcaacaggcaatagagattatgccaaggatgatccattggaatttaagtcccatcagtggtttggagcatctgtgaggtcgaaacaggataaaattttggcctgtgccccattgtaccattggagaactgagatgaaacaggagcgagagcctgttggaacatgctttcttcaagatggaacaaagactgttgagtatgctccatgtagatcacaagatattgatgctgatggacagggattttgtcaaggaggattcagcattgattttactaaagctgacagagtacttcttggtggtcctggtagcttttattggcaaggtcagcttatttcggatcaagtggcagaaatcgtatctaaatacgaccccaatgtttacagcatcaagtataataaccaattagcaactcggactgcacaagctatttttgatgacagctatttgggttattctgtggctgtcggagatttcaatggtgatggcatagatgactttgtttcaggagttccaagagcagcaaggactttgggaatggtttatatttatgatgggaagaacatgtcctccttatacaattttactggcgagcagatggctgcatatttcggattttctgtagctgccactgacattaatggagatgattatgcagatgtgtttattggagcacctctcttcatggatcgtggctctgatggcaaactccaagaggtggggcaggtctcagtgtctctacagagagcttcaggagacttccagacgacaaagctgaatggatttgaggtctttgcacggtttggcagtgccatagctcctttgggagatctggaccaggatggtttcaatgatattgcaattgctgctccatatgggggtgaagataaaaaaggaattgtttatatcttcaatggaagatcaacaggcttgaacgcagtcccatctcaaatccttgaagggcagtgggctgctcgaagcatgccaccaagctttggctattcaatgaaaggagccacagatatagacaaaaatggatatccagacttaattgtaggagcttttggtgtagatcgagctatcttatacagggccagaccagttatcactgtaaatgctggtcttgaagtgtaccctagcattttaaatcaagacaataaaacctgctcactgcctggaacagctctcaaagtttcctgttttaatgttaggttctgcttaaaggcagatggcaaaggagtacttcccaggaaacttaatttccaggtggaacttcttttggataaactcaagcaaaagggagcaattcgacgagcactgtttctctacagcaggtccccaagtcactccaagaacatgactatttcaagggggggactgatgcagtgtgaggaattgatagcgtatctgcgggatgaatctgaatttagagacaaactcactccaattactatttttatggaatatcggttggattatagaacagctgctgatacaacaggcttgcaacccattcttaaccagttcacgcctgctaacattagtcgacaggctcacattctacttgactgtggtgaagacaatgtctgtaaacccaagctggaagtttctgtagatagtgatcaaaagaagatctatattggggatgacaaccctctgacattgattgttaaggctcagaatcaaggagaaggtgcctacgaagctgagctcatcgtttccattccactgcaggctgatttcatcggggttgtccgaaacaatgaagccttagcaagactttcctgtgcatttaagacagaaaaccaaactcgccaggtggtatgtgaccttggaaacccaatgaaggctggaactcaactcttagctggtcttcgtttcagtgtgcaccagcagtcagagatggatacttctgtgaaatttgacttacaaatccaaagctcaaatctatttgacaaagtaagcccagttgtatctcacaaagttgatcttgctgttttagctgcagttgagataagaggagtctcgagtcctgatcatatctttcttccgattccaaactgggagcacaaggagaaccctgagactgaagaagatgttgggccagttgttcagcacatctatgagctgagaaacaatggtccaagttcattcagcaaggcaatgctccatcttcagtggccttacaaatataataataacactctgttgtatatccttcattatgatattgatggaccaatgaactgcacttcagatatggagatcaaccctttgagaattaagatctcatctttgcaaacaactgaaaagaatgacacggttgccgggcaaggtgagcgggaccatctcatcactaagcgggatcttgccctcagtgaaggagatattcacactttgggttgtggagttgctcagtgcttgaagattgtctgccaagttgggagattagacagaggaaagagtgcaatcttgtacgtaaagtcattactgtggactgagacttttatgaataaagaaaatcagaatcattcctattctctgaagtcgtctgcttcatttaatgtcatagagtttccttataagaatcttccaattgaggatatcaccaactccacattggttaccactaatgtcacctggggcattcagccagcgcccatgcctgtgcctgtgtgggtgatcattttagcagttctagcaggattgttgctactggctgttttggtatttgtaatgtacaggatgggcttttttaaacgggtccggccacctcaagaagaacaagaaagggagcagcttcaacctcatgaaaatggtgaaggaaactcagaaacttaactgcagtttttaagttatgctacatcttgacccactagaattagcaactttattatagatttaaactttcttcatgaggagtaaaaatccaaggctttactgctgatagtgctaattggcattaaccacaaaatgagaattatatttgtcaaccttctccttataaataagttcagacatacatttaataacatagggtgacttgtgtttttaggtatttaaataataaaatttcaagggatagtttttattcaatgtatataagacaggtagtgcctgatttactactttatataaaatagtacctccttcagttactgtttctgatttaatgtacggaactttatttgttgttgttgttgttgttgttgttgttgttttaaagcagtccaaatttggaccttagcaatcatgtcttttgtataggtacttaatgttaatacatattacactacagtttacttttcagaatactaaagactttataactgcatgaacttggatttttttaatcactcatatggtagaattttataaacacatacatgataccatccaaattcttgcttttaataacaaaggtacaatattttgttttagtatgaaaatctggtagatcctattacacttctgtttatattaaatccacaatattttattacatttttaacttgtataaattttaggtcaaatccttcaagccaacctatactaaaaattagttccataatcacaaatggctcttttgtgtaattgtttaatttcacctgaatatcataatgcttaaagccatatggagttggaaattatttccaaagcatatttattccattgttttagtctggctatttacagtataaaaaaagcatttttattaaaatactgtgtagttctttgagatagttgcttatgcatatagtaagtattacattcttagagtagagcagagtttttagttagtattaatttattttcctccattcatgtacttttccttatatttccaaaactgttactgagaatgggtcaagatcagtgagaaatctttacagttgacaggaacctggaccccttaccccaactttatgagtaatgcttggaataaaaactcttaaggcaactcactgatttacttctagcaatagcatgatgttacaggaatattacctctgtttaagcaaggtaatgtgtaaaatcagtctcggctgtcagaataacttctaaaaggtatttttataagcagttcaagttactgaaaaccttttaaacctttctgaagttcgttagtataaattacttttctaggattattaataaaagccacataggtggcaagttgtagttttatatggctctgtagagtggtgaaccttctagaggaatatatgatttattcacagttcctcaaggcctggggatgatgatcagttatacctatttttgtgcaattacatcatgttgtacattagaaatggagagtttaatagctctttaactgctgtcctcattaggtaatgataaatatttcccttaaataattgactattttgctgtgttttaaaaatgattgaaatttatcttgccatatctcataatttcatgcacaagttgactgagctaatcttgagaatatattcgtaaaataggagcacatttagttgaggtatacaaggtaggactctagacaaaaccttctattttagctttagtgaatttcaaaagtaatgggtcttggagtatagatttttattagtagcttgaaagagcttaatcatatgcagtaagtatttttattaccaataaatttaaaattttttaagaaaaatatttttatcctagggccaagtgttgcctgccaccaatcagtaagttagtctataacaaattttaccctaacagttttaccacctagtaacagtcatttctgaaaatatgttggatagaaagtcactctttggcaaaagtgttagaatttgcttttgtgccatctattccttttatggcatctatcttgaaagtaatcttgtattggagattgaaagatgctgtaatttagaaattaacatgatatcttaaattacctttatgaaatatagttttgtataatagcatagattttccttcaaaaaatgaacatttatatatctacaaaaatatggagaagagtaatttgaaagcctactttctgaagaaaatggtgggatttttttttatcatgattaaatatcaaaaaattgccctatgaaaactttaaatctctaaaacatttgaaatactaccatatttgtgatttattgagaataaaaatccattttgaaatgtaaaatttttatgatctgattcagttttaagaaaacatgaatgaactagaagatattaaaaacatttgacattggtaagaaatattgatactgatattgatttttatataggtatttatttcagaattgatattttgagaaaaatacatgtgagtcattttttctgtttctcttttctcttaacgattatcactgtaattctgaatctgaaaggtaaaacaattagtcaaaatattattgccatcattctacctgtgttatgaaactacttattcatagttaattctcattaacacttacatttccataaagaaaactcaagtattaataaaagagactttactggcttaagagggctgtgaaagatttttgatagtgaatcatgaccctaagggagagatttgtgtgataaaagtattgtatataatagatcagcgatttttgtaaggcaaacagaatttgtaagttggcagatcttcctaagttgcaaaatgtaatgatgagcttggtggagaagaatgagtcgttcttggaatacctatgtgcagccactacccatctcaatgtcaccttgtttgcattcttggatagcttgtatatgtagtagtttgatgaataatttaaagaaaaacacctaaaatttgaaaaatgattgtaggatcaaaaaaggcagatgaaattacttaatactcagtgttttggagagtattccttttagtttgttggttggctggtttgaacgatagaaatatgcagcatgcaatatatgcttatatttcattttaatttctgatatataatgaacttcttgggagaggtactgaatctttgatgttttttgtcattgttctcaagtgcaatataacaatgtaaccaaatctagataatttcaaagttgtcattaatttagtaagcctaatataaacaaatatttgtattatttttgttagcaggaaagagtgattaagtgaggttatttacccctaaatggtccattctgcattgtatttcaggctggaaatgaattattctttaccagttttgaaacactttgaaatatcctaaggtaacttggaagctgtgtagtatatcaaattaatttgctacctaataacatagaaagtaaatatctttgtggtcacccacattgggtgagacagaaaatgaatctgttctaaaatttgtaatttgctaacttgatttgagttagtgaaaactggtacagtgttctgcttgatttacaacatgtaacttgtgactgtacaataaacataagcatatggta

SEQ ID NO: 329217 - DNA, 7623 bp, Homo sapiens
gataaaaagctttcctcatttttaaacaacagtcgcacggaagttcccggcgggacaagggaacgtgggtgcccttgctactcccgtggacgcgggtagattgggacgctggaccgtatctccccgcccccgcccccacgcctcctcaggtgctcagcctgaggccttcgtccaggagcgctgccgctgacccaggctcaggagctgggggcccctgcacagacgcccaggtctcgggacaggcggcgactgcactcacggaagtacgctgagctctcccctgtagaagggcgcctctcctcccccacttcctcctccagctccacagcagcctcccgggccggctcctcctccttccaggtctcctcccagtgccgccgcggctctcaggcctgaggtgcggcgctcaccccggcagtccccagcctcagacgctgcgtggagcggcggagccggagggaagcaaaggaccgtctgcgctgctgtccccgccccgcgcgctctgcgcccctcgtccctggcggtcgctccgaagctcagccctcttgcctgccccggagctgtcccgggctagccgagaagagagcggccggcaagtttgggcgcgcgcaggcggcgggccgcgggcactgggcgcctcgctggggcggggggaggtggctaccgctcccggcttggcgtcccgcgcgcacttcggcgatggcttttccgccgcggcgacggctgcgcctcggtccccgcggcctcccgcttcttctctcgggactcctgctacctctgtgccgcgccttcaacctagacgtggacagtcctgccgagtactctggccccgagggaagttacttcggcttcgccgtggatttcttcgtgcccagcgcgtcttcccggatgtttcttctcgtgggagctcccaaagcaaacaccacccagcctgggattgtggaaggagggcaggtcctcaaatgtgactggtcttctacccgccggtgccagccaattgaatttgatgcaacaggcaatagagattatgccaaggatgatccattggaatttaagtcccatcagtggtttggagcatctgtgaggtcgaaacaggataaaattttggcctgtgccccattgtaccattggagaactgagatgaaacaggagcgagagcctgttggaacatgctttcttcaagatggaacaaagactgttgagtatgctccatgtagatcacaagatattgatgctgatggacagggattttgtcaaggaggattcagcattgattttactaaagctgacagagtacttcttggtggtcctggtagcttttattggcaaggtcagcttatttcggatcaagtggcagaaatcgtatctaaatacgaccccaatgtttacagcatcaagtataataaccaattagcaactcggactgcacaagctatttttgatgacagctatttgggttattctgtggctgtcggagatttcaatggtgatggcatagatgactttgtttcaggagttccaagagcagcaaggactttgggaatggtttatatttatgatgggaagaacatgtcctccttatacaattttactggcgagcagatggctgcatatttcggattttctgtagctgccactgacattaatggagatgattatgcagatgtgtttattggagcacctctcttcatggatcgtggctctgatggcaaactccaagaggtggggcaggtctcagtgtctctacagagagcttcaggagacttccagacgacaaagctgaatggatttgaggtctttgcacggtttggcagtgccatagctcctttgggagatctggaccaggatggtttcaatgatattgcaattgctgctccatatgggggtgaagataaaaaaggaattgtttatatcttcaatggaagatcaacaggcttgaacgcagtcccatctcaaatccttgaagggcagtgggctgctcgaagcatgccaccaagctttggctattcaatgaaaggagccacagatatagacaaaaatggatatccagacttaattgtaggagcttttggtgtagatcgagctatcttatacagggccagaccagttatcactgtaaatgctggtcttgaagtgtaccctagcattttaaatcaagacaataaaacctgctcactgcctggaacagctctcaaagtttcctgttttaatgttaggttctgcttaaaggcagatggcaaaggagtacttcccaggaaacttaatttccaggtggaacttcttttggataaactcaagcaaaagggagcaattcgacgagcactgtttctctacagcaggtccccaagtcactccaagaacatgactatttcaagggggggactgatgcagtgtgaggaattgatagcgtatctgcgggatgaatctgaatttagagacaaactcactccaattactatttttatggaatatcggttggattatagaacagctgctgatacaacaggcttgcaacccattcttaaccagttcacgcctgctaacattagtcgacaggctcacattctacttgactgtggtgaagacaatgtctgtaaacccaagctggaagtttctgtagatagtgatcaaaagaagatctatattggggatgacaaccctctgacattgattgttaaggctcagaatcaaggagaaggtgcctacgaagctgagctcatcgtttccattccactgcaggctgatttcatcggggttgtccgaaacaatgaagccttagcaagactttcctgtgcatttaagacagaaaaccaaactcgccaggtggtatgtgaccttggaaacccaatgaaggctggaactcaactcttagctggtcttcgtttcagtgtgcaccagcagtcagagatggatacttctgtgaaatttgacttacaaatccaaagctcaaatctatttgacaaagtaagcccagttgtatctcacaaagttgatcttgctgttttagctgcagttgagataagaggagtctcgagtcctgatcatatctttcttccgattccaaactgggagcacaaggagaaccctgagactgaagaagatgttgggccagttgttcagcacatctatgagctgagaaacaatggtccaagttcattcagcaaggcaatgctccatcttcagtggccttacaaatataataataacactctgttgtatatccttcattatgatattgatggaccaatgaactgcacttcagatatggagatcaaccctttgagaattaagatctcatctttgcaaacaactgaaaagaatgacacggttgccgggcaaggtgagcgggaccatctcatcactaagcgggatcttgccctcagtgaaggagatattcacactttgggttgtggagttgctcagtgcttgaagattgtctgccaagttgggagattagacagaggaaagagtgcaatcttgtacgtaaagtcattactgtggactgagacttttatgaataaagaaaatcagaatcattcctattctctgaagtcgtctgcttcatttaatgtcatagagtttccttataagaatcttccaattgaggatatcaccaactccacattggttaccactaatgtcacctggggcattcagccagcgcccatgcctgtgcctgtgtgggtgatcattttagcagttctagcaggattgttgctactggctgttttggtatttgtaatgtacaggatgggcttttttaaacgggtccggccacctcaagaagaacaagaaagggagcagcttcaacctcatgaaaatggtgaaggaaactcagaaacttaactgcagtttttaagttatgctacatcttgacccactagaattagcaactttattatagatttaaactttcttcatgaggagtaaaaatccaaggctttactgctgatagtgctaattggcattaaccacaaaatgagaattatatttgtcaaccttctccttataaataagttcagacatacatttaataacatagggtgacttgtgtttttaggtatttaaataataaaatttcaagggatagtttttattcaatgtatataagacaggtagtgcctgatttactactttatataaaatagtacctccttcagttactgtttctgatttaatgtacggaactttatttgttgttgttgttgttgttgttgttgttgttttaaagcagtccaaatttggaccttagcaatcatgtcttttgtataggtacttaatgttaatacatattacactacagtttacttttcagaatactaaagactttataactgcatgaacttggatttttttaatcactcatatggtagaattttataaacacatacatgataccatccaaattcttgcttttaataacaaaggtacaatattttgttttagtatgaaaatctggtagatcctattacacttctgtttatattaaatccacaatattttattacatttttaacttgtataaattttaggtcaaatccttcaagccaacctatactaaaaattagttccataatcacaaatggctcttttgtgtaattgtttaatttcacctgaatatcataatgcttaaagccatatggagttggaaattatttccaaagcatatttattccattgttttagtctggctatttacagtataaaaaaagcatttttattaaaatactgtgtagttctttgagatagttgcttatgcatatagtaagtattacattcttagagtagagcagagtttttagttagtattaatttattttcctccattcatgtacttttccttatatttccaaaactgttactgagaatgggtcaagatcagtgagaaatctttacagttgacaggaacctggaccccttaccccaactttatgagtaatgcttggaataaaaactcttaaggcaactcactgatttacttctagcaatagcatgatgttacaggaatattacctctgtttaagcaaggtaatgtgtaaaatcagtctcggctgtcagaataacttctaaaaggtatttttataagcagttcaagttactgaaaaccttttaaacctttctgaagttcgttagtataaattacttttctaggattattaataaaagccacataggtggcaagttgtagttttatatggctctgtagagtggtgaaccttctagaggaatatatgatttattcacagttcctcaaggcctggggatgatgatcagttatacctatttttgtgcaattacatcatgttgtacattagaaatggagagtttaatagctctttaactgctgtcctcattaggtaatgataaatatttcccttaaataattgactattttgctgtgttttaaaaatgattgaaatttatcttgccatatctcataatttcatgcacaagttgactgagctaatcttgagaatatattcgtaaaataggagcacatttagttgaggtatacaaggtaggactctagacaaaaccttctattttagctttagtgaatttcaaaagtaatgggtcttggagtatagatttttattagtagcttgaaagagcttaatcatatgcagtaagtatttttattaccaataaatttaaaattttttaagaaaaatatttttatcctagggccaagtgttgcctgccaccaatcagtaagttagtctataacaaattttaccctaacagttttaccacctagtaacagtcatttctgaaaatatgttggatagaaagtcactctttggcaaaagtgttagaatttgcttttgtgccatctattccttttatggcatctatcttgaaagtaatcttgtattggagattgaaagatgctgtaatttagaaattaacatgatatcttaaattacctttatgaaatatagttttgtataatagcatagattttccttcaaaaaatgaacatttatatatctacaaaaatatggagaagagtaatttgaaagcctactttctgaagaaaatggtgggatttttttttatcatgattaaatatcaaaaaattgccctatgaaaactttaaatctctaaaacatttgaaatactaccatatttgtgatttattgagaataaaaatccattttgaaatgtaaaatttttatgatctgattcagttttaagaaaacatgaatgaactagaagatattaaaaacatttgacattggtaagaaatattgatactgatattgatttttatataggtatttatttcagaattgatattttgagaaaaatacatgtgagtcattttttctgtttctcttttctcttaacgattatcactgtaattctgaatctgaaaggtaaaacaattagtcaaaatattattgccatcattctacctgtgttatgaaactacttattcatagttaattctcattaacacttacatttccataaagaaaactcaagtattaataaaagagactttactggcttaagagggctgtgaaagatttttgatagtgaatcatgaccctaagggagagatttgtgtgataaaagtattgtatataatagatcagcgatttttgtaaggcaaacagaatttgtaagttggcagatcttcctaagttgcaaaatgtaatgatgagcttggtggagaagaatgagtcgttcttggaatacctatgtgcagccactacccatctcaatgtcaccttgtttgcattcttggatagcttgtatatgtagtagtttgatgaataatttaaagaaaaacacctaaaatttgaaaaatgattgtaggatcaaaaaaggcagatgaaattacttaatactcagtgttttggagagtattccttttagtttgttggttggctggtttgaacgatagaaatatgcagcatgcaatatatgcttatatttcattttaatttctgatatataatgaacttcttgggagaggtactgaatctttgatgttttttgtcattgttctcaagtgcaatataacaatgtaaccaaatctagataatttcaaagttgtcattaatttagtaagcctaatataaacaaatatttgtattatttttgttagcaggaaagagtgattaagtgaggttatttacccctaaatggtccattctgcattgtatttcaggctggaaatgaattattctttaccagttttgaaacactttgaaatatcctaaggtaacttggaagctgtgtagtatatcaaattaatttgctacctaataacatagaaagtaaatatctttgtggtcacccacattgggtgagacagaaaatgaatctgttctaaaatttgtaatttgctaacttgatttgagttagtgaaaactggtacagtgttctgcttgatttacaacatgtaacttgtgactgtacaataaacataagcatatggtactaaaaaacacaaccgacacacaccaaacacacagaggacagacgaacccgcaaaacgacagagcaagaaagaaaacggcgacacgcgcaccaagaagcggacaagaaagagggcgcagcaacatgaataagacgcagaaaaggcacggagaacacggacgcaacgacgcg

SEQ ID NO: 329218 - DNA, 6846 bp, Homo sapiens
gataaaaagctttcctcatttttaaacaacagtcgcacggaagttcccggcgggacaagggaacgtgggtgcccttgctactcccgtggacgcgggtagattgggacgctggaccgtatctccccgcccccgcccccacgcctcctcaggtgctcagcctgaggccttcgtccaggagcgctgccgctgacccaggctcaggagctgggggcccctgcacagacgcccaggtctcgggacaggcggcgactgcactcacggaagtacgctgagctctcccctgtagaagggcgcctctcctcccccacttcctcctccagctccacagcagcctcccgggccggctcctcctccttccaggtctcctcccagtgccgccgcggctctcaggcctgaggtgcggcgctcaccccggcagtccccagcctcagacgctgcgtggagcggcggagccggagggaagcaaaggaccgtctgcgctgctgtccccgccccgcgcgctctgcgcccctcgtccctggcggtcgctccgaagctcagccctcttgcctgccccggagctgtcccgggctagccgagaagagagcggccggcaagtttgggcgcgcgcaggcggcgggccgcgggcactgggcgcctcgctggggcggggggaggtggctaccgctcccggcttggcgtcccgcgcgcacttcggcgatggcttttccgccgcggcgacggctgcgcctcggtccccgcggcctcccgcttcttctctcgggactcctgctacctctgtgccgcgccttcaacctagacgtggacagtcctgccgagtactctggccccgagggaagttacttcggcttcgccgtggatttcttcgtgcccagcgcgtcttcccggatgtttcttctcgtgggagctcccaaagcaaacaccacccagcctgggattgtggaaggagggcaggtcctcaaatgtgactggtcttctacccgccggtgccagccaattgaatttgatgcaacaggcaatagagattatgccaaggatgatccattggaatttaagtcccatcagtggtttggagcatctgtgaggtcgaaacaggataaaattttggcctgtgccccattgtaccattggagaactgagatgaaacaggagcgagagcctgttggaacatgctttcttcaagatggaacaaagactgttgagtatgctccatgtagatcacaagatattgatgctgatggacagggattttgtcaaggaggattcagcattgattttactaaagctgacagagtacttcttggtggtcctggtagcttttattggcaaggtcagcttatttcggatcaagtggcagaaatcgtatctaaatacgaccccaatgtttacagcatcaagtataataaccaattagcaactcggactgcacaagctatttttgatgacagctatttgggttattctgtggctgtcggagatttcaatggtgatggcatagatgactttgtttcaggagttccaagagcagcaaggactttgggaatggtttatatttatgatgggaagaacatgtcctccttatacaattttactggcgagcagatggctgcatatttcggattttctgtagctgccactgacattaatggagatgattatgcagatgtgtttattggagcacctctcttcatggatcgtggctctgatggcaaactccaagaggtggggcaggtctcagtgtctctacagagagcttcaggagacttccagacgacaaagctgaatggatttgaggtctttgcacggtttggcagtgccatagctcctttgggagatctggaccaggatggtttcaatgatattgcaattgctgctccatatgggggtgaagataaaaaaggaattgtttatatcttcaatggaagatcaacaggcttgaacgcagtcccatctcaaatccttgaagggcagtgggctgctcgaagcatgccaccaagctttggctattcaatgaaaggagccacagatatagacaaaaatggatatccagacttaattgtaggagcttttggtgtagatcgagctatcttatacagggccagaccagttatcactgtaaatgctggtcttgaagtgtaccctagcattttaaatcaagacaataaaacctgctcactgcctggaacagctctcaaagtttcctgttttaatgttaggttctgcttaaaggcagatggcaaaggagtacttcccaggaaacttaatttccaggtggaacttcttttggataaactcaagcaaaagggagcaattcgacgagcactgtttctctacagcaggtccccaagtcactccaagaacatgactatttcaagggggggactgatgcagtgtgaggaattgatagcgtatctgcgggatgaatctgaatttagagacaaactcactccaattactatttttatggaatatcggttggattatagaacagctgctgatacaacaggcttgcaacccattcttaaccagttcacgcctgctaacattagtcgacaggctcacattctacttgactgtggtgaagacaatgtctgtaaacccaagctggaagtttctgtagatagtgatcaaaagaagatctatattggggatgacaaccctctgacattgattgttaaggctcagaatcaaggagaaggtgcctacgaagctgagctcatcgtttccattccactgcaggctgatttcatcggggttgtccgaaacaatgaagccttagcaagactttcctgtgcatttaagacagaaaaccaaactcgccaggtggtatgtgaccttggaaacccaatgaaggctggaactcaactcttagctggtcttcgtttcagtgtgcaccagcagtcagagatggatacttctgtgaaatttgacttacaaatccaaagctcaaatctatttgacaaagtaagcccagttgtatctcacaaagttgatcttgctgttttagctgcagttgagataagaggagtctcgagtcctgatcatatctttcttccgattccaaactgggagcacaaggagaaccctgagactgaagaagatgttgggccagttgttcagcacatctatgagctgagaaacaatggtccaagttcattcagcaaggcaatgctccatcttcagtggccttacaaatataataataacactctgttgtatatccttcattatgatattgatggaccaatgaactgcacttcagatatggagatcaaccctttgagaattaagatctcatctttgcaaacaactgaaaagaatgacacggttgccgggcaaggtgagcgggaccatctcatcactaagcgggatcttgccctcagtgaaggagatattcacactttgggttgtggagttgctcagtgcttgaagattgtctgccaagttgggagattagacagaggaaagagtgcaatcttgtacgtaaagtcattactgtggactgagacttttatgaataaagaaaatcagaatcattcctattctctgaagtcgtctgcttcatttaatgtcatagagtttccttataagaatcttccaattgaggatatcaccaactccacattggttaccactaatgtcacctggggcattcagccagcgcccatgcctgtgcctgtgtgggtgatcattttagcagttctagcaggattgttgctactggctgttttggtatttgtaatgtacaggatgggcttttttaaacgggtccggccacctcaagaagaacaagaaagggagcagcttcaacctcatgaaaatggtgaaggaaactcagaaacttaactgcagtttttaagttatgctacatcttgacccactagaattagcaactttattatagatttaaactttcttcatgaggagtaaaaatccaaggctttactgctgatagtgctaattggcattaaccacaaaatgagaattatatttgtcaaccttctccttataaataagttcagacatacatttaataacatagggtgacttgtgtttttaggtatttaaataataaaatttcaagggatagtttttattcaatgtatataagacaggtagtgcctgatttactactttatataaaatagtacctccttcagttactgtttctgatttaatgtacggaactttatttgttgttgttgttgttgttgttgttgttgttttaaagcagtccaaatttggaccttagcaatcatgtcttttgtataggtacttaatgttaatacatattacactacagtttacttttcagaatactaaagactttataactgcatgaacttggatttttttaatcactcatatggtagaattttataaacacatacatgataccatccaaattcttgcttttaataacaaaggtacaatattttgttttagtatgaaaatctggtagatcctattacacttctgtttatattaaatccacaatattttattacatttttaacttgtataaattttaggtcaaatccttcaagccaacctatactaaaaattagttccataatcacaaatggctcttttgtgtaattgtttaatttcacctgaatatcataatgcttaaagccatatggagttggaaattatttccaaagcatatttattccattgttttagtctggctatttacagtataaaaaaagcatttttattaaaatactgtgtagttctttgagatagttgcttatgcatatagtaagtattacattcttagagtagagcagagtttttagttagtattaatttattttcctccattcatgtacttttccttatatttccaaaactgttactgagaatgggtcaagatcagtgagaaatctttacagttgacaggaacctggaccccttaccccaactttatgagtaatgcttggaataaaaactcttaaggcaactcactgatttacttctagcaatagcatgatgttacaggaatattacctctgtttaagcaaggtaatgtgtaaaatcagtctcggctgtcagaataacttctaaaaggtatttttataagcagttcaagttactgaaaaccttttaaacctttctgaagttcgttagtataaattacttttctaggattattaataaaagccacataggtggcaagttgtagttttatatggctctgtagagtggtgaaccttctagaggaatatatgatttattcacagttcctcaaggcctggggatgatgatcagttatacctatttttgtgcaattacatcatgttgtacattagaaatggagagtttaatagctctttaactgctgtcctcattaggtaatgataaatatttcccttaaataattgactattttgctgtgttttaaaaatgattgaaatttatcttgccatatctcataatttcatgcacaagttgactgagctaatcttgagaatatattcgtaaaataggagcacatttagttgaggtatacaaggtaggactctagacaaaaccttctattttagctttagtgaatttcaaaagtaatgggtcttggagtatagatttttattagtagcttgaaagagcttaatcatatgcagtaagtatttttattaccaataaatttaaaattttttaagaaaaatatttttatcctagggccaagtgttgcctgccaccaatcagtaagttagtctataacaaattttaccctaacagttttaccacctagtaacagtcatttctgaaaatatgttggatagaaagtcactctttggcaaaagtgttagaatttgcttttgtgccatctattccttttatggcatctatcttgaaagtaatcttgtattggagattgaaagatgctgtaatttagaaattaacatgatatcttaaattacctttatgaaatatagttttgtataatagcatagattttccttcaaaaaatgaacatttatatatctacaaaaatatggagaagagtaatttgaaagcctactttctgaagaaaatggtgggatttttttttatcatgattaaatatcaaaaaattgccctatgaaaactttaaatctctaaaacatttgaaatactaccatatttgtgatttattgagaataaaaatccattttgaaatgtaaaatttttatgatctgattcagttttaagaaaacatgaatgaactagaagatattaaaaacatttgacattggtaagaaatattgatactgatattgatttttatataggtatttatttcagaattgatattttgagaaaaatacatgtgagtcattttttctgtttctcttttctcttaacgattatcactgtaattctgaatctgaaaggtaaaacaattagtcaaaatattattgccatcattctacctgtgttatgaaactacttattcatagttaattctcattaacacttacatttccataaagaaaactcaagtattaataaaagagactttactggcttaagagggctgtgaaagatttttgatagtgaatcatgaccctaagggagagatttgtgtgataaaagtattgtatataatagatcagcgatttttgtaaggcaaacagaatttgtaagttggcagatcttcctaagttgcaaaatgtaatgatgagcttggtggagaagaatgagtcgttcttggaatacctatgtgcagccactacccatctcaatgtcaccttgtttgcattcttggatagcttgtatatgtagtagtttctgactgagcatggtcatcgcttgtttatgtaaacgacggtcggttcatgtagtacacgtgttaactgt

SEQ ID NO: 329219 - DNA, 5141 bp, Homo sapiens
gggaggcagaacccaggaagtactgtttttatatgtcatttgtgtgatccccaagaagccttcttttttgtacctggtggttcaattgttttatttaaaatctaccaattttctgcctgcaggaattaggatatttggtgttgggagtgttatgagaggtgtgtggagaaattctggttgtggccctactcatgccttctttagccatgttcccttactctagtaaaccatccatttcttctttcctggcctatgaacacagcacatactttggtggttagcttcgtgttatcaaattattgtacccagttgctagactttcactggatcaacaaacatttacttttgcactttttagaaagatggttagtattataaggaggtataattatgattaataattgttgttaaataggctctcttatggattggtccaggtatattaagtaaaataggtttgatagaaaataagatttagttatctttgttcagttttattgtaagctcataattagacattgactagcattactatcttttcctctctcctttagctcttagctggtcttcgtttcagtgtgcaccagcagtcagagatggatacttctgtgaaatttgacttacaaatccaaagctcaaatctatttgacaaagtaagcccagttgtatctcacaaagttgatcttgctgttttagctgcagttgagataagaggagtctcgagtcctgatcatatctttcttccgattccaaactgggagcacaaggagaaccctgagactgaagaagatgttgggccagttgttcagcacatctatgagctgagaaacaatggtccaagttcattcagcaaggcaatgctccatcttcagtggccttacaaatataataataacactctgttgtatatccttcattatgatattgatggaccaatgaactgcacttcagatatggagatcaaccctttgagaattaagatctcatctttgcaaacaactgaaaagaatgacacggttgccgggcaaggtgagcgggaccatctcatcactaagcgggatcttgccctcagtgaaggagatattcacactttgggttgtggagttgctcagtgcttgaagattgtctgccaagttgggagattagacagaggaaagagtgcaatcttgtacgtaaagtcattactgtggactgagacttttatgaataaagaaaatcagaatcattcctattctctgaagtcgtctgcttcatttaatgtcatagagtttccttataagaatcttccaattgaggatatcaccaactccacattggttaccactaatgtcacctggggcattcagccagcgcccatgcctgtgcctgtgtgggtgatcattttagcagttctagcaggattgttgctactggctgttttggtatttgtaatgtacaggatgggcttttttaaacgggtccggccacctcaagaagaacaagaaagggagcagcttcaacctcatgaaaatggtgaaggaaactcagaaacttaactgcagtttttaagttatgctacatcttgacccactagaattagcaactttattatagatttaaactttcttcatgaggagtaaaaatccaaggctttactgctgatagtgctaattggcattaaccacaaaatgagaattatatttgtcaaccttctccttataaataagttcagacatacatttaataacatagggtgacttgtgtttttaggtatttaaataataaaatttcaagggatagtttttattcaatgtatataagacaggtagtgcctgatttactactttatataaaatagtacctccttcagttactgtttctgatttaatgtacggaactttatttgttgttgttgttgttgttgttgttgttgttttaaagcagtccaaatttggaccttagcaatcatgtcttttgtataggtacttaatgttaatacatattacactacagtttacttttcagaatactaaagactttataactgcatgaacttggatttttttaatcactcatatggtagaattttataaacacatacatgataccatccaaattcttgcttttaataacaaaggtacaatattttgttttagtatgaaaatctggtagatcctattacacttctgtttatattaaatccacaatattttattacatttttaacttgtataaattttaggtcaaatccttcaagccaacctatactaaaaattagttccataatcacaaatggctcttttgtgtaattgtttaatttcacctgaatatcataatgcttaaagccatatggagttggaaattatttccaaagcatatttattccattgttttagtctggctatttacagtataaaaaaagcatttttattaaaatactgtgtagttctttgagatagttgcttatgcatatagtaagtattacattcttagagtagagcagagtttttagttagtattaatttattttcctccattcatgtacttttccttatatttccaaaactgttactgagaatgggtcaagatcagtgagaaatctttacagttgacaggaacctggaccccttaccccaactttatgagtaatgcttggaataaaaactcttaaggcaactcactgatttacttctagcaatagcatgatgttacaggaatattacctctgtttaagcaaggtaatgtgtaaaatcagtctcggctgtcagaataacttctaaaaggtatttttataagcagttcaagttactgaaaaccttttaaacctttctgaagttcgttagtataaattacttttctaggattattaataaaagccacataggtggcaagttgtagttttatatggctctgtagagtggtgaaccttctagaggaatatatgatttattcacagttcctcaaggcctggggatgatgatcagttatacctatttttgtgcaattacatcatgttgtacattagaaatggagagtttaatagctctttaactgctgtcctcattaggtaatgataaatatttcccttaaataattgactattttgctgtgttttaaaaatgattgaaatttatcttgccatatctcataatttcatgcacaagttgactgagctaatcttgagaatatattcgtaaaataggagcacatttagttgaggtatacaaggtaggactctagacaaaaccttctattttagctttagtgaatttcaaaagtaatgggtcttggagtatagatttttattagtagcttgaaagagcttaatcatatgcagtaagtatttttattaccaataaatttaaaattttttaagaaaaatatttttatcctagggccaagtgttgcctgccaccaatcagtaagttagtctataacaaattttaccctaacagttttaccacctagtaacagtcatttctgaaaatatgttggatagaaagtcactctttggcaaaagtgttagaatttgcttttgtgccatctattccttttatggcatctatcttgaaagtaatcttgtattggagattgaaagatgctgtaatttagaaattaacatgatatcttaaattacctttatgaaatatagttttgtataatagcatagattttccttcaaaaaatgaacatttatatatctacaaaaatatggagaagagtaatttgaaagcctactttctgaagaaaatggtgggatttttttttatcatgattaaatatcaaaaaattgccctatgaaaactttaaatctctaaaacatttgaaatactaccatatttgtgatttattgagaataaaaatccattttgaaatgtaaaatttttatgatctgattcagttttaagaaaacatgaatgaactagaagatattaaaaacatttgacattggtaagaaatattgatactgatattgatttttatataggtatttatttcagaattgatattttgagaaaaatacatgtgagtcattttttctgtttctcttttctcttaacgattatcactgtaattctgaatctgaaaggtaaaacaattagtcaaaatattattgccatcattctacctgtgttatgaaactacttattcatagttaattctcattaacacttacatttccataaagaaaactcaagtattaataaaagagactttactggcttaagagggctgtgaaagatttttgatagtgaatcatgaccctaagggagagatttgtgtgataaaagtattgtatataatagatcagcgatttttgtaaggcaaacagaatttgtaagttggcagatcttcctaagttgcaaaatgtaatgatgagcttggtggagaagaatgagtcgttcttggaatacctatgtgcagccactacccatctcaatgtcaccttgtttgcattcttggatagcttgtatatgtagtagtttgatgaataatttaaagaaaaacacctaaaatttgaaaaatgattgtaggatcaaaaaaggcagatgaaattacttaatactcagtgttttggagagtattccttttagtttgttggttggctggtttgaacgatagaaatatgcagcatgcaatatatgcttatatttcattttaatttctgatatataatgaacttcttgggagaggtactgaatctttgatgttttttgtcattgttctcaagtgcaatataacaatgtaaccaaatctagataatttcaaagttgtcattaatttagtaagcctaatataaacaaatatttgtattatttttgttagcaggaaagagtgattaagtgaggttatttacccctaaatggtccattctgcattgtatttcaggctggaaatgaattattctttaccagttttgaaacactttgaaatatcctaaggtaacttggaagctgtgtagtatatcaaattaatttgctacctaataacatagaaagtaaatatctttgtggtcacccacattgggtgagacagaaaatgaatctgttctaaaatttgtaatttgctaacttgatttgagttagtgaaaactggtacagtgttctgcttgatttacaacatgtaacttgtgactgtacaataaacataagcatatggta

SEQ ID NO: 329220 - DNA, 1228 bp, Homo sapiens
cggccgctccaacatcagaatcaatatttcttaccaatgtcaaatgtttttaatgtatttatttcagaattgatattttgagaaaaatacatgtgagtcattttttctgtttctcttttctcttaacgattatcactgtaattctgaatctgaaaggtaaaacaattagtcaaaatattattgccatcattctacctgtgttatgaaactacttattcatagttaattctcattaacacttacatttccataaagaaaactcaagtattaataaaagagactttactggcttaagagggctgtgaaagatttttgatagtgaatcatgaccctaagggagagatttgtgtgataaaagtattgtatataatagatcagcgatttttgtaaggcaaacagaatttgtaagttggcagatcttcctaagttgcaaaatgtaatgatgagcttggtggagaagaatgagtcgttcttggaatacctatgtgcagccactacccatctcaatgtcaccttgtttgcattcttggatagcttgtatatgtagtagtttgatgaataatttaaagaaaaacacctaaaatttgaaaaatgattgtaggatcaaaaaaggcagatgaaattacttaatactcagtgttttggagagtattccttttagtttgttggttggctggtttgaacgatagaaatatgcagcatgcaatatatgcttatatttcattttaatttctgatatataatgaacttcttgggagaggtactgaatctttgatgttttttgtcattgttctcaagtgcaatataacaatgtaaccaaatctagataatttcaaagttgtcattaatttagtaagcctaatataaacaaatatttgtattatttttgttagcaggaaagagtgattaagtgaggttatttacccctaaatggtccattctgcattgtatttcaggctggaaatgaattattctttaccagttttgaaacactttgaaatatcctaaggtaacttggaagctgtgtagtatatcaaattaatttgctacctaataacatagaaagtaaatatctttgtggtcacccacattgggtgagacagaaaatgaatctgttctaaaatttgtaatttgctaacttgatttgagttagtgaaaactggtacagtgttctgcttgatttacaacatgtaacttgtgactgtacaataaacataagcatatggta

SEQ ID NO: 329221 - DNA, 4518 bp, Homo sapiens
gataaaaagctttcctcatttttaaacaacagtcgcacggaagttcccggcgggacaagggaacgtgggtgcccttgctactcccgtggacgcgggtagattgggacgctggaccgtatctccccgcccccgcccccacgcctcctcaggtgctcagcctgaggccttcgtccaggagcgctgccgctgacccaggctcaggagctgggggcccctgcacagacgcccaggtctcgggacaggcggcgactgcactcacggaagtacgctgagctctcccctgtagaagggcgcctctcctcccccacttcctcctccagctccacagcagcctcccgggccggctcctcctccttccaggtctcctcccagtgccgccgcggctctcaggcctgaggtgcggcgctcaccccggcagtccccagcctcagacgctgcgtggagcggcggagccggagggaagcaaaggaccgtctgcgctgctgtccccgccccgcgcgctctgcgcccctcgtccctggcggtcgctccgaagctcagccctcttgcctgccccggagctgtcccgggctagccgagaagagagcggccggcaagtttgggcgcgcgcaggcggcgggccgcgggcactgggcgcctcgctggggcggggggaggtggctaccgctcccggcttggcgtcccgcgcgcacttcggcgatggcttttccgccgcggcgacggctgcgcctcggtccccgcggcctcccgcttcttctctcgggactcctgctacctctgtgccgcgccttcaacctagacgtggacagtcctgccgagtactctggccccgagggaagttacttcggcttcgccgtggatttcttcgtgcccagcgcgtcttcccggatgtttcttctcgtgggagctcccaaagcaaacaccacccagcctgggattgtggaaggagggcaggtcctcaaatgtgactggtcttctacccgccggtgccagccaattgaatttgatgcaacaggcaatagagattatgccaaggatgatccattggaatttaagtcccatcagtggtttggagcatctgtgaggtcgaaacaggataaaattttggcctgtgccccattgtaccattggagaactgagatgaaacaggagcgagagcctgttggaacatgctttcttcaagatggaacaaagactgttgagtatgctccatgtagatcacaagatattgatgctgatggacagggattttgtcaaggaggattcagcattgattttactaaagctgacagagtacttcttggtggtcctggtagcttttattggcaaggtcagcttatttcggatcaagtggcagaaatcgtatctaaatacgaccccaatgtttacagcatcaagtataataaccaattagcaactcggactgcacaagctatttttgatgacagctatttgggttattctgtggctgtcggagatttcaatggtgatggcatagatgactttgtttcaggagttccaagagcagcaaggactttgggaatggtttatatttatgatgggaagaacatgtcctccttatacaattttactggcgagcagatggctgcatatttcggattttctgtagctgccactgacattaatggagatgattatgcagatgtgtttattggagcacctctcttcatggatcgtggctctgatggcaaactccaagaggtggggcaggtctcagtgtctctacagagagcttcaggagacttccagacgacaaagctgaatggatttgaggtctttgcacggtttggcagtgccatagctcctttgggagatctggaccaggatggtttcaatgatattgcaattgctgctccatatgggggtgaagataaaaaaggaattgtttatatcttcaatggaagatcaacaggcttgaacgcagtcccatctcaaatccttgaagggcagtgggctgctcgaagcatgccaccaagctttggctattcaatgaaaggagccacagatatagacaaaaatggatatccagacttaattgtaggagcttttggtgtagatcgagctatcttatacagggccagaccagttatcactgtaaatgctggtcttgaagtgtaccctagcattttaaatcaagacaataaaacctgctcactgcctggaacagctctcaaagtttcctgttttaatgttaggttctgcttaaaggcagatggcaaaggagtacttcccaggaaacttaatttccaggtggaacttcttttggataaactcaagcaaaagggagcaattcgacgagcactgtttctctacagcaggtccccaagtcactccaagaacatgactatttcaagggggggactgatgcagtgtgaggaattgatagcgtatctgcgggatgaatctgaatttagagacaaactcactccaattactatttttatggaatatcggttggattatagaacagctgctgatacaacaggcttgcaacccattcttaaccagttcacgcctgctaacattagtcgacaggctcacattctacttgactgtggtgaagacaatgtctgtaaacccaagctggaagtttctgtagatagtgatcaaaagaagatctatattggggatgacaaccctctgacattgattgttaaggctcagaatcaaggagaaggtgcctacgaagctgagctcatcgtttccattccactgcaggctgatttcatcggggttgtccgaaacaatgaagccttagcaagactttcctgtgcatttaagacagaaaaccaaactcgccaggtggtatgtgaccttggaaacccaatgaaggctggaactcaactcttagctggtcttcgtttcagtgtgcaccagcagtcagagatggatacttctgtgaaatttgacttacaaatccaaagctcaaatctatttgacaaagtaagcccagttgtatctcacaaagttgatcttgctgttttagctgcagttgagataagaggagtctcgagtcctgatcatatctttcttccgattccaaactgggagcacaaggagaaccctgagactgaagaagatgttgggccagttgttcagcacatctatgagctgagaaacaatggtccaagttcattcagcaaggcaatgctccatcttcagtggccttacaaatataataataacactctgttgtatatccttcattatgatattgatggaccaatgaactgcacttcagatatggagatcaaccctttgagaattaagatctcatctttgcaaacaactgaaaagaatgacacggttgccgggcaaggtgagcgggaccatctcatcactaagcgggatcttgccctcagtgaaggagatattcacactttgggttgtggagttgctcagtgcttgaagattgtctgccaagttgggagattagacagaggaaagagtgcaatcttgtacgtaaagtcattactgtggactgagacttttatgaataaagaaaatcagaatcattcctattctctgaagtcgtctgcttcatttaatgtcatagagtttccttataagaatcttccaattgaggatatcaccaactccacattggttaccactaatgtcacctggggcattcagccagcgcccatgcctgtgcctgtgtgggtgatcattttagcagttctagcaggattgttgctactggctgttttggtatttgtaatgtacaggatgggcttttttaaacgggtccggccacctcaagaagaacaagaaagggagcagcttcaacctcatgaaaatggtgaaggaaactcagaaacttaactgcagtttttaagttatgctacatcttgacccactagaattagcaactttattatagatttaaactttcttcatgaggagtaaaaatccaaggctttactgctgatagtgctaattggcattaaccacaaaatgagaattatatttgtcaaccttctccttataaataagttcagacatacatttaataacatagggtgacttgtgtttttaggtatttaaataataaaatttcaagggatagtttttattcaatgtatataagacaggtagtgcctgatttactactttatataaaatagtacctccttcaaaaaaaaaaaaaaaaaaaaaaaaaaaaaaaaaaaaaaaaaaaaaaaaaaaaaaaaaaaaaaaaaaaaaaaaaaaaaaaaagagggggggagccagacgcgcaagaaagaaagattgagcaacaaccactggggggaccggcgcggacacaaggaaagaagagaacagccggacagagaagggacaaaagagaacaccagggagcgacaacagagagggaggggcgaccgcaaagaaaaaaacaggccggaggaggacaagagacgtttcgacaaacaagagagagggagcaaggaggaccaagagagaagacacaagggaggaagaagagacgaagaaaaaaaaccgccgaaggggggg

SEQ ID NO: 329222 - DNA, 1956 bp, Homo sapiens
gataaaaagctttcctcatttttaaacaacagtcgcacggaagttcccggcgggacaagggaacgtgggtgcccttgctactcccgtggacgcgggtagattgggacgctggaccgtatctccccgcccccgcccccacgcctcctcaggtgctcagcctgaggccttcgtccaggagcgctgccgctgacccaggctcaggagctgggggcccctgcacagacgcccaggtctcgggacaggcggcgactgcactcacggaagtacgctgagctctcccctgtagaagggcgcctctcctcccccacttcctcctccagctccacagcagcctcccgggccggctcctcctccttccaggtctcctcccagtgccgccgcggctctcaggcctgaggtgcggcgctcaccccggcagtccccagcctcagacgctgcgtggagcggcggagccggagggaagcaaaggaccgtctgcgctgctgtccccgccccgcgcgctctgcgcccctcgtccctggcggtcgctccgaagctcagccctcttgcctgccccggagctgtcccgggctagccgagaagagagcggccggcaagtttgggcgcgcgcaggcggcgggccgcgggcactgggcgcctcgctggggcggggggaggtggctaccgctcccggcttggcgtcccgcgcgcacttcggcgatggcttttccgccgcggcgacggctgcgcctcggtccccgcggcctcccgcttcttctctcgggactcctgctacctctgtgccgcgccttcaacctagacgtggacagtcctgccgagtactctggccccgagggaagttacttcggcttcgccgtggatttcttcgtgcccagcgcgtcttcccggatgtttcttctcgtgggagctcccaaagcaaacaccacccagcctgggattgtggaaggagggcaggtcctcaaatgtgactggtcttctacccgccggtgccagccaattgaatttgatgcaacaggcaatagagattatgccaaggatgatccattggaatttaagtcccatcagtggtttggagcatctgtgaggtcgaaacaggataaaattttggcctgtgccccattgtaccattggagaactgagatgaaacaggagcgagagcctgttggaacatgctttcttcaagatggaacaaagactgttgagtatgctccatgtagatcacgtatgtataggatattgtaccagcttttaagaagaggggtgggaagcctagtttgtgaaaaatatgtgtgtgtgtgtgtgtgtgtgtgtgtgtgtgagagagagagagatattaaaagatatagacatattatgatgataacaaaatgaaaacaatcctactaatgtaaagatattacaaatgtgaagtaaacaggtttactttttctaagaactcattttcatcttccttcgtgagtataataatagttactacctgattttaagaatctgtatttttgatgactaacagtcaaaagatgcttagttgaacttctcttaacagagaagatgtagaccccacaactaaagattctgattcagtaggtctaggtcaggcctgggtacctgcacttttaacagactctacaaggcaattctgatagataccaaagtttgagaactcctgctttatattaataatgatgttgaaaataaagaatattatgtcttaaagagccaaagtttatataggaagatgaacattgaactcaggagtcttgactctgaattttcctgctcttaatcagaatttctttgttaacctgctaccaagcccacccctttttggtgatccagaggattttatgctctttgctaatattacttgaaatttcaaaaggaattaatatcatggctaaagatgacttcaagcaattataattttgattatgcttttccaaaatctctacatcc

SEQ ID NO: 329223 - DNA, 1855 bp, Homo sapiens
gataaaaagctttcctcatttttaaacaacagtcgcacggaagttcccggcgggacaagggaacgtgggtgcccttgctactcccgtggacgcgggtagattgggacgctggaccgtatctccccgcccccgcccccacgcctcctcaggtgctcagcctgaggccttcgtccaggagcgctgccgctgacccaggctcaggagctgggggcccctgcacagacgcccaggtctcgggacaggcggcgactgcactcacggaagtacgctgagctctcccctgtagaagggcgcctctcctcccccacttcctcctccagctccacagcagcctcccgggccggctcctcctccttccaggtctcctcccagtgccgccgcggctctcaggcctgaggtgcggcgctcaccccggcagtccccagcctcagacgctgcgtggagcggcggagccggagggaagcaaaggaccgtctgcgctgctgtccccgccccgcgcgctctgcgcccctcgtccctggcggtcgctccgaagctcagccctcttgcctgccccggagctgtcccgggctagccgagaagagagcggccggcaagtttgggcgcgcgcaggcggcgggccgcgggcactgggcgcctcgctggggcggggggaggtggctaccgctcccggcttggcgtcccgcgcgcacttcggcgatggcttttccgccgcggcgacggctgcgcctcggtccccgcggcctcccgcttcttctctcgggactcctgctacctctgtgccgcgccttcaacctagacgtggacagtcctgccgagtactctggccccgagggaagttacttcggcttcgccgtggatttcttcgtgcccagcgcgtcttcccggatgtttcttctcgtgggagctcccaaagcaaacaccacccagcctgggattgtggaaggagggcaggtcctcaaatgtgactggtcttctacccgccggtgccagccaattgaatttgatgcaacaggcaatagagattatgccaaggatgatccattggaatttaagtcccatcagtggtttggagcatctgtgaggtcgaaacaggataaaattttggcctgtgccccattgtaccattggagaactgagatgaaacaggagcgagagcctgttggaacatgctttcttcaagatggaacaaagactgttgagtatgctccatgtagatcacaagatattgatgctgatggacagggattttgtcaaggaggattcagcattgattttactaaagctgacagagtacttcttggtggtcctggtagcttttattggcaaggtcagcttatttcggatcaagtggcagaaatcgtatctaaatacgaccccaatgtttacagcatcaagtataataaccaattagcaactcggactgcacaagctatttttgatgacagctatttgggttattctgtggctgtcggagatttcaatggtgatggcatagatgactttgtttcaggagttccaagagcagcaaggactttgggaatgagctattgataatggccagagatatccacagcttggaggagcccagagaccgtttgctttatacccacacagcaactggtccactgctttactgtctgttggataatggctgtaaaatgtttaaaaacaaaacaaaacaaaaaagaggcactagtctatctgcaattactcaacgaggcattttcataggaaacagactatgattaatccatttattcttcccacacacttaccttactaagtctttgctttaataaatgagcaaccctgggtatagtcttaaaattctgcacaataaattttgagaaag

SEQ ID NO: 329224 - DNA, 691 bp, Homo sapiens
actggattggattatttaaaaatcatttcaagctgggtgtggttgcctcacacctgtaatcccagcattttgggaggctgagacaggtggatcatttgaggccaggatttcaagaccagcctggccaacatggtgaaaccccttctctacgaaaaatacagaaaaattagctgggtatagtggcgcaggcctgtaattccaactactggggaggctgaagcatggaggttgcagtgagccgagttcatgcccctgcattccagcttggcctacatactgggcgagactctgtcaaaaaaaaggaaaacaaatcatgtcagatgcaatcagaagtcagcctatcattgggagtttcatgtgtgtatgtgcatgctcttgatatcaaatgtgaaaccactataattatcatatgcaggaaaagaatatactgtgaattccattaaaataaaatataatatttactcagatatttgttgattaagtcaatggactgtttttaaaactaaaagcttttttcctcgataggttaccactaatgtcacctggggcattcagccagcgcccatgcctgtgcctgtgtgggtgatcattttagcagttctagcaggattgttgctactggctgttttggtatttgtaatgtacagggtaagtaacggacttagaaagaaggagagagggaaagcagaag

SEQ ID NO: 329225 - DNA, 7403 bp, Homo sapiens
gataaaaagctttcctcatttttaaacaacagtcgcacggaagttcccggcgggacaagggaacgtgggtgcccttgctactcccgtggacgcgggtagattgggacgctggaccgtatctccccgcccccgcccccacgcctcctcaggtgctcagcctgaggccttcgtccaggagcgctgccgctgacccaggctcaggagctgggggcccctgcacagacgcccaggtctcgggacaggcggcgactgcactcacggaagtacgctgagctctcccctgtagaagggcgcctctcctcccccacttcctcctccagctccacagcagcctcccgggccggctcctcctccttccaggtctcctcccagtgccgccgcggctctcaggcctgaggtgcggcgctcaccccggcagtccccagcctcagacgctgcgtggagcggcggagccggagggaagcaaaggaccgtctgcgctgctgtccccgccccgcgcgctctgcgcccctcgtccctggcggtcgctccgaagctcagccctcttgcctgccccggagctgtcccgggctagccgagaagagagcggccggcaagtttgggcgcgcgcaggcggcgggccgcgggcactgggcgcctcgctggggcggggggaggtggctaccgctcccggcttggcgtcccgcgcgcacttcggcgatggcttttccgccgcggcgacggctgcgcctcggtccccgcggcctcccgcttcttctctcgggactcctgctacctctgtgccgcgccttcaacctagacgtggacagtcctgccgagtactctggccccgagggaagttacttcggcttcgccgtggatttcttcgtgcccagcgcgtcttcccggatgtttcttctcgtgggagctcccaaagcaaacaccacccagcctgggattgtggaaggagggcaggtcctcaaatgtgactggtcttctacccgccggtgccagccaattgaatttgatgcaacaggcaatagagattatgccaaggatgatccattggaatttaagtcccatcagtggtttggagcatctgtgaggtcgaaacaggataaaattttggcctgtgccccattgtaccattggagaactgagatgaaacaggagcgagagcctgttggaacatgctttcttcaagatggaacaaagactgttgagtatgctccatgtagatcacaagatattgatgctgatggacagggattttgtcaaggaggattcagcattgattttactaaagctgacagagtacttcttggtggtcctggtagcttttattggcaaggtcagcttatttcggatcaagtggcagaaatcgtatctaaatacgaccccaatgtttacagcatcaagtataataaccaattagcaactcggactgcacaagctatttttgatgacagctatttgggttattctgtggctgtcggagatttcaatggtgatggcatagatgactttgtttcaggagttccaagagcagcaaggactttgggaatggtttatatttatgatgggaagaacatgtcctccttatacaattttactggcgagcagatggctgcatatttcggattttctgtagctgccactgacattaatggagatgattatgcagatgtgtttattggagcacctctcttcatggatcgtggctctgatggcaaactccaagaggtggggcaggtctcagtgtctctacagagagcttcaggagacttccagacgacaaagctgaatggatttgaggtctttgcacggtttggcagtgccatagctcctttgggagatctggaccaggatggtttcaatgatattgcaattgctgctccatatgggggtgaagataaaaaaggaattgtttatatcttcaatggaagatcaacaggcttgaacgcagtcccatctcaaatccttgaagggcagtgggctgctcgaagcatgccaccaagctttggctattcaatgaaaggagccacagatatagacaaaaatggatatccagacttaattgtaggagcttttggtgtagatcgagctatcttatacagggccagaccagttatcactgtaaatgctggtcttgaagtgtaccctagcattttaaatcaagacaataaaacctgctcactgcctggaacagctctcaaagtttcctgttttaatgttaggttctgcttaaaggcagatggcaaaggagtacttcccaggaaacttaatttccaggtggaacttcttttggataaactcaagcaaaagggagcaattcgacgagcactgtttctctacagcaggtccccaagtcactccaagaacatgactatttcaagggggggactgatgcagtgtgaggaattgatagcgtatctgcgggatgaatctgaatttagagacaaactcactccaattactatttttatggaatatcggttggattatagaacagctgctgatacaacaggcttgcaacccattcttaaccagttcacgcctgctaacattagtcgacaggctcacattctacttgactgtggtgaagacaatgtctgtaaacccaagctggaagtttctgtagatagtgatcaaaagaagatctatattggggatgacaaccctctgacattgattgttaaggctcagaatcaaggagaaggtgcctacgaagctgagctcatcgtttccattccactgcaggctgatttcatcggggttgtccgaaacaatgaagccttagcaagactttcctgtgcatttaagacagaaaaccaaactcgccaggtggtatgtgaccttggaaacccaatgaaggctggaactcaactcttagctggtcttcgtttcagtgtgcaccagcagtcagagatggatacttctgtgaaatttgacttacaaatccaaagctcaaatctatttgacaaagtaagcccagttgtatctcacaaagttgatcttgctgttttagctgcagttgagataagaggagtctcgagtcctgatcatatctttcttccgattccaaactgggagcacaaggagaaccctgagactgaagaagatgttgggccagttgttcagcacatctatgagctgagaaacaatggtccaagttcattcagcaaggcaatgctccatcttcagtggccttacaaatataataataacactctgttgtatatccttcattatgatattgatggaccaatgaactgcacttcagatatggagatcaaccctttgagaattaagatctcatctttgcaaacaactgaaaagaatgacacggttgccgggcaaggtgagcgggaccatctcatcactaagcgggatcttgccctcagtgaaggagatattcacactttgggttgtggagttgctcagtgcttgaagattgtctgccaagttgggagattagacagaggaaagagtgcaatcttgtacgtaaagtcattactgtggactgagacttttatgaataaagaaaatcagaatcattcctattctctgaagtcgtctgcttcatttaatgtcatagagtttccttataagaatcttccaattgaggatatcaccaactccacattggttaccactaatgtcacctggggcattcagccagcgcccatgcctgtgcctgtgtgggtgatcattttagcagttctagcaggattgttgctactggctgttttggtatttgtaatgtacaggatgggcttttttaaacgggtccggccacctcaagaagaacaagaaagggagcagcttcaacctcatgaaaatggtgaaggaaactcagaaacttaactgcagtttttaagttatgctacatcttgacccactagaattagcaactttattatagatttaaactttcttcatgaggagtaaaaatccaaggctttactgctgatagtgctaattggcattaaccacaaaatgagaattatatttgtcaaccttctccttataaataagttcagacatacatttaataacatagggtgacttgtgtttttaggtatttaaataataaaatttcaagggatagtttttattcaatgtatataagacaggtagtgcctgatttactactttatataaaatagtacctccttcagttactgtttctgatttaatgtacggaactttatttgttgttgttgttgttgttgttgttgttgttttaaagcagtccaaatttggaccttagcaatcatgtcttttgtataggtacttaatgttaatacatattacactacagtttacttttcagaatactaaagactttataactgcatgaacttggatttttttaatcactcatatggtagaattttataaacacatacatgataccatccaaattcttgcttttaataacaaaggtacaatattttgttttagtatgaaaatctggtagatcctattacacttctgtttatattaaatccacaatattttattacatttttaacttgtataaattttaggtcaaatccttcaagccaacctatactaaaaattagttccataatcacaaatggctcttttgtgtaattgtttaatttcacctgaatatcataatgcttaaagccatatggagttggaaattatttccaaagcatatttattccattgttttagtctggctatttacagtataaaaaaagcatttttattaaaatactgtgtagttctttgagatagttgcttatgcatatagtaagtattacattcttagagtagagcagagtttttagttagtattaatttattttcctccattcatgtacttttccttatatttccaaaactgttactgagaatgggtcaagatcagtgagaaatctttacagttgacaggaacctggaccccttaccccaactttatgagtaatgcttggaataaaaactcttaaggcaactcactgatttacttctagcaatagcatgatgttacaggaatattacctctgtttaagcaaggtaatgtgtaaaatcagtctcggctgtcagaataacttctaaaaggtatttttataagcagttcaagttactgaaaaccttttaaacctttctgaagttcgttagtataaattacttttctaggattattaataaaagccacataggtggcaagttgtagttttatatggctctgtagagtggtgaaccttctagaggaatatatgatttattcacagttcctcaaggcctggggatgatgatcagttatacctatttttgtgcaattacatcatgttgtacattagaaatggagagtttaatagctctttaactgctgtcctcattaggtaatgataaatatttcccttaaataattgactattttgctgtgttttaaaaatgattgaaatttatcttgccatatctcataatttcatgcacaagttgactgagctaatcttgagaatatattcgtaaaataggagcacatttagttgaggtatacaaggtaggactctagacaaaaccttctattttagctttagtgaatttcaaaagtaatgggtcttggagtatagatttttattagtagcttgaaagagcttaatcatatgcagtaagtatttttattaccaataaatttaaaattttttaagaaaaatatttttatcctagggccaagtgttgcctgccaccaatcagtaagttagtctataacaaattttaccctaacagttttaccacctagtaacagtcatttctgaaaatatgttggatagaaagtcactctttggcaaaagtgttagaatttgcttttgtgccatctattccttttatggcatctatcttgaaagtaatcttgtattggagattgaaagatgctgtaatttagaaattaacatgatatcttaaattacctttatgaaatatagttttgtataatagcatagattttccttcaaaaaatgaacatttatatatctacaaaaatatggagaagagtaatttgaaagcctactttctgaagaaaatggtgggatttttttttatcatgattaaatatcaaaaaattgccctatgaaaactttaaatctctaaaacatttgaaatactaccatatttgtgatttattgagaataaaaatccattttgaaatgtaaaatttttatgatctgattcagttttaagaaaacatgaatgaactagaagatattaaaaacatttgacattggtaagaaatattgatactgatattgatttttatataggtatttatttcagaattgatattttgagaaaaatacatgtgagtcattttttctgtttctcttttctcttaacgattatcactgtaattctgaatctgaaaggtaaaacaattagtcaaaatattattgccatcattctacctgtgttatgaaactacttattcatagttaattctcattaacacttacatttccataaagaaaactcaagtattaataaaagagactttactggcttaagagggctgtgaaagatttttgatagtgaatcatgaccctaagggagagatttgtgtgataaaagtattgtatataatagatcagcgatttttgtaaggcaaacagaatttgtaagttggcagatcttcctaagttgcaaaatgtaatgatgagcttggtggagaagaatgagtcgttcttggaatacctatgtgcagccactacccatctcaatgtcaccttgtttgcattcttggatagcttgtatatgtagtagtttgatgaataatttaaagaaaaacacctaaaatttgaaaaatgattgtaggatcaaaaaagtttgttggttggctggtttgaacgatagaaatatgcagcatgcaatatatgcttatatttcattttaatttctgatatataatgaacttcttgggagaggtactgaatctttgatgttttttgtcattgttctcaagtgcaatataacaatgtaaccaaatctagataatttcaaagttgtcattaatttagtaagcctaatataaacaaatatttgtattatttttgttagcaggaaagagtgattaagtgaggttatttacccctaaatggtccattctgcattgtatttcaggctggaaatgaattattctttaccagttttgaaacactttgaaatatcctaaggtaacttggaagctgtgtagtatatcaaattaatttgctacctaataacatagaaagtaaatatctttgtggtcacccacattgggtgagacagaaaatgaatctgttctaaaatttgtaatttgctaacttgatttgagttagtgaaaactggtacagtgttctgcttgatttacaacatgtaacttgtgactgtacaataaacataagcatatggta

SEQ ID NO: 329226 - DNA, 5957 bp, Homo sapiens
tgaggatcccccagcgcagcaagcccgggatatggctttatatttgttcatcgcgagatgaactatttctaccgatgatacattttctatctcggtcatcagattgctgcatttttcggcttgcctgtctctgccatcgacattaatggacatgattatgtacatgtgttgctcggagcgcctctcgatcaatggtctctgtgactcgagaagcctctcgcgaagaggtggggcaggtctcagtgtctctacagagagcttcaggagacttccagacgacaaagctgaatggatttgaggtctttgcacggtttggcagtgccatagctcctttgggagatctggaccaggatggtttcaatgatattgcaattgctgctccatatgggggtgaagataaaaaaggaattgtttatatcttcaatggaagatcaacaggcttgaacgcagtcccatctcaaatccttgaagggcagtgggctgctcgaagcatgccaccaagctttggctattcaatgaaaggagccacagatatagacaaaaatggatatccagacttaattgtaggagcttttggtgtagatcgagctatcttatacagggccagaccagttatcactgtaaatgctggtcttgaagtgtaccctagcattttaaatcaagacaataaaacctgctcactgcctggaacagctctcaaagtttcctgttttaatgttaggttctgcttaaaggcagatggcaaaggagtacttcccaggaaacttaatttccaggtggaacttcttttggataaactcaagcaaaagggagcaattcgacgagcactgtttctctacagcaggtccccaagtcactccaagaacatgactatttcaagggggggactgatgcagtgtgaggaattgatagcgtatctgcgggatgaatctgaatttagagacaaactcactccaattactatttttatggaatatcggttggattatagaacagctgctgatacaacaggcttgcaacccattcttaaccagttcacgcctgctaacattagtcgacaggctcacattctacttgactgtggtgaagacaatgtctgtaaacccaagctggaagtttctgtagatagtgatcaaaagaagatctatattggggatgacaaccctctgacattgattgttaaggctcagaatcaaggagaaggtgcctacgaagctgagctcatcgtttccattccactgcaggctgatttcatcggggttgtccgaaacaatgaagccttagcaagactttcctgtgcatttaagacagaaaaccaaactcgccaggtggtatgtgaccttggaaacccaatgaaggctggaactcaactcttagctggtcttcgtttcagtgtgcaccagcagtcagagatggatacttctgtgaaatttgacttacaaatccaaagctcaaatctatttgacaaagtaagcccagttgtatctcacaaagttgatcttgctgttttagctgcagttgagataagaggagtctcgagtcctgatcatatctttcttccgattccaaactgggagcacaaggagaaccctgagactgaagaagatgttgggccagttgttcagcacatctatgagctgagaaacaatggtccaagttcattcagcaaggcaatgctccatcttcagtggccttacaaatataataataacactctgttgtatatccttcattatgatattgatggaccaatgaactgcacttcagatatggagatcaaccctttgagaattaagatctcatctttgcaaacaactgaaaagaatgacacggttgccgggcaaggtgagcgggaccatctcatcactaagcgggatcttgccctcagtgaaggagatattcacactttgggttgtggagttgctcagtgcttgaagattgtctgccaagttgggagattagacagaggaaagagtgcaatcttgtacgtaaagtcattactgtggactgagacttttatgaataaagaaaatcagaatcattcctattctctgaagtcgtctgcttcatttaatgtcatagagtttccttataagaatcttccaattgaggatatcaccaactccacattggttaccactaatgtcacctggggcattcagccagcgcccatgcctgtgcctgtgtgggtgatcattttagcagttctagcaggattgttgctactggctgttttggtatttgtaatgtacaggatgggcttttttaaacgggtccggccacctcaagaagaacaagaaagggagcagcttcaacctcatgaaaatggtgaaggaaactcagaaacttaactgcagtttttaagttatgctacatcttgacccactagaattagcaactttattatagatttaaactttcttcatgaggagtaaaaatccaaggctttactgctgatagtgctaattggcattaaccacaaaatgagaattatatttgtcaaccttctccttataaataagttcagacatacatttaataacatagggtgacttgtgtttttaggtatttaaataataaaatttcaagggatagtttttattcaatgtatataagacaggtagtgcctgatttactactttatataaaatagtacctccttcagttactgtttctgatttaatgtacggaactttatttgttgttgttgttgttgttgttgttgttgttttaaagcagtccaaatttggaccttagcaatcatgtcttttgtataggtacttaatgttaatacatattacactacagtttacttttcagaatactaaagactttataactgcatgaacttggatttttttaatcactcatatggtagaattttataaacacatacatgataccatccaaattcttgcttttaataacaaaggtacaatattttgttttagtatgaaaatctggtagatcctattacacttctgtttatattaaatccacaatattttattacatttttaacttgtataaattttaggtcaaatccttcaagccaacctatactaaaaattagttccataatcacaaatggctcttttgtgtaattgtttaatttcacctgaatatcataatgcttaaagccatatggagttggaaattatttccaaagcatatttattccattgttttagtctggctatttacagtataaaaaaagcatttttattaaaatactgtgtagttctttgagatagttgcttatgcatatagtaagtattacattcttagagtagagcagagtttttagttagtattaatttattttcctccattcatgtacttttccttatatttccaaaactgttactgagaatgggtcaagatcagtgagaaatctttacagttgacaggaacctggaccccttaccccaactttatgagtaatgcttggaataaaaactcttaaggcaactcactgatttacttctagcaatagcatgatgttacaggaatattacctctgtttaagcaaggtaatgtgtaaaatcagtctcggctgtcagaataacttctaaaaggtatttttataagcagttcaagttactgaaaaccttttaaacctttctgaagttcgttagtataaattacttttctaggattattaataaaagccacataggtggcaagttgtagttttatatggctctgtagagtggtgaaccttctagaggaatatatgatttattcacagttcctcaaggcctggggatgatgatcagttatacctatttttgtgcaattacatcatgttgtacattagaaatggagagtttaatagctctttaactgctgtcctcattaggtaatgataaatatttcccttaaataattgactattttgctgtgttttaaaaatgattgaaatttatcttgccatatctcataatttcatgcacaagttgactgagctaatcttgagaatatattcgtaaaataggagcacatttagttgaggtatacaaggtaggactctagacaaaaccttctattttagctttagtgaatttcaaaagtaatgggtcttggagtatagatttttattagtagcttgaaagagcttaatcatatgcagtaagtatttttattaccaataaatttaaaattttttaagaaaaatatttttatcctagggccaagtgttgcctgccaccaatcagtaagttagtctataacaaattttaccctaacagttttaccacctagtaacagtcatttctgaaaatatgttggatagaaagtcactctttggcaaaagtgttagaatttgcttttgtgccatctattccttttatggcatctatcttgaaagtaatcttgtattggagattgaaagatgctgtaatttagaaattaacatgatatcttaaattacctttatgaaatatagttttgtataatagcatagattttccttcaaaaaatgaacatttatatatctacaaaaatatggagaagagtaatttgaaagcctactttctgaagaaaatggtgggatttttttttatcatgattaaatatcaaaaaattgccctatgaaaactttaaatctctaaaacatttgaaatactaccatatttgtgatttattgagaataaaaatccattttgaaatgtaaaatttttatgatctgattcagttttaagaaaacatgaatgaactagaagatattaaaaacatttgacattggtaagaaatattgatactgatattgatttttatataggtatttatttcagaattgatattttgagaaaaatacatgtgagtcattttttctgtttctcttttctcttaacgattatcactgtaattctgaatctgaaaggtaaaacaattagtcaaaatattattgccatcattctacctgtgttatgaaactacttattcatagttaattctcattaacacttacatttccataaagaaaactcaagtattaataaaagagactttactggcttaagagggctgtgaaagatttttgatagtgaatcatgaccctaagggagagatttgtgtgataaaagtattgtatataatagatcagcgatttttgtaaggcaaacagaatttgtaagttggcagatcttcctaagttgcaaaatgtaatgatgagcttggtggagaagaatgagtcgttcttggaatacctatgtgcagccactacccatctcaatgtcaccttgtttgcattcttggatagcttgtatatgtagtagtttgatgaataatttaaagaaaaacacctaaaatttgaaaaatgattgtaggatcaaaaaaggcagatgaaattacttaatactcagtgttttggagagtattccttttagtttgttggttggctggtttgaacgatagaaatatgcagcatgcaatatatgcttatatttcattttaatttctgatatataatgaacttcttgggagaggtactgaatctttgatgttttttgtcattgttctcaagtgcaatataacaatgtaaccaaatctagataatttcaaagttgtcattaatttagtaagcctaatataaacaaatatttgtattatttttgttagcaggaaagagtgattaagtgaggttatttacccctaaatggtccattctgcattgtatttcaggctggaaatgaattattctttaccagttttgaaacactttgaaatatcctaaggtaacttggaagctgtgtagtatatcaaattaatttgctacctaataacatagaaagtaaatatctttgtggtcacccacattgggtgagacagaaaatgaatctgttctaaaatttgtaatttgctaacttgatttgagttagtgaaaactggtacagtgttctgcttgatttacaacatgtaacttgtgactgtacaataaacataagcatatggta

SEQ ID NO: 329227 - DNA, 5088 bp, Homo sapiens
gggaggcagaacccaggaagtactgtttttatatgtcatttgtgtgatccccaagaagccttcttttttgtacctggtggttcaattgttttattgttatgagaggtgtgtggagaaattctggttgtggccctactcatgccttctttagccatgttcccttactctagtaaaccatccatttcttctttcctggcctatgaacacagcacatactttggtggttagcttcgtgttatcaaattattgtacccagttgctagactttcactggatcaacaaacatttacttttgcactttttagaaagatggttagtattataaggaggtataattatgattaataattgttgttaaataggctctcttatggattggtccaggtatattaagtaaaataggtttgatagaaaataagatttagttatctttgttcagttttattgtaagctcataattagacattgactagcattactatcttttcctctctcctttagctcttagctggtcttcgtttcagtgtgcaccagcagtcagagatggatacttctgtgaaatttgacttacaaatccaaagctcaaatctatttgacaaagtaagcccagttgtatctcacaaagttgatcttgctgttttagctgcagttgagataagaggagtctcgagtcctgatcatatctttcttccgattccaaactgggagcacaaggagaaccctgagactgaagaagatgttgggccagttgttcagcacatctatgagctgagaaacaatggtccaagttcattcagcaaggcaatgctccatcttcagtggccttacaaatataataataacactctgttgtatatccttcattatgatattgatggaccaatgaactgcacttcagatatggagatcaaccctttgagaattaagatctcatctttgcaaacaactgaaaagaatgacacggttgccgggcaaggtgagcgggaccatctcatcactaagcgggatcttgccctcagtgaaggagatattcacactttgggttgtggagttgctcagtgcttgaagattgtctgccaagttgggagattagacagaggaaagagtgcaatcttgtacgtaaagtcattactgtggactgagacttttatgaataaagaaaatcagaatcattcctattctctgaagtcgtctgcttcatttaatgtcatagagtttccttataagaatcttccaattgaggatatcaccaactccacattggttaccactaatgtcacctggggcattcagccagcgcccatgcctgtgcctgtgtgggtgatcattttagcagttctagcaggattgttgctactggctgttttggtatttgtaatgtacaggatgggcttttttaaacgggtccggccacctcaagaagaacaagaaagggagcagcttcaacctcatgaaaatggtgaaggaaactcagaaacttaactgcagtttttaagttatgctacatcttgacccactagaattagcaactttattatagatttaaactttcttcatgaggagtaaaaatccaaggctttactgctgatagtgctaattggcattaaccacaaaatgagaattatatttgtcaaccttctccttataaataagttcagacatacatttaataacatagggtgacttgtgtttttaggtatttaaataataaaatttcaagggatagtttttattcaatgtatataagacaggtagtgcctgatttactactttatataaaatagtacctccttcagttactgtttctgatttaatgtacggaactttatttgttgttgttgttgttgttgttgttgttgttttaaagcagtccaaatttggaccttagcaatcatgtcttttgtataggtacttaatgttaatacatattacactacagtttacttttcagaatactaaagactttataactgcatgaacttggatttttttaatcactcatatggtagaattttataaacacatacatgataccatccaaattcttgcttttaataacaaaggtacaatattttgttttagtatgaaaatctggtagatcctattacacttctgtttatattaaatccacaatattttattacatttttaacttgtataaattttaggtcaaatccttcaagccaacctatactaaaaattagttccataatcacaaatggctcttttgtgtaattgtttaatttcacctgaatatcataatgcttaaagccatatggagttggaaattatttccaaagcatatttattccattgttttagtctggctatttacagtataaaaaaagcatttttattaaaatactgtgtagttctttgagatagttgcttatgcatatagtaagtattacattcttagagtagagcagagtttttagttagtattaatttattttcctccattcatgtacttttccttatatttccaaaactgttactgagaatgggtcaagatcagtgagaaatctttacagttgacaggaacctggaccccttaccccaactttatgagtaatgcttggaataaaaactcttaaggcaactcactgatttacttctagcaatagcatgatgttacaggaatattacctctgtttaagcaaggtaatgtgtaaaatcagtctcggctgtcagaataacttctaaaaggtatttttataagcagttcaagttactgaaaaccttttaaacctttctgaagttcgttagtataaattacttttctaggattattaataaaagccacataggtggcaagttgtagttttatatggctctgtagagtggtgaaccttctagaggaatatatgatttattcacagttcctcaaggcctggggatgatgatcagttatacctatttttgtgcaattacatcatgttgtacattagaaatggagagtttaatagctctttaactgctgtcctcattaggtaatgataaatatttcccttaaataattgactattttgctgtgttttaaaaatgattgaaatttatcttgccatatctcataatttcatgcacaagttgactgagctaatcttgagaatatattcgtaaaataggagcacatttagttgaggtatacaaggtaggactctagacaaaaccttctattttagctttagtgaatttcaaaagtaatgggtcttggagtatagatttttattagtagcttgaaagagcttaatcatatgcagtaagtatttttattaccaataaatttaaaattttttaagaaaaatatttttatcctagggccaagtgttgcctgccaccaatcagtaagttagtctataacaaattttaccctaacagttttaccacctagtaacagtcatttctgaaaatatgttggatagaaagtcactctttggcaaaagtgttagaatttgcttttgtgccatctattccttttatggcatctatcttgaaagtaatcttgtattggagattgaaagatgctgtaatttagaaattaacatgatatcttaaattacctttatgaaatatagttttgtataatagcatagattttccttcaaaaaatgaacatttatatatctacaaaaatatggagaagagtaatttgaaagcctactttctgaagaaaatggtgggatttttttttatcatgattaaatatcaaaaaattgccctatgaaaactttaaatctctaaaacatttgaaatactaccatatttgtgatttattgagaataaaaatccattttgaaatgtaaaatttttatgatctgattcagttttaagaaaacatgaatgaactagaagatattaaaaacatttgacattggtaagaaatattgatactgatattgatttttatataggtatttatttcagaattgatattttgagaaaaatacatgtgagtcattttttctgtttctcttttctcttaacgattatcactgtaattctgaatctgaaaggtaaaacaattagtcaaaatattattgccatcattctacctgtgttatgaaactacttattcatagttaattctcattaacacttacatttccataaagaaaactcaagtattaataaaagagactttactggcttaagagggctgtgaaagatttttgatagtgaatcatgaccctaagggagagatttgtgtgataaaagtattgtatataatagatcagcgatttttgtaaggcaaacagaatttgtaagttggcagatcttcctaagttgcaaaatgtaatgatgagcttggtggagaagaatgagtcgttcttggaatacctatgtgcagccactacccatctcaatgtcaccttgtttgcattcttggatagcttgtatatgtagtagtttgatgaataatttaaagaaaaacacctaaaatttgaaaaatgattgtaggatcaaaaaaggcagatgaaattacttaatactcagtgttttggagagtattccttttagtttgttggttggctggtttgaacgatagaaatatgcagcatgcaatatatgcttatatttcattttaatttctgatatataatgaacttcttgggagaggtactgaatctttgatgttttttgtcattgttctcaagtgcaatataacaatgtaaccaaatctagataatttcaaagttgtcattaatttagtaagcctaatataaacaaatatttgtattatttttgttagcaggaaagagtgattaagtgaggttatttacccctaaatggtccattctgcattgtatttcaggctggaaatgaattattctttaccagttttgaaacactttgaaatatcctaaggtaacttggaagctgtgtagtatatcaaattaatttgctacctaataacatagaaagtaaatatctttgtggtcacccacattgggtgagacagaaaatgaatctgttctaaaatttgtaatttgctaacttgatttgagttagtgaaaactggtacagtgttctgcttgatttacaacatgtaacttgtgactgtacaataaacataagcatatggta

SEQ ID NO: 329228 - DNA, 3379 bp, Homo sapiens
gataaaaagctttcctcatttttaaacaacagtcgcacggaagttcccggcgggacaagggaacgtgggtgcccttgctactcccgtggacgcgggtagattgggacgctggaccgtatctccccgcccccgcccccacgcctcctcaggtgctcagcctgaggccttcgtccaggagcgctgccgctgacccaggctcaggagctgggggcccctgcacagacgcccaggtctcgggacaggcggcgactgcactcacggaagtacgctgagctctcccctgtagaagggcgcctctcctcccccacttcctcctccagctccacagcagcctcccgggccggctcctcctccttccaggtctcctcccagtgccgccgcggctctcaggcctgaggtgcggcgctcaccccggcagtccccagcctcagacgctgcgtggagcggcggagccggagggaagcaaaggaccgtctgcgctgctgtccccgccccgcgcgctctgcgcccctcgtccctggcggtcgctccgaagctcagccctcttgcctgccccggagctgtcccgggctagccgagaagagagcggccggcaagtttgggcgcgcgcaggcggcgggccgcgggcactgggcgcctcgctggggcggggggaggtggctaccgctcccggcttggcgtcccgcgcgcacttcggcgatggcttttccgccgcggcgacggctgcgcctcggtccccgcggcctcccgcttcttctctcgggactcctgctacctctgtgccgcgccttcaacctagacgtggacagtcctgccgagtactctggccccgagggaagttacttcggcttcgccgtggatttcttcgtgcccagcgcgtcttcccggatgtttcttctcgtgggagctcccaaagcaaacaccacccagcctgggattgtggaaggagggcaggtcctcaaatgtgactggtcttctacccgccggtgccagccaattgaatttgatgcaacaggcaatagagattatgccaaggatgatccattggaatttaagtcccatcagtggtttggagcatctgtgaggtcgaaacaggataaaattttggcctgtgccccattgtaccattggagaactgagatgaaacaggagcgagagcctgttggaacatgctttcttcaagatggaacaaagactgttgagtatgctccatgtagatcacaagatattgatgctgatggacagggattttgtcaaggaggattcagcattgattttactaaagctgacagagtacttcttggtggtcctggtagcttttattggcaaggtcagcttatttcggatcaagtggcagaaatcgtatctaaatacgaccccaatgtttacagcatcaagtataataaccaattagcaactcggactgcacaagctatttttgatgacagctatttgggttattctgtggctgtcggagatttcaatggtgatggcatagatgactttgtttcaggagttccaagagcagcaaggactttgggaatggtttatatttatgatgggaagaacatgtcctccttatacaattttactggcgagcagatggctgcatatttcggattttctgtagctgccactgacattaatggagatgattatgcagatgtgtttattggagcacctctcttcatggatcgtggctctgatggcaaactccaagaggtggggcaggtctcagtgtctctacagagagcttcaggagacttccagacgacaaagctgaatggatttgaggtctttgcacggtttggcagtgccatagctcctttgggagatctggaccaggatggtttcaatgatattgcaattgctgctccatatgggggtgaagataaaaaaggaattgtttatatcttcaatggaagatcaacaggcttgaacgcagtcccatctcaaatccttgaagggcagtgggctgctcgaagcatgccaccaagctttggctattcaatgaaaggagccacagatatagacaaaaatggatatccagacttaattgtaggagcttttggtgtagatcgagctatcttatacagggccagaccagttatcactgtaaatgctggtcttgaagtgtaccctagcattttaaatcaagacaataaaacctgctcactgcctggaacagctctcaaagtttcctgttttaatgttaggttctgcttaaaggcagatggcaaaggagtacttcccaggaaacttaatttccaggtggaacttcttttggataaactcaagcaaaagggagcaattcgacgagcactgtttctctacagcaggtccccaagtcactccaagaacatgactatttcaagggggggactgatgcagtgtgaggaattgatagcgtatctgcgggatgaatctgaatttagagacaaactcactccaattactatttttatggaatatcggttggattatagaacagctgctgatacaacaggcttgcaacccattcttaaccagttcacgcctgctaacattagtcgacaggctcacattctacttgactgtggtgaagacaatgtctgtaaacccaagctggaagtttctgtagatagtgatcaaaagaagatctatattggggatgacaaccctctgacattgattgttaaggctcagaatcaaggagaaggtgcctacgaagctgagctcatcgtttccattccactgcaggctgatttcatcggggttgtccgaaacaatgaagccttagcaagactttcctgtgcatttaagacagaaaaccaaactcgccaggtggtatgtgaccttggaaacccaatgaaggctggaactcaactcttagctggtcttcgtttcagtgtgcaccagcagtcagagatggatacttctgtgaaatttgacttacaaatccaaagctcaaatctatttgacaaagtaagcccagttgtatctcacaaagttgatcttgctgttttagctgcagttgagataagaggagtctcgagtcctgatcatatctttcttccgattccaaactgggagcacaaggagaaccctgagactgaagaagatgttgggccagttgttcagcacatctatgaggtttgcagttgttagattttactcaaacctcgtgagcaagccaacgaagagaggaacaactaagctactttaaaaaaaaaattctatgtaatttttatgtaaactctacattggttaagtatgtgtcagagatttctttgaatattttccctatacataaattcatttttatttgacaaatagacttgtttaaataaagcagtttatataatttgttgtttaaaataaattagttctacttgaataa

SEQ ID NO: 329229 - DNA, 1566 bp, Homo sapiens
gataaaaagctttcctcatttttaaacaacagtcgcacggaagttcccggcgggacaagggaacgtgggtgcccttgctactcccgtggacgcgggtagattgggacgctggaccgtatctccccgcccccgcccccacgcctcctcaggtgctcagcctgaggccttcgtccaggagcgctgccgctgacccaggctcaggagctgggggcccctgcacagacgcccaggtctcgggacaggcggcgactgcactcacggaagtacgctgagctctcccctgtagaagggcgcctctcctcccccacttcctcctccagctccacagcagcctcccgggccggctcctcctccttccaggtctcctcccagtgccgccgcggctctcaggcctgaggtgcggcgctcaccccggcagtccccagcctcagacgctgcgtggagcggcggagccggagggaagcaaaggaccgtctgcgctgctgtccccgccccgcgcgctctgcgcccctcgtccctggcggtcgctccgaagctcagccctcttgcctgccccggagctgtcccgggctagccgagaagagagcggccggcaagtttgggcgcgcgcaggcggcgggccgcgggcactgggcgcctcgctggggcggggggaggtggctaccgctcccggcttggcgtcccgcgcgcacttcggcgatggcttttccgccgcggcgacggctgcgcctcggtccccgcggcctcccgcttcttctctcgggactcctgctacctctgtgccgcgccttcaacctagacgtggacagtcctgccgagtactctggccccgagggaagttacttcggcttcgccgtggatttcttcgtgcccagcgcgtcttcccggatgtttcttctcgtgggagctcccaaagcaaacaccacccagcctgggattgtggaaggagggcaggtcctcaaatgtgactggtcttctacccgccggtgccagccaattgaatttgatgcaacaggcaatagagattatgccaaggatgatccattggaatttaagtcccatcagtggtttggagcatctgtgaggtcgaaacaggataaaattttggcctgtgccccattgtaccattggagaactgagatgaaacaggagcgagagcctgttggaacatgctttcttcaagatggaacaaagactgttgagtatgctccatgtagatcacaagatattgatgctgatggacagggattttgtcaaggaggattcagcattgattttactaaagctgacagagtacttcttggtggtcctggtagcttttattggcaaggtcagcttatttcggatcaagtggcagaaatcgtatctaaatacgaccccaatgtttacagcatcaagtataataaccaattagcaactcggactgcacaagctatttttgatgacagctatttgggttattctgtggctgtcggagatttcaatggtgatggcatagatgactttgtttcaggagttccaagagcagcaaggactttgggaatggtaggacagttaaaaggtatt

SEQ ID NO: 329230 - DNA, 1232 bp, Homo sapiens
tttttttttaagacagagtctcgctctgttgcccaggctggagtgcagtggcgccatctcagctcactgcaagctccgcctcctgggttcacgccattctcttgcctcagcctcccgagtagctgggactacaggtgcccgccaacacgacctaattttttgtatttttttttagtagagacagggtttcactgtgtcagccaggatggtcttgatctctggcccaagcttttaaaagtgaaaacggtggccaggcacggcagcacacgcttgtaattctagcacttcaggaggccgagatagaaggatcactcgagcccaggaattcgagaccagccctgacgatataaatagggaaagagagagagagagagagagagcgcgtgcacgcgagggagaatgcctgcccctctccagcctggccaacagaaggagatcctgtctcaaagaaagtgaaaatgcttcagctagaattataggataatcctgtgtgagataatttacatagtgactggaagagttattaaatattgctttcttgttgctaagttctgtagttgggttagatatctaatgcgtaactattgtgaaagtcaagagattctaatttttccagaaaataatgttgagtttccatgaagaacaggaagtactgccagaaactttccttgctaatttcccttctctgataaagatggacattcacaaaaaagtaactgacccaagtgtggccaaaagcatgatggcttgcctcctgtcttcactgaaggctaatggctcccggggagctttctgtgaagtgagaccagatgataaaagaattctggaattttacagcaagttaggatgttttgaaattgcaaaaatggaaggatttccaaaggatgtggttatacttggtcggagcctgtgacatttgttgacactgtgaactgtccaaaagtctcttaactgcaccttgtgaatggtagttgaggtcttcatacagttcagcctctagaatggtaacaaatcagccaattggattcgaaacaaagaagactatgtaaaactcacccatcacactttgagactactcactggttggaagaatatagtattgcagcaaatcctgtatgaaagagagatgtgggcttcctttttgagtcttgtgttaggtgctgagaccttttacatgggcttatacagggagagagtcttcaataaatgtagtcagcactattttctgcatc

SEQ ID NO: 329231 - DNA, 579 bp, Homo sapiens
  misc_feature (118)..(118): n is a, c, g, or t
  misc_feature (122)..(122): n is a, c, g, or t
ggccattagatgtacatgacggtagcgcttctctgttactgatggtttttcactagacggagagcgtgagccagtgtggctagagcatgatggcttgcagcgtgtcttcactgaaggntaanggctcccggggagctttctgtgaagtgagaccagatgataaaagaattctggaattttacagcaagttaggatgttttgaaattgcaaaaatggaaggatttccaaaggatgtggttatacttggtcggagcctgtgacatttgttgacactgtgaactgtccaaaagtctcttaactgcaccttgtgaatggtagttgaggtcttcatacagttcagcctctagaatggtaacaaatcagccaattggattcgaaacaaagaagactatgtaaaactcacccatcacactttgagactactcactggttggaagaatatagtattgcagcaaatcctgtatgaaagagagatgtgggcttcctttttgagtcttgtgttaggtgctgagaccttttacatgggcttatacagggagagagtcttcaataaatgtagtcagcactattttctgcatc

SEQ ID NO: 329232 - DNA, 694 bp, Homo sapiens
tttttttttaagacagagtctcgctctgttgcccaggctggagtgcagtggcgccatctcagctcactgcaagctccgcctcctgggttcacgccattctcttgcctcagcctcccgagtagctgggactacaggtgcccgccaacacgacctaattttttgtatttttttttagtagagacagggtttcactgtgtcagccaggatggtcttgatctctggcccaagcttttaaaagtgaaaacggtggccaggcacggcagcacacgcttgtaattctagcacttcaggaggccgagatagaaggatcactcgagcccaggaattcgagaccagccctgacgatataaatagggaaagagagagagagagagagagagcgcgtgcacgcgagggagaatgcctgcccctctccagcctggccaacagaaggagatcctgtctcaaagaaagtgaaaatgcttcagctagaattataggataatcctgtgtgagataatttacatagtgactggaagagttattaaatattgctttcttgttgctaagttctgtagttgggttagatatctaatgcgtaactattgtgaaagtccatctttatcagagaagggaaatgagtatggaaagtttctggcagtacttcctgtttttcatggaaactcaacattatgttatggaaaaattagaatct

SEQ ID NO: 329233 - DNA, 774 bp, Homo sapiens
tgtggtggctcacacctgtaatctcagcactttgggaggccgaggcaggcggatcacctgaggtcaggagttcgagaccagcctgacctcaagtgatccacccaccttggactcccaaaatgctgggattacacacatgagccactgtgcccggcccaggaggagaatctgaagcttaggatctactagaaagaacactggatcaggaggattctagtctcgaccactcctgaagaataatcccagctaatccctaacttttatgcctcagctttctcagctataaaatggcggccaaagctagctccatctaagaacaaggataatgtaaagtataaaagagaatgccataggccggttatgatggctcatgcctgtagtcccagaactttgggaggcagaggcgggcagatcacctgaggtcaggagtttgagatcagcctggccaacatggtgaaaccccatctgtactaaaaatacaaaaattagccgggcgtggtggcgcatgcctgtaatcccagctacttgagaggctgaggcaggagaattgcttgaactcaggaggcagaggttgcagtgagctgagatcacaccattgcactccagcctgggcgatagagggagactccatctcaaaataaatacaataaataaaggaaatactgaccgtgcgcagcggctcaaacctgtagtcccagcacttagggaggcctaggcgggcagaccacaaggtcaggagtttgagaccagcctggccaatatggtgaaacccca

SEQ ID NO: 329234 - DNA, 5088 bp, Homo sapiens
agcaagatccagtaccatggctcatgcctgcaatcccaacactgtaagaggctaaggcaggcggatcacttgaggccaggagttcgagaccagcctgggcaatatggcaaaaccctcatctctactaaacaaaaattagccgggtatgcctgtaatcccacctactcaggaggtggaggttgcagtgagtcaggatcgtgccactgcactccagccttgggcaacagagcaaggctctcaaaataaaaaagcagcggctgcattttatgcctttcaaatgctgcaggaaatagaaatggcttaagttcagtaagagaattgacaattcagtgtttttgagaagtggcaatgaaagggaggaaaatgtttattgattttagcctgtttccccaaaaggataagaaactatttggaagtgaaaaagaagggcctcttattttctgttggttcagatttcaaaggtgtgaaaactattctttttcccttactgtgacattaaatcacttcaggcttgtaccattttgtatggcctgttgttaagttggacatgacaatttgtaaaatgtgaggatcttttcctttcttgtaagttagaagaaataacctcttcagttaaaccttcagtgaaggttcttttagttttctgttctgctttctaaaaacatagactctgttctttagagcaacttatgactctcatctctgctgcacgagaatatgagatagagttcatctatgcgatctcacctggattggatatcactttttctaaccccaaggaagtatccacattgaaacgtaaattggaccaggtttctcagtttgggtgcagatcatttgctttgctttttgatgatatagaccataatatgtgtgcagcagacaaagaggtattcagttcttttgctcatgcccaagtctccatcacaaatgaaatctatcagtacctaggagagccagaaactttcctcttctgtcccacagaatactgtggcactttctgttatccaaatgtgtctcagtctccatatttaaggactgtgggtgaaaagcttctacctggaattgaagtgctttggacaggtcccaaagttgtttctaaagaaattccagtagagtccatcgaagaggtttctaagattattaagagagctccagtaatctgggataacattcatgctaatgattatgatcagaagagactgtttctgggcccgtacaaaggaagatccacagaactcatcccacggttaaaaggagtcctcactaatccaaattgtgaatttgaagccaactacgttgctatccacacccttgccacctggtacaaatcaaacatgaatggagtgagaaaagatgtagtgatgactgacagtgaagatagtactgtgtccatccagataaaattagaaaatgaaggcagtgatgaagatattgaaactgatgtactctatagtccacagatggctctaaagctagcattaacagaatggttgcaagagtttggtgtgcctcatcaatacagcagtaggcaagttgcacacagtggagctaaagcaagtgtagttgatgggactcctttagttgcagcaccctctttaaatgccacaaccgtagtaacaacagtttatcaggagcccattatgagccagggagcagccttgagtggtgagcctactactctgaccaaggaagaagaaaagaaacagcctgatgaagaacccatggacatggtggtggaaaaacaagaagaaacggaccacaagaatgacaatcaaatactgagtgaaattgttgaagcgaaaatggcagaggaattgaaaccaatggacactgataaagagagcatagctgaatcaaaatccccagagatgtccatgcaagaagattgtattagtgacattgcccccatgcaaactgatgaacagacaaacaaggagcagtttgtgccaggtccaaatgaaaagcctttgtacactgcggaaccagtgaccctggaggatttgcagttacttgctgatctattctaccttccttacgagcatggacccaaaggagcacagatgttacgggaatttcaatggcttcgagcaaatagtagtgttgtcagtgtcaattgcaaaggaaaagactctgaaaaaattgaagaatggcggtcacgagcagccaagtttgaagagatgtgtggactagtgatgggaatgttcactcggctctccaattgtgccaacaggacaattctttatgacatgtactcctatgtttgggatatcaagagtataatgtctatggtgaagtcttttgtacagtggttagggtgtcgtagtcattcttcagcacaattcttaattggagaccaagaaccctgggcctttagaggtggtctagcaggagagttccagcgtttgctgccaattgatggggcaaatgatctcttttttcagccacctccactgactcctacctccaaagtttatactatcagaccttattttcctaaggatgaggcatccgtgtacaagatttgcagagaaatgtatgacgatggagtgggtttaccctttcaaagtcagcctgatcttattggagacaagttagtaggagggctgctttccctcagcctggattactgctttgtcctagaagatgaagatggcatatgtggttatgccttgggcactgtagatgtgaccccctttattaaaaaatgtaaaatttcctggatccccttcatgcaggagaagtataccaagccaaatggtgacaaggaactctctgaggctgagaaaataatgttgagtttccatgaagaacaggaagtactgccagaaactttccttgctaatttcccttctctgataaagatggacattcacaaaaaagtaactgacccaagtgtggccaaaagcatgatggcttgcctcctgtcttcactgaaggctaatggctcccggggagctttctgtgaagtgagaccagatgataaaagaattctggaattttacagcaagttaggatgttttgaaattgcaaaaatggaaggatttccaaaggatgtggttatacttggtcggagcctgtgacatttgttgacactgtgaactgtccaaaagtctcttaactgcaccttgtgaatggtagttgaggtcttcatacagttcagcctctagaatggtaacaaatcagccaattggattcgaaacaaagaagactatgtaaaactcacccatcacactttgagactactcactggttggaagaatatagtattgcagcaaatcctgtatgaaagagagatgtgggcttcctttttgagtcttgtgttaggtgctgagaccttttacatgggcttatacagggagagagtcttcaataaatgtagtcagcactattttctgcatccagtgtggttgcgtttctcacctgagagtaatcaagataacatctgtcatcttccttggtttattgagtgaaatgcctctcagtcttaggggacatggcagagatgaaagaaagaaagagtgggtttcagaagtgtcagggtggagtgattccaagtgggatggttgtggcattagtttaagctgaataaataatttcaatttggggcagttattctgctttttgtaaagccgtggccaattgtctcctgtaatgactgttggttcaggcatgttgtactttgtagggacaaatgtgcatttgtttgtggcaaaagcctacaattgacaaacttgtaaatttctttgtatataaactagctgtaacctgactatcctttgtgtttactgtttttgtaaatttttttcctctataaatgaaagggtgttggttcagaatggcactttgaataatgtaaaccagtgaaaagtggattttctttacttttgtctttgggtttggggttgtttttgttctttttgaagttttattatttttaaagtgcctcccacctaggcgtaggccatgaccatttggggtacgagagcctaattttgtaggacttaatctgttgaaaagtgcagttacttctggaaattaacctcaatattaggtcagcatgtgaaatgttggatttgacatgtcaggtagggttcagggactgattggtcccatttgccctcaggtcagttgtttaatctcaagacctgttactactgattttattaaatcagagtctttaattcttgcatgtttgtatctaatttctgaacgaatgagcacactttaaccagttatttacagttacctttttcctttaaccggattgtgaaagcttcatgtattttaatttagattctgtgtttttaagggttctgagcatgaagctggcagatagtcggcaggactcattttttcatcatggctggctgatttctccatagattgataacagtattttgttatcttgcttctctgtagttttgcatcagctgtttaactttgagctgagtgaggggagaggggtaaagagaaagaaacttaagttttctttcacagaactccaccattgtgggctttgagagagccctaaagcattgtacctagtggtacctagtgacttccaaccaaagcctttgagtatgcactaaataggtgagaagaaaggagagaaggtttttaggttagaaacctttaaccgatagaaggatatggtatgttgtaaagctggaaccaagtttgcatttttgagggcttgagatgaagggaagactcttaccagatagtaagacagctgagttttcctcagttttctcgtcttaacactagtggacaattctagcattttgtttggaggatttcagagttaacctcatggaattcaggattttttagcaagtttgcttttggttttatcttggcttttagtaatcatgttggctggtctggtcacaggtgactgtgaaacagatgccctggtcttgctttcatcactctaggatcatgaagtgctatgctatttcctggttatgaatattaaggttggaattacatttttattgattgtttggatcagagctcagttcctgtagaaaacgaactgtaaaagaccatgcaagaggcaaaataaaacttgaagtgaatgct

SEQ ID NO: 329235 - DNA, 5093 bp, Homo sapiens
cagcgcaagcgcagtgcggataaacaggaagcgggcggtggaggcagcagcagagggagagctcggggcttggaggggaaacagcggaagacctaagattatcgggagggcagcagaggcagagaacgaggacaggacccttggccgtcttcttccagggaacgagaggtcacagcctcgctctccgcttatgcttctggcgccccagcttaaagccgaggctgcggctgacaaagggctcgcgccggtgccgccgcccttctcatccgggcattcgggtccctgcgagaaggagggggaaggacagagggggaggggaaggagccggaggggcgcacacttggagctgaagccctctccagggctccgggccggtgccccaacggacagaggtcgaggaggacccgcagaggtggcagcggccgggggcaggaggatggtgcagaaggagagtcaagcgacgttggaggagcgggagagcgagctcagctccaaccctgccgcctctgcgggggcatcgctggagccgccggcagctccggcacccggagaagacaaccccgccggggctgggggagcggcggtggccggggctgcaggaggggctcggcggttcctctgcggtgtggtggaaggattttatggaagaccttgggttatggaacagagaaaagaactctttagaaggctccagaaatgggaattaaatacatacttgtatgccccaaaagatgactacaaacataggatgttttggcgagagatgtattcagtggaggaagctgagcaacttatgactctcatctctgctgcacgagaatatgagatagagttcatctatgcgatctcacctggattggatatcactttttctaaccccaaggaagtatccacattgaaacgtaaattggaccaggtttctcagtttgggtgcagatcatttgctttgctttttgatgatatagaccataatatgtgtgcagcagacaaagaggtattcagttcttttgctcatgcccaagtctccatcacaaatgaaatctatcagtacctaggagagccagaaactttcctcttctgtcccacaggtcccaaagttgtttctaaagaaattccagtagagtccatcgaagaggtttctaagattattaagagagctccagtaatctgggataacattcatgctaatgattatgatcagaagagactgtttctgggcccgtacaaaggaagatccacagaactcatcccacggttaaaaggagtcctcactaatccaaattgtgaatttgaagccaactacgttgctatccacacccttgccacctggtacaaatcaaacatgaatggagtgagaaaagatgtagtgatgactgacagtgaagatagtactgtgtccatccagataaaattagaaaatgaaggcagtgatgaagatattgaaactgatgtactctatagtccacagatggctctaaagctagcattaacagaatggttgcaagagtttggtgtgcctcatcaatacagcagtaggcaagttgcacacagtggagctaaagcaagtgtagttgatgggactcctttagttgcagcaccctctttaaatgccacaaccgtagtaacaacagtttatcaggagcccattatgagccagggagcagccttgagtggtgagcctactactctgaccaaggaagaagaaaagaaacagcctgatgaagaacccatggacatggtggtggaaaaacaagaagaaacggaccacaagaatgacaatcaaatactgagtgaaattgttgaagcgaaaatggcagaggaattgaaaccaatggacactgataaagagagcatagctgaatcaaaatccccagagatgtccatgcaagaagattgtattagtgacattgcccccatgcaaactgatgaacagacaaacaaggagcagtttgtgccaggtccaaatgaaaagcctttgtacactgcggaaccagtgaccctggaggatttgcagttacttgctgatctattctaccttccttacgagcatggacccaaaggagcacagatgttacgggaatttcaatggcttcgagcaaatagtagtgttgtcagtgtcaattgcaaaggaaaagactctgaaaaaattgaagaatggcggtcacgagcagccaagtttgaagagatgtgtggactagtgatgggaatgttcactcggctctccaattgtgccaacaggacaattctttatgacatgtactcctatgtttgggatatcaagagtataatgtctatggtgaagtcttttgtacagtggttagggtgtcgtagtcattcttcagcacaattcttaattggagaccaagaaccctgggcctttagaggtggtctagcaggagagttccagcgtttgctgccaattgatggggcaaatgatctcttttttcagccacctccactgactcctacctccaaagtttatactatcagaccttattttcctaaggatgaggcatccgtgtacaagatttgcagagaaatgtatgacgatggagtgggtttaccctttcaaagtcagcctgatcttattggagacaagttagtaggagggctgctttccctcagcctggattactgctttgtcctagaagatgaagatggcatatgtggttatgccttgggcactgtagatgtgaccccctttattaaaaaatgtaaaatttcctggatccccttcatgcaggagaagtataccaagccaaatggtgacaaggaactctctgaggctgagaaaataatgttgagtttccatgaagaacaggaagtactgccagaaactttccttgctaatttcccttctctgataaagatggacattcacaaaaaagtaactgacccaagtgtggccaaaagcatgatggcttgcctcctgtcttcactgaaggctaatggctcccggggagctttctgtgaagtgagaccagatgataaaagaattctggaattttacagcaagttaggatgttttgaaattgcaaaaatggaaggatttccaaaggatgtggttatacttggtcggagcctgtgacatttgttgacactgtgaactgtccaaaagtctcttaactgcaccttgtgaatggtagttgaggtcttcatacagttcagcctctagaatggtaacaaatcagccaattggattcgaaacaaagaagactatgtaaaactcacccatcacactttgagactactcactggttggaagaatatagtattgcagcaaatcctgtatgaaagagagatgtgggcttcctttttgagtcttgtgttaggtgctgagaccttttacatgggcttatacagggagagagtcttcaataaatgtagtcagcactattttctgcatccagtgtggttgcgtttctcacctgagagtaatcaagataacatctgtcatcttccttggtttattgagtgaaatgcctctcagtcttaggggacatggcagagatgaaagaaagaaagagtgggtttcagaagtgtcagggtggagtgattccaagtgggatggttgtggcattagtttaagctgaataaataatttcaatttggggcagttattctgctttttgtaaagccgtggccaattgtctcctgtaatgactgttggttcaggcatgttgtactttgtagggacaaatgtgcatttgtttgtggcaaaagcctacaattgacaaacttgtaaatttctttgtatataaactagctgtaacctgactatcctttgtgtttactgtttttgtaaatttttttcctctataaatgaaagggtgttggttcagaatggcactttgaataatgtaaaccagtgaaaagtggattttctttacttttgtctttgggtttggggttgtttttgttctttttgaagttttattatttttaaagtgcctcccacctaggcgtaggccatgaccatttggggtacgagagcctaattttgtaggacttaatctgttgaaaagtgcagttacttctggaaattaacctcaatattaggtcagcatgtgaaatgttggatttgacatgtcaggtagggttcagggactgattggtcccatttgccctcaggtcagttgtttaatctcaagacctgttactactgattttattaaatcagagtctttaattcttgcatgtttgtatctaatttctgaacgaatgagcacactttaaccagttatttacagttacctttttcctttaaccggattgtgaaagcttcatgtattttaatttagattctgtgtttttaagggttctgagcatgaagctggcagatagtcggcaggactcattttttcatcatggctggctgatttctccatagattgataacagtattttgttatcttgcttctctgtagttttgcatcagctgtttaactttgagctgagtgaggggagaggggtaaagagaaagaaacttaagttttctttcacagaactccaccattgtgggctttgagagagccctaaagcattgtacctagtggtacctagtgacttccaaccaaagcctttgagtatgcactaaataggtgagaagaaaggagagaaggtttttaggttagaaacctttaaccgatagaaggatatggtatgttgtaaagctggaaccaagtttgcatttttgagggcttgagatgaagggaagactcttaccagatagtaagacagctgagttttcctcagttttctcgtcttaacactagtggacaattctagcattttgtttggaggatttcagagttaacctcatggaattcaggattttttagcaagtttgcttttggttttatcttggcttttagtaatcatgttggctggtctggtcacaggtgactgtgaaacagatgccctggtcttgctttcatcactctaggatcatgaagtgctatgctatttcctggttatgaatattaaggttggaattacatttttattgattgtttggatcagagctcagttcctgtagaaaacgaactgtaaaagaccatgcaagaggcaaaataaaacttgaagtgaatgct

SEQ ID NO: 329236 - DNA, 4245 bp, Homo sapiens
cttttggggcatacaagtatgtatttaattcccatttctggagccttctaaagagttcttttgctcatgcccaagtctccatcacaaatgaaatctatcagtacctaggagagccagaaactttcctcttctgtcccacagaatactgtggcactttctgttatccaaatgtgtctcagtctccatatttaaggactgtgggtgaaaagcttctacctggaattgaagtgctttggacaggtcccaaagttgtttctaaagaaattccagtagagtccatcgaagaggtttctaagattattaagagagctccagtaatctgggataacattcatgctaatgattatgatcagaagagactgtttctgggcccgtacaaaggaagatccacagaactcatcccacggttaaaaggagtcctcactaatccaaattgtgaatttgaagccaactacgttgctatccacacccttgccacctggtacaaatcaaacatgaatggagtgagaaaagatgtagtgatgactgacagtgaagatagtactgtgtccatccagataaaattagaaaatgaaggcagtgatgaagatattgaaactgatgtactctatagtccacagatggctctaaagctagcattaacagaatggttgcaagagtttggtgtgcctcatcaatacagcagtaggcaagttgcacacagtggagctaaagcaagtgtagttgatgggactcctttagttgcagcaccctctttaaatgccacaaccgtagtaacaacagtttatcaggagcccattatgagccagggagcagccttgagtggtgagcctactactctgaccaaggaagaagaaaagaaacagcctgatgaagaacccatggacatggtggtggaaaaacaagaagaaacggaccacaagaatgacaatcaaatactgagtgaaattgttgaagcgaaaatggcagaggaattgaaaccaatggacactgataaagagagcatagctgaatcaaaatccccagagatgtccatgcaagaagattgtattagtgacattgcccccatgcaaactgatgaacagacaaacaaggagcagtttgtgccaggtccaaatgaaaagcctttgtacactgcggaaccagtgaccctggaggatttgcagttacttgctgatctattctaccttccttacgagcatggacccaaaggagcacagatgttacgggaatttcaatggcttcgagcaaatagtagtgttgtcagtgtcaattgcaaaggaaaagactctgaaaaaattgaagaatggcggtcacgagcagccaagtttgaagagatgtgtggactagtgatgggaatgttcactcggctctccaattgtgccaacaggacaattctttatgacatgtactcctatgtttgggatatcaagagtataatgtctatggtgaagtcttttgtacagtggttagggtgtcgtagtcattcttcagcacaattcttaattggagaccaagaaccctgggcctttagaggtggtctagcaggagagttccagcgtttgctgccaattgatggggcaaatgatctcttttttcagccacctccactgactcctacctccaaagtttatactatcagaccttattttcctaaggatgaggcatccgtgtacaagatttgcagagaaatgtatgacgatggagtgggtttaccctttcaaagtcagcctgatcttattggagacaagttagtaggagggctgctttccctcagcctggattactgctttgtcctagaagatgaagatggcatatgtggttatgccttgggcactgtagatgtgaccccctttattaaaaaatgtaaaatttcctggatccccttcatgcaggagaagtataccaagccaaatggtgacaaggaactctctgaggctgagaaaataatgttgagtttccatgaagaacaggaagtactgccagaaactttccttgctaatttcccttctctgataaagatggacattcacaaaaaagtaactgacccaagtgtggccaaaagcatgatggcttgcctcctgtcttcactgaaggctaatggctcccggggagctttctgtgaagtgagaccagatgataaaagaattctggaattttacagcaagttaggatgttttgaaattgcaaaaatggaaggatttccaaaggatgtggttatacttggtcggagcctgtgacatttgttgacactgtgaactgtccaaaagtctcttaactgcaccttgtgaatggtagttgaggtcttcatacagttcagcctctagaatggtaacaaatcagccaattggattcgaaacaaagaagactatgtaaaactcacccatcacactttgagactactcactggttggaagaatatagtattgcagcaaatcctgtatgaaagagagatgtgggcttcctttttgagtcttgtgttaggtgctgagaccttttacatgggcttatacagggagagagtcttcaataaatgtagtcagcactattttctgcatccagtgtggttgcgtttctcacctgagagtaatcaagataacatctgtcatcttccttggtttattgagtgaaatgcctctcagtcttaggggacatggcagagatgaaagaaagaaagagtgggtttcagaagtgtcagggtggagtgattccaagtgggatggttgtggcattagtttaagctgaataaataatttcaatttggggcagttattctgctttttgtaaagccgtggccaattgtctcctgtaatgactgttggttcaggcatgttgtactttgtagggacaaatgtgcatttgtttgtggcaaaagcctacaattgacaaacttgtaaatttctttgtatataaactagctgtaacctgactatcctttgtgtttactgtttttgtaaatttttttcctctataaatgaaagggtgttggttcagaatggcactttgaataatgtaaaccagtgaaaagtggattttctttacttttgtctttgggtttggggttgtttttgttctttttgaagttttattatttttaaagtgcctcccacctaggcgtaggccatgaccatttggggtacgagagcctaattttgtaggacttaatctgttgaaaagtgcagttacttctggaaattaacctcaatattaggtcagcatgtgaaatgttggatttgacatgtcaggtagggttcagggactgattggtcccatttgccctcaggtcagttgtttaatctcaagacctgttactactgattttattaaatcagagtctttaattcttgcatgtttgtatctaatttctgaacgaatgagcacactttaaccagttatttacagttacctttttcctttaaccggattgtgaaagcttcatgtattttaatttagattctgtgtttttaagggttctgagcatgaagctggcagatagtcggcaggactcattttttcatcatggctggctgatttctccatagattgataacagtattttgttatcttgcttctctgtagttttgcatcagctgtttaactttgagctgagtgaggggagaggggtaaagagaaagaaacttaagttttctttcacagaactccaccattgtgggctttgagagagccctaaagcattgtacctagtggtacctagtgacttccaaccaaagcctttgagtatgcactaaataggtgagaagaaaggagagaaggtttttaggttagaaacctttaaccgatagaaggatatggtatgttgtaaagctggaaccaagtttgcatttttgagggcttgagatgaagggaagactcttaccagatagtaagacagctgagttttcctcagttttctcgtcttaacactagtggacaattctagcattttgtttggaggatttcagagttaacctcatggaattcaggattttttagcaagtttgcttttggttttatcttggcttttagtaatcatgttggctggtctggtcacaggtgactgtgaaacagatgccctggtcttgctttcatcactctaggatcatgaagtgctatgctatttcctggttatgaatattaaggttggaattacatttttattgattgtttggatcagagctcagttcctgtagaaaacgaactgtaaaagaccatgcaagaggcaaaataaaacttgaagtgaatgct

SEQ ID NO: 329237 - DNA, 3943 bp, Homo sapiens
caccccttatgttctgccccccccttaggttcctgaccccccatcgattggaagagactgtttctgggcccgtacaaaggaagatccacagaactcatcccacggttaaaaggagtcctcactaatccaaattgtgaatttgaagccaactacgttgctatccacacccttgccacctggtacaaatcaaacatgaatggagtgagaaaagatgtagtgatgactgacagtgaagatagtactgtgtccatccagataaaattagaaaatgaaggcagtgatgaagatattgaaactgatgtactctatagtccacagatggctctaaagctagcattaacagaatggttgcaagagtttggtgtgcctcatcaatacagcagtaggcaagttgcacacagtggagctaaagcaagtgtagttgatgggactcctttagttgcagcaccctctttaaatgccacaaccgtagtaacaacagtttatcaggagcccattatgagccagggagcagccttgagtggtgagcctactactctgaccaaggaagaagaaaagaaacagcctgatgaagaacccatggacatggtggtggaaaaacaagaagaaacggaccacaagaatgacaatcaaatactgagtgaaattgttgaagcgaaaatggcagaggaattgaaaccaatggacactgataaagagagcatagctgaatcaaaatccccagagatgtccatgcaagaagattgtattagtgacattgcccccatgcaaactgatgaacagacaaacaaggagcagtttgtgccaggtccaaatgaaaagcctttgtacactgcggaaccagtgaccctggaggatttgcagttacttgctgatctattctaccttccttacgagcatggacccaaaggagcacagatgttacgggaatttcaatggcttcgagcaaatagtagtgttgtcagtgtcaattgcaaaggaaaagactctgaaaaaattgaagaatggcggtcacgagcagccaagtttgaagagatgtgtggactagtgatgggaatgttcactcggctctccaattgtgccaacaggacaattctttatgacatgtactcctatgtttgggatatcaagagtataatgtctatggtgaagtcttttgtacagtggttagggtgtcgtagtcattcttcagcacaattcttaattggagaccaagaaccctgggcctttagaggtggtctagcaggagagttccagcgtttgctgccaattgatggggcaaatgatctcttttttcagccacctccactgactcctacctccaaagtttatactatcagaccttattttcctaaggatgaggcatccgtgtacaagatttgcagagaaatgtatgacgatggagtgggtttaccctttcaaagtcagcctgatcttattggagacaagttagtaggagggctgctttccctcagcctggattactgctttgtcctagaagatgaagatggcatatgtggttatgccttgggcactgtagatgtgaccccctttattaaaaaatgtaaaatttcctggatccccttcatgcaggagaagtataccaagccaaatggtgacaaggaactctctgaggctgagaaaataatgttgagtttccatgaagaacaggaagtactgccagaaactttccttgctaatttcccttctctgataaagatggacattcacaaaaaagtaactgacccaagtgtggccaaaagcatgatggcttgcctcctgtcttcactgaaggctaatggctcccggggagctttctgtgaagtgagaccagatgataaaagaattctggaattttacagcaagttaggatgttttgaaattgcaaaaatggaaggatttccaaaggatgtggttatacttggtcggagcctgtgacatttgttgacactgtgaactgtccaaaagtctcttaactgcaccttgtgaatggtagttgaggtcttcatacagttcagcctctagaatggtaacaaatcagccaattggattcgaaacaaagaagactatgtaaaactcacccatcacactttgagactactcactggttggaagaatatagtattgcagcaaatcctgtatgaaagagagatgtgggcttcctttttgagtcttgtgttaggtgctgagaccttttacatgggcttatacagggagagagtcttcaataaatgtagtcagcactattttctgcatccagtgtggttgcgtttctcacctgagagtaatcaagataacatctgtcatcttccttggtttattgagtgaaatgcctctcagtcttaggggacatggcagagatgaaagaaagaaagagtgggtttcagaagtgtcagggtggagtgattccaagtgggatggttgtggcattagtttaagctgaataaataatttcaatttggggcagttattctgctttttgtaaagccgtggccaattgtctcctgtaatgactgttggttcaggcatgttgtactttgtagggacaaatgtgcatttgtttgtggcaaaagcctacaattgacaaacttgtaaatttctttgtatataaactagctgtaacctgactatcctttgtgtttactgtttttgtaaatttttttcctctataaatgaaagggtgttggttcagaatggcactttgaataatgtaaaccagtgaaaagtggattttctttacttttgtctttgggtttggggttgtttttgttctttttgaagttttattatttttaaagtgcctcccacctaggcgtaggccatgaccatttggggtacgagagcctaattttgtaggacttaatctgttgaaaagtgcagttacttctggaaattaacctcaatattaggtcagcatgtgaaatgttggatttgacatgtcaggtagggttcagggactgattggtcccatttgccctcaggtcagttgtttaatctcaagacctgttactactgattttattaaatcagagtctttaattcttgcatgtttgtatctaatttctgaacgaatgagcacactttaaccagttatttacagttacctttttcctttaaccggattgtgaaagcttcatgtattttaatttagattctgtgtttttaagggttctgagcatgaagctggcagatagtcggcaggactcattttttcatcatggctggctgatttctccatagattgataacagtattttgttatcttgcttctctgtagttttgcatcagctgtttaactttgagctgagtgaggggagaggggtaaagagaaagaaacttaagttttctttcacagaactccaccattgtgggctttgagagagccctaaagcattgtacctagtggtacctagtgacttccaaccaaagcctttgagtatgcactaaataggtgagaagaaaggagagaaggtttttaggttagaaacctttaaccgatagaaggatatggtatgttgtaaagctggaaccaagtttgcatttttgagggcttgagatgaagggaagactcttaccagatagtaagacagctgagttttcctcagttttctcgtcttaacactagtggacaattctagcattttgtttggaggatttcagagttaacctcatggaattcaggattttttagcaagtttgcttttggttttatcttggcttttagtaatcatgttggctggtctggtcacaggtgactgtgaaacagatgccctggtcttgctttcatcactctaggatcatgaagtgctatgctatttcctggttatgaatattaaggttggaattacatttttattgattgtttggatcagagctcagttcctgtagaaaacgaactgtaaaagaccatgcaagaggcaaaataaaacttgaagtgaatgct

SEQ ID NO: 329238 - DNA, 5903 bp, Homo sapiens
gttcttataattcattcttatagggatttaaacttaagtttctaaggcccttaggaattttgaacctgaaatctggattattgagcttgaaatgtattacagaaaacatttgatattcagtttttaatttaagaattattaaaagttaaattcttaatgatacacagtattgtttctttctcttctcagggtttatctctgcactgagcatttatggtggtagctttccaaaattatatagatacctcttacacaatctcaagctcttacagcaagcttgtccagcctgtggctcaacacaagtttataaactttcttaaaacattgtgagtttttttattttttattttttttaagctcatcaactatcattagtgtattttatgtgtggcccaagacagttcttccagtgtggcccagggaagccaaaagattggacaccccttataacatcttagaagttttaaataattatcttcatatccacatagctttacaaaagctcacgacagggagagtattttcttggttctgtagtaatttcagggggtttactgattggaacccttccttttcctcctctctccagtccagctggcattcagtcctttaaacaatgtggctatgcagtacttttgattactaatgacttctattatcttcttccccattgtgtacagatgggagaatcctcagcacaagtgtctactactattggatggacagcggcagatgttcacagcgcgtcatgattaattagtttaaattgcaaggttctatctgtgaggtagctcaggtagatttaagggcggtagacatgaactgaagtcacgtttgcgcagcgactgaggcattaaccatgttttcatttacacagctcttcgtacatgcagctttttattgtaatagttggaagtgctagttatgttgtagtctcaaagtagggggtaggggaaattggctgatcttaaagtttgagaggtatagtttttttcctgcagtgtaaattacactgagttacggaatgggacaggttctcgtatagtctaaattttgaccctgtttcatatttattttacaaatactacattttatgttttttaaaagtacccctacccttgaaaaatgacaaaccagatacaaactcttaatgggcctgaattgttaacaaaaaattggtttgctttgggactgtctgactagcacactatatttgtactgatgagactgttaacttgaacaggaggtagaatgctgtcttccaatggaaaagaactatattgcgctgctttatcttgtcagaagactaggcaagtgattttgatttggcctccaaacatttgcctttatgtcttactgttagctagcgttattgcctattaagttagttaactggtgaccttaaatagagacttctgtattccatgtgtatgttcagtgtattgcaaagattattataatggctggtcagaggaaccagatactgtcatacttttaagaaaagtatatttagctctgggcaaaataacatcaattggctctccttagttctcagaatctgtcagactggtattattagccaagtctgattttgaattgtttttgtccaaaaaaatttttctcattatgtttcattttgtcaacttaatttcttgtattttattctactgaccttagttttctgacaagattaatccttctcccccgcccttttcccttacctgtacccttcctcaaaatgtaaaatgtgacttcagacaggttgaattccttcatgggctgtgataataaagtgtctaattatcagtcattttagttaatagttactataattttatgacagagcaagcagctagcttgatttgtataatatctagggaatatataaagttgactcagacaaacttgggacttactttccttccagtaattaaagagtagaactgataatactgattattcattaattggaggaaggaacattagtattgaaatgccgttaacattttaaaaaataataattattatcatagccttgccctgaaaccctgattattgttagagagttatttccacgaagtgtttgtcagtttgttggacatttgagaccccaggaaatcccctttctcgtaacgttctccgcttggatctgatctcaacagggtgtcgtagtcattcttcagcacaattcttaattggagaccaagaaccctgggcctttagaggtggtctagcaggagagttccaggtatcaatatgaattcacaactgaattgacattttctttgttttatgagaaaccttatgttgcgcatcagatggctggaaggattggtctgccgaaggctttctagtcccaaattcaatttagttacatagctggatttttaaatcaaattttcctcctctttcacagtaatttctgaaggagatgctgccaatcccccccgcgcctgcgaagcgcagcggctctaggtatacacttcacattgtttctttgcaggtcgcacagcattttaatctgcgcccgcaatgcacaatgcgcgcatgcttgtctgccagtggaagctccatgaacaaaagatagtaattatgccaataaatggtgaaagagcttttggatatttatccaattattttataaatataatgtgcttgaaagaattgtccattgctgaaaatatgaacaaaataggaagtttttttgctgctggaatttgttcatggactttctaggtgctctacttttctccccccaacaggtgctctgctgcgcacagcaaactgaagcgcattgctttggggataaagcgtctcctggacagataaccctcttcagaccaaacctctcctcctgacattctgttctgccatcttatcgtagggagatggtctatctaagataggttttaaaaaaaaatagatttgtcataattggaataggtttgtttttgtttttgtttttgtttttactgtaaatttaaatccccattaatatgccactaaagctgtaactcagagtgggtaatttctattcagaagcactcccctcccccagcaaagaggtatttctattagtaaagcatagtacacccctcttctttaggtctgcctgcagtagccagttaatataagttggtaatctgcagtgcacacccatttaaaaaaatggataccttccccaaactaatccatctccttttttttcttcccacagcgtttgctgccaattgatggggcaaatgatctcttttttcagccacctccactgactcctacctccaaagtttatactatcagaccttattttcctaaggatgaggcatccgtgtacaagatttgcagagaaatgtatgacgatggagtgggtttaccctttcaaagtcagcctgatcttattggagacaagttagtaggagggctgctttccctcagcctggattactgctttgtcctagaagatgaagatggcatatgtggttatgccttgggcactgtagatgtgaccccctttattaaaaaatgtaaaatttcctggatccccttcatgcaggagaagtataccaagccaaatggtgacaaggaactctctgaggctgagaaaataatgttgagtttccatgaagaacaggaagtactgccagaaactttccttgctaatttcccttctctgataaagatggacattcacaaaaaagtaactgacccaagtgtggccaaaagcatgatggcttgcctcctgtcttcactgaaggctaatggctcccggggagctttctgtgaagtgagaccagatgataaaagaattctggaattttacagcaagttaggatgttttgaaattgcaaaaatggaaggatttccaaaggatgtggttatacttggtcggagcctgtgacatttgttgacactgtgaactgtccaaaagtctcttaactgcaccttgtgaatggtagttgaggtcttcatacagttcagcctctagaatggtaacaaatcagccaattggattcgaaacaaagaagactatgtaaaactcacccatcacactttgagactactcactggttggaagaatatagtattgcagcaaatcctgtatgaaagagagatgtgggcttcctttttgagtcttgtgttaggtgctgagaccttttacatgggcttatacagggagagagtcttcaataaatgtagtcagcactattttctgcatccagtgtggttgcgtttctcacctgagagtaatcaagataacatctgtcatcttccttggtttattgagtgaaatgcctctcagtcttaggggacatggcagagatgaaagaaagaaagagtgggtttcagaagtgtcagggtggagtgattccaagtgggatggttgtggcattagtttaagctgaataaataatttcaatttggggcagttattctgctttttgtaaagccgtggccaattgtctcctgtaatgactgttggttcaggcatgttgtactttgtagggacaaatgtgcatttgtttgtggcaaaagcctacaattgacaaacttgtaaatttctttgtatataaactagctgtaacctgactatcctttgtgtttactgtttttgtaaatttttttcctctataaatgaaagggtgttggttcagaatggcactttgaataatgtaaaccagtgaaaagtggattttctttacttttgtctttgggtttggggttgtttttgttctttttgaagttttattatttttaaagtgcctcccacctaggcgtaggccatgaccatttggggtacgagagcctaattttgtaggacttaatctgttgaaaagtgcagttacttctggaaattaacctcaatattaggtcagcatgtgaaatgttggatttgacatgtcaggtagggttcagggactgattggtcccatttgccctcaggtcagttgtttaatctcaagacctgttactactgattttattaaatcagagtctttaattcttgcatgtttgtatctaatttctgaacgaatgagcacactttaaccagttatttacagttacctttttcctttaaccggattgtgaaagcttcatgtattttaatttagattctgtgtttttaagggttctgagcatgaagctggcagatagtcggcaggactcattttttcatcatggctggctgatttctccatagattgataacagtattttgttatcttgcttctctgtagttttgcatcagctgtttaactttgagctgagtgaggggagaggggtaaagagaaagaaacttaagttttctttcacagaactccaccattgtgggctttgagagagccctaaagcattgtacctagtggtacctagtgacttccaaccaaagcctttgagtatgcactaaataggtgagaagaaaggagagaaggtttttaggttagaaacctttaaccgatagaaggatatggtatgttgtaaagctggaaccaagtttgcatttttgagggcttgagatgaagggaagactcttaccagatagtaagacagctgagttttcctcagttttctcgtcttaacactagtggacaattctagcattttgtttggaggatttcagagttaacctcatggaattcaggattttttagcaagtttgcttttggttttatcttggcttttagtaatcatgttggctggtctggtcacaggtgactgtgaaacagatgccctggtcttgctttcatcactctaggatcatgaagtgctatgctatttcctggttatgaatattaaggttggaattacatttttattgattgtttggatcagagctcagttcctgtagaaaacgaactgtaaaagaccatgcaagaggcaaaataaaacttgaagtgaatgct

SEQ ID NO: 329239 - DNA, 4280 bp, Homo sapiens
gttcttataattcattcttatagggatttaaacttaagtttctaaggcccttaggaattttgaacctgaaatctggattattgagcttgaaatgtattacagaaaacatttgatattcagtttttaatttaagaattattaaaagttaaattcttaatgatacacagtattgtttctttctcttctcagggtttatctctgcactgagcatttatggtggtagctttccaaaattatatagatacctcttacacaatctcaagctcttacagcaagcttgtccagcctgtggctcaacacaagtttataaactttcttaaaacattgtgagtttttttattttttattttttttaagctcatcaactatcattagtgtattttatgtgtggcccaagacagttcttccagtgtggcccagggaagccaaaagattggacaccccttataacatcttagaagttttaaataattatcttcatatccacatagctttacaaaagctcacgacagggagagtattttcttggttctgtagtaatttcagggggtttactgattggaacccttccttttcctcctctctccagtccagctggcattcagtcctttaaacaatgtggctatgcagtacttttgattactaatgacttctattatcttcttccccattgtgtacagatgggagaatcctcagcacaagtgtctactactattggatggacagcggcagatgttcacagcgcgtcatgattaattagtttaaattgcaaggttctatctgtgaggtagctcaggtagatttaagggcggtagacatgaactgaagtcacgtttgccgcagcggctctaggtatacacttcacattgtttctttgcaggtcgcacagcattttaatctgcgcccgcaatgcacaatgcgcgcatgcttgtctgccagtggaagctccatgaacaaaagatagtaattatgccaataaatggtgaaagagcttttggatatttatccaattattttataaatataatgtgcttgaaagaattgtccattgctgaaaatatgaacaaaataggaagtttttttgctgctggaatttgttcatggactttctaggtgctctacttttctccccccaacaggtgctctgctgcgcacagcaaactgaagcgcattgctttggggataaagcgtctcctggacagataaccctcttcagaccaaacctctcctcctgacattctgttctgccatcttatcgtagggagatggtctatctaagataggttttaaaaaaaaatagatttgtcataattggaataggtttgtttttgtttttgtttttgtttttactgtaaatttaaatccccattaatatgccactaaagctgtaactcagagtgggtaatttctattcagaagcactcccctcccccagcaaagaggtatttctattagtaaagcatagtacacccctcttctttaggtctgcctgcagtagccagttaatataagttggtaatctgcagtgcacacccatttaaaaaaatggataccttccccaaactaatccatctccttttttttcttcccacagcgtttgctgccaattgatggggcaaatgatctcttttttcagccacctccactgactcctacctccaaagtttatactatcagaccttattttcctaaggatgaggcatccgtgtacaagatttgcagagaaatgtatgacgatggagtgggtttaccctttcaaagtcagcctgatcttattggagacaagttagtaggagggctgctttccctcagcctggattactgctttgtcctagaagatgaagatggcatatgtggttatgccttgggcactgtagatgtgaccccctttattaaaaaatgtaaaatttcctggatccccttcatgcaggagaagtataccaagccaaatggtgacaaggaactctctgaggctgagaaaataatgttgagtttccatgaagaacaggaagtactgccagaaactttccttgctaatttcccttctctgataaagatggacattcacaaaaaagtaactgacccaagtgtggccaaaagcatgatggcttgcctcctgtcttcactgaaggctaatggctcccggggagctttctgtgaagtgagaccagatgataaaagaattctggaattttacagcaagttaggatgttttgaaattgcaaaaatggaaggatttccaaaggatgtggttatacttggtcggagcctgtgacatttgttgacactgtgaactgtccaaaagtctcttaactgcaccttgtgaatggtagttgaggtcttcatacagttcagcctctagaatggtaacaaatcagccaattggattcgaaacaaagaagactatgtaaaactcacccatcacactttgagactactcactggttggaagaatatagtattgcagcaaatcctgtatgaaagagagatgtgggcttcctttttgagtcttgtgttaggtgctgagaccttttacatgggcttatacagggagagagtcttcaataaatgtagtcagcactattttctgcatccagtgtggttgcgtttctcacctgagagtaatcaagataacatctgtcatcttccttggtttattgagtgaaatgcctctcagtcttaggggacatggcagagatgaaagaaagaaagagtgggtttcagaagtgtcagggtggagtgattccaagtgggatggttgtggcattagtttaagctgaataaataatttcaatttggggcagttattctgctttttgtaaagccgtggccaattgtctcctgtaatgactgttggttcaggcatgttgtactttgtagggacaaatgtgcatttgtttgtggcaaaagcctacaattgacaaacttgtaaatttctttgtatataaactagctgtaacctgactatcctttgtgtttactgtttttgtaaatttttttcctctataaatgaaagggtgttggttcagaatggcactttgaataatgtaaaccagtgaaaagtggattttctttacttttgtctttgggtttggggttgtttttgttctttttgaagttttattatttttaaagtgcctcccacctaggcgtaggccatgaccatttggggtacgagagcctaattttgtaggacttaatctgttgaaaagtgcagttacttctggaaattaacctcaatattaggtcagcatgtgaaatgttggatttgacatgtcaggtagggttcagggactgattggtcccatttgccctcaggtcagttgtttaatctcaagacctgttactactgattttattaaatcagagtctttaattcttgcatgtttgtatctaatttctgaacgaatgagcacactttaaccagttatttacagttacctttttcctttaaccggattgtgaaagcttcatgtattttaatttagattctgtgtttttaagggttctgagcatgaagctggcagatagtcggcaggactcattttttcatcatggctggctgatttctccatagattgataacagtattttgttatcttgcttctctgtagttttgcatcagctgtttaactttgagctgagtgaggggagaggggtaaagagaaagaaacttaagttttctttcacagaactccaccattgtgggctttgagagagccctaaagcattgtacctagtggtacctagtgacttccaaccaaagcctttgagtatgcactaaataggtgagaagaaaggagagaaggtttttaggttagaaacctttaaccgatagaaggatatggtatgttgtaaagctggaaccaagtttgcatttttgagggcttgagatgaagggaagactcttaccagatagtaagacagctgagttttcctcagttttctcgtcttaacactagtggacaattctagcattttgtttggaggatttcagagttaacctcatggaattcaggattttttagcaagtttgcttttggttttatcttggcttttagtaatcatgttggctggtctggtcacaggtgactgtgaaacagatgccctggtcttgctttcatcactctaggatcatgaagtgctatgctatttcctggttatgaatattaaggttggaattacatttttattgattgtttggatcagagctcagttcctgtagaaaacgaactgtaaaagaccatgcaagaggcaaaataaaacttgaagtgaatgct

SEQ ID NO: 329240 - DNA, 2918 bp, Homo sapiens
tttttttttaagacagagtctcgctctgttgcccaggctggagtgcagtggcgccatctcagctcactgcaagctccgcctcctgggttcacgccattctcttgcctcagcctcccgagtagctgggactacaggtgcccgccaacacgacctaattttttgtatttttttttagtagagacagggtttcactgtgtcagccaggatggtcttgatctctggcccaagcttttaaaagtgaaaacggtggccaggcacggcagcacacgcttgtaattctagcacttcaggaggccgagatagaaggatcactcgagcccaggaattcgagaccagccctgacgatataaatagggaaagagagagagagagagagagagcgcgtgcacgcgagggagaatgcctgcccctctccagcctggccaacagaaggagatcctgtctcaaagaaagtgaaaatgcttcagctagaattataggataatcctgtgtgagataatttacatagtgactggaagagttattaaatattgctttcttgttgctaagttctgtagttgggttagatatctaatgcgtaactattgtgaaagtcaagagattctaatttttccagaaaataatgttgagtttccatgaagaacaggaagtactgccagaaactttccttgctaatttcccttctctgataaagatggacattcacaaaaaagtaactgacccaagtgtggccaaaagcatgatggcttgcctcctgtcttcactgaaggctaatggctcccggggagctttctgtgaagtgagaccagatgataaaagaattctggaattttacagcaagttaggatgttttgaaattgcaaaaatggaaggatttccaaaggatgtggttatacttggtcggagcctgtgacatttgttgacactgtgaactgtccaaaagtctcttaactgcaccttgtgaatggtagttgaggtcttcatacagttcagcctctagaatggtaacaaatcagccaattggattcgaaacaaagaagactatgtaaaactcacccatcacactttgagactactcactggttggaagaatatagtattgcagcaaatcctgtatgaaagagagatgtgggcttcctttttgagtcttgtgttaggtgctgagaccttttacatgggcttatacagggagagagtcttcaataaatgtagtcagcactattttctgcatccagtgtggttgcgtttctcacctgagagtaatcaagataacatctgtcatcttccttggtttattgagtgaaatgcctctcagtcttaggggacatggcagagatgaaagaaagaaagagtgggtttcagaagtgtcagggtggagtgattccaagtgggatggttgtggcattagtttaagctgaataaataatttcaatttggggcagttattctgctttttgtaaagccgtggccaattgtctcctgtaatgactgttggttcaggcatgttgtactttgtagggacaaatgtgcatttgtttgtggcaaaagcctacaattgacaaacttgtaaatttctttgtatataaactagctgtaacctgactatcctttgtgtttactgtttttgtaaatttttttcctctataaatgaaagggtgttggttcagaatggcactttgaataatgtaaaccagtgaaaagtggattttctttacttttgtctttgggtttggggttgtttttgttctttttgaagttttattatttttaaagtgcctcccacctaggcgtaggccatgaccatttggggtacgagagcctaattttgtaggacttaatctgttgaaaagtgcagttacttctggaaattaacctcaatattaggtcagcatgtgaaatgttggatttgacatgtcaggtagggttcagggactgattggtcccatttgccctcaggtcagttgtttaatctcaagacctgttactactgattttattaaatcagagtctttaattcttgcatgtttgtatctaatttctgaacgaatgagcacactttaaccagttatttacagttacctttttcctttaaccggattgtgaaagcttcatgtattttaatttagattctgtgtttttaagggttctgagcatgaagctggcagatagtcggcaggactcattttttcatcatggctggctgatttctccatagattgataacagtattttgttatcttgcttctctgtagttttgcatcagctgtttaactttgagctgagtgaggggagaggggtaaagagaaagaaacttaagttttctttcacagaactccaccattgtgggctttgagagagccctaaagcattgtacctagtggtacctagtgacttccaaccaaagcctttgagtatgcactaaataggtgagaagaaaggagagaaggtttttaggttagaaacctttaaccgatagaaggatatggtatgttgtaaagctggaaccaagtttgcatttttgagggcttgagatgaagggaagactcttaccagatagtaagacagctgagttttcctcagttttctcgtcttaacactagtggacaattctagcattttgtttggaggatttcagagttaacctcatggaattcaggattttttagcaagtttgcttttggttttatcttggcttttagtaatcatgttggctggtctggtcacaggtgactgtgaaacagatgccctggtcttgctttcatcactctaggatcatgaagtgctatgctatttcctggttatgaatattaaggttggaattacatttttattgattgtttggatcagagctcagttcctgtagaaaacgaactgtaaaagaccatgcaagaggcaaaataaaacttgaagtgaatgct

SEQ ID NO: 329241 - DNA, 2489 bp, Homo sapiens
  misc_feature (10)..(10): n is a, c, g, or t
ttaccaaaanaccatatccttctatggggttaaagggtttctaacctaaaaaccttctctcctttcttctcacctatttagtgcatactcaaaggctttggttggaagtcactaggtaccactaggtacaatgctttagggctctctcaaagcccacaatggtgacaaggaactctctgaggctgagaaaataatgttgagtttccatgaagaacaggaagtactgccagaaactttccttgctaatttcccttctctgataaagatggacattcacaaaaaagtaactgacccaagtgtggccaaaagcatgatggcttgcctcctgtcttcactgaaggctaatggctcccggggagctttctgtgaagtgagaccagatgataaaagaattctggaattttacagcaagttaggatgttttgaaattgcaaaaatggaaggatttccaaaggatgtggttatacttggtcggagcctgtgacatttgttgacactgtgaactgtccaaaagtctcttaactgcaccttgtgaatggtagttgaggtcttcatacagttcagcctctagaatggtaacaaatcagccaattggattcgaaacaaagaagactatgtaaaactcacccatcacactttgagactactcactggttggaagaatatagtattgcagcaaatcctgtatgaaagagagatgtgggcttcctttttgagtcttgtgttaggtgctgagaccttttacatgggcttatacagggagagagtcttcaataaatgtagtcagcactattttctgcatccagtgtggttgcgtttctcacctgagagtaatcaagataacatctgtcatcttccttggtttattgagtgaaatgcctctcagtcttaggggacatggcagagatgaaagaaagaaagagtgggtttcagaagtgtcagggtggagtgattccaagtgggatggttgtggcattagtttaagctgaataaataatttcaatttggggcagttattctgctttttgtaaagccgtggccaattgtctcctgtaatgactgttggttcaggcatgttgtactttgtagggacaaatgtgcatttgtttgtggcaaaagcctacaattgacaaacttgtaaatttctttgtatataaactagctgtaacctgactatcctttgtgtttactgtttttgtaaatttttttcctctataaatgaaagggtgttggttcagaatggcactttgaataatgtaaaccagtgaaaagtggattttctttacttttgtctttgggtttggggttgtttttgttctttttgaagttttattatttttaaagtgcctcccacctaggcgtaggccatgaccatttggggtacgagagcctaattttgtaggacttaatctgttgaaaagtgcagttacttctggaaattaacctcaatattaggtcagcatgtgaaatgttggatttgacatgtcaggtagggttcagggactgattggtcccatttgccctcaggtcagttgtttaatctcaagacctgttactactgattttattaaatcagagtctttaattcttgcatgtttgtatctaatttctgaacgaatgagcacactttaaccagttatttacagttacctttttcctttaaccggattgtgaaagcttcatgtattttaatttagattctgtgtttttaagggttctgagcatgaagctggcagatagtcggcaggactcattttttcatcatggctggctgatttctccatagattgataacagtattttgttatcttgcttctctgtagttttgcatcagctgtttaactttgagctgagtgaggggagaggggtaaagagaaagaaacttaagttttctttcacagaactccaccattgtgggctttgagagagccctaaagcattgtacctagtggtacctagtgacttccaaccaaagcctttgagtatgcactaaataggtgagaagaaaggagagaaggtttttaggttagaaacctttaaccgatagaaggatatggtatgttgtaaagctggaaccaagtttgcatttttgagggcttgagatgaagggaagactcttaccagatagtaagacagctgagttttcctcagttttctcgtcttaacactagtggacaattctagcattttgtttggaggatttcagagttaacctcatggaattcaggattttttagcaagtttgcttttggttttatcttggcttttagtaatcatgttggctggtctggtcacaggtgactgtgaaacagatgccctggtcttgctttcatcactctaggatcatgaagtgctatgctatttcctggttatgaatattaaggttggaattacatttttattgattgtttggatcagagctcagttcctgtagaaaacgaactgtaaaagaccatgcaagaggcaaaataaaacttgaagtgaatgct

SEQ ID NO: 329242 - DNA, 2265 bp, Homo sapiens
  misc_feature (118)..(118): n is a, c, g, or t
  misc_feature (122)..(122): n is a, c, g, or t
ggccattagatgtacatgacggtagcgcttctctgttactgatggtttttcactagacggagagcgtgagccagtgtggctagagcatgatggcttgcagcgtgtcttcactgaaggntaanggctcccggggagctttctgtgaagtgagaccagatgataaaagaattctggaattttacagcaagttaggatgttttgaaattgcaaaaatggaaggatttccaaaggatgtggttatacttggtcggagcctgtgacatttgttgacactgtgaactgtccaaaagtctcttaactgcaccttgtgaatggtagttgaggtcttcatacagttcagcctctagaatggtaacaaatcagccaattggattcgaaacaaagaagactatgtaaaactcacccatcacactttgagactactcactggttggaagaatatagtattgcagcaaatcctgtatgaaagagagatgtgggcttcctttttgagtcttgtgttaggtgctgagaccttttacatgggcttatacagggagagagtcttcaataaatgtagtcagcactattttctgcatccagtgtggttgcgtttctcacctgagagtaatcaagataacatctgtcatcttccttggtttattgagtgaaatgcctctcagtcttaggggacatggcagagatgaaagaaagaaagagtgggtttcagaagtgtcagggtggagtgattccaagtgggatggttgtggcattagtttaagctgaataaataatttcaatttggggcagttattctgctttttgtaaagccgtggccaattgtctcctgtaatgactgttggttcaggcatgttgtactttgtagggacaaatgtgcatttgtttgtggcaaaagcctacaattgacaaacttgtaaatttctttgtatataaactagctgtaacctgactatcctttgtgtttactgtttttgtaaatttttttcctctataaatgaaagggtgttggttcagaatggcactttgaataatgtaaaccagtgaaaagtggattttctttacttttgtctttgggtttggggttgtttttgttctttttgaagttttattatttttaaagtgcctcccacctaggcgtaggccatgaccatttggggtacgagagcctaattttgtaggacttaatctgttgaaaagtgcagttacttctggaaattaacctcaatattaggtcagcatgtgaaatgttggatttgacatgtcaggtagggttcagggactgattggtcccatttgccctcaggtcagttgtttaatctcaagacctgttactactgattttattaaatcagagtctttaattcttgcatgtttgtatctaatttctgaacgaatgagcacactttaaccagttatttacagttacctttttcctttaaccggattgtgaaagcttcatgtattttaatttagattctgtgtttttaagggttctgagcatgaagctggcagatagtcggcaggactcattttttcatcatggctggctgatttctccatagattgataacagtattttgttatcttgcttctctgtagttttgcatcagctgtttaactttgagctgagtgaggggagaggggtaaagagaaagaaacttaagttttctttcacagaactccaccattgtgggctttgagagagccctaaagcattgtacctagtggtacctagtgacttccaaccaaagcctttgagtatgcactaaataggtgagaagaaaggagagaaggtttttaggttagaaacctttaaccgatagaaggatatggtatgttgtaaagctggaaccaagtttgcatttttgagggcttgagatgaagggaagactcttaccagatagtaagacagctgagttttcctcagttttctcgtcttaacactagtggacaattctagcattttgtttggaggatttcagagttaacctcatggaattcaggattttttagcaagtttgcttttggttttatcttggcttttagtaatcatgttggctggtctggtcacaggtgactgtgaaacagatgccctggtcttgctttcatcactctaggatcatgaagtgctatgctatttcctggttatgaatattaaggttggaattacatttttattgattgtttggatcagagctcagttcctgtagaaaacgaactgtaaaagaccatgcaagaggcaaaataaaacttgaagtgaatgct

SEQ ID NO: 329243 - DNA, 2078 bp, Homo sapiens
ccctgctgtgactatttgttgcacgtattatattgtgcaacaatgaaagaggagggttggtcggagcctgtgacatttgttgacactgtgaactgtccaaaagtctcttaactgcaccttgtgaatggtagttgaggtcttcatacagttcagcctctagaatggtaacaaatcagccaattggattcgaaacaaagaagactatgtaaaactcacccatcacactttgagactactcactggttggaagaatatagtattgcagcaaatcctgtatgaaagagagatgtgggcttcctttttgagtcttgtgttaggtgctgagaccttttacatgggcttatacagggagagagtcttcaataaatgtagtcagcactattttctgcatccagtgtggttgcgtttctcacctgagagtaatcaagataacatctgtcatcttccttggtttattgagtgaaatgcctctcagtcttaggggacatggcagagatgaaagaaagaaagagtgggtttcagaagtgtcagggtggagtgattccaagtgggatggttgtggcattagtttaagctgaataaataatttcaatttggggcagttattctgctttttgtaaagccgtggccaattgtctcctgtaatgactgttggttcaggcatgttgtactttgtagggacaaatgtgcatttgtttgtggcaaaagcctacaattgacaaacttgtaaatttctttgtatataaactagctgtaacctgactatcctttgtgtttactgtttttgtaaatttttttcctctataaatgaaagggtgttggttcagaatggcactttgaataatgtaaaccagtgaaaagtggattttctttacttttgtctttgggtttggggttgtttttgttctttttgaagttttattatttttaaagtgcctcccacctaggcgtaggccatgaccatttggggtacgagagcctaattttgtaggacttaatctgttgaaaagtgcagttacttctggaaattaacctcaatattaggtcagcatgtgaaatgttggatttgacatgtcaggtagggttcagggactgattggtcccatttgccctcaggtcagttgtttaatctcaagacctgttactactgattttattaaatcagagtctttaattcttgcatgtttgtatctaatttctgaacgaatgagcacactttaaccagttatttacagttacctttttcctttaaccggattgtgaaagcttcatgtattttaatttagattctgtgtttttaagggttctgagcatgaagctggcagatagtcggcaggactcattttttcatcatggctggctgatttctccatagattgataacagtattttgttatcttgcttctctgtagttttgcatcagctgtttaactttgagctgagtgaggggagaggggtaaagagaaagaaacttaagttttctttcacagaactccaccattgtgggctttgagagagccctaaagcattgtacctagtggtacctagtgacttccaaccaaagcctttgagtatgcactaaataggtgagaagaaaggagagaaggtttttaggttagaaacctttaaccgatagaaggatatggtatgttgtaaagctggaaccaagtttgcatttttgagggcttgagatgaagggaagactcttaccagatagtaagacagctgagttttcctcagttttctcgtcttaacactagtggacaattctagcattttgtttggaggatttcagagttaacctcatggaattcaggattttttagcaagtttgcttttggttttatcttggcttttagtaatcatgttggctggtctggtcacaggtgactgtgaaacagatgccctggtcttgctttcatcactctaggatcatgaagtgctatgctatttcctggttatgaatattaaggttggaattacatttttattgattgtttggatcagagctcagttcctgtagaaaacgaactgtaaaagaccatgcaagaggcaaaataaaacttgaagtgaatgct

SEQ ID NO: 329244 - DNA, 4928 bp, Homo sapiens
cagcgcaagcgcagtgcggataaacaggaagcgggcggtggaggcagcagcagagggagagctcggggcttggaggggaaacagcggaagacctaagattatcgggagggcagcagaggcagagaacgaggacaggacccttggccgtcttcttccagggaacgagaggtcacagcctcgctctccgcttatgcttctggcgccccagcttaaagccgaggctgcggctgacaaagggctcgcgccggtgccgccgcccttctcatccgggcattcgggtccctgcgagaaggagggggaaggacagagggggaggggaaggagccggaggggcgcacacttggagctgaagccctctccagggctccgggccggtgccccaacggacagaggtcgaggaggacccgcagaggtggcagcggccgggggcaggaggatggtgcagaaggagagtcaagcgacgttggaggagcgggagagcgagctcagctccaaccctgccgcctctgcgggggcatcgctggagccgccggcagctccggcacccggagaagacaaccccgccggggctgggggagcggcggtggccggggctgcaggaggggctcggcggttcctctgcggtgtggtggaaggattttatggaagaccttgggttatggaacagagaaaagaactctttagaaggctccagaaatgggaattaaatacatacttgtatgccccaaaagatgactacaaacataggatgttttggcgagagatgtattcagtggaggaagctgagcaacttatgactctcatctctgctgcacgagaatatgagatagagttcatctatgcgatctcacctggattggatatcactttttctaaccccaaggaagtatccacattgaaacgtaaattggaccaggtttctcagtttgggtgcagatcatttgctttgctttttgatgatatagaccataatatgtgtgcagcagacaaagaggtattcagttcttttgctcatgcccaagtctccatcacaaatgaaatctatcagtacctaggagagccagaaactttcctcttctgtcccacagaatactgtggcactttctgttatccaaatgtgtctcagtctccatatttaaggactgtgggtgaaaagcttctacctggaattgaagtgctttggacaggtcccaaagttgtttctaaagaaattccagtagagtccatcgaagaggtttctaagattattaagagagctccagtaatctgggataacattcatgctaatgattatgatcagaagagactgtttctgggcccgtacaaaggaagatccacagaactcatcccacggttaaaaggagtcctcactaatccaaattgtgaatttgaagccaactacgttgctatccacacccttgccacctggtacaaatcaaacatgaatggagtgagaaaagatgtagtgatgactgacagtgaagatagtactgtgtccatccagataaaattagaaaatgaaggcagtgatgaagatattgaaactgatgtactctatagtccacagatggctctaaagctagcattaacagaatggttgcaagagtttggtgtgcctcatcaatacagcagtaggcaagttgcacacagtggagctaaagcaagtgtagttgatgggactcctttagttgcagcaccctctttaaatgccacaaccgtagtaacaacagtttatcaggagcccattatgagccagggagcagccttgagtggtgagcctactactctgaccaaggaagaagaaaagaaacagcctgatgaagaacccatggacatggtggtggaaaaacaagaagaaacggaccacaagaatgacaatcaaatactgagtgaaattgttgaagcgaaaatggcagaggaattgaaaccaatggacactgataaagagagcatagctgaatcaaaatccccagagatgtccatgcaagaagattgtattagtgacattgcccccatgcaaactgatgaacagacaaacaaggagcagtttgtgccaggtccaaatgaaaagcctttgtacactgcggaaccagtgaccctggaggatttgcagttacttgctgatctattctaccttccttacgagcatggacccaaaggagcacagatgttacgggaatttcaatggcttcgagcaaatagtagtgttgtcagtgtcaattgcaaaggaaaagactctgaaaaaattgaagaatggcggtcacgagcagccaagtttgaagagatgtgtggactagtgatgggaatgttcactcggctctccaattgtgccaacaggacaattctttatgacatgtactcctatgtttgggatatcaagagtataatgtctatggtgaagtcttttgtacagtggttagggtgtcgtagtcattcttcagcacaattcttaattggagaccaagaaccctgggcctttagaggtggtctagcaggagagttccagcgtttgctgccaattgatggggcaaatgatctcttttttcagccacctccactgactcctacctccaaagtttatactatcagaccttattttcctaaggatgaggcatccgtgtacaagatttgcagagaaatgtatgacgatggagtgggtttaccctttcaaagtcagcctgatcttattggagacaagttagtaggagggctgctttccctcagcctggattactgctttgtcctagaagatgaagatggcatatgtggttatgccttgggcactgtagatgtgaccccctttattaaaaaatgtaaaatttcctggatccccttcatgcaggagaagtataccaagccaaatggtgacaaggaactctctgaggctgagaaaataatgttgagtttccatgaagaacaggaagtactgccagaaactttccttgctaatttcccttctctgataaagatggacattcacaaaaaagtaactgacccaagtgtggccaaaagcatgatggcttgcctcctgtcttcactgaaggctaatggctcccggggagctttctgtgaagtgagaccagatgataaaagaattctggaattttacagcaagttaggatgttttgaaattgcaaaaatggaaggatttccaaaggatgtggttatacttggtcggagcctgtgacatttgttgacactgtgaactgtccaaaagtctcttaactgcaccttgtgaatggtagttgaggtcttcatacagttcagcctctagaatggtaacaaatcagccaattggattcgaaacaaagaagactatgtaaaactcacccatcacactttgagactactcactggttggaagaatatagtattgcagcaaatcctgtatgaaagagagatgtgggcttcctttttgagtcttgtgttaggtgctgagaccttttacatgggcttatacagggagagagtcttcaataaatgtagtcagcactattttctgcatccagtgtggttgcgtttctcacctgagagtaatcaagataacatctgtcatcttccttggtttattgagtgaaatgcctctcagtcttaggggacatggcagagatgaaagaaagaaagagtgggtttcagaagtgtcagggtggagtgattccaagtgggatggttgtggcattagtttaagctgaataaataatttcaatttggggcagttattctgctttttgtaaagccgtggccaattgtctcctgtaatgactgttggttcaggcatgttgtactttgtagggacaaatgtgcatttgtttgtggcaaaagcctacaattgacaaacttgtaaatttctttgtatataaactagctgtaacctgactatcctttgtgtttactgtttttgtaaatttttttcctctataaatgaaagggtgttggttcagaatggcactttgaataatgtaaaccagtgaaaagtggattttctttacttttgtctttgggtttggggttgtttttgttctttttgaagttttattatttttaaagtgcctcccacctaggcgtaggccatgaccatttggggtacgagagcctaattttgtaggacttaatctgttgaaaagtgcagttacttctggaaattaacctcaatattaggtcagcatgtgaaatgttggatttgacatgtcaggtagggttcagggactgattggtcccatttgccctcaggtcagttgtttaatctcaagacctgttactactgattttattaaatcagagtctttaattcttgcatgtttgtatctaatttctgaacgaatgagcacactttaaccagttatttacagttacctttttcctttaaccggattgtgaaagcttcatgtattttaatttagattctgtgtttttaagggttctgagcatgaagctggcagatagtcggcaggactcattttttcatcatggctggctgatttctccatagattgataacagtattttgttatcttgcttctctgtagttttgcatcagctgtttaactttgagctgagtgaggggagaggggtaaagagaaagaaacttaagttttctttcacagaactccaccattgtgggctttgagagagccctaaagcattgtacctagtggtacctagtgacttccaaccaaagcctttgagtatgcactaaataggtgagaagaaaggagagaaggtttttaggttagaaacctttaaccgatagaaggatatggtatgttgtaaagctggaaccaagtttgcatttttgagggcttgagatgaagggaagactcttaccagatagtaagacagctgagttttcctcagttttctcgtcttaacactagtgacttatctagctgataatctgggtcctctagatacgccgcggcatcgctcct

SEQ ID NO: 329245 - DNA, 4694 bp, Homo sapiens
cagcgcaagcgcagtgcggataaacaggaagcgggcggtggaggcagcagcagagggagagctcggggcttggaggggaaacagcggaagacctaagattatcgggagggcagcagaggcagagaacgaggacaggacccttggccgtcttcttccagggaacgagaggtcacagcctcgctctccgcttatgcttctggcgccccagcttaaagccgaggctgcggctgacaaagggctcgcgccggtgccgccgcccttctcatccgggcattcgggtccctgcgagaaggagggggaaggacagagggggaggggaaggagccggaggggcgcacacttggagctgaagccctctccagggctccgggccggtgccccaacggacagaggtcgaggaggacccgcagaggtggcagcggccgggggcaggaggatggtgcagaaggagagtcaagcgacgttggaggagcgggagagcgagctcagctccaaccctgccgcctctgcgggggcatcgctggagccgccggcagctccggcacccggagaagacaaccccgccggggctgggggagcggcggtggccggggctgcaggaggggctcggcggttcctctgcggtgtggtggaaggattttatggaagaccttgggttatggaacagagaaaagaactctttagaaggctccagaaatgggaattaaatacatacttgtatgccccaaaagatgactacaaacataggatgttttggcgagagatgtattcagtggaggaagctgagcaacttatgactctcatctctgctgcacgagaatatgagatagagttcatctatgcgatctcacctggattggatatcactttttctaaccccaaggaagtatccacattgaaacgtaaattggaccaggtttctcagtttgggtgcagatcatttgctttgctttttgatgatatagaccataatatgtgtgcagcagacaaagaggtattcagttcttttgctcatgcccaagtctccatcacaaatgaaatctatcagtacctaggagagccagaaactttcctcttctgtcccacagaatactgtggcactttctgttatccaaatgtgtctcagtctccatatttaaggactgtgggtgaaaagcttctacctggaattgaagtgctttggacaggtcccaaagttgtttctaaagaaattccagtagagtccatcgaagaggtttctaagattattaagagagctccagtaatctgggataacattcatgctaatgattatgatcagaagagactgtttctgggcccgtacaaaggaagatccacagaactcatcccacggttaaaaggagtcctcactaatccaaattgtgaatttgaagccaactacgttgctatccacacccttgccacctggtacaaatcaaacatgaatggagtgagaaaagatgtagtgatgactgacagtgaagatagtactgtgtccatccagataaaattagaaaatgaaggcagtgatgaagatattgaaactgatgtactctatagtccacagatggctctaaagctagcattaacagaatggttgcaagagtttggtgtgcctcatcaatacagcagtaggcaagttgcacacagtggagctaaagcaagtgtagttgatgggactcctttagttgcagcaccctctttaaatgccacaaccgtagtaacaacagtttatcaggagcccattatgagccagggagcagccttgagtggtgagcctactactctgaccaaggaagaagaaaagaaacagcctgatgaagaacccatggacatggtggtggaaaaacaagaagaaacggaccacaagaatgacaatcaaatactgagtgaaattgttgaagcgaaaatggcagaggaattgaaaccaatggacactgataaagagagcatagctgaatcaaaatccccagagatgtccatgcaagaagattgtattagtgacattgcccccatgcaaactgatgaacagacaaacaaggagcagtttgtgccaggtccaaatgaaaagcctttgtacactgcggaaccagtgaccctggaggatttgcagttacttgctgatctattctaccttccttacgagcatggacccaaaggagcacagatgttacgggaatttcaatggcttcgagcaaatagtagtgttgtcagtgtcaattgcaaaggaaaagactctgaaaaaattgaagaatggcggtcacgagcagccaagtttgaagagatgtgtggactagtgatgggaatgttcactcggctctccaattgtgccaacaggacaattctttatgacatgtactcctatgtttgggatatcaagagtataatgtctatggtgaagtcttttgtacagtggttagggtgtcgtagtcattcttcagcacaattcttaattggagaccaagaaccctgggcctttagaggtggtctagcaggagagttccagcgtttgctgccaattgatggggcaaatgatctcttttttcagccacctccactgactcctacctccaaagtttatactatcagaccttattttcctaaggatgaggcatccgtgtacaagatttgcagagaaatgtatgacgatggagtgggtttaccctttcaaagtcagcctgatcttattggagacaagttagtaggagggctgctttccctcagcctggattactgctttgtcctagaagatgaagatggcatatgtggttatgccttgggcactgtagatgtgaccccctttattaaaaaatgtaaaatttcctggatccccttcatgcaggagaagtataccaagccaaatggtgacaaggaactctctgaggctgagaaaataatgttgagtttccatgaagaacaggaagtactgccagaaactttccttgctaatttcccttctctgataaagatggacattcacaaaaaagtaactgacccaagtgtggccaaaagcatgatggcttgcctcctgtcttcactgaaggctaatggctcccggggagctttctgtgaagtgagaccagatgataaaagaattctggaattttacagcaagttaggatgttttgaaattgcaaaaatggaaggatttccaaaggatgtggttatacttggtcggagcctgtgacatttgttgacactgtgaactgtccaaaagtctcttaactgcaccttgtgaatggtagttgaggtcttcatacagttcagcctctagaatggtaacaaatcagccaattggattcgaaacaaagaagactatgtaaaactcacccatcacactttgagactactcactggttggaagaatatagtattgcagcaaatcctgtatgaaagagagatgtgggcttcctttttgagtcttgtgttaggtgctgagaccttttacatgggcttatacagggagagagtcttcaataaatgtagtcagcactattttctgcatccagtgtggttgcgtttctcacctgagagtaatcaagataacatctgtcatcttccttggtttattgagtgaaatgcctctcagtcttaggggacatggcagagatgaaagaaagaaagagtgggtttcagaagtgtcagggtggagtgattccaagtgggatggttgtggcattagtttaagctgaataaataatttcaatttggggcagttattctgctttttgtaaagccgtggccaattgtctcctgtaatgactgttggttcaggcatgttgtactttgtagggacaaatgtgcatttgtttgtggcaaaagcctacaattgacaaacttgtaaatttctttgtatataaactagctgtaacctgactatcctttgtgtttactgtttttgtaaatttttttcctctataaatgaaagggtgttggttcagaatggcactttgaataatgtaaaccagtgaaaagtggattttctttacttttgtctttgggtttggggttgtttttgttctttttgaagttttattatttttaaagtgcctcccacctaggcgtaggccatgaccatttggggtacgagagcctaattttgtaggacttaatctgttgaaaagtgcagttacttctggaaattaacctcaatattaggtcagcatgtgaaatgttggatttgacatgtcaggtagggttcagggactgattggtcccatttgccctcaggtcagttgtttaatctcaagacctgttactactgattttattaaatcagagtctttaattcttgcatgtttgtatctaatttctgaacgaatgagcacaccataaaaaaaaaaaaaaaaaaaaaaacaaaaaaaaaaaaaaagggggggggggaaaaaaaaaccccgggggggccccaattatgggtcccgctttttgtaaaaagggggcccccaaagggcgcgggaaaaaaaaggaacacgggcgggggttcacacccgcgccgggggacacagcgcgtccggcgcctttggggacgcctccccctcgtcgcgggcgccaatcggcccccacaaagaattcagcccggaaaaacattccgtagtcggggcccccccgccactcgcggtgaaccgctctggtattctagccgctcatcatcatctcatcaccaagcacacggcagcacagccacaccccctctg

SEQ ID NO: 329246 - DNA, 3876 bp, Homo sapiens
cagcgcaagcgcagtgcggataaacaggaagcgggcggtggaggcagcagcagagggagagctcggggcttggaggggaaacagcggaagacctaagattatcgggagggcagcagaggcagagaacgaggacaggacccttggccgtcttcttccagggaacgagaggtcacagcctcgctctccgcttatgcttctggcgccccagcttaaagccgaggctgcggctgacaaagggctcgcgccggtgccgccgcccttctcatccgggcattcgggtccctgcgagaaggagggggaaggacagagggggaggggaaggagccggaggggcgcacacttggagctgaagccctctccagggctccgggccggtgccccaacggacagaggtcgaggaggacccgcagaggtggcagcggccgggggcaggaggatggtgcagaaggagagtcaagcgacgttggaggagcgggagagcgagctcagctccaaccctgccgcctctgcgggggcatcgctggagccgccggcagctccggcacccggagaagacaaccccgccggggctgggggagcggcggtggccggggctgcaggaggggctcggcggttcctctgcggtgtggtggaaggattttatggaagaccttgggttatggaacagagaaaagaactctttagaaggctccagaaatgggaattaaatacatacttgtatgccccaaaagatgactacaaacataggatgttttggcgagagatgtattcagtggaggaagctgagcaacttatgactctcatctctgctgcacgagaatatgagatagagttcatctatgcgatctcacctggattggatatcactttttctaaccccaaggaagtatccacattgaaacgtaaattggaccaggtttctcagtttgggtgcagatcatttgctttgctttttgatgatatagaccataatatgtgtgcagcagacaaagaggtattcagttcttttgctcatgcccaagtctccatcacaaatgaaatctatcagtacctaggagagccagaaactttcctcttctgtcccacagaatactgtggcactttctgttatccaaatgtgtctcagtctccatatttaaggactgtgggtgaaaagcttctacctggaattgaagtgctttggacaggtcccaaagttgtttctaaagaaattccagtagagtccatcgaagaggtttctaagattattaagagagctccagtaatctgggataacattcatgctaatgattatgatcagaagagactgtttctgggcccgtacaaaggaagatccacagaactcatcccacggttaaaaggagtcctcactaatccaaattgtgaatttgaagccaactacgttgctatccacacccttgccacctggtacaaatcaaacatgaatggagtgagaaaagatgtagtgatgactgacagtgaagatagtactgtgtccatccagataaaattagaaaatgaaggcagtgatgaagatattgaaactgatgtactctatagtccacagatggctctaaagctagcattaacagaatggttgcaagagtttggtgtgcctcatcaatacagcagtaggcaagttgcacacagtggagctaaagcaagtgtagttgatgggactcctttagttgcagcaccctctttaaatgccacaaccgtagtaacaacagtttatcaggagcccattatgagccagggagcagccttgagtggtgagcctactactctgaccaaggaagaagaaaagaaacagcctgatgaagaacccatggacatggtggtggaaaaacaagaagaaacggaccacaagaatgacaatcaaatactgagtgaaattgttgaagcgaaaatggcagaggaattgaaaccaatggacactgataaagagagcatagctgaatcaaaatccccagagatgtccatgcaagaagattgtattagtgacattgcccccatgcaaactgatgaacagacaaacaaggagcagtttgtgccaggtccaaatgaaaagcctttgtacactgcggaaccagtgaccctggaggatttgcagttacttgctgatctattctaccttccttacgagcatggacccaaaggagcacagatgttacgggaatttcaatggcttcgagcaaatagtagtgttgtcagtgtcaattgcaaaggaaaagactctgaaaaaattgaagaatggcggtcacgagcagccaagtttgaagagatgtgtggactagtgatgggaatgttcactcggctctccaattgtgccaacaggacaattctttatgacatgtactcctatgtttgggatatcaagagtataatgtctatggtgaagtcttttgtacagtggttagggtgtcgtagtcattcttcagcacaattcttaattggagaccaagaaccctgggcctttagaggtggtctagcaggagagttccagcgtttgctgccaattgatggggcaaatgatctcttttttcagccacctccactgactcctacctccaaagtttatactatcagaccttattttcctaaggatgaggcatccgtgtacaagatttgcagagaaatgtatgacgatggagtgggtttaccctttcaaagtcagcctgatcttattggagacaagttagtaggagggctgctttccctcagcctggattactgctttgtcctagaagatgaagatggcatatgtggttatgccttgggcactgtagatgtgaccccctttattaaaaaatgtaaaatttcctggatccccttcatgcaggagaagtataccaagccaaatggtgacaaggaactctctgaggctgagaaaataatgttgagtttccatgaagaacaggaagtactgccagaaactttccttgctaatttcccttctctgataaagatggacattcacaaaaaagtaactgacccaagtgtggccaaaagcatgatggcttgcctcctgtcttcactgaaggctaatggctcccggggagctttctgtgaagtgagaccagatgataaaagaattctggaattttacagcaagttaggatgttttgaaattgcaaaaatggaaggatttccaaaggatgtggttatacttggtcggagcctgtgacatttgttgacactgtgaactgtccaaaagtctcttaactgcaccttgtgaatggtagttgaggtcttcatacagttcagcctctagaatggtaacaaatcagccaattggattcgaaacaaagaagactatgtaaaactcacccatcacactttgagactactcactggttggaagaatatagtattgcagcaaatcctgtatgaaagagagatgtgggcttcctttttgagtcttgtgttaggtgctgagaccttttacatgggcttatacagggagagagtcttcaataaatgtagtcagcactattttctgcatccagtgtggttgcgtttctcacctgagagtaatcaagataacatctgtcatcttccttggtttattgagtgaaatgcctctcagtcttaggggacatggcagagatgaaagaaagaaagagtgggtttcagaagtgtcagggtggagtgattccaagtgggatggttgtggcattagtttaagctgaataaataatttcaatttggggcagttattctgctttttgtaaagccgtggccaattgtctcctgtaatgactgttggttcaggcatgttgtactttgtagggacaaatgtgcatttgtttgtggcaaaagcctacaattgacaaacttgtaaatttctttgtatataaactagctgtaacctga

SEQ ID NO: 329247 - DNA, 1748 bp, Homo sapiens
agttacaacagctccagttacaacagtcttcaataaatgtagtcagcactattttctgcatccagtgtggttgcgtttctcacctgagagtaatcaagataacatctgtcatcttccttggtttattgagtgaaatgcctctcagtcttaggggacatggcagagatgaaagaaagaaagagtgggtttcagaagtgtcagggtggagtgattccaagtgggatggttgtggcattagtttaagctgaataaataatttcaatttggggcagttattctgctttttgtaaagccgtggccaattgtctcctgtaatgactgttggttcaggcatgttgtactttgtagggacaaatgtgcatttgtttgtggcaaaagcctacaattgacaaacttgtaaatttctttgtatataaactagctgtaacctgactatcctttgtgtttactgtttttgtaaatttttttcctctataaatgaaagggtgttggttcagaatggcactttgaataatgtaaaccagtgaaaagtggattttctttacttttgtctttgggtttggggttgtttttgttctttttgaagttttattatttttaaagtgcctcccacctaggcgtaggccatgaccatttggggtacgagagcctaattttgtaggacttaatctgttgaaaagtgcagttacttctggaaattaacctcaatattaggtcagcatgtgaaatgttggatttgacatgtcaggtagggttcagggactgattggtcccatttgccctcaggtcagttgtttaatctcaagacctgttactactgattttattaaatcagagtctttaattcttgcatgtttgtatctaatttctgaacgaatgagcacactttaaccagttatttacagttacctttttcctttaaccggattgtgaaagcttcatgtattttaatttagattctgtgtttttaagggttctgagcatgaagctggcagatagtcggcaggactcattttttcatcatggctggctgatttctccatagattgataacagtattttgttatcttgcttctctgtagttttgcatcagctgtttaactttgagctgagtgaggggagaggggtaaagagaaagaaacttaagttttctttcacagaactccaccattgtgggctttgagagagccctaaagcattgtacctagtggtacctagtgacttccaaccaaagcctttgagtatgcactaaataggtgagaagaaaggagagaaggtttttaggttagaaacctttaaccgatagaaggatatggtatgttgtaaagctggaaccaagtttgcatttttgagggcttgagatgaagggaagactcttaccagatagtaagacagctgagttttcctcagttttctcgtcttaacactagtggacaattctagcattttgtttggaggatttcagagttaacctcatggaattcaggattttttagcaagtttgcttttggttttatcttggcttttagtaatcatgttggctggtctggtcacaggtgactgtgaaacagatgccctggtcttgctttcatcactctaggatcatgaagtgctatgctatttcctggttatgaatattaaggttggaattacatttttattgattgtttggatcagagctcagttcctgtagaaaacgaactgtaaaagaccatgcaagaggcaaaataaaacttgaagtgaatgct

SEQ ID NO: 329248 - DNA, 1664 bp, Homo sapiens
tcgtctttgttgtcgaatccatttggctgattttttaccattctagaggctgaactgtatgaagaatatagtattgcagcaatacctgtatgaaagagtgggtttcagaagtgtcagggtggagtgattccaagtgggatggttgtggcattagtttaagctgaataaataatttcaatttggggcagttattctgctttttgtaaagccgtggccaattgtctcctgtaatgactgttggttcaggcatgttgtactttgtagggacaaatgtgcatttgtttgtggcaaaagcctacaattgacaaacttgtaaatttctttgtatataaactagctgtaacctgactatcctttgtgtttactgtttttgtaaatttttttcctctataaatgaaagggtgttggttcagaatggcactttgaataatgtaaaccagtgaaaagtggattttctttacttttgtctttgggtttggggttgtttttgttctttttgaagttttattatttttaaagtgcctcccacctaggcgtaggccatgaccatttggggtacgagagcctaattttgtaggacttaatctgttgaaaagtgcagttacttctggaaattaacctcaatattaggtcagcatgtgaaatgttggatttgacatgtcaggtagggttcagggactgattggtcccatttgccctcaggtcagttgtttaatctcaagacctgttactactgattttattaaatcagagtctttaattcttgcatgtttgtatctaatttctgaacgaatgagcacactttaaccagttatttacagttacctttttcctttaaccggattgtgaaagcttcatgtattttaatttagattctgtgtttttaagggttctgagcatgaagctggcagatagtcggcaggactcattttttcatcatggctggctgatttctccatagattgataacagtattttgttatcttgcttctctgtagttttgcatcagctgtttaactttgagctgagtgaggggagaggggtaaagagaaagaaacttaagttttctttcacagaactccaccattgtgggctttgagagagccctaaagcattgtacctagtggtacctagtgacttccaaccaaagcctttgagtatgcactaaataggtgagaagaaaggagagaaggtttttaggttagaaacctttaaccgatagaaggatatggtatgttgtaaagctggaaccaagtttgcatttttgagggcttgagatgaagggaagactcttaccagatagtaagacagctgagttttcctcagttttctcgtcttaacactagtggacaattctagcattttgtttggaggatttcagagttaacctcatggaattcaggattttttagcaagtttgcttttggttttatcttggcttttagtaatcatgttggctggtctggtcacaggtgactgtgaaacagatgccctggtcttgctttcatcactctaggatcatgaagtgctatgctatttcctggttatgaatattaaggttggaattacatttttattgattgtttggatcagagctcagttcctgtagaaaacgaactgtaaaagaccatgcaagaggcaaaataaaacttgaagtgaatgct

SEQ ID NO: 329249 - DNA, 4314 bp, Homo sapiens
cagcgcaagcgcagtgcggataaacaggaagcgggcggtggaggcagcagcagagggagagctcggggcttggaggggaaacagcggaagacctaagattatcgggagggcagcagaggcagagaacgaggacaggacccttggccgtcttcttccagggaacgagaggtcacagcctcgctctccgcttatgcttctggcgccccagcttaaagccgaggctgcggctgacaaagggctcgcgccggtgccgccgcccttctcatccgggcattcgggtccctgcgagaaggagggggaaggacagagggggaggggaaggagccggaggggcgcacacttggagctgaagccctctccagggctccgggccggtgccccaacggacagaggtcgaggaggacccgcagaggtggcagcggccgggggcaggaggatggtgcagaaggagagtcaagcgacgttggaggagcgggagagcgagctcagctccaaccctgccgcctctgcgggggcatcgctggagccgccggcagctccggcacccggagaagacaaccccgccggggctgggggagcggcggtggccggggctgcaggaggggctcggcggttcctctgcggtgtggtggaaggattttatggaagaccttgggttatggaacagagaaaagaactctttagaaggctccagaaatgggaattaaatacatacttgtatgccccaaaagatgactacaaacataggatgttttggcgagagatgtattcagtggaggaagctgagcaacttatgactctcatctctgctgcacgagaatatgagatagagttcatctatgcgatctcacctggattggatatcactttttctaaccccaaggaagtatccacattgaaacgtaaattggaccaggtttctcagtttgggtgcagatcatttgctttgctttttgatgatatagaccataatatgtgtgcagcagacaaagaggtattcagttcttttgctcatgcccaagtctccatcacaaatgaaatctatcagtacctaggagagccagaaactttcctcttctgtcccacagaatactgtggcactttctgttatccaaatgtgtctcagtctccatatttaaggactgtgggtgaaaagcttctacctggaattgaagtgctttggacaggtcccaaagttgtttctaaagaaattccagtagagtccatcgaagaggtttctaagattattaagagagctccagtaatctgggataacattcatgctaatgattatgatcagaagagactgtttctgggcccgtacaaaggaagatccacagaactcatcccacggttaaaaggagtcctcactaatccaaattgtgaatttgaagccaactacgttgctatccacacccttgccacctggtacaaatcaaacatgaatggagtgagaaaagatgtagtgatgactgacagtgaagatagtactgtgtccatccagataaaattagaaaatgaaggcagtgatgaagatattgaaactgatgtactctatagtccacagatggctctaaagctagcattaacagaatggttgcaagagtttggtgtgcctcatcaatacagcagtaggcaagttgcacacagtggagctaaagcaagtgtagttgatgggactcctttagttgcagcaccctctttaaatgccacaaccgtagtaacaacagtttatcaggagcccattatgagccagggagcagccttgagtggtgagcctactactctgaccaaggaagaagaaaagaaacagcctgatgaagaacccatggacatggtggtggaaaaacaagaagaaacggaccacaagaatgacaatcaaatactgagtgaaattgttgaagcgaaaatggcagaggaattgaaaccaatggacactgataaagagagcatagctgaatcaaaatccccagagatgtccatgcaagaagattgtattagtgacattgcccccatgcaaactgatgaacagacaaacaaggagcagtttgtgccaggtccaaatgaaaagcctttgtacactgcggaaccagtgaccctggaggatttgcagttacttgctgatctattctaccttccttacgagcatggacccaaaggagcacagatgttacgggaatttcaatggcttcgagcaaatagtagtgttgtcagtgtcaattgcaaaggaaaagactctgaaaaaattgaagaatggcggtcacgagcagccaagtttgaagagatgtgtggactagtgatgggaatgttcactcggctctccaattgtgccaacaggacaattctttatgacatgtactcctatgtttgggatatcaagagtataatgtctatggtgaagtcttttgtacagtggttaggtaggtgcaccaggaataatctcttctcctcaaatatattgtccctttaaaaaaaattatcccacagggagaaaaacatttagggaattggcacatttccaagtctcttcaattcgttgcctaggtttctttcaaaaataggcattattgaagacttgagatgcaagtcttagtaaatacatcaagcacattaatttttctcccttgggctaattcagcataagtatcttatggaaccctgtataccacttttatctgatttggagatgagacactatgaaatgtgactccacaagctttctgctgcttgctgtgtcttgataacattaatgctatgtttaacagaacaattgctgaaatgacctaaagggcctggcaagaggaagccatcctcccagccctgtgcgcatgcgagctttagtgtaaggctattctggtgctattcagtattatttcacgtggctttttctttatccttctaccaagtattggttttaccaggggatagaaattgtaatcccctaaacatctctgctacattaaatggacttttgtatgtctcctttgaacactgattttttttttttaaattgtcaaacttggtaaaaagcaccagcatggccaagtttctctagggacttcatttcattttcaggttttcaatccagctataaggaatatgtaatggacttatatacagcacacagcaggcagcaaggctgactgacatgtcatagttttcatagtagtcacaaatactatgatgggtttcatggtcttggttgtgaaatagatatctgaaacaccgtgagcttagaataaaaagtagtagtgagattttccactttctgcctgtatacctttgagctcttaaatatttaaaaaaaaaaaaaaaaagtttccctgtgatacaactaattagctactaaaagtagagtctcagattgttaatttgaaaatagataactttttttggattgctgtaataacaggtagaagagagtattttgacctcatgttaaaaggctctgtatagcttcgggcgcggttgctcacccctgtaatcccagcgctcttggtggctgaggtgggtggatcacttgagatcaggagttcgagaccagcctggtgaaaaccagcatgagaccagcatggtgaaaccctatctctactaaaaaaatacaaaaattagccaggcgtggtggcgcatgcctgtaatcccagctacttgagaggctgaggcaggagaattgcttgaactcaggaggcagaggttgcagtgagctgagatcacaccattgcactccagcctgggcgatagagggagactccatctcaaaataaatacaataaataaaggaaatactgaccgtgcgcagcggctcaacactcccgacctcaggtgatacagaacctccttcaggctccccacagttgctacggattaatacggcggtgaagccaccacgagcctggacttcatttacctccactagatctattttctactatttcaccctttactgacctataggtcacatggatgtgtaccaaggaggacatggcccaggttgacgacaccacgtcaatagggaattacaactgacacctatggcaggcgagttgaggctgactgaatgtattgcggtcgccccatctgaacacatgacggcactacacacctgtacaacaatggtggaatctatcagtccatgacatcatggacatgcagcgacgcactacgcagcagaactctagctataaaacgaagtcactccagactgcatgtacacaacactgcagacctaagacaattggagcagcgcacgcgggatcaactagaactatcccgacaggagtccagagtacacagctaaacctgtacctcacgaga

SEQ ID NO: 329250 - DNA, 3271 bp, Homo sapiens
cagcgcaagcgcagtgcggataaacaggaagcgggcggtggaggcagcagcagagggagagctcggggcttggaggggaaacagcggaagacctaagattatcgggagggcagcagaggcagagaacgaggacaggacccttggccgtcttcttccagggaacgagaggtcacagcctcgctctccgcttatgcttctggcgccccagcttaaagccgaggctgcggctgacaaagggctcgcgccggtgccgccgcccttctcatccgggcattcgggtccctgcgagaaggagggggaaggacagagggggaggggaaggagccggaggggcgcacacttggagctgaagccctctccagggctccgggccggtgccccaacggacagaggtcgaggaggacccgcagaggtggcagcggccgggggcaggaggatggtgcagaaggagagtcaagcgacgttggaggagcgggagagcgagctcagctccaaccctgccgcctctgcgggggcatcgctggagccgccggcagctccggcacccggagaagacaaccccgccggggctgggggagcggcggtggccggggctgcaggaggggctcggcggttcctctgcggtgtggtggaaggattttatggaagaccttgggttatggaacagagaaaagaactctttagaaggctccagaaatgggaattaaatacatacttgtatgccccaaaagatgactacaaacataggatgttttggcgagagatgtattcagtggaggaagctgagcaacttatgactctcatctctgctgcacgagaatatgagatagagttcatctatgcgatctcacctggattggatatcactttttctaaccccaaggaagtatccacattgaaacgtaaattggaccaggtttctcagtttgggtgcagatcatttgctttgctttttgatgatatagaccataatatgtgtgcagcagacaaagaggtattcagttcttttgctcatgcccaagtctccatcacaaatgaaatctatcagtacctaggagagccagaaactttcctcttctgtcccacagaatactgtggcactttctgttatccaaatgtgtctcagtctccatatttaaggactgtgggtgaaaagcttctacctggaattgaagtgctttggacaggtcccaaagttgtttctaaagaaattccagtagagtccatcgaagaggtttctaagattattaagagagctccagtaatctgggataacattcatgctaatgattatgatcagaagagactgtttctgggcccgtacaaaggaagatccacagaactcatcccacggttaaaaggagtcctcactaatccaaattgtgaatttgaagccaactacgttgctatccacacccttgccacctggtacaaatcaaacatgaatggagtgagaaaagatgtagtgatgactgacagtgaagatagtactgtgtccatccagataaaattagaaaatgaaggcagtgatgaagatattgaaactgatgtactctatagtccacagatggctctaaagctagcattaacagaatggttgcaagagtttggtgtgcctcatcaatacagcagtaggcaagttgcacacagtggagctaaagcaagtgtagttgatgggactcctttagttgcagcaccctctttaaatgccacaaccgtagtaacaacagtttatcaggagcccattatgagccagggagcagccttgagtggtgagcctactactctgaccaaggaagaagaaaagaaacagcctgatgaagaacccatggacatggtggtggaaaaacaagaagaaacggaccacaagaatgacaatcaaatactgagtgaaattgttgaagcgaaaatggcagaggaattgaaaccaatggacactgataaagagagcatagctgaatcaaaatccccagagatgtccatgcaagaagattgtattagtgacattgcccccatgcaaactgatgaacagacaaacaaggagcagtttgtgccaggtccaaatgaaaagcctttgtacactgcggaaccagtgaccctggaggatttgcagttacttgctgatctattctaccttccttacgagcatggacccaaaggagcacagatgttacgggaatttcaatggcttcgagcaaatagtagtgttgtcagtgtcaattgcaaaggaaaagactctgaaaaaattgaagaatggcggtcacgagcagccaagtttgaagagatgtgtggactagtgatgggaatgttcactcggctctccaattgtgccaacaggacaattctttatgacatgtactcctatgtttgggatatcaagagtataatgtctatggtgaagtcttttgtacagtggttagggtgtcgtagtcattcttcagcacaattcttaattggagaccaagaaccctgggcctttagaggtggtctagcaggagagttccagcgtttgctgccaattgatggggcaaatgatctcttttttcagccacctccactgactcctacctccaaagtttatactatcagaccttattttcctaaggatgaggcatccgtgtacaagatttgcagagaaatgtatgacgatggagtgggtttaccctttcaaagtcagcctgatcttattggagacaagttagtaggagggctgctttccctcagcctggattactgctttgtcctagaagatgaagatggcatatgtggttatgccttgggcactgtagatgtgaccccctttattaaaaaatgtaaaatttcctggatccccttcatgcaggagaagtataccaagccaaatggtgacaaggaactctctgaggctgagaaaataatgttgagtttccatgaagaacaggaagtactgccagaaactttccttgctaatttcccttctctgataaagatggacattcacaaaaaagtaactgacccaagtgtggccaaaagcatgatggcttgcctcctgtcttcactgaaggctaatggctcccggggagctttctgtgaagtgagaccagatgataaaagaattctggaattttacagcaagttaggatgttttgaaattgcaaaaatggaaggatttccaaaggatgtggttatacttggtcggagcctgtgacatttgttgacactgtgaactgtccaaaagtctcttaactgcaccttgtgaatggtaggagggggggggatcctaaagagtcgc

SEQ ID NO: 329251 - DNA, 3549 bp, Homo sapiens
cagcgcaagcgcagtgcggataaacaggaagcgggcggtggaggcagcagcagagggagagctcggggcttggaggggaaacagcggaagacctaagattatcgggagggcagcagaggcagagaacgaggacaggacccttggccgtcttcttccagggaacgagaggtcacagcctcgctctccgcttatgcttctggcgccccagcttaaagccgaggctgcggctgacaaagggctcgcgccggtgccgccgcccttctcatccgggcattcgggtccctgcgagaaggagggggaaggacagagggggaggggaaggagccggaggggcgcacacttggagctgaagccctctccagggctccgggccggtgccccaacggacagaggtcgaggaggacccgcagaggtggcagcggccgggggcaggaggatggtgcagaaggagagtcaagcgacgttggaggagcgggagagcgagctcagctccaaccctgccgcctctgcgggggcatcgctggagccgccggcagctccggcacccggagaagacaaccccgccggggctgggggagcggcggtggccggggctgcaggaggggctcggcggttcctctgcggtgtggtggaaggattttatggaagaccttgggttatggaacagagaaaagaactctttagaaggctccagaaatgggaattaaatacatacttgtatgccccaaaagatgactacaaacataggatgttttggcgagagatgtattcagtggaggaagctgagcaacttatgactctcatctctgctgcacgagaatatgagatagagttcatctatgcgatctcacctggattggatatcactttttctaaccccaaggaagtatccacattgaaacgtaaattggaccaggtttctcagtttgggtgcagatcatttgctttgctttttgatgatatagaccataatatgtgtgcagcagacaaagaggtattcagttcttttgctcatgcccaagtctccatcacaaatgaaatctatcagtacctaggagagccagaaactttcctcttctgtcccacagaatactgtggcactttctgttatccaaatgtgtctcagtctccatatttaaggactgtgggtgaaaagcttctacctggaattgaagtgctttggacaggtcccaaagttgtttctaaagaaattccagtagagtccatcgaagaggtttctaagattattaagagagctccagtaatctgggataacattcatgctaatgattatgatcagaagagactgtttctgggcccgtacaaaggaagatccacagaactcatcccacggttaaaaggagtcctcactaatccaaattgtgaatttgaagccaactacgttgctatccacacccttgccacctggtacaaatcaaacatgaatggagtgagaaaagatgtagtgatgactgacagtgaagatagtactgtgtccatccagataaaattagaaaatgaaggcagtgatgaagatattgaaactgatgtactctatagtccacagatggctctaaagctagcattaacagaatggttgcaagagtttggtgtgcctcatcaatacagcagtaggcaagttgcacacagtggagctaaagcaagtgtagttgatgggactcctttagttgcagcaccctctttaaatgccacaaccgtagtaacaacagtttatcaggagcccattatgagccagggagcagccttgagtggtgagcctactactctgaccaaggaagaagaaaagaaacagcctgatgaagaacccatggacatggtggtggaaaaacaagaagaaacggaccacaagaatgacaatcaaatactgagtgaaattgttgaagcgaaaatggcagaggaattgaaaccaatggacactgataaagagagcatagctgaatcaaaatccccagagatgtccatgcaagaagattgtattagtgacattgcccccatgcaaactgatgaacagacaaacaaggagcagtttgtgccaggtccaaatgaaaagcctttgtacactgcggaaccagtgaccctggaggatttgcagttacttgctgatctattctaccttccttacgagcatggacccaaaggagcacagatgttacgggaatttcaatggcttcgagcaaatagtagtgttgtcagtgtcaattgcaaaggaaaagactctgaaaaaattgaagaatggcggtcacgagcagccaagtttgaagagatgtgtggactagtgatgggaatgttcactcggctctccaattgtgccaacaggacaattctttatgacatgtactcctatgtttgggatatcaagagtataatgtctatggtgaagtcttttgtacagtggttagggtgtcgtagtcattcttcagcacaattcttaattggagaccaagaaccctgggcctttagaggtggtctagcaggagagttccagcgtttgctgccaattgatggggcaaatgatctcttttttcagccacctccactgactcctacctccaaagtttatactatcagaccttattttcctaaggatgaggcatccgtgtacaagatttgcagagaaatgtatgacgatggagtgggtttaccctttcaaagtcagcctgatcttattggagacaagttagtaggagggctgctttccctcagcctggattactgctttgtcctagaagatgaagatggcatatgtggttatgccttgggcactgtagatgtgaccccctttattaaaaaatgtaaaatttcctggatccccttcatgcaggagaagtataccaagccaaatggtgacaaggaactctctgaggctgagaaaataatgttgagtttccatgaagaacaggaagtactgccagaaactttccttgctaatttcccttctctgataaagatggacattcacaaaaaagtaactgacccaagtgtggccaaaagcatgatggcttgcctcctgtcttcactgaaggctaatggctcccggggagctctctgtcgaagtgagaccagcatgactacaccagacacttctggcaacttctacacgccacagcttaggcatggcctcacgcaaacttcgccacacaacactgcgccacgcgacttttcccacacagggactgtggcatcatacttgcgatccggcagccctgtgcaccactcacgcacacggaccaactggttgaaacctcggtccccaaatcagttactccctttcaaaccttggccaaccctttgctctgacaacttgggctccaacacaatccaacgcgcgccacccgtcttccccaacttaaccccagggaacatacccagctgcccgcctcccgtctacgcacaccccttggcgcggtaagacccccacccgaagtttccaccatactacccaccaacaacatcaccggctgttcagcttctccctgccgacagatgacccacgacaccgcaactagcggcaagacgtctcaatcttgg

SEQ ID NO: 329252 - DNA, 1761 bp, Homo sapiens
cagcgcaagcgcagtgcggataaacaggaagcgggcggtggaggcagcagcagagggagagctcggggcttggaggggaaacagcggaagacctaagattatcgggagggcagcagaggcagagaacgaggacaggacccttggccgtcttcttccagggaacgagaggtcacagcctcgctctccgcttatgcttctggcgccccagcttaaagccgaggctgcggctgacaaagggctcgcgccggtgccgccgcccttctcatccgggcattcgggtccctgcgagaaggagggggaaggacagagggggaggggaaggagccggaggggcgcacacttggagctgaagccctctccagggctccgggccggtgccccaacggacagaggtcgaggaggacccgcagaggtggcagcggccgggggcaggaggatggtgcagaaggagagtcaagcgacgttggaggagcgggagagcgagctcagctccaaccctgccgcctctgcgggggcatcgctggagccgccggcagctccggcacccggagaagacaaccccgccggggctgggggagcggcggtggccggggctgcaggaggggctcggcggttcctctgcggtgtggtggaaggattttatggaagaccttgggttatggaacagagaaaagaactctttagaaggctccagaaatgggaattaaatacatacttgtatgccccaaaagatgactacaaacataggatgttttggcgagagatgtattcagtggaggaagctgagcaacttatgactctcatctctgctgcacgagaatatgagatagagttcatctatgcgatctcacctggattggatatcactttttctaaccccaaggaagtatccacattgaaacgtaaattggaccaggtttctcagtttgggtgcagatcatttgctttgctttttgatgatatagaccataatatgtgtgcagcagacaaagaggtattcagttcttttgctcatgcccaagtctccatcacaaatgaaatctatcagtacctaggagagccagaaactttcctcttctgtcccacagaatactgtggcactttctgttatccaaatgtgtctcagtctccatatttaaggactgtgggtgaaaagcttctacctggaattgaagtgctttggacaggtcccaaagttgtttctaaagaaattccagtagagtccatcgaagaggtttctaagattattaagagagctccagtaatctgggataacattcatgctaatgattatgatcagaagagactgtttctgggcccgtacaaaggaagatccacagaactcatcccacggttaaaaggagtcctcactaatccaaattgtgaatttgaagccaactacgttgctatccacacccttgccacctggtacaaatcaaacatgaatggagtgagaaaagatgtagtgatgactgacagtgaagatagtactgtgtccatccagataaaattagaaaatgaaggcagtgatgaagatattgaaactgatgtactctatagtccacagatggctctaaagctagcattaacagaatggttgcaagagtttggtgtgcctcatcaatacagcagtagggcaagtgccacagtggagctaagcagtggtactgatggactctttattgcagacctcttaatgccaacgagtaccacagtatcaggccatatagcgggcactgatgggcatatcttacaaaaaaa

SEQ ID NO: 329253 - DNA, 836 bp, Homo sapiens
agcaagatccagtaccatggctcatgcctgcaatcccaacactgtaagaggctaaggcaggcggatcacttgaggccaggagttcgagaccagcctgggcaatatggcaaaaccctcatctctactaaacaaaaattagccgggtatgcctgtaatcccacctactcaggaggtggaggttgcagtgagtcaggatcgtgccactgcactccagccttgggcaacagagcaaggctctcaaaataaaaaagcagcggctgcattttatgcctttcaaatgctgcaggaaatagaaatggcttaagttcagtaagagaattgacaattcagtgtttttgagaagtggcaatgaaagggaggaaaatgtttattgattttagcctgtttccccaaaaggataagaaactatttggaagtgaaaaagaagggcctcttattttctgttggttcagatttcaaaggtgtgaaaactattctttttcccttactgtgacattaaatcacttcaggcttgtaccattttgtatggcctgttgttaagttggacatgacaatttgtaaaatgtgaggatcttttcctttcttgtaagttagaagaaataacctcttcagttaaaccttcagtgaaggttcttttagttttctgttctgctttctaaaaacatagactctgttctttagagcaacttatgactctcatctctgctgcacgagaatatgagatagagttcatctatgcgatctcacctggattggatatcactttttctaaccccaaggaagtatccacattgaaacgtaaattggaccaggtaactcctcacttataatccctt

SEQ ID NO: 329254 - DNA, 854 bp, Homo sapiens
cagcgcaagcgcagtgcggataaacaggaagcgggcggtggaggcagcagcagagggagagctcggggcttggaggggaaacagcggaagacctaagattatcgggagggcagcagaggcagagaacgaggacaggacccttggccgtcttcttccagggaacgagaggtcacagcctcgctctccgcttatgcttctggcgccccagcttaaagccgaggctgcggctgacaaagggctcgcgccggtgccgccgcccttctcatccgggcattcgggtccctgcgagaaggagggggaaggacagagggggaggggaaggagccggaggggcgcacacttggagctgaagccctctccagggctccgggccggtgccccaacggacagaggtcgaggaggacccgcagaggtggcagcggccgggggcaggaggatggtgcagaaggagagtcaagcgacgttggaggagcgggagagcgagctcagctccaaccctgccgcctctgcgggggcatcgctggagccgccggcagctccggcacccggagaagacaaccccgccggggctgggggagcggcggtggccggggctgcaggaggggctcggcggttcctctgcggtgtggtggaaggattttatggaagaccttgggttatggaacagagaaaagaactctttagaaggctccagaaatgggaattaaatacatacttgtatgccccaaaagatgactacaaacataggatgttttggcgagagatgtattcagtggaggaagctggctggagtgcagtggtgcgatctcggctaactgcaaacctcgccctcccgagttcaagagattctgctg

SEQ ID NO: 329255 - DNA, 303 bp, Homo sapiens
tccaggaaaaaacaaaaatgaaaatccaaaacatttttggtcccaagcatttcagataaggaatactcagcctgtagtgcattcaaacccaaatgagaaatgggtcccaaaactgtttaacttacgattttttaattgaaaatgtaaaaacaataaatctgtctttgaacattctagtaaggaaaatactggattttaagtataactgttaacgctgtaatgtttggaattcttaatttttttactcttgattcttttttttttttttctcctaggtttctcagtttgggtgcagatcatttg

SEQ ID NO: 329256 - DNA, 451 bp, Homo sapiens
tatttatgttttgaatatttgttttatttctaggctcccggggagctttctgtgaagtgagaccagatgataaaagaattctggaattttacagcaagttaggatgttttgaaattgcaaaaatggaaggatttccaaaggatgtggttatacttggtcggagcctgtgacatttgttgacactgtgaactgtccaaaagtctcttaactgcaccttgtgaatggtagttgaggtcttcatacagttcagcctctagaatggtaacaaatcagccaattggattcgaaacaaagaagactatgtaaaactcacccatcacactttgagactactcactggttggaagaatatagtattgcagcaaatcctgtatgaaagagagatgtgggcttcctttttgagtcttgtgttaggtgctgagaccttttacatgggcttatacagggagag

SEQ ID NO: 329257 - DNA, 447 bp, Homo sapiens
cttattcttagcatgacatttttcactgtttccccaatattgggacagttttttatttgggagtactattgtaatatttcctcaggtgaaaacacaataaagacaaagaacatttttttcctctgttttaaagtttcatacttaaagatgttatggtcttggtcaggcacagtggctcgtgcctgtaatcccagcactttgggaggccaaggcgggtgtatcacctgaagtcaggagttcaagaccagcccggccaacgtggtgaaactccatctctactaaaaatacaaaaaaaaattagctgggtgtggtggcgggtgcctgtaatgccagctactcaggaggctgaggcaggagaattgcttgaacccgggagcgggaggttgcagtgagctgagatggcgccactgcactccagccggggcagcagagtgaaactctgtctca

SEQ ID NO: 329258 - DNA, 5192 bp, Homo sapiens
cagcgcaagcgcagtgcggataaacaggaagcgggcggtggaggcagcagcagagggagagctcggggcttggaggggaaacagcggaagacctaagattatcgggagggcagcagaggcagagaacgaggacaggacccttggccgtcttcttccagggaacgagaggtcacagcctcgctctccgcttatgcttctggcgccccagcttaaagccgaggctgcggctgacaaagggctcgcgccggtgccgccgcccttctcatccgggcattcgggtccctgcgagaaggagggggaaggacagagggggaggggaaggagccggaggggcgcacacttggagctgaagccctctccagggctccgggccggtgccccaacggacagaggtcgaggaggacccgcagaggtggcagcggccgggggcaggaggatggtgcagaaggagagtcaagcgacgttggaggagcgggagagcgagctcagctccaaccctgccgcctctgcgggggcatcgctggagccgccggcagctccggcacccggagaagacaaccccgccggggctgggggagcggcggtggccggggctgcaggaggggctcggcggttcctctgcggtgtggtggaaggattttatggaagaccttgggttatggaacagagaaaagaactctttagaaggctccagaaatgggaattaaatacatacttgtatgccccaaaagatgactacaaacataggatgttttggcgagagatgtattcagtggaggaagctgagcaacttatgactctcatctctgctgcacgagaatatgagatagagttcatctatgcgatctcacctggattggatatcactttttctaaccccaaggaagtatccacattgaaacgtaaattggaccaggtttctcagtttgggtgcagatcatttgctttgctttttgatgatatagaccataatatgtgtgcagcagacaaagaggtattcagttcttttgctcatgcccaagtctccatcacaaatgaaatctatcagtacctaggagagccagaaactttcctcttctgtcccacagaatactgtggcactttctgttatccaaatgtgtctcagtctccatatttaaggactgtgggtgaaaagcttctacctggaattgaagtgctttggacaggtcccaaagttgtttctaaagaaattccagtagagtccatcgaagaggtttctaagattattaagagagctccagtaatctgggataacattcatgctaatgattatgatcagaagagactgtttctgggcccgtacaaaggaagatccacagaactcatcccacggttaaaaggagtcctcactaatccaaattgtgaatttgaagccaactacgttgctatccacacccttgccacctggtacaaatcaaacatgaatggagtgagaaaagatgtagtgatgactgacagtgaagatagtactgtgtccatccagataaaattagaaaatgaaggcagtgatgaagatattgaaactgatgtactctatagtccacagatggctctaaagctagcattaacagaatggttgcaagagtttggtgtgcctcatcaatacagcagtaggcaagttgcacacagtggagctaaagcaagtgtagttgatgggactcctttagttgcagcaccctctttaaatgccacaaccgtagtaacaacagtttatcaggagcccattatgagccagggagcagccttgagtggtgagcctactactctgaccaaggaagaagaaaagaaacagcctgatgaagaacccatggacatggtggtggaaaaacaagaagaaacggaccacaagaatgacaatcaaatactgagtgaaattgttgaagcgaaaatggcagaggaattgaaaccaatggacactgataaagagagcatagctgaatcaaaatccccagagatgtccatgcaagaagattgtattagtgacattgcccccatgcaaactgatgaacagacaaacaaggagcagtttgtgccaggtccaaatgaaaagcctttgtacactgcggaaccagtgaccctggaggatttgcagttacttgctgatctattctaccttccttacgagcatggacccaaaggagcacagatgttacgggaatttcaatggcttcgagcaaatagtagtgttgtcagtgtcaattgcaaaggaaaagactctgaaaaaattgaagaatggcggtcacgagcagccaagtttgaagagatgtgtggactagtgatgggaatgttcactcggctctccaattgtgccaacaggacaattctttatgacatgtactcctatgtttgggatatcaagagtataatgtctatggtgaagtcttttgtacagtggttagggtgtcgtagtcattcttcagcacaattcttaattggagaccaagaaccctgggcctttagaggtggtctagcaggagagttccagcgtttgctgccaattgatggggcaaatgatctcttttttcagccacctccactgactcctacctccaaagtttatactatcagaccttattttcctaaggatgaggcatccgtgtacaagatttgcagagaaatgtatgacgatggagtgggtttaccctttcaaagtcagcctgatcttattggagacaagttagtaggagggctgctttccctcagcctggattactgctttgtcctagaagatgaagatggcatatgtggttatgccttgggcactgtagatgtgaccccctttattaaaaaatgtaaaatttcctggatccccttcatgcaggagaagtataccaagccaaatggtgacaaggaactctctgaggctgagaaaataatgttgagtttccatgaagaacaggaagtactgccagaaactttccttgctaatttcccttctctgataaagatggacattcacaaaaaagtaactgacccaagtgtggccaaaagcatgatggcttgcctcctgtcttcactgaaggctaatggctcccggggagctttctgtgaagtgagaccagatgataaaagaattctggaattttacagcaagttaggatgttttgaaattgcaaaaatggaaggatttccaaaggatgtggttatacttggtcggagcctgtgacatttgttgacactgtgaactgtccaaaagtctcttaactgcaccttgtgaatggtagttgaggtcttcatacagttcagcctctagaatggtaacaaatcagccaattggattcgaaacaaagaagactatgtaaaactcacccatcacactttgagactactcactggttggaagaatatagtattgcagcaaatcctgtatgaaagagagatgtgggcttcctttttgagtcttgtgttaggtgctgagaccttttacatgggcttatacagggagagagtcttcaataaatgtagtcagcactattttctgcatccagtgtggttgcgtttctcacctgagagtaatcaagataacatctgtcatcttccttggtttattgagtgaaatgcctctcagtcttaggggacatggcagagatgaaagaaagaaagagtgggtttcagaagtgtcagggtggagtgattccaagtgggatggttgtggcattagtttaagctgaataaataatttcaatttggggcagttattctgctttttgtaaagccgtggccaattgtctcctgtaatgactgttggttcaggcatgttgtactttgtagggacaaatgtgcatttgtttgtggcaaaagcctacaattgacaaacttgtaaatttctttgtatataaactagctgtaacctgactatcctttgtgtttactgtttttgtaaatttttttcctctataaatgaaagggtgttggttcagaatggcactttgaataatgtaaaccagtgaaaagtggattttctttacttttgtctttgggtttggggttgtttttgttctttttgaagttttattatttttaaagtgcctcccacctaggcgtaggccatgaccatttggggtacgagagcctaattttgtaggacttaatctgttgaaaagtgcagttacttctggaaattaacctcaatattaggtcagcatgtgaaatgttggatttgacatgtcaggtagggttcagggactgattggtcccatttgccctcaggtcagttgtttaatctcaagacctgttactactgattttattaaatcagagtctttaattcttgcatgtttgtatctaatttctgaacgaatgagcacactttaaccagttatttacagttacctttttcctttaaccggattgtgaaagcttcatgtattttaatttagattctgtgtttttaagggttctgagcatgaagctggcagatagtcggcaggactcattttttcatcatggctggctgatttctccatagattgataacagtattttgttatcttgcttctctgtagttttgcatcagctgtttaactttgagctgagtgaggggagaggggtaaagagaaagaaacttaagttttctttcacagaactccaccattgtgggctttgagagagccctaaagcattgtacctagtggtacctagtgacttccaaccaaagcctttgagtatgcactaaataggtgagaagaaaggagagaaggtttttaggttagaaacctttaaccgatagaaggatatggtatgttgtaaagctggaaccaagtttgcatttttgagggcttgagatgaagggaagactcttaccagatagtaagacagctgagttttcctcagttttctcgtcttaacactagtggacaattctagcattttgtttggaggatttcagagttaacctcatggaattcaggattttttagcaagtttgcttttggttttatcttggcttttagtaatcatgttggctggtctggtcacaggtgactgtgaaacagatgccctggtcttgctttcatcactctaggatcatgaagtgctatgctatttcctggttatgaatattaaggttggaattacatttttattgattgtttggatcagagctcagttcctgtagaaaacgaactgtaaaagaccatgcaagaggcaaaataaaacttgaagtgaatgct

SEQ ID NO: 329259 - DNA, 6161 bp, Homo sapiens
cagcgcaagcgcagtgcggataaacaggaagcgggcggtggaggcagcagcagagggagagctcggggcttggaggggaaacagcggaagacctaagattatcgggagggcagcagaggcagagaacgaggacaggacccttggccgtcttcttccagggaacgagaggtcacagcctcgctctccgcttatgcttctggcgccccagcttaaagccgaggctgcggctgacaaagggctcgcgccggtgccgccgcccttctcatccgggcattcgggtccctgcgagaaggagggggaaggacagagggggaggggaaggagccggaggggcgcacacttggagctgaagccctctccagggctccgggccggtgccccaacggacagaggtcgaggaggacccgcagaggtggcagcggccgggggcaggaggatggtgcagaaggagagtcaagcgacgttggaggagcgggagagcgagctcagctccaaccctgccgcctctgcgggggcatcgctggagccgccggcagctccggcacccggagaagacaaccccgccggggctgggggagcggcggtggccggggctgcaggaggggctcggcggttcctctgcggtgtggtggaaggattttatggaagaccttgggttatggaacagagaaaagaactctttagaaggctccagaaatgggaattaaatacatacttgtatgccccaaaagatgactacaaacataggatgttttggcgagagatgtattcagtggaggaagctgagcaacttatgactctcatctctgctgcacgagaatatgagatagagttcatctatgcgatctcacctggattggatatcactttttctaaccccaaggaagtatccacattgaaacgtaaattggaccaggtttctcagtttgggtgcagatcatttgctttgctttttgatgatatagaccataatatgtgtgcagcagacaaagaggtattcagttcttttgctcatgcccaagtctccatcacaaatgaaatctatcagtacctaggagagccagaaactttcctcttctgtcccacagaatactgtggcactttctgttatccaaatgtgtctcagtctccatatttaaggactgtgggtgaaaagcttctacctggaattgaagtgctttggacaggtcccaaagttgtttctaaagaaattccagtagagtccatcgaagaggtttctaagattattaagagagctccagtaatctgggataacattcatgctaatgattatgatcagaagagactgtttctgggcccgtacaaaggaagatccacagaactcatcccacggttaaaaggagtcctcactaatccaaattgtgaatttgaagccaactacgttgctatccacacccttgccacctggtacaaatcaaacatgaatggagtgagaaaagatgtagtgatgactgacagtgaagatagtactgtgtccatccagataaaattagaaaatgaaggcagtgatgaagatattgaaactgatgtactctatagtccacagatggctctaaagctagcattaacagaatggttgcaagagtttggtgtgcctcatcaatacagcagtaggcaagttgcacacagtggagctaaagcaagtgtagttgatgggactcctttagttgcagcaccctctttaaatgccacaaccgtagtaacaacagtttatcaggagcccattatgagccagggagcagccttgagtggtgagcctactactctgaccaaggaagaagaaaagaaacagcctgatgaagaacccatggacatggtggtggaaaaacaagaagaaacggaccacaagaatgacaatcaaatactgagtgaaattgttgaagcgaaaatggcagaggaattgaaaccaatggacactgataaagagagcatagctgaatcaaaatccccagagatgtccatgcaagaagattgtattagtgacattgcccccatgcaaactgatgaacagacaaacaaggagcagtttgtgccaggtccaaatgaaaagcctttgtacactgcggaaccagtgaccctggaggatttgcagttacttgctgatctattctaccttccttacgagcatggacccaaaggagcacagatgttacgggaatttcaatggcttcgagcaaatagtagtgttgtcagtgtcaattgcaaaggaaaagactctgaaaaaattgaagaatggcggtcacgagcagccaagtttgaagagatgtgtggactagtgatgggaatgttcactcggctctccaattgtgccaacaggacaattctttatgacatgtactcctatgtttgggatatcaagagtataatgtctatggtgaagtcttttgtacagtggttagggtgtcgtagtcattcttcagcacaattcttaattggagaccaagaaccctgggcctttagaggtggtctagcaggagagttccaggtatcaatatgaattcacaactgaattgacattttctttgttttatgagaaaccttatgttgcgcatcagatggctggaaggattggtctgccgaaggctttctagtcccaaattcaatttagttacatagctggatttttaaatcaaattttcctcctctttcacagtaatttctgaaggagatgctgccaatcccccccgcgcctgcgaagcgcagcggctctaggtatacacttcacattgtttctttgcaggtcgcacagcattttaatctgcgcccgcaatgcacaatgcgcgcatgcttgtctgccagtggaagctccatgaacaaaagatagtaattatgccaataaatggtgaaagagcttttggatatttatccaattattttataaatataatgtgcttgaaagaattgtccattgctgaaaatatgaacaaaataggaagtttttttgctgctggaatttgttcatggactttctaggtgctctacttttctccccccaacaggtgctctgctgcgcacagcaaactgaagcgcattgctttggggataaagcgtctcctggacagataaccctcttcagaccaaacctctcctcctgacattctgttctgccatcttatcgtagggagatggtctatctaagataggttttaaaaaaaaatagatttgtcataattggaataggtttgtttttgtttttgtttttgtttttactgtaaatttaaatccccattaatatgccactaaagctgtaactcagagtgggtaatttctattcagaagcactcccctcccccagcaaagaggtatttctattagtaaagcatagtacacccctcttctttaggtctgcctgcagtagccagttaatataagttggtaatctgcagtgcacacccatttaaaaaaatggataccttccccaaactaatccatctccttttttttcttcccacagcgtttgctgccaattgatggggcaaatgatctcttttttcagccacctccactgactcctacctccaaagtttatactatcagaccttattttcctaaggatgaggcatccgtgtacaagatttgcagagaaatgtatgacgatggagtgggtttaccctttcaaagtcagcctgatcttattggagacaagttagtaggagggctgctttccctcagcctggattactgctttgtcctagaagatgaagatggcatatgtggttatgccttgggcactgtagatgtgaccccctttattaaaaaatgtaaaatttcctggatccccttcatgcaggagaagtataccaagccaaatggtgacaaggaactctctgaggctgagaaaataatgttgagtttccatgaagaacaggaagtactgccagaaactttccttgctaatttcccttctctgataaagatggacattcacaaaaaagtaactgacccaagtgtggccaaaagcatgatggcttgcctcctgtcttcactgaaggctaatggctcccggggagctttctgtgaagtgagaccagatgataaaagaattctggaattttacagcaagttaggatgttttgaaattgcaaaaatggaaggatttccaaaggatgtggttatacttggtcggagcctgtgacatttgttgacactgtgaactgtccaaaagtctcttaactgcaccttgtgaatggtagttgaggtcttcatacagttcagcctctagaatggtaacaaatcagccaattggattcgaaacaaagaagactatgtaaaactcacccatcacactttgagactactcactggttggaagaatatagtattgcagcaaatcctgtatgaaagagagatgtgggcttcctttttgagtcttgtgttaggtgctgagaccttttacatgggcttatacagggagagagtcttcaataaatgtagtcagcactattttctgcatccagtgtggttgcgtttctcacctgagagtaatcaagataacatctgtcatcttccttggtttattgagtgaaatgcctctcagtcttaggggacatggcagagatgaaagaaagaaagagtgggtttcagaagtgtcagggtggagtgattccaagtgggatggttgtggcattagtttaagctgaataaataatttcaatttggggcagttattctgctttttgtaaagccgtggccaattgtctcctgtaatgactgttggttcaggcatgttgtactttgtagggacaaatgtgcatttgtttgtggcaaaagcctacaattgacaaacttgtaaatttctttgtatataaactagctgtaacctgactatcctttgtgtttactgtttttgtaaatttttttcctctataaatgaaagggtgttggttcagaatggcactttgaataatgtaaaccagtgaaaagtggattttctttacttttgtctttgggtttggggttgtttttgttctttttgaagttttattatttttaaagtgcctcccacctaggcgtaggccatgaccatttggggtacgagagcctaattttgtaggacttaatctgttgaaaagtgcagttacttctggaaattaacctcaatattaggtcagcatgtgaaatgttggatttgacatgtcaggtagggttcagggactgattggtcccatttgccctcaggtcagttgtttaatctcaagacctgttactactgattttattaaatcagagtctttaattcttgcatgtttgtatctaatttctgaacgaatgagcacactttaaccagttatttacagttacctttttcctttaaccggattgtgaaagcttcatgtattttaatttagattctgtgtttttaagggttctgagcatgaagctggcagatagtcggcaggactcattttttcatcatggctggctgatttctccatagattgataacagtattttgttatcttgcttctctgtagttttgcatcagctgtttaactttgagctgagtgaggggagaggggtaaagagaaagaaacttaagttttctttcacagaactccaccattgtgggctttgagagagccctaaagcattgtacctagtggtacctagtgacttccaaccaaagcctttgagtatgcactaaataggtgagaagaaaggagagaaggtttttaggttagaaacctttaaccgatagaaggatatggtatgttgtaaagctggaaccaagtttgcatttttgagggcttgagatgaagggaagactcttaccagatagtaagacagctgagttttcctcagttttctcgtcttaacactagtggacaattctagcattttgtttggaggatttcagagttaacctcatggaattcaggattttttagcaagtttgcttttggttttatcttggcttttagtaatcatgttggctggtctggtcacaggtgactgtgaaacagatgccctggtcttgctttcatcactctaggatcatgaagtgctatgctatttcctggttatgaatattaaggttggaattacatttttattgattgtttggatcagagctcagttcctgtagaaaacgaactgtaaaagaccatgcaagaggcaaaataaaacttgaagtgaatgct

SEQ ID NO: 329260 - DNA, 4397 bp, Homo sapiens
agtcttgctctgtcgcccagactggagtgcagtggcacaatctcggctcactgcaacctcctccgcctcccgggttcaagtgattctcctgcctcagcttcccgagtagctgggactataggtttctcagtttgggtgcagatcatttgctttgctttttgatgatatagaccataatatgtgtgcagcagacaaagaggtattcagttcttttgctcatgcccaagtctccatcacaaatgaaatctatcagtacctaggagagccagaaactttcctcttctgtcccacagaatactgtggcactttctgttatccaaatgtgtctcagtctccatatttaaggactgtgggtgaaaagcttctacctggaattgaagtgctttggacaggtcccaaagttgtttctaaagaaattccagtagagtccatcgaagaggtttctaagattattaagagagctccagtaatctgggataacattcatgctaatgattatgatcagaagagactgtttctgggcccgtacaaaggaagatccacagaactcatcccacggttaaaaggagtcctcactaatccaaattgtgaatttgaagccaactacgttgctatccacacccttgccacctggtacaaatcaaacatgaatggagtgagaaaagatgtagtgatgactgacagtgaagatagtactgtgtccatccagataaaattagaaaatgaaggcagtgatgaagatattgaaactgatgtactctatagtccacagatggctctaaagctagcattaacagaatggttgcaagagtttggtgtgcctcatcaatacagcagtaggcaagttgcacacagtggagctaaagcaagtgtagttgatgggactcctttagttgcagcaccctctttaaatgccacaaccgtagtaacaacagtttatcaggagcccattatgagccagggagcagccttgagtggtgagcctactactctgaccaaggaagaagaaaagaaacagcctgatgaagaacccatggacatggtggtggaaaaacaagaagaaacggaccacaagaatgacaatcaaatactgagtgaaattgttgaagcgaaaatggcagaggaattgaaaccaatggacactgataaagagagcatagctgaatcaaaatccccagagatgtccatgcaagaagattgtattagtgacattgcccccatgcaaactgatgaacagacaaacaaggagcagtttgtgccaggtccaaatgaaaagcctttgtacactgcggaaccagtgaccctggaggatttgcagttacttgctgatctattctaccttccttacgagcatggacccaaaggagcacagatgttacgggaatttcaatggcttcgagcaaatagtagtgttgtcagtgtcaattgcaaaggaaaagactctgaaaaaattgaagaatggcggtcacgagcagccaagtttgaagagatgtgtggactagtgatgggaatgttcactcggctctccaattgtgccaacaggacaattctttatgacatgtactcctatgtttgggatatcaagagtataatgtctatggtgaagtcttttgtacagtggttagggtgtcgtagtcattcttcagcacaattcttaattggagaccaagaaccctgggcctttagaggtggtctagcaggagagttccagcgtttgctgccaattgatggggcaaatgatctcttttttcagccacctccactgactcctacctccaaagtttatactatcagaccttattttcctaaggatgaggcatccgtgtacaagatttgcagagaaatgtatgacgatggagtgggtttaccctttcaaagtcagcctgatcttattggagacaagttagtaggagggctgctttccctcagcctggattactgctttgtcctagaagatgaagatggcatatgtggttatgccttgggcactgtagatgtgaccccctttattaaaaaatgtaaaatttcctggatccccttcatgcaggagaagtataccaagccaaatggtgacaaggaactctctgaggctgagaaaataatgttgagtttccatgaagaacaggaagtactgccagaaactttccttgctaatttcccttctctgataaagatggacattcacaaaaaagtaactgacccaagtgtggccaaaagcatgatggcttgcctcctgtcttcactgaaggctaatggctcccggggagctttctgtgaagtgagaccagatgataaaagaattctggaattttacagcaagttaggatgttttgaaattgcaaaaatggaaggatttccaaaggatgtggttatacttggtcggagcctgtgacatttgttgacactgtgaactgtccaaaagtctcttaactgcaccttgtgaatggtagttgaggtcttcatacagttcagcctctagaatggtaacaaatcagccaattggattcgaaacaaagaagactatgtaaaactcacccatcacactttgagactactcactggttggaagaatatagtattgcagcaaatcctgtatgaaagagagatgtgggcttcctttttgagtcttgtgttaggtgctgagaccttttacatgggcttatacagggagagagtcttcaataaatgtagtcagcactattttctgcatccagtgtggttgcgtttctcacctgagagtaatcaagataacatctgtcatcttccttggtttattgagtgaaatgcctctcagtcttaggggacatggcagagatgaaagaaagaaagagtgggtttcagaagtgtcagggtggagtgattccaagtgggatggttgtggcattagtttaagctgaataaataatttcaatttggggcagttattctgctttttgtaaagccgtggccaattgtctcctgtaatgactgttggttcaggcatgttgtactttgtagggacaaatgtgcatttgtttgtggcaaaagcctacaattgacaaacttgtaaatttctttgtatataaactagctgtaacctgactatcctttgtgtttactgtttttgtaaatttttttcctctataaatgaaagggtgttggttcagaatggcactttgaataatgtaaaccagtgaaaagtggattttctttacttttgtctttgggtttggggttgtttttgttctttttgaagttttattatttttaaagtgcctcccacctaggcgtaggccatgaccatttggggtacgagagcctaattttgtaggacttaatctgttgaaaagtgcagttacttctggaaattaacctcaatattaggtcagcatgtgaaatgttggatttgacatgtcaggtagggttcagggactgattggtcccatttgccctcaggtcagttgtttaatctcaagacctgttactactgattttattaaatcagagtctttaattcttgcatgtttgtatctaatttctgaacgaatgagcacactttaaccagttatttacagttacctttttcctttaaccggattgtgaaagcttcatgtattttaatttagattctgtgtttttaagggttctgagcatgaagctggcagatagtcggcaggactcattttttcatcatggctggctgatttctccatagattgataacagtattttgttatcttgcttctctgtagttttgcatcagctgtttaactttgagctgagtgaggggagaggggtaaagagaaagaaacttaagttttctttcacagaactccaccattgtgggctttgagagagccctaaagcattgtacctagtggtacctagtgacttccaaccaaagcctttgagtatgcactaaataggtgagaagaaaggagagaaggtttttaggttagaaacctttaaccgatagaaggatatggtatgttgtaaagctggaaccaagtttgcatttttgagggcttgagatgaagggaagactcttaccagatagtaagacagctgagttttcctcagttttctcgtcttaacactagtggacaattctagcattttgtttggaggatttcagagttaacctcatggaattcaggattttttagcaagtttgcttttggttttatcttggcttttagtaatcatgttggctggtctggtcacaggtgactgtgaaacagatgccctggtcttgctttcatcactctaggatcatgaagtgctatgctatttcctggttatgaatattaaggttggaattacatttttattgattgtttggatcagagctcagttcctgtagaaaacgaactgtaaaagaccatgcaagaggcaaaataaaacttgaagtgaatgct

SEQ ID NO: 329261 - DNA, 5457 bp, Homo sapiens
cagcgcaagcgcagtgcggataaacaggaagcgggcggtggaggcagcagcagagggagagctcggggcttggaggggaaacagcggaagacctaagattatcgggagggcagcagaggcagagaacgaggacaggacccttggccgtcttcttccagggaacgagaggtcacagcctcgctctccgcttatgcttctggcgccccagcttaaagccgaggctgcggctgacaaagggctcgcgccggtgccgccgcccttctcatccgggcattcgggtccctgcgagaaggagggggaaggacagagggggaggggaaggagccggaggggcgcacacttggagctgaagccctctccagggctccgggccggtgccccaacggacagaggtcgaggaggacccgcagaggtggcagcggccgggggcaggaggatggtgcagaaggagagtcaagcgacgttggaggagcgggagagcgagctcagctccaaccctgccgcctctgcgggggcatcgctggagccgccggcagctccggcacccggagaagacaaccccgccggggctgggggagcggcggtggccggggctgcaggaggggctcggcggttcctctgcggtgtggtggaaggattttatggaagaccttgggttatggaacagagaaaagaactctttagaaggctccagaaatgggaattaaatacatacttgtatgccccaaaagatgactacaaacataggatgttttggcgagagatgtattcagtggaggaagctgagcaacttatgactctcatctctgctgcacgagaatatgagatagagttcatctatgcgatctcacctggattggatatcactttttctaaccccaaggaagtatccacattgaaacgtaaattggaccaggtttctcagtttgggtgcagatcatttgctttgctttttgatgatatagaccataatatgtgtgcagcagacaaagaggtattcagttcttttgctcatgcccaagtctccatcacaaatgaaatctatcagtacctaggagagccagaaactttcctcttctgtcccacagaatactgtggcactttctgttatccaaatgtgtctcagtctccatatttaaggactgtgggtgaaaagcttctacctggaattgaagtgctttggacaggtcccaaagttgtttctaaagaaattccagtagagtccatcgaagaggtttctaagattattaagagagctccagtaatctgggataacattcatgctaatgattatgatcagaagagactgtttctgggcccgtacaaaggaagatccacagaactcatcccacggttaaaaggagtcctcactaatccaaattgtgaatttgaagccaactacgttgctatccacacccttgccacctggtacaaatcaaacatgaatggagtgagaaaagatgtagtgatgactgacagtgaagatagtactgtgtccatccagataaaattagaaaatgaaggcagtgatgaagatattgaaactgatgtactctatagtccacagatggctctaaagctagcattaacagaatggttgcaagagtttggtgtgcctcatcaatacagcagtaggcaagttgcacacagtggagctaaagcaagtgtagttgatgggactcctttagttgcagcaccctctttaaatgccacaaccgtagtaacaacagtttatcaggagcccattatgagccagggagcagccttgagtggtgagcctactactctgaccaaggaagaagaaaagaaacagcctgatgaagaacccatggacatggtggtggaaaaacaagaagaaacggaccacaagaatgacaatcaaatactgagtgaaattgttgaagcgaaaatggcagaggaattgaaaccaatggacactgataaagagagcatagctgaatcaaaatccccagagatgtccatgcaagaagattgtattagtgacattgcccccatgcaaactgatgaacagacaaacaaggagcagtttgtgccaggtccaaatgaaaagcctttgtacactgcggaaccagtgaccctggaggatttgcagttacttgctgatctattctaccttccttacgagcatggacccaaaggagcacagatgttacgggaatttcaatggcttcgagcaaatagtagtgttgtcagtgtcaattgcaaaggaaaagactctgaaaaaattgaagaatggcggtcacgagcagccaagtttgaagagatgtgtggactagtgatgggaatgttcactcggctctccaattgtgccaacaggacaattctttatgacatgtactcctatgtttgggatatcaagagtataatgtctatggtgaagtcttttgtacagtggttagggtgtcgtagtcattcttcagcacaattcttaattggagaccaagaaccctgggcctttagaggtggtctagcaggagagttccagcgtttgctgccaattgatggggcaaatgatctcttttttcagccacctccactgactcctacctccaaagtttatactatcagaccttattttcctaaggatgaggcatccgtgtacaagatttgcagagaaatgtatgacgatggagtgggtttaccctttcaaagtcagcctgatcttattggagacaagtatgtgataagtatttggatttgagagtagacctttcatagtgaggcttatcaggttgaggggaggtgatgactggaaatatatttatttattttaaatcccactttggctttagtaaaatctgaatatgtgtgcatttctagtttcttacaccaaatgtaggttccgtaagttcatgcaagtacagtgggtcttggatcactgaagtctgaattttatattagcaactgaaaagtttactgtggcctctttccttctgagcaggttagtaggagggctgctttccctcagcctggattactgctttgtcctagaagatgaagatggcatatgtggttatgccttgggcactgtagatgtgaccccctttattaaaaaatgtaaaatttcctggatccccttcatgcaggagaagtataccaagccaaatggtgacaaggaactctctgaggctgagaaaataatgttgagtttccatgaagaacaggaagtactgccagaaactttccttgctaatttcccttctctgataaagatggacattcacaaaaaagtaactgacccaagtgtggccaaaagcatgatggcttgcctcctgtcttcactgaaggctaatggctcccggggagctttctgtgaagtgagaccagatgataaaagaattctggaattttacagcaagttaggatgttttgaaattgcaaaaatggaaggatttccaaaggatgtggttatacttggtcggagcctgtgacatttgttgacactgtgaactgtccaaaagtctcttaactgcaccttgtgaatggtagttgaggtcttcatacagttcagcctctagaatggtaacaaatcagccaattggattcgaaacaaagaagactatgtaaaactcacccatcacactttgagactactcactggttggaagaatatagtattgcagcaaatcctgtatgaaagagagatgtgggcttcctttttgagtcttgtgttaggtgctgagaccttttacatgggcttatacagggagagagtcttcaataaatgtagtcagcactattttctgcatccagtgtggttgcgtttctcacctgagagtaatcaagataacatctgtcatcttccttggtttattgagtgaaatgcctctcagtcttaggggacatggcagagatgaaagaaagaaagagtgggtttcagaagtgtcagggtggagtgattccaagtgggatggttgtggcattagtttaagctgaataaataatttcaatttggggcagttattctgctttttgtaaagccgtggccaattgtctcctgtaatgactgttggttcaggcatgttgtactttgtagggacaaatgtgcatttgtttgtggcaaaagcctacaattgacaaacttgtaaatttctttgtatataaactagctgtaacctgactatcctttgtgtttactgtttttgtaaatttttttcctctataaatgaaagggtgttggttcagaatggcactttgaataatgtaaaccagtgaaaagtggattttctttacttttgtctttgggtttggggttgtttttgttctttttgaagttttattatttttaaagtgcctcccacctaggcgtaggccatgaccatttggggtacgagagcctaattttgtaggacttaatctgttgaaaagtgcagttacttctggaaattaacctcaatattaggtcagcatgtgaaatgttggatttgacatgtcaggtagggttcagggactgattggtcccatttgccctcaggtcagttgtttaatctcaagacctgttactactgattttattaaatcagagtctttaattcttgcatgtttgtatctaatttctgaacgaatgagcacactttaaccagttatttacagttacctttttcctttaaccggattgtgaaagcttcatgtattttaatttagattctgtgtttttaagggttctgagcatgaagctggcagatagtcggcaggactcattttttcatcatggctggctgatttctccatagattgataacagtattttgttatcttgcttctctgtagttttgcatcagctgtttaactttgagctgagtgaggggagaggggtaaagagaaagaaacttaagttttctttcacagaactccaccattgtgggctttgagagagccctaaagcattgtacctagtggtacctagtgacttccaaccaaagcctttgagtatgcactaaataggtgagaagaaaggagagaaggtttttaggttagaaacctttaaccgatagaaggatatggtatgttgtaaagctggaaccaagtttgcatttttgagggcttgagatgaagggaagactcttaccagatagtaagacagctgagttttcctcagttttctcgtcttaacactagtggacaattctagcattttgtttggaggatttcagagttaacctcatggaattcaggattttttagcaagtttgcttttggttttatcttggcttttagtaatcatgttggctggtctggtcacaggtgactgtgaaacagatgccctggtcttgctttcatcactctaggatcatgaagtgctatgctatttcctggttatgaatattaaggttggaattacatttttattgattgtttggatcagagctcagttcctgtagaaaacgaactgtaaaagaccatgcaagaggcaaaataaaacttgaagtgaatgct

SEQ ID NO: 329262 - DNA, 2323 bp, Homo sapiens
tgtaaacgcggcagttctggtcgtagctatagtgtaaaacgcgcagtgcatgcttgctatagagtaaccatgagggcagctcgcttgtctgttgctgatagtgataacacgaaggagaacgcaatgccaagtgtggccaaaagcatgatggcttgcctcctgtcttcactgaaggctaatggctcccggggagctttctgtgaagtgagaccagatgataaaagaattctggaattttacagcaagttaggatgttttgaaattgcaaaaatggaaggatttccaaaggatgtggttatacttggtcggagcctgtgacatttgttgacactgtgaactgtccaaaagtctcttaactgcaccttgtgaatggtagttgaggtcttcatacagttcagcctctagaatggtaacaaatcagccaattggattcgaaacaaagaagactatgtaaaactcacccatcacactttgagactactcactggttggaagaatatagtattgcagcaaatcctgtatgaaagagagatgtgggcttcctttttgagtcttgtgttaggtgctgagaccttttacatgggcttatacagggagagagtcttcaataaatgtagtcagcactattttctgcatccagtgtggttgcgtttctcacctgagagtaatcaagataacatctgtcatcttccttggtttattgagtgaaatgcctctcagtcttaggggacatggcagagatgaaagaaagaaagagtgggtttcagaagtgtcagggtggagtgattccaagtgggatggttgtggcattagtttaagctgaataaataatttcaatttggggcagttattctgctttttgtaaagccgtggccaattgtctcctgtaatgactgttggttcaggcatgttgtactttgtagggacaaatgtgcatttgtttgtggcaaaagcctacaattgacaaacttgtaaatttctttgtatataaactagctgtaacctgactatcctttgtgtttactgtttttgtaaatttttttcctctataaatgaaagggtgttggttcagaatggcactttgaataatgtaaaccagtgaaaagtggattttctttacttttgtctttgggtttggggttgtttttgttctttttgaagttttattatttttaaagtgcctcccacctaggcgtaggccatgaccatttggggtacgagagcctaattttgtaggacttaatctgttgaaaagtgcagttacttctggaaattaacctcaatattaggtcagcatgtgaaatgttggatttgacatgtcaggtagggttcagggactgattggtcccatttgccctcaggtcagttgtttaatctcaagacctgttactactgattttattaaatcagagtctttaattcttgcatgtttgtatctaatttctgaacgaatgagcacactttaaccagttatttacagttacctttttcctttaaccggattgtgaaagcttcatgtattttaatttagattctgtgtttttaagggttctgagcatgaagctggcagatagtcggcaggactcattttttcatcatggctggctgatttctccatagattgataacagtattttgttatcttgcttctctgtagttttgcatcagctgtttaactttgagctgagtgaggggagaggggtaaagagaaagaaacttaagttttctttcacagaactccaccattgtgggctttgagagagccctaaagcattgtacctagtggtacctagtgacttccaaccaaagcctttgagtatgcactaaataggtgagaagaaaggagagaaggtttttaggttagaaacctttaaccgatagaaggatatggtatgttgtaaagctggaaccaagtttgcatttttgagggcttgagatgaagggaagactcttaccagatagtaagacagctgagttttcctcagttttctcgtcttaacactagtggacaattctagcattttgtttggaggatttcagagttaacctcatggaattcaggattttttagcaagtttgcttttggttttatcttggcttttagtaatcatgttggctggtctggtcacaggtgactgtgaaacagatgccctggtcttgctttcatcactctaggatcatgaagtgctatgctatttcctggttatgaatattaaggttggaattacatttttattgattgtttggatcagagctcagttcctgtagaaaacgaactgtaaaagaccatgcaagaggcaaaataaaacttgaagtgaatgct

SEQ ID NO: 329263 - DNA, 3506 bp, Homo sapiens
cagcgcaagcgcagtgcggataaacaggaagcgggcggtggaggcagcagcagagggagagctcggggcttggaggggaaacagcggaagacctaagattatcgggagggcagcagaggcagagaacgaggacaggacccttggccgtcttcttccagggaacgagaggtcacagcctcgctctccgcttatgcttctggcgccccagcttaaagccgaggctgcggctgacaaagggctcgcgccggtgccgccgcccttctcatccgggcattcgggtccctgcgagaaggagggggaaggacagagggggaggggaaggagccggaggggcgcacacttggagctgaagccctctccagggctccgggccggtgccccaacggacagaggtcgaggaggacccgcagaggtggcagcggccgggggcaggaggatggtgcagaaggagagtcaagcgacgttggaggagcgggagagcgagctcagctccaaccctgccgcctctgcgggggcatcgctggagccgccggcagctccggcacccggagaagacaaccccgccggggctgggggagcggcggtggccggggctgcaggaggggctcggcggttcctctgcggtgtggtggaaggattttatggaagaccttgggttatggaacagagaaaagaactctttagaaggctccagaaatgggaattaaatacatacttgtatgccccaaaagatgactacaaacataggatgttttggcgagagatgtattcagtggaggaagctgagcaacttatgactctcatctctgctgcacgagaatatgagatagagttcatctatgcgatctcacctggattggatatcactttttctaaccccaaggaagtatccacattgaaacgtaaattggaccaggtttctcagtttgggtgcagatcatttgctttgctttttgatgatatagaccataatatgtgtgcagcagacaaagaggtattcagttcttttgctcatgcccaagtctccatcacaaatgaaatctatcagtacctaggagagccagaaactttcctcttctgtcccacagaatactgtggcactttctgttatccaaatgtgtctcagtctccatatttaaggactgtgggtgaaaagcttctacctggaattgaagtgctttggacaggtcccaaagttgtttctaaagaaattccagtagagtccatcgaagaggtttctaagattattaagagagctccagtaatctgggataacattcatgctaatgattatgatcagaagagactgtttctgggcccgtacaaaggaagatccacagaactcatcccacggttaaaaggagtcctcactaatccaaattgtgaatttgaagccaactacgttgctatccacacccttgccacctggtacaaatcaaacatgaatggagtgagaaaagatgtagtgatgactgacagtgaagatagtactgtgtccatccagataaaattagaaaatgaaggcagtgatgaagatattgaaactgatgtactctatagtccacagatggctctaaagctagcattaacagaatggttgcaagagtttggtgtgcctcatcaatacagcagtaggcaagttgcacacagtggagctaaagcaagtgtagttgatgggactcctttagttgcagcaccctctttaaatgccacaaccgtagtaacaacagtttatcaggagcccattatgagccagggagcagccttgagtggtgagcctactactctgaccaaggaagaagaaaagaaacagcctgatgaagaacccatggacatggtggtggaaaaacaagaagaaacggaccacaagaatgacaatcaaatactgagtgaaattgttgaagcgaaaatggcagaggaattgaaaccaatggacactgataaagagagcatagctgaatcaaaatccccagagatgtccatgcaagaagattgtattagtgacattgcccccatgcaaactgatgaacagacaaacaaggagcagtttgtgccaggtccaaatgaaaagcctttgtacactgcggaaccagtgaccctggaggatttgcagttacttgctgatctattctaccttccttacgagcatggacccaaaggagcacagatgttacgggaatttcaatggcttcgagcaaatagtagtgttgtcagtgtcaattgcaaaggaaaagactctgaaaaaattgaagaatggcggtcacgagcagccaagtttgaagagatgtgtggactagtgatgggaatgttcactcggctctccaattgtgccaacaggacaattctttatgacatgtactcctatgtttgggatatcaagagtataatgtctatggtgaagtcttttgtacagtggttagggtgtcgtagtcattcttcagcacaattcttaattggagaccaagaaccctgggcctttagaggtggtctagcaggagagttccagcgtttgctgccaattgatggggcaaatgatctcttttttcagccacctccactgactcctacctccaaagtttatactatcagaccttattttcctaaggatgaggcatccgtgtacaagatttgcagagaaatgtatgacgatggagtgggtttaccctttcaaagtcagcctgatcttattggagacaagttagtaggagggctgctttccctcagcctggattactgctttgtcctagaagatgaagatggcatatgtggttatgccttgggcactgtagatgtgaccccctttattaaaaaatgtaaaatttcctggatccccttcatgcaggagaagtataccaagccaaatggtgacaaggaactctctgaggctgagaaaataatgttgagtttccatgaagaacaggaagtactgccagaaactttccttgctaatttcccttctctgataaagatggacattcacaaaaaagtaactgacccaagtgtggccaaaagcatgatggcttgcctcctgtcttcactgaaggctaatggctcccggggagctttctgtgaagtgagaccagatgataaaagaattctggaattttacagcaagttaggatgttttgaaattgcaaaaatggaaggatttccaaaggatgtggttatacttggtcggagcctgtgacatttgttgacactgtgaactgtccaaaagtctcttaactgcaccttgtgaatggtagttgaggtcttcatacagttcagcctctagaatggtaacaaatcagccaattggattcgaaacaaagaagactatgtaaaactcacccatcacactttgagactactcactggttggaagaatatagtattgcagcaaatcctgtatgaaagagagatgtgggcttcctttttgagtcttgtgttaggtgctgagaccttttacatgggcttatacagggagagagtcttcaataaatgtagtcagcactattttctgcatc

SEQ ID NO: 329264 - DNA, 4155 bp, Homo sapiens
cagcgcaagcgcagtgcggataaacaggaagcgggcggtggaggcagcagcagagggagagctcggggcttggaggggaaacagcggaagacctaagattatcgggagggcagcagaggcagagaacgaggacaggacccttggccgtcttcttccagggaacgagaggtcacagcctcgctctccgcttatgcttctggcgccccagcttaaagccgaggctgcggctgacaaagggctcgcgccggtgccgccgcccttctcatccgggcattcgggtccctgcgagaaggagggggaaggacagagggggaggggaaggagccggaggggcgcacacttggagctgaagccctctccagggctccgggccggtgccccaacggacagaggtcgaggaggacccgcagaggtggcagcggccgggggcaggaggatggtgcagaaggagagtcaagcgacgttggaggagcgggagagcgagctcagctccaaccctgccgcctctgcgggggcatcgctggagccgccggcagctccggcacccggagaagacaaccccgccggggctgggggagcggcggtggccggggctgcaggaggggctcggcggttcctctgcggtgtggtggaaggattttatggaagaccttgggttatggaacagagaaaagaactctttagaaggctccagaaatgggaattaaatacatacttgtatgccccaaaagatgactacaaacataggatgttttggcgagagatgtattcagtggaggaagctgagcaacttatgactctcatctctgctgcacgagaatatgagatagagttcatctatgcgatctcacctggattggatatcactttttctaaccccaaggaagtatccacattgaaacgtaaattggaccaggtttctcagtttgggtgcagatcatttgctttgctttttgatgatatagaccataatatgtgtgcagcagacaaagaggtattcagttcttttgctcatgcccaagtctccatcacaaatgaaatctatcagtacctaggagagccagaaactttcctcttctgtcccacagaatactgtggcactttctgttatccaaatgtgtctcagtctccatatttaaggactgtgggtgaaaagcttctacctggaattgaagtgctttggacaggtcccaaagttgtttctaaagaaattccagtagagtccatcgaagaggtttctaagattattaagagagctccagtaatctgggataacattcatgctaatgattatgatcagaagagactgtttctgggcccgtacaaaggaagatccacagaactcatcccacggttaaaaggagtcctcactaatccaaattgtgaatttgaagccaactacgttgctatccacacccttgccacctggtacaaatcaaacatgaatggagtgagaaaagatgtagtgatgactgacagtgaagatagtactgtgtccatccagataaaattagaaaatgaaggcagtgatgaagatattgaaactgatgtactctatagtccacagatggctctaaagctagcattaacagaatggttgcaagagtttggtgtgcctcatcaatacagcagtaggcaagttgcacacagtggagctaaagcaagtgtagttgatgggactcctttagttgcagcaccctctttaaatgccacaaccgtagtaacaacagtttatcaggagcccattatgagccagggagcagccttgagtggtgagcctactactctgaccaaggaagaagaaaagaaacagcctgatgaagaacccatggacatggtggtggaaaaacaagaagaaacggaccacaagaatgacaatcaaatactgagtgaaattgttgaagcgaaaatggcagaggaattgaaaccaatggacactgataaagagagcatagctgaatcaaaatccccagagatgtccatgcaagaagattgtattagtgacattgcccccatgcaaactgatgaacagacaaacaaggagcagtttgtgccaggtccaaatgaaaagcctttgtacactgcggaaccagtgaccctggaggatttgcagttacttgctgatctattctaccttccttacgagcatggacccaaaggagcacagatgttacgggaatttcaatggcttcgagcaaatagtagtgttgtcagtgtcaattgcaaaggaaaagactctgaaaaaattgaagaatggcggtcacgagcagccaagtttgaagagatgtgtggactagtgatgggaatgttcactcggctctccaattgtgccaacaggacaattctttatgacatgtactcctatgtttgggatatcaagagtataatgtctatggtgaagtcttttgtacagtggttagggtgtcgtagtcattcttcagcacaattcttaattggagaccaagaaccctgggcctttagaggtggtctagcaggagagttccagcgtttgctgccaattgatggggcaaatgatctcttttttcagccacctccactgactcctacctccaaagtttatactatcagaccttattttcctaaggatgaggcatccgtgtacaagatttgcagagaaatgtatgacgatggagtgggtttaccctttcaaagtcagcctgatcttattggagacaagttagtaggagggctgctttccctcagcctggattactgctttgtcctagaagatgaagatggcatatgtggttatgccttgggcactgtagatgtgaccccctttattaaaaaatgtaaaatttcctggatccccttcatgcaggagaagtataccaagccaaatggtgacaaggaactctctgaggctgagaaaataatgttgagtttccatgaagaacaggaagtactgccagaaactttccttgctaatttcccttctctgataaagatggacattcacaaaaaagtaactgacccaagtgtggccaaaagcatgatggcttgcctcctgtcttcactgaaggctaatggctcccggggagctttctgtgaagtgagaccagatgataaaagaattctggaattttacagcaagttaggatgttttgaaattgcaaaaatggaaggatttccaaaggatgtggttatacttggtcggagcctgtgacatttgttgacactgtgaactgtccaaaagtctcttaactgcaccttgtgaatggtagttgaggtcttcatacagttcagcctctagaatggtaacaaatcagccaattggattcgaaacaaagaagactatgtaaaactcacccatcacactttgagactactcactggttggaagaatatagtattgcagcaaatcctgtatgaaagagagatgtgggcttcctttttgagtcttgtgttaggtgctgagaccttttacatgggcttatacagggagagagtcttcaataaatgtagtcagcactattttctgcatccagtgtggttgcgtttctcacctgagagtaatcaagataacatctgtcatcttccttggtttattgagtgaaatgcctctcagtcttaggggacatggcagagatgaaagaaagaaagagtgggtttcagaagtgtcagggtggagtgattccaagtgggatggttgtggcattagtttaagctgaataaataatttcaatttggggcagttattctgctttttgtaaagccgtggccaattgtctcctgtaatgactgttggttcaggcatgttgtactttgtagggacaaatgtgcatttgtttgtggcaaaagcctacaattgacaaacttgtaaatttctttgtatataaactagctgtaacctgactatcctttgtgtttactgtttttgtaaatttttttcctctataaatgaaagggtgttggttcagaatggcactttgaataatgtaaaccagtgaaaagtggattttctttacttttgtctttgggtttggggttgtttttgttctttttgaagttttattatttttaaagtgcctcccacctaggcgtaggccatgaccatttggggcccagacccaaatcttattggtctttattttgtctaaaagagccgtctctctgtgtatttaactctcgtat

SEQ ID NO: 329265 - DNA, 4368 bp, Homo sapiens
cagcgcaagcgcagtgcggataaacaggaagcgggcggtggaggcagcagcagagggagagctcggggcttggaggggaaacagcggaagacctaagattatcgggagggcagcagaggcagagaacgaggacaggacccttggccgtcttcttccagggaacgagaggtcacagcctcgctctccgcttatgcttctggcgccccagcttaaagccgaggctgcggctgacaaagggctcgcgccggtgccgccgcccttctcatccgggcattcgggtccctgcgagaaggagggggaaggacagagggggaggggaaggagccggaggggcgcacacttggagctgaagccctctccagggctccgggccggtgccccaacggacagaggtcgaggaggacccgcagaggtggcagcggccgggggcaggaggatggtgcagaaggagagtcaagcgacgttggaggagcgggagagcgagctcagctccaaccctgccgcctctgcgggggcatcgctggagccgccggcagctccggcacccggagaagacaaccccgccggggctgggggagcggcggtggccggggctgcaggaggggctcggcggttcctctgcggtgtggtggaaggattttatggaagaccttgggttatggaacagagaaaagaactctttagaaggctccagaaatgggaattaaatacatacttgtatgccccaaaagatgactacaaacataggatgttttggcgagagatgtattcagtggaggaagctgagcaacttatgactctcatctctgctgcacgagaatatgagatagagttcatctatgcgatctcacctggattggatatcactttttctaaccccaaggaagtatccacattgaaacgtaaattggaccaggtttctcagtttgggtgcagatcatttgctttgctttttgatgatatagaccataatatgtgtgcagcagacaaagaggtattcagttcttttgctcatgcccaagtctccatcacaaatgaaatctatcagtacctaggagagccagaaactttcctcttctgtcccacagaatactgtggcactttctgttatccaaatgtgtctcagtctccatatttaaggactgtgggtgaaaagcttctacctggaattgaagtgctttggacaggtcccaaagttgtttctaaagaaattccagtagagtccatcgaagaggtttctaagattattaagagagctccagtaatctgggataacattcatgctaatgattatgatcagaagagactgtttctgggcccgtacaaaggaagatccacagaactcatcccacggttaaaaggagtcctcactaatccaaattgtgaatttgaagccaactacgttgctatccacacccttgccacctggtacaaatcaaacatgaatggagtgagaaaagatgtagtgatgactgacagtgaagatagtactgtgtccatccagataaaattagaaaatgaaggcagtgatgaagatattgaaactgatgtactctatagtccacagatggctctaaagctagcattaacagaatggttgcaagagtttggtgtgcctcatcaatacagcagtaggcaagttgcacacagtggagctaaagcaagtgtagttgatgggactcctttagttgcagcaccctctttaaatgccacaaccgtagtaacaacagtttatcaggagcccattatgagccagggagcagccttgagtggtgagcctactactctgaccaaggaagaagaaaagaaacagcctgatgaagaacccatggacatggtggtggaaaaacaagaagaaacggaccacaagaatgacaatcaaatactgagtgaaattgttgaagcgaaaatggcagaggaattgaaaccaatggacactgataaagagagcatagctgaatcaaaatccccagagatgtccatgcaagaagattgtattagtgacattgcccccatgcaaactgatgaacagacaaacaaggagcagtttgtgccaggtccaaatgaaaagcctttgtacactgcggaaccagtgaccctggaggatttgcagttacttgctgatctattctaccttccttacgagcatggacccaaaggagcacagatgttacgggaatttcaatggcttcgagcaaatagtagtgttgtcagtgtcaattgcaaaggaaaagactctgaaaaaattgaagaatggcggtcacgagcagccaagtttgaagagatgtgtggactagtgatgggaatgttcactcggctctccaattgtgccaacaggacaattctttatgacatgtactcctatgtttgggatatcaagagtataatgtctatggtgaagtcttttgtacagtggttaggtaggtgcaccaggaataatctcttctcctcaaatatattgtccctttaaaaaaaattatcccacagggagaaaaacatttagggaattggcacatttccaagtctcttcaattcgttgcctaggtttctttcaaaaataggcattattgaagacttgagatgcaagtcttagtaaatacatcaagcacattaatttttctcccttgggctaattcagcataagtatcttaaaagtatgttagaaagtactgactttaacttgctctgactgaatgctttctggatggaaccctgtataccacttttatctgatttggagatgagacactatgaaatgtgactccacaagctttctgctgcttgctgtgtcttgataacattaatgctatgtttaacagaacaattgctgaaatgacctaaagggcctggcaagaggaagccatcctcccagccctgtgcgcatgcgagctttagtgtaaggctattctggtgctattcagtattatttcacgtggctttttctttatccttctaccaagtattggttttaccaggggatagaaattgtaatcccctaaacatctctgctacattaaatggacttttgtatgtctcctttgaacactgattttttttttttaaattgtcaaacttggtaaaaagcaccagcatggccaagtttctctagggacttcatttcattttcaggttttcaatccagctataaggaatatgtaatggacttatatacagcacacagcaggcagcaaggctgactgacatgtcatagttttcatagtagtcacaaatactatgatgggtttcatggtcttggttgtgaaatagatatctgaaacaccgtgagcttagaataaaaagtagtagtgagattttccactttctgcctgtatacctttgagctcttaaatatttaaaaaaaaaaaaaaaaagtttccctgtgatacaactaattagctactaaaagtagagtctcagattgttaatttgaaaatagataactttttttggattgctgtaataacaggtagaagagagtattttgacctcatgttaaaaggctctgtatagcttcgggcgcggttgctcacccctgtaatcccagcgctcttggtggctgaggtgggtggatcacttgagatcaggagttcgagaccagcctggtgaaaaccagcatgagaccagcatggtgaaaccctatctctactaaaaaaatacaaaaattagccaggcgtggtggcgcatgcctgtaatcccagctacttgagaggctgaggcaggagaattgcttgaactcaggaggcagaggttgcagtgagctgagatcacaccattgcactccagcctgggcgatagagggagactccatctcaaaataaatacaataaataaaggaaatactgaccgtgcgcagcggctcaacactcccgacctcaggtgatacagaacctccttcaggctccccacagttgctacggattaatacggcggtgaagccaccacgagcctggacttcatttacctccactagatctattttctactatttcaccctttactgacctataggtcacatggatgtgtaccaaggaggacatggcccaggttgacgacaccacgtcaatagggaattacaactgacacctatggcaggcgagttgaggctgactgaatgtattgcggtcgccccatctgaacacatgacggcactacacacctgtacaacaatggtggaatctatcagtccatgacatcatggacatgcagcgacgcactacgcagcagaactctagctataaaacgaagtcactccagactgcatgtacacaacactgcagacctaagacaattggagcagcgcacgcgggatcaactagaactatcccgacaggagtccagagtacacagctaaacctgtacctcacgaga

SEQ ID NO: 329266 - DNA, 3358 bp, Homo sapiens
  misc_feature (3277)..(3277): n is a, c, g, or t
  misc_feature (3327)..(3327): n is a, c, g, or t
  misc_feature (3330)..(3330): n is a, c, g, or t
cagcgcaagcgcagtgcggataaacaggaagcgggcggtggaggcagcagcagagggagagctcggggcttggaggggaaacagcggaagacctaagattatcgggagggcagcagaggcagagaacgaggacaggacccttggccgtcttcttccagggaacgagaggtcacagcctcgctctccgcttatgcttctggcgccccagcttaaagccgaggctgcggctgacaaagggctcgcgccggtgccgccgcccttctcatccgggcattcgggtccctgcgagaaggagggggaaggacagagggggaggggaaggagccggaggggcgcacacttggagctgaagccctctccagggctccgggccggtgccccaacggacagaggtcgaggaggacccgcagaggtggcagcggccgggggcaggaggatggtgcagaaggagagtcaagcgacgttggaggagcgggagagcgagctcagctccaaccctgccgcctctgcgggggcatcgctggagccgccggcagctccggcacccggagaagacaaccccgccggggctgggggagcggcggtggccggggctgcaggaggggctcggcggttcctctgcggtgtggtggaaggattttatggaagaccttgggttatggaacagagaaaagaactctttagaaggctccagaaatgggaattaaatacatacttgtatgccccaaaagatgactacaaacataggatgttttggcgagagatgtattcagtggaggaagctgagcaacttatgactctcatctctgctgcacgagaatatgagatagagttcatctatgcgatctcacctggattggatatcactttttctaaccccaaggaagtatccacattgaaacgtaaattggaccaggtttctcagtttgggtgcagatcatttgctttgctttttgatgatatagaccataatatgtgtgcagcagacaaagaggtattcagttcttttgctcatgcccaagtctccatcacaaatgaaatctatcagtacctaggagagccagaaactttcctcttctgtcccacagaatactgtggcactttctgttatccaaatgtgtctcagtctccatatttaaggactgtgggtgaaaagcttctacctggaattgaagtgctttggacaggtcccaaagttgtttctaaagaaattccagtagagtccatcgaagaggtttctaagattattaagagagctccagtaatctgggataacattcatgctaatgattatgatcagaagagactgtttctgggcccgtacaaaggaagatccacagaactcatcccacggttaaaaggagtcctcactaatccaaattgtgaatttgaagccaactacgttgctatccacacccttgccacctggtacaaatcaaacatgaatggagtgagaaaagatgtagtgatgactgacagtgaagatagtactgtgtccatccagataaaattagaaaatgaaggcagtgatgaagatattgaaactgatgtactctatagtccacagatggctctaaagctagcattaacagaatggttgcaagagtttggtgtgcctcatcaatacagcagtaggcaagttgcacacagtggagctaaagcaagtgtagttgatgggactcctttagttgcagcaccctctttaaatgccacaaccgtagtaacaacagtttatcaggagcccattatgagccagggagcagccttgagtggtgagcctactactctgaccaaggaagaagaaaagaaacagcctgatgaagaacccatggacatggtggtggaaaaacaagaagaaacggaccacaagaatgacaatcaaatactgagtgaaattgttgaagcgaaaatggcagaggaattgaaaccaatggacactgataaagagagcatagctgaatcaaaatccccagagatgtccatgcaagaagattgtattagtgacattgcccccatgcaaactgatgaacagacaaacaaggagcagtttgtgccaggtccaaatgaaaagcctttgtacactgcggaaccagtgaccctggaggatttgcagttacttgctgatctattctaccttccttacgagcatggacccaaaggagcacagatgttacgggaatttcaatggcttcgagcaaatagtagtgttgtcagtgtcaattgcaaaggaaaagactctgaaaaaattgaagaatggcggtcacgagcagccaagtttgaagagatgtgtggactagtgatgggaatgttcactcggctctccaattgtgccaacaggacaattctttatgacatgtactcctatgtttgggatatcaagagtataatgtctatggtgaagtcttttgtacagtggttagggtgtcgtagtcattcttcagcacaattcttaattggagaccaagaaccctgggcctttagaggtggtctagcaggagagttccagcgtttgctgccaattgatggggcaaatgatctcttttttcagccacctccactgactcctacctccaaagtttatactatcagaccttattttcctaaggatgaggcatccgtgtacaagatttgcagagaaatgtatgacgatggagtgggtttaccctttcaaagtcagcctgatcttattggagacaagttagtaggagggctgctttccctcagcctggattactgctttgtcctagaagatgaagatggcatatgtggttatgccttgggcactgtagatgtgaccccctttattaaaaaatgtaaaatttcctggatccccttcatgcaggagaagtataccaagccaaatggtgacaaggaactctctgaggctgagaaaataatgttgagtttccatgaagaacaggaagtactgccagaaactttccttgctaatttcccttctctgataaagatggacattcacaaaaaagtaactgacccaagtgtggccaaaagcatgatggcttgcctcctgtcttcactgaaggctaatggtgagtacatatttgtggagttggtggtatttgggcaagatagggaaagaactatatatttttggatataaaaggaaagaagtgaattgtaaatttatactgcttttcccaccttttatgatttggtttctgaattaattagtggtgaagaatcgcatgtgtattaataattgagaaatgctggctggtctcaaactcctggactcaagtgatcctcccacttcggnctcccgaagtgctaggattacaagcatgagccactaagccgcgacgcggncgngaatttagtagtaggagtcgacccggga

SEQ ID NO: 329267 - DNA, 3614 bp, Homo sapiens
cagcgcaagcgcagtgcggataaacaggaagcgggcggtggaggcagcagcagagggagagctcggggcttggaggggaaacagcggaagacctaagattatcgggagggcagcagaggcagagaacgaggacaggacccttggccgtcttcttccagggaacgagaggtcacagcctcgctctccgcttatgcttctggcgccccagcttaaagccgaggctgcggctgacaaagggctcgcgccggtgccgccgcccttctcatccgggcattcgggtccctgcgagaaggagggggaaggacagagggggaggggaaggagccggaggggcgcacacttggagctgaagccctctccagggctccgggccggtgccccaacggacagaggtcgaggaggacccgcagaggtggcagcggccgggggcaggaggatggtgcagaaggagagtcaagcgacgttggaggagcgggagagcgagctcagctccaaccctgccgcctctgcgggggcatcgctggagccgccggcagctccggcacccggagaagacaaccccgccggggctgggggagcggcggtggccggggctgcaggaggggctcggcggttcctctgcggtgtggtggaaggattttatggaagaccttgggttatggaacagagaaaagaactctttagaaggctccagaaatgggaattaaatacatacttgtatgccccaaaagatgactacaaacataggatgttttggcgagagatgtattcagtggaggaagctgagcaacttatgactctcatctctgctgcacgagaatatgagatagagttcatctatgcgatctcacctggattggatatcactttttctaaccccaaggaagtatccacattgaaacgtaaattggaccaggtttctcagtttgggtgcagatcatttgctttgctttttgatgatatagaccataatatgtgtgcagcagacaaagaggtattcagttcttttgctcatgcccaagtctccatcacaaatgaaatctatcagtacctaggagagccagaaactttcctcttctgtcccacagaatactgtggcactttctgttatccaaatgtgtctcagtctccatatttaaggactgtgggtgaaaagcttctacctggaattgaagtgctttggacaggtcccaaagttgtttctaaagaaattccagtagagtccatcgaagaggtttctaagattattaagagagctccagtaatctgggataacattcatgctaatgattatgatcagaagagactgtttctgggcccgtacaaaggaagatccacagaactcatcccacggttaaaaggagtcctcactaatccaaattgtgaatttgaagccaactacgttgctatccacacccttgccacctggtacaaatcaaacatgaatggagtgagaaaagatgtagtgatgactgacagtgaagatagtactgtgtccatccagataaaattagaaaatgaaggcagtgatgaagatattgaaactgatgtactctatagtccacagatggctctaaagctagcattaacagaatggttgcaagagtttggtgtgcctcatcaatacagcagtaggcaagttgcacacagtggagctaaagcaagtgtagttgatgggactcctttagttgcagcaccctctttaaatgccacaaccgtagtaacaacagtttatcaggagcccattatgagccagggagcagccttgagtggtgagcctactactctgaccaaggaagaagaaaagaaacagcctgatgaagaacccatggacatggtggtggaaaaacaagaagaaacggaccacaagaatgacaatcaaatactgagtgaaattgttgaagcgaaaatggcagaggaattgaaaccaatggacactgataaagagagcatagctgaatcaaaatccccagagatgtccatgcaagaagattgtattagtgacattgcccccatgcaaactgatgaacagacaaacaaggagcagtttgtgccaggtccaaatgaaaagcctttgtacactgcggaaccagtgaccctggaggatttgcagttacttgctgatctattctaccttccttacgagcatggacccaaaggagcacagatgttacgggaatttcaatggcttcgagcaaatagtagtgttgtcagtgtcaattgcaaaggaaaagactctgaaaaaattgaagaatggcggtcacgagcagccaagtttgaagagatgtgtggactagtgatgggaatgttcactcggctctccaattgtgccaacaggacaattctttatgacatgtactcctatgtttgggatatcaagagtataatgtctatggtgaagtcttttgtacagtggttagggtgtcgtagtcattcttcagcacaattcttaattggagaccaagaaccctgggcctttagaggtggtctagcaggagagttccaggtatcaatatgaattcacaactgaattgacattttctttgttttatgagaaaccttatgttgcgcatcagatggctggaaggattggtctgccgaaggctttctagtcccaaattcaatttagttacatagctggatttttaaatcaaattttcctcctctttcacagtaatttctgaaggagatgctgccaatcccccccgcgcctgcgaagcgcagcggctctaggtatacacttcacattgtttctttgcaggtcgcacagcattttaatctgcgcccgcaatgcacaatgcgcgcatgcttgtctgccagtggaagctccatgaacaaaagatagtaattatgccaataaatggtgaaagagcttttggatatttatccaattattttataaatataatgtgcttgaaagaattgtccattgctgaaaatatgaacaaaataggaagtttttttgctgctggaatttgttcatggactttctaggtgctctacttttctccccccaacaggtgctctgctgcgcacagcaaactgaagcgcattgctttggggataaagcgtctcctggacagataaccctcttcagaccaaacctctcctcctgacattctgttctgccatcttatcgtagggagatggtctatctaagataggttttaaaaaaaaatagatttgtcataattggaataggtttgtttttgtttttgtttttgtttttactgtaaatttaaatccccattaatatgccactaaagctgtaactcagagtgggtaatttctattcagaagcactcccctcccccagcaaagaggtatttctattagtaaagcatagtacacccctcttctttaggtctgcctgcagtagccagttaatataagttggtaatctgcagtgcacacccatttaaaaaaatggataccttccccaaactaatccatctctactaaaaatacaaaaaaaaattagctgggtgtggtggcgggtgcctgtaatgccagctactcaggaggctgaggcaggagaattgcttgaacccgggagcgggaggttgcagtgagctgagatggcgccactgcactccagccggggcagcagagtg

SEQ ID NO: 329268 - DNA, 1537 bp, Homo sapiens
cagcgcaagcgcagtgcggataaacaggaagcgggcggtggaggcagcagcagagggagagctcggggcttggaggggaaacagcggaagacctaagattatcgggagggcagcagaggcagagaacgaggacaggacccttggccgtcttcttccagggaacgagaggtcacagcctcgctctccgcttatgcttctggcgccccagcttaaagccgaggctgcggctgacaaagggctcgcgccggtgccgccgcccttctcatccgggcattcgggtccctgcgagaaggagggggaaggacagagggggaggggaaggagccggaggggcgcacacttggagctgaagccctctccagggctccgggccggtgccccaacggacagaggtcgaggaggacccgcagaggtggcagcggccgggggcaggaggatggtgcagaaggagagtcaagcgacgttggaggagcgggagagcgagctcagctccaaccctgccgcctctgcgggggcatcgctggagccgccggcagctccggcacccggagaagacaaccccgccggggctgggggagcggcggtggccggggctgcaggaggggctcggcggttcctctgcggtgtggtggaaggattttatggaagaccttgggttatggaacagagaaaagaactctttagaaggctccagaaatgggaattaaatacatacttgtatgccccaaaagatgactacaaacataggatgttttggcgagagatgtattcagtggaggaagctgagcaacttatgactctcatctctgctgcacgagaatatgagatagagttcatctatgcgatctcacctggattggatatcactttttctaaccccaaggaagtatccacattgaaacgtaaattggaccaggtttctcagtttgggtgcagatcatttgctttgctttttgatgatatagaccataatatgtgtgcagcagacaaagaggtattcagttcttttgctcatgcccaagtctccatcacaaatgaaatctatcagtacctaggagagccagaaactttcctcttctgtcccacagaatactgtggcactttctgttatccaaatgtgtctcagtctccatatttaaggactgtgggtgaaaagcttctacctggaattgaagtgctttggacaggtcccaaagttgtttctaaagaaattccagtagagtccatcgaagaggtttctaagattattaagagagctccagtaatctgggataacattcatgctaatgattatgatcagaagagactgtttctgggcccgtacaaaggaagatccacagaactcatcccacggttaaaaggagtcctcactaatccaaattgtgaatttgaagccaactacgttgctatccacacccttgccacctggtacaaatcaaacatgaatggagtgagaaaagatgtagtgatgactgacagtgaagatagtgctgtggacacccagataatgttaatagctgtttcctcatctaaagcg

SEQ ID NO: 329269 - DNA, 2789 bp, Homo sapiens
agtgagccgaggagccttcatagggacagccgcccctggtgcacacaccctcgtattctcctgcccttccccagccaggcgggcaccacggcaggggctgagctaccctcatggaagggagaggaccgtaccggatctacgaccctgggggcagcgtgccctcaggagaggcatccgcagcttttgagcgcctagtgaaggagaattcccggctgaaggaaaaaatgcaagggataaagatgttaggggagcttttggaagagtcccagatggaagcgaccaggctccggcagaaggcagaggagctagtgaaggacaacgagctgctcccaccaccttctccctccttgggctccttcgaccccctggctgagctcacaggaaaggactcaaatgtcacagcatctcccacagcccctgcatgccccagtgacaagccagcaccagtccagaagcctccatccagtggcacctcctctgaatttgaagtggtcactcctgaggagcagaattcaccagagagcagcagccatgccaatgcgatggcgctgggccccctgccccgtgaggacggcaacctgatgctgcacctgcagcgcctggagaccacgctgagtgtgtgtgccgaggagccggaccacggccagctcttcacccacctgggccgcatggccctggagttcaaccgactggcatccaaggtgcacaagaatgagcagcgcacctccattctgcagaccctgtgtgagcagcttcggaaggagaacgaggctctgaaggccaagttggataagggcctggaacagcgggatcaggctgccgagaggctgcgggaggaaaatttggagctcaagaagttgttgatgagcaatggcaacaaagagggtgcgtctgggcggccaggctcaccgaagatggaagggacaggcaagaaggcagtggctggacagcagcaggctagtgtgacggcaggtaaggtcccagaggtggtggccttgggcgcagccgagaagaaggtgaagatgctggagcagcagcgcagtgagctgctggaagtgaacaagcagtgggaccagcatttccggtccatgaagcagcagtatgagcagaagatcactgagctgcgtcagaagctggctgatttgcagaagcaggtgactgacctggaggccgagcgggagcagaagcagcgtgactttgaccgcaagctcctcctggccaagtccaagattgaaatggaggagaccgacaaggagcagctgacagcagaggccaaggagctgcgccaaaaggtcaagtacctgcaggatcagctgagcccactcacccgacagcgtgagtaccaggaaaaggagatccagcggctcaacaaggccctggaggaagcactgagcatccaaaccccgccatcatctccaccaacagcatttgggagcccagaaggagcaggggccctcctaaggaaacaggagctggtcacgcagaatgagttgctgaaacagcaggtgaagatcttcgaggaggacttccagagggagcgcagtgatcgtgagcgcatgaatgaggagaaggaagagctgaagaagcaagtggagaagctgcaggcccaggtcaccctgtcaaatgcccagctaaaagcattcaaagatgaggagaaggcaagagaagccctcagacagcagaagaggaaagcaaaggcctcaggagagcgttaccatgtggagccccacccagaacatctctgcggggcctacccctacgcctacccgcccatgccagccatggtgccacaccatggcttcgaggactggtcccagatccgctacccccctccccccatggccatggagcacccgcccccactccccaactcgcgcctcttccatctgccggaatacacctggcgtctaccctgtggaggggttcgaaatccaaatcagagctcccaagtgatggaccctcccacagccaggcctacagaaccagagtctccaaaaaatgaccgtgaggggcctcagtgagaccagattgtgtcatttggctccaccttcatcttgcagagccagctgatctcagattgccaagaaactagaagccacttgcacggtgtggccagagcctcagctggatgagaggctgagatgggtggccagcttgtataccagtccctgaactgagctgtttacaggactggggaggctccacccagaaggctttcatttgtactctgctgggagtgactgggaaaaactccttccctgctgctgagtggagagaggcctcatccggctttgacccaccatccgttgcagaagcctccaggagcagcaatcctaagagtgggaggcagccaagacccccttccttcaaaacctcccggaagtggtttcaggccctctagttgccatgaccaatttgtgtgtgtgtttaatttttgcttcaagctctgtagcaggacctgccccacgcacacccctacccctctgtgaggagctgtgggaagtgtgggtttgtctccagaacagaagagaatgatggatattctggctctggggccctctccaccaccactcacagtagccttgctgaagccatcacagatgggagaaggccatgccagccacgtccgccgaggggcgccagcctgaagctgccaggccctgaggttcagaccctggaccccatagctggaggcctgtggtgccagaagcccagattagggtggctgtccatccctggatagctatttgcacgaatcatggacataaatccaagttgaagaagatcaa

SEQ ID NO: 329270 - DNA, 2715 bp, Homo sapiens
agtgagccgaggagccttcatagggacagccgcccctggtgcacacaccctcgtattctcctgcccttccccagccaggcgggcaccacggcaggggctgagctaccctcatggaagggagaggaccgtaccggatctacgaccctgggggcagcgtgccctcaggagaggcatccgcagcttttgagcgcctagtgaaggagaattcccggctgaaggaaaaaatgcaagggataaagatgttaggggagcttttggaagagtcccagatggaagcgaccaggctccggcagaaggcagaggagctagtgaaggacaacgagctgctcccaccaccttctccctccttgggctccttcgaccccctggctgagctcacaggaaaggactcaaatgtcacagcatctcccacagcccctgcatgccccagtgacaagccagcaccagtccagaagcctccatccagtggcacctcctctgaatttgaagtggtcactcctgaggagcagaattcaccagagagcagcagccatgccaatgcgatggcgctgggccccctgccccgtgaggacggcaacctgatgctgcacctgcagcgcctggagaccacgctgagtgtgtgtgccgaggagccggaccacggccagctcttcacccacctgggccgcatggccctggagttcaaccgactggcatccaaggtgcacaagaatgagcagcgcacctccattctgcagaccctgtgtgagcagcttcggaaggagaacgaggctctgaaggccaagttggataagggcctggaacagcgggatcaggctgccgagaggctgcgggaggaaaatttggagctcaagaagttgttgatgagcaatggcaacaaagagggtgcgtctgggcggccaggctcaccgaagatggaagggacaggcaagaaggcagtggctggacagcagcaggctagtgtgacggcaggtaaggtcccagaggtggtggccttgggcgcagccgagaagaaggtgaagatgctggagcagcagcgcagtgagctgctggaagtgaacaagcagtgggaccagcatttccggtccatgaagcagcagtatgagcagaagatcactgagctgcgtcagaagctggctgatttgcagaagcaggtgactgacctggaggccgagcgggagcagaagcagcgtgactttgaccgcaagctcctcctggccaagtccaagattgaaatggaggagaccgacaaggagcagctgacagcagaggccaaggagctgcgccaaaaggtcaagtacctgcaggatcagctgagcccactcacccgacagcgtgagtaccaggaaaaggagatccagcggctcaacaaggccctggaggaagcactgagcatccaaaccccgccatcatctccaccaacagcatttgggagcccagaaggagcaggggccctcctaaggaaacaggagctggtcacgcagaatgagttgctgaaacagcaggtgaagatcttcgaggaggacttccagagggagcgcagtgatcgtgagcgcatgaatgaggagaaggaagagctgaagaagcaagtggagaagctgcaggcccaggtcaccctgtcaaatgcccagctaaaagcattcaaagatgaggagaaggcaagagaagccctcagacagcagaagaggaaagcaaaggcctcaggagagcgttaccatgtggagccccacccagaacatctctgcggggcctacccctacgcctacccgcccatgccagccatggtgccacaccatggcttcgaggactggtcccagatccgctacccccctccccccatggccatggagcacccgcccccactccccaactcgcgcctcttccatctgccggaatacacctggcgtctaccctgtggaggggttcgaaatccaaatcagagctcccaagtgatggaccctcccacagccaggcctacagaaccagagccagctgatctcagattgccaagaaactagaagccacttgcacggtgtggccagagcctcagctggatgagaggctgagatgggtggccagcttgtataccagtccctgaactgagctgtttacaggactggggaggctccacccagaaggctttcatttgtactctgctgggagtgactgggaaaaactccttccctgctgctgagtggagagaggcctcatccggctttgacccaccatccgttgcagaagcctccaggagcagcaatcctaagagtgggaggcagccaagacccccttccttcaaaacctcccggaagtggtttcaggccctctagttgccatgaccaatttgtgtgtgtgtttaatttttgcttcaagctctgtagcaggacctgccccacgcacacccctacccctctgtgaggagctgtgggaagtgtgggtttgtctccagaacagaagagaatgatggatattctggctctggggccctctccaccaccactcacagtagccttgctgaagccatcacagatgggagaaggccatgccagccacgtccgccgaggggcgccagcctgaagctgccaggccctgaggttcagaccctggaccccatagctggaggcctgtggtgccagaagcccagattagggtggctgtccatccctggatagctatttgcacgaatcatggacataaatccaagttgaagaagatcaa

SEQ ID NO: 329271 - DNA, 773 bp, Homo sapiens
agggtggtacctgggcttctccccttcccagtcagttcatctgtgctttcttgattctccaggaaaggactcaaatgtcacagcatctcccacagcccctgcatgccccagtgacaagccagcaccagtccagaagcctccatccagtgtaagttttatttggagtcatgggtggaggttgcctggatggacctcaagtcctactgacagatacaagaacatgaagaaagagggttgaggtcaagaaactgtgttccgtctcgctgggtgatattgggcaagtccatcgcaaactctctggggcctcagcctccccattttgaaatgaaggtcatagttaaaacttaccaggaagaccctggtatgtacaaggaattcttctcacttactaagttgtatactgttaagtatcactgagtgtgcacagtgctaggaaaacagacagatgtgacatggagctcacattctcaaagagggctcagaaactatcttctacaggctgggcgcagtggctcatgcctataatcccaagtagctgggattacaggcatgcaccaccacgcccggtaattttttgtatttttggtagagacggggtttctccatattggccaggctggtcttgaactcctgacctcaggtgatccacccgccttggcctcccaaagtgctaggattacaggcgtgagccactgcgcctggcctcttttcccttcttatcattcttcttccaaagatctgctgtcacttgtcccattttccccagtcctctg

SEQ ID NO: 329272 - DNA, 429 bp, Homo sapiens
taaaaaatgcaatcctcctgctgctggttcaaggtcagctagtcccacatctcccttctacaaaagaggattggccatcgaggggatatgacctcacattatgcagagggctacgacaggcttgtcgagaatcctgctttgtgatctcatgtgagatgatatgtaacggtccctgtgtactcaaaatgggaagagattttgtcccccttgctgctctcagccacagggccgcagaggaggggtgagctgtttttctctcgggcagcacctaacttcctttctgcacagggcacctcctctgaatttgaagtggtcactcctgaggagcagaattcaccagagagcagcagccatgccaatgcgatgagcagcaggaggaattccgcgagcagcaggaggaattccgcgagcagcaggaggaattccgcg

SEQ ID NO: 329273 - DNA, 2767 bp, Homo sapiens
  misc_feature (3)..(3): n is a, c, g, or t
  misc_feature (5)..(6): n is a, c, g, or t
  misc_feature (8)..(8): n is a, c, g, or t
  misc_feature (11)..(11): n is a, c, g, or t
  misc_feature (13)..(13): n is a, c, g, or t
  misc_feature (53)..(54): n is a, c, g, or t
  misc_feature (56)..(56): n is a, c, g, or t
  misc_feature (59)..(59): n is a, c, g, or t
gtngnncnagngncctgccagtctccggggactttcccaggggtggggcggcnngnccnggcccccggcacttcctcgtcctcggcccgggtgccctgcccccgtccaggagccctaggagtgctacggggggccggagccttgcccgggccgctgccccgtccctggattcggggctggacgcagcaagcggggcgctgtgtccccaagctccccgtcctcgggggagcttttggaagagtcccagatggaagcgaccaggctccggcagaaggcagaggagctagtgaaggacaacgagctgctcccaccaccttctccctccttgggctccttcgaccccctggctgagctcacaggaaaggactcaaatgtcacagcatctcccacagcccctgcatgccccagtgacaagccagcaccagtccagaagcctccatccagtggcacctcctctgaatttgaagtggtcactcctgaggagcagaattcaccagagagcagcagccatgccaatgcgatggcgctgggccccctgccccgtgaggacggcaacctgatgctgcacctgcagcgcctggagaccacgctgagtgtgtgtgccgaggagccggaccacggccagctcttcacccacctgggccgcatggccctggagttcaaccgactggcatccaaggtgcacaagaatgagcagcgcacctccattctgcagaccctgtgtgagcagcttcggaaggagaacgaggctctgaaggccaagttggataagggcctggaacagcgggatcaggctgccgagaggctgcgggaggaaaatttggagctcaagaagttgttgatgagcaatggcaacaaagagggtgcgtctgggcggccaggctcaccgaagatggaagggacaggcaagaaggcagtggctggacagcagcaggctagtgtgacggcaggtaaggtcccagaggtggtggccttgggcgcagccgagaagaaggtgaagatgctggagcagcagcgcagtgagctgctggaagtgaacaagcagtgggaccagcatttccggtccatgaagcagcagtatgagcagaagatcactgagctgcgtcagaagctggctgatttgcagaagcaggtgactgacctggaggccgagcgggagcagaagcagcgtgactttgaccgcaagctcctcctggccaagtccaagattgaaatggaggagaccgacaaggagcagctgacagcagaggccaaggagctgcgccaaaaggtcaagtacctgcaggatcagctgagcccactcacccgacagcgtgagtaccaggaaaaggagatccagcggctcaacaaggccctggaggaagcactgagcatccaaaccccgccatcatctccaccaacagcatttgggagcccagaaggagcaggggccctcctaaggaaacaggagctggtcacgcagaatgagttgctgaaacagcaggtgaagatcttcgaggaggacttccagagggagcgcagtgatcgtgagcgcatgaatgaggagaaggaagagctgaagaagcaagtggagaagctgcaggcccaggtcaccctgtcaaatgcccagctaaaagcattcaaagatgaggagaaggcaagagaagccctcagacagcagaagaggaaagcaaaggcctcaggagagcgttaccatgtggagccccacccagaacatctctgcggggcctacccctacgcctacccgcccatgccagccatggtgccacaccatggcttcgaggactggtcccagatccgctacccccctccccccatggccatggagcacccgcccccactccccaactcgcgcctcttccatctgccggaatacacctggcgtctaccctgtggaggggttcgaaatccaaatcagagctcccaagtgatggaccctcccacagccaggcctacagaaccagagtctccaaaaaatgaccgtgaggggcctcagtgagaccagattgtgtcatttggctccaccttcatcttgcagagccagctgatctcagattgccaagaaactagaagccacttgcacggtgtggccagagcctcagctggatgagaggctgagatgggtggccagcttgtataccagtccctgaactgagctgtttacaggactggggaggctccacccagaaggctttcatttgtactctgctgggagtgactgggaaaaactccttccctgctgctgagtggagagaggcctcatccggctttgacccaccatccgttgcagaagcctccaggagcagcaatcctaagagtgggaggcagccaagacccccttccttcaaaacctcccggaagtggtttcaggccctctagttgccatgaccaatttgtgtgtgtgtttaatttttgcttcaagctctgtagcaggacctgccccacgcacacccctacccctctgtgaggagctgtgggaagtgtgggtttgtctccagaacagaagagaatgatggatattctggctctggggccctctccaccaccactcacagtagccttgctgaagccatcacagatgggagaaggccatgccagccacgtccgccgaggggcgccagcctgaagctgccaggccctgaggttcagaccctggaccccatagctggaggcctgtggtgccagaagcccagattagggtggctgtccatccctggatagctatttgcacgaatcatggacataaatccaagttgaagaagatcaa

SEQ ID NO: 329274 - DNA, 3424 bp, Homo sapiens
  misc_feature (3)..(3): n is a, c, g, or t
  misc_feature (5)..(6): n is a, c, g, or t
  misc_feature (8)..(8): n is a, c, g, or t
  misc_feature (11)..(11): n is a, c, g, or t
  misc_feature (13)..(13): n is a, c, g, or t
  misc_feature (53)..(54): n is a, c, g, or t
  misc_feature (56)..(56): n is a, c, g, or t
  misc_feature (59)..(59): n is a, c, g, or t
gtngnncnagngncctgccagtctccggggactttcccaggggtggggcggcnngnccnggcccccggcacttcctcgtcctcggcccgggtgccctgcccccgtccaggagccctaggagtgctacggggggccggagccttgcccgggccgctgccccgtccctggattcggggctggacgcagcaagcggggcgctgtgtccccaagctccccgtcctcggccaggcgggcaccacggcaggggctgagctaccctcatggaagggagaggaccgtaccggatctacgaccctgggggcagcgtgccctcaggagaggcatccgcagcttttgagcgcctagtgaaggagaattcccggctgaaggaaaaaatgcaagggataaagatgttaggggagcttttggaagagtcccagatggaagcgaccaggctccggcagaaggcagaggagctagtgaaggacaacgagctgctcccaccaccttctccctccttgggctccttcgaccccctggctgagctcacaggaaaggactcaaatgtcacagcatctcccacagcccctgcatgccccagtgacaagccagcaccagtccagaagcctccatccagtggcacctcctctgaatttgaagtggtcactcctgaggagcagaattcaccagagagcagcagccatgccaatgcgatggcgctgggccccctgccccgtgaggacggcaacctgatgctgcacctgcagcgcctggagaccacgctgagtgtgtgtgccgaggagccggaccacggccagctcttcacccacctgggccgcatggccctggagttcaaccgactggcatccaaggtgcacaagaatgagcagcgcacctccattctgcagaccctgtgtgagcagcttcggaaggagaacgaggctctgaaggccaagttggataagggcctggaacagcgggatcaggctgccgagaggctgcgggaggaaaatttggagctcaagaagttgttgatgagcaatggcaacaaagagggtgcgtctgggcggccaggctcaccgaagatggaagggacaggcaagaaggcagtggctggacagcagcaggctagtgtgacggcaggtaaggtcccagaggtggtggccttgggcgcagccgagaagaaggtgaagatgctggagcagcagcgcagtgagctgctggaagtgaacaagcagtgggaccagcatttccggtccatgaagcagcagtatgagcagaagatcactgagctgcgtcagaagctggctgatttgcagaagcaggtgactgacctggaggccgagcgggagcagaagcagcgtgactttgaccgcaagctcctcctggccaagtccaagattgaaatggaggagaccgacaaggagcagctgacagcagaggccaaggagctgcgccaaaaggtcaagtacctgcaggatcagctgagcccactcacccgacagcgtgagtaccaggaaaaggagatccagcggctcaacaaggccctggaggaagcactgagcatccaaaccccgccatcatctccaccaacagcatttgggagcccagaaggagcaggggccctcctaaggaaacaggagctggtcacgcagaatgagttgctgaaacagcaggtgaagatcttcgaggaggacttccagagggagcgcagtgatcgtgagcgcatgaatgaggagaaggaagagctgaagaagcaagtggagaagctgcaggcccaggtcaccctgtcaaatgcccagctaaaagcattcaaagatgaggagaaggcaagagaagccctcagacagcagaagaggaaagcaaaggcctcaggagagcgttaccatgtggagccccacccagaacatctctgcggggcctacccctacgcctacccgcccatgccagccatggtgccacaccatggcttcgaggactggtcccagatccgctacccccctccccccatggccatggagcacccgcccccactccccaactcgcgcctcttccatctgccggaatacacctggcgtctaccctgtggaggggttcgaaatccaaatcagagctcccaagtgatggaccctcccacagccaggcctacagaaccagagtctccaaaaaatgaccgtgaggggcctcagtgagaccagattgtgtcatttggctccaccttcatcttgcagagccagctgatctcagattgccaagaaactagaagccacttgcacggtgtggccagagcctcagctggatgagaggctgagatgggtggccagcttgtataccagtccctgaactgagctgtttacaggactggggaggctccacccagaaggctttcatttgtactctgctgggagtgactgggaaaaactccttccctgctgctgagtggagagaggcctcatccggctttgacccaccatccgttgcagaagcctccaggagcagcaatcctaagagtgggaggcagccaagacccccttccttcaaaacctcccggaagtggtttcaggccctctagttgccatgaccaatttgtgtgtgtgtttaatttttgcttcaagctctgtagcaggacctgccccacgcacacccctacccctctgtgaggagctgtgggaagtgtgggtttgtctccagaacagaagagaatgatggatattctggctctggggccctctccaccaccactcacagtagccttgctgaagccatcacagatgggagaaggccatgccagccacgtccgccgaggggcgccagcctgaagctgccaggccctgaggttcagaccctggaccccatagctggaggcctgtggtgccagaagcccagattagggtggctgtccatccctggatagctatttgcacgaatcatggacataaatccaagttgaagaagatcaaaaaaaaaaaaaaaaaaaaaaaaaaaaaaaaaaaaaaaaaaaaaagcacggtgtgatggtgtatgtctgtggttccagctacttgggaggctggctgaggcagaagggtcgcttgagccccggaggtccaggctgcagtgagccctgttgatgcccccacactcccgcctgggtgacagagtcagaccctctcattaaaaaaaaaaaatctacagatttggctggagaagttttgcttggtatcctacaagggattgcatagttcagcatccttatcctacagatcaggtgcagggaaagaaggacctgttctgaggttacacgggtaatggggaaaatgtagatggaggagggagactttctagggcagggccaagagccagaggtgagttcttggtggccatgagggtcagctggaagctgagcactgactcctctcatctatcctgcacctttctgggacgaagggggatgacacgaatcctg

SEQ ID NO: 329275 - DNA, 2669 bp, Homo sapiens
  misc_feature (3)..(3): n is a, c, g, or t
  misc_feature (5)..(6): n is a, c, g, or t
  misc_feature (8)..(8): n is a, c, g, or t
  misc_feature (11)..(11): n is a, c, g, or t
  misc_feature (13)..(13): n is a, c, g, or t
  misc_feature (53)..(54): n is a, c, g, or t
  misc_feature (56)..(56): n is a, c, g, or t
  misc_feature (59)..(59): n is a, c, g, or t
gtngnncnagngncctgccagtctccggggactttcccaggggtggggcggcnngnccnggcccccggcacttcctcgtcctcggcccgggtgccctgcccccgtccaggagccctaggagtgctacggggggccggagccttgcccgggccgctgccccgtccctggattcggggctggacgcagcaagcggggcgctgtgtccccaagctccccgtcctcggccaggcgggcaccacggcaggggctgagctaccctcatggaagggagaggaccgtaccggatctacgaccctgggggcagcgtgccctcaggagaggcatccgcagcttttgagcgcctagtgaaggagaattcccggctgaaggaaaaaatgcaagggataaagatgttaggggagcttttggaagagtcccagatggaagcgaccaggctccggcagaaggcagaggagctagtgaaggacaacgagctgctcccaccaccttctccctccttgggctccttcgaccccctggctgagctcacaggaaaggactcaaatgtcacagcatctcccacagcccctgcatgccccagtgacaagccagcaccagtccagaagcctccatccagtaccctgtgtgagcagcttcggaaggagaacgaggctctgaaggccaagttggataagggcctggaacagcgggatcaggctgccgagaggctgcgggaggaaaatttggagctcaagaagttgttgatgagcaatggcaacaaagagggtgcgtctgggcggccaggctcaccgaagatggaagggacaggcaagaaggcagtggctggacagcagcaggctagtgtgacggcaggtaaggtcccagaggtggtggccttgggcgcagccgagaagaaggtgaagatgctggagcagcagcgcagtgagctgctggaagtgaacaagcagtgggaccagcatttccggtccatgaagcagcagtatgagcagaagatcactgagctgcgtcagaagctggctgatttgcagaagcaggtgactgacctggaggccgagcgggagcagaagcagcgtgactttgaccgcaagctcctcctggccaagtccaagattgaaatggaggagaccgacaaggagcagctgacagcagaggccaaggagctgcgccaaaaggtcaagtacctgcaggatcagctgagcccactcacccgacagcgtgagtaccaggaaaaggagatccagcggctcaacaaggccctggaggaagcactgagcatccaaaccccgccatcatctccaccaacagcatttgggagcccagaaggagcaggggccctcctaaggaaacaggagctggtcacgcagaatgagttgctgaaacagcaggtgaagatcttcgaggaggacttccagagggagcgcagtgatcgtgagcgcatgaatgaggagaaggaagagctgaagaagcaagtggagaagctgcaggcccaggtcaccctgtcaaatgcccagctaaaagcattcaaagatgaggagaaggcaagagaagccctcagacagcagaagaggaaagcaaaggcctcaggagagcgttaccatgtggagccccacccagaacatctctgcggggcctacccctacgcctacccgcccatgccagccatggtgccacaccatggcttcgaggactggtcccagatccgctacccccctccccccatggccatggagcacccgcccccactccccaactcgcgcctcttccatctgccggaatacacctggcgtctaccctgtggaggggttcgaaatccaaatcagagctcccaagtgatggaccctcccacagccaggcctacagaaccagagtctccaaaaaatgaccgtgaggggcctcagtgagaccagattgtgtcatttggctccaccttcatcttgcagagccagctgatctcagattgccaagaaactagaagccacttgcacggtgtggccagagcctcagctggatgagaggctgagatgggtggccagcttgtataccagtccctgaactgagctgtttacaggactggggaggctccacccagaaggctttcatttgtactctgctgggagtgactgggaaaaactccttccctgctgctgagtggagagaggcctcatccggctttgacccaccatccgttgcagaagcctccaggagcagcaatcctaagagtgggaggcagccaagacccccttccttcaaaacctcccggaagtggtttcaggccctctagttgccatgaccaatttgtgtgtgtgtttaatttttgcttcaagctctgtagcaggacctgccccacgcacacccctacccctctgtgaggagctgtgggaagtgtgggtttgtctccagaacagaagagaatgatggatattctggctctggggccctctccaccaccactcacagtagccttgctgaagccatcacagatgggagaaggccatgccagccacgtccgccgaggggcgccagcctgaagctgccaggccctgaggttcagaccctggaccccatagctggaggcctgtggtgccagaagcccagattagggtggctgtccatccctggatagctatttgcacgaatcatggacataaatccaagttgaagaagatcaa

SEQ ID NO: 329276 - DNA, 1979 bp, Homo sapiens
agtgagccgaggagccttcatagggacagccgcccctggtgcacacaccctcgtattctcctgcccttccccagccaggcgggcaccacggcaggggctgagctaccctcatggaagggagaggaccgtaccggatctacgaccctgggggcagcgtgccctcaggagaggcatccgcagcttttgagcgcctagtgaagaagaaggtgaagatgctggagcagcagcgcagtgagctgctggaagtgaacaagcagtgggaccagcatttccggtccatgaagcagcagtatgagcagaagatcactgagctgcgtcagaagctggctgatttgcagaagcaggtgactgacctggaggccgagcgggagcagaagcagcgtgactttgaccgcaagctcctcctggccaagtccaagattgaaatggaggagaccgacaaggagcagctgacagcagaggccaaggagctgcgccaaaaggtcaagtacctgcaggatcagctgagcccactcacccgacagcgtgagtaccaggaaaaggagatccagcggctcaacaaggccctggaggaagcactgagcatccaaaccccgccatcatctccaccaacagcatttgggagcccagaaggagcaggggccctcctaaggaaacaggagctggtcacgcagaatgagttgctgaaacagcaggtgaagatcttcgaggaggacttccagagggagcgcagtgatcgtgagcgcatgaatgaggagaaggaagagctgaagaagcaagtggagaagctgcaggcccaggtcaccctgtcaaatgcccagctaaaagcattcaaagatgaggagaaggcaagagaagccctcagacagcagaagaggaaagcaaaggcctcaggagagcgttaccatgtggagccccacccagaacatctctgcggggcctacccctacgcctacccgcccatgccagccatggtgccacaccatggcttcgaggactggtcccagatccgctacccccctccccccatggccatggagcacccgcccccactccccaactcgcgcctcttccatctgccggaatacacctggcgtctaccctgtggaggggttcgaaatccaaatcagagctcccaagtgatggaccctcccacagccaggcctacagaaccagagtctccaaaaaatgaccgtgaggggcctcagtgagaccagattgtgtcatttggctccaccttcatcttgcagagccagctgatctcagattgccaagaaactagaagccacttgcacggtgtggccagagcctcagctggatgagaggctgagatgggtggccagcttgtataccagtccctgaactgagctgtttacaggactggggaggctccacccagaaggctttcatttgtactctgctgggagtgactgggaaaaactccttccctgctgctgagtggagagaggcctcatccggctttgacccaccatccgttgcagaagcctccaggagcagcaatcctaagagtgggaggcagccaagacccccttccttcaaaacctcccggaagtggtttcaggccctctagttgccatgaccaatttgtgtgtgtgtttaatttttgcttcaagctctgtagcaggacctgccccacgcacacccctacccctctgtgaggagctgtgggaagtgtgggtttgtctccagaacagaagagaatgatggatattctggctctggggccctctccaccaccactcacagtagccttgctgaagccatcacagatgggagaaggccatgccagccacgtccgccgaggggcgccagcctgaagctgccaggccctgaggttcagaccctggaccccatagctggaggcctgtggtgccagaagcccagattagggtggctgtccatccctggatagctatttgcacgaatcatggacataaatccaagttgaagaagatcaa

SEQ ID NO: 329277 - DNA, 2885 bp, Homo sapiens
  misc_feature (3)..(3): n is a, c, g, or t
  misc_feature (5)..(6): n is a, c, g, or t
  misc_feature (8)..(8): n is a, c, g, or t
  misc_feature (11)..(11): n is a, c, g, or t
  misc_feature (13)..(13): n is a, c, g, or t
  misc_feature (53)..(54): n is a, c, g, or t
  misc_feature (56)..(56): n is a, c, g, or t
  misc_feature (59)..(59): n is a, c, g, or t
gtngnncnagngncctgccagtctccggggactttcccaggggtggggcggcnngnccnggcccccggcacttcctcgtcctcggcccgggtgccctgcccccgtccaggagccctaggagtgctacggggggccggagccttgcccgggccgctgccccgtccctggattcggggctggacgcagcaagcggggcgctgtgtccccaagctccccgtcctcggccaggcgggcaccacggcaggggctgagctaccctcatggaagggagaggaccgtaccggatctacgaccctgggggcagcgtgccctcaggagaggcatccgcagcttttgagcgcctagtgaaggagaattcccggctgaaggaaaaaatgcaagggataaagatgttaggggagcttttggaagagtcccagatggaagcgaccaggctccggcagaaggcagaggagctagtgaaggacaacgagctgctcccaccaccttctccctccttgggctccttcgaccccctggctgagctcacaggaaaggactcaaatgtcacagcatctcccacagcccctgcatgccccagtgacaagccagcaccagtccagaagcctccatccagtggcacctcctctgaatttgaagtggtcactcctgaggagcagaattcaccagagagcagcagccatgccaatgcgatggcgctgggccccctgccccgtgaggacggcaacctgatgctgcacctgcagcgcctggagaccacgctgagtgtgtgtgccgaggagccggaccacggccagctcttcacccacctgggccgcatggccctggagttcaaccgactggcatccaaggtgcacaagaatgagcagcgcacctccattctgcagaccctgtgtgagcagcttcggaaggagaacgaggctctgaaggccaagttggataagggcctggaacagcgggatcaggctgccgagaggctgcgggaggaaaatttggagctcaagaagttgttgatgagcaatggcaacaaagagggtgcgtctgggcggccaggctcaccgaagatggaagggacaggcaagaaggcagtggctggacagcagcaggctagtgtgacggcaggtaaggtcccagaggtggtggccttgggcgcagccgagaagaaggtgaagatgctggagcagcagcgcagtgagctgctggaagtgaacaagcagtgggaccagcatttccggtccatgaagcagcagtatgagcagaagatcactgagctgcgtcagaagctggctgatttgcagaagcaggtgactgacctggaggccgagcgggagcagaagcagcgtgactttgaccgcaagctcctcctggccaagtccaagattgaaatggaggagaccgacaaggagcagctgacagcagaggccaaggagctgcgccaaaaggtcaagtacctgcaggatcagctgagcccactcacccgacagcgtgagtaccaggaaaaggagatccagcggctcaacaaggccctggaggaagcactgagcatccaaaccccgccatcatctccaccaacagcatttgggagcccagaaggagcaggggccctcctaaggaaacaggagctggtcacgcagaatgagttgctgaaacagcaggtgaagatcttcgaggaggacttccagagggagcgcagtgatcgtgagcgcatgaatgaggagaaggaagagctgaagaagcaagtggagaagctgcaggcccaggtcaccctgtcaaatgcccagctaaaagcattcaaagatgaggagaaggcaagagaagccctcagacagcagaagaggaaagcaaaggcctcaggagagcgttaccatgtggagccccacccagaacatctctgcggggcctacccctacgcctacccgcccatgccagccatggtgccacaccatggcttcgaggactggtcccagatccgctacccccctccccccatggccatggagcacccgcccccactccccaactcgcgcctcttccatctgccggaatacacctggcgtctaccctgtggaggggttcgaaatccaaatcagagctcccaagtgatggaccctcccacagccaggcctacagaaccagagtctccaaaaaatgaccgtgaggggcctcagtgagaccagattgtgtcatttggctccaccttcatcttgcagagccagctgatctcagattgccaagaaactagaagccacttgcacggtgtggccagagcctcagctggatgagaggctgagatgggtggccagcttgtataccagtccctgaactgagctgtttacaggactggggaggctccacccagaaggctttcatttgtactctgctgggagtgactgggaaaaactccttccctgctgctgagtggagagaggcctcatccggctttgacccaccatccgttgcagaagcctccaggagcagcaatcctaagagtgggaggcagccaagacccccttccttctgtgtttaatttttgcttcaagctctgtagcaggacctgccccacgcacacccctacccctctgtgaggagctgtgggaagtgtgggtttgtctccagaacagaagagaatgatggatattctggctctggggccctctccaccaccactcacagtagccttgctgaagccatcacagatgggagaaggccatgccagccacgtccgccgaggggcgccagcctgaagctgccaggccctgaggttcagaccctggaccccatagctggaggcctgtggtgccagaagcccagattagggtggctgtccatccctggatagctatttgcacgaatcatggacataaatccaagttgaagaagatcaa

SEQ ID NO: 329278 - DNA, 2211 bp, Homo sapiens
  misc_feature (3)..(3): n is a, c, g, or t
  misc_feature (5)..(6): n is a, c, g, or t
  misc_feature (8)..(8): n is a, c, g, or t
  misc_feature (11)..(11): n is a, c, g, or t
  misc_feature (13)..(13): n is a, c, g, or t
  misc_feature (53)..(54): n is a, c, g, or t
  misc_feature (56)..(56): n is a, c, g, or t
  misc_feature (59)..(59): n is a, c, g, or t
gtngnncnagngncctgccagtctccggggactttcccaggggtggggcggcnngnccnggcccccggcacttcctcgtcctcggcccgggtgccctgcccccgtccaggagccctaggagtgctacggggggccggagccttgcccgggccgctgccccgtccctggattcggggctggacgcagcaagcggggcgctgtgtccccaagctccccgtcctcggccaggcgggcaccacggcaggggctgagctaccctcatggaagggagaggaccgtaccggatctacgaccctgggggcagcgtgccctcaggagaggcatccgcagcttttgagcgcctagtgaaggagaattcccggctgaaggaaaaaatgcaagggataaagatgttaggggagcttttggaagagtcccagatggaagcgaccaggctccggcagaaggcagaggagctagtgaaggacaacgagctgctcccaccaccttctccctccttgggctccttcgaccccctggctgagctcacaggaaaggactcaaatgtcacagcatctcccacagcccctgcatgccccagtgacaagccagcaccagtccagaagcctccatccagtggcacctcctctgaatttgaagtggtcactcctgaggagcagaattcaccagagagcagcagccatgccaatgcgatggcgctgggccccctgccccgtgaggacggcaacctgatgctgcacctgcagcgcctggagaccacgctgagtgtgtgtgccgaggagccggaccacggccagctcttcacccacctgggccgcatggccctggagttcaaccgactggcatccaaggtgcacaagaatgagcagcgcacctccattctgcagaccctgtgtgagcagcttcggaaggagaacgaggctctgaaggccaagttggataagggcctggaacagcgggatcaggctgccgagaggctgcgggaggaaaatttggagctcaagaagttgttgatgagcaatggcaacaaagagggtgcgtctgggcggccaggctcaccgaagatggaagggacaggcaagaaggcagtggctggacagcagcaggctagtgtgacggcaggtaaggtcccagaggtggtggccttgggcgcagccgagaagaaggtgaagatgctggagcagcagcgcagtgagctgctggaagtgaacaagcagtgggaccagcatttccggtccatgaagcagcagtatgagcagaagatcactgagctgcgtcagaagctggctgatttgcagaagcaggtgactgacctggaggccgagcgggagcagaagcagcgtgactttgaccgcaagctcctcctggccaagtccaagattgaaatggaggagaccgacaaggagcagctgacagcagaggccaaggagctgcgccaaaaggtcaagtacctgcaggatcagctgagcccactcacccgacagcgtgagtaccaggaaaaggagatccagcggctcaacaaggccctggaggaagcactgagcatccaaaccccgccatcatctccaccaacagcatttgggagcccagaaggagcaggggccctcctaaggaaacaggagctggtcacgcagaatgagttgctgaaacagcaggtgaagatcttcgaggaggacttccagagggagcgcagtgatcgtgagcgcatgaatgaggagaaggaagagctgaagaagcaagtggagaagctgcaggcccaggtcaccctgtcaaatgcccagctaaaagcattcaaagatgaggagaaggcaagagaagccctcagacagcagaagaggaaagcaaaggcctcaggagagcgttaccatgtggagccccacccagaacatctctgcggggcctacccctacgcctacccgcccatgccagccatggtgccacaccatggcttcgaggactggtcccagatccgctacccccctccccccatggccatggagcacccgcccccactccccaactcgcgcctcttccatctgcagccacgtccgccgaggggcgccagcctgaagctgccaggccctgaggttcagaccctggaccccatagctggaggcctgtggtgccagaagcccagattagggtggctgtccatccctggatagctatttgcacgaatcatggacataaatccaagttgaagaagatcaa

SEQ ID NO: 329279 - DNA, 1384 bp, Homo sapiens
gaaaatgacgtgacaagtagagggccgggttgtagtcggccgaggggccctcctaaggaaacaggagctggtcacgcagaatgagttgctgaaacagcaggtgaagatcttcgaggaggacttccagagggagcgcagtgatcgtgagcgcatgaatgaggagaaggaagagctgaagaagcaagtggagaagctgcaggcccaggtcaccctgtcaaatgcccagctaaaagcattcaaagatgaggagaaggcaagagaagccctcagacagcagaagaggaaagcaaaggcctcaggagagcgttaccatgtggagccccacccagaacatctctgcggggcctacccctacgcctacccgcccatgccagccatggtgccacaccatggcttcgaggactggtcccagatccgctacccccctccccccatggccatggagcacccgcccccactccccaactcgcgcctcttccatctgccggaatacacctggcgtctaccctgtggaggggttcgaaatccaaatcagagctcccaagtgatggaccctcccacagccaggcctacagaaccagagtctccaaaaaatgaccgtgaggggcctcagtgagaccagattgtgtcatttggctccaccttcatcttgcagagccagctgatctcagattgccaagaaactagaagccacttgcacggtgtggccagagcctcagctggatgagaggctgagatgggtggccagcttgtataccagtccctgaactgagctgtttacaggactggggaggctccacccagaaggctttcatttgtactctgctgggagtgactgggaaaaactccttccctgctgctgagtggagagaggcctcatccggctttgacccaccatccgttgcagaagcctccaggagcagcaatcctaagagtgggaggcagccaagacccccttccttcaaaacctcccggaagtggtttcaggccctctagttgccatgaccaatttgtgtgtgtgtttaatttttgcttcaagctctgtagcaggacctgccccacgcacacccctacccctctgtgaggagctgtgggaagtgtgggtttgtctccagaacagaagagaatgatggatattctggctctggggccctctccaccaccactcacagtagccttgctgaagccatcacagatgggagaaggccatgccagccacgtccgccgaggggcgccagcctgaagctgccaggccctgaggttcagaccctggaccccatagctggaggcctgtggtgccagaagcccagattagggtggctgtccatccctggatagctatttgcacgaatcatggacataaatccaagttgaagaagatcaa

SEQ ID NO: 329280 - DNA, 1577 bp, Homo sapiens
  misc_feature (3)..(3): n is a, c, g, or t
  misc_feature (5)..(6): n is a, c, g, or t
  misc_feature (8)..(8): n is a, c, g, or t
  misc_feature (11)..(11): n is a, c, g, or t
  misc_feature (13)..(13): n is a, c, g, or t
  misc_feature (53)..(54): n is a, c, g, or t
  misc_feature (56)..(56): n is a, c, g, or t
  misc_feature (59)..(59): n is a, c, g, or t
gtngnncnagngncctgccagtctccggggactttcccaggggtggggcggcnngnccnggcccccggcacttcctcgtcctcggcccgggtgccctgcccccgtccaggagccctaggagtgctacggggggccggagccttgcccgggccgctgccccgtccctggattcggggctggacgcagcaagcggggcgctgtgtccccaagctccccgtcctcggccaggcgggcaccacggcaggggctgagctaccctcatggaagggagaggaccgtaccggatctacgaccctgggggcagcgtgccctcaggagaggcatccgcagcttttgagcgcctagtgaaggagaattcccggctgaaggaaaaaatgcaagggataaagatgttaggggagcttttggaagagtcccagatggaagcgaccaggctccggcagaaggcaagagaagccctcagacagcagaagaggaaagcaaaggcctcaggagagcgttaccatgtggagccccacccagaacatctctgcggggcctacccctacgcctacccgcccatgccagccatggtgccacaccatggcttcgaggactggtcccagatccgctacccccctccccccatggccatggagcacccgcccccactccccaactcgcgcctcttccatctgccggaatacacctggcgtctaccctgtggaggggttcgaaatccaaatcagagctcccaagtgatggaccctcccacagccaggcctacagaaccagagtctccaaaaaatgaccgtgaggggcctcagtgagaccagattgtgtcatttggctccaccttcatcttgcagagccagctgatctcagattgccaagaaactagaagccacttgcacggtgtggccagagcctcagctggatgagaggctgagatgggtggccagcttgtataccagtccctgaactgagctgtttacaggactggggaggctccacccagaaggctttcatttgtactctgctgggagtgactgggaaaaactccttccctgctgctgagtggagagaggcctcatccggctttgacccaccatccgttgcagaagcctccaggagcagcaatcctaagagtgggaggcagccaagacccccttccttcaaaacctcccggaagtggtttcaggccctctagttgccatgaccaatttgtgtgtgtgtttaatttttgcttcaagctctgtagcaggacctgccccacgcacacccctacccctctgtgaggagctgtgggaagtgtgggtttgtctccagaacagaagagaatgatggatattctggctctggggccctctccaccaccactcacagtagccttgctgaagccatcacagatgggagaaggccatgccagccacgtccgccgaggggcgccagcctgaagctgccaggccctgaggttcagaccctggaccccatagctggaggcctgtggtgccagaagcccagattagggtggctgtccatccctggatagctatttgcacgaatcatggacataaatccaagttgaagaagatcaa

SEQ ID NO: 329281 - DNA, 2490 bp, Homo sapiens
  misc_feature (3)..(3): n is a, c, g, or t
  misc_feature (5)..(6): n is a, c, g, or t
  misc_feature (8)..(8): n is a, c, g, or t
  misc_feature (11)..(11): n is a, c, g, or t
  misc_feature (13)..(13): n is a, c, g, or t
  misc_feature (53)..(54): n is a, c, g, or t
  misc_feature (56)..(56): n is a, c, g, or t
  misc_feature (59)..(59): n is a, c, g, or t
gtngnncnagngncctgccagtctccggggactttcccaggggtggggcggcnngnccnggcccccggcacttcctcgtcctcggcccgggtgccctgcccccgtccaggagccctaggagtgctacggggggccggagccttgcccgggccgctgccccgtccctggattcggggctggacgcagcaagcggggcgctgtgtccccaagctccccgtcctcggccaggcgggcaccacggcaggggctgagctaccctcatggaagggagaggaccgtaccggatctacgaccctgggggcagcgtgccctcaggagaggcatccgcagcttttgagcgcctagtgaaggagaattcccggctgaaggaaaaaatgcaagggataaagatgttaggggagcttttggaagagtcccagatggaagcgaccaggctccggcagaaggcagaggagctagtgaaggacaacgagctgctcccaccaccttctccctccttgggctccttcgaccccctggctgagctcacaggaaaggactcaaatgtcacagcatctcccacagcccctgcatgccccagtgacaagccagcaccagtccagaagcctccatccagtggcacctcctctgaatttgaagtggtcactcctgaggagcagaattcaccagagagcagcagccatgccaatgcgatggcgctgggccccctgccccgtgaggacggcaacctgatgctgcacctgcagcgcctggagaccacgctgagtgtgtgtgccgaggagccggaccacggccagctcttcacccacctgggccgcatggccctggagttcaaccgactggcatccaaggtgcacaagaatgagcagcgcacctccattctgcagaccctgtgtgagcagcttcggaaggagaacgaggctctgaaggccaagttggataagggcctggaacagcgggatcaggctgccgagaggctgcgggaggaaaatttggagctcaagaagttgttgatgagcaatggcaacaaagagggtgcgtctgggcggccaggctcaccgaagatggaagggacaggcaagaaggcagtggctggacagcagcaggctagtgtgacggcaggtaaggtcccagaggtggtggccttgggcgcagccgagaagaaggtgaagatgctggagcagcagcgcagtgagctgctggaagtgaacaagcagtgggaccagcatttccggtccatgaagcagcagtatgagcagaagatcactgagctgcgtcagaagctggctgatttgcagaagcaggtgactgacctggaggccgagcgggagcagaagcagcgtgactttgaccgcaagctcctcctggccaagtccaagattgaaatggaggagaccgacaaggagcagctgacagcagaggccaaggagctgcgccaaaaggtcaagtacctgcaggatcagctgagcccactcacccgacagcgtgagtaccaggaaaaggagatccagcggctcaacaaggccctggaggaagcactgagcatccaaaccccgccatcatctccaccaacagcatttgggagcccagaaggagcaggggccctcctaaggaaacaggagctggtcacgcagaatgagttgctgaaacagcaggtgaagatcttcgaggaggacttccagagggagcgcagtgatcgtgagcgcatgaatgaggagaaggaagagctgaagaagcaagtggagaagctgcaggcccaggtcaccctgtcaaatgcccagctaaaagcattcaaagatgaggagaaggcaagagaagccctcagacagcagaagaggaaagcaaaggtgaggaggcttgagggaggtagcagcactgacatcctcttaccttcctcatggagctagcctgatggatgcacagtgtgtgctcgggcgtggggacatcctctgctaactaactgatgagtaatacaggaaaagccttagagcagtattggtacagaggcagtgcccacaatgcattagctgtcatcactgttgacattctgtgtccaggtagcaaccttccgtgcccatgtgactagccttctttggccgtgtatgagccttccgtgcccatgtatccaactttctatgcccatgttccagccctccgtgcccatgtaccagccttttgtgcccatgcccagccttttgtgcccatgcccagccttccatgcccatgtaccagccttccgtgtccatgtaccagccttccatgcccatgtgctcagccttccgtttccatgtatcagccttccgtgcccatgtgcccagccttctgtgtccatttacccagccttccgtgcccatgtatgagccttctgtgcccatgtgcccagccttccatgcccatgtgcccagccttccgtgcccatgtacccagccttccgtgcccatgtaccagccttctgtgcccatgttctagccttccgtgcccatgtaccag

SEQ ID NO: 329282 - DNA, 938 bp, Homo sapiens
tcccaactcgcgccgttccatctgcgggaactaacgggccggaatacacctggcgtctaccctgtggaggggttcgaaatccaaatcagagctcccaagtgatggaccctcccacagccaggcctacagaaccagagtctccaaaaaatgaccgtgaggggcctcagtgagaccagattgtgtcatttggctccaccttcatcttgcagagccagctgatctcagattgccaagaaactagaagccacttgcacggtgtggccagagcctcagctggatgagaggctgagatgggtggccagcttgtataccagtccctgaactgagctgtttacaggactggggaggctccacccagaaggctttcatttgtactctgctgggagtgactgggaaaaactccttccctgctgctgagtggagagaggcctcatccggctttgacccaccatccgttgcagaagcctccaggagcagcaatcctaagagtgggaggcagccaagacccccttccttcaaaacctcccggaagtggtttcaggccctctagttgccatgaccaatttgtgtgtgtgtttaatttttgcttcaagctctgtagcaggacctgccccacgcacacccctacccctctgtgaggagctgtgggaagtgtgggtttgtctccagaacagaagagaatgatggatattctggctctggggccctctccaccaccactcacagtagccttgctgaagccatcacagatgggagaaggccatgccagccacgtccgccgaggggcgccagcctgaagctgccaggccctgaggttcagaccctggaccccatagctggaggcctgtggtgccagaagcccagattagggtggctgtccatccctggatagctatttgcacgaatcatggacataaatccaagttgaagaagatcaa

SEQ ID NO: 329283 - DNA, 909 bp, Homo sapiens
ccaaaaaaaagacagggtctccctatgttgcccaggctggtctttaactcctgggctaaagggatcctcctgcctcggcctcccacagccaggcctacagaaccagagtctccaaaaaatgaccgtgaggggcctcagtgagaccagattgtgtcatttggctccaccttcatcttgcagagccagctgatctcagattgccaagaaactagaagccacttgcacggtgtggccagagcctcagctggatgagaggctgagatgggtggccagcttgtataccagtccctgaactgagctgtttacaggactggggaggctccacccagaaggctttcatttgtactctgctgggagtgactgggaaaaactccttccctgctgctgagtggagagaggcctcatccggctttgacccaccatccgttgcagaagcctccaggagcagcaatcctaagagtgggaggcagccaagacccccttccttcaaaacctcccggaagtggtttcaggccctctagttgccatgaccaatttgtgtgtgtgtttaatttttgcttcaagctctgtagcaggacctgccccacgcacacccctacccctctgtgaggagctgtgggaagtgtgggtttgtctccagaacagaagagaatgatggatattctggctctggggccctctccaccaccactcacagtagccttgctgaagccatcacagatgggagaaggccatgccagccacgtccgccgaggggcgccagcctgaagctgccaggccctgaggttcagaccctggaccccatagctggaggcctgtggtgccagaagcccagattagggtggctgtccatccctggatagctatttgcacgaatcatggacataaatccaagttgaagaagatcaa

SEQ ID NO: 329284 - DNA, 1307 bp, Homo sapiens
  misc_feature (3)..(3): n is a, c, g, or t
  misc_feature (5)..(6): n is a, c, g, or t
  misc_feature (8)..(8): n is a, c, g, or t
  misc_feature (11)..(11): n is a, c, g, or t
  misc_feature (13)..(13): n is a, c, g, or t
  misc_feature (53)..(54): n is a, c, g, or t
  misc_feature (56)..(56): n is a, c, g, or t
  misc_feature (59)..(59): n is a, c, g, or t
gtngnncnagngncctgccagtctccggggactttcccaggggtggggcggcnngnccnggcccccggcacttcctcgtcctcggcccgggtgccctgcccccgtccaggagccctaggagtgctacggggggccggagccttgcccgggccgctgccccgtccctggattcggggctggacgcagcaagcggggcgctgtgtccccaagctccccgtcctcggccaggcgggcaccacggcaggggctgagctaccctcatggaagggagaggaccgtaccggatctacgaccctgggggcagcgtgccctcaggagaggcatccgcagcttttgagcgcctagtgaaggagaattcccggctgaaggaaaaaatgcaagggataaagatgttaggggagcttttggaagagtcccagatggaagcgaccaggctccggcagaaggcagaggagctagtgaaggacaacgagctgctcccaccaccttctccctccttgggctccttcgaccccctggctgagctcacaggaaaggactcaaatgtcacagcatctcccacagcccctgcatgccccagtgacaagccagcaccagtccagaagcctccatccagtggcacctcctctgaatttgaagtggtcactcctgaggagcagaattcaccagagagcagcagccatgccaatgcgatggcgctgggccccctgccccgtgaggacggcaacctgatgctgcacctgcagcgcctggagaccacgctgagtgtgtgtgccgaggagccggaccacggccagctcttcacccacctgggccgcatggccctggagttcaaccgactggcatccaaggtgcacaagaatgagcagcgcacctccattctgcagaccctgtgtgagcagcttcggaaggagaacgaggctctgaaggccaagttggataagggcctggaacagcgggatcaggctgccgagaggctgcgggaggaaaatttggagctcaagaagttgttgatgagcaatggcaacaaagagggtgcgtctgggcggccaggctcaccgaagatggaagggacaggcaagaaggcagtggctggacagcagcagaagccatcacagatgggagaaggccatgccagccacgtccgccgaggggcgccagcctgaagctgccaggccctgaggttcagaccctggaccccatagctggaggcctgtggtgccagaagcccagattagggtggctgtccatccctggatagctatttgcacgaatcatggacataaatccaagttgaagaagatcaa

SEQ ID NO: 329285 - DNA, 1040 bp, Homo sapiens
  misc_feature (3)..(3): n is a, c, g, or t
  misc_feature (5)..(6): n is a, c, g, or t
  misc_feature (8)..(8): n is a, c, g, or t
  misc_feature (11)..(11): n is a, c, g, or t
  misc_feature (13)..(13): n is a, c, g, or t
  misc_feature (53)..(54): n is a, c, g, or t
  misc_feature (56)..(56): n is a, c, g, or t
  misc_feature (59)..(59): n is a, c, g, or t
gtngnncnagngncctgccagtctccggggactttcccaggggtggggcggcnngnccnggcccccggcacttcctcgtcctcggcccgggtgccctgcccccgtccaggagccctaggagtgctacggggggccggagccttgcccgggccgctgccccgtccctggattcggggctggacgcagcaagcggggcgctgtgtccccaagctccccgtcctcggccaggcgggcaccacggcaggggctgagctaccctcatggaagggagaggaccgtaccggatctacgaccctgggggcagcgtgccctcaggagaggcatccgcagcttttgagcgcctagtgaaggagaattcccggctgaaggaaaaaatgcaagggataaagatgttaggggagcttttggaagagtcccagatggaagcgaccaggctccggcagaaggcagaggagctagtgaaggacaacgagctgctcccaccaccttctccctccttgggctccttcgaccccctggctgagctcacaggaaaggactcaaatgtcacagcatctcccacagcccctgcatgccccagtgacaagccagcaccagtccagaagcctccatccagtggcacctcctctgaatttgaagtggtcactcctgaggagcagaattcaccagagagcagcagccatgccaatgcgatggcgctgggccccctgccccgtgaggacggcaacctgatgctgcacctgcagcgcctggagaccacgctgagtgtgtgtgccgaggagccggaccacggccagctcttcacccacctgggccgcatggccctggagttcaaccgactggcatccaaggtgcacaagaatgagcagcgcacctccattctgcagaccctgtgtgagcagcttcggaaggagaacgaggctctgaaggccaagttggataagggcctggaacagcgggatcaggctgccgagaggctgcgggaggctgatttataactcgtgaagttgctattaagctttgcaacgtggggttcttct

SEQ ID NO: 329286 - DNA, 985 bp, Homo sapiens
agtgagccgaggagccttcatagggacagccgcccctggtgcacacaccctcgtattctcctgcccttccccaggggagcttttggaagagtcccagatggaagcgaccaggctccggcagaaggcagaggagctagtgaaggacaacgagctgctcccaccaccttctccctccttgggctccttcgaccccctggctgagctcacaggaaaggactcaaatgtcacagcatctcccacagcccctgcatgccccagtgacaagccagcaccagtccagaagcctccatccagtggcacctcctctgaatttgaagtggtcactcctgaggagcagaattcaccagagagcagcagccatgccaatgcgatggcgctgggccccctgccccgtgaggacggcaacctgatgctgcacctgcagcgcctggagaccacgctgagtgtgtgtgccgaggagccggaccacggccagctcttcacccacctgggccgcatggccctggagttcaaccgactggcatccaaggtgcacaagaatgagcagcgcacctccattctgcagaccctgtgtgagcagcttcggaaggagaacgaggctctgaaggccaagttggataagggcctggaacagcgggatcaggctgccgagaggctgcgggaggaaaatttggagctcaagaagttgttgatgagcaatggcaacaaagagggtgcgtctgggcggccaggctcaccgaagatggaagggacaggcaagaaggcagtggctggacagcagcagaagccatcacagatgggagaaggccatgccagccacgtccgccgaggggcgccagcctgaagctgccaggccctgaggttcagaccctggaccccatagctggaggcctgtggtgccagaagcccagattagggtggctgtccatccctggatagctatttgcacgaatcatggacataaatccaagttgaagaagatcaa

SEQ ID NO: 329287 - DNA, 1248 bp, Homo sapiens
  misc_feature (3)..(3): n is a, c, g, or t
  misc_feature (5)..(6): n is a, c, g, or t
  misc_feature (8)..(8): n is a, c, g, or t
  misc_feature (11)..(11): n is a, c, g, or t
  misc_feature (13)..(13): n is a, c, g, or t
  misc_feature (53)..(54): n is a, c, g, or t
  misc_feature (56)..(56): n is a, c, g, or t
  misc_feature (59)..(59): n is a, c, g, or t
gtngnncnagngncctgccagtctccggggactttcccaggggtggggcggcnngnccnggcccccggcacttcctcgtcctcggcccgggtgccctgcccccgtccaggagccctaggagtgctacggggggccggagccttgcccgggccgctgccccgtccctggattcggggctggacgcagcaagcggggcgctgtgtccccaagctccccgtcctcggccaggcgggcaccacggcaggggctgagctaccctcatggaagggagaggaccgtaccggatctacgaccctgggggcagcgtgccctcaggagaggcatccgcagcttttgagcgcctagtgaaggagaattcccggctgaaggaaaaaatgcaagggataaagatgttaggggagcttttggaagagtcccagatggaagcgaccaggctccggcagaaggcagaggagctagtgaaggacaacgagctgctcccaccaccttctccctccttgggctccttcgaccccctggctgagctcacaggaaaggactcaaatgtcacagcatctcccacagcccctgcatgccccagtgacaagccagcaccagtccagaagcctccatccagtgtaagttttatttggagtcatgggtggaggttgcctggatggacctcaagtcctactgacagatacaagaacatgaagaaagagggttgaggtcaagaaactgtgttccgtctcgctgggtgatattgggcaagtccatcgcaaactctctggggcctcagcctccccattttgaaatgaaggtcatagttaaaacttaccaggaagaccctggtatgtacaaggaattcttctcacttactaagttgtatactgttaagtatcactgagtgtgcacagtgctaggaaaacagacagatgtgacatggagctcacattctcaaagagggctcagaaactatcttctacaggctgggcgcagtggctcatgcctataatcccagcacttggggaggctgaggcaggaggattgcttgaacccaggagtttgagaccagcctgggcaggatagtgagactccatctctctaagaaaaaaagtagtcaggtgtgatggtgtatgtctgtggttccagctacttgggaggctggctgaggcagaagggtcgcttgagcccaggaggtcaaggctgcagtgagccatgttgatgccaccacactccagcctgggtgacagagtcagaccctctcat

SEQ ID NO: 329288 - DNA, 209 bp, Homo sapiens
gtataagaggagtctgggtacctctgactctccctgtaccccaaactgcccaaatccttcacagtgaactcccttcttatgccaaaacccacattctctcgtttatccttaggtcacaggctacccttccattcatgttttggctgccacatcccccagaaggtcagatttggaagggacttcaaaacaatcttgttaaaaatagccag

SEQ ID NO: 329289 - DNA, 334 bp, Homo sapiens
atcagccggtcagtcctcgtggctggttaggccctggatccaggcctggccagaaaccacctgtgccgacagtcttttctccctcccttcttctctcagctaaaagcattcaaagatgaggagaaggcaagagaagccctcagacagcagaagaggaaagcaaaggtgaggaggcttgagggaggtagcagcactgacatcctcttaccttcctcatggagctagcctgatggatgcacagtgtgtgctcgggcgtggggacatcctctgctaactaactgatgagtaatacaggaaaagccttagagcagtattggtacagaggcagtgccca

SEQ ID NO: 329290 - DNA, 401 bp, Homo sapiens
ctcaaaatttttgtttatttagagtctccaaaaaatgaccgtgaggggcctcagtgagaccagattgtgtcatttggctccaccttcatcttgcagagccagctgatctcagattgccaagaaactagaagccacttgcacggtgtggccagagcctcagctggatgagaggctgagatgggtggccagcttgtataccagtccctgaactgagctgtttacaggactggggaggctccacccagaaggctttcatttgtactctgctgggagtgactgggaaaaactccttccctgctgctgagtggagagaggcctcatccggctttgacccaccatccgttgcagaagcctccaggagcagcaatcctaagagtgggaggcagccaagacccccttcc

SEQ ID NO: 329291 - DNA, 2939 bp, Homo sapiens
  misc_feature (3)..(3): n is a, c, g, or t
  misc_feature (5)..(6): n is a, c, g, or t
  misc_feature (8)..(8): n is a, c, g, or t
  misc_feature (11)..(11): n is a, c, g, or t
  misc_feature (13)..(13): n is a, c, g, or t
  misc_feature (53)..(54): n is a, c, g, or t
  misc_feature (56)..(56): n is a, c, g, or t
  misc_feature (59)..(59): n is a, c, g, or t
gtngnncnagngncctgccagtctccggggactttcccaggggtggggcggcnngnccnggcccccggcacttcctcgtcctcggcccgggtgccctgcccccgtccaggagccctaggagtgctacggggggccggagccttgcccgggccgctgccccgtccctggattcggggctggacgcagcaagcggggcgctgtgtccccaagctccccgtcctcggccaggcgggcaccacggcaggggctgagctaccctcatggaagggagaggaccgtaccggatctacgaccctgggggcagcgtgccctcaggagaggcatccgcagcttttgagcgcctagtgaaggagaattcccggctgaaggaaaaaatgcaagggataaagatgttaggggagcttttggaagagtcccagatggaagcgaccaggctccggcagaaggcagaggagctagtgaaggacaacgagctgctcccaccaccttctccctccttgggctccttcgaccccctggctgagctcacaggaaaggactcaaatgtcacagcatctcccacagcccctgcatgccccagtgacaagccagcaccagtccagaagcctccatccagtggcacctcctctgaatttgaagtggtcactcctgaggagcagaattcaccagagagcagcagccatgccaatgcgatggcgctgggccccctgccccgtgaggacggcaacctgatgctgcacctgcagcgcctggagaccacgctgagtgtgtgtgccgaggagccggaccacggccagctcttcacccacctgggccgcatggccctggagttcaaccgactggcatccaaggtgcacaagaatgagcagcgcacctccattctgcagaccctgtgtgagcagcttcggaaggagaacgaggctctgaaggccaagttggataagggcctggaacagcgggatcaggctgccgagaggctgcgggaggaaaatttggagctcaagaagttgttgatgagcaatggcaacaaagagggtgcgtctgggcggccaggctcaccgaagatggaagggacaggcaagaaggcagtggctggacagcagcaggctagtgtgacggcaggtaaggtcccagaggtggtggccttgggcgcagccgagaagaaggtgaagatgctggagcagcagcgcagtgagctgctggaagtgaacaagcagtgggaccagcatttccggtccatgaagcagcagtatgagcagaagatcactgagctgcgtcagaagctggctgatttgcagaagcaggtgactgacctggaggccgagcgggagcagaagcagcgtgactttgaccgcaagctcctcctggccaagtccaagattgaaatggaggagaccgacaaggagcagctgacagcagaggccaaggagctgcgccaaaaggtcaagtacctgcaggatcagctgagcccactcacccgacagcgtgagtaccaggaaaaggagatccagcggctcaacaaggccctggaggaagcactgagcatccaaaccccgccatcatctccaccaacagcatttgggagcccagaaggagcaggggccctcctaaggaaacaggagctggtcacgcagaatgagttgctgaaacagcaggtgaagatcttcgaggaggacttccagagggagcgcagtgatcgtgagcgcatgaatgaggagaaggaagagctgaagaagcaagtggagaagctgcaggcccaggtcaccctgtcaaatgcccagctaaaagcattcaaagatgaggagaaggcaagagaagccctcagacagcagaagaggaaagcaaaggcctcaggagagcgttaccatgtggagccccacccagaacatctctgcggggcctacccctacgcctacccgcccatgccagccatggtgccacaccatggcttcgaggactggtcccagatccgctacccccctccccccatggccatggagcacccgcccccactccccaactcgcgcctcttccatctgccggaatacacctggcgtctaccctgtggaggggttcgaaatccaaatcagagctcccaagtgatggaccctcccacagccaggcctacagaaccagagtctccaaaaaatgaccgtgaggggcctcagtgagaccagattgtgtcatttggctccaccttcatcttgcagagccagctgatctcagattgccaagaaactagaagccacttgcacggtgtggccagagcctcagctggatgagaggctgagatgggtggccagcttgtataccagtccctgaactgagctgtttacaggactggggaggctccacccagaaggctttcatttgtactctgctgggagtgactgggaaaaactccttccctgctgctgagtggagagaggcctcatccggctttgacccaccatccgttgcagaagcctccaggagcagcaatcctaagagtgggaggcagccaagacccccttccttcaaaacctcccggaagtggtttcaggccctctagttgccatgaccaatttgtgtgtgtgtttaatttttgcttcaagctctgtagcaggacctgccccacgcacacccctacccctctgtgaggagctgtgggaagtgtgggtttgtctccagaacagaagagaatgatggatattctggctctggggccctctccaccaccactcacagtagccttgctgaagccatcacagatgggagaaggccatgccagccacgtccgccgaggggcgccagcctgaagctgccaggccctgaggttcagaccctggaccccatagctggaggcctgtggtgccagaagcccagattagggtggctgtccatccctggatagctatttgcacgaatcatggacataaatccaagttgaagaagatcaa

SEQ ID NO: 329292 - DNA, 443 bp, Homo sapiens
caggtagaggcactggagctttgattactccagagccccccacaagctagatggggcctggctaaggagttgacagtgaccttagtacaggacagacagctcatttggggctacagttgcttagaggggtcaccttcaccgtagctggtcttcccaactccgcagcgttctctcgttttcagcagagggctagtgtgacggcaggtaaggtcccagaggtggtggccttgggcgcagccgagaagaaggtgaagatgctggagcagcagcgcagtgagctgctggaagtgaacaagcagtgggaccagcatttccggtccatgaagcagcagtatgagcagaagatctctgagttgtgtcagaacctgccttgtatgcagaagcacggtgatgactgggtcttcgttcttgatctatccgccggtgaaccaggactgacagtt

SEQ ID NO: 329293 - DNA, 2617 bp, Homo sapiens
agtgagccgaggagccttcatagggacagccgcccctggtgcacacaccctcgtattctcctgcccttccccaggggagcttttggaagagtcccagatggaagcgaccaggctccggcagaaggcagaggagctagtgaaggacaacgagctgctcccaccaccttctccctccttgggctccttcgaccccctggctgagctcacaggaaaggactcaaatgtcacagcatctcccacagcccctgcatgccccagtgacaagccagcaccagtccagaagcctccatccagtggcacctcctctgaatttgaagtggtcactcctgaggagcagaattcaccagagagcagcagccatgccaatgcgatggcgctgggccccctgccccgtgaggacggcaacctgatgctgcacctgcagcgcctggagaccacgctgagtgtgtgtgccgaggagccggaccacggccagctcttcacccacctgggccgcatggccctggagttcaaccgactggcatccaaggtgcacaagaatgagcagcgcacctccattctgcagaccctgtgtgagcagcttcggaaggagaacgaggctctgaaggccaagttggataagggcctggaacagcgggatcaggctgccgagaggctgcgggaggaaaatttggagctcaagaagttgttgatgagcaatggcaacaaagagggtgcgtctgggcggccaggctcaccgaagatggaagggacaggcaagaaggcagtggctggacagcagcaggctagtgtgacggcaggtaaggtcccagaggtggtggccttgggcgcagccgagaagaaggtgaagatgctggagcagcagcgcagtgagctgctggaagtgaacaagcagtgggaccagcatttccggtccatgaagcagcagtatgagcagaagatcactgagctgcgtcagaagctggctgatttgcagaagcaggtgactgacctggaggccgagcgggagcagaagcagcgtgactttgaccgcaagctcctcctggccaagtccaagattgaaatggaggagaccgacaaggagcagctgacagcagaggccaaggagctgcgccaaaaggtcaagtacctgcaggatcagctgagcccactcacccgacagcgtgagtaccaggaaaaggagatccagcggctcaacaaggccctggaggaagcactgagcatccaaaccccgccatcatctccaccaacagcatttgggagcccagaaggagcaggggccctcctaaggaaacaggagctggtcacgcagaatgagttgctgaaacagcaggtgaagatcttcgaggaggacttccagagggagcgcagtgatcgtgagcgcatgaatgaggagaaggaagagctgaagaagcaagtggagaagctgcaggcccaggtcaccctgtcaaatgcccagctaaaagcattcaaagatgaggagaaggcaagagaagccctcagacagcagaagaggaaagcaaaggcctcaggagagcgttaccatgtggagccccacccagaacatctctgcggggcctacccctacgcctacccgcccatgccagccatggtgccacaccatggcttcgaggactggtcccagatccgctacccccctccccccatggccatggagcacccgcccccactccccaactcgcgcctcttccatctgccggaatacacctggcgtctaccctgtggaggggttcgaaatccaaatcagagctcccaagtgatggaccctcccacagccaggcctacagaaccagagtctccaaaaaatgaccgtgaggggcctcagtgagaccagattgtgtcatttggctccaccttcatcttgcagagccagctgatctcagattgccaagaaactagaagccacttgcacggtgtggccagagcctcagctggatgagaggctgagatgggtggccagcttgtataccagtccctgaactgagctgtttacaggactggggaggctccacccagaaggctttcatttgtactctgctgggagtgactgggaaaaactccttccctgctgctgagtggagagaggcctcatccggctttgacccaccatccgttgcagaagcctccaggagcagcaatcctaagagtgggaggcagccaagacccccttccttcaaaacctcccggaagtggtttcaggccctctagttgccatgaccaatttgtgtgtgtgtttaatttttgcttcaagctctgtagcaggacctgccccacgcacacccctacccctctgtgaggagctgtgggaagtgtgggtttgtctccagaacagaagagaatgatggatattctggctctggggccctctccaccaccactcacagtagccttgctgaagccatcacagatgggagaaggccatgccagccacgtccgccgaggggcgccagcctgaagctgccaggccctgaggttcagaccctggaccccatagctggaggcctgtggtgccagaagcccagattagggtggctgtccatccctggatagctatttgcacgaatcatggacataaatccaagttgaagaagatcaa

SEQ ID NO: 329294 - DNA, 3251 bp, Homo sapiens
  misc_feature (3)..(3): n is a, c, g, or t
  misc_feature (5)..(6): n is a, c, g, or t
  misc_feature (8)..(8): n is a, c, g, or t
  misc_feature (11)..(11): n is a, c, g, or t
  misc_feature (13)..(13): n is a, c, g, or t
  misc_feature (53)..(54): n is a, c, g, or t
  misc_feature (56)..(56): n is a, c, g, or t
  misc_feature (59)..(59): n is a, c, g, or t
gtngnncnagngncctgccagtctccggggactttcccaggggtggggcggcnngnccnggcccccggcacttcctcgtcctcggcccgggtgccctgcccccgtccaggagccctaggagtgctacggggggccggagccttgcccgggccgctgccccgtccctggattcggggctggacgcagcaagcggggcgctgtgtccccaagctccccgtcctcggccaggcgggcaccacggcaggggctgagctaccctcatggaagggagaggaccgtaccggatctacgaccctgggggcagcgtgccctcaggagaggcatccgcagcttttgagcgcctagtgaaggagaattcccggctgaaggaaaaaatgcaagggataaagatgttaggggagcttttggaagagtcccagatggaagcgaccaggctccggcagaaggcagaggagctagtgaaggacaacgagctgctcccaccaccttctccctccttgggctccttcgaccccctggctgagctcacaggaaaggactcaaatgtcacagcatctcccacagcccctgcatgccccagtgacaagccagcaccagtccagaagcctccatccagtggcacctcctctgaatttgaagtggtcactcctgaggagcagaattcaccagagagcagcagccatgccaatgcgatggcgctgggccccctgccccgtgaggacggcaacctgatgctgcacctgcagcgcctggagaccacgctgagtgtgtgtgccgaggagccggaccacggccagctcttcacccacctgggccgcatggccctggagttcaaccgactggcatccaaggtgcacaagaatgagcagcgcacctccattctgcagaccctgtgtgagcagcttcggaaggagaacgaggctctgaaggccaagttggataagggcctggaacagcgggatcaggctgccgagaggctgcgggaggaaaatttggagctcaagaagttgttgatgagcaatggcaacaaagagggtgcgtctgggcggccaggctcaccgaagatggaagggacaggcaagaaggcagtggctggacagcagcaggctagtgtgacggcaggtaaggtcccagaggtggtggccttgggcgcagccgagaagaaggtgaagatgctggagcagcagcgcagtgagctgctggaagtgaacaagcagtgggaccagcatttccggtccatgaagcagcagtatgagcagaagatcactgagctgcgtcagaagctggctgatttgcagaagcaggtgactgacctggaggccgagcgggagcagaagcagcgtgactttgaccgcaagctcctcctggccaagtccaagattgaaatggaggagaccgacaaggagcagctgacagcagaggccaaggagctgcgccaaaaggtcaagtacctgcaggatcagctgagcccactcacccgacagcgtgagtaccaggaaaaggagatccagcggctcaacaaggccctggaggaagcactgagcatccaaaccccgccatcatctccaccaacagcatttgggagcccagaaggagcaggggccctcctaaggaaacaggagctggtcacgcagaatgagttgctgaaacagcaggtgaagatcttcgaggaggacttccagagggagcgcagtgatcgtgagcgcatgaatgaggagaaggaagagctgaagaagcaagtggagaagctgcaggcccaggtcaccctgtcaaatgcccagctaaaagcattcaaagatgaggagaaggcaagagaagccctcagacagcagaagaggaaagcaaaggcctcaggagagcgttaccatgtggagccccacccagaacatctctgcggggcctacccctacgcctacccgcccatgccagccatggtgccacaccatggcttcgaggactggtcccagatccgctacccccctccccccatggccatggagcacccgcccccactccccaactcgcgcctcttccatctgccggaatacacctggcgtctaccctgtggaggggttcgaaatccaaatcagagctcccaagtgatggaccctcccacagccaggcctacagaaccagagtctccaaaaaatgaccgtgaggggcctcagtgagaccagattgtgtcatttggctccaccttcatcttgcagagccagctgatctcagattgccaagaaactagaagccacttgcacggtgtggccagagcctcagctggatgagaggctgagatgggtggccagcttgtataccagtccctgaactgagctgtttacaggactggggaggctccacccagaaggctttcatttgtactctgctgggagtgactgggaaaaactccttccctgctgctgagtggagagaggcctcatccggctttgacccaccatccgttgcagaagcctccaggagcagcaatcctaagagtgggaggcagccaagacccccttccttcaaaacctcccggaagtggtttcaggccctctagttgccatgaccaatttgtgtgtgtgtttaatttttgcttcaagctctgtagcaggacctgccccacgcacacccctacccctctgtgaggagctgtgggaagtgtgggtttgtctccagaacagaagagaatgatggatattctggctctggggccctctccaccaccactcacagtagccttgctgaagccatcacagatgggagaaggccatgccagccacgtccgccgaggggcgccagcctgaagctgccaggccctgaggttcagaccctggaccccatagctggaggcctgtggtgccagaagcccagattagggtggctgtccatccctggatagctatttgcacgaatcatggacataaatccaagttgaagaagatcaaaaaaaaaaatcgggggctttttgtcggggtgggcaaacgcgctatgaatggccctggccatacctgttcctgacccagtttcttgtcccaagggtaattgccggcccctatgggagccgattaatacgaaagcagtactggagatcacgccacacaacatctgtcaccacgcatccaccgaggcgcacacctctacacacacacggaggcacacacatcccgcactcacacctacccaccactcgctccacccacacgcccacactccactccccgcaacagcatcacgagcacctccaactgccacacaga

SEQ ID NO: 329295 - DNA, 1777 bp, Homo sapiens
  misc_feature (52)..(52): n is a, c, g, or t
agtgctgcgcagtagctgttcctatgatgtacccccttctactctccgtgangtgctctacatccttgcctcacacactcctctctgcctctgaacccagatcactgagctgcgtcagaagctggctgatttgcagaagcaggtgactgacctggaggccgagcgggagcagaagcagcgtgactttgaccgcaagctcctcctggccaagtccaagattgaaatggaggagaccgacaaggagcagctgacagcagaggccaaggagctgcgccaaaaggtcaagtacctgcaggatcagctgagcccactcacccgacagcgtgagtaccaggaaaaggagatccagcggctcaacaaggccctggaggaagcactgagcatccaaaccccgccatcatctccaccaacagcatttgggagcccagaaggagcaggggccctcctaaggaaacaggagctggtcacgcagaatgagttgctgaaacagcaggtgaagatcttcgaggaggacttccagagggagcgcagtgatcgtgagcgcatgaatgaggagaaggaagagctgaagaagcaagtggagaagctgcaggcccaggtcaccctgtcaaatgcccagctaaaagcattcaaagatgaggagaaggcaagagaagccctcagacagcagaagaggaaagcaaaggcctcaggagagcgttaccatgtggagccccacccagaacatctctgcggggcctacccctacgcctacccgcccatgccagccatggtgccacaccatggcttcgaggactggtcccagatccgctacccccctccccccatggccatggagcacccgcccccactccccaactcgcgcctcttccatctgccggaatacacctggcgtctaccctgtggaggggttcgaaatccaaatcagagctcccaagtgatggaccctcccacagccaggcctacagaaccagagtctccaaaaaatgaccgtgaggggcctcagtgagaccagattgtgtcatttggctccaccttcatcttgcagagccagctgatctcagattgccaagaaactagaagccacttgcacggtgtggccagagcctcagctggatgagaggctgagatgggtggccagcttgtataccagtccctgaactgagctgtttacaggactggggaggctccacccagaaggctttcatttgtactctgctgggagtgactgggaaaaactccttccctgctgctgagtggagagaggcctcatccggctttgacccaccatccgttgcagaagcctccaggagcagcaatcctaagagtgggaggcagccaagacccccttccttcaaaacctcccggaagtggtttcaggccctctagttgccatgaccaatttgtgtgtgtgtttaatttttgcttcaagctctgtagcaggacctgccccacgcacacccctacccctctgtgaggagctgtgggaagtgtgggtttgtctccagaacagaagagaatgatggatattctggctctggggccctctccaccaccactcacagtagccttgctgaagccatcacagatgggagaaggccatgccagccacgtccgccgaggggcgccagcctgaagctgccaggccctgaggttcagaccctggaccccatagctggaggcctgtggtgccagaagcccagattagggtggctgtccatccctggatagctatttgcacgaatcatggacataaatccaagttgaagaagatcaa

SEQ ID NO: 329296 - DNA, 1579 bp, Homo sapiens
ggacgcgtgggtcgcccacgcgtcgatggaggagaccgacaaggagcagctgacagcagaggccaaggagctgcgccaaaaggtcaagtacctgcaggatcagctgagcccactcacccgacagcgtgagtaccaggaaaaggagatccagcggctcaacaaggccctggaggaagcactgagcatccaaaccccgccatcatctccaccaacagcatttgggagcccagaaggagcaggggccctcctaaggaaacaggagctggtcacgcagaatgagttgctgaaacagcaggtgaagatcttcgaggaggacttccagagggagcgcagtgatcgtgagcgcatgaatgaggagaaggaagagctgaagaagcaagtggagaagctgcaggcccaggtcaccctgtcaaatgcccagctaaaagcattcaaagatgaggagaaggcaagagaagccctcagacagcagaagaggaaagcaaaggcctcaggagagcgttaccatgtggagccccacccagaacatctctgcggggcctacccctacgcctacccgcccatgccagccatggtgccacaccatggcttcgaggactggtcccagatccgctacccccctccccccatggccatggagcacccgcccccactccccaactcgcgcctcttccatctgccggaatacacctggcgtctaccctgtggaggggttcgaaatccaaatcagagctcccaagtgatggaccctcccacagccaggcctacagaaccagagtctccaaaaaatgaccgtgaggggcctcagtgagaccagattgtgtcatttggctccaccttcatcttgcagagccagctgatctcagattgccaagaaactagaagccacttgcacggtgtggccagagcctcagctggatgagaggctgagatgggtggccagcttgtataccagtccctgaactgagctgtttacaggactggggaggctccacccagaaggctttcatttgtactctgctgggagtgactgggaaaaactccttccctgctgctgagtggagagaggcctcatccggctttgacccaccatccgttgcagaagcctccaggagcagcaatcctaagagtgggaggcagccaagacccccttccttcaaaacctcccggaagtggtttcaggccctctagttgccatgaccaatttgtgtgtgtgtttaatttttgcttcaagctctgtagcaggacctgccccacgcacacccctacccctctgtgaggagctgtgggaagtgtgggtttgtctccagaacagaagagaatgatggatattctggctctggggccctctccaccaccactcacagtagccttgctgaagccatcacagatgggagaaggccatgccagccacgtccgccgaggggcgccagcctgaagctgccaggccctgaggttcagaccctggaccccatagctggaggcctgtggtgccagaagcccagattagggtggctgtccatccctggatagctatttgcacgaatcatggacataaatccaagttgaagaagatcaa

SEQ ID NO: 329297 - DNA, 2162 bp, Homo sapiens
  misc_feature (3)..(3): n is a, c, g, or t
  misc_feature (5)..(6): n is a, c, g, or t
  misc_feature (8)..(8): n is a, c, g, or t
  misc_feature (11)..(11): n is a, c, g, or t
  misc_feature (13)..(13): n is a, c, g, or t
  misc_feature (53)..(54): n is a, c, g, or t
  misc_feature (56)..(56): n is a, c, g, or t
  misc_feature (59)..(59): n is a, c, g, or t
  misc_feature (1980)..(1980): n is a, c, g, or t
gtngnncnagngncctgccagtctccggggactttcccaggggtggggcggcnngnccnggcccccggcacttcctcgtcctcggcccgggtgccctgcccccgtccaggagccctaggagtgctacggggggccggagccttgcccgggccgctgccccgtccctggattcggggctggacgcagcaagcggggcgctgtgtccccaagctccccgtcctcggccaggcgggcaccacggcaggggctgagctaccctcatggaagggagaggaccgtaccggatctacgaccctgggggcagcgtgccctcaggagaggcatccgcagcttttgagcgcctagtgaaggagaattcccggctgaaggaaaaaatgcaagggataaagatgttaggggagcttttggaagagtcccagatggaagcgaccaggctccggcagaaggcagaggagctagtgaaggacaacgagctgctcccaccaccttctccctccttgggctccttcgaccccctggctgagctcacaggaaaggactcaaatgtcacagcatctcccacagcccctgcatgccccagtgacaagccagcaccagtccagaagcctccatccagtggcacctcctctgaatttgaagtggtcactcctgaggagcagaattcaccagagagcagcagccatgccaatgcgatggcgctgggccccctgccccgtgaggacggcaacctgatgctgcacctgcagcgcctggagaccacgctgagtgtgtgtgccgaggagccggaccacggccagctcttcacccacctgggccgcatggccctggagttcaaccgactggcatccaaggtgcacaagaatgagcagcgcacctccattctgcagaccctgtgtgagcagcttcggaaggagaacgaggctctgaaggccaagttggataagggcctggaacagcgggatcaggctgccgagaggctgcgggaggaaaatttggagctcaagaagttgttgatgagcaatggcaacaaagagggtgcgtctgggcggccaggctcaccgaagatggaagggacaggcaagaaggcagtggctggacagcagcaggctagtgtgacggcaggtaaggtcccagaggtggtggccttgggcgcagccgagaagaaggtgaagatgctggagcagcagcgcagtgagctgctggaagtgaacaagcagtgggaccagcatttccggtccatgaagcagcagtatgagcagaagatcactgagctgcgtcagaagctggctgatttgcagaagcaggtgactgacctggaggccgagcgggagcagaagcagcgtgactttgaccgcaagctcctcctggccaagtccaagattgaaatggaggagaccgacaaggagcagctgacagcagaggccaaggagctgcgccaaaaggtcaagtacctgcaggatcagctgagcccactcacccgacagcgtgagtaccaggaaaaggagatccagcggctcaacaaggccctggaggaagcactgagcatccaaaccccgccatcatctccaccaacagcatttgggagcccagaaggagcaggggccctcctaaggaaacaggagctggtcacgcagaatgagttgctgaaacagcaggtgaagatcttcgaggaggacttccagagggagcgcagtgatcgtgagcgcatgaatgaggagaaggaagagctgaagaagcaagtggagaagctgcaggcccaggtcaccctgtcaaatgcccagctaaaagcattcaaagatgaggagaaggcaagagaagccctcagacagcagaagaggaaagcaaaggcctcaggagagcgttaccatgtggagccccacccagaacatctctgcggggcctacccctacgcctacccgcccatgccagccatggtgccacaccatggcttcgaggactggtcccagatccgctaccctngttcagacggggcacggcgagagtggctgccagataagctgtaggggctcatgccactctccctgctaagcggagacgcacaggccgaacccaaactggggccacctctgaaccctcactttatggcacctgagccaccctcatccaggagtctctgtgtcccctgggtttcaacggccttc

SEQ ID NO: 329298 - DNA, 1592 bp, Homo sapiens
accagccttcactgcccatgtagcagccttctgtgcccatgtactagctttccgtgcccatgtaccagccttccgtgtccatgtaccagccttccatgcccatgtaccagctttccatgcccatgtactagccttctgtgcccatgtaccagccttccgtgcccatgtaccagccttccgtgcccatgtactagccttccatgcccatgtaccagccttccgtgcccatgtaccagccttctgtgcccatgtcacaaccttccatgcatgtgtacccagccttccatgcccatgcagccttccatgctcatatatccagccttctatgcccatgtatccagatttctgtacccatgtagcagcctttcatgaccacataccagcctttggtacccagcctgctagccttcagagagctaacattctatttagagggtgatgagatgggtgtcctttgcagcctgttgcaggccaaagccagacgtcagcctttcttgcaggcctcaggagagcgttaccatgtggagccccacccagaacatctctgcggggcctacccctacgcctacccgcccatgccagccatggtgccacaccatggcttcgaggactggtcccagatccgctacccccctccccccatggccatggagcacccgcccccactccccaactcgcgcctcttccatctgccggaatacacctggcgtctaccctgtggaggggttcgaaatccaaatcagagctcccaagtgatggaccctcccacagccaggcctacagaaccagagtctccaaaaaatgaccgtgaggggcctcagtgagaccagattgtgtcatttggctccaccttcatcttgcagagccagctgatctcagattgccaagaaactagaagccacttgcacggtgtggccagagcctcagctggatgagaggctgagatgggtggccagcttgtataccagtccctgaactgagctgtttacaggactggggaggctccacccagaaggctttcatttgtactctgctgggagtgactgggaaaaactccttccctgctgctgagtggagagaggcctcatccggctttgacccaccatccgttgcagaagcctccaggagcagcaatcctaagagtgggaggcagccaagacccccttccttcaaaacctcccggaagtggtttcaggccctctagttgccatgaccaatttgtgtgtgtgtttaatttttgcttcaagctctgtagcaggacctgccccacgcacacccctacccctctgtgaggagctgtgggaagtgtgggtttgtctccagaacagaagagaatgatggatattctggctctggggccctctccaccaccactcacagtagccttgctgaagccatcacagatgggagaaggccatgccagccacgtccgccgaggggcgccagcctgaagctgccaggccctgaggttcagaccctggaccccatagctggaggcctgtggtgccagaagcccagattagggtggctgtccatccctggatagctatttgcacgaatcatggacataaatccaagttgaagaagatcaa

SEQ ID NO: 329299 - DNA, 1982 bp, Homo sapiens
  misc_feature (3)..(3): n is a, c, g, or t
  misc_feature (5)..(6): n is a, c, g, or t
  misc_feature (8)..(8): n is a, c, g, or t
  misc_feature (11)..(11): n is a, c, g, or t
  misc_feature (13)..(13): n is a, c, g, or t
  misc_feature (53)..(54): n is a, c, g, or t
  misc_feature (56)..(56): n is a, c, g, or t
  misc_feature (59)..(59): n is a, c, g, or t
gtngnncnagngncctgccagtctccggggactttcccaggggtggggcggcnngnccnggcccccggcacttcctcgtcctcggcccgggtgccctgcccccgtccaggagccctaggagtgctacggggggccggagccttgcccgggccgctgccccgtccctggattcggggctggacgcagcaagcggggcgctgtgtccccaagctccccgtcctcggccaggcgggcaccacggcaggggctgagctaccctcatggaagggagaggaccgtaccggatctacgaccctgggggcagcgtgccctcaggagaggcatccgcagcttttgagcgcctagtgaaggagaattcccggctgaaggaaaaaatgcaagggataaagatgttaggggagcttttggaagagtcccagatggaagcgaccaggctccggcagaaggcagaggagctagtgaaggacaacgagctgctcccaccaccttctccctccttgggctccttcgaccccctggctgagctcacaggaaaggactcaaatgtcacagcatctcccacagcccctgcatgccccagtgacaagccagcaccagtccagaagcctccatccagtggcacctcctctgaatttgaagtggtcactcctgaggagcagaattcaccagagagcagcagccatgccaatgcgatggcgctgggccccctgccccgtgaggacggcaacctgatgctgcacctgcagcgcctggagaccacgctgagtgtgtgtgccgaggagccggaccacggccagctcttcacccacctgggccgcatggccctggagttcaaccgactggcatccaaggtgcacaagaatgagcagcgcacctccattctgcagaccctgtgtgagcagcttcggaaggagaacgaggctctgaaggccaagttggataagggcctggaacagcgggatcaggctgccgagaggctgcgggaggaaaatttggagctcaagaagttgttgatgagcaatggcaacaaagagggtgcgtctgggcggccaggctcaccgaagatggaagggacaggcaagaaggcagtggctggacagcagcaggctagtgtgacggcaggtaaggtcccagaggtggtggccttgggcgcagccgagaagaaggtgaagatgctggagcagcagcgcagtgagctgctggaagtgaacaagcagtgggaccagcatttccggtccatgaagcagcagtatgagcagaagatcactgagctgcgtcagaagctggctgatttgcagaagcaggtgactgacctggaggccgagcgggagcagaagcagcgtgactttgaccgcaagctcctcctggccaagtccaagattgaaatggaggagaccgacaaggagcagctgacagcagaggccaaggagctgcgccaaaaggtcaagtacctgcaggatcagctgagcccactcacccgacagcgtgagtaccaggaaaaggagatccagcggctcaacaaggccctggaggaagcactgagcatccaaaccccgccatcatctccaccaacagcatttgggagcccagaaggagcaggggccctcctaaggaaacaggagctggtcacgcagaatgagttgctgaaacagcaggtgaagatcttcgaggaggacttccagagggagcgcagtgatcgtgagcgcatgaatgaggagaaggaagagctgaagaagcaagtggagaagctgcaggcccaggtcaccctgtcaaatgcccagaagccatcacagatgggagaaggccatgccagccacgtccgccgaggggcgccagcctgaagctgccaggccctgaggttcagaccctggaccccatagctggaggcctgtggtgccagaagcccagattagggtggctgtccatccctggatagctatttgcacgaatcatggacataaatccaagttgaagaagatcaa

SEQ ID NO: 329300 - DNA, 1231 bp, Homo sapiens
  misc_feature (3)..(3): n is a, c, g, or t
  misc_feature (5)..(6): n is a, c, g, or t
  misc_feature (8)..(8): n is a, c, g, or t
  misc_feature (11)..(11): n is a, c, g, or t
  misc_feature (13)..(13): n is a, c, g, or t
  misc_feature (53)..(54): n is a, c, g, or t
  misc_feature (56)..(56): n is a, c, g, or t
  misc_feature (59)..(59): n is a, c, g, or t
gtngnncnagngncctgccagtctccggggactttcccaggggtggggcggcnngnccnggcccccggcacttcctcgtcctcggcccgggtgccctgcccccgtccaggagccctaggagtgctacggggggccggagccttgcccgggccgctgccccgtccctggattcggggctggacgcagcaagcggggcgctgtgtccccaagctccccgtcctcggccaggcgggcaccacggcaggggctgagctaccctcatggaagggagaggaccgtaccggatctacgaccctgggggcagcgtgccctcaggagaggcatccgcagcttttgagcgcctagtgaaggagaattcccggctgaaggaaaaaatgcaagggataaagatgttaggggagcttttggaagagtcccagatggaagcgaccaggctccggcagaaggcagaggagctagtgaaggacaacgagctgctcccaccaccttctccctccttgggctccttcgaccccctggctgagctcacaggaaaggactcaaatgtcacagcatctcccacagcccctgcatgccccagtgacaagccagcaccagtccagaagcctccatccagtggcacctcctctgaatttgaagtggtcactcctgaggagcagaattcaccagagagcagcagccatgccaatgcgatggcgctgggccccctgccccgtgaggacggcaacctgatgctgcacctgcagcgcctggagaccacgctgagtgtgtgtgccgaggagccggaccacggccagctcttcacccacctgggccgcatggccctggagttcaaccgactggcatccaaggtgcacaagaatgagcagcgcacctccattctgcagaccctgtgtgagcagcttcggaaggagaacgaggctctgaaggccaagttggataagggcctggaacagcgggatcaggctgccgagaggctgcgggaggaaaatttggagctcaagaagttgttgatgagcaatggcaacaaagagggtgcgtctgggcggccaggctcaccgaagatggaagggacaggcaagaaggcagtggctggacagcagcagggttcagaccctggaccccatagctggaggcctgtggtgccagaagcccagattagggtggctgtccatccctggatagctatttgcacgaatcatggacataaatccaagttgaagaagatcaa

SEQ ID NO: 329301 - DNA, 1242 bp, Homo sapiens
  misc_feature (3)..(3): n is a, c, g, or t
  misc_feature (5)..(6): n is a, c, g, or t
  misc_feature (8)..(8): n is a, c, g, or t
  misc_feature (11)..(11): n is a, c, g, or t
  misc_feature (13)..(13): n is a, c, g, or t
  misc_feature (53)..(54): n is a, c, g, or t
  misc_feature (56)..(56): n is a, c, g, or t
  misc_feature (59)..(59): n is a, c, g, or t
gtngnncnagngncctgccagtctccggggactttcccaggggtggggcggcnngnccnggcccccggcacttcctcgtcctcggcccgggtgccctgcccccgtccaggagccctaggagtgctacggggggccggagccttgcccgggccgctgccccgtccctggattcggggctggacgcagcaagcggggcgctgtgtccccaagctccccgtcctcggccaggcgggcaccacggcaggggctgagctaccctcatggaagggagaggaccgtaccggatctacgaccctgggggcagcgtgccctcaggagaggcatccgcagcttttgagcgcctagtgaaggagaattcccggctgaaggaaaaaatgcaagggataaagatgttaggggagcttttggaagagtcccagatggaagcgaccaggctccggcagaaggcagaggagctagtgaaggacaacgagctgctcccaccaccttctccctccttgggctccttcgaccccctggctgagctcacaggaaaggactcaaatgtcacagcatctcccacagcccctgcatgccccagtgacaagccagcaccagtccagaagcctccatccagtgtaagttttatttggagtcatgggtggaggttgcctggatggacctcaagtcctactgacagatacaagaacatgaagaaagagggttgaggtcaagaaactgtgttccgtctcgctgggtgatattgggcaagtccatcgcaaactctctggggcctcagcctccccattttgaaatgaaggtcatagttaaaacttaccaggaagaccctggtatgtacaaggaattcttctcacttactaagttgtatactgttaagtatcactgagtgtgcacagtgctaggaaaacagacagatgtgacatggagctcacattctcaaagagggctcagaaactatcttctacaggctgggcgcagtggctcatgcctataatcccaagtagctgggattacaggcatgcaccaccacgcccggtaattttttgtatttttggtagagacggggtttctccatattggccaggctggtcttgaactcctgacctcaggtgatccacccgccttggcctcccaaagtgctaggattacaggcgtgagccactgcgcctggcctcttttcccttcttatcattcttcttccaaagatctgctgtcacttgtcccattttccccagtcctctg

SEQ ID NO: 329302 - DNA, 721 bp, Homo sapiens
  misc_feature (3)..(3): n is a, c, g, or t
  misc_feature (5)..(6): n is a, c, g, or t
  misc_feature (8)..(8): n is a, c, g, or t
  misc_feature (11)..(11): n is a, c, g, or t
  misc_feature (13)..(13): n is a, c, g, or t
  misc_feature (53)..(54): n is a, c, g, or t
  misc_feature (56)..(56): n is a, c, g, or t
  misc_feature (59)..(59): n is a, c, g, or t
gtngnncnagngncctgccagtctccggggactttcccaggggtggggcggcnngnccnggcccccggcacttcctcgtcctcggcccgggtgccctgcccccgtccaggagccctaggagtgctacggggggccggagccttgcccgggccgctgccccgtccctggattcggggctggacgcagcaagcggggcgctgtgtccccaagctccccgtcctcggccaggcgggcaccacggcaggggctgagctaccctcatggaagggagaggaccgtaccggatctacgaccctgggggcagcgtgccctcaggagaggcatccgcagcttttgagcgcctagtgaaggagaattcccggctgaaggaaaaaatgcaagggataaagatgttaggggagcttttggaagagtcccagatggaagcgaccaggctccggcagaaggcagaggagctagtgaaggacaacgagctgctcccaccaccttctccctccttgggctccttcgaccccctggctgagctcacaggaaaggactcaaatgtcacagcatctcccacagcccctgcatgccccagtgacaagccagcaccaggttcagaccctggaccccatagctggaggcctgtggtgccagaagcccagattagggtggctgtccatccctggatagctatttgcacgaatcatggacataaatccaagttgaagaagatcaa

SEQ ID NO: 329303 - DNA, 532 bp, Homo sapiens
cccattgatcgccagggttgatcggctgatctggctggctagcgggtgccctcctccctcaccgctccatgtgcgtccctcccgaagctgccgctcggtcgaagaggacgaccatccccgatagaggaggaccggtcttcggtcaagggtatacgagtactgcgctcccctgctagaacctccaaacaagctctcaaggtccatttgtaggagaacgtagggtagtcaagcttccaaaactccagaacacagtcacgaggataatgggaatttaccgaaacccgtggaagcctttaaggaatggaaagagtggataataaaatgcctggctgttctccaaaaatgaggaccttcaaataggagtgattgaaataaataactacttgcatgttatgctttcatttgggtggaatacttcattggaataaactactgatcttgtgctgtgtcaaagtaacagactagaaccttctttcaagtacctgaattgaaatgaaactcattttgaataataaaaactctagaaactctt

SEQ ID NO: 329304 - DNA, 201 bp, Homo sapiens
gcggccgcctactactactactgctcgaattcaagcttctaacgatgtacggggacatgttatgctttcatttgggtggaatacttcattggaataaactactgatcttgtgctgtgtcaaagtaacagactagaaccttctttcaagtacctgaattgaaatgaaactcattttgaataataaaaactctagaaactctt

SEQ ID NO: 329305 - DNA, 2076 bp, Homo sapiens
aaaaaaaaaaaaaaagcaagaaaaagaaagagaatggcgaggcccagagagaccgaaagtcccaccagagggtacagagctagctcagccctaatgccggccccgcggtgcctttccgagctcacggcctcccctcagcatccgggtttcggcctcggagcgccagggacgccacgaggacgcgccccacacttgcgcttctgggttccagcccccgcggcccccaacaaataaagaagggaaagtgctgagggtgacggccccggggagcgctgcggctctacgtcaacctgcggcggccgccgactcatttggggccacgctggttgcattcgtcacgccggcgatgcctctcaaacccgcggcctgccgaggacgttcccacacgggagaccccagcgacgcgggcgcatctgtggctctcgagaaccgggccgcggagccgccgcgagcgcaagcgaggaatcggcgactgcgggggtggacagctggggcttgtagtcccctcgctaccctctattctggaagaggcgggtcgcggccgctgaactccagctctgcgcctgcccaggcggccgcacgctcaggggcgtggcatgggtgggtcgtgagttgggcggggcccacagggcgtgcgcgacgcagcggcgcggcgcgtggcgtaaggggcgtggcgccagtgggcgtggcgtggcgcagtgcgaagggacgcggtgcgcatgcgcgtgagggctgccgcggccaggcccagacatgtccgtccttgtaagttaaaagcttccatgggagccttccttcctaatcaagatgcaaataatacggcactccgaacagacactaaaaacagctctcatctcaaagaacccagtgcttgtatcacagtatgagaaattagatgctggggaacaacgtttaatgaatgaagccttccagccagccagtgatctctttggacccattaccttgcattctccatcagattggatcacctcccaccctgaggctccccaagactttgaacagttcttcagtgatccttacagaaagacaccctctccaaacaaacgcagcatttatatacagtccattggctctctaggaaacaccagaattatcagtgaagaatatattaaatggctcacgggctactgtaaagcatatttctatggcttgagagtaaaactcctagaaccagttcctgtttctgtaacaagatgttcctttagagtcaatgagaacacacacaacctacaaattcatgcaggggacatcctgaagttcttgaaaaagaagaaacctgaagatgccttctgtgttgtgggaataacaatgattgatctttacccaagagactcgtggaattttgtctttggacaggcctctttgacagatggtgtggggatattcagctttgccaggtatggcagtgatttttatagcatgcactataaaggcaaagtgaagaagctcaagaaaacatcttcaagtgactattcaattttcgacaactattatattccagaaataactagtgttttactacttcgatcctgtaagactttaacccatgagatcggacacatatttggactgcgacactgccagtggcttgcatgcctcatgcaaggctccaaccacttggaagaagctgaccggcgccctctaaacctttgccctatctgtttgcacaagttgcagtgtgctgttggcttcagcattgtagaaagatacaaagcactggtgaggtggattgatgatgaatcttctgacacacctggagcaactccagaacacagtcacgaggataatgggaatttaccgaaacccgtggaagcctttaaggaatggaaagagtggataataaaatgcctggctgttctccaaaaatgaggaccttcaaataggagtgattgaaataaataactacttgcatgttatgctttcatttgggtggaatacttcattggaataaactactgatcttgtgctgtgtcaaagtaacagactagaaccttctttcaagtacctgaattgaaatgaaactcattttgaataataaaaactctagaaactctt

SEQ ID NO: 329306 - DNA, 2100 bp, Homo sapiens
aaaaaaaaaaaaaaagcaagaaaaagaaagagaatggcgaggcccagagagaccgaaagtcccaccagagggtacagagctagctcagccctaatgccggccccgcggtgcctttccgagctcacggcctcccctcagcatccgggtttcggcctcggagcgccagggacgccacgaggacgcgccccacacttgcgcttctgggttccagcccccgcggcccccaacaaataaagaagggaaagtgctgagggtgacggccccggggagcgctgcggctctacgtcaacctgcggcggccgccgactcatttggggccacgctggttgcattcgtcacgccggcgatgcctctcaaacccgcggcctgccgaggacgttcccacacgggagaccccagcgacgcgggcgcatctgtggctctcgagaaccgggccgcggagccgccgcgagcgcaagcgaggaatcggcgactgcgggggtggacagctggggcttgtagtcccctcgctaccctctattctggaagaggcgggtcgcggccgctgaactccagctctgcgcctgcccaggcggccgcacgctcaggggcgtggcatgggtgggtcgtgagttgggcggggcccacagggcgtgcgcgacgcagcggcgcggcgcgtggcgtaaggggcgtggcgccagtgggcgtggcgtggcgcagtgcgaagggacgcggtgcgcatgcgcgtgagggctgccgcgggtgggtggtatcgaggcctgtcggccaggcccagacatgtccgtccttgtaagttaaaagcttccatgggagccttccttcctaatcaagatgcaaataatacggcactccgaacagacactaaaaacagctctcatctcaaagaacccagtgcttgtatcacagtatgagaaattagatgctggggaacaacgtttaatgaatgaagccttccagccagccagtgatctctttggacccattaccttgcattctccatcagattggatcacctcccaccctgaggctccccaagactttgaacagttcttcagtgatccttacagaaagacaccctctccaaacaaacgcagcatttatatacagtccattggctctctaggaaacaccagaattatcagtgaagaatatattaaatggctcacgggctactgtaaagcatatttctatggcttgagagtaaaactcctagaaccagttcctgtttctgtaacaagatgttcctttagagtcaatgagaacacacacaacctacaaattcatgcaggggacatcctgaagttcttgaaaaagaagaaacctgaagatgccttctgtgttgtgggaataacaatgattgatctttacccaagagactcgtggaattttgtctttggacaggcctctttgacagatggtgtggggatattcagctttgccaggtatggcagtgatttttatagcatgcactataaaggcaaagtgaagaagctcaagaaaacatcttcaagtgactattcaattttcgacaactattatattccagaaataactagtgttttactacttcgatcctgtaagactttaacccatgagatcggacacatatttggactgcgacactgccagtggcttgcatgcctcatgcaaggctccaaccacttggaagaagctgaccggcgccctctaaacctttgccctatctgtttgcacaagttgcagtgtgctgttggcttcagcattgtagaaagatacaaagcactggtgaggtggattgatgatgaatcttctgacacacctggagcaactccagaacacagtcacgaggataatgggaatttaccgaaacccgtggaagcctttaaggaatggaaagagtggataataaaatgcctggctgttctccaaaaatgaggaccttcaaataggagtgattgaaataaataactacttgcatgttatgctttcatttgggtggaatacttcattggaataaactactgatcttgtgctgtgtcaaagtaacagactagaaccttctttcaagtacctgaattgaaatgaaactcattttgaataataaaaactctagaaactctt

SEQ ID NO: 329307 - DNA, 2629 bp, Homo sapiens
aaaaaaaaaaaaaaagcaagaaaaagaaagagaatggcgaggcccagagagaccgaaagtcccaccagagggtacagagctagctcagccctaatgccggccccgcggtgcctttccgagctcacggcctcccctcagcatccgggtttcggcctcggagcgccagggacgccacgaggacgcgccccacacttgcgcttctgggttccagcccccgcggcccccaacaaataaagaagggaaagtgctgagggtgacggccccggggagcgctgcggctctacgtcaacctgcggcggccgccgactcatttggggccacgctggttgcattcgtcacgccggcgatgcctctcaaacccgcggcctgccgaggacgttcccacacgggagaccccagcgacgcgggcgcatctgtggctctcgagaaccgggccgcggagccgccgcgagcgcaagcgaggaatcggcgactgcgggggtggacagctggggcttgtagtcccctcgctaccctctattctggaagaggcgggtcgcggccgctgaactccagctctgcgcctgcccaggcggccgcacgctcaggggcgtggcatgggtgggtcgtgagttgggcggggcccacagggcgtgcgcgacgcagcggcgcggcgcgtggcgtaaggggcgtggcgccagtgggcgtggcgtggcgcagtgcgaagggacgcggtgcgcatgcgcgtgagggctgccgcgggtgggtggtatcgaggcctgtcgggtcagggcggttcgcgggtgctgtcagagctgggccggggcccctaggcagggtagccgggtcgtagaggcgggggccggtcgcggtcggtggagcgggatgaggatgtaggaggggcggacgtggcggaagccgcggggtccgcggggtcggtgcctctagggagccagggaggcctttcccgaggctcctggggaagaagaggcgaagcgagagtccctggggaacccccactccactcccagctggagactgggttgtgtctgcatggaccagagcccacagtgcgagttgctataggcaaccagccagggtggccagctcctccccgtttgcccgtgatgttctggttttgggaccaaagcatcctaggcctccagcccactgcagtgaccgaattctgcgccccctgcccatcttctcccgcagcttccctagattaggcttgggaggcaagaggaggcctcctgacctttcacactgcctttttaatattaagatgaagtcacactccacaactttcttccagccaggcccagacatgtccgtccttgtaagttaaaagcttccatgggagccttccttcctaatcaagatgcaaataatacggcactccgaacagacactaaaaacagctctcatctcaaagaacccagtgcttgtatcacagtatgagaaattagatgctggggaacaacgtttaatgaatgaagccttccagccagccagtgatctctttggacccattaccttgcattctccatcagattggatcacctcccaccctgaggctccccaagactttgaacagttcttcagtgatccttacagaaagacaccctctccaaacaaacgcagcatttatatacagtccattggctctctaggaaacaccagaattatcagtgaagaatatattaaatggctcacgggctactgtaaagcatatttctatggcttgagagtaaaactcctagaaccagttcctgtttctgtaacaagatgttcctttagagtcaatgagaacacacacaacctacaaattcatgcaggggacatcctgaagttcttgaaaaagaagaaacctgaagatgccttctgtgttgtgggaataacaatgattgatctttacccaagagactcgtggaattttgtctttggacaggcctctttgacagatggtgtggggatattcagctttgccaggtatggcagtgatttttatagcatgcactataaaggcaaagtgaagaagctcaagaaaacatcttcaagtgactattcaattttcgacaactattatattccagaaataactagtgttttactacttcgatcctgtaagactttaacccatgagatcggacacatatttggactgcgacactgccagtggcttgcatgcctcatgcaaggctccaaccacttggaagaagctgaccggcgccctctaaacctttgccctatctgtttgcacaagttgcagtgtgctgttggcttcagcattgtagaaagatacaaagcactggtgaggtggattgatgatgaatcttctgacacacctggagcaactccagaacacagtcacgaggataatgggaatttaccgaaacccgtggaagcctttaaggaatggaaagagtggataataaaatgcctggctgttctccaaaaatgaggaccttcaaataggagtgattgaaataaataactacttgcatgttatgctttcatttgggtggaatacttcattggaataaactactgatcttgtgctgtgtcaaagtaacagactagaaccttctttcaagtacctgaattgaaatgaaactcattttgaataataaaaactctagaaactctt

SEQ ID NO: 329308 - DNA, 2478 bp, Homo sapiens
aaaaaaaaaaaaaaagcaagaaaaagaaagagaatggcgaggcccagagagaccgaaagtcccaccagagggtacagagctagctcagccctaatgccggccccgcggtgcctttccgagctcacggcctcccctcagcatccgggtttcggcctcggagcgccagggacgccacgaggacgcgccccacacttgcgcttctgggttccagcccccgcggcccccaacaaataaagaagggaaagtgctgagggtgacggccccggggagcgctgcggctctacgtcaacctgcggcggccgccgactcatttggggccacgctggttgcattcgtcacgccggcgatgcctctcaaacccgcggcctgccgaggacgttcccacacgggagaccccagcgacgcgggcgcatctgtggctctcgagaaccgggccgcggagccgccgcgagcgcaagcgaggaatcggcgactgcgggggtggacagctggggcttgtagtcccctcgctaccctctattctggaagaggcgggtcgcggccgctgaactccagctctgcgcctgcccaggcggccgcacgctcaggggcgtggcatgggtgggtcgtgagttgggcggggcccacagggcgtgcgcgacgcagcggcgcggcgcgtggcgtaaggggcgtggcgccagtgggcgtggcgtggcgcagtgcgaagggacgcggtgcgcatgcgcgtgagggctgccgcgggtgggtggtatcgaggcctgtcgggtcagggcggttcgcgggtgctgtcagagctgggccggggcccctaggcagggtagccgggtcgtagaggcgggggccggtcgcggtcggtggactggagactgggttgtgtctgcatggaccagagcccacagtgcgagttgctataggcaaccagccagggtggccagctcctccccgtttgcccgtgatgttctggttttgggaccaaagcatcctaggcctccagcccactgcagtgaccgaattctgcgccccctgcccatcttctcccgcagcttccctagattaggcttgggaggcaagaggaggcctcctgacctttcacactgcctttttaatattaagatgaagtcacactccacaactttcttccagccaggcccagacatgtccgtccttgtaagttaaaagcttccatgggagccttccttcctaatcaagatgcaaataatacggcactccgaacagacactaaaaacagctctcatctcaaagaacccagtgcttgtatcacagtatgagaaattagatgctggggaacaacgtttaatgaatgaagccttccagccagccagtgatctctttggacccattaccttgcattctccatcagattggatcacctcccaccctgaggctccccaagactttgaacagttcttcagtgatccttacagaaagacaccctctccaaacaaacgcagcatttatatacagtccattggctctctaggaaacaccagaattatcagtgaagaatatattaaatggctcacgggctactgtaaagcatatttctatggcttgagagtaaaactcctagaaccagttcctgtttctgtaacaagatgttcctttagagtcaatgagaacacacacaacctacaaattcatgcaggggacatcctgaagttcttgaaaaagaagaaacctgaagatgccttctgtgttgtgggaataacaatgattgatctttacccaagagactcgtggaattttgtctttggacaggcctctttgacagatggtgtggggatattcagctttgccaggtatggcagtgatttttatagcatgcactataaaggcaaagtgaagaagctcaagaaaacatcttcaagtgactattcaattttcgacaactattatattccagaaataactagtgttttactacttcgatcctgtaagactttaacccatgagatcggacacatatttggactgcgacactgccagtggcttgcatgcctcatgcaaggctccaaccacttggaagaagctgaccggcgccctctaaacctttgccctatctgtttgcacaagttgcagtgtgctgttggcttcagcattgtagaaagatacaaagcactggtgaggtggattgatgatgaatcttctgacacacctggagcaactccagaacacagtcacgaggataatgggaatttaccgaaacccgtggaagcctttaaggaatggaaagagtggataataaaatgcctggctgttctccaaaaatgaggaccttcaaataggagtgattgaaataaataactacttgcatgttatgctttcatttgggtggaatacttcattggaataaactactgatcttgtgctgtgtcaaagtaacagactagaaccttctttcaagtacctgaattgaaatgaaactcattttgaataataaaaactctagaaactctt

SEQ ID NO: 329309 - DNA, 2071 bp, Homo sapiens
aaaaaaaaaaaaaaagcaagaaaaagaaagagaatggcgaggcccagagagaccgaaagtcccaccagagggtacagagctagctcagccctaatgccggccccgcggtgcctttccgagctcacggcctcccctcagcatccgggtttcggcctcggagcgccagggacgccacgaggacgcgccccacacttgcgcttctgggttccagcccccgcggcccccaacaaataaagaagggaaagtgctgagggtgacggccccggggagcgctgcggctctacgtcaacctgcggcggccgccgactcatttggggccacgctggttgcattcgtcacgccggcgatgcctctcaaacccgcggcctgccgaggacgttcccacacgggagaccccagcgacgcgggcgcatctgtggctctcgagaaccgggccgcggagccgccgcgagcgcaagcgaggaatcggcgactgcgggggtggacagctggggcttgtagtcccctcgctaccctctattctggaagaggcgggtcgcggccgctgaactccagctctgcgcctgcccaggcggccgcacgctcaggggcgtggcatgggtgggtcgtgagttgggcggggcccacagggcgtgcgcgacgcagcggcgcggcgcgtggcgtaaggggcgtggcgccagtgggcgtggcgtggcgcagtgcgaagggacgcggtgcgcatgcgcgtgagggctgccgcgggtgggtggtatcgaggcctgtcgggtcagggcggttcgcgggtgctgtcagagctgggccggggcccctagccaggcccagacatgtccgtccttgtaagttaaaagcttccatgggagccttccttcctaatcaagatgcaaataatacggcactccgaacagacactaaaaacagctctcatctcaaagaacccagtgcttgtatcacagtatgagaaattagatgctggggaacaacgtttaatgaatgaagccttccagccagccagtgatctctttggacccattaccttgcattctccatcagattggatcacctcccaccctgaggctccccaagactttgaacagttcttcagtgatccttacagaaagacaccctctccaaacaaacgcagcatttatatacagtccattggctctctaggaaacaccagaattatcagtgaagaatatattaaatggctcacgggctactgtaaagcatatttctatggcttgagagtaaaactcctagaaccagttcctgtttctgtaacaagatgttcctttagagtcaatgagaacacacacaacctacaaattcatgcaggggacatcctgaagttcttgaaaaagaagaaacctgaagatgccttctgtgttgtgggaataacaatgattgatctttacccaagagactcgtggaattttgtctttggacaggcctctttgacagatggtgtggggatattcagctttgccaggtatggcagtgatttttatagcatgcactataaaggcaaagtgaagaagctcaagaaaacatcttcaagtgactattcaattttcgacaactattatattccagaaataactagtgttttactacttcgatcctgtaagactttaacccatgagatcggacacatatttggactgcgacactgccagtggcttgcatgcctcatgcaaggctccaaccacttggaagaagctgaccggcgccctctaaacctttgccctatctgtttgcacaagttgcagtgtgctgttggcttcagcattgtagaaagatacaaagcactggtgaggtggattgatgatgaatcttctgacacacctggagcaactccagaacacagtcacgaggataatgggaatttaccgaaacccgtggaagcctttaaggaatggaaagagtggataataaaatgcctggctgttctccaaaaatgaggaccttcaaataggagtgattgaaataaataactacttgcatgttatgctttcatttgggtggaatacttcattggaataaactactgatcttgtgctgtgtcaaagta

SEQ ID NO: 329310 - DNA, 1555 bp, Homo sapiens
agcagtagccggaggaagccgccgctggtcccccaagcaccagcgcccgggtggaaggggcgaggaggcggggccgtgaacaaagtggtgtacgatgaccacgggagctaggaggaagaggacggcgacgtcgaggagacccaggagtctgaggacaacgaggagcatgagatggaggaggacgaggctgattccgattatctggaggagctggaagacgacgacgacgccagttactgcacagaaagcagcttcaggagccatagtacctacagcagcactccagatgcaaataatacggcactccgaacagacactaaaaacagctctcatctcaaagaacccagtgcttgtatcacagtatgagaaattagatgctggggaacaacgtttaatgaatgaagccttccagccagccagtgatctctttggacccattaccttgcattctccatcagattggatcacctcccaccctgaggctccccaagactttgaacagttcttcagtgatccttacagaaagacaccctctccaaacaaacgcagcatttatatacagtccattggctctctaggaaacaccagaattatcagtgaagaatatattaaatggctcacgggctactgtaaagcatatttctatggcttgagagtaaaactcctagaaccagttcctgtttctgtaacaagatgttcctttagagtcaatgagaacacacacaacctacaaattcatgcaggggacatcctgaagttcttgaaaaagaagaaacctgaagatgccttctgtgttgtgggaataacaatgattgatctttacccaagagactcgtggaattttgtctttggacaggcctctttgacagatggtgtggggatattcagctttgccaggtatggcagtgatttttatagcatgcactataaaggcaaagtgaagaagctcaagaaaacatcttcaagtgactattcaattttcgacaactattatattccagaaataactagtgttttactacttcgatcctgtaagactttaacccatgagatcggacacatatttggactgcgacactgccagtggcttgcatgcctcatgcaaggctccaaccacttggaagaagctgaccggcgccctctaaacctttgccctatctgtttgcacaagttgcagtgtgctgttggcttcagcattgtagaaagatacaaagcactggtgaggtggattgatgatgaatcttctgacacacctggagcaactccagaacacagtcacgaggataatgggaatttaccgaaacccgtggaagcctttaaggaatggaaagagtggataataaaatgcctggctgttctccaaaaatgaggaccttcaaataggagtgattgaaataaataactacttgcatgttatgctttcatttgggtggaatacttcattggaataaactactgatcttgtgctgtgtcaaagtaacagactagaaccttctttcaagtacctgaattgaaatgaaactcattttgaataataaaaactctagaaactctt

SEQ ID NO: 329311 - DNA, 1567 bp, Homo sapiens
agcagtagccggaggaagccgccgctggtcccccaagcaccagcgcccgggtggaaggggcgaggaggcggggccgtgaacaaagtggtgtacgatgaccacgggagctaggaggaagaggacggcgacgtcgaggagacccaggagtctgaggacaacgaggagcatgagatggaggaggacgaggctgattccgattatctggaggagctggaagacgacgacgacgccagttactgcacagaaagcagcttcaggagccatagtacctacagcagcactccagccaggcccagacatgtccgtccttgtaagttaaaagcttccatgggagccttccttcctaatcaagatgcaaataatacggcactccgaacagacattagatgctggggaacaacgtttaatgaatgaagccttccagccagccagtgatctctttggacccattaccttgcattctccatcagattggatcacctcccaccctgaggctccccaagactttgaacagttcttcagtgatccttacagaaagacaccctctccaaacaaacgcagcatttatatacagtccattggctctctaggaaacaccagaattatcagtgaagaatatattaaatggctcacgggctactgtaaagcatatttctatggcttgagagtaaaactcctagaaccagttcctgtttctgtaacaagatgttcctttagagtcaatgagaacacacacaacctacaaattcatgcaggggacatcctgaagttcttgaaaaagaagaaacctgaagatgccttctgtgttgtgggaataacaatgattgatctttacccaagagactcgtggaattttgtctttggacaggcctctttgacagatggtgtggggatattcagctttgccaggtatggcagtgatttttatagcatgcactataaaggcaaagtgaagaagctcaagaaaacatcttcaagtgactattcaattttcgacaactattatattccagaaataactagtgttttactacttcgatcctgtaagactttaacccatgagatcggacacatatttggactgcgacactgccagtggcttgcatgcctcatgcaaggctccaaccacttggaagaagctgaccggcgccctctaaacctttgccctatctgtttgcacaagttgcagtgtgctgttggcttcagcattgtagaaagatacaaagcactggtgaggtggattgatgatgaatcttctgacacacctggagcaactccagaacacagtcacgaggataatgggaatttaccgaaacccgtggaagcctttaaggaatggaaagagtggataataaaatgcctggctgttctccaaaaatgaggaccttcaaataggagtgattgaaataaataactacttgcatgttatgctttcatttgggtggaatacttcattggaataaactactgatcttgtgctgtgtcaaagtaacagactagaaccttctttcaagtacctgaattgaaatgaaactcattttgaataataaaaactctagaaactctt

SEQ ID NO: 329312 - DNA, 1951 bp, Homo sapiens
aaaaaaaaaaaaaaagcaagaaaaagaaagagaatggcgaggcccagagagaccgaaagtcccaccagagggtacagagctagctcagccctaatgccggccccgcggtgcctttccgagctcacggcctcccctcagcatccgggtttcggcctcggagcgccagggacgccacgaggacgcgccccacacttgcgcttctgggttccagcccccgcggcccccaacaaataaagaagggaaagtgctgagggtgacggccccggggagcgctgcggctctacgtcaacctgcggcggccgccgactcatttggggccacgctggttgcattcgtcacgccggcgatgcctctcaaacccgcggcctgccgaggacgttcccacacgggagaccccagcgacgcgggcgcatctgtggctctcgagaaccgggccgcggagccgccgcgagcgcaagcgaggaatcggcgactgcgggggtggacagctggggcttgtagtcccctcgctaccctctattctggaagaggcgggtcgcggccgctgaactccagctctgcgcctgcccaggcggccgcacgctcaggggcgtggcatgggtgggtcgtgagttgggcggggcccacagggcgtgcgcgacgcagcggcgcggcgcgtggcgtaaggggcgtggcgccagtgggcgtggcgtggcgcagtgcgaagggacgcggtgcgcatgcgcgtgagggctgccgcggccaggcccagacatgtccgtccttgtaagttaaaagcttccatgggagccttccttcctaatcaagatgcaaataatacggcactccgaacagacactaaaaacagctctcatctcaaagaacccagtgcttgtatcacagtatgagaaattagatgctggggaacaacgtttaatgaatgaagccttccagccagccagtgatctctttggacccattaccttgcattctccatcagattggatcacctcccaccctgaggctccccaagactttgaacagttcttcagtgatccttacagaaagacaccctctccaaacaaacgcagcatttatatacagtccattggctctctaggaaacaccagaattatcagtgaagaatatattaaatggctcacgggctactgtaaagcatatttctatggcttgagagtaaaactcctagaaccagttcctgtttctgtaacaagatgttcctttagagtcaatgagaacacacacaacctacaaattcatgcaggggacatcctgaagttcttgaaaaagaagaaacctgaagatgccttctgtgttgtgggaataacaatgattgatctttacccagaaaacatcttcaagtgactattcaattttcgacaactattatattccagaaataactagtgttttactacttcgatcctgtaagactttaacccatgagatcggacacatatttggactgcgacactgccagtggcttgcatgcctcatgcaaggctccaaccacttggaagaagctgaccggcgccctctaaacctttgccctatctgtttgcacaagttgcagtgtgctgttggcttcagcattgtagaaagatacaaagcactggtgaggtggattgatgatgaatcttctgacacacctggagcaactccagaacacagtcacgaggataatgggaatttaccgaaacccgtggaagcctttaaggaatggaaagagtggataataaaatgcctggctgttctccaaaaatgaggaccttcaaataggagtgattgaaataaataactacttgcatgttatgctttcatttgggtggaatacttcattggaataaactactgatcttgtgctgtgtcaaagtaacagactagaaccttctttcaagtacctgaattgaaatgaaactcattttgaataataaaaactctagaaactctt

SEQ ID NO: 329313 - DNA, 2455 bp, Homo sapiens
aaaaaaaaaaaaaaagcaagaaaaagaaagagaatggcgaggcccagagagaccgaaagtcccaccagagggtacagagctagctcagccctaatgccggccccgcggtgcctttccgagctcacggcctcccctcagcatccgggtttcggcctcggagcgccagggacgccacgaggacgcgccccacacttgcgcttctgggttccagcccccgcggcccccaacaaataaagaagggaaagtgctgagggtgacggccccggggagcgctgcggctctacgtcaacctgcggcggccgccgactcatttggggccacgctggttgcattcgtcacgccggcgatgcctctcaaacccgcggcctgccgaggacgttcccacacgggagaccccagcgacgcgggcgcatctgtggctctcgagaaccgggccgcggagccgccgcgagcgcaagcgaggaatcggcgactgcgggggtggacagctggggcttgtagtcccctcgctaccctctattctggaagaggcgggtcgcggccgctgaactccagctctgcgcctgcccaggcggccgcacgctcaggggcgtggcatgggtgggtcgtgagttgggcggggcccacagggcgtgcgcgacgcagcggcgcggcgcgtggcgtaaggggcgtggcgccagtgggcgtggcgtggcgcagtgcgaagggacgcggtgcgcatgcgcgtgagggctgccgcgggtgggtggtatcgaggcctgtcgggtcagggcggttcgcgggtgctgtcagagctgggccggggcccctaggcagggtagccgggtcgtagaggcgggggccggtcgcggtcggtggagcgggatgaggatgtaggaggggcggacgtggcggaagccgcggggtccgcggggtcggtgcctctagggagccagggaggcctttcccgaggctcctggggaagaagaggcgaagcgagagtccctggggaacccccactccactcccagctggagactgggttgtgtctgcatggaccagagcccacagtgcgagttgctataggcaaccagccagggtggccagctcctccccgtttgcccgtgatgttctggttttgggaccaaagcatcctaggcctccagcccactgcagtgaccgaattctgcgccccctgcccatcttctcccgcagcttccctagattaggcttgggaggcaagaggaggcctcctgacctttcacactgcctttttaatattaagatgaagtcacactccacaactttcttccagccaggcccagacatgtccgtccttgtaagttaaaagcttccatgggagccttccttcctaatcaagatgcaaataatacggcactccgaacagacactaaaaacagctctcatctcaaagaacccagtgcttgtatcacagtatgagaaattagatgctggggaacaacgtttaatgaatgaagccttccagccagccagtgatctctttggacccattaccttgcattctccatcagattggatcacctcccaccctgaggctccccaagactttgaacagttcttcagtgatccttacagaaagacaccctctccaaacaaacgcagcatttatatacagtccattggggacatcctgaagttcttgaaaaagaagaaacctgaagatgccttctgtgttgtgggaataacaatgattgatctttacccaagagactcgtggaattttgtctttggacaggcctctttgacagatggtgtggggatattcagctttgccaggtatggcagtgatttttatagcatgcactataaaggcaaagtgaagaagctcaagaaaacatcttcaagtgactattcaattttcgacaactattatattccagaaataactagtgttttactacttcgatcctgtaagactttaacccatgagatcggacacatatttggactgcgacactgccagtggcttgcatgcctcatgcaaggctccaaccacttggaagaagctgaccggcgccctctaaacctttgccctatctgtttgcacaagttgcagtgtgctgttggcttcagcattgtagaaagatacaaagcactggtgaggtggattgatgatgaatcttctgacacacctggagcaactccagaacacagtcacgaggataatgggaatttaccgaaacccgtggaagcctttaaggaatggaaagagtggataataaaatgcctggctgttctccaaaaatgaggaccttcaaataggagtgattgaaataaataactacttgcatgttatgctttcatttgggtggaatacttcattggaataaactactgatcttgtgctgtgtcaaagtaacagactagaaccttctttcaagtacctgaattgaaatgaaactcattttgaataataaaaactctagaaactctt

SEQ ID NO: 329314 - DNA, 1671 bp, Homo sapiens
aaaaaaaaaaaaaaagcaagaaaaagaaagagaatggcgaggcccagagagaccgaaagtcccaccagagggtacagagctagctcagccctaatgccggccccgcggtgcctttccgagctcacggcctcccctcagcatccgggtttcggcctcggagcgccagggacgccacgaggacgcgccccacacttgcgcttctgggttccagcccccgcggcccccaacaaataaagaagggaaagtgctgagggtgacggccccggggagcgctgcggctctacgtcaacctgcggcggccgccgactcatttggggccacgctggttgcattcgtcacgccggcgatgcctctcaaacccgcggcctgccgaggacgttcccacacgggagaccccagcgacgcgggcgcatctgtggctctcgagaaccgggccgcggagccgccgcgagcgcaagcgaggaatcggcgactgcgggggtggacagctggggcttgtagtcccctcgctaccctctattctggaagaggcgggtcgcggccgctgaactccagctctgcgcctgcccaggcggccgcacgctcaggggcgtggcatgggtgggtcgtgagttgggcggggcccacagggcgtgcgcgacgcagcggcgcggcgcgtggcgtaaggggcgtggcgccagtgggcgtggcgtggcgcagtgcgaagggacgcggtgcgcatgcgcgtgagggctgccgcgggtgggtggtatcgaggcctgtcgggtcagggcggttcgcgggtgctgtcagagctgggccggggcccctaggcagggtagccgggtcgtagaggcgggggccggtcgcggtcggtggagcgggatgaggatgtaggaggggcggacgtggcggaagccgcggggtccgcggggtcggtgcctctagggagccagggaggcctttcccgaggctcctggggaagaagaggcgaagcgagagtccctggggaacccccactccactcccagctggagactgggttgtgtctgcatggaccagagcccacagtgcgagttgctataggcaaccagccagggtggccagctcctccccgtttgcccgtgatgttctggttttgggaccaaagcatcctaggcctccagcccactgcagtgaccgaattctgcgccccctgcccatcttctcccgcagcttccctagattaggcttgggaggcaagaggaggcctcctgacctttcacactgcctttttaatattaagatgaagtcacactccacaactttcttccagccaggcccagacatgtccgtccttgtaagttaaaagcttccatgggagccttccttcctaatcaagatgcaaataatacggcactccgaacagacactaaaaacagctctcatctcaaagaacccagtgcttgtatcacagtatgagaaattagatgctggggaacaacgtttaatgaatgaagccttccagccagccagtgatctctttggacccattaccttgcattctccatcagattggatcacctcccaccctgaggctccccaagactttgaacagttcttcagtgatccttacagaagccatggtcaacacaagaccacggtaacccacaagccacggtaacccacaagccacggtaacccaaaagtacg

SEQ ID NO: 329315 - DNA, 1519 bp, Homo sapiens
aaaaaaaaaaaaaaagcaagaaaaagaaagagaatggcgaggcccagagagaccgaaagtcccaccagagggtacagagctagctcagccctaatgccggccccgcggtgcctttccgagctcacggcctcccctcagcatccgggtttcggcctcggagcgccagggacgccacgaggacgcgccccacacttgcgcttctgggttccagcccccgcggcccccaacaaataaagaagggaaagtgctgagggtgacggccccggggagcgctgcggctctacgtcaacctgcggcggccgccgactcatttggggccacgctggttgcattcgtcacgccggcgatgcctctcaaacccgcggcctgccgaggacgttcccacacgggagaccccagcgacgcgggcgcatctgtggctctcgagaaccgggccgcggagccgccgcgagcgcaagcgaggaatcggcgactgcgggggtggacagctggggcttgtagtcccctcgctaccctctattctggaagaggcgggtcgcggccgctgaactccagctctgcgcctgcccaggcggccgcacgctcaggggcgtggcatgggtgggtcgtgagttgggcggggcccacagggcgtgcgcgacgcagcggcgcggcgcgtggcgtaaggggcgtggcgccagtgggcgtggcgtggcgcagtgcgaagggacgcggtgcgcatgcgcgtgagggctgccgcgggtgggtggtatcgaggcctgtcgggtcagggcggttcgcgggtgctgtcagagctgggccggggcccctaggcagggtagccgggtcgtagaggcgggggccggtcgcggtcggtggagcgggatgaggatgtaggaggggcggacgtggcggaagccgcggggtccgcggggtcggtgcctctagggagccagggaggcctttcccgaggctcctggggaagaagaggcgaagcgagagtccctggggaacccccactccactcccagctggagactgggttgtgtctgcatggaccagagcccacagtgcgagttgctataggcaaccagccagggtggccagctcctccccgtttgcccgtgatgttctggttttgggaccaaagcatcctaggcctccagcccactgcagtgaccgaattctgcgccccctgcccatcttctcccgcagcttccctagattaggcttgggaggcaagaggaggcctcctgacctttcacactgcctttttaatattaagatgaagtcacactccacaactttcttccagccaggcccagacatgtccgtccttgtaagttaaaagcttccatgggagccttccttcctaatcaaggtaggtagactacaggaaggtacatcttgttttatattttgtcctgtagaagtcagatttcagcccagttgtgtaggagtgaggatgagcctatgcttatatcagagctttgagtacagagacatttggtctggaattttagtcagcctcttcaacccc

SEQ ID NO: 329316 - DNA, 305 bp, Homo sapiens
agtaagacatttggggaaatgagggattattaagtctttgaaggtctggacagggtgaagttttggtggtaatggtaagggagttgattcctatgtttcttggaaaagcaagaaaaagaagagacgtgtagcctaatgtgatggtggtcttataaagcctcaacatgattgtcttgcagactttaacccatgagatcggacacatatttggactgcgacactgccagtggcttgcatgcctcatgcaaggctccaaccacttggaagaagctgaccggcgccctctaaacctttgccctatctgt

SEQ ID NO: 329317 - DNA, 344 bp, Homo sapiens
attatttcatattcacaccatcattatcaaatgcagcgtcttcatggggtaatatgtcaccctatgatctagaagccaatgcttctctcttgcctgatggtattttgctgtggtttgttgaagtgcgcatctttcatgtttttccaggcactggtgaggtggattgatgatgaatcttctgacacacctggagcaactccagaacacagtcacgaggataatgggaatttaccgaaacccgtggaagcctttaaggaatggaaagagtggataataaaatgcctggctgttctccaaaaatgaggaccttcaaataggagtgattgaaataaataactacttgc

SEQ ID NO: 329318 - DNA, 415 bp, Homo sapiens
gtaaatactggtaatgtgctggttttggttcagttttgcagtggcgctcttgtcaggaatagtccaggctatgggtctgattcagatgggccgttttaggatcgtttttgatattcattgcggcggtacaagttttgtagccaaactgacttaaaagataacattttgtttctttttgtttcatagcaacaccaatgaatgataaaggttattgaaaatttagagttggttttgtttctaatttgaatcttcttactcatagactgggtaaacactgaataatcatcttaaagtctgtttttaaatgttcttccatattgtaggctctctaggaaacaccagaattatcagtgaagaatatattaaatggctcacgggctactgtaaagcatatttctatggcttgagagtaaaa

SEQ ID NO: 329319 - DNA, 456 bp, Homo sapiens
cccattgatcgccagggttgatcggctgatctggctggctagcgggtgccctcctccctcaccgctccatgtgcgtccctcccgaagctgccgctcggtcgaagaggacgaccatccccgatagaggaggaccggtcttcggtcaagggtatacgagtactgcgctcccctgctagaacctccaaacaagctctcaaggtccatttgtaggagaacgtagggtagtcaagcttccaaaactccagaacacagtcacgaggataatgggaatttaccgaaacccgtggaagcctttaaggaatggaaagagtggataataaaatgcctggctgttctccaaaaatgaggaccttcaaataggagtgattgaaataaataactacttgcatgttatgctttcatttgggtggaatacttcattggaataaactactgatcttgtgctgtgtcaaagta

SEQ ID NO: 329320 - DNA, 2000 bp, Homo sapiens
aaaaaaaaaaaaaaagcaagaaaaagaaagagaatggcgaggcccagagagaccgaaagtcccaccagagggtacagagctagctcagccctaatgccggccccgcggtgcctttccgagctcacggcctcccctcagcatccgggtttcggcctcggagcgccagggacgccacgaggacgcgccccacacttgcgcttctgggttccagcccccgcggcccccaacaaataaagaagggaaagtgctgagggtgacggccccggggagcgctgcggctctacgtcaacctgcggcggccgccgactcatttggggccacgctggttgcattcgtcacgccggcgatgcctctcaaacccgcggcctgccgaggacgttcccacacgggagaccccagcgacgcgggcgcatctgtggctctcgagaaccgggccgcggagccgccgcgagcgcaagcgaggaatcggcgactgcgggggtggacagctggggcttgtagtcccctcgctaccctctattctggaagaggcgggtcgcggccgctgaactccagctctgcgcctgcccaggcggccgcacgctcaggggcgtggcatgggtgggtcgtgagttgggcggggcccacagggcgtgcgcgacgcagcggcgcggcgcgtggcgtaaggggcgtggcgccagtgggcgtggcgtggcgcagtgcgaagggacgcggtgcgcatgcgcgtgagggctgccgcggccaggcccagacatgtccgtccttgtaagttaaaagcttccatgggagccttccttcctaatcaagatgcaaataatacggcactccgaacagacactaaaaacagctctcatctcaaagaacccagtgcttgtatcacagtatgagaaattagatgctggggaacaacgtttaatgaatgaagccttccagccagccagtgatctctttggacccattaccttgcattctccatcagattggatcacctcccaccctgaggctccccaagactttgaacagttcttcagtgatccttacagaaagacaccctctccaaacaaacgcagcatttatatacagtccattggctctctaggaaacaccagaattatcagtgaagaatatattaaatggctcacgggctactgtaaagcatatttctatggcttgagagtaaaactcctagaaccagttcctgtttctgtaacaagatgttcctttagagtcaatgagaacacacacaacctacaaattcatgcaggggacatcctgaagttcttgaaaaagaagaaacctgaagatgccttctgtgttgtgggaataacaatgattgatctttacccaagagactcgtggaattttgtctttggacaggcctctttgacagatggtgtggggatattcagctttgccaggtatggcagtgatttttatagcatgcactataaaggcaaagtgaagaagctcaagaaaacatcttcaagtgactattcaattttcgacaactattatattccagaaataactagtgttttactacttcgatcctgtaagactttaacccatgagatcggacacatatttggactgcgacactgccagtggcttgcatgcctcatgcaaggctccaaccacttggaagaagctgaccggcgccctctaaacctttgccctatctgtttgcacaagttgcagtgtgctgttggcttcagcattgtagaaagatacaaagcactggtgaggtggattgatgatgaatcttctgacacacctggagcaactccagaacacagtcacgaggataatgggaatttaccgaaacccgtggaagcctttaaggaatggaaagagtggataataaaatgcctggctgttctccaaaaatgaggaccttcaaataggagtgattgaaataaataactacttgcatgttatgctttcatttgggtggaatacttcattggaataaactactgatcttgtgctgtgtcaaagta

SEQ ID NO: 329321 - DNA, 2048 bp, Homo sapiens
aaaaaaaaaaaaaaagcaagaaaaagaaagagaatggcgaggcccagagagaccgaaagtcccaccagagggtacagagctagctcagccctaatgccggccccgcggtgcctttccgagctcacggcctcccctcagcatccgggtttcggcctcggagcgccagggacgccacgaggacgcgccccacacttgcgcttctgggttccagcccccgcggcccccaacaaataaagaagggaaagtgctgagggtgacggccccggggagcgctgcggctctacgtcaacctgcggcggccgccgactcatttggggccacgctggttgcattcgtcacgccggcgatgcctctcaaacccgcggcctgccgaggacgttcccacacgggagaccccagcgacgcgggcgcatctgtggctctcgagaaccgggccgcggagccgccgcgagcgcaagcgaggaatcggcgactgcgggggtggacagctggggcttgtagtcccctcgctaccctctattctggaagaggcgggtcgcggccgctgaactccagctctgcgcctgcccaggcggccgcacgctcaggggcgtggcatgggtgggtcgtgagttgggcggggcccacagggcgtgcgcgacgcagcggcgcggcgcgtggcgtaaggggcgtggcgccagtgggcgtggcgtggcgcagtgcgaagggacgcgccaggcccagacatgtccgtccttgtaagttaaaagcttccatgggagccttccttcctaatcaagatgcaaataatacggcactccgaacagacactaaaaacagctctcatctcaaagaacccagtgcttgtatcacagtatgagaaattagatgctggggaacaacgtttaatgaatgaagccttccagccagccagtgatctctttggacccattaccttgcattctccatcagattggatcacctcccaccctgaggctccccaagactttgaacagttcttcagtgatccttacagaaagacaccctctccaaacaaacgcagcatttatatacagtccattggctctctaggaaacaccagaattatcagtgaagaatatattaaatggctcacgggctactgtaaagcatatttctatggcttgagagtaaaactcctagaaccagttcctgtttctgtaacaagatgttcctttagagtcaatgagaacacacacaacctacaaattcatgcaggggacatcctgaagttcttgaaaaagaagaaacctgaagatgccttctgtgttgtgggaataacaatgattgatctttacccaagagactcgtggaattttgtctttggacaggcctctttgacagatggtgtggggatattcagctttgccaggtatggcagtgatttttatagcatgcactataaaggcaaagtgaagaagctcaagaaaacatcttcaagtgactattcaattttcgacaactattatattccagaaataactagtgttttactacttcgatcctgtaagactttaacccatgagatcggacacatatttggactgcgacactgccagtggcttgcatgcctcatgcaaggctccaaccacttggaagaagctgaccggcgccctctaaacctttgccctatctgtttgcacaagttgcagtgtgctgttggcttcagcattgtagaaagatacaaagcactggtgaggtggattgatgatgaatcttctgacacacctggagcaactccagaacacagtcacgaggataatgggaatttaccgaaacccgtggaagcctttaaggaatggaaagagtggataataaaatgcctggctgttctccaaaaatgaggaccttcaaataggagtgattgaaataaataactacttgcatgttatgctttcatttgggtggaatacttcattggaataaactactgatcttgtgctgtgtcaaagtaacagactagaaccttctttcaagtacctgaattgaaatgaaactcattttgaataataaaaactctagaaactctt

SEQ ID NO: 329322 - DNA, 2147 bp, Homo sapiens
aaaaaaaaaaaaaaagcaagaaaaagaaagagaatggcgaggcccagagagaccgaaagtcccaccagagggtacagagctagctcagccctaatgccggccccgcggtgcctttccgagctcacggcctcccctcagcatccgggtttcggcctcggagcgccagggacgccacgaggacgcgccccacacttgcgcttctgggttccagcccccgcggcccccaacaaataaagaagggaaagtgctgagggtgacggccccggggagcgctgcggctctacgtcaacctgcggcggccgccgactcatttggggccacgctggttgcattcgtcacgccggcgatgcctctcaaacccgcggcctgccgaggacgttcccacacgggagaccccagcgacgcgggcgcatctgtggctctcgagaaccgggccgcggagccgccgcgagcgcaagcgaggaatcggcgactgcgggggtggacagctggggcttgtagtcccctcgctaccctctattctggaagaggcgggtcgcggccgctgaactccagctctgcgcctgcccaggcggccgcacgctcaggggcgtggcatgggtgggtcgtgagttgggcggggcccacagggcgtgcgcgacgcagcggcgcggcgcgtggcgtaaggggcgtggcgccagtgggcgtggcgtggcgcagtgcgaagggacgcggtgcgcatgcgcgtgagggctgccgcgggtgggtggtatcgaggcctgtcgggtcagggcggttcgcgggtgctgtcagagctgggccggggcccctagccaggcccagacatgtccgtccttgtaagttaaaagcttccatgggagccttccttcctaatcaagatgcaaataatacggcactccgaacagacactaaaaacagctctcatctcaaagaacccagtgcttgtatcacagtatgagaaattagatgctggggaacaacgtttaatgaatgaagccttccagccagccagtgatctctttggacccattaccttgcattctccatcagattggatcacctcccaccctgaggctccccaagactttgaacagttcttcagtgatccttacagaaagacaccctctccaaacaaacgcagcatttatatacagtccattggctctctaggaaacaccagaattatcagtgaagaatatattaaatggctcacgggctactgtaaagcatatttctatggcttgagagtaaaactcctagaaccagttcctgtttctgtaacaagatgttcctttagagtcaatgagaacacacacaacctacaaattcatgcaggggacatcctgaagttcttgaaaaagaagaaacctgaagatgccttctgtgttgtgggaataacaatgattgatctttacccaagagactcgtggaattttgtctttggacaggcctctttgacagatggtgtggggatattcagctttgccaggtatggcagtgatttttatagcatgcactataaaggcaaagtgaagaagctcaagaaaacatcttcaagtgactattcaattttcgacaactattatattccagaaataactagtgttttactacttcgatcctgtaagactttaacccatgagatcggacacatatttggactgcgacactgccagtggcttgcatgcctcatgcaaggctccaaccacttggaagaagctgaccggcgccctctaaacctttgccctatctgtttgcacaagttgcagtgtgctgttggcttcagcattgtagaaagatacaaagcactggtgaggtggattgatgatgaatcttctgacacacctggagcaactccagaacacagtcacgaggataatgggaatttaccgaaacccgtggaagcctttaaggaatggaaagagtggataataaaatgcctggctgttctccaaaaatgaggaccttcaaataggagtgattgaaataaataactacttgcatgttatgctttcatttgggtggaatacttcattggaataaactactgatcttgtgctgtgtcaaagtaacagactagaaccttctttcaagtacctgaattgaaatgaaactcattttgaataataaaaactctagaaactctt

SEQ ID NO: 329323 - DNA, 1574 bp, Homo sapiens
gcaatcctcctatcccaaagtgctgaaattacaggcatgagccaccacacctggccaccactagtttttgtaatgggagcaggttccatatgagatggaggaatggatttcatgattgtctttttaatttcttagatctccaagaaattggacatgaggaaaccactctaagtgtgaccactctaaagcattagcaatcagtcatttcactctagggagaaatcagagctgaaatatagaggataggtaaagtccccaatgtagatatgtatttttatatttgattacttgcttttttttgttagatgcaaataatacggcactccgaacagacactaaaaacagctctcatctcaaagaacccagtgcttgtatcacagtatgagaaattagatgctggggaacaacgtttaatgaatgaagccttccagccagccagtgatctctttggacccattaccttgcattctccatcagattggatcacctcccaccctgaggctccccaagactttgaacagttcttcagtgatccttacagaaagacaccctctccaaacaaacgcagcatttatatacagtccattggctctctaggaaacaccagaattatcagtgaagaatatattaaatggctcacgggctactgtaaagcatatttctatggcttgagagtaaaactcctagaaccagttcctgtttctgtaacaagatgttcctttagagtcaatgagaacacacacaacctacaaattcatgcaggggacatcctgaagttcttgaaaaagaagaaacctgaagatgccttctgtgttgtgggaataacaatgattgatctttacccaagagactcgtggaattttgtctttggacaggcctctttgacagatggtgtggggatattcagctttgccaggtatggcagtgatttttatagcatgcactataaaggcaaagtgaagaagctcaagaaaacatcttcaagtgactattcaattttcgacaactattatattccagaaataactagtgttttactacttcgatcctgtaagactttaacccatgagatcggacacatatttggactgcgacactgccagtggcttgcatgcctcatgcaaggctccaaccacttggaagaagctgaccggcgccctctaaacctttgccctatctgtttgcacaagttgcagtgtgctgttggcttcagcattgtagaaagatacaaagcactggtgaggtggattgatgatgaatcttctgacacacctggagcaactccagaacacagtcacgaggataatgggaatttaccgaaacccgtggaagcctttaaggaatggaaagagtggataataaaatgcctggctgttctccaaaaatgaggaccttcaaataggagtgattgaaataaataactacttgcatgttatgctttcatttgggtggaatacttcattggaataaactactgatcttgtgctgtgtcaaagtaacagactagaaccttctttcaagtacctgaattgaaatgaaactcattttgaataataaaaactctagaaactctt

SEQ ID NO: 329324 - DNA, 2403 bp, Homo sapiens
aaaaaaaaaaaaaaagcaagaaaaagaaagagaatggcgaggcccagagagaccgaaagtcccaccagagggtacagagctagctcagccctaatgccggccccgcggtgcctttccgagctcacggcctcccctcagcatccgggtttcggcctcggagcgccagggacgccacgaggacgcgccccacacttgcgcttctgggttccagcccccgcggcccccaacaaataaagaagggaaagtgctgagggtgacggccccggggagcgctgcggctctacgtcaacctgcggcggccgccgactcatttggggccacgctggttgcattcgtcacgccggcgatgcctctcaaacccgcggcctgccgaggacgttcccacacgggagaccccagcgacgcgggcgcatctgtggctctcgagaaccgggccgcggagccgccgcgagcgcaagcgaggaatcggcgactgcgggggtggacagctggggcttgtagtcccctcgctaccctctattctggaagaggcgggtcgcggccgctgaactccagctctgcgcctgcccaggcggccgcacgctcaggggcgtggcatgggtgggtcgtgagttgggcggggcccacagggcgtgcgcgacgcagcggcgcggcgcgtggcgtaaggggcgtggcgccagtgggcgtggcgtggcgcagtgcgaagggacgcggtgcgcatgcgcgtgagggctgccgcgggtgggtggtatcgaggcctgtcgggtcagggcggttcgcgggtgctgtcagagctgggccggggcccctaggcagggtagccgggtcgtagaggcgggggccggtcgcggtcggtggagcgggatgaggatgtaggaggggcggacgtggcggaagccgcggggtccgcggggtcggtgcctctagggagccagggaggcctttcccgaggctcctggggaagaagaggcgaagcgagagtccctggggaacccccactccactcccagctggagactgggttgtgtctgcatggaccagagcccacagtgcgagttgctataggcaaccagccagggtggccagctcctccccgtttgcccgtgatgttctggttttgggaccaaagcatcctaggcctccagcccactgcagtgaccgaattctgcgccccctgcccatcttctcccgcagcttccctagattaggcttgggaggcaagaggaggcctcctgacctttcacactgcctttttaatattaagatgaagtcacactccacaactttcttccagccaggcccagacatgtccgtccttgtaagttaaaagctccccaagactttgaacagttcttcagtgatccttacagaaagacaccctctccaaacaaacgcagcatttatatacagtccattggctctctaggaaacaccagaattatcagtgaagaatatattaaatggctcacgggctactgtaaagcatatttctatggcttgagagtaaaactcctagaaccagttcctgtttctgtaacaagatgttcctttagagtcaatgagaacacacacaacctacaaattcatgcaggggacatcctgaagttcttgaaaaagaagaaacctgaagatgccttctgtgttgtgggaataacaatgattgatctttacccaagagactcgtggaattttgtctttggacaggcctctttgacagatggtgtggggatattcagctttgccaggtatggcagtgatttttatagcatgcactataaaggcaaagtgaagaagctcaagaaaacatcttcaagtgactattcaattttcgacaactattatattccagaaataactagtgttttactacttcgatcctgtaagactttaacccatgagatcggacacatatttggactgcgacactgccagtggcttgcatgcctcatgcaaggctccaaccacttggaagaagctgaccggcgccctctaaacctttgccctatctgtttgcacaagttgcagtgtgctgttggcttcagcattgtagaaagatacaaagcactggtgaggtggattgatgatgaatcttctgacacacctggagcaactccagaacacagtcacgaggataatgggaatttaccgaaacccgtggaagcctttaaggaatggaaagagtggataataaaatgcctggctgttctccaaaaatgaggaccttcaaataggagtgattgaaataaataactacttgcatgttatgctttcatttgggtggaatacttcattggaataaactactgatcttgtgctgtgtcaaagtaacagactagaaccttctttcaagtacctgaattgaaatgaaactcattttgaataataaaaactctagaaactctt

SEQ ID NO: 329325 - DNA, 1445 bp, Homo sapiens
  misc_feature (164)..(164): n is a, c, g, or t
ggtggtatcgaggcctgtcgggcaggcccagacatgtccgaccttgtaagttaaaagcttccatgggagcctgccttcctaggtcaagatgcaggaataattacgggacatccgcaaagaagatcaactaggaagaagcagcgtcgtcagtcgtcagaagaacnccagctgccttagtcctcagaggtagtgagaagactctagagtgctgggtgagacaatggttggaagagtgaagtgaagcgcttccaagccaagccatgtggatctccctttgggagcccacttaccctgtgcaatttcttcgcattcaagagtggggatcacctcgtcctcagccgcgtgtacggcgtcccccccaaaggaacttttgaggacgaggttctgtcgagatgactcgctttacagaagagacaccgatctccaaataaacgcagcaatttatatacagtccatgtggctctctaggaaacaccagaattatcagtgaagaatatattaaatggctcacgggctactgtaaagcatatttctatggcttgagagtaaaactcctagaaccagttcctgtttctgtaacaagatgttcctttagagtcaatgagaacacacacaacctacaaattcatgcaggggacatcctgaagttcttgaaaaagaagaaacctgaagatgccttctgtgttgtgggaataacaatgattgatctttacccaagagactcgtggaattttgtctttggacaggcctctttgacagatggtgtggggatattcagctttgccaggtatggcagtgatttttatagcatgcactataaaggcaaagtgaagaagctcaagaaaacatcttcaagtgactattcaattttcgacaactattatattccagaaataactagtgttttactacttcgatcctgtaagactttaacccatgagatcggacacatatttggactgcgacactgccagtggcttgcatgcctcatgcaaggctccaaccacttggaagaagctgaccggcgccctctaaacctttgccctatctgtttgcacaagttgcagtgtgctgttggcttcagcattgtagaaagatacaaagcactggtgaggtggattgatgatgaatcttctgacacacctggagcaactccagaacacagtcacgaggataatgggaatttaccgaaacccgtggaagcctttaaggaatggaaagagtggataataaaatgcctggctgttctccaaaaatgaggaccttcaaataggagtgattgaaataaataactacttgcatgttatgctttcatttgggtggaatacttcattggaataaactactgatcttgtgctgtgtcaaagtaacagactagaaccttctttcaagtacctgaattgaaatgaaactcattttgaataataaaaactctagaaactctt

SEQ ID NO: 329326 - DNA, 1984 bp, Homo sapiens
aaaaaaaaaaaaaaagcaagaaaaagaaagagaatggcgaggcccagagagaccgaaagtcccaccagagggtacagagctagctcagccctaatgccggccccgcggtgcctttccgagctcacggcctcccctcagcatccgggtttcggcctcggagcgccagggacgccacgaggacgcgccccacacttgcgcttctgggttccagcccccgcggcccccaacaaataaagaagggaaagtgctgagggtgacggccccggggagcgctgcggctctacgtcaacctgcggcggccgccgactcatttggggccacgctggttgcattcgtcacgccggcgatgcctctcaaacccgcggcctgccgaggacgttcccacacgggagaccccagcgacgcgggcgcatctgtggctctcgagaaccgggccgcggagccgccgcgagcgcaagcgaggaatcggcgactgcgggggtggacagctggggcttgtagtcccctcgctaccctctattctggaagaggcgggtcgcggccgctgaactccagctctgcgcctgcccaggcggccgcacgctcaggggcgtggcatgggtgggtcgtgagttgggcggggcccacagggcgtgcgcgacgcagcggcgcggcgcgtggcgtaaggggcgtggcgccagtgggcgtggcgtggcgcagtgcgaagggacgcgccaggcccagacatgtccgtccttgtaagttaaaagcttccatgggagccttccttcctaatcaagatgcaaataatacggcactccgaacagacactaaaaacagctctcatctcaaagaacccagtgcttgtatcacagtatgagaaattagatgctggggaacaacgtttaatgaatgaagccttccagccagccagtgatctctttggacccattaccttgcattctccatcagattggatcacctcccaccctgaggctccccaagactttgaacagttcttcagtgatccttacagaaagacaccctctccaaacaaacgcagcatttatatacagtccattggctctctaggaaacaccagaattatcagtgaagaatatattaaatggctcacgggctactgtaaagcatatttctatggcttgagagtaaaactcctagaaccagttcctgtttctgtaacaagatgttcctttagagtcaatgagaacacacacaacctacaaattcatgcagaatgattgatctttacccaagagactcgtggaattttgtctttggacaggcctctttgacagatggtgtggggatattcagctttgccaggtatggcagtgatttttatagcatgcactataaaggcaaagtgaagaagctcaagaaaacatcttcaagtgactattcaattttcgacaactattatattccagaaataactagtgttttactacttcgatcctgtaagactttaacccatgagatcggacacatatttggactgcgacactgccagtggcttgcatgcctcatgcaaggctccaaccacttggaagaagctgaccggcgccctctaaacctttgccctatctgtttgcacaagttgcagtgtgctgttggcttcagcattgtagaaagatacaaagcactggtgaggtggattgatgatgaatcttctgacacacctggagcaactccagaacacagtcacgaggataatgggaatttaccgaaacccgtggaagcctttaaggaatggaaagagtggataataaaatgcctggctgttctccaaaaatgaggaccttcaaataggagtgattgaaataaataactacttgcatgttatgctttcatttgggtggaatacttcattggaataaactactgatcttgtgctgtgtcaaagtaacagactagaaccttctttcaagtacctgaattgaaatgaaactcattttgaataataaaaactctagaaactctt

SEQ ID NO: 329327 - DNA, 326 bp, Homo sapiens
agcagtagccggaggaagccgccgctggtcccccaagcaccagcgcccgggtggaaggggcgaggaggcggggccgtgaacaaagtggtgtacgatgaccacgggagctaggaggaagaggacggcgacgtcgaggagacccaggagtctgaggacaacgaggagcatgagatggaggaggacgaggctgattccgattatctggaggagctggaagacgacgacgacgccagttactgcacagaaagcagcttcaggagccatagtacctacagcagcactccaggtacccacccagcccagttgctgcagactccttccccacc

SEQ ID NO: 329328 - DNA, 3041 bp, Homo sapiens
  misc_feature (950)..(951): n is a, c, g, or t
  misc_feature (953)..(954): n is a, c, g, or t
  misc_feature (958)..(958): n is a, c, g, or t
  misc_feature (964)..(965): n is a, c, g, or t
  misc_feature (968)..(968): n is a, c, g, or t
  misc_feature (970)..(970): n is a, c, g, or t
tgtggaagcccaggagaccagatttcgtttcctgcatctccaaacatggcgacctaggagaaagggaagaacaattttttctcctcttttgggaaggtttgcgtctagtagtgcctgtgcccctgggcagattggagagaagagggacgactggagaatcgtcgagaaccagcggagaaaagaaaaagcaacgtttaattctagaaggcctcctgtccctgcctgctctgggtgctcatggaatcagctgctgccctgcacttctcccggccagcctccctcctcctcctcctcctcagcctgtgtgcactggtctcagcccagtttattgtcgtggggcccactgatcccatcttggccacggttggagaaaacactacgttacgctgccatctgtcacccgagaaaaatgctgaggacatggaggtgcggtggttccggtctcagttctcccccgcagtgtttgtgtataaaggtggcagagagagaacagaggagcagatggaggagtaccgaggaagaaccacctttgtgagcaaagacatcagcaggggcagcgtggccctggtcatacacaacatcacagcccaggaaaacggcacctaccgctgttacttccaagaaggcaggtcctacgatgaggccatcctgcacctcgtagtggcaggactaggctctaagcccctcatttcaatgaggggccatgaagacgggggcatccggctggagtgcatatctagagggtggtacccaaagcccctcacagtgtggagggacccctacggtggggttgcgcctgccctgaaagaggtctccatgcctgatgcagacggcctcttcatggtcaccacggctgtgatcatcagagacaagtctgtgaggaacatgtcctgctctatcaacaacaccctgctcggccagaagaaagaaagtgtcatttttattccagnntnntttntgcccnntgngnctccccattgccgtatgcatctattggatcaacaaactccaaaaggaaaaaaagattctgtcaggggaaaaggagtttgaacgggaaacaagagaaattgctctaaaggaactggagaaagaacgtgtgcaaaaagaggaagaacttcaagtaaaagagaaacttcaagaagaattgcgatggagaagaacattcttacatgctgttgatgtggtcctggatccagacaccgctcatcccgatctcttcctgtcagaggaccggagaagtgtgagaaggtgccccttcaggcacctaggggagagcgtgcctgacaacccagagagattcgacagtcagccttgtgtcctaggccgggagagcttcgcttcagggaaacattactgggaggtggaggtggaaaacgtgattgagtggactgtgggggtctgtagagacagtgttgagaggaaaggggaggtcctgctgattcctcagaatggcttctggaccttggagatgcataaagggcaataccgggccgtgtcctcccctgataggattctccctttgaaggagtccctttgccgggtgggcgtcttcctggactatgaagctggagatgtctccttctacaacatgagggacagatcgcacatctacacatgtccccgttcagccttttccagggcctgacacttcacagagtggggacccaccagagcctatagaatcaattccttggtctcacagccatgtagacaagccctggtcatctcagcagccaccgcacaacacccatcttccagctgcctctttcacacccactacagacctcagccccagttttctcctcctcactaggctgtgtttttagtagttcctttgcttgtaactatgggatgggatccaggcatagggaactagttgttacacagctcccagccaagaagaaagtgtgagaagttgatgggcagcaaacctgctgtttaacatcagggtgaccacattaagcccagtattccagttggcaccagaagatatggacttggaatgaggcctacagggttcaccaggatgtaagaggagagaggaatccacaggaccaccagagaggagagggaaccagatatgcagatcagagatagaggaagtggaaccagagagctgggagggaccaaggttgtaagggtggctaagtcccaccataacagctaaggggacctgggagatgatggctcatttccacccagccccaggatttccagagcgcacatccacaggcctggacctgggatgaagatgaatgaagaacatggatgcacgtggatgtagtttggctcaggtgtccctgcagttggcaaggagtcagtactcagtccctgagtgtggctgaaatttgaggtcctggctgagccaaggagtaatggaccagatctacctcagtattcaagttcagtggggacaccagtggcttcaaacttcctggtttcatgatatcttgagacgccttacaaatgatggaggattccaaagagtttttgtttatttgggttaatatttgttggtatttatggcatttgagattgaaactaagaaatgttttaatttattacctttacaacatttatttacattacatacatacatttacaacatttattaatttatattaaaatagcatgaataagccaattataggttaatataagtagaatgtttgtgaaaaataagtatggtatccaaagcaaaataaattttattgtgaagtgtgaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagcgggaaaaaaaaaacccgggaggggggaaaaaactggggggctggcccccttttgggccctttccactttttgggacccctttgaaatttggggggacctttaaaaccgggggaacggcaaacaaatttaaaactggcccctttttaaaaacctggggtttggaaaaaacttgggtttaccaaaattaatttttttgcaaaaaatcccct

SEQ ID NO: 329329 - DNA, 3231 bp, Homo sapiens
  misc_feature (1172)..(1172): n is a, c, g, or t
  misc_feature (1177)..(1177): n is a, c, g, or t
tgtggaagcccaggagaccagatttcgtttcctgcatctccaaacatggcgacctaggagaaagggaagaacaattttttctcctcttttgggaaggtttgcgtctagtagtgcctgtgcccctgggcagattggagagaagagggacgactggagaatcgtcgagaaccagcggagaaaagaaaaagcaacgtttaattctagaaggcctcctgtccctgcctgctctgggtgctcatggaatcagctgctgccctgcacttctcccggccagcctccctcctcctcctcctcctcagcctgtgtgcactggtctcagcccagtttattgtcgtggggcccactgatcccatcttggccacggttggagaaaacactacgttacgctgccatctgtcacccgagaaaaatgctgaggacatggaggtgcggtggttccggtctcagttctcccccgcagtgtttgtgtataaaggtggcagagagagaacagaggagcagatggaggagtaccgaggaagaaccacctttgtgagcaaagacatcagcaggggcagcgtggccctggtcatacacaacatcacagcccaggaaaacggcacctaccgctgttacttccaagaaggcaggtcctacgatgaggccatcctgcacctcgtagtggcaggactaggctctaagcccctcatttcaatgaggggccatgaagacgggggcatccggctggagtgcatatctagagggtggtacccaaagcccctcacagtgtggagggacccctacggtggggttgcgcctgccctgaaagaggtctccatgcctgatgcagacggcctcttcatggtcaccacggctgtgatcatcagagacaagtctgtgaggaacatgtcctgctctatcaacaacaccctgctcggccagaagaaagaaagtgtcatttttattccagaatcctttatgcccagtgtgtctccctgtgcagtggccctgcctatcattgtggttattctgatgatacccattgccgtatgcatctattggatcaacaaactccaaaaggaaaaaaagattctgtcaggggaaaaggagtttgaacgggaaacaagagaaattgctctaaaggaactggagaaagaacgtgtgcaaaaagaggaagaacttcaagtaaaagnagagnaaacttcaagaagaattgcgatggagaagaacattcttacatgctgttgatgtggtcctggatccagacaccgctcatcccgatctcttcctgtcagaggaccggagaagtgtgagaaggtgccccttcaggcacctaggggagagcgtgcctgacaacccagagagattcgacagtcagccttgtgtcctaggccgggagagcttcgcttcagggaaacattactgggaggtggaggtggaaaacgtgattgagtggactgtgggggtctgtagagacagtgttgagaggaaaggggaggtcctgctgattcctcagaatggcttctggaccttggagatgcataaagggcaataccgggccgtgtcctcccctgataggattctccctttgaaggagtccctttgccgggtgggcgtcttcctggactatgaagctggagatgtctccttctacaacatgagggacagatcgcacatctacacatgtccccgttcagccttttccgtgcctgtgaggcccttcttcaggttggggtgtgaggacagccccatcttcatctgccctgcactcacaggagccaatggggtcacggtgcctgaagagggcctgacacttcacagagtggggacccaccagagcctatagaatcaattccttggtctcacagccatgtagacaagccctggtcatctcagcagccaccgcacaacacccctggtggaagacacgccctcctcccctctggtcacacaagagaacatcttccagctgcctctttcacacccactacagacctcagccccagttttctcctcctcactaggctgtgtttttagtagttcctttgcttgtaactatgggatgggatccaggcatagggaactagttgttacacagctcccagccaagaagaaagtgtgagaagttgatgggcagcaaacctgctgtttaacatcagggtgaccacattaagcccagtattccagttggcaccagaagatatggacttggaatgaggcctacagggttcaccaggatgtaagaggagagaggaatccacaggaccaccagagaggagagggaaccagatatgcagatcagagatagaggaagtggaaccagagagctgggagggaccaaggttgtaagggtggctaagtcccaccataacagctaaggggacctgggagatgatggctcatttccacccagccccaggatttccagagcgcacatccacaggcctggacctgggatgaagatgaatgaagaacatggatgcacgtggatgtagtttggctcaggtgtccctgcagttggcaaggagtcagtactcagtccctgagtgtggctgaaatttgaggtcctggctgagccaaggagtaatggaccagatctacctcagtattcaagttcagtggggacaccagtggcttcaaacttcctggtttcatgatatcttgagacgccttacaaatgatggaggattccaaagagtttttgtttatttgggttaatatttgttggtatttatggcatttgagattgaaactaagaaatgttttaatttattacctttacaacatttatttacattacatacatacatttacaacatttattaatttatattaaaatagcatgaataagccaattataggttaatataagtagaatgtttgtgaaaaataagtatggtatccaaagcaaaataaattttattgtgaagtgtgaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagcgggaaaaaaaaaacccgggaggggggaaaaaactggggggctggcccccttttgggccctttccactttttgggacccctttgaaatttggggggacctttaaaaccgggggaacggcaaacaaatttaaaactggcccctttttaaaaacctggggtttggaaaaaacttgggtttaccaaaattaatttttttgcaaaaaatcccct

SEQ ID NO: 329330 - DNA, 3220 bp, Homo sapiens
  misc_feature (1161)..(1161): n is a, c, g, or t
  misc_feature (1166)..(1166): n is a, c, g, or t
tgtggaagcccaggagaccagatttcgtttcctgcatctccaaacatggcgacctaggagaaagggaagaacaattttttctcctcttttgggaaggtttgcgtctagtagtgcctgtgcccctgggcagattggagagaagagggacgactggagaatcgtcgagaaccagcggagaaaagaaaaagcaacgtttaattctagaagcccagtttattgtcgtggggcccactgatcccatcttggccacggttggagaaaacactacgttacgctgccatctgtcacccgagaaaaatgctgaggacatggaggtgcggtggttccggtctcagttctcccccgcagtgtttgtgtataaaggtggcagagagagaacagaggagcagatggaggagtaccgaggaagaaccacctttgtgagcaaagacatcagcaggggcagcgtggccctggtcatacacaacatcacagcccaggaaaacggcacctaccgctgttacttccaagaaggcaggtcctacgatgaggccatcctgcacctcgtagtggcagagcttctggaagctgaggtctactgagaagtcgtcccagaagcagaaagtgaaatccaaaacctgcctgtttgaagttggagtcgacacacccatctcaaagactaggctctaagcccctcatttcaatgaggggccatgaagacgggggcatccggctggagtgcatatctagagggtggtacccaaagcccctcacagtgtggagggacccctacggtggggttgcgcctgccctgaaagaggtctccatgcctgatgcagacggcctcttcatggtcaccacggctgtgatcatcagagacaagtctgtgaggaacatgtcctgctctatcaacaacaccctgctcggccagaagaaagaaagtgtcatttttattccagaatcctttatgcccagtgtgtctccctgtgcagtggccctgcctatcattgtggttattctgatgatacccattgccgtatgcatctattggatcaacaaactccaaaaggaaaaaaagattctgtcaggggaaaaggagtttgaacgggaaacaagagaaattgctctaaaggaactggagaaagaacgtgtgcaaaaagaggaagaacttcaagtaaaagnagagnaaacttcaagaagaattgcgatggagaagaacattcttacatgctgttgatgtggtcctggatccagacaccgctcatcccgatctcttcctgtcagaggaccggagaagtgtgagaaggtgccccttcaggcacctaggggagagcgtgcctgacaacccagagagattcgacagtcagccttgtgtcctaggccgggagagcttcgcttcagggaaacattactgggaggtggaggtggaaaacgtgattgagtggactgtgggggtctgtagagacagtgttgagaggaaaggggaggtcctgctgattcctcagaatggcttctggaccttggagatgcataaagggcaataccgggccgtgtcctcccctgataggattctccctttgaaggagtccctttgccgggtgggcgtcttcctggactatgaagctggagatgtctccttctacaacatgagggacagatcgcacatctacacatgtccccgttcagccttttccgtgcctgtgaggcccttcttcaggttggggtgtgaggacagccccatcttcatctgccctgcactcacaggagccaatggggtcacggtgcctgaagagggcctgacacttcacagagtggggacccaccagagcctatagaatcaattccttggtctcacagccatgtagacaagccctggtcatctcagcagccaccgcacaacacccctggtggaagacacgccctcctcccctctggtcacacaagagaacatcttccagctgcctctttcacacccactacagacctcagccccagttttctcctcctcactaggctgtgtttttagtagttcctttgcttgtaactatgggatgggatccaggcatagggaactagttgttacacagctcccagccaagaagaaagtgtgagaagttgatgggcagcaaacctgctgtttaacatcagggtgaccacattaagcccagtattccagttggcaccagaagatatggacttggaatgaggcctacagggttcaccaggatgtaagaggagagaggaatccacaggaccaccagagaggagagggaaccagatatgcagatcagagatagaggaagtggaaccagagagctgggagggaccaaggttgtaagggtggctaagtcccaccataacagctaaggggacctgggagatgatggctcatttccacccagccccaggatttccagagcgcacatccacaggcctggacctgggatgaagatgaatgaagaacatggatgcacgtggatgtagtttggctcaggtgtccctgcagttggcaaggagtcagtactcagtccctgagtgtggctgaaatttgaggtcctggctgagccaaggagtaatggaccagatctacctcagtattcaagttcagtggggacaccagtggcttcaaacttcctggtttcatgatatcttgagacgccttacaaatgatggaggattccaaagagtttttgtttatttgggttaatatttgttggtatttatggcatttgagattgaaactaagaaatgttttaatttattacctttacaacatttatttacattacatacatacatttacaacatttattaatttatattaaaatagcatgaataagccaattataggttaatataagtagaatgtttgtgaaaaataagtatggtatccaaagcaaaataaattttattgtgaagtgtgaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagcgggaaaaaaaaaacccgggaggggggaaaaaactggggggctggcccccttttgggccctttccactttttgggacccctttgaaatttggggggacctttaaaaccgggggaacggcaaacaaatttaaaactggcccctttttaaaaacctggggtttggaaaaaacttgggtttaccaaaattaatttttttgcaaaaaatcccct

SEQ ID NO: 329331 - DNA, 3409 bp, Homo sapiens
  misc_feature (1350)..(1350): n is a, c, g, or t
  misc_feature (1355)..(1355): n is a, c, g, or t
gggaggagggtgtggtagaatccagcgacaactgaagaaactgcattctggccagagaagtgagccgaggagggcggaaaaaggcccccttgatcttggcattgatggcttacttcatggaatgtttaaggaatccctctctcgggacatacctgagccttcggatgcaggggactccctgaagttggggcactgatgagacctacttgagtgacgggagaggttgggcccgaccagcactgaggtgccaagactcctaggctgattctcctctgtaaccctaggcctcctgtccctgcctgctctgggtgctcatggaatcagctgctgccctgcacttctcccggccagcctccctcctcctcctcctcctcagcctgtgtgcactggtctcagcccagtttattgtcgtggggcccactgatcccatcttggccacggttggagaaaacactacgttacgctgccatctgtcacccgagaaaaatgctgaggacatggaggtgcggtggttccggtctcagttctcccccgcagtgtttgtgtataaaggtggcagagagagaacagaggagcagatggaggagtaccgaggaagaaccacctttgtgagcaaagacatcagcaggggcagcgtggccctggtcatacacaacatcacagcccaggaaaacggcacctaccgctgttacttccaagaaggcaggtcctacgatgaggccatcctgcacctcgtagtggcagagcttctggaagctgaggtctactgagaagtcgtcccagaagcagaaagtgaaatccaaaacctgcctgtttgaagttggagtcgacacacccatctcaaagactaggctctaagcccctcatttcaatgaggggccatgaagacgggggcatccggctggagtgcatatctagagggtggtacccaaagcccctcacagtgtggagggacccctacggtggggttgcgcctgccctgaaagaggtctccatgcctgatgcagacggcctcttcatggtcaccacggctgtgatcatcagagacaagtctgtgaggaacatgtcctgctctatcaacaacaccctgctcggccagaagaaagaaagtgtcatttttattccagaatcctttatgcccagtgtgtctccctgtgcagtggccctgcctatcattgtggttattctgatgatacccattgccgtatgcatctattggatcaacaaactccaaaaggaaaaaaagattctgtcaggggaaaaggagtttgaacgggaaacaagagaaattgctctaaaggaactggagaaagaacgtgtgcaaaaagaggaagaacttcaagtaaaagnagagnaaacttcaagaagaattgcgatggagaagaacattcttacatgctgttgatgtggtcctggatccagacaccgctcatcccgatctcttcctgtcagaggaccggagaagtgtgagaaggtgccccttcaggcacctaggggagagcgtgcctgacaacccagagagattcgacagtcagccttgtgtcctaggccgggagagcttcgcttcagggaaacattactgggaggtggaggtggaaaacgtgattgagtggactgtgggggtctgtagagacagtgttgagaggaaaggggaggtcctgctgattcctcagaatggcttctggaccttggagatgcataaagggcaataccgggccgtgtcctcccctgataggattctccctttgaaggagtccctttgccgggtgggcgtcttcctggactatgaagctggagatgtctccttctacaacatgagggacagatcgcacatctacacatgtccccgttcagccttttccgtgcctgtgaggcccttcttcaggttggggtgtgaggacagccccatcttcatctgccctgcactcacaggagccaatggggtcacggtgcctgaagagggcctgacacttcacagagtggggacccaccagagcctatagaatcaattccttggtctcacagccatgtagacaagccctggtcatctcagcagccaccgcacaacacccctggtggaagacacgccctcctcccctctggtcacacaagagaacatcttccagctgcctctttcacacccactacagacctcagccccagttttctcctcctcactaggctgtgtttttagtagttcctttgcttgtaactatgggatgggatccaggcatagggaactagttgttacacagctcccagccaagaagaaagtgtgagaagttgatgggcagcaaacctgctgtttaacatcagggtgaccacattaagcccagtattccagttggcaccagaagatatggacttggaatgaggcctacagggttcaccaggatgtaagaggagagaggaatccacaggaccaccagagaggagagggaaccagatatgcagatcagagatagaggaagtggaaccagagagctgggagggaccaaggttgtaagggtggctaagtcccaccataacagctaaggggacctgggagatgatggctcatttccacccagccccaggatttccagagcgcacatccacaggcctggacctgggatgaagatgaatgaagaacatggatgcacgtggatgtagtttggctcaggtgtccctgcagttggcaaggagtcagtactcagtccctgagtgtggctgaaatttgaggtcctggctgagccaaggagtaatggaccagatctacctcagtattcaagttcagtggggacaccagtggcttcaaacttcctggtttcatgatatcttgagacgccttacaaatgatggaggattccaaagagtttttgtttatttgggttaatatttgttggtatttatggcatttgagattgaaactaagaaatgttttaatttattacctttacaacatttatttacattacatacatacatttacaacatttattaatttatattaaaatagcatgaataagccaattataggttaatataagtagaatgtttgtgaaaaataagtatggtatccaaagcaaaataaattttattgtgaagtgtgaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagcgggaaaaaaaaaacccgggaggggggaaaaaactggggggctggcccccttttgggccctttccactttttgggacccctttgaaatttggggggacctttaaaaccgggggaacggcaaacaaatttaaaactggcccctttttaaaaacctggggtttggaaaaaacttgggtttaccaaaattaatttttttgcaaaaaatcccct

SEQ ID NO: 329332 - DNA, 3227 bp, Homo sapiens
tgtggaagcccaggagaccagatttcgtttcctgcatctccaaacatggcgacctaggagaaagggaagaacaattttttctcctcttttgggaaggtttgcgtctagtagtgcctgtgcccctgggcagattggagagaagagggacgactggagaatcgtcgagaaccagcggagaaaagaaaaagcaacgtttaattctagaaggcctcctgtccctgcctgctctgggtgctcatggaatcagctgctgccctgcacttctcccggccagcctccctcctcctcctcctcctcagcctgtgtgcactggtctcagcccagtttattgtcgtggggcccactgatcccatcttggccacggttggagaaaacactacgttacgctgccatctgtcacccgagaaaaatgctgaggacatggaggtgcggtggttccggtctcagttctcccccgcagtgtttgtgtataaaggtggcagagagagaacagaggagcagatggaggagtaccgaggaagaaccacctttgtgagcaaagacatcagcaggggcagcgtggccctggtcatacacaacatcacagcccaggaaaacggcacctaccgctgttacttccaagaaggcaggtcctacgatgaggccatcctgcacctcgtagtggcaggactaggctctaagcccctcatttcaatgaggggccatgaagacgggggcatccggctggagtgcatatctagagggtggtacccaaagcccctcacagtgtggagggacccctacggtggggttgcgcctgccctgaaagaggtctccatgcctgatgcagacggcctcttcatggtcaccacggctgtgatcatcagagacaagtctgtgaggaacatgtcctgctctatcaacaacaccctgctcggccagaagaaagaaagtgtcatttttattccagaatcctttatgcccagtgtgtctccctgtgcagtggccctgcctatcattgtggttattctgatgatacccattgccgtatgcatctattggatcaacaaactccaaaaggaaaaaaagattctgtcaggggaaaaggagtttgaacgggaaacaagagaaattgctctaaaggaactggagaaagaacgtgtgcaaaaagaggaagaacttcaagtaaaagagaaacttcaagaagaattgcgatggagaagaacattcttacatgctgttgatgtggtcctggatccagacaccgctcatcccgatctcttcctgtcagaggaccggagaagtgtgagaaggtgccccttcaggcacctaggggagagcgtgcctgacaacccagagagattcgacagtcagccttgtgtcctaggccgggagagcttcgcttcagggaaacattactgggaggtggaggtggaaaacgtgattgagtggactgtgggggtctgtagagacagtgttgagaggaaaggggaggtcctgctgattcctcagaatggcttctggaccttggagatgcataaagggcaataccgggccgtgtcctcccctgataggattctccctttgaaggagtccctttgccgggtgggcgtcttcctggactatgaagctggagatgtctccttctacaacatgagggacagatcgcacatctacacatgtccccgttcagccttttccgtgcctgtgaggcccttcttcaggttggggtgtgaggacagccccatcttcatctgccctgcactcacaggagccaatggggtcacggtgcctgaagagggcctgacacttcacagagtggggacccaccagagcctatagaatcaattccttggtctcacagccatgtagacaagccctggtcatctcagcagccaccgcacaacacccctggtggaagacacgccctcctcccctctggtcacacaagagaacatcttccagctgcctctttcacacccactacagacctcagccccagttttctcctcctcactaggctgtgtttttagtagttcctttgcttgtaactatgggatgggatccaggcatagggaactagttgttacacagctcccagccaagaagaaagtgtgagaagttgatgggcagcaaacctgctgtttaacatcagggtgaccacattaagcccagtattccagttggcaccagaagatatggacttggaatgaggcctacagggttcaccaggatgtaagaggagagaggaatccacaggaccaccagagaggagagggaaccagatatgcagatcagagatagaggaagtggaaccagagagctgggagggaccaaggttgtaagggtggctaagtcccaccataacagctaaggggacctgggagatgatggctcatttccacccagccccaggatttccagagcgcacatccacaggcctggacctgggatgaagatgaatgaagaacatggatgcacgtggatgtagtttggctcaggtgtccctgcagttggcaaggagtcagtactcagtccctgagtgtggctgaaatttgaggtcctggctgagccaaggagtaatggaccagatctacctcagtattcaagttcagtggggacaccagtggcttcaaacttcctggtttcatgatatcttgagacgccttacaaatgatggaggattccaaagagtttttgtttatttgggttaatatttgttggtatttatggcatttgagattgaaactaagaaatgttttaatttattacctttacaacatttatttacattacatacatacatttacaacatttattaatttatattaaaatagcatgaataagccaattataggttaatataagtagaatgtttgtgaaaaataagtatggtatccaaagcaaaataaattttattgtgaagtgtgaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagcgggaaaaaaaaaacccgggaggggggaaaaaactggggggctggcccccttttgggccctttccactttttgggacccctttgaaatttggggggacctttaaaaccgggggaacggcaaacaaatttaaaactggcccctttttaaaaacctggggtttggaaaaaacttgggtttaccaaaattaatttttttgcaaaaaatcccct

SEQ ID NO: 329333 - DNA, 3332 bp, Homo sapiens
  misc_feature (1273)..(1273): n is a, c, g, or t
  misc_feature (1278)..(1278): n is a, c, g, or t
tgtggaagcccaggagaccagatttcgtttcctgcatctccaaacatggcgacctaggagaaagggaagaacaattttttctcctcttttgggaaggtttgcgtctagtagtgcctgtgcccctgggcagattggagagaagagggacgactggagaatcgtcgagaaccagcggagaaaagaaaaagcaacgtttaattctagaaggcctcctgtccctgcctgctctgggtgctcatggaatcagctgctgccctgcacttctcccggccagcctccctcctcctcctcctcctcagcctgtgtgcactggtctcagcccagtttattgtcgtggggcccactgatcccatcttggccacggttggagaaaacactacgttacgctgccatctgtcacccgagaaaaatgctgaggacatggaggtgcggtggttccggtctcagttctcccccgcagtgtttgtgtataaaggtggcagagagagaacagaggagcagatggaggagtaccgaggaagaaccacctttgtgagcaaagacatcagcaggggcagcgtggccctggtcatacacaacatcacagcccaggaaaacggcacctaccgctgttacttccaagaaggcaggtcctacgatgaggccatcctgcacctcgtagtggcagagcttctggaagctgaggtctactgagaagtcgtcccagaagcagaaagtgaaatccaaaacctgcctgtttgaagttggagtcgacacacccatctcaaagactaggctctaagcccctcatttcaatgaggggccatgaagacgggggcatccggctggagtgcatatctagagggtggtacccaaagcccctcacagtgtggagggacccctacggtggggttgcgcctgccctgaaagaggtctccatgcctgatgcagacggcctcttcatggtcaccacggctgtgatcatcagagacaagtctgtgaggaacatgtcctgctctatcaacaacaccctgctcggccagaagaaagaaagtgtcatttttattccagaatcctttatgcccagtgtgtctccctgtgcagtggccctgcctatcattgtggttattctgatgatacccattgccgtatgcatctattggatcaacaaactccaaaaggaaaaaaagattctgtcaggggaaaaggagtttgaacgggaaacaagagaaattgctctaaaggaactggagaaagaacgtgtgcaaaaagaggaagaacttcaagtaaaagnagagnaaacttcaagaagaattgcgatggagaagaacattcttacatgctgttgatgtggtcctggatccagacaccgctcatcccgatctcttcctgtcagaggaccggagaagtgtgagaaggtgccccttcaggcacctaggggagagcgtgcctgacaacccagagagattcgacagtcagccttgtgtcctaggccgggagagcttcgcttcagggaaacattactgggaggtggaggtggaaaacgtgattgagtggactgtgggggtctgtagagacagtgttgagaggaaaggggaggtcctgctgattcctcagaatggcttctggaccttggagatgcataaagggcaataccgggccgtgtcctcccctgataggattctccctttgaaggagtccctttgccgggtgggcgtcttcctggactatgaagctggagatgtctccttctacaacatgagggacagatcgcacatctacacatgtccccgttcagccttttccgtgcctgtgaggcccttcttcaggttggggtgtgaggacagccccatcttcatctgccctgcactcacaggagccaatggggtcacggtgcctgaagagggcctgacacttcacagagtggggacccaccagagcctatagaatcaattccttggtctcacagccatgtagacaagccctggtcatctcagcagccaccgcacaacacccctggtggaagacacgccctcctcccctctggtcacacaagagaacatcttccagctgcctctttcacacccactacagacctcagccccagttttctcctcctcactaggctgtgtttttagtagttcctttgcttgtaactatgggatgggatccaggcatagggaactagttgttacacagctcccagccaagaagaaagtgtgagaagttgatgggcagcaaacctgctgtttaacatcagggtgaccacattaagcccagtattccagttggcaccagaagatatggacttggaatgaggcctacagggttcaccaggatgtaagaggagagaggaatccacaggaccaccagagaggagagggaaccagatatgcagatcagagatagaggaagtggaaccagagagctgggagggaccaaggttgtaagggtggctaagtcccaccataacagctaaggggacctgggagatgatggctcatttccacccagccccaggatttccagagcgcacatccacaggcctggacctgggatgaagatgaatgaagaacatggatgcacgtggatgtagtttggctcaggtgtccctgcagttggcaaggagtcagtactcagtccctgagtgtggctgaaatttgaggtcctggctgagccaaggagtaatggaccagatctacctcagtattcaagttcagtggggacaccagtggcttcaaacttcctggtttcatgatatcttgagacgccttacaaatgatggaggattccaaagagtttttgtttatttgggttaatatttgttggtatttatggcatttgagattgaaactaagaaatgttttaatttattacctttacaacatttatttacattacatacatacatttacaacatttattaatttatattaaaatagcatgaataagccaattataggttaatataagtagaatgtttgtgaaaaataagtatggtatccaaagcaaaataaattttattgtgaagtgtgaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagcgggaaaaaaaaaacccgggaggggggaaaaaactggggggctggcccccttttgggccctttccactttttgggacccctttgaaatttggggggacctttaaaaccgggggaacggcaaacaaatttaaaactggcccctttttaaaaacctggggtttggaaaaaacttgggtttaccaaaattaatttttttgcaaaaaatcccct

SEQ ID NO: 329334 - DNA, 2263 bp, Homo sapiens
tgtggaagcccaggagaccagatttcgtttcctgcatctccaaacatggcgacctaggagaaagggaagaacaattttttctcctcttttgggaaggtttgcgtctagtagtgcctgtgcccctgggcagattggagagaagagggacgactggagaatcgtcgagaaccagcggagaaaagaaaaagcaacgtttaattctagaaggcctcctgtccctgcctgctctgggtgctcatggaatcagctgctgccctgcacttctcccggccagcctccctcctcctcctcctcctcagcctgtgtgcactggtctcagtgtgagaaggtgccccttcaggcacctaggggagagcgtgcctgacaacccagagagattcgacagtcagccttgtgtcctaggccgggagagcttcgcttcagggaaacattactgggaggtggaggtggaaaacgtgattgagtggactgtgggggtctgtagagacagtgttgagaggaaaggggaggtcctgctgattcctcagaatggcttctggaccttggagatgcataaagggcaataccgggccgtgtcctcccctgataggattctccctttgaaggagtccctttgccgggtgggcgtcttcctggactatgaagctggagatgtctccttctacaacatgagggacagatcgcacatctacacatgtccccgttcagccttttccgtgcctgtgaggcccttcttcaggttggggtgtgaggacagccccatcttcatctgccctgcactcacaggagccaatggggtcacggtgcctgaagagggcctgacacttcacagagtggggacccaccagagcctatagaatcaattccttggtctcacagccatgtagacaagccctggtcatctcagcagccaccgcacaacacccctggtggaagacacgccctcctcccctctggtcacacaagagaacatcttccagctgcctctttcacacccactacagacctcagccccagttttctcctcctcactaggctgtgtttttagtagttcctttgcttgtaactatgggatgggatccaggcatagggaactagttgttacacagctcccagccaagaagaaagtgtgagaagttgatgggcagcaaacctgctgtttaacatcagggtgaccacattaagcccagtattccagttggcaccagaagatatggacttggaatgaggcctacagggttcaccaggatgtaagaggagagaggaatccacaggaccaccagagaggagagggaaccagatatgcagatcagagatagaggaagtggaaccagagagctgggagggaccaaggttgtaagggtggctaagtcccaccataacagctaaggggacctgggagatgatggctcatttccacccagccccaggatttccagagcgcacatccacaggcctggacctgggatgaagatgaatgaagaacatggatgcacgtggatgtagtttggctcaggtgtccctgcagttggcaaggagtcagtactcagtccctgagtgtggctgaaatttgaggtcctggctgagccaaggagtaatggaccagatctacctcagtattcaagttcagtggggacaccagtggcttcaaacttcctggtttcatgatatcttgagacgccttacaaatgatggaggattccaaagagtttttgtttatttgggttaatatttgttggtatttatggcatttgagattgaaactaagaaatgttttaatttattacctttacaacatttatttacattacatacatacatttacaacatttattaatttatattaaaatagcatgaataagccaattataggttaatataagtagaatgtttgtgaaaaataagtatggtatccaaagcaaaataaattttattgtgaagtgtgaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagcgggaaaaaaaaaacccgggaggggggaaaaaactggggggctggcccccttttgggccctttccactttttgggacccctttgaaatttggggggacctttaaaaccgggggaacggcaaacaaatttaaaactggcccctttttaaaaacctggggtttggaaaaaacttgggtttaccaaaattaatttttttgcaaaaaatcccct

SEQ ID NO: 329335 - DNA, 509 bp, Homo sapiens
tgccccggctgaagagaagggatcctttgcaaccccatggctgtcagtgagcaaacagcccaggattcacccgccctgctgtccccaaaggcaggaatgccagcaggtggaagaggggagactgtgatccacctgggtcccacatgcctgtttccagtttctgcccaccctgattcatagctgggtggaatcataggcagcactggaaataccctccaagatcatgtgtcccaccccgttagacagacagggacactctggcgcgtttcatgtacgactcacccacttccttaagagccagtgtgggtttcttcccctgtgatatcagcttcatggactggatgttaaggcttaatgtgttatctttcccagaaatactttaattccaaagatggatgtgctgagcacataacatttaacacagaacaaggggtaagagagaaggaaccagcacatacggatgtcctattatgagtgagtcactgtgctagtgttcttcttaagaatat

SEQ ID NO: 329336 - DNA, 345 bp, Homo sapiens
atctgggaacaagacccaggggggttggggaataatttcaagggtagcagatgctttttggtaatggtcagatgaggtgttttaagctgtgaaaaaccgaaggccagcagtatggtctgtatgtttcggaaggggatggtcagtttttgtttgtcttcggggagaggtgagatggtatagcaaactgtttttttggagacggattcttactgtattgtccagactggagtgcagtggcacgatctcggctcactgcaacctctgcctcctgggttcaagcgattctcctgccttagcctcctgagtagctgggattacaggtgctcaccaccatgcttggctaat

SEQ ID NO: 329337 - DNA, 536 bp, Homo sapiens
ggaaactaaaacctagggatagacaggaagaagaaagaggcttctttttatactttattgtccctacctccagtaaaacaacctaaattcttcaatttggagctttaacaaggataagtaaatatgaccatgggcatgtaacattgtaaatactaagtcctgctgtgtttgcaaacattgagagtgaaaggtaagattgccagcaagtgcagagtcacagaagagattgaagttacagtacactcatgagaattcctgatgaccctacggtacaacctctaaaggtgggagaagcagatgtatataatgtgattttgtgtgtgagttttttgatgcttttttcattacttatttaccttgtctggagagaaaagcacgagttcatgttgtttcactaccacttttctatccatttcttggcctagagccgtttctttactaccataactgccaacactatctccataaacaaagaatcttatgtctggaggtctgtcatgtcacgtccttttgctattaagacagctctatgaata

SEQ ID NO: 329338 - DNA, 388 bp, Homo sapiens
ctccagtgaaaccatctgagcctggatatttctttttggagtttaaaatgacaaattcaatttctagttatagggctatttaaattattatttcataccaggtgagttgtggtagtttgtgttttttgaggaattggtctatttcatccaagttataaaatttatgtatgtagatgtttgtcgtagtcgcttattatccttttcagattgcagggtctgtagtgatatctctttttcgtttcgagacagaatcttgtggtgtcgcccaggctggagtgcagtgctgcagtctcggctcgagcaattctcgtgtttcagcctcccaagtagctgggactacaggcacctgccaccacgcccagccaagtttttgtatttttagtagaga

SEQ ID NO: 329339 - DNA, 2076 bp, Homo sapiens
  misc_feature (1657)..(1657): n is a, c, g, or t
tatggcgactgacaacaagaggtatagcacttttattttgttgcgttgttttaccactaattgctgtggtttaactaatatagggaaatggcctcagaatggatcattattttacccaattttagaaggtgcccttaaacaagatggcaacctcaggcgcgttaacaaggtgctgaagcagcagcgatgtaacctgttgcttggacaccaggctggagtgggaggactcaccgctaagggttcagaaccgattttcaaccagtcacgcccttctcaaagatggccgacctcacttcccttacgcaacatggacgttttcagtcacttcctgtgattttgaggttattctgatccaggactacttgcatgaccaaagccaagatggcaggtacgtccttttagaatttaaggttagtgaagccatctatttccccgacccccttcagtgaaaatggtctttcgcatctggctcttctttttggaggcgtgcttgccagcagtcaaaatggctccattccggaatagatttaataggaagtgaagctgtgacggcgaggcgttgcccggcctatctttgctaggcgttctcagaattagttctttctgcccacactagacatggcgcttgccagcgtgttggagagaccgctaccggtgaaccagcgcgggtttttcggacttgggggtcgtgcagatctgctggatctaggtccagggagtctcagtgatggtctgagcctggccgcgccaggctggggtgtcccagaagagccaggaatcgaaatgcttcatggaacaaccaccctggccttcaagttccgccatggagtcatagttgcagctgactccagggctacagcgggtgcttacattgcctcccagacggtgaagaaggtgatagagatcaacccatacctgctaggcaccatggctgggggcgcagcggattgcagcttctgggaacggctgttggctcggcaatgtcgaatctatgagcttcgaaataaggaacgcatctctgtagcagctgcctccaaactgcttgccaacatggtgtatcagtacaaaggcatggggctgtccatgggcaccatgatctgtggctgggataagagaggccctggcctctactacgtggacagtgaagggaaccggatttcaggggccaccttctctgtaggttctggctctgtgtatgcatatggggtcatggatcggggctattcctatgacctggaagtggagcaggcctatgatctggcccgtcgagccatctaccaagccacctacagagatgcctactcaggaggtgcagtcaacctctaccacgtgcgggaggatggctggatccgagtctccagtgacaatgtggctgatctacatgagaagtatagtggctctaccccctgaaagagggtggatgcagctgcttgtgtttcttggggtgactgtcattggtaatacggacacagtgacccatcctccatcctatttatagtggaagggccttcaattgtatcagtacttttttttaagctctggcacattgacctctatgtgttaccagtcattaatgagctgctgcagaggtgactatttgttttactttcttggatgttaacattacactactcactactcaaaaaaaaaaaaacanaaaaaaaaacaaaaaaaaaaaaaaaaaaaaacaaaaaaaaacaaacacccgccggcggccttttttgggagggggcgagaaagaagagggaggaagaaagaagggacgcccggtgggcccgcgggggtccgcagccccccctttttgtgacacagggggtggataccttctggggggcgaccaccacactataaaggagggaggggcgaattaatacttccgataataacaccgccggggatacccgctgcggtataaaatgagtagttggcaggaaaaaacgccacgacgaaacatgacacccaccgcccaactaataacgggaggtacatgtgatagcagaccacgaaacgacctgtaaccaatcacctcgacgcgacgagcacccgactcgcactgcacaaaaacaaaacacacgc

SEQ ID NO: 329340 - DNA, 1716 bp, Homo sapiens
tatggcgactgacaacaagaggtatagcacttttattttgttgcgttgttttaccactaattgctgtggtttaactaatatagggaaatggcctcagaatggatcattattttacccaattttagaaggtgcccttaaacaagatggcaacctcaggcgcgttaacaaggtgctgaagcagcagcgatgtaacctgttgcttggacaccaggctggagtgggaggactcaccgctaagggttcagaaccgattttcaaccagtcacgcccttctcaaagatggccgacctcacttcccttacgcaacatggacgttttcagtcacttcctgtgattttgaggttattctgatccaggactacttgcatgaccaaagccaagatggcaggtacgtccttttagaatttaaggttagtgaagccatctatttccccgacccccttcagtgaaaatggtctttcgcatctggctcttctttttggaggcgtgcttgccagcagtcaaaatggctccattccggaatagatttaataggaagtgaagctgtgacggcgaggcgttgcccggcctatctttgctaggcgttctcagaattagttctttctgcccacactagacatggcgcttgccagcgtgttggagagaccgctaccggtgaaccagcgcgggtttttcggacttgggggtcgtgcagatctgctggatctaggtccagggagtctcagtgatggtctgagcctggccgcgccaggctggggtgtcccagaagagccaggaatcgaaatgcttcatggaacaaccaccctggccttcaagttccgccatggagtcatagttgcagctgactccagggctacagcgggtgcttacattgcctcccagacggtgaagaaggtgatagagatcaacccatacctgctaggcaccatggctgggggcgcagcggattgcagcttctgggaacggctgttggctcggcaatgtcgaatctatgagcttcgaaataaggaacgcatctctgtagcagctgcctccaaactgcttgccaacatggtgtatcagtacaaaggcatggggctgtccatgggcaccatgatctgtggctgggataagagaggccctggcctctactacgtggacagtgaagggaaccggatttcaggggccaccttctctgtaggttctggctctgtgtatgcatatggggtcatggatcggggctattcctatgacctggaagtggagcaggcctatgatctggcccgtcgagccatctaccaagccacctacagagatgcctactcaggaggtgcagtcaacctctaccacgtgcgggaggatggctggatccgagtctccagtgacaatgtggctgatctacatgagaagtatagtggctctaccccctgaaagagggtggatgcagctgcttgtgtttcttggggtgactgtcattggtaatacggacacagtgacccatcctccatcctatttatagtggaagggccttcaattgtatcagtacttttttttaagctctggcacattgacctctatgtgttaccagtcattaatgagctgctgcagaggtgactatttgttttactttcttggatgttaacattacactactcactactcaaaaaaaacgaaaaaacacacacacacacaaaaaatcgcggagggccactataatccgggggcgcgggaacaaaa

SEQ ID NO: 329341 - DNA, 2052 bp, Homo sapiens
tatggcgactgacaacaagaggtatagcacttttattttgttgcgttgttttaccactaattgctgtggtttaactaatatagggaaatggcctcagaatggatcattattttacccaattttagaaggtgcccttaaacaagatggcaacctcaggcgcgttaacaaggtgctgaagcagcagcgatgtaacctgttgcttggacaccaggctggagtgggaggactcaccgctaagggttcagaaccgattttcaaccagtcacgcccttctcaaagatggccgacctcacttcccttacgcaacatggacgttttcagtcacttcctgtgattttgaggttattctgatccaggactacttgcatgaccaaagccaagatggcaggtacgtccttttagaatttaaggttagtgaagccatctatttccccgacccccttcagtgaaaatggtctttcgcatctggctcttctttttggaggcgtgcttgccagcagtcaaaatggctccattccggaatagatttaataggaagtgaagctgtgacggcgaggcgttgcccggcctatctttgctaggcgttctcagaattagttctttctgcccacactagacatggcgcttgccagcgtgttggagagaccgctaccggtgaaccagcgcgggtttttcggacttgggggtcgtgcagatctgctggatctaggtccagggagtctcagtgatggtctgagcctggccgcgccaggctggggtgtcccagaagagccaggaatcgaaatgcttcatggaacaaccaccctggccttcaagttccgccatggagtcatagttgcagctgactccagggctacagcgggtgcttacattgcctcccagacggtgaagaaggtgatagagatcaacccatacctgctaggcaccatggctgggggcgcagcggattgcagcttctgggaacggctgttggctcggcaatgtcgaatctatgagcttcgaaataaggaacgcatctctgtagcagctgcctccaaactgcttgccaacatggtgtatcagtacaaaggcatggggctgtccatgggcaccatgatctgtggctgggataagagaggccctggcctctactacgtggacagtgaagggaaccggatttcaggggccaccttctctgtaggttctggctctgtgtatgcatatggggtcatggatcggggctattcctatgacctggaagtggagcaggcctatgatctggcccgtcgagccatctaccaagccacctacagagatgcctactcaggaggtgcagtcaacctctaccacgtgcgggaggatggctggatccgagtctccagtgacaatgtggctgatctacatgagaagtatagtggctctaccccctgaaagagggtggatgcagctgcttgtgtttcttggggtgactgtcattggtaatacggacacagtgacccatcctccatcctatttatagtggaagggccttcaattgtatcagtacttttttttaagctctggcacattgacctctatgtgttaccagtcattaatgagctgctgcagaggtgactatttgttttactttcttggatgttaacattacactactcactactcaaaaaaaaaaaaaaaaaaaaaaacaaaaaaaaacaaacacccgccggcggccttttttgggagggggcgagaaagaagagggaggaagaaagaagggacgcccggtgggcccgcgggggtccgcagccccccctttttgtgacacagggggtggataccttctggggggcgaccaccacactataaaggagggaggggcgaattaatacttccgataataacaccgccggggatacccgctgcggtataaaatgagtagttggcaggaaaaaacgccacgacgaaacatgacacccaccgcccaactaataacgggaggtacatgtgatagcagaccacgaaacgacctgtaaccaatcacctcgacgcgacgagcacccgactcgcactgcacaaaaacaaaacacacgc

SEQ ID NO: 329342 - DNA, 1651 bp, Homo sapiens
  misc_feature (1510)..(1510): n is a, c, g, or t
  misc_feature (1523)..(1523): n is a, c, g, or t
  misc_feature (1537)..(1537): n is a, c, g, or t
  misc_feature (1539)..(1539): n is a, c, g, or t
  misc_feature (1546)..(1546): n is a, c, g, or t
  misc_feature (1548)..(1548): n is a, c, g, or t
tatggcgactgacaacaagaggtatagcacttttattttgttgcgttgttttaccactaattgctgtggtttaactaatatagggaaatggcctcagaatggatcattattttacccaattttagaaggtgcccttaaacaagatggcaacctcaggcgcgttaacaaggtgctgaagcagcagcgatgtaacctgttgcttggacaccaggctggagtgggaggactcaccgctaagggttcagaaccgattttcaaccagtcacgcccttctcaaagatggccgacctcacttcccttacgcaacatggacgttttcagtcacttcctgtgattttgaggttattctgatccaggactacttgcatgaccaaagccaagatggcaggtacgtccttttagaatttaaggttagtgaagccatctatttccccgacccccttcagtgaaaatggtctttcgcatctggctcttctttttggaggcgtgcttgccagcagtcaaaatggctccattccggaatagatttaataggaagtgaagctgtgacggcgaggcgttgcccggcctatctttgctaggcgttctcagaattagttctttctgcccacactagacatggcgcttgccagcgtgttggagagaccgctaccggtgaaccagcgcgggtttttcggacttgggggtcgtgcagatctgctggatctaggtccagggagtctcagtgatggtctgagcctggccgcgccaggctggggtgtcccagaagagccaggaatcgaaatgcttcatggaacaaccaccctggccttcaagttccgccatggagtcatagttgcagctgactccagggctacagcgggtgcttacattgcctcccagacggtgaagaaggtgatagagatcaacccatacctgctaggcaccatggctgggggcgcagcggattgcagcttctgggaacggctgttggctcggcaatgtcgaatctatgagcttcgaaataaggaacgcatctctgtagcagctgcctccaaactgcttgccaacatggtgtatcagtacaaaggcatggggctgtccatgggcaccatgatctgtggctgggataagagaggccctggcctctactacgtggacagtgaagggaaccggatttcaggggccaccttctctgtaggttctggctctgtgtatgcatatggggtcatggatcggggctattcctatgacctggaagtggagcaggcctatgatctggcccgtcgagccatctaccaagccacctacagagatgcctactcaggaggtgcagtcaacctctaccacgtgcgggaggatggctggatccgagtctccagtgacaatgtggctgatctacatgagaagtatagtggctctaccccctgaaagagggtggatgcagctgcttgtgtttcttggggtgactgtcattggtaatacggacacagtgacccatcctccatcctatttatagggaggcccatgntagacttttagcnggcatggccttgtncntaaggcngngagggaatgtacttggggactactctctcaaaaaacggtttggggggaaagggctttcctcttgtagcttaacacagcacggcaaaggataatatgttttagc

SEQ ID NO: 329343 - DNA, 1648 bp, Homo sapiens
  misc_feature (1229)..(1229): n is a, c, g, or t
tatggcgactgacaacaagaggtatagcacttttattttgttgcgttgttttaccactaattgctgtggtttaactaatatagggaaatggcctcagaatggatcattattttacccaattttagaaggtgcccttaaacaagatggcaacctcaggcgcgttaacaaggtgctgaagcagcagcgatgtaacctgttgcttggacaccaggctggagtgggaggactcaccgctaagggttcagaaccgattttcaaccagtcacgcccttctcaaagatggccgacctcacttcccttacgcaacatggacgttttcagtcacttcctgtgattttgaggttattctgatccaggactacttgcatgaccaaagccaagatggcagttccgccatggagtcatagttgcagctgactccagggctacagcgggtgcttacattgcctcccagacggtgaagaaggtgatagagatcaacccatacctgctaggcaccatggctgggggcgcagcggattgcagcttctgggaacggctgttggctcggcaatgtcgaatctatgagcttcgaaataaggaacgcatctctgtagcagctgcctccaaactgcttgccaacatggtgtatcagtacaaaggcatggggctgtccatgggcaccatgatctgtggctgggataagagaggccctggcctctactacgtggacagtgaagggaaccggatttcaggggccaccttctctgtaggttctggctctgtgtatgcatatggggtcatggatcggggctattcctatgacctggaagtggagcaggcctatgatctggcccgtcgagccatctaccaagccacctacagagatgcctactcaggaggtgcagtcaacctctaccacgtgcgggaggatggctggatccgagtctccagtgacaatgtggctgatctacatgagaagtatagtggctctaccccctgaaagagggtggatgcagctgcttgtgtttcttggggtgactgtcattggtaatacggacacagtgacccatcctccatcctatttatagtggaagggccttcaattgtatcagtacttttttttaagctctggcacattgacctctatgtgttaccagtcattaatgagctgctgcagaggtgactatttgttttactttcttggatgttaacattacactactcactactcaaaaaaaaaaaaacanaaaaaaaaacaaaaaaaaaaaaaaaaaaaaacaaaaaaaaacaaacacccgccggcggccttttttgggagggggcgagaaagaagagggaggaagaaagaagggacgcccggtgggcccgcgggggtccgcagccccccctttttgtgacacagggggtggataccttctggggggcgaccaccacactataaaggagggaggggcgaattaatacttccgataataacaccgccggggatacccgctgcggtataaaatgagtagttggcaggaaaaaacgccacgacgaaacatgacacccaccgcccaactaataacgggaggtacatgtgatagcagaccacgaaacgacctgtaaccaatcacctcgacgcgacgagcacccgactcgcactgcacaaaaacaaaacacacgc

SEQ ID NO: 329344 - DNA, 2001 bp, Homo sapiens
  misc_feature (1582)..(1582): n is a, c, g, or t
tatggcgactgacaacaagaggtatagcacttttattttgttgcgttgttttaccactaattgctgtggtttaactaatatagggaaatggcctcagaatggatcattattttacccaattttagaaggtgcccttaaacaagatggcaacctcaggcgcgttaacaaggtgctgaagcagcagcgatgtaacctgttgcttggacaccaggctggagtgggaggactcaccgctaagggttcagaaccgattttcaaccagtcacgcccttctcaaagatggccgacctcacttcccttacgcaacatggacgttttcagtcacttcctgtgattttgaggttattctgatccaggactacttgcatgaccaaagccaagatggcaggtacgtccttttagaatttaaggttagtgaagccatctatttccccgacccccttcagtgaaaatggtctttcgcatctggctcttctttttggaggcgtgcttgccagcagtcaaaatggctccattccggaatagatttaataggaagtgaagctgtgacggcgaggcgttgcccggcctatctttgctaggcgttctcagaattagttctttctgcccacactagacatggcgcttgccagcgtgttggagagaccgctaccggtgaaccagcgcgggtttttcggacttgggggtcgtgcagatctgctggatctaggtccagggagtctcagtgatggtctgagcctggccgcgccaggctggggtgtcccagaagagccaggaatcgaaatgcttcatggaacaaccaccctggccttcaagttccgccatggagtcatagttgcagctgactccagggctacagcgggcgcagcggattgcagcttctgggaacggctgttggctcggcaatgtcgaatctatgagcttcgaaataaggaacgcatctctgtagcagctgcctccaaactgcttgccaacatggtgtatcagtacaaaggcatggggctgtccatgggcaccatgatctgtggctgggataagagaggccctggcctctactacgtggacagtgaagggaaccggatttcaggggccaccttctctgtaggttctggctctgtgtatgcatatggggtcatggatcggggctattcctatgacctggaagtggagcaggcctatgatctggcccgtcgagccatctaccaagccacctacagagatgcctactcaggaggtgcagtcaacctctaccacgtgcgggaggatggctggatccgagtctccagtgacaatgtggctgatctacatgagaagtatagtggctctaccccctgaaagagggtggatgcagctgcttgtgtttcttggggtgactgtcattggtaatacggacacagtgacccatcctccatcctatttatagtggaagggccttcaattgtatcagtacttttttttaagctctggcacattgacctctatgtgttaccagtcattaatgagctgctgcagaggtgactatttgttttactttcttggatgttaacattacactactcactactcaaaaaaaaaaaaacanaaaaaaaaacaaaaaaaaaaaaaaaaaaaaacaaaaaaaaacaaacacccgccggcggccttttttgggagggggcgagaaagaagagggaggaagaaagaagggacgcccggtgggcccgcgggggtccgcagccccccctttttgtgacacagggggtggataccttctggggggcgaccaccacactataaaggagggaggggcgaattaatacttccgataataacaccgccggggatacccgctgcggtataaaatgagtagttggcaggaaaaaacgccacgacgaaacatgacacccaccgcccaactaataacgggaggtacatgtgatagcagaccacgaaacgacctgtaaccaatcacctcgacgcgacgagcacccgactcgcactgcacaaaaacaaaacacacgc

SEQ ID NO: 329345 - DNA, 2161 bp, Homo sapiens
  misc_feature (1742)..(1742): n is a, c, g, or t
tatggcgactgacaacaagaggtatagcacttttattttgttgcgttgttttaccactaattgctgtggtttaactaatatagggaaatggcctcagaatggatcattattttacccaattttagaaggtgcccttaaacaagatggcaacctcaggcgcgttaacaaggtgctgaagcagcagcgatgtaacctgttgcttggacaccaggctggagtgggaggactcaccgctaagggttcagaaccgattttcaaccagtcacgcccttctcaaagatggccgacctcacttcccttacgcaacatggacgttttcagtcacttcctgtgattttgaggttattctgatccaggactacttgcatgaccaaagccaagatggcaggtacgtccttttagaatttaaggttagtgaagccatctatttccccgacccccttcagtgaaaatggtctttcgcatctggctcttctttttggaggcgtgcttgccagcagtcaaaatggctccattccggaatagatttaataggaagtgaagctgtgacggcgaggcgttgcccggcctatctttgctaggcgttctcagaattagttctttctgcccacactagacatggcgcttgccagcgtgttggagagaccgctaccggtgaaccagcgcgggtttttcggacttgggggtcgtgcagatctgctggatctaggtccagggagtctcagtgatggtctgagcctggccgcgccaggctggggtgtcccagaagagccaggaatcgaaatgcttcatggaacaaccaccctggccttcaagttccgccatggagtcatagttgcagctgactccagggctacagcgggtgcttacattgcctcccagacggtgaagaaggtgatagagatcaacccatacctgctaggcaccatggctgggggcgcagcggattgcagcttctgggaacggctgttggctcggcaatgtcgaatctatgagcttcgaaataaggaacgcatctctgtagcagctgcctccaaactgcttgccaacatggtgtatcagtacaaaggcatggggctgtccatgggcaccatgatctgtggctgggataagagaggccctgtgtctgaagttctgtgcttgaaacctaagtcatttggaatgtacttgttttgtgggtgtgctgagaggatcggcaacatggcaaggcctctactacgtggacagtgaagggaaccggatttcaggggccaccttctctgtaggttctggctctgtgtatgcatatggggtcatggatcggggctattcctatgacctggaagtggagcaggcctatgatctggcccgtcgagccatctaccaagccacctacagagatgcctactcaggaggtgcagtcaacctctaccacgtgcgggaggatggctggatccgagtctccagtgacaatgtggctgatctacatgagaagtatagtggctctaccccctgaaagagggtggatgcagctgcttgtgtttcttggggtgactgtcattggtaatacggacacagtgacccatcctccatcctatttatagtggaagggccttcaattgtatcagtacttttttttaagctctggcacattgacctctatgtgttaccagtcattaatgagctgctgcagaggtgactatttgttttactttcttggatgttaacattacactactcactactcaaaaaaaaaaaaacanaaaaaaaaacaaaaaaaaaaaaaaaaaaaaacaaaaaaaaacaaacacccgccggcggccttttttgggagggggcgagaaagaagagggaggaagaaagaagggacgcccggtgggcccgcgggggtccgcagccccccctttttgtgacacagggggtggataccttctggggggcgaccaccacactataaaggagggaggggcgaattaatacttccgataataacaccgccggggatacccgctgcggtataaaatgagtagttggcaggaaaaaacgccacgacgaaacatgacacccaccgcccaactaataacgggaggtacatgtgatagcagaccacgaaacgacctgtaaccaatcacctcgacgcgacgagcacccgactcgcactgcacaaaaacaaaacacacgc

SEQ ID NO: 329346 - DNA, 1769 bp, Homo sapiens
  misc_feature (1350)..(1350): n is a, c, g, or t
tatggcgactgacaacaagaggtatagcacttttattttgttgcgttgttttaccactaattgctgtggtttaactaatatagggaaatggcctcagaatggatcattattttacccaattttagaaggtgcccttaaacaagatggcaacctcaggcgcgttaacaaggtgctgaagcagcagcgatgtaacctgttgcttggacaccaggctggagtgggaggactcaccgctaagggttcagaaccgattttcaaccagtcacgcccttctcaaagatggccgacctcacttcccttacgcaacatggacgttttcagtcacttcctgtgattttgaggttattctgatccaggactacttgcatgaccaaagccaagatggcaggtacgtccttttagaatttaaggttagtgaagccatctatttccccgacccccttcagtgaaaatggtctttcgcatctggctcttctttttggaggcgtgcttgccagcagtcaaaatggctccattccggaatagatttaataggaagtgaagctgtgacggcgaggcgttgcccggcctatctttgctaggcgttctcagaattagttctttctgcccacactagacatggcgcttgccagcgtgttggagagaccgctaccggtgaaccagcgcgggtttttcggacttgggggtcgtgcagatctgctggatctaggtccagggagtctcagtgatggtctgagcctggccgcgccaggctggggtgtcccagaagagccaggaatcgaaatgcttcatggaacaaccaccctggccttcaaggcctctactacgtggacagtgaagggaaccggatttcaggggccaccttctctgtaggttctggctctgtgtatgcatatggggtcatggatcggggctattcctatgacctggaagtggagcaggcctatgatctggcccgtcgagccatctaccaagccacctacagagatgcctactcaggaggtgcagtcaacctctaccacgtgcgggaggatggctggatccgagtctccagtgacaatgtggctgatctacatgagaagtatagtggctctaccccctgaaagagggtggatgcagctgcttgtgtttcttggggtgactgtcattggtaatacggacacagtgacccatcctccatcctatttatagtggaagggccttcaattgtatcagtacttttttttaagctctggcacattgacctctatgtgttaccagtcattaatgagctgctgcagaggtgactatttgttttactttcttggatgttaacattacactactcactactcaaaaaaaaaaaaacanaaaaaaaaacaaaaaaaaaaaaaaaaaaaaacaaaaaaaaacaaacacccgccggcggccttttttgggagggggcgagaaagaagagggaggaagaaagaagggacgcccggtgggcccgcgggggtccgcagccccccctttttgtgacacagggggtggataccttctggggggcgaccaccacactataaaggagggaggggcgaattaatacttccgataataacaccgccggggatacccgctgcggtataaaatgagtagttggcaggaaaaaacgccacgacgaaacatgacacccaccgcccaactaataacgggaggtacatgtgatagcagaccacgaaacgacctgtaaccaatcacctcgacgcgacgagcacccgactcgcactgcacaaaaacaaaacacacgc

SEQ ID NO: 329347 - DNA, 701 bp, Homo sapiens
  misc_feature (282)..(282): n is a, c, g, or t
tattaccaatgacagtcaccccaagaaacacaagcagctgcatccaccctctttcagggggtagagccactatacttctcatgtagatcagccacagtgacccatcctccatcctatttatagtggaagggccttcaattgtatcagtacttttttttaagctctggcacattgacctctatgtgttaccagtcattaatgagctgctgcagaggtgactatttgttttactttcttggatgttaacattacactactcactactcaaaaaaaaaaaaacanaaaaaaaaacaaaaaaaaaaaaaaaaaaaaacaaaaaaaaacaaacacccgccggcggccttttttgggagggggcgagaaagaagagggaggaagaaagaagggacgcccggtgggcccgcgggggtccgcagccccccctttttgtgacacagggggtggataccttctggggggcgaccaccacactataaaggagggaggggcgaattaatacttccgataataacaccgccggggatacccgctgcggtataaaatgagtagttggcaggaaaaaacgccacgacgaaacatgacacccaccgcccaactaataacgggaggtacatgtgatagcagaccacgaaacgacctgtaaccaatcacctcgacgcgacgagcacccgactcgcactgcacaaaaacaaaacacacgc

SEQ ID NO: 329348 - DNA, 298 bp, Homo sapiens
ctgcgcctggccggggattatgttttaaatgttatctttcacagtgtctgaagttctgtgcttgaaacctaagtcatttggaatgtacttgttttgtgggtgtgctgagaggatcggcaacatggcaaggtagttattataatataaggtgagatggggtggtatgttgtagaatcctggagtcttaatattaaattttattccttcaggttttttttttttcctgaagacagcatctcagtctgttgcccaagctggagtgtggtggtgtgattatagcttactgcagcctgcaagt

SEQ ID NO: 329349 - DNA, 1732 bp, Homo sapiens
tatggcgactgacaacaagaggtatagcacttttattttgttgcgttgttttaccactaattgctgtggtttaactaatatagggaaatggcctcagaatggatcattattttacccaattttagaaggtgcccttaaacaagatggcaacctcaggcgcgttaacaaggtgctgaagcagcagcgatgtaacctgttgcttggacaccaggctggagtgggaggactcaccgctaagggttcagaaccgattttcaaccagtcacgcccttctcaaagatggccgacctcacttcccttacgcaacatggacgttttcagtcacttcctgtgattttgaggttattctgatccaggactacttgcatgaccaaagccaagatggcaggtacgtccttttagaatttaaggttagtgaagccatctatttccccgacccccttcagtgaaaatggtctttcgcatctggctcttctttttggaggcgtgcttgccagcagtcaaaatggctccattccggaatagatttaataggaagtgaagctgtgacggcgaggcgttgcccggcctatctttgctaggcgttctcagaattagttctttctgcccacactagacatggcgcttgccagcgtgttggagagaccgctaccggtgaaccagcgcgggtttttcggacttgggggtcgtgcagatctgctggatctaggtccagggagtctcagtgatggtctgagcctggccgcgccaggctggggtgtcccagaagagccaggaatcgaaatgcttcatggaacaaccaccctggccttcaagttccgccatggagtcatagttgcagctgactccagggctacagcgggtgcttacattgcctcccagacggtgaagaaggtgatagagatcaacccatacctgctaggcaccatggctgggggcgcagcggattgcagcttctgggaacggctgttggctcggcaatgtcgaatctatgagcttcgaaataaggaacgcatctctgtagcagctgcctccaaactgcttgccaacatggtgtatcagtacaaaggcatggggctgtccatgggcaccatgatctgtggctgggataagagaggccctggcctctactacgtggacagtgaagggaaccggatttcaggggccaccttctctgtaggttctggctctgtgtatgcatatggggtcatggatcggggctattcctatgacctggaagtggagcaggcctatgatctggcccgtcgagccatctaccaagccacctacagagatgcctactcaggaggtgcagtcaacctctaccacgtgcgggaggatggctggatccgagtctccagtgacaatgtggctgatctacatgagaagtatagtggctctaccccctgaaagagggtggatgcagctgcttgtgtttcttggggtgactgtcattggtaatacggacacagtgacccatcctccatcctatttatagtggaagggccttcaattgtatcagtacttttttttaagctctggcacattgacctctatgtgttaccagtcattaatgagctgctgcagaggtgactatttgttttactttcttggatgttaacattacactactcactactcaaaaaaaacacacaaaaaccccgggcctctaagccggggcgcaccaaaaggtcatacatggccccctggtccaagccggtcccctgaacca

SEQ ID NO: 329350 - DNA, 1642 bp, Homo sapiens
tatggcgactgacaacaagaggtatagcacttttattttgttgcgttgttttaccactaattgctgtggtttaactaatatagggaaatggcctcagaatggatcattattttacccaattttagaaggtgcccttaaacaagatggcaacctcaggcgcgttaacaaggtgctgaagcagcagcgatgtaacctgttgcttggacaccaggctggagtgggaggactcaccgctaagggttcagaaccgattttcaaccagtcacgcccttctcaaagatggccgacctcacttcccttacgcaacatggacgttttcagtcacttcctgtgattttgaggttattctgatccaggactacttgcatgaccaaagccaagatggcaggtacgtccttttagaatttaaggttagtgaagccatctatttccccgacccccttcagtgaaaatggtctttcgcatctggctcttctttttggaggcgtgcttgccagcagtcaaaatggctccattccggaatagatttaataggaagtgaagctgtgacggcgaggcgttgcccggcctatctttgctaggcgttctcagaattagttctttctgcccacactagacatggcgcttgccagcgtgttggagagaccgctaccggtgaaccagcgcgggtttttcggacttgggggtcgtgcagatctgctggatctaggtccagggagtctcagtgatggtctgagcctggccgcgccaggctggggtgtcccagaagagccaggaatcgaaatgcttcatggaacaaccaccctggccttcaagttccgccatggagtcatagttgcagctgactccagggctacagcgggtgcttacattgcctcccagacggtgaagaaggtgatagagatcaacccatacctgctaggcaccatggctgggggcgcagcggattgcagcttctgggaacggctgttggctcggcaatgtcgaatctatgagcttcgaaataaggaacgcatctctgtagcagctgcctccaaactgcttgccaacatggtgtatcagtacaaaggcatggggctgtccatgggcaccatgatctgtggctgggataagagaggccctggcctctactacgtggacagtgaagggaaccggatttcaggggccaccttctctgtaggttctggctctgtgtatgcatatggggtcatggatcggggctattcctatgacctggaagtggagcaggcctatgatctggcccgtcgagccatctaccaagccacctacagagatgcctactcaggaggtgcagtcaacctctaccacgtgcgggaggatggctggatccgagtctccagtgacaatgtggctgatctacatgagaagtatagtggctctaccccctgaaagagggtggatgcagctgcttgtgtttcttggggtgactgtcattggtaatacggacacagtgacccatcctccatcctatttatagtggaagggccttcaattgtatcagtacttttttttaagctctggcacattgacctctatgtgttaccagtcattaatgagctgctgcagaggtgactatttgttttactttcttggtaagtggcaagacgagatcctcgtagaa

SEQ ID NO: 329351 - DNA, 2285 bp, Homo sapiens
  misc_feature (1866)..(1866): n is a, c, g, or t
tatggcgactgacaacaagaggtatagcacttttattttgttgcgttgttttaccactaattgctgtggtttaactaatatagggaaatggcctcagaatggatcattattttacccaattttagaaggtgcccttaaacaagatggcaacctcaggcgcgttaacaaggtgctgaagcagcagcgatgtaacctgttgcttggacaccaggctggagtgggaggactcaccgctaagggttcagaaccgattttcaaccagtcacgcccttctcaaagatggccgacctcacttcccttacgcaacatggacgttttcagtcacttcctgtgattttgaggttattctgatccaggactacttgcatgaccaaagccaagatggcaggtacgtccttttagaatttaaggttagtgaagccatctatttccccgacccccttcagtgaaaatggtctttcgcatctggctcttctttttggaggcgtgcttgccagcagtcaaaatggctccattccggaatagatttaataggaagtgaagctgtgacggcgaggcgttgcccggcctatctttgctaggcgttctcagaattagttctttctgcccacactagacatggcgcttgccagcgtgttggagagaccgctaccggtgaaccagcgcgggtttttcggacttgggggtcgtgcagatctgctggatctaggtccagggagtctcagtgatggtctgagcctggccgcgccaggctggggtgtcccagaagagccaggaatcgaaatgcttcatggaacaaccaccctggccttcaagggtgtggagccagcccccttgccaggctgagtactgaacgcccgcgacttgcctggcctcccagcctgaccggagtttgcggtggccttggccaccaacccaggcggaggctgggtcctctcgttcggaccgcagcagttttgctgtctcattggcccaggaggcccctgtctttgctctggttggaaagggtggcggtggggccggggttccgccatggagtcatagttgcagctgactccagggctacagcgggtgcttacattgcctcccagacggtgaagaaggtgatagagatcaacccatacctgctaggcaccatggctgggggcgcagcggattgcagcttctgggaacggctgttggctcggcaatgtcgaatctatgagcttcgaaataaggaacgcatctctgtagcagctgcctccaaactgcttgccaacatggtgtatcagtacaaaggcatggggctgtccatgggcaccatgatctgtggctgggataagagaggccctggcctctactacgtggacagtgaagggaaccggatttcaggggccaccttctctgtaggttctggctctgtgtatgcatatggggtcatggatcggggctattcctatgacctggaagtggagcaggcctatgatctggcccgtcgagccatctaccaagccacctacagagatgcctactcaggaggtgcagtcaacctctaccacgtgcgggaggatggctggatccgagtctccagtgacaatgtggctgatctacatgagaagtatagtggctctaccccctgaaagagggtggatgcagctgcttgtgtttcttggggtgactgtcattggtaatacggacacagtgacccatcctccatcctatttatagtggaagggccttcaattgtatcagtacttttttttaagctctggcacattgacctctatgtgttaccagtcattaatgagctgctgcagaggtgactatttgttttactttcttggatgttaacattacactactcactactcaaaaaaaaaaaaacanaaaaaaaaacaaaaaaaaaaaaaaaaaaaaacaaaaaaaaacaaacacccgccggcggccttttttgggagggggcgagaaagaagagggaggaagaaagaagggacgcccggtgggcccgcgggggtccgcagccccccctttttgtgacacagggggtggataccttctggggggcgaccaccacactataaaggagggaggggcgaattaatacttccgataataacaccgccggggatacccgctgcggtataaaatgagtagttggcaggaaaaaacgccacgacgaaacatgacacccaccgcccaactaataacgggaggtacatgtgatagcagaccacgaaacgacctgtaaccaatcacctcgacgcgacgagcacccgactcgcactgcacaaaaacaaaacacacgc

SEQ ID NO: 329352 - DNA, 1692 bp, Homo sapiens
  misc_feature (1273)..(1273): n is a, c, g, or t
gagcggagtggttggcttgtgtaggtagagagtgtgggcctagatcggtacacggtgaactcagcgcggatcagtcatcaacttgcaggttcaagggcatttagctgaaaactgggattcagggagtctcagtgatggtctgagcctggccgcgccaggctggggtgtcccagaagagccaggaatcgaaatgcttcatggaacaaccaccctggccttcaagggtgtggagccagcccccttgccaggctgagtactgaacgcccgcgacttgcctggcctcccagcctgaccggagtttgcggtggccttggccaccaacccaggcggaggctgggtcctctcgttcggaccgcagcagttttgctgtctcattggcccaggaggcccctgtctttgctctggttggaaagggtggcggtggggccggggttccgccatggagtcatagttgcagctgactccagggctacagcgggtgcttacattgcctcccagacggtgaagaaggtgatagagatcaacccatacctgctaggcaccatggctgggggcgcagcggattgcagcttctgggaacggctgttggctcggcaatgtcgaatctatgagcttcgaaataaggaacgcatctctgtagcagctgcctccaaactgcttgccaacatggtgtatcagtacaaaggcatggggctgtccatgggcaccatgatctgtggctgggataagagaggccctggcctctactacgtggacagtgaagggaaccggatttcaggggccaccttctctgtaggttctggctctgtgtatgcatatggggtcatggatcggggctattcctatgacctggaagtggagcaggcctatgatctggcccgtcgagccatctaccaagccacctacagagatgcctactcaggaggtgcagtcaacctctaccacgtgcgggaggatggctggatccgagtctccagtgacaatgtggctgatctacatgagaagtatagtggctctaccccctgaaagagggtggatgcagctgcttgtgtttcttggggtgactgtcattggtaatacggacacagtgacccatcctccatcctatttatagtggaagggccttcaattgtatcagtacttttttttaagctctggcacattgacctctatgtgttaccagtcattaatgagctgctgcagaggtgactatttgttttactttcttggatgttaacattacactactcactactcaaaaaaaaaaaaacanaaaaaaaaacaaaaaaaaaaaaaaaaaaaaacaaaaaaaaacaaacacccgccggcggccttttttgggagggggcgagaaagaagagggaggaagaaagaagggacgcccggtgggcccgcgggggtccgcagccccccctttttgtgacacagggggtggataccttctggggggcgaccaccacactataaaggagggaggggcgaattaatacttccgataataacaccgccggggatacccgctgcggtataaaatgagtagttggcaggaaaaaacgccacgacgaaacatgacacccaccgcccaactaataacgggaggtacatgtgatagcagaccacgaaacgacctgtaaccaatcacctcgacgcgacgagcacccgactcgcactgcacaaaaacaaaacacacgc

SEQ ID NO: 329353 - DNA, 1036 bp, Homo sapiens
  misc_feature (617)..(617): n is a, c, g, or t
agaactactgccatggcatatgaattagatatctaaaggggtgatctttttttttttcctgctaacctcatctccctttccaggcctctactacgtggacagtgaagggaaccggatttcaggggccaccttctctgtaggttctggctctgtgtatgcatatggggtcatggatcggggctattcctatgacctggaagtggagcaggcctatgatctggcccgtcgagccatctaccaagccacctacagagatgcctactcaggaggtgcagtcaacctctaccacgtgcgggaggatggctggatccgagtctccagtgacaatgtggctgatctacatgagaagtatagtggctctaccccctgaaagagggtggatgcagctgcttgtgtttcttggggtgactgtcattggtaatacggacacagtgacccatcctccatcctatttatagtggaagggccttcaattgtatcagtacttttttttaagctctggcacattgacctctatgtgttaccagtcattaatgagctgctgcagaggtgactatttgttttactttcttggatgttaacattacactactcactactcaaaaaaaaaaaaacanaaaaaaaaacaaaaaaaaaaaaaaaaaaaaacaaaaaaaaacaaacacccgccggcggccttttttgggagggggcgagaaagaagagggaggaagaaagaagggacgcccggtgggcccgcgggggtccgcagccccccctttttgtgacacagggggtggataccttctggggggcgaccaccacactataaaggagggaggggcgaattaatacttccgataataacaccgccggggatacccgctgcggtataaaatgagtagttggcaggaaaaaacgccacgacgaaacatgacacccaccgcccaactaataacgggaggtacatgtgatagcagaccacgaaacgacctgtaaccaatcacctcgacgcgacgagcacccgactcgcactgcacaaaaacaaaacacacgc

SEQ ID NO: 329354 - DNA, 1395 bp, Homo sapiens
  misc_feature (976)..(976): n is a, c, g, or t
tatggcgactgacaacaagaggtatagcacttttattttgttgcgttgttttaccactaattgctgtggtttaactaatatagggaaatggcctcagaatggatcattattttacccaattttagaaggtgcccttaaacaagatggcaacctcaggcgcgttaacaaggtgctgaagcagcagcgatgtaacctgttgcttggacaccaggctggagtgggaggactcaccgctaagggttcagaaccgattttcaaccagtcacgcccttctcaaagatggccgacctcacttcccttacgcaacatggacgttttcagtcacttcctgtgattttgaggttattctgatccaggactacttgcatgaccaaagccaagatggcaggtacgtccttttagaatttaaggttagtgaagccatctatttccccgacccccttcagtgaaaatggtctttcgcatctggctcttctttttggaggcgtgcttgccagcagtcaaaatggctccattccggaatagatttaataggaagtgaagctgtgacggcgaggcgttgcccggcctatctttgctaggcgttctcagaattagttctttctgcccacactagacatggcgcttgccagcgtgttggagagaccgctaccggtgaaccagcgcgggtttttcggacttgggggtcgtgcagatctgctggatctaggtccagggagtctcagtgatggtctgagcctggccgcgccaggctggggtgtcccagaagagccaggaatcgaaatgcttcatggaacaaccaccctggccttcaaggtggaagggccttcaattgtatcagtacttttttttaagctctggcacattgacctctatgtgttaccagtcattaatgagctgctgcagaggtgactatttgttttactttcttggatgttaacattacactactcactactcaaaaaaaaaaaaacanaaaaaaaaacaaaaaaaaaaaaaaaaaaaaacaaaaaaaaacaaacacccgccggcggccttttttgggagggggcgagaaagaagagggaggaagaaagaagggacgcccggtgggcccgcgggggtccgcagccccccctttttgtgacacagggggtggataccttctggggggcgaccaccacactataaaggagggaggggcgaattaatacttccgataataacaccgccggggatacccgctgcggtataaaatgagtagttggcaggaaaaaacgccacgacgaaacatgacacccaccgcccaactaataacgggaggtacatgtgatagcagaccacgaaacgacctgtaaccaatcacctcgacgcgacgagcacccgactcgcactgcacaaaaacaaaacacacgc

SEQ ID NO: 329355 - DNA, 458 bp, Homo sapiens
agctggaatcctctaaaataagtcacatgggaaaaaattctgatcttattctagacgaagaatgaaaagccaggaagctacataacccaaggtagggtggaaagagttgggtagagagttggcaactgttttggaaaccgaaatagtgttaaagatgtcagaaaaatgtgaagtgacattccactaagactgttcaaagatattttgaaagacactagctacataagctaagtaccttgcgttgacttaagtttgactttgttctcttagttctatagctgagacaagtcccagaaggattaagtaggttttgggaaattaattaatgactaagtcatacttgtatatcttcattcaagtgctctatctgccagaaaacatagtgatccaaatgactattctggtatattaatgcgtgtttaataggttacatctataaaatgatttatttcaatcca

SEQ ID NO: 329356 - DNA, 406 bp, Homo sapiens
gaaacccctaagaactctgcagcaggtggtaaagggattccagcagttgaggcagccttcctaagagaaatgcaggtgcaacagaaaaacaaaagcaaacacaagccaggagaaggatgcagccaaggagaaaaggggattggaggagatttaacagagtatcaacaggatccactgcagaagaggtaacaaattaaaaaattaaaatatcatatcccaaaatggaaataaaacagatagaatgccgagtatatattaaataaggcaagctatttatgatgaggaatgtgctgagctcctgggacaatacagaagtagtaatctacaccatgcctgcatcaagaagcctaaatttgatccactgttactactcagagctgttttattaaagctcatgaacagaaaa

SEQ ID NO: 329357 - DNA, 443 bp, Homo sapiens
agctggaatcctctaaaataagtcacatgggaaaaaattctgatcttattctagacgaagaatgaaaagccaggaagctacataacccaagttctaggattttagcacatggaagaaatgtccctacccatgcatacagaaacgcataagaacaggaagtgacgtattgtttatcaggaaaaacagtattcatgtattatttacaaaaattgaggctgatctccaagctctactgtggaaagagttcatcaagttcctagactgaagaaagctaattaaaaagtcattaaaatgacaaaaatctaggacacctgtgcattttgaaatatctcattttgtatcaaatactttggcagttctggattgataaccaagtttatatttcagcaaacaggggacctcaagagcataacttaatctcagagttgttcacctccgtgcaa

SEQ ID NO: 329358 - DNA, 443 bp, Homo sapiens
aattttatctgcccactagggtggtacaaagaagagaagaccagggaagagaagctcatgaaggaaacaaacatggctgtctggtttggaaaagcacatttgatagtttatgaagtcacagaggagagtgactcttgcctcgccacccacttattcatctggaaggaggcttccatttctaggattttagcacatggaagaaatgtccctacccatgcatacagaaacgcataagaacaggaagtgacgtattgtttatcaggaaaaacagtattcatgtattatttacaaaaattgaggctgatctccaagctctactgtggaaagagttcatcaagttcctagactgaagaaagctaattgtaagaaatacatatgtagtatgcacaagtttcattataaataagagtaaaaacgtgcattgtatatgtacatccttgtga

SEQ ID NO: 329359 - DNA, 482 bp, Homo sapiens
agctggaatcctctaaaataagtcacatgggaaaaaattctgatcttattctagacgaagaatgaaaagccaggaagctacataacccaagaaacaacagtcagatgccaataaccaggaaccacctgcaggacaagctaagcccagaaatgctgccttcacctgaacttctgcctcagtgcgagacctgacctgatttcttgcctctttctcataccaacatttccatccagtggggagaaatgtaccttgctgggtgcaaaaagtgccaatgcaaaagaaaatgcaagactgcgcatacttaacccctcctggaagaacaaacttttttcaaggaatccccacccctgtctccacctacctgcccaaaagtccttaaaaatttccctttactctacttccagggagaaggtgctttgagcatgagctcccgttctccattacttgatcaatgaatggaatttctgcactgttttgccaaa

SEQ ID NO: 329360 - DNA, 409 bp, Homo sapiens
agctggaatcctctaaaataagtcacatgggaaaaaattctgatcttattctagacgaagaatgaaaagccaggaagctacataacccaaggtaacaaattaaaaaattaaaatatcatatcccaaaatggaaataaaacagatagaatgccgagtatatattaaataaggcaagctatttatgatgagctaactcacttgcaagttaccagagagcatggagtaaatcctttatttctcatgtcctcattgtgcctaagactgcgtttctgtacacacattaaaaaaacaggaaatcaatggttcccaatggtgatgtgtgaactcttcaggatctggaggaacattattaaattgctccattagctttctcttgtttgggttgaaaataaaaattgtgatgccattt

SEQ ID NO: 329361 - DNA, 318 bp, Homo sapiens
agctggaatcctctaaaataagtcacatgggaaaaaattctgatcttattctagacgaagaatgaaaagccaggaagctacataacccaagagagaagttatacatactcatgaatcaatgtgtacaatggagaattaatactgaaaacaaatgtattttattctactttttaaaaaattgttgaaatggagcccagccttcccactaccacttgttgcaactcccacacttcatatgtacaccacctctttccttgacccttgaaagacaccatgtggttttcacctgagaatgatataaatatgaacactctaata

SEQ ID NO: 329362 - DNA, 373 bp, Homo sapiens
ggtggagagcggtggactggtctgagctatcagcgatgtggcatggatagggcttttggtgctgggtagggagacagaatgagaaaagtcagagaaacattgatggccactatggctgccacagcagccccactgcctgagaactcacatgtgccaggcactctgcctaacctttccatgcatcgctccatttcatccctgcaacaatctacgacttaggttctgttattctcattttatggatgaagaaactgaggcttagaggttaagtgatttgcccaatgtcatacagcaagtgtggcagagccaagtgtcaaactgagatccagttccaggcatgctgttccaggtcactatgatgcactccccaggc

SEQ ID NO: 329363 - DNA, 359 bp, Homo sapiens
ctgcaattggagtcatctgaggagtttgaaaatataccactgcctgtgttcctcctccagggatttcctgggtctggggtgtggcatgggtttgggtatgtttaaatggtccccagataattgtaatatttagccaagttgggaatccctggtatatttcattgctttgcaaccctggctgtcatcccttggagagctttaaaaaggtcagtgtctgaccccaggccaagccaattatatcagaatctgggggggtgtggtacttgagaaccaatatttgtttaagtctgcccccaggtgatactaatatagacctaggagaaggagtgggtcctgaaacttcctaatttaaagctggg

SEQ ID NO: 329364 - DNA, 353 bp, Homo sapiens
ggggagaaagaaaggggcatggcctgtttgtatccttctcacgtggccatccaccaggtcctgggggagtgggagccagtgcaaggagggaagtccagtgagaatgacaaatggacgatgtcagacccaggggctgaggcccccacctgcagccgggcagcttctggagtggacaaggagcagcagggaaggttgcggcctggtgttctgggatccactgtctcatctcattctttggggcaccagaacttatccaaagacaagactcagtgtctctggcaacagcgggccagaggaataatgtgtttcaggaggaagaaggggttgtaccccatggaaacagtatatagttt

SEQ ID NO: 329365 - DNA, 1096 bp, Homo sapiens
gagccaagatggctgaataggaacagctccagtctgcagctcccagtgagaccaacgcagaagattcttctttggagcagaataaaagatctggcccatcagttcacacaggtccagcgggacatgttcaccctggaggacacgctgctaggctaccttgctgatgacctcacatggtgtggtgaattcaacacttccaaaataaactatcaatcttgcccagactggagaaaggactgcagcaacaaccctgtttcagtattctggaaaacggtttcccgcaggtttgcagaagctgcctgtgatgtggtccatgtgatgctcaatggatcccgcagtaaaatctttgacaaaaacagcacttttgggagtgtggaagtccataatttgcaaccagagaaggttcagacactagaggcctgggtgatacatggtggaagagaagattccagagacttatgccaggatcccaccataaaagagctggaatcgattataagcaaaaggaatattcaattttcctgcaagaatatctacagacctgacaagtttcttcagtgtgtgaaaaatcctgaggattcatcttgcacatctgagatctgagccagtcgctgtggttgttttagctccttgactccttgtggtttatgtcatcatacatgactcagcatacctgctggtgcagagctgaagattttggagggtcctccacaataaggtcaatgccagagacggaagcctttttccccaaagtcttaaaataacttatatcatcagcatacctttattgtgatctatcaatagtcaagaaaaattattgtataagattagaatgaaaattgtatgttaagttacttcactttaattctcatgtgatccttttatgttatttatatattggtaacatcctttctattgaaaaatcaccacaccaaacctctcttattagaacaggcaagtgaagaaaagtgaatgctcaagtttttcagaaagcattacatttccaaatgaatgaccttgttgcatgatgtatttttgtacccttcctacagatagtcaaaccataaacttcatggtcatgggtcaaaaaaaaaaa

SEQ ID NO: 329366 - DNA, 2009 bp, Homo sapiens
gccactttattatttattaaactcccgcatagagtgcagtattattactgtgtgccagaccctgcttcaaacacattccatggactataaaattgcatctctgagcagctcctagagctggtagtaacaacttacatttactgggtgattaccatgtgccaggtattgtgctaaacacgttgtagatattaactcacttaatcctcgtaacaatcccatgaagtaggtactgctactatcccggctttacatctgaagtacagagaggttaagtaacttgccccatgtcatccagcaagaactaaatttgaacccagagcttagccactgatgcctcttgagagaaggagtcagacttaagttgagtctttaaaggtggttgaccaggcatttgtcagagttaagaaagagaggtaggacatccttttccaggcagagggcattgtgtgcacacacgtatagaagcaggcagcccaccctcatgctttccaggaagcaaatgtggctcaggtgtaaagtgcccggttgatgaagggagttagcggagggagtataaggatgtactgtctgcccccttaggacacctgcagaggattaaggtggctgtttctccctggaggtggagtgggtgggtcactgcacaggagcctatagttgttggtcttttaaactcttattggtgtaaccagccacggaactctgaggcaaggggttgggggtgggaagggaaacagagaaaaggcaagtgaaacagaaggggaggtgcagtttcagaacccagccagcctctctcttgctgcctagcctcctgccggcctcatcttcgcccagccaaccccgcctggagccctatggccaactgcgagttcagcccggtgtccggggacaaaccctgctgccggctctctaggagagcccaactctgtcttggcgtcagtatcctggtcctgatcctcgtcgtggtgctcgcggtggtcgtcccgaggtggcgccagcagtggagcggtccgggcaccaccaagcgctttcccgagaccgtcctggcgcgatgcgtcaagtacactgaaattcatcctgagatgagacatgtagactgccaaagtgtatgggatgctttcaagggtgcatttatttcaaaacatccttgcaacattactgaagaagactatcagccactaatgaagttgggaactcagaccgtaccttgcaacaagattcttctttggagcagaataaaagatctggcccatcagttcacacaggtccagcgggacatgttcaccctggaggacacgctgctaggctaccttgctgatgacctcacatggtgtggtgaattcaacacttccaaaataaactatcaatcttgcccagactggagaaaggactgcagcaacaaccctgtttcagtattctggaaaacggtttcccgcaggtttgcagaagctgcctgtgatgtggtccatgtgatgctcaatggatcccgcagtaaaatctttgacaaaaacagcacttttgggagtgtggaagtccataatttgcaaccagagaaggttcagacactagaggcctgggtgatacatggtggaagagaagattccagagacttatgccaggatcccaccataaaagagctggaatcgattataagcaaaaggaatattcaattttcctgcaagaatatctacagacctgacaagtttcttcagtgtgtgaaaaatcctgaggattcatcttgcacatctgagatctgagccagtcgctgtggttgttttagctccttgactccttgtggtttatgtcatcatacatgactcagcatacctgctggtgcagagctgaagattttggagggtcctccacaataaggtcaatgccagagacggaagcctttttccccaaagtcttaaaataacttatatcatcagcatacctttattgtgatctatcaatagtcaagaaaaattattgtataagattagaatgaaaattgtatgttaagttacttc

SEQ ID NO: 329367 - DNA, 1873 bp, Homo sapiens
gccactttattatttattaaactcccgcatagagtgcagtattattactgtgtgccagaccctgcttcaaacacattccatggactataaaattgcatctctgagcagctcctagagctggtagtaacaacttacatttactgggtgattaccatgtgccaggtattgtgctaaacacgttgtagatattaactcacttaatcctcgtaacaatcccatgaagtaggtactgctactatcccggctttacatctgaagtacagagaggttaagtaacttgccccatgtcatccagcaagaactaaatttgaacccagagcttagccactgatgcctcttgagagaaggagtcagacttaagttgagtctttaaaggtggttgaccaggcatttgtcagagttaagaaagagaggtaggacatccttttccaggcagagggcattgtgtgcacacacgtatagaagcaggcagcccaccctcatgctttccaggaagcaaatgtggctcaggtgtaaagtgcccggttgatgaagggagttagcggagggagtataaggatgtactgtctgcccccttaggacacctgcagaggattaaggtggctgtttctccctggaggtggagtgggtgggtcactgcacaggagcctatagttgttggtcttttaaactcttattggtgtaaccagccacggaactctgaggcaaggggttgggggtgggaagggaaacagagaaaaggcaagtgaaacagaaggggaggtgcagtttcagaacccagccagcctctctcttgctgcctagcctcctgccggcctcatcttcgcccagccaaccccgcctggagccctatggccaactgcgagttcagcccggtgtccggggacaaaccctgctgccggctctctaggagagcccaactctgtcttggcgtcagtatcctggtcctgatcctcgtcgtggtgctcgcggtggtcgtcccgaggtggcgccagcagtggagcggtccgggcaccaccaagcgctttcccgagaccgtcctggcgcgatgcgtcaagtacactgaaattcatcctgagatgagacatgtagactgccaaagtgtatgggatgctttcaagggtgcatttatttcaaaacatccttgcaacattactgaagaagactatcagccactaatgaagttgggaactcagaccgtaccttgcaacaagaaataaactatcaatcttgcccagactggagaaaggactgcagcaacaaccctgtttcagtattctggaaaacggtttcccgcaggtttgcagaagctgcctgtgatgtggtccatgtgatgctcaatggatcccgcagtaaaatctttgacaaaaacagcacttttgggagtgtggaagtccataatttgcaaccagagaaggttcagacactagaggcctgggtgatacatggtggaagagaagattccagagacttatgccaggatcccaccataaaagagctggaatcgattataagcaaaaggaatattcaattttcctgcaagaatatctacagacctgacaagtttcttcagtgtgtgaaaaatcctgaggattcatcttgcacatctgagatctgagccagtcgctgtggttgttttagctccttgactccttgtggtttatgtcatcatacatgactcagcatacctgctggtgcagagctgaagattttggagggtcctccacaataaggtcaatgccagagacggaagcctttttccccaaagtcttaaaataacttatatcatcagcatacctttattgtgatctatcaatagtcaagaaaaattattgtataagattagaatgaaaattgtatgttaagttacttc

SEQ ID NO: 329368 - DNA, 1489 bp, Homo sapiens
  misc_feature (1257)..(1257): n is a, c, g, or t
gccactttattatttattaaactcccgcatagagtgcagtattattactgtgtgccagaccctgcttcaaacacattccatggactataaaattgcatctctgagcagctcctagagctggtagtaacaacttacatttactgggtgattaccatgtgccaggtattgtgctaaacacgttgtagatattaactcacttaatcctcgtaacaatcccatgaagtaggtactgctactatcccggctttacatctgaagtacagagaggttaagtaacttgccccatgtcatccagcaagaactaaatttgaacccagagcttagccactgatgcctcttgagagaaggagtcagacttaagttgagtctttaaaggtggttgaccaggcatttgtcagagttaagaaagagaggtaggacatccttttccaggcagagggcattgtgtgcacacacgtatagaagcaggcagcccaccctcatgctttccaggaagcaaatgtggctcaggtgtaaagtgcccggttgatgaagggagttagcggagggagtataaggatgtactgtctgcccccttaggacacctgcagaggattaaggtggctgtttctccctggaggtggagtgggtgggtcactgcacaggagcctatagttgttggtcttttaaactcttattggtgtaaccagccacggaactctgaggcaaggggttgggggtgggaagggaaacagagaaaaggcaagtgaaacagaaggggaggtgcagtttcagaacccagccagcctctctcttgctgcctagcctcctgccggcctcatcttcgcccagccaaccccgcctggagccctatggccaactgcgagttcagcccggtgtccggggacaaaccctgctgccggctctctaggagagcccaactctgtcttggcgtcagtatcctggtcctgatcctcgtcgtggtgctcgcggtggtcgtcccgaggtggcgccagcagtggagcggtccgggcaccaccaagcgctttcccgagaccgtcctggcgcgatgcgtcaagtacactgaaattcatcctgagatgaggtgggttggcgactaaggcgcaccggtgggcactgcggggacagcagggccccgcgcgcagggaagccgcccggatcgcccggaaccgggcatcttccgtggcgggtcagccgagagcccgccgggtggtgctgagtagggagtcccgggctcggggctccgcgggccgcttncaggagcagctggccttggcaccgagcgtgcccgcgggaggcgggggggggcgctgctcggtggctctgctgcgtagccggtgaacacttggcaccgatgcccgccttctgggcaaggtgccctgagcccagcccctcgccgggctgcagcccaccctcggcgcgctcagcccgcttcaccgcttcagggacggaatagaactcgcagatgcagggtgtcgctgacattttc

SEQ ID NO: 329369 - DNA, 1713 bp, Homo sapiens
gccactttattatttattaaactcccgcatagagtgcagtattattactgtgtgccagaccctgcttcaaacacattccatggactataaaattgcatctctgagcagctcctagagctggtagtaacaacttacatttactgggtgattaccatgtgccaggtattgtgctaaacacgttgtagatattaactcacttaatcctcgtaacaatcccatgaagtaggtactgctactatcccggctttacatctgaagtacagagaggttaagtaacttgccccatgtcatccagcaagaactaaatttgaacccagagcttagccactgatgcctcttgagagaaggagtcagacttaagttgagtctttaaaggtggttgaccaggcatttgtcagagttaagaaagagaggtaggacatccttttccaggcagagggcattgtgtgcacacacgtatagaagcaggcagcccaccctcatgctttccaggaagcaaatgtggctcaggtgtaaagtgcccggttgatgaagggagttagcggagggagtataaggatgtactgtctgcccccttaggacacctgcagaggattaaggtggctgtttctccctggaggtggagtgggtgggtcactgcacaggagcctatagttgttggtcttttaaactcttattggtgtaaccagccacggaactctgaggcaaggggttgggggtgggaagggaaacagagaaaaggcaagtgaaacagaaggggaggtgcagtttcagaacccagccagcctctctcttgctgcctagcctcctgccggcctcatcttcgcccagccaaccccgcctggagccctatggccaactgcgagttcagcccggtgtccggggacaaaccctgctgccggctctctaggagagcccaactctgtcttggcgtcagtatcctggtcctgatcctcgtcgtggtgctcgcggtggtcgtcccgaggtggcgccagcagtggagcggtccgggcaccaccaagcgctttcccgagaccgtcctggcgcgatgcgtcaagtacactgaaattcatcctgagatgagacatgtagactgccaaagtgtatgggatgctttcaagggtgcatttatttcaaaacatccttgcaacattactgaagaagactatcagccactaatgaagttgggaactcagaccgtaccttgcaacaagattcttctttggagcagaataaaagatctggcccatcagttcacacaggtccagcgggacatgttcaccctggaggacacgctgctaggctaccttgctgatgacctcacatggtgtggtgaattcaacacttccaaaataaactatcaatcttgcccagactggagaaaggactgcagcaacaaccctgtttcagtattctggaaaacggtttcccgcaggtttgcagaagctgcctgtgatgtggtccatgtgatgctcaatggatcccgcagtaaaatctttgacaaaaacagcacttttgggagtgtggaagtccataatttgcaaccagagaaggttcagacactagaggcctgggtgatacatggtggaagagaagattccagagacttatgccaggatcccaccataaaagagctggaatcgattataagcaaaaggaatattcaattttcctgcaagaatatctacaggtaattaatttcttcttgaagaa

SEQ ID NO: 329370 - DNA, 2247 bp, Homo sapiens
gccactttattatttattaaactcccgcatagagtgcagtattattactgtgtgccagaccctgcttcaaacacattccatggactataaaattgcatctctgagcagctcctagagctggtagtaacaacttacatttactgggtgattaccatgtgccaggtattgtgctaaacacgttgtagatattaactcacttaatcctcgtaacaatcccatgaagtaggtactgctactatcccggctttacatctgaagtacagagaggttaagtaacttgccccatgtcatccagcaagaactaaatttgaacccagagcttagccactgatgcctcttgagagaaggagtcagacttaagttgagtctttaaaggtggttgaccaggcatttgtcagagttaagaaagagaggtaggacatccttttccaggcagagggcattgtgtgcacacacgtatagaagcaggcagcccaccctcatgctttccaggaagcaaatgtggctcaggtgtaaagtgcccggttgatgaagggagttagcggagggagtataaggatgtactgtctgcccccttaggacacctgcagaggattaaggtggctgtttctccctggaggtggagtgggtgggtcactgcacaggagcctatagttgttggtcttttaaactcttattggtgtaaccagccacggaactctgaggcaaggggttgggggtgggaagggaaacagagaaaaggcaagtgaaacagaaggggaggtgcagtttcagaacccagccagcctctctcttgctgcctagcctcctgccggcctcatcttcgcccagccaaccccgcctggagccctatggccaactgcgagttcagcccggtgtccggggacaaaccctgctgccggctctctaggagagcccaactctgtcttggcgtcagtatcctggtcctgatcctcgtcgtggtgctcgcggtggtcgtcccgaggtggcgccagcagtggagcggtccgggcaccaccaagcgctttcccgagaccgtcctggcgcgatgcgtcaagtacactgaaattcatcctgagatgagacatgtagactgccaaagtgtatgggatgctttcaagggtgcatttatttcaaaacatccttgcaacattactgaagaagactatcagccactaatgaagttgggaactcagaccgtaccttgcaacaagattcttctttggagcagaataaaagatctggcccatcagttcacacaggtccagcgggacatgttcaccctggaggacacgctgctaggctaccttgctgatgacctcacatggtgtggtgaattcaacacttccaaaataaactatcaatcttgcccagactggagaaaggactgcagcaacaaccctgtttcagtattctggaaaacggtttcccgcaggtttgcagaagctgcctgtgatgtggtccatgtgatgctcaatggatcccgcagtaaaatctttgacaaaaacagcacttttgggagtgtggaagtccataatttgcaaccagagaaggttcagacactagaggcctgggtgatacatggtggaagagaagattccagagacttatgccaggatcccaccataaaagagctggaatcgattataagcaaaaggaatattcaattttcctgcaagaatatctacagacctgacaagtttcttcagtgtgtgaaaaatcctgaggattcatcttgcacatctgagatctgagccagtcgctgtggttgttttagctccttgactccttgtggtttatgtcatcatacatgactcagcatacctgctggtgcagagctgaagattttggagggtcctccacaataaggtcaatgccagagacggaagcctttttccccaaagtcttaaaataacttatatcatcagcatacctttattgtgatctatcaatagtcaagaaaaattattgtataagattagaatgaaaattgtatgttaagttacttcactttaattctcatgtgatccttttatgttatttatatattggtaacatcctttctattgaaaaatcaccacaccaaacctctcttattagaacaggcaagtgaagaaaagtgaatgctcaagtttttcagaaagcattacatttccaaatgaatgaccttgttgcatgatgtatttttgtacccttcctacagatagtcaaaccataaacttcatggtcatgggtcaaaaaaaaaaa

SEQ ID NO: 329371 - DNA, 2229 bp, Homo sapiens
gccactttattatttattaaactcccgcatagagtgcagtattattactgtgtgccagaccctgcttcaaacacattccatggactataaaattgcatctctgagcagctcctagagctggtagtaacaacttacatttactgggtgattaccatgtgccaggtattgtgctaaacacgttgtagatattaactcacttaatcctcgtaacaatcccatgaagtaggtactgctactatcccggctttacatctgaagtacagagaggttaagtaacttgccccatgtcatccagcaagaactaaatttgaacccagagcttagccactgatgcctcttgagagaaggagtcagacttaagttgagtctttaaaggtggttgaccaggcatttgtcagagttaagaaagagaggtaggacatccttttccaggcagagggcattgtgtgcacacacgtatagaagcaggcagcccaccctcatgctttccaggaagcaaatgtggctcaggtgtaaagtgcccggttgatgaagggagttagcggagggagtataaggatgtactgtctgcccccttaggacacctgcagaggattaaggtggctgtttctccctggaggtggagtgggtgggtcactgcacaggagcctatagttgttggtcttttaaactcttattggtgtaaccagccacggaactctgaggcaaggggttgggggtgggaagggaaacagagaaaaggcaagtgaaacagaaggggaggtgcagtttcagaacccagccagcctctctcttgctgcctagcctcctgccggcctcatcttcgcccagccaaccccgcctggagccctatggccaactgcgagttcagcccggtgtccggggacaaaccctgctgccggctctctaggagagcccaactctgtcttggcgtcagtatcctggtcctgatcctcgtcgtggtgctcgcggtggtcgtcccgaggtggcgccagcagtggagcggtccgggcaccaccaagcgctttcccgagaccgtcctggcgcgatgcgtcaagtacactgaaattcatcctgagatgagacatgtagactgccaaagtgtatgggatgctttcaagggtgcatttatttcaaaacatccttgcaacattactgaagaagactatcagccactaatgaagttgggaactcagaccgtaccttgcaacaagattcttctttggagcagaataaaagatctggcccatcagttcacacaggtccagcgggacatgttcaccctggaggacacgctgctaggctaccttgctgatgacctcacatggtgtgaaataaactatcaatcttgcccagactggagaaaggactgcagcaacaaccctgtttcagtattctggaaaacggtttcccgcaggtttgcagaagctgcctgtgatgtggtccatgtgatgctcaatggatcccgcagtaaaatctttgacaaaaacagcacttttgggagtgtggaagtccataatttgcaaccagagaaggttcagacactagaggcctgggtgatacatggtggaagagaagattccagagacttatgccaggatcccaccataaaagagctggaatcgattataagcaaaaggaatattcaattttcctgcaagaatatctacagacctgacaagtttcttcagtgtgtgaaaaatcctgaggattcatcttgcacatctgagatctgagccagtcgctgtggttgttttagctccttgactccttgtggtttatgtcatcatacatgactcagcatacctgctggtgcagagctgaagattttggagggtcctccacaataaggtcaatgccagagacggaagcctttttccccaaagtcttaaaataacttatatcatcagcatacctttattgtgatctatcaatagtcaagaaaaattattgtataagattagaatgaaaattgtatgttaagttacttcactttaattctcatgtgatccttttatgttatttatatattggtaacatcctttctattgaaaaatcaccacaccaaacctctcttattagaacaggcaagtgaagaaaagtgaatgctcaagtttttcagaaagcattacatttccaaatgaatgaccttgttgcatgatgtatttttgtacccttcctacagatagtcaaaccataaacttcatggtcatgggtcaaaaaaaaaaa

SEQ ID NO: 329372 - DNA, 697 bp, Homo sapiens
  misc_feature (18)..(18): n is a, c, g, or t
  misc_feature (22)..(22): n is a, c, g, or t
agagacgcggtgcactcngtcnagggatgtcgcgggatctctatgaagcaccagaattatcagtgaagaatatattaaatggctcacgggctactgtaaagcatatttctatcgcttgagagtaaaactgctagaaccagttcctgtttctacaacaaggtgttcctttagagtcaatgagaacacacaaaacctacaaattcatgcaggggacatcctgaagttcttgaaaaagaagaaacctgaagatgccttctgtgttgtgggaataacaatgattgatctttacccaagagacttgtggaattttgtctttggacaggcctctttgacagatggcactggtgaggtggattgatgatgaatcttctggcacacctggagcaactccagaacacagtcgtgaggataatgggaatttactgaaacccgtggaaggaagcctttaaggaatggaaagagtggataataaaatgcctgactgttctccaaaaataaggaccttcaaataggagtgattgaaataaatgactacttgcatgttatgctttcatttgggtggaatacttcatcagaataaactattgatcttgtgctgtgtcaaagtaacagactagaaccttctttcaagtacctgaattgaaatgaaactcattttgaataataaaaactctagaaactctttaaaaactcaaaa

SEQ ID NO: 329373 - DNA, 485 bp, Homo sapiens
acacccagctattttattttattttttttgtcgagatgggatctccctgtgttgctcaagctcatcttgaattcctgggctcaagcgagcctcccacctcagcctcccaaagtgctttgataaaaggcactggtgaggtggattgatgatgaatcttctggcacacctggagcaactccagaacacagtcgtgaggataatgggaatttactgaaacccgtggaaggaagcctttaaggaatggaaagagtggataataaaatgcctgactgttctccaaaaataaggaccttcaaataggagtgattgaaataaatgactacttgcatgttatgctttcatttgggtggaatacttcatcagaataaactattgatcttgtgctgtgtcaaagtaacagactagaaccttctttcaagtacctgaattgaaatgaaactcattttgaataataaaaactctagaaactctttaaaaactcaaaa

SEQ ID NO: 329374 - DNA, 1091 bp, Homo sapiens
caggggcgtggcgcgggcgggtcgtgagtggggcggggcccagagagcgtgtgcgatggagcggcgcgtcgcgcggcgcgaaggggcgtggcgccagtgggcgtggcgtagtgcgaagagacgcggtgcgcacgcgcgtgagggatgtcgcggatgcaaatagtacggtattccgaacagacactaaaaatagctgtcatctcaaagaatccagtgcttgtgtcacagtatgagaaagtagatgctggggaacagcgtttaatgaatgaagcattccagccagccagtgatctctttggaccttgcattctccatcagattggatcacctcccaccctgaggccccccaagactttgaacagttcttcagtcatccttacagaaagataccctctccagacaaacgcagtatttatatacggtccattggatctctatgaagcaccagaattatcagtgaagaatatattaaatggctcacgggctactgtaaagcatatttctatcgcttgagagtaaaactgctagaaccagttcctgtttctacaacaaggtgttcctttagagtcaatgagaacacacaaaacctacaaattcatgcaggggacatcctgaagttcttgaaaaagaagaaacctgaagatgccttctgtgttgtgggaataacaatgattgatctttacccaagagacttgtggaattttgtctttggacaggcctctttgacagatggcactggtgaggtggattgatgatgaatcttctggcacacctggagcaactccagaacacagtcgtgaggataatgggaatttactgaaacccgtggaaggaagcctttaaggaatggaaagagtggataataaaatgcctgactgttctccaaaaataaggaccttcaaataggagtgattgaaataaatgactacttgcatgttatgctttcatttgggtggaatacttcatcagaataaactattgatcttgtgctgtgtcaaagtaacagactagaaccttctttcaagtacctgaattgaaatgaaactcattttgaataataaaaactctagaaactctttaaaaactcaaaa

SEQ ID NO: 329375 - DNA, 2022 bp, Homo sapiens
ggtggagagggatgaggatgtggagggacggacgtggcggaagccgcggggacttgcgatggggcgtaggatgtcgcgggtgagtggtgtcgaggcctgttgggtcagggcggttcgcaggtgctgtcagagctgggcggggcagccgggtcgtagaggcgggcgccagtcgcggtcggtggagagggatgaggatgtaggagggacggacgtggcggaagccgcggggactgcgggggcggagtgcctctggggagccaggaggcctttccagaggctcctgggggaagaagaggcgaagcgagagtccccggggaagccctactccacccccagccggagcctgggttgtgcctgcacggaccagagcccacagtgcgagttgctgtaggcaaccagctagggtggccaacttctcccggttggcccgagatgttctggttttgggaccacagcgtcccaggcctccagcccaccacagtgaccatattgtgcgccccctgcccatcttctcccgcagcttccctagattaggcttgggaggcaaggggaggcctcctgacttttctcactgccttcgttaatataaagatgaaggcacactccacaacttccttctggccaggcccagacatgtctgtccttgtgagataaaagcttccatgggagccttccttcctaatcaaggtaggtagaccactggaaggtacatctggttttatattttgtcctgtagaagtcagatttcagcccagttgtgtaggagtgaggatgagcttatgctcttatcagagctttgagtacagagacatttgatctgggaatttcagccagcctcttcaaccccagaattcagaggttcaatcagaacagacattagcttaagttttcccatcagttgtctatcattaaactggcaaaatctagataattagaaaatatgacagagatgatccagacagagatgttcaggtttttccttgtgtaattcaaaaagtctcgtggtggaacatctgacccttttcaagaggaaggatgaaaactctacataggaacacgatgtgaatggaagaaacctgtcattatgcaaatagtacggtattccgaacagacactaaaaatagctgtcatctcaaagaatccagtgcttgtgtcacagtatgagaaagtagatgctggggaacagcgtttaatgaatgaagcattccagccagccagtgatctctttggaccttgcattctccatcagattggatcacctcccaccctgaggccccccaagactttgaacagttcttcagtcatccttacagaaagataccctctccagacaaacgcagtatttatatacggtccattggatctctatgaagcaccagaattatcagtgaagaatatattaaatggctcacgggctactgtaaagcatatttctatcgcttgagagtaaaactgctagaaccagttcctgtttctacaacaaggtgttcctttagagtcaatgagaacacacaaaacctacaaattcatgcaggggacatcctgaagttcttgaaaaagaagaaacctgaagatgccttctgtgttgtgggaataacaatgattgatctttacccaagagacttgtggaattttgtctttggacaggcctctttgacagatggcactggtgaggtggattgatgatgaatcttctggcacacctggagcaactccagaacacagtcgtgaggataatgggaatttactgaaacccgtggaaggaagcctttaaggaatggaaagagtggataataaaatgcctgactgttctccaaaaataaggaccttcaaataggagtgattgaaataaatgactacttgcatgttatgctttcatttgggtggaatacttcatcagaataaactattgatcttgtgctgtgtcaaagtaacagactagaaccttctttcaagtacctgaattgaaatgaaactcattttgaataataaaaactctagaaactctttaaaaactcaaaa

SEQ ID NO: 329376 - DNA, 1797 bp, Homo sapiens
caggggcgtggcgcgggcgggtcgtgagtggggcggggcccagagagcgtgtgcgatggagcggcgcgtcgcgcggcgcgaaggggcgtggcgccagtgggcgtggcgtagtgcgaagagacgcggtgcgcacgcgcgtgagggatgtcgcggggatgtcgcgggtgagtggtgtcgaggcctgttgggtcagggcggttcgcaggtgctgtcagagctgggcggggcagccgggtcgtagaggcgggcgccagtcgcggtcggtggagagggatgaggatgtaggagggacggacgtggcggaagccgcggggactgcgggggcggagtgcctctggggagccaggaggcctttccagaggctcctgggggaagaagaggcgaagcgagagtccccggggaagccctactccacccccagccggagcctgggttgtgcctgcacggaccagagcccacagtgcgagttgctgtaggcaaccagctagggtggccaacttctcccggttggcccgagatgttctggttttgggaccacagcgtcccaggcctccagcccaccacagtgaccatattgtgcgccccctgcccatcttctcccgcagcttccctagattaggcttgggaggcaaggggaggcctcctgacttttctcactgccttcgttaatataaagatgaaggcacactccacaacttccttctggccaggcccagacatgtctgtccttgtgagataaaagcttccatgggagccttccttcctaatcaagtctcgtggtggaacatctgacccttttcaagaggaaggatgaaaactctacataggaacacgatgtgaatggaagaaacctgtcattatgcaaatagtacggtattccgaacagacactaaaaatagctgtcatctcaaagaatccagtgcttgtgtcacagtatgagaaagtagatgctggggaacagcgtttaatgaatgaagcattccagccagccagtgatctctttggaccttgcattctccatcagattggatcacctcccaccctgaggccccccaagactttgaacagttcttcagtcatccttacagaaagataccctctccagacaaacgcagtatttatatacggtccattggatctctatgaagcaccagaattatcagtgaagaatatattaaatggctcacgggctactgtaaagcatatttctatcgcttgagagtaaaactgctagaaccagttcctgtttctacaacaaggtgttcctttagagtcaatgagaacacacaaaacctacaaattcatgcaggggacatcctgaagttcttgaaaaagaagaaacctgaagatgccttctgtgttgtgggaataacaatgattgatctttacccaagagacttgtggaattttgtctttggacaggcctctttgacagatggcactggtgaggtggattgatgatgaatcttctggcacacctggagcaactccagaacacagtcgtgaggataatgggaatttactgaaacccgtggaaggaagcctttaaggaatggaaagagtggataataaaatgcctgactgttctccaaaaataaggaccttcaaataggagtgattgaaataaatgactacttgcatgttatgctttcatttgggtggaatacttcatcagaataaactattgatcttgtgctgtgtcaaagtaacagactagaaccttctttcaagtacctgaattgaaatgaaactcattttgaataataaaaactctagaaactctttaaaaactcaaaa

SEQ ID NO: 329377 - DNA, 1945 bp, Homo sapiens
caggggcgtggcgcgggcgggtcgtgagtggggcggggcccagagagcgtgtgcgatggagcggcgcgtcgcgcggcgcgaaggggcgtggcgccagtgggcgtggcgtagtgcgaagagacgcggtgcgcacgcgcgtgagggatgtcgcggggatgtcgcgggtgagtggtgtcgaggcctgttgggtcagggcggttcgcaggtgctgtcagagctgggcggggcagccgggtcgtagaggcgggcgccagtcgcggtcggtggagagggatgaggatgtaggagggacggacgtggcggaagccgcggggactgcgggggcggagtgcctctggggagccaggaggcctttccagaggctcctgggggaagaagaggcgaagcgagagtccccggggaagccctactccacccccagccggagcctgggttgtgcctgcacggaccagagcccacagtgcgagttgctgtaggcaaccagctagggtggccaacttctcccggttggcccgagatgttctggttttgggaccacagcgtcccaggcctccagcccaccacagtgaccatattgtgcgccccctgcccatcttctcccgcagcttccctagattaggcttgggaggcaaggggaggcctcctgacttttctcactgccttcgttaatataaagatgaaggcacactccacaacttccttctggccaggcccagacatgtctgtccttgtgagataaaagcttccatgggagccttccttcctaatcaaggtaggtagaccactggaaggtacatctggttttatattttgtcctgtagaagtcagatttcagcccagttgtgtaggagtgaggatgagcttatgctcttatcagagctttgagtacagagacatttgatctgggaatttcagccagcctcttcaaccccagaattcagaggttcaatcagaacagacattagcttaagttttcccatcagttgtctatcattaaactggcaaaatctagataattagaaaatatgacagagatgatccagacagagatgttcaggtttttccttgtgtaattcaaaaagtctcgtggtggaacatctgacccttttcaagaggaaggatgaaaactctacataggaacacgatgtgaatggaagaaacctgtcattgtccccaagaaattgattggacatgaggaaaccactctaagtgtgaccactctaaagcattagcagtcagtcatttcactctagggagaaatcagagctgtatatggagaataggatctctatgaagcaccagaattatcagtgaagaatatattaaatggctcacgggctactgtaaagcatatttctatcgcttgagagtaaaactgctagaaccagttcctgtttctacaacaaggtgttcctttagagtcaatgagaacacacaaaacctacaaattcatgcaggggacatcctgaagttcttgaaaaagaagaaacctgaagatgccttctgtgttgtgggaataacaatgattgatctttacccaagagacttgtggaattttgtctttggacaggcctctttgacagatggcactggtgaggtggattgatgatgaatcttctggcacacctggagcaactccagaacacagtcgtgaggataatgggaatttactgaaacccgtggaaggaagcctttaaggaatggaaagagtggataataaaatgcctgactgttctccaaaaataaggaccttcaaataggagtgattgaaataaatgactacttgcatgttatgctttcatttgggtggaatacttcatcagaataaactattgatcttgtgctgtgtcaaagtaacagactagaaccttctttcaagtacctgaattgaaatgaaactcattttgaataataaaaactctagaaactctttaaaaactcaaaa

SEQ ID NO: 329378 - DNA, 1710 bp, Homo sapiens
caggggcgtggcgcgggcgggtcgtgagtggggcggggcccagagagcgtgtgcgatggagcggcgcgtcgcgcggcgcgaaggggcgtggcgccagtgggcgtggcgtagtgcgaagagacgcggtgcgcacgcgcgtgagggatgtcgcggggatgtcgcgggtgagtggtgtcgaggcctgttgggtcagggcggttcgcaggtgctgtcagagctgggcggggcagccgggtcgtagaggcgggcgccagtcgcggtcggtggagagggatgaggatgtaggagggacggacgtggcggaagccgcggggactgcgggggcggagtgcctctggggagccaggaggcctttccagaggctcctgggggaagaagaggcgaagcgagagtccccggggaagccctactccacccccagccggagcctgggttgtgcctgcacggaccagagcccacagtgcgagttgctgtaggcaaccagctagggtggccaacttctcccggttggcccgagatgttctggttttgggaccacagcgtcccaggcctccagcccaccacagtgaccatattgtgcgccccctgcccatcttctcccgcagcttccctagattaggcttgggaggcaaggggaggcctcctgacttttctcactgccttcgttaatataaagatgaaggcacactccacaacttccttctggccaggcccagacatgtctgtccttgtgagataaaagcttccatgggagccttccttcctaatcaagatgcaaatagtacggtattccgaacagacactaaaaatagctgtcatctcaaagaatccagtgcttgtgtcacagtatgagaaagtagatgctggggaacagcgtttaatgaatgaagcattccagccagccagtgatctctttggaccttgcattctccatcagattggatcacctcccaccctgaggccccccaagactttgaacagttcttcagtcatccttacagaaagataccctctccagacaaacgcagtatttatatacggtccattggatctctatgaagcaccagaattatcagtgaagaatatattaaatggctcacgggctactgtaaagcatatttctatcgcttgagagtaaaactgctagaaccagttcctgtttctacaacaaggtgttcctttagagtcaatgagaacacacaaaacctacaaattcatgcaggggacatcctgaagttcttgaaaaagaagaaacctgaagatgccttctgtgttgtgggaataacaatgattgatctttacccaagagacttgtggaattttgtctttggacaggcctctttgacagatggcactggtgaggtggattgatgatgaatcttctggcacacctggagcaactccagaacacagtcgtgaggataatgggaatttactgaaacccgtggaaggaagcctttaaggaatggaaagagtggataataaaatgcctgactgttctccaaaaataaggaccttcaaataggagtgattgaaataaatgactacttgcatgttatgctttcatttgggtggaatacttcatcagaataaactattgatcttgtgctgtgtcaaagtaacagactagaaccttctttcaagtacctgaattgaaatgaaactcattttgaataataaaaactctagaaactctttaaaaactcaaaa

SEQ ID NO: 329379 - DNA, 1632 bp, Homo sapiens
caggggcgtggcgcgggcgggtcgtgagtggggcggggcccagagagcgtgtgcgatggagcggcgcgtcgcgcggcgcgaaggggcgtggcgccagtgggcgtggcgtagtgcgaagagacgcggtgcgcacgcgcgtgagggatgtcgcggggatgtcgcgggtgagtggtgtcgaggcctgttgggtcagggcggttcgcaggtgctgtcagagctgggcggggcagccgggtcgtagaggcgggcgccagtcgcggtcggtggagagggatgaggatgtaggagggacggacgtggcggaagccgcggggactgcgggggcggagtgcctctggggagccaggaggcctttccagaggctcctgggggaagaagaggcgaagcgagagtccccggggaagccctactccacccccagccggagcctgggttgtgcctgcacggaccagagcccacagtgcgagttgctgtaggcaaccagctagggtggccaacttctcccggttggcccgagatgttctggttttgggaccacagcgtcccaggcctccagcccaccacagtgaccatattgtgcgccccctgcccatcttctcccgcagcttccctagattaggcttgggaggcaaggggaggcctcctgacttttctcactgccttcgttaatataaagatgaaggcacactccacaacttccttctggccaggcccagacatgtctgtccttgtgagataaaagcttccatgggagccttccttcctaatcaagtctcgtggtggaacatctgacccttttcaagaggaaggatgaaaactctacataggaacacgatgtgaatggaagaaacctgtcattattggatcacctcccaccctgaggccccccaagactttgaacagttcttcagtcatccttacagaaagataccctctccagacaaacgcagtatttatatacggtccattggatctctatgaagcaccagaattatcagtgaagaatatattaaatggctcacgggctactgtaaagcatatttctatcgcttgagagtaaaactgctagaaccagttcctgtttctacaacaaggtgttcctttagagtcaatgagaacacacaaaacctacaaattcatgcaggggacatcctgaagttcttgaaaaagaagaaacctgaagatgccttctgtgttgtgggaataacaatgattgatctttacccaagagacttgtggaattttgtctttggacaggcctctttgacagatggcactggtgaggtggattgatgatgaatcttctggcacacctggagcaactccagaacacagtcgtgaggataatgggaatttactgaaacccgtggaaggaagcctttaaggaatggaaagagtggataataaaatgcctgactgttctccaaaaataaggaccttcaaataggagtgattgaaataaatgactacttgcatgttatgctttcatttgggtggaatacttcatcagaataaactattgatcttgtgctgtgtcaaagtaacagactagaaccttctttcaagtacctgaattgaaatgaaactcattttgaataataaaaactctagaaactctttaaaaactcaaaa

SEQ ID NO: 329380 - DNA, 1545 bp, Homo sapiens
caggggcgtggcgcgggcgggtcgtgagtggggcggggcccagagagcgtgtgcgatggagcggcgcgtcgcgcggcgcgaaggggcgtggcgccagtgggcgtggcgtagtgcgaagagacgcggtgcgcacgcgcgtgagggatgtcgcggggatgtcgcgggtgagtggtgtcgaggcctgttgggtcagggcggttcgcaggtgctgtcagagctgggcggggcagccgggtcgtagaggcgggcgccagtcgcggtcggtggagagggatgaggatgtaggagggacggacgtggcggaagccgcggggactgcgggggcggagtgcctctggggagccaggaggcctttccagaggctcctgggggaagaagaggcgaagcgagagtccccggggaagccctactccacccccagccggagcctgggttgtgcctgcacggaccagagcccacagtgcgagttgctgtaggcaaccagctagggtggccaacttctcccggttggcccgagatgttctggttttgggaccacagcgtcccaggcctccagcccaccacagtgaccatattgtgcgccccctgcccatcttctcccgcagcttccctagattaggcttgggaggcaaggggaggcctcctgacttttctcactgccttcgttaatataaagatgaaggcacactccacaacttccttctggccaggcccagacatgtctgtccttgtgagataaaagcttccatgggagccttccttcctaatcaagattggatcacctcccaccctgaggccccccaagactttgaacagttcttcagtcatccttacagaaagataccctctccagacaaacgcagtatttatatacggtccattggatctctatgaagcaccagaattatcagtgaagaatatattaaatggctcacgggctactgtaaagcatatttctatcgcttgagagtaaaactgctagaaccagttcctgtttctacaacaaggtgttcctttagagtcaatgagaacacacaaaacctacaaattcatgcaggggacatcctgaagttcttgaaaaagaagaaacctgaagatgccttctgtgttgtgggaataacaatgattgatctttacccaagagacttgtggaattttgtctttggacaggcctctttgacagatggcactggtgaggtggattgatgatgaatcttctggcacacctggagcaactccagaacacagtcgtgaggataatgggaatttactgaaacccgtggaaggaagcctttaaggaatggaaagagtggataataaaatgcctgactgttctccaaaaataaggaccttcaaataggagtgattgaaataaatgactacttgcatgttatgctttcatttgggtggaatacttcatcagaataaactattgatcttgtgctgtgtcaaagtaacagactagaaccttctttcaagtacctgaattgaaatgaaactcattttgaataataaaaactctagaaactctttaaaaactcaaaa

SEQ ID NO: 329381 - DNA, 746 bp, Homo sapiens
agttcctgtttctacaacaaggtgttcctttagagtcaatgagaacacacaaaacctacaaattcatgcaggggacatcctgaagatctctatgaagcaccagaattatcagtgaagaatatattaaatggctcacgggctactgtaaagcatatttctatcgcttgagagtaaaactgctagaaccagttcctgtttctacaacaaggtgttcctttagagtcaatgagaacacacaaaacctacaaattcatgcaggggacatcctgaagttcttgaaaaagaagaaacctgaagatgccttctgtgttgtgggaataacaatgattgatctttacccaagagacttgtggaattttgtctttggacaggcctctttgacagatggcactggtgaggtggattgatgatgaatcttctggcacacctggagcaactccagaacacagtcgtgaggataatgggaatttactgaaacccgtggaaggaagcctttaaggaatggaaagagtggataataaaatgcctgactgttctccaaaaataaggaccttcaaataggagtgattgaaataaatgactacttgcatgttatgctttcatttgggtggaatacttcatcagaataaactattgatcttgtgctgtgtcaaagtaacagactagaaccttctttcaagtacctgaattgaaatgaaactcattttgaataataaaaactctagaaactctttaaaaactcaaaa

SEQ ID NO: 329382 - DNA, 2326 bp, Homo sapiens
caggggcgtggcgcgggcgggtcgtgagtggggcggggcccagagagcgtgtgcgatggagcggcgcgtcgcgcggcgcgaaggggcgtggcgccagtgggcgtggcgtagtgcgaagagacgcggtgcgcacgcgcgtgagggatgtcgcggggatgtcgcgggtgagtggtgtcgaggcctgttgggtcagggcggttcgcaggtgctgtcagagctgggcggggcagccgggtcgtagaggcgggcgccagtcgcggtcggtggagagggatgaggatgtaggagggacggacgtggcggaagccgcggggactgcgggggcggagtgcctctggggagccaggaggcctttccagaggctcctgggggaagaagaggcgaagcgagagtccccggggaagccctactccacccccagccggagcctgggttgtgcctgcacggaccagagcccacagtgcgagttgctgtaggcaaccagctagggtggccaacttctcccggttggcccgagatgttctggttttgggaccacagcgtcccaggcctccagcccaccacagtgaccatattgtgcgccccctgcccatcttctcccgcagcttccctagattaggcttgggaggcaaggggaggcctcctgacttttctcactgccttcgttaatataaagatgaaggcacactccacaacttccttctggccaggcccagacatgtctgtccttgtgagataaaagcttccatgggagccttccttcctaatcaaggtaggtagaccactggaaggtacatctggttttatattttgtcctgtagaagtcagatttcagcccagttgtgtaggagtgaggatgagcttatgctcttatcagagctttgagtacagagacatttgatctgggaatttcagccagcctcttcaaccccagaattcagaggttcaatcagaacagacattagcttaagttttcccatcagttgtctatcattaaactggcaaaatctagataattagaaaatatgacagagatgatccagacagagatgttcaggtttttccttgtgtaattcaaaaagtctcgtggtggaacatctgacccttttcaagaggaaggatgaaaactctacataggaacacgatgtgaatggaagaaacctgtcattatgcaaatagtacggtattccgaacagacactaaaaatagctgtcatctcaaagaatccagtgcttgtgtcacagtatgagaaagtagatgctggggaacagcgtttaatgaatgaagcattccagccagccagtgatctctttggaccttgcattctccatcagattggatcacctcccaccctgaggccccccaagactttgaacagttcttcagtcatccttacagaaagataccctctccagacaaacgcagtatttatatacggtccattggatctctatgaagcaccagaattatcagtgaagaatatattaaatggctcacgggctactgtaaagcatatttctatcgcttgagagtaaaactgctagaaccagttcctgtttctacaacaaggtgttcctttagagtcaatgagaacacacaaaacctacaaattcatgcaggggacatcctgaagttcttgaaaaagaagaaacctgaagatgccttctgtgttgtgggaataacaatgattgatctttacccaagagacttgtggaattttgtctttggacaggcctctttgacagatgatggtattccgtttttggcattgttgttagaagcttcttcaacttgagaatatttgaagatgttaaaagagggaaaaaaattccaaccaagaatcatattgatatttaaaactatagtattttcagttgagacattatgccataatgggaagtgtgctgttggtagattgtgataatctaggttctggttggccactcactacctacaggaccttaaaggcactggtgaggtggattgatgatgaatcttctggcacacctggagcaactccagaacacagtcgtgaggataatgggaatttactgaaacccgtggaaggaagcctttaaggaatggaaagagtggataataaaatgcctgactgttctccaaaaataaggaccttcaaataggagtgattgaaataaatgactacttgcatgttatgctttcatttgggtggaatacttcatcagaataaactattgatcttgtgctgtgtcaaagtaacagactagaaccttctttcaagtacctgaattgaaatgaaactcattttgaataataaaaactctagaaactctttaaaaactcaaaa

SEQ ID NO: 329383 - DNA, 2073 bp, Homo sapiens
caggggcgtggcgcgggcgggtcgtgagtggggcggggcccagagagcgtgtgcgatggagcggcgcgtcgcgcggcgcgaaggggcgtggcgccagtgggcgtggcgtagtgcgaagagacgcggtgcgcacgcgcgtgagggatgtcgcggggatgtcgcgggtgagtggtgtcgaggcctgttgggtcagggcggttcgcaggtgctgtcagagctgggcggggcagccgggtcgtagaggcgggcgccagtcgcggtcggtggagagggatgaggatgtaggagggacggacgtggcggaagccgcggggactgcgggggcggagtgcctctggggagccaggaggcctttccagaggctcctgggggaagaagaggcgaagcgagagtccccggggaagccctactccacccccagccggagcctgggttgtgcctgcacggaccagagcccacagtgcgagttgctgtaggcaaccagctagggtggccaacttctcccggttggcccgagatgttctggttttgggaccacagcgtcccaggcctccagcccaccacagtgaccatattgtgcgccccctgcccatcttctcccgcagcttccctagattaggcttgggaggcaaggggaggcctcctgacttttctcactgccttcgttaatataaagatgaaggcacactccacaacttccttctggccaggcccagacatgtctgtccttgtgagataaaagcttccatgggagccttccttcctaatcaaggtaggtagaccactggaaggtacatctggttttatattttgtcctgtagaagtcagatttcagcccagttgtgtaggagtgaggatgagcttatgctcttatcagagctttgagtacagagacatttgatctgggaatttcagccagcctcttcaaccccagaattcagaggttcaatcagaacagacattagcttaagttttcccatcagttgtctatcattaaactggcaaaatctagataattagaaaatatgacagagatgatccagacagagatgttcaggtttttccttgtgtaattcaaaaagtctcgtggtggaacatctgacccttttcaagaggaaggatgaaaactctacataggaacacgatgtgaatggaagaaacctgtcattatgcaaatagtacggtattccgaacagacactaaaaatagctgtcatctcaaagaatccagtgcttgtgtcacagtatgagaaagtagatgctggggaacagcgtttaatgaatgaagcattccagccagccagtgatctctttggaccttgcattctccatcagattggatcacctcccaccctgaggccccccaagactttgaacagttcttcagtcatccttacagaaagataccctctccagacaaacgcagtatttatatacggtccattggatctctatgaagcaccagaattatcagtgaagaatatattaaatggctcacgggctactgtaaagcatatttctatcgcttgagagtaaaactgctagaaccagttcctgtttctacaacaaggtgttcctttagagtcaatgagaacacacaaaacctacaaattcatgcaggggacatcctgaagttcttgaaaaagaagaaacctgaagatgccttctgtgttgtgggaataacaatgattgatctttacccaagagacttgtggaattttgtctttggacaggcctctttgacagatgatggtattccgtttttggcattgttgttagaagcttcttcaacttgagaatatttgaagatgttaaaagagggaaaaaaattccaaccaagaatcatattgatatttaaaactatagtattttcagttgagacattatgccataatgggaagtgtgctgttggtagattgtgataatctaggttctggttggccactcactacctacaggaccttaaaggtaacaatacccacatcatggagtcatttggagataatttacataaaagtgcctgtacataaaaagtgtggatacacgtcgcgaggggatcctcatagagcgccgc

SEQ ID NO: 329384 - DNA, 1262 bp, Homo sapiens
caggggcgtggcgcgggcgggtcgtgagtggggcggggcccagagagcgtgtgcgatggagcggcgcgtcgcgcggcgcgaaggggcgtggcgccagtgggcgtggcgtagtgcgaagagacgcggtgcgcacgcgcgtgagggatgtcgcggggatgtcgcgggtgagtggtgtcgaggcctgttgggtcagggcggttcgcaggtgctgtcagagctgggcggggcagccgggtcgtagaggcgggcgccagtcgcggtcggtggagagggatgaggatgtaggagggacggacgtggcggaagccgcggggactgcgggggcggagtgcctctggggagccaggaggcctttccagaggctcctgggggaagaagaggcgaagcgagagtccccggggaagccctactccacccccagccggagcctgggttgtgcctgcacggaccagagcccacagtgcgagttgctgtaggcaaccagctagggtggccaacttctcccggttggcccgagatgttctggttttgggaccacagcgtcccaggcctccagcccaccacagtgaccatattgtgcgccccctgcccatcttctcccgcagcttccctagattaggcttgggaggcaaggggaggcctcctgacttttctcactgccttcgttaatataaagatgaaggcacactccacaacttccttctggccaggcccagacatgtctgtccttgtgagataaaagcttccatgggagccttccttcctaatcaaggtaggtagaccactggaaggtacatctggttttatattttgtcctgtagaagtcagatttcagcccagttgtgtaggagtgaggatgagcttatgctcttatcagagctttgagtacagagacatttgatctgggaatttcagccagcctcttcaaccccagaattcagaggttcaatcagaacagacattagcttaagttttcccatcagttgtctatcattaaactggcaaaatctagataattagaaaatatgacagagatgatccagacagagatgttcaggtttttccttgtgtaattcaaaaagtctcgtggtggaacatctgacccttttcaagaggaaggatgaaaactctacataggaacacgatgtgaatggaagaaacctgtcattgtgagtctggcttttgattagtcatctgatgtcttccctaatgtgatgtgactaagccgtagcttctcagcctgcagttaaattgcagaaatg

SEQ ID NO: 329385 - DNA, 643 bp, Homo sapiens
ccatgttgcccaagctgttctcaaactcctggcctcaagcagtcctcctatcccaaagtgctgaaattacaggcatgagccaccacgcctggccaccactagtttttgtaatgggagcaggttccatatgagatggaggaatggatttcatgattgtctttgtaatttcttaggtccccaagaaattgattggacatgaggaaaccactctaagtgtgaccactctaaagcattagcagtcagtcatttcactctagggagaaatcagagctgtatatggagaataggtaaagtccccaatatggatatgtatttttatatttgactgcttgtatttttttgttagatgcaaatagtacggtattccgaacagacatagatgctggggaacagcgtttaatgaatgaagcattccagccagccagtgatctctttggaccttgcattctccatcagattggatcacctcccaccctgaggccccccaagactttgaacagttcttcagtcatccttacagaaagataccctctccagacaaacgcagtatttatatacggtccattgtaaatactggtaatgtgctagttttggttcggttttgcaatggttctgttgtcaggaatagtccgggctattggtc

SEQ ID NO: 329386 - DNA, 695 bp, Homo sapiens
tgcacagaaatgtctacacatgtgttttcacatacatatgtctacccatgcctgtgtggacacttatatatgtatatacatacatgtcaaattaatataatgccttgtagaatattcagcaagttgagaaaaaatatcctatcatgctagaaacaaagtataagaatgagtgtatttctttttcatcttttttcagtgcgtacttttgacatcatttgtaattctgtgtgtatttggtacgtgccatttcactcagtatatcattagcattattcatattcacagcatcattatcaaatgcagcgtcttcatggggtaatatgtcaccctatgatctagaagccaatgcttctctcttgcctgatggtattttgctgtggtttgttgaagtgcgcatctttcaatgcttttccaggcactggtgaggtggattgatgatgaatcttctggcacacctggagcaactccagaacacagtcgtgaggataatgggaatttactgaaacccgtggaaggaagcctttaaggaatggaaagagtggataataaaatgcctgactgttctccaaaaataaggaccttcaaataggagtgattgaaataaatgactacttgcatgttatgctttcatttgggtggaatacttcatcagaataaactattgatcttgtgctgtgtcaaagtaacagactaga

SEQ ID NO: 329387 - DNA, 863 bp, Homo sapiens
caggggcgtggcgcgggcgggtcgtgagtggggcggggcccagagagcgtgtgcgatggagcggcgcgtcgcgcggcgcgaaggggcgtggcgccagtgggcgtggcgtagtgcgaagagacgcggtgcgcacgcgcgtgagggatgtcgcggtctcgtggtggaacatctgacccttttcaagaggaaggatgaaaactctacataggaacacgatgtgaatggaagaaacctgtcattatgcaaatagtacggtattccgaacagacactaaaaatagctgtcatctcaaagaatccagtgcttgtgtcacagtatgagaaagtagatgctggggaacagcgtttaatgaatgaagcattccagccagccagtgatctctttggaccttgcattctccatcagattggatcacctcccaccctgaggccccccaagactttgaacagttcttcagtcatccttacagaaagataccctctccagacaaacgcagtatttatatacggtccattggatctctatgaagcaccagaattatcagtgaagaatatattaaatggctcacgggctactgtaaagcatatttctatcgcttgagagtaaaactgctagaaccagttcctgtttctacaacaaggtgttcctttagagtcaatgagaacacacaaaacctacaaattcatgcaggggacatcctgaagttcttgaaaaagaagaaacctgaagatgccttctgtgttgtgggaataacaatgattgatctttacccaagagacttgtggaattttgtctttggacaggcctctttgacagatgaggcttttgcacgaaggacttgggtggatttgttttttttcccc

SEQ ID NO: 329388 - DNA, 2107 bp, Homo sapiens
caggggcgtggcgcgggcgggtcgtgagtggggcggggcccagagagcgtgtgcgatggagcggcgcgtcgcgcggcgcgaaggggcgtggcgccagtgggcgtggcgtagtgcgaagagacgcggtgcgcacgcgcgtgagggatgtcgcggggatgtcgcgggtgagtggtgtcgaggcctgttgggtcagggcggttcgcaggtgctgtcagagctgggcggggcagccgggtcgtagaggcgggcgccagtcgcggtcggtggagagggatgaggatgtaggagggacggacgtggcggaagccgcggggactgcgggggcggagtgcctctggggagccaggaggcctttccagaggctcctgggggaagaagaggcgaagcgagagtccccggggaagccctactccacccccagccggagcctgggttgtgcctgcacggaccagagcccacagtgcgagttgctgtaggcaaccagctagggtggccaacttctcccggttggcccgagatgttctggttttgggaccacagcgtcccaggcctccagcccaccacagtgaccatattgtgcgccccctgcccatcttctcccgcagcttccctagattaggcttgggaggcaaggggaggcctcctgacttttctcactgccttcgttaatataaagatgaaggcacactccacaacttccttctggccaggcccagacatgtctgtccttgtgagataaaagcttccatgggagccttccttcctaatcaaggtaggtagaccactggaaggtacatctggttttatattttgtcctgtagaagtcagatttcagcccagttgtgtaggagtgaggatgagcttatgctcttatcagagctttgagtacagagacatttgatctgggaatttcagccagcctcttcaaccccagaattcagaggttcaatcagaacagacattagcttaagttttcccatcagttgtctatcattaaactggcaaaatctagataattagaaaatatgacagagatgatccagacagagatgttcaggtttttccttgtgtaattcaaaaagtctcgtggtggaacatctgacccttttcaagaggaaggatgaaaactctacataggaacacgatgtgaatggaagaaacctgtcattatgcaaatagtacggtattccgaacagacactaaaaatagctgtcatctcaaagaatccagtgcttgtgtcacagtatgagaaagtagatgctggggaacagcgtttaatgaatgaagcattccagccagccagtgatctctttggaccttgcattctccatcagattggatcacctcccaccctgaggccccccaagactttgaacagttcttcagtcatccttacagaaagataccctctccagacaaacgcagtatttatatacggtccattggatctctatgaagcaccagaattatcagtgaagaatatattaaatggctcacgggctactgtaaagcatatttctatcgcttgagagtaaaactgctagaaccagttcctgtttctacaacaaggtgttcctttagagtcaatgagaacacacaaaacctacaaattcatgcaggggacatcctgaagttcttgaaaaagaagaaacctgaagatgccttctgtgttgtgggaataacaatgattgatctttacccaagagacttgtggaattttgtctttggacaggcctctttgacagatggcactggtgaggtggattgatgatgaatcttctggcacacctggagcaactccagaacacagtcgtgaggataatgggaatttactgaaacccgtggaaggaagcctttaaggaatggaaagagtggataataaaatgcctgactgttctccaaaaataaggaccttcaaataggagtgattgaaataaatgactacttgcatgttatgctttcatttgggtggaatacttcatcagaataaactattgatcttgtgctgtgtcaaagtaacagactagaaccttctttcaagtacctgaattgaaatgaaactcattttgaataataaaaactctagaaactctttaaaaactcaaaa

SEQ ID NO: 329389 - DNA, 1178 bp, Homo sapiens
caggggcgtggcgcgggcgggtcgtgagtggggcggggcccagagagcgtgtgcgatggagcggcgcgtcgcgcggcgcgaaggggcgtggcgccagtgggcgtggcgtagtgcgaagagacgcggtgcgcacgcgcgtgagggatgtcgcggtctcgtggtggaacatctgacccttttcaagaggaaggatgaaaactctacataggaacacgatgtgaatggaagaaacctgtcattatgcaaatagtacggtattccgaacagacactaaaaatagctgtcatctcaaagaatccagtgcttgtgtcacagtatgagaaagtagatgctggggaacagcgtttaatgaatgaagcattccagccagccagtgatctctttggaccttgcattctccatcagattggatcacctcccaccctgaggccccccaagactttgaacagttcttcagtcatccttacagaaagataccctctccagacaaacgcagtatttatatacggtccattggatctctatgaagcaccagaattatcagtgaagaatatattaaatggctcacgggctactgtaaagcatatttctatcgcttgagagtaaaactgctagaaccagttcctgtttctacaacaaggtgttcctttagagtcaatgagaacacacaaaacctacaaattcatgcaggggacatcctgaagttcttgaaaaagaagaaacctgaagatgccttctgtgttgtgggaataacaatgattgatctttacccaagagacttgtggaattttgtctttggacaggcctctttgacagatggcactggtgaggtggattgatgatgaatcttctggcacacctggagcaactccagaacacagtcgtgaggataatgggaatttactgaaacccgtggaaggaagcctttaaggaatggaaagagtggataataaaatgcctgactgttctccaaaaataaggaccttcaaataggagtgattgaaataaatgactacttgcatgttatgctttcatttgggtggaatacttcatcagaataaactattgatcttgtgctgtgtcaaagtaacagactagaaccttctttcaagtacctgaattgaaatgaaactcattttgaataataaaaactctagaaactctttaaaaactcaaaa

SEQ ID NO: 329390 - DNA, 1284 bp, Homo sapiens
ccatgttgcccaagctgttctcaaactcctggcctcaagcagtcctcctatcccaaagtgctgaaattacaggcatgagccaccacgcctggccaccactagtttttgtaatgggagcaggttccatatgagatggaggaatggatttcatgattgtctttgtaatttcttaggtccccaagaaattgattggacatgaggaaaccactctaagtgtgaccactctaaagcattagcagtcagtcatttcactctagggagaaatcagagctgtatatggagaataggtaaagtccccaatatggatatgtatttttatatttgactgcttgtatttttttgttagatgcaaatagtacggtattccgaacagacactaaaaatagctgtcatctcaaagaatccagtgcttgtgtcacagtatgagaaagtagatgctggggaacagcgtttaatgaatgaagcattccagccagccagtgatctctttggaccttgcattctccatcagattggatcacctcccaccctgaggccccccaagactttgaacagttcttcagtcatccttacagaaagataccctctccagacaaacgcagtatttatatacggtccattggatctctatgaagcaccagaattatcagtgaagaatatattaaatggctcacgggctactgtaaagcatatttctatcgcttgagagtaaaactgctagaaccagttcctgtttctacaacaaggtgttcctttagagtcaatgagaacacacaaaacctacaaattcatgcaggggacatcctgaagttcttgaaaaagaagaaacctgaagatgccttctgtgttgtgggaataacaatgattgatctttacccaagagacttgtggaattttgtctttggacaggcctctttgacagatggcactggtgaggtggattgatgatgaatcttctggcacacctggagcaactccagaacacagtcgtgaggataatgggaatttactgaaacccgtggaaggaagcctttaaggaatggaaagagtggataataaaatgcctgactgttctccaaaaataaggaccttcaaataggagtgattgaaataaatgactacttgcatgttatgctttcatttgggtggaatacttcatcagaataaactattgatcttgtgctgtgtcaaagtaacagactagaaccttctttcaagtacctgaattgaaatgaaactcattttgaataataaaaactctagaaactctttaaaaactcaaaa

SEQ ID NO: 329391 - DNA, 1521 bp, Homo sapiens
caggggcgtggcgcgggcgggtcgtgagtggggcggggcccagagagcgtgtgcgatggagcggcgcgtcgcgcggcgcgaaggggcgtggcgccagtgggcgtggcgtagtgcgaagagacgcggtgcgcacgcgcgtgagggatgtcgcggggatgtcgcgggtgagtggtgtcgaggcctgttgggtcagggcggttcgcaggtgctgtcagagctgggcggggcagccgggtcgtagaggcgggcgccagtcgcggtcggtggagagggatgaggatgtaggagggacggacgtggcggaagccgcggggactgcgggggcggagtgcctctggggagccaggaggcctttccagaggctcctgggggaagaagaggcgaagcgagagtccccggggaagccctactccacccccagccggagcctgggttgtgcctgcacggaccagagcccacagtgcgagttgctgtaggcaaccagctagggtggccaacttctcccggttggcccgagatgttctggttttgggaccacagcgtcccaggcctccagcccaccacagtgaccatattgtgcgccccctgcccatcttctcccgcagcttccctagattaggcttgggaggcaaggggaggcctcctgacttttctcactgccttcgttaatataaagatgaaggcacactccacaacttccttctggccaggcccagacatgtctgtccttgtgagataaaagcttccatgggagccttccttcctaatcaagtctcgtggtggaacatctgacccttttcaagaggaaggatgaaaactctacataggaacacgatgtgaatggaagaaacctgtcattgatctctatgaagcaccagaattatcagtgaagaatatattaaatggctcacgggctactgtaaagcatatttctatcgcttgagagtaaaactgctagaaccagttcctgtttctacaacaaggtgttcctttagagtcaatgagaacacacaaaacctacaaattcatgcaggggacatcctgaagttcttgaaaaagaagaaacctgaagatgccttctgtgttgtgggaataacaatgattgatctttacccaagagacttgtggaattttgtctttggacaggcctctttgacagatggcactggtgaggtggattgatgatgaatcttctggcacacctggagcaactccagaacacagtcgtgaggataatgggaatttactgaaacccgtggaaggaagcctttaaggaatggaaagagtggataataaaatgcctgactgttctccaaaaataaggaccttcaaataggagtgattgaaataaatgactacttgcatgttatgctttcatttgggtggaatacttcatcagaataaactattgatcttgtgctgtgtcaaagtaacagactagaaccttctttcaagtacctgaattgaaatgaaactcattttgaataataaaaactctagaaactctttaaaaactcaaaa

SEQ ID NO: 329392 - DNA, 1203 bp, Homo sapiens
caggggcgtggcgcgggcgggtcgtgagtggggcggggcccagagagcgtgtgcgatggagcggcgcgtcgcgcggcgcgaaggggcgtggcgccagtgggcgtggcgtagtgcgaagagacgcggtgcgcacgcgcgtgagggatgtcgcggtctcgtggtggaacatctgacccttttcaagaggaaggatgaaaactctacataggaacacgatgtgaatggaagaaacctgtcattatgcaaatagtacggtattccgaacagacactaaaaatagctgtcatctcaaagaatccagtgcttgtgtcacagtatgagaaagtagatgctggggaacagcgtttaatgaatgaagcattcccacaattttttccccccccaaaaggagccagccagtgatctctttggaccttgcattctccatcagattggatcacctcccaccctgaggccccccaagactttgaacagttcttcagtcatccttacagaaagataccctctccagacaaacgcagtatttatatacggtccattggatctctatgaagcaccagaattatcagtgaagaatatattaaatggctcacgggctactgtaaagcatatttctatcgcttgagagtaaaactgctagaaccagttcctgtttctacaacaaggtgttcctttagagtcaatgagaacacacaaaacctacaaattcatgcaggggacatcctgaagttcttgaaaaagaagaaacctgaagatgccttctgtgttgtgggaataacaatgattgatctttacccaagagacttgtggaattttgtctttggacaggcctctttgacagatggcactggtgaggtggattgatgatgaatcttctggcacacctggagcaactccagaacacagtcgtgaggataatgggaatttactgaaacccgtggaaggaagcctttaaggaatggaaagagtggataataaaatgcctgactgttctccaaaaataaggaccttcaaataggagtgattgaaataaatgactacttgcatgttatgctttcatttgggtggaatacttcatcagaataaactattgatcttgtgctgtgtcaaagtaacagactagaaccttctttcaagtacctgaattgaaatgaaactcattttgaataataaaaactctagaaactctttaaaaactcaaaa

SEQ ID NO: 329393 - DNA, 1953 bp, Homo sapiens
caggggcgtggcgcgggcgggtcgtgagtggggcggggcccagagagcgtgtgcgatggagcggcgcgtcgcgcggcgcgaaggggcgtggcgccagtgggcgtggcgtagtgcgaagagacgcggtgcgcacgcgcgtgagggatgtcgcggggatgtcgcgggtgagtggtgtcgaggcctgttgggtcagggcggttcgcaggtgctgtcagagctgggcggggcagccgggtcgtagaggcgggcgccagtcgcggtcggtggagagggatgaggatgtaggagggacggacgtggcggaagccgcggggactgcgggggcggagtgcctctggggagccaggaggcctttccagaggctcctgggggaagaagaggcgaagcgagagtccccggggaagccctactccacccccagccggagcctgggttgtgcctgcacggaccagagcccacagtgcgagttgctgtaggcaaccagctagggtggccaacttctcccggttggcccgagatgttctggttttgggaccacagcgtcccaggcctccagcccaccacagtgaccatattgtgcgccccctgcccatcttctcccgcagcttccctagattaggcttgggaggcaaggggaggcctcctgacttttctcactgccttcgttaatataaagatgaaggcacactccacaacttccttctggccaggcccagacatgtctgtccttgtgagataaaagcttccatgggagccttccttcctaatcaaggtaggtagaccactggaaggtacatctggttttatattttgtcctgtagaagtcagatttcagcccagttgtgtaggagtgaggatgagcttatgctcttatcagagctttgagtacagagacatttgatctgggaatttcagccagcctcttcaaccccagaattcagaggttcaatcagaacagacattagcttaagttttcccatcagttgtctatcattaaactggcaaaatctagataattagaaaatatgacagagatgatccagacagagatgttcaggtttttccttgtgtaattcaaaaagtctcgtggtggaacatctgacccttttcaagaggaaggatgaaaactctacataggaacacgatgtgaatggaagaaacctgtcattatgcaaatagtacggtattccgaacagacactaaaaatagctgtcatctcaaagaatccagtgcttgtgtcacagtatgagaaagtagatgctggggaacagcgtttaatgaatgaagcattccagccagccagtgatctctttggaccttgcattctccatcagattggatcacctcccaccctgaggccccccaagactttgaacagttcttcagtcatccttacagaaagataccctctccagacaaacgcagtatttatatacggtccattggatctctatgaagcaccagaattatcagtgaagaatatattaaatggctcacgggctactgtaaagcatatttctatcgcttgagagtaaaactgctagaaccagttcctgtttctacaacaaggtgttcctttagagtcaatgagaacacacaaaacctacaaattcatgcaggggacatcctgaagttcttgaaaaagaagaaacctgaagatgccttctgtgttgtgggaataacaatgattgatctttacccaagagacttgtggaattttgtctttggacaggcctctttgacagatggcactggtgaggtggattgatgatgaatcttctggcacacctggagcaactccagaacacagtcgtgaggataatgggaatttactgaaacccgtggaaggaagcctttaaggaatggaaagagtggataataaaatgcctgactgttctccaaaaataaggaccttcaaataggagtgattgaaataaatgactacttgcatgt

SEQ ID NO: 329394 - DNA, 1677 bp, Homo sapiens
caggggcgtggcgcgggcgggtcgtgagtggggcggggcccagagagcgtgtgcgatggagcggcgcgtcgcgcggcgcgaaggggcgtggcgccagtgggcgtggcgtagtgcgaagagacgcggtgcgcacgcgcgtgagggatgtcgcggggatgtcgcgggtgagtggtgtcgaggcctgttgggtcagggcggttcgcaggtgctgtcagagctgggcggggcagccgggtcgtagaggcgggcgccagtcgcggtcggtggagagggatgaggatgtaggagggacggacgtggcggaagccgcggggactgcgggggcggagtgcctctggggagccaggaggcctttccagaggctcctgggggaagaagaggcgaagcgagagtccccggggaagccctactccacccccagccggagcctgggttgtgcctgcacggaccagagcccacagtgcgagttgctgtaggcaaccagctagggtggccaacttctcccggttggcccgagatgttctggttttgggaccacagcgtcccaggcctccagcccaccacagtgaccatattgtgcgccccctgcccatcttctcccgcagcttccctagattaggcttgggaggcaaggggaggcctcctgacttttctcactgccttcgttaatataaagatgaaggcacactccacaacttccttctggccaggcccagacatgtctgtccttgtgagataaaagcttccatgggagccttccttcctaatcaaggtaggtagaccactggaaggtacatctggttttatattttgtcctgtagaagtcagatttcagcccagttgtgtaggagtgaggatgagcttatgctcttatcagagctttgagtacagagacatttgatctgggaatttcagccagcctcttcaaccccagaattcagaggttcaatcagaacagacattagcttaagttttcccatcagttgtctatcattaaactggcaaaatctagataattagaaaatatgacagagatgatccagacagagatgttcaggtttttccttgtgtaattcaaaaagtctcgtggtggaacatctgacccttttcaagaggaaggatgaaaactctacataggaacacgatgtgaatggaagaaacctgtcattgatctctatgaagcaccagaattatcagtgaagaatatattaaatggctcacgggctactgtaaagcatatttctatcgcttgagagtaaaactgctagaaccagttcctgtttctacaacaaggtgttcctttagagtcaatgagaacacacaaaacctacaaattcatgcaggggacatcctgaagttcttgaaaaagaagaaacctgaagatgccttctgtgttgtgggaataacaatgattgatctttacccaagagacttgtggaattttgtctttggacaggcctctttgacagatggcactggtgaggtggattgatgatgaatcttctggcacacctggagcaactccagaacacagtcgtgaggataatgggaatttactgaaacccgtggaaggaagcctttaaggaatggaaagagtggataataaaatgcctgactgttctccaaaaataaggaccttcaaataggagtgattgaaataaatgactacttgcatgt

SEQ ID NO: 329395 - DNA, 384 bp, Homo sapiens
tctatcgcctaggctggagtgctgtaccttgatctcagctcactgcaacctctacctcccaggttcaagcgattctcctgcctcagcccccagagtagctggggctacaggcatgcaccaccatgcctggctaacttctttggtatttttagtagagacagggtttcaccatgttggccaggctggtctcgaactcctaacctcaagtgatccgcccgtctcggcctcccaaagtgctgggattacaggcatgagccaccgtgcccagccagaatggctattactaaaagtaaaaaaataacagatgctgatgaagctatagggaaaaggaaacacttataccctgttggtagaaatgtaaattagtttatccactgtggaacg

SEQ ID NO: 329396 - DNA, 326 bp, Homo sapiens
tagattataatttcatatgggaaagaactactccttttatttctttggatctctgtcctctaagagtttagaacaaaacctctaaaatagtcaacaaatatgtgttgaggagagaaagaagctgggagaaacgctgaaaagatactgacagtgggttataaaatagcagaaggtctctgcaaggaacacagcaggacagaaatgtagaagtattgctctaaaaactcaacagaaaaaaaaaagctacctaaaaaatgagctattaaaagcaggagatcaaaaccaagtgagctatgactgaaaggtaatttacagcaagtctattt

SEQ ID NO: 329397 - DNA, 222 bp, Homo sapiens
ccatcttgttctgcacagaagtctgactacctagcgagaagacaatctacatctcacgagaaactgaatgaaagtagatcaaactgaagctaacaaaggtaactttctaaaatgggtatttaacatgtagataattttttccttagaagtatttcaggataaacatacaaatgaatatcacaaccctgaattaggttcttctcaaatgctcagattttttaa

SEQ ID NO: 329398 - DNA, 546 bp, Homo sapiens
ctgcaatatatatctgcacacaccagattcctccatacaagcatgcccacaaagggtaataaaatgacacgtgtacacgctggatacaccaatgggaggctccccacaatgcctcacatggggctaagatgtactgccttactattactcactatgctctttcttccttttttttttttttttttggctaattctctgctctgtagtataacgatatggttgaaagtatcaaaaaggcctgcatgatatccacagagtaatgcaaacattccaaaatgtgaaaacaatgtgaaaccgttctctggatctaagcatattgataagggatactcaacctgtaatataacttccaggaagtatccttaaaggaagtgagatgtgtccttctctttctccttctgatgattgcaatgtatgtgaaaaagctgaagctagtagctctcttagaccctaaagtgtctttggaaaataatagaatctgaacacagtggggaaacgtgacaccacggcaaaccacgtgagtcctaaactgactacttctggaat

SEQ ID NO: 329399 - DNA, 233 bp, Homo sapiens
tgttgggtcttgctgctagggttacctgcaaatgagcattcatgcttatgtatttccttctcaacacaagttggaaaagcaagggcacatcactttggggagccataaaatattttaaaactacacactcagtattaaattaattgatgcttcacttttgtgttagtgcactatttcctctctttgtcctatagacgttcttgctatatagcatctaagacactccctaaaac

SEQ ID NO: 329400 - DNA, 116 bp, Homo sapiens
atatcatctattctacataaattttcatgcagcactgcaaagatttctcttagtaccctaagtaatcttaacaagacttttttctgagacagggtcttgctctgtcacccaggctg

SEQ ID NO: 329401 - DNA, 380 bp, Homo sapiens
tttcacaactttttcatcagcctaaaaggaaatccatacccatattaagcagtcagtcctcattcccctgtccctgacatccactaatctactttctgtctctatggatttgcctattctgaatatttcatataaatggaatcatatatgactttttgtgtttgacttctttcacttagcataattttttcaaggttcatccatgtatcagtatttcatttcttttgatggctgaataatattccattgtagagatgttccacattatgtttatccattcatcagttgatagacatctggctggtttctaccttttggctatggtgaacagcgctgctataaacgttcatgtgcaagtttttgtttgaacacttgttttc

SEQ ID NO: 329402 - DNA, 480 bp, Homo sapiens
ctaagaaataaatttcttttatttataaattatccagtctcaggtgtttaaatatagcaacagaaaacagactaagagagcgtttcatgtttctcaggaccatggaaccttttccctccatcaaactgtctaagaggcctgctgtttccagaaatatactttagaaagcaccatataaaatactaaatgggcctagcagcacagtagctcatgcctgtaatcccattgccttgggaggccaaggcaggaagatcacttgagaacagagttcaagaccagtctgggcaacacagtgaaaccccatctctacaaaagatacaaaaattagcagatgtggtagcgtgtgcctatggtcccagctactcagaaggctgaggtgggaggctcccttgagccaggaggtcaaggctgcagtgagctgtgatcataccactgcactccagcctgggcaaaagagcgagaccctgtctccaaacataa

SEQ ID NO: 329403 - DNA, 5941 bp, Homo sapiens
tttctagctggaaagttgcgcgccaggcagcggggggcggagagaggagcccagactggcccccacctcccgcttcctgcccggccgccgcccattggccggaggaatccccaggaatgcgagcgcccctttaaaagcgcgcggctcctccgccttgccagccgctgcgcccgagctggcctgcgagttcagggctcctgtcgctctccaggagcaacctctactccggacgcacaggcattccccgcgcccctccagccctcgccgccctcgccaccgctcccggccgccgcgctccggtacacacaggatccctgctgggcaccaacagctccaccatggggctggcctggggactaggcgtcctgttcctgatgcatgtgtgtggcaccaaccgcattccagagtctggcggagacaacagcgtgtttgacatctttgaactcaccggggccgcccgcaaggggtctgggcgccgactggtgaagggccccgacccttccagcccagctttccgcatcgaggatgccaacctgatcccccctgtgcctgatgacaagttccaagacctggtggatgctgtgcgggcagaaaagggtttcctccttctggcatccctgaggcagatgaagaagacccggggcacgctgctggccctggagcggaaagaccactctggccaggtcttcagcgtggtgtccaatggcaaggcgggcaccctggacctcagcctgaccgtccaaggaaagcagcacgtggtgtctgtggaagaagctctcctggcaaccggccagtggaagagcatcaccctgtttgtgcaggaagacagggcccagctgtacatcgactgtgaaaagatggagaatgctgagttggacgtccccatccaaagcgtcttcaccagagacctggccagcatcgccagactccgcatcgcaaaggggggcgtcaatgacaatttccagggggtgctgcagaatgtgaggtttgtctttggaaccacaccagaagacatcctcaggaacaaaggctgctccagctctaccagtgtcctcctcacccttgacaacaacgtggtgaatggttccagccctgccatccgcactaactacattggccacaagacaaaggacttgcaagccatctgcggcatctcctgtgatgagctgtccagcatggtcctggaactcaggggcctgcgcaccattgtgaccacgctgcaggacagcatccgcaaagtgactgaagagaacaaagagttggccaatgagctgaggcggcctcccctatgctatcacaacggagttcagtacagaaataacgaggaatggactgttgatagctgcactgagtgtcactgtcagaactcagttaccatctgcaaaaaggtgtcctgccccatcatgccctgctccaatgccacagttcctgatggagaatgctgtcctcgctgttggcccagcgactctgcggacgatggctggtctccatggtccgagtggacctcctgttctacgagctgtggcaatggaattcagcagcgcggccgctcctgcgatagcctcaacaaccgatgtgagggctcctcggtccagacacggacctgccacattcaggagtgtgacaagagatttaaacaggatggtggctggagccactggtccccgtggtcatcttgttctgtgacatgtggtgatggtgtgatcacaaggatccggctctgcaactctcccagcccccagatgaacgggaaaccctgtgaaggcgaagcgcgggagaccaaagcctgcaagaaagacgcctgccccatcaatggaggctggggtccttggtcaccatgggacatctgttctgtcacctgtggaggaggggtacagaaacgtagtcgtctctgcaacaaccccacaccccagtttggaggcaaggactgcgttggtgatgtaacagaaaaccagatctgcaacaagcaggactgtccaattgatggatgcctgtccaatccctgctttgccggcgtgaagtgtactagctaccctgatggcagctggaaatgtggtgcttgtccccctggttacagtggaaatggcatccagtgcacagatgttgatgagtgcaaagaagtgcctgatgcctgcttcaaccacaatggagagcaccggtgtgagaacacggaccccggctacaactgcctgccctgccccccacgcttcaccggctcacagcccttcggccagggtgtcgaacatgccacggccaacaaacaggtgtgcaagccccgtaacccctgcacggatgggacccacgactgcaacaagaacgccaagtgcaactacctgggccactatagcgaccccatgtaccgctgcgagtgcaagcctggctacgctggcaatggcatcatctgcggggaggacacagacctggatggctggcccaatgagaacctggtgtgcgtggccaatgcgacttaccactgcaaaaaggataattgccccaaccttcccaactcagggcaggaagactatgacaaggatggaattggtgatgcctgtgatgatgacgatgacaatgataaaattccagatgacagggacaactgtccattccattacaacccagctcagtatgactatgacagagatgatgtgggagaccgctgtgacaactgtccctacaaccacaacccagatcaggcagacacagacaacaatggggaaggagacgcctgtgctgcagacattgatggagacggtatcctcaatgaacgggacaactgccagtacgtctacaatgtggaccagagagacactgatatggatggggttggagatcagtgtgacaattgccccttggaacacaatccggatcagctggactctgactcagaccgcattggagatacctgtgacaacaatcaggatattgatgaagatggccaccagaacaatctggacaactgtccctatgtgcccaatgccaaccaggctgaccatgacaaagatggcaagggagatgcctgtgaccacgatgatgacaacgatggcattcctgatgacaaggacaactgcagactcgtgcccaatcccgaccagaaggactctgacggcgatggtcgaggtgatgcctgcaaagatgattttgaccatgacagtgtgccagacatcgatgacatctgtcctgagaatgttgacatcagtgagaccgatttccgccgattccagatgattcctctggaccccaaagggacatcccaaaatgaccctaactgggttgtacgccatcagggtaaagaactcgtccagactgtcaactgtgatcctggactcgctgtaggttatgatgagtttaatgctgtggacttcagtggcaccttcttcatcaacaccgaaagggacgatgactatgctggatttgtctttggctaccagtccagcagccgcttttatgttgtgatgtggaagcaagtcacccagtcctactgggacaccaaccccacgagggctcagggatactcgggcctttctgtgaaagttgtaaactccaccacagggcctggcgagcacctgcggaacgccctgtggcacacaggaaacacccctggccaggtgcgcaccctgtggcatgaccctcgtcacataggctggaaagatttcaccgcctacagatggcgtctcagccacaggccaaagacgggtttcattagagtggtgatgtatgaagggaagaaaatcatggctgactcaggacccatctatgataaaacctatgctggtggtagactagggttgtttgtcttctctcaagaaatggtgttcttctctgacctgaaatacgaatgtagagatccctaatcatcaaattgttgattgaaagactgatcataaaccaatgctggtattgcaccttctggaactatgggcttgagaaaacccccaggatcacttctccttggcttccttcttttctgtgcttgcatcagtgtggactcctagaacgtgcgacctgcctcaagaaaatgcagttttcaaaaacagactcagcattcagcctccaatgaataagacatcttccaagcatataaacaattgctttggtttccttttgaaaaagcatctacttgcttcagttgggaaggtgcccattccactctgcctttgtcacagagcagggtgctattgtgaggccatctctgagcagtggactcaaaagcattttcaggcatgtcagagaagggaggactcactagaattagcaaacaaaaccaccctgacatcctccttcaggaacacggggagcagaggccaaagcactaaggggagggcgcatacccgagacgattgtatgaagaaaatatggaggaactgttacatgttcggtactaagtcattttcaggggattgaaagactattgctggatttcatgatgctgactggcgttagctgattaacccatgtaaataggcacttaaatagaagcaggaaagggagacaaagactggcttctggacttcctccctgatccccacccttactcatcacctgcagtggccagaattagggaatcagaatcaaaccagtgtaaggcagtgctggctgccattgcctggtcacattgaaattggtggcttcattctagatgtagcttgtgcagatgtagcaggaaaataggaaaacctaccatctcagtgagcaccagctgcctcccaaaggaggggcagccgtgcttatatttttatggttacaatggcacaaaattattatcaacctaactaaaacattccttttctcttttttcctgaattatcatggagttttctaattctctcttttggaatgtagattttttttaaatgctttacgatgtaaaatatttattttttacttattctggaagatctggctgaaggattattcatggaacaggaagaagcgtaaagactatccatgtcatctttgttgagagtcttcgtgactgtaagattgtaaatacagattatttattaactctgttctgcctggaaatttaggcttcatacggaaagtgtttgagagcaagtagttgacatttatcagcaaatctcttgcaagaacagcacaaggaaaatcagtctaataagctgctctgccccttgtgctcagagtggatgttatgggattctttttttctctgttttatcttttcaagtggaattagttggttatccatttgcaaatgttttaaattgcaaagaaagccatgaggtcttcaatactgttttaccccatcccttgtgcatatttccagggagaaggaaagcatatacacttttttctttcatttttccaaaagagaaaaaaatgacaaaaggtgaaacttacatacaaatattacctcatttgttgtgtgactgagtaaagaatttttggatcaagcggaaagagtttaagtgtctaacaaacttaaagctactgtagtacctaaaaagtcagtgttgtacatagcataaaaactctgcagagaagtattcccaataaggaaatagcattgaaatgttaaatacaatttctgaaagttatgttttttttctatcatctggtataccattgctttatttttataaattattttctcattgccattggaatagatatctcagattgtgtagatatgctatttaaataatttatcaggaaatactgcctgtagagttagtatttctatttttatataatgtttgcacactgaattgaagaattgttggttttttcttttttttggttttgttttttttttttttttttttgcttttgacctcccatttttactatttgccaatacctttttctaggaatgtgcttttttttgtacacatttttatccattttacattctaaagcagtgtaagttgtatattactgtttcttatgtacaaggaacaacaataaatcatatggaaattta

SEQ ID NO: 329404 - DNA, 374 bp, Homo sapiens
  misc_feature (110)..(111): n is a, c, g, or t
  misc_feature (355)..(355): n is a, c, g, or t
gaatcacttgaacctgggaggtggaggttgccgcgagcctagatcacaccactgcactccagcctgggcaacagagagacttggtctcagtaaaaaaaaaaaaaaaaaannaggagcgccgcgaatttagtagtagtagggcccgcctactactactaaattcgcggccgcgtcgacggagaaggaaagcatatacacttttttctttcatttttccaaaagagaaaaaaatgacaaaaggtgaaacttacatacaaatattacctcatttgttgtgtgactgagtaaagaatttttaggtactacagtagctttaagtttgttagacacttaaactctttccgcttgatccaanatttctttactcagtcaca

SEQ ID NO: 329405 - DNA, 120 bp, Homo sapiens
gtgtagattgaagaaatgaaaccaaggctcaaagcatttgacaggatgaagggaccaaatgccaacttagacaagatagtgacatttctgacaccagtaataataatagcactttagaat

SEQ ID NO: 329406 - DNA, 656 bp, Homo sapiens
agtactctatccaaataccagcaaagcatgacttgtgttcacaacatctataaagctagagcattacacaaattctgtatgtatatcccccaagaaaagttttattttcttgtcttcccataaaaaaaatatgctgttactgagccaaattctgttctttttctatttggaattccaggtacactccctcgtgcatgagctcagcatgaggaaggcaactgaagcagtgatatatatcttctctttcctaggataattgccccaaccttcccaactcagggcaggaagactatgacaaggatggaattggtgatgcctgtgatgatgacgatgacaatgataaaattccagatgacagggtataaacagttttctatccctttttcatcttttcagttcagcaacagcctgaaacactttgggattcaaggaaattacatggctatagcaaaaaatataccaaatcaatacacaggataattagaaattattcattgtgttccagtagtttaaggatgtagatgttgccaagagaatttttaaatgagggttttgtttttcatcagaactgtttttctctgtacttgagaaattataatgcataaacatatgccactttgttccctagactcatttcaaagtcacatcgtggagtg

SEQ ID NO: 329407 - DNA, 7650 bp, Homo sapiens
tttctagctggaaagttgcgcgccaggcagcggggggcggagagaggagcccagactggcccccacctcccgcttcctgcccggccgccgcccattggccggaggaatccccaggaatgcgagcgcccctttaaaagcgcgcggctcctccgccttgccagccgctgcgcccgagctggcctgcgagttcagggctcctgtcgctctccaggagcaacctctactccggacgcacaggcattccccgcgcccctccagccctcgccgccctcgccaccgctcccggccgccgcgctccggtacacacaggatccctgctgggcaccaacagctccaccatggggctggcctggggactaggcgtcctgttcctgatgcatgtgtgtggcaccaaccgcattccagagtctggcggagacaacagcgtgtttgacatctttgaactcaccggggccgcccgcaaggggtctgggcgccgactggtgaagggccccgacccttccagcccagctttccgcatcgaggatgccaacctgatcccccctgtgcctgatgacaagttccaagacctggtggatgctgtgcgggcagaaaagggtttcctccttctggcatccctgaggcagatgaagaagacccggggcacgctgctggccctggagcggaaagaccactctggccaggtcttcagcgtggtgtccaatggcaaggcgggcaccctggacctcagcctgaccgtccaaggaaagcagcacgtggtgtctgtggaagaagctctcctggcaaccggccagtggaagagcatcaccctgtttgtgcaggaagacagggcccagctgtacatcgactgtgaaaagatggagaatgctgagttggacgtccccatccaaagcgtcttcaccagagacctggccagcatcgccagactccgcatcgcaaaggggggcgtcaatgacaatttccagggggtgctgcagaatgtgaggtttgtctttggaaccacaccagaagacatcctcaggaacaaaggctgctccagctctaccagtgtcctcctcacccttgacaacaacgtggtgaatggttccagccctgccatccgcactaactacattggccacaagacaaaggacttgcaagccatctgcggcatctcctgtgatgagctgtccagcatggtcctggaactcaggggcctgcgcaccattgtgaccacgctgcaggacagcatccgcaaagtgactgaagagaacaaagagttggccaatgagctgaggcggcctcccctatgctatcacaacggagttcagtacagaaataacgaggaatggactgttgatagctgcactgagtgtcactgtcagaactcagttaccatctgcaaaaaggtgtcctgccccatcatgccctgctccaatgccacagttcctgatggagaatgctgtcctcgctgttggcccagcgactctgcggacgatggctggtctccatggtccgagtggacctcctgttctacgagctgtggcaatggaattcagcagcgcggccgctcctgcgatagcctcaacaaccgatgtgagggctcctcggtccagacacggacctgccacattcaggagtgtgacaagagatttaaacaggatggtggctggagccactggtccccgtggtcatcttgttctgtgacatgtggtgatggtgtgatcacaaggatccggctctgcaactctcccagcccccagatgaacgggaaaccctgtgaaggcgaagcgcgggagaccaaagcctgcaagaaagacgcctgccccatcaatggaggctggggtccttggtcaccatgggacatctgttctgtcacctgtggaggaggggtacagaaacgtagtcgtctctgcaacaaccccacaccccagtttggaggcaaggactgcgttggtgatgtaacagaaaaccagatctgcaacaagcaggactgtccaattgatggatgcctgtccaatccctgctttgccggcgtgaagtgtactagctaccctgatggcagctggaaatgtggtgcttgtccccctggttacagtggaaatggcatccagtgcacagatgttgatgagtgcaaagaagtgcctgatgcctgcttcaaccacaatggagagcaccggtgtgagaacacggaccccggctacaactgcctgccctgccccccacgcttcaccggctcacagcccttcggccagggtgtcgaacatgccacggccaacaaacaggtgtgcaagccccgtaacccctgcacggatgggacccacgactgcaacaagaacgccaagtgcaactacctgggccactatagcgaccccatgtaccgctgcgagtgcaagcctggctacgctggcaatggcatcatctgcggggaggacacagacctggatggctggcccaatgagaacctggtgtgcgtggccaatgcgacttaccactgcaaaaaggataattgccccaaccttcccaactcagggcaggaagactatgacaaggatggaattggtgatgcctgtgatgatgacgatgacaatgataaaattccagatgacagggacaactgtccattccattacaacccagctcagtatgactatgacagagatgatgtgggagaccgctgtgacaactgtccctacaaccacaacccagatcaggcagacacagacaacaatggggaaggagacgcctgtgctgcagacattgatggagacggtatcctcaatgaacgggacaactgccagtacgtctacaatgtggaccagagagacactgatatggatggggttggagatcagtgtgacaattgccccttggaacacaatccggatcagctggactctgactcagaccgcattggagatacctgtgacaacaatcaggatattgatgaagatggccaccagaacaatctggacaactgtccctatgtgcccaatgccaaccaggctgaccatgacaaagatggcaagggagatgcctgtgaccacgatgatgacaacgatggcattcctgatgacaaggacaactgcagactcgtgcccaatcccgaccagaaggactctgacggcgatggtcgaggtgatgcctgcaaagatgattttgaccatgacagtgtgccagacatcgatgacatctgtcctgagaatgttgacatcagtgagaccgatttccgccgattccagatgattcctctggaccccaaagggacatcccaaaatgaccctaactgggttgtacgccatcagggtaaagaactcgtccagactgtcaactgtgatcctggactcgctgtaggttatgatgagtttaatgctgtggacttcagtggcaccttcttcatcaacaccgaaagggacgatgactatgctggatttgtctttggctaccagtccagcagccgcttttatgttgtgatgtggaagcaagtcacccagtcctactgggacaccaaccccacgagggctcagggatactcgggcctttctgtgaaagttgtaaactccaccacagggcctggcgagcacctgcggaacgccctgtggcacacaggaaacacccctggccaggtgcgcaccctgtggcatgaccctcgtcacataggctggaaagatttcaccgcctacagatggcgtctcagccacaggccaaagacgggtttcattagagtggtgatgtatgaagggaagaaaatcatggctgactcaggacccatctatgataaaacctatgctggtggtagactagggttgtttgtcttctctcaagaaatggtgttcttctctgacctgaaatacgaatgtagagatccctaatcatcaaattgttgattgaaagactgatcataaaccaatgctggtattgcaccttctggaactatgggcttgagaaaacccccaggatcacttctccttggcttccttcttttctgtgcttgcatcagtgtggactcctagaacgtgcgacctgcctcaagaaaatgcagttttcaaaaacagactcagcattcagcctccaatgaataagacatcttccaagcatataaacaattgctttggtttccttttgaaaaagcatctacttgcttcagttgggaaggtgcccattccactctgcctttgtcacagagcagggtgctattgtgaggccatctctgagcagtggactcaaaagcattttcaggcatgtcagagaagggaggactcactagaattagcaaacaaaaccaccctgacatcctccttcaggaacacggggagcagaggccaaagcactaaggggagggcgcatacccgagacgattgtatgaagaaaatatggaggaactgttacatgttcggtactaagtcattttcaggggattgaaagactattgctggatttcatgatgctgactggcgttagctgattaacccatgtaaataggcacttaaatagaagcaggaaagggagacaaagactggcttctggacttcctccctgatccccacccttactcatcacctgcagtggccagaattagggaatcagaatcaaaccagtgtaaggcagtgctggctgccattgcctggtcacattgaaattggtggcttcattctagatgtagcttgtgcagatgtagcaggaaaataggaaaacctaccatctcagtgagcaccagctgcctcccaaaggaggggcagccgtgcttatatttttatggttacaatggcacaaaattattatcaacctaactaaaacattccttttctcttttttcctgaattatcatggagttttctaattctctcttttggaatgtagattttttttaaatgctttacgatgtaaaatatttattttttacttattctggaagatctggctgaaggattattcatggaacaggaagaagcgtaaagactatccatgtcatctttgttgagagtcttcgtgactgtaagattgtaaatacagattatttattaactctgttctgcctggaaatttaggcttcatacggaaagtgtttgagagcaagtagttgacatttatcagcaaatctcttgcaagaacagcacaaggaaaatcagtctaataagctgctctgccccttgtgctcagagtggatgttatgggattctttttttctctgttttatcttttcaagtggaattagttggttatccatttgcaaatgttttaaattgcaaagaaagccatgaggtcttcaatactgttttaccccatcccttgtgcatatttccagggagaaggaaagcatatacacttttttctttcatttttccaaaagagaaaaaaatgacaaaaggtgaaacttacatacaaatattacctcatttgttgtgtgactgagtaaagaatttttggatcaagcggaaagagtttaagtgtctaacaaacttaaagctactgtagtacctaaaaagtcagtgttgtacatagcataaaaactctgcagagaagtattcccaataaggaaatagcattgaaatgttaaatacaatttctgaaagttatgttttttttctatcatctggtataccattgctttatttttataaattattttctcattgccattggaatagatatctcagattgtgtagatatgctatttaaataatttatcaggaaatactgcctgtagagttagtatttctatttttatataatgtttgcacactgaattgaagaattgttggttttttcttttttttggttttgttttttttttttttttttttgcttttgacctcccatttttactatttgccaatacctttttctaggaatgtgcttttttttgtacacatttttatccattttacattctaaagcagtgtaagttgtatattactgtttcttatgtacaaggaacaacaataaatcatatggaaatttatatttatacttactgtatccatgcttatttgttctctactggctttatgtcatgaagtatatgcgtaaataccattcataaatcaatatagcatatacaaaaataaattacagtaagtcatagcaacattcacagtttgtatgtgattgagaaagactgagttgctcaggcctaggcttagaatttgctgcgtttgtggaataaaagaacaaaatgatacattagcctgccatatcaaaaacatataaaagagaaattatccctaagtcaagggcccccataagaataaaatttcttattaaggtcattagatgtcattgaatccttttcaaagtgcagtatgaaaacaaagggaaaaacactgaagcacacgcaactctcacagcgacattttctgacccacgaatgatgccttgggtgggcaacacgattgcatgttgtggagacacttcggaagtaaatgtggatgagggaggagctgtccttgcaatgttgagccaagcattacagatacctcctcttgaagaaggaataataagtttaatcaaaaaagaagactaaaaaatgtaaaatttggaaggaatccataaatgcgtgtgtgtctaaatacaaattatcatgtgaagaaaaggcccaagtgtaccaataagcagaccttgatttttggatgggctaattatgaatgtggaatactgaccagttaatttccagttttaatgaaaacagatcaaagaagaaattttatgagtaggttaaaggtctggctttgaggtctattaaacactagaaaggactggctgggtgagataaaatcttccttgttgattttcactctcattctataaatactcatctttctgagtagccatgatcacatacaaatgtaaattgccaaatcattttatagtaccaaggtgaagaagcaggaactagaaagtgttgataatagctgtggagttaggaaaactgatgtgaaggaaataattctttgaaatggcaaagaattaaataccatcattcattatcagaagagttcaacgtttgaagtgctgggagataattctaattcattcttggatagtgaagcaaaactgattgaaaataccaagataagacagaaaaagtgactggaaagaggagcttttcttccaggcatgttccagtttcaccctaagactgaccttcaaataatcaggttgtactgaaataaaggacttgttaaaaattaaaattatgtcatcgagatgatagcttttttcctcctccaacagtttattgtcatgtgttgtgggagagctcgagtgaagagcaataaactccaggtcttataagaatgtacatacaataaaggtggtgccagcagtttttttttttctaaagagtcacatgtagaaaagcctccagtattaagctcctgaattcattccttaaataaattggctctctctctcttctataatttctttttctttttatttttgagatgaagtcttgctctgtcgcccaggctggagtgcagtgacacaatctcggctcactgcaacctctgcctccccggttcaagcaattctccctcctgcctcagcctcccaagtagctgggactacaagcgcccgccaccaagcctggctaattctgtatttttagtaaagacggggtttcaccttgttccggacaaacactaagccctaaagggaaatccaaaataa

SEQ ID NO: 329408 - DNA, 6650 bp, Homo sapiens
tttctagctggaaagttgcgcgccaggcagcggggggcggagagaggagcccagactggcccccacctcccgcttcctgcccggccgccgcccattggccggaggaatccccaggaatgcgagcgcccctttaaaagcgcgcggctcctccgccttgccagccgctgcgcccgagctggcctgcgagttcagggctcctgtcgctctccaggagcaacctctactccggacgcacaggcattccccgcgcccctccagccctcgccgccctcgccaccgctcccggccgccgcgctccggtacacacaggatccctgctgggcaccaacagctccaccatggggctggcctggggactaggcgtcctgttcctgatgcatgtgtgtggcaccaaccgcattccagagtctggcggagacaacagcgtgtttgacatctttgaactcaccggggccgcccgcaaggggtctgggcgccgactggtgaagggccccgacccttccagcccagctttccgcatcgaggatgccaacctgatcccccctgtgcctgatgacaagttccaagacctggtggatgctgtgcgggcagaaaagggtttcctccttctggcatccctgaggcagatgaagaagacccggggcacgctgctggccctggagcggaaagaccactctggccaggtcttcagcgtggtgtccaatggcaaggcgggcaccctggacctcagcctgaccgtccaaggaaagcagcacgtggtgtctgtggaagaagctctcctggcaaccggccagtggaagagcatcaccctgtttgtgcaggaagacagggcccagctgtacatcgactgtgaaaagatggagaatgctgagttggacgtccccatccaaagcgtcttcaccagagacctggccagcatcgccagactccgcatcgcaaaggggggcgtcaatgacaatttccagggggtgctgcagaatgtgaggtttgtctttggaaccacaccagaagacatcctcaggaacaaaggctgctccagctctaccagtgtcctcctcacccttgacaacaacgtggtgaatggttccagccctgccatccgcactaactacattggccacaagacaaaggacttgcaagccatctgcggcatctcctgtgatgagctgtccagcatggtcctggaactcaggggcctgcgcaccattgtgaccacgctgcaggacagcatccgcaaagtgactgaagagaacaaagagttggccaatgagctgaggcggcctcccctatgctatcacaacggagttcagtacagaaataacgaggaatggactgttgatagctgcactgagtgtcactgtcagaactcagttaccatctgcaaaaaggtgtcctgccccatcatgccctgctccaatgccacagttcctgatggagaatgctgtcctcgctgttggcccagcgactctgcggacgatggctggtctccatggtccgagtggacctcctgttctacgagctgtggcaatggaattcagcagcgcggccgctcctgcgatagcctcaacaaccgatgtgagggctcctcggtccagacacggacctgccacattcaggagtgtgacaagagatttaaacaggatggtggctggagccactggtccccgtggtcatcttgttctgtgacatgtggtgatggtgtgatcacaaggatccggctctgcaactctcccagcccccagatgaacgggaaaccctgtgaaggcgaagcgcgggagaccaaagcctgcaagaaagacgcctgccccatcaatggaggctggggtccttggtcaccatgggacatctgttctgtcacctgtggaggaggggtacagaaacgtagtcgtctctgcaacaaccccacaccccagtttggaggcaaggactgcgttggtgatgtaacagaaaaccagatctgcaacaagcaggactgtccaattggtgagccacgcagcccaggatgaaacgacccaggagctttgctcttttactgaatgctgcagtcagcattcgaggagattccagcttggttagtcctgagcgatttgattgctctaagatgcaggtggacaacataatcccaacaagttatcggttccctataccctataatatcttacactgtgttaagtgcccagcatggcagtatggcagcttagaccaaccatttactgtgactgtctctctctccttgtctcagatggatgcctgtccaatccctgctttgccggcgtgaagtgtactagctaccctgatggcagctggaaatgtggtgcttgtccccctggttacagtggaaatggcatccagtgcacagatgttgatgagtgcaaagaagtgcctgatgcctgcttcaaccacaatggagagcaccggtgtgagaacacggaccccggctacaactgcctgccctgccccccacgcttcaccggctcacagcccttcggccagggtgtcgaacatgccacggccaacaaacaggtacagtcaactagacgagtaaaccagaggacaggagagctgtccttgaccaaaataactgggagcgggaggaatgtaatttcatacccttcaccaaaaaaaaaagggcgaggagatgaatgtacggtctagttttagaaacgtgattagaaaatccatggtaaatcctgcaggggaaaaacagtcttccatatttaaaaatgctgctctggaataagttgtgagcagatggacttgtaaacgcctaggtgctgagcaaattcaagaaaaataaacataaagcaaagtttgcttatagcctcagggagaatggggagggacagaggtaacccacactcttccaaatggagcctctgtctactcagagatgacagggatctggattcttgtttccatgatatctgaggattctcaaaagctctgtgtaacagcagcatggtgtaccctcaggtgtgcaagccccgtaacccctgcacggatgggacccacgactgcaacaagaacgccaagtgcaactacctgggccactatagcgaccccatgtaccgctgcgagtgcaagcctggctacgctggcaatggcatcatctgcggggaggacacagacctggatggctggcccaatgagaacctggtgtgcgtggccaatgcgacttaccactgcaaaaaggataattgccccaaccttcccaactcagggcaggaagactatgacaaggatggaattggtgatgcctgtgatgatgacgatgacaatgataaaattccagatgacagggacaactgtccattccattacaacccagctcagtatgactatgacagagatgatgtgggagaccgctgtgacaactgtccctacaaccacaacccagatcaggcagacacagacaacaatggggaaggagacgcctgtgctgcagacattgatggagacggtatcctcaatgaacgggacaactgccagtacgtctacaatgtggaccagagagacactgatatggatggggttggagatcagtgtgacaattgccccttggaacacaatccggatcagctggactctgactcagaccgcattggagatacctgtgacaacaatcaggatattgatgaagatggccaccagaacaatctggacaactgtccctatgtgcccaatgccaaccaggctgaccatgacaaagatggcaagggagatgcctgtgaccacgatgatgacaacgatggcattcctgatgacaaggacaactgcagactcgtgcccaatcccgaccagaaggactctgacggcgatggtcgaggtgatgcctgcaaagatgattttgaccatgacagtgtgccagacatcgatgacatctgtcctgagaatgttgacatcagtgagaccgatttccgccgattccagatgattcctctggaccccaaagggacatcccaaaatgaccctaactgggttgtacgccatcagggtaaagaactcgtccagactgtcaactgtgatcctggactcgctgtaggttatgatgagtttaatgctgtggacttcagtggcaccttcttcatcaacaccgaaagggacgatgactatgctggatttgtctttggctaccagtccagcagccgcttttatgttgtgatgtggaagcaagtcacccagtcctactgggacaccaaccccacgagggctcagggatactcgggcctttctgtgaaagttgtaaactccaccacagggcctggcgagcacctgcggaacgccctgtggcacacaggaaacacccctggccaggtgcgcaccctgtggcatgaccctcgtcacataggctggaaagatttcaccgcctacagatggcgtctcagccacaggccaaagacgggtttcattagagtggtgatgtatgaagggaagaaaatcatggctgactcaggacccatctatgataaaacctatgctggtggtagactagggttgtttgtcttctctcaagaaatggtgttcttctctgacctgaaatacgaatgtagagatccctaatcatcaaattgttgattgaaagactgatcataaaccaatgctggtattgcaccttctggaactatgggcttgagaaaacccccaggatcacttctccttggcttccttcttttctgtgcttgcatcagtgtggactcctagaacgtgcgacctgcctcaagaaaatgcagttttcaaaaacagactcagcattcagcctccaatgaataagacatcttccaagcatataaacaattgctttggtttccttttgaaaaagcatctacttgcttcagttgggaaggtgcccattccactctgcctttgtcacagagcagggtgctattgtgaggccatctctgagcagtggactcaaaagcattttcaggcatgtcagagaagggaggactcactagaattagcaaacaaaaccaccctgacatcctccttcaggaacacggggagcagaggccaaagcactaaggggagggcgcatacccgagacgattgtatgaagaaaatatggaggaactgttacatgttcggtactaagtcattttcaggggattgaaagactattgctggatttcatgatgctgactggcgttagctgattaacccatgtaaataggcacttaaatagaagcaggaaagggagacaaagactggcttctggacttcctccctgatccccacccttactcatcacctgcagtggccagaattagggaatcagaatcaaaccagtgtaaggcagtgctggctgccattgcctggtcacattgaaattggtggcttcattctagatgtagcttgtgcagatgtagcaggaaaataggaaaacctaccatctcagtgagcaccagctgcctcccaaaggaggggcagccgtgcttatatttttatggttacaatggcacaaaattattatcaacctaactaaaacattccttttctcttttttcctgaattatcatggagttttctaattctctcttttggaatgtagattttttttaaatgctttacgatgtaaaatatttattttttacttattctggaagatctggctgaaggattattcatggaacaggaagaagcgtaaagactatccatgtcatctttgttgagagtcttcgtgactgtaagattgtaaatacagattatttattaactctgttctgcctggaaatttaggcttcatacggaaagtgtttgagagcaagtagttgacatttatcagcaaatctcttgcaagaacagcacaaggaaaatcagtctaataagctgctctgccccttgtgctcagagtggatgttatgggattctttttttctctgttttatcttttcaagtggaattagttggttatccatttgcaaatgttttaaattgcaaagaaagccatgaggtcttcaatactgttttaccccatcccttgtgcatatttccagggagaaggaaagcatatacacttttttctttcatttttccaaaagagaaaaaaatgacaaaaggtgaaacttacatacaaatattacctcatttgttgtgtgactgagtaaagaatttttggatcaagcggaaagagtttaagtgtctaacaaacttaaagctactgtagtacctaaaaagtcagtgttgtacatagcataaaaactctgcagagaagtattcccaataaggaaatagcattgaaatgttaaatacaatttctgaaagttatgttttttttctatcatctggtataccattgctttatttttataaattattttctcattgccattggaatagatatctcagattgtgtagatatgctatttaaataatttatcaggaaatactgcctgtagagttagtatttctatttttatataatgtttgcacactgaattgaagaattgttggttttttcttttttttggttttgttttttttttttttttttttgcttttgacctcccatttttactatttgccaatacctttttctaggaatgtgcttttttttgtacacatttttatccattttacattctaaagcagtgtaagttgtatattactgtttcttatgtacaaggaacaacaataaatcatatggaaattta

SEQ ID NO: 329409 - DNA, 5887 bp, Homo sapiens
tttctagctggaaagttgcgcgccaggcagcggggggcggagagaggagcccagactggcccccacctcccgcttcctgcccggccgccgcccattggccggaggaatccccaggaatgcgagcgcccctttaaaagcgcgcggctcctccgccttgccagccgctgcgcccgagctggcctgcgagttcagggctcctgtcgctctccaggagcaacctctactccggacgcacaggcattccccgcgcccctccagccctcgccgccctcgccaccgctcccggccgccgcgctccggtacacacaggatccctgctgggcaccaacagctccaccatggggctggcctggggactaggcgtcctgttcctgatgcatgtgtgtggcaccaaccgcattccagagtctggcggagacaacagcgtgtttgacatctttgaactcaccggggccgcccgcaaggggtctgggcgccgactggtgaagggccccgacccttccagcccagctttccgcatcgaggatgccaacctgatcccccctgtgcctgatgacaagttccaagacctggtggatgctgtgcgggcagaaaagggtttcctccttctggcatccctgaggcagatgaagaagacccggggcacgctgctggccctggagcggaaagaccactctggccaggtcttcagcgtggtgtccaatggcaaggcgggcaccctggacctcagcctgaccgtccaaggaaagcagcacgtggtgtctgtggaagaagctctcctggcaaccggccagtggaagagcatcaccctgtttgtgcaggaagacagggcccagctgtacatcgactgtgaaaagatggagaatgctgagttggacgtccccatccaaagcgtcttcaccagagacctggccagcatcgccagactccgcatcgcaaaggggggcgtcaatgacaatttccagggggtgctgcagaatgtgaggtttgtctttggaaccacaccagaagacatcctcaggaacaaaggctgctccagctctaccagtgtcctcctcacccttgacaacaacgtggtgaatggttccagccctgccatccgcactaactacattggccacaagacaaaggacttgcaagccatctgcggcatctcctgtgatgagctgtccagcatggtcctggaactcaggggcctgcgcaccattgtgaccacgctgcaggacagcatccgcaaagtgactgaagagaacaaagagttggccaatgagctgaggcggcctcccctatgctatcacaacggagttcagtacagaaataacgaggaatggactgttgatagctgcactgagtgtcactgtcagaactcagttaccatctgcaaaaaggtgtcctgccccatcatgccctgctccaatgccacagttcctgatggagaatgctgtcctcgctgttggcccagcgactctgcggacgatggctggtctccatggtccgagtggacctcctgttctacgagctgtggcaatggaattcagcagcgcggccgctcctgcgatagcctcaacaaccgatgtgagggctcctcggtccagacacggacctgccacattcaggagtgtgacaagagatttaaacaggatggtggctggagccactggtccccgtggtcatcttgttctgtgacatgtggtgatggtgtgatcacaaggatccggctctgcaactctcccagcccccagatgaacgggaaaccctgtgaaggcgaagcgcgggagaccaaagcctgcaagaaagacgcctgccccatcaatggaggctggggtccttggtcaccatgggacatctgttctgtcacctgtggaggaggggtacagaaacgtagtcgtctctgcaacaaccccacaccccagtttggaggcaaggactgcgttggtgatgtaacagaaaaccagatctgcaacaagcaggactgtccaattgatggatgcctgtccaatccctgctttgccggcgtgaagtgtactagctaccctgatggcagctggaaatgtggtgcttgtccccctggttacagtggaaatggcatccagtgcacagatgttgatgagtgcaaagaagtgcctgatgcctgcttcaaccacaatggagagcaccggtgtgagaacacggaccccggctacaactgcctgccctgccccccacgcttcaccggctcacagcccttcggccagggtgtcgaacatgccacggccaacaaacaggtgtgcaagccccgtaacccctgcacggatgggacccacgactgcaacaagaacgccaagtgcaactacctgggccactatagcgaccccatgtaccgctgcgagtgcaagcctggctacgctggcaatggcatcatctgcggggaggacacagacctggatggctggcccaatgagaacctggtgtgcgtggccaatgcgacttaccactgcaaaaaggataattgccccaaccttcccaactcagggcaggaagactatgacaaggatggaattggtgatgcctgtgatgatgacgatgacaatgataaaattccagatgacagggacaactgtccattccattacaacccagctcagtatgactatgacagagatgatgtgggagaccgctgtgacaactgtccctacaaccacaacccagatcaggcagacacagacaacaatggggaaggagacgcctgtgctgcagacattgatggagacggtatcctcaatgaacgggacaactgccagtacgtctacaatgtggaccagagagacactgatatggatggggttggagatcagtgtgacaattgccccttggaacacaatccggatcagctggactctgactcagaccgcattggagatacctgtgacaacaatcaggatattgatgaagatggccaccagaacaatctggacaactgtccctatgtgcccaatgccaaccaggctgaccatgacaaagatggcaagggagatgcctgtgaccacgatgatgacaacgatggcattcctgatgacaaggacaactgcagactcgtgcccaatcccgaccagaaggactctgacggcgatggtcgaggtgatgcctgcaaagatgattttgaccatgacagtgtgccagacatcgatgacatctgtcctgagaatgttgacatcagtgagaccgatttccgccgattccagatgattcctctggaccccaaagggacatcccaaaatgaccctaactgggttgtacgccatcagggtaaagaactcgtccagactgtcaactgtgatcctggactcgctgtaggttatgatgagtttaatgctgtggacttcagtggcaccttcttcatcaacaccgaaagggacgatgactatgctggatttgtctttggctaccagtccagcagccgcttttatgttgtgatgtggaagcaagtcacccagtcctactgggacaccaaccccacgagggctcagggatactcgggcctttctgtgaaagttgtaaactccaccacagggcctggcgagcacctgcggaacgccctgtggcacacaggaaacacccctggccaggtgcgcaccctgtggcatgaccctcgtcacataggctggaaagatttcaccgcctacagatggcgtctcagccacaggccaaagacgggtttcattagagtggtgatgtatgaagggaagaaaatcatggctgactcaggacccatctatgataaaacctatgctggtggtagactagggttgtttgtcttctctcaagaaatggtgttcttctctgacctgaaatacgaatgtagagatccctaatcatcaaattgttgattgaaagactgatcataaaccaatgctggtattgcaccttctggaactatgggcttgagaaaacccccaggatcacttctccttggcttccttcttttctgtgcttgcatcagtgtggactcctagaacgtgcgacctgcctcaagaaaatgcagttttcaaaaacagactcagcattcagcctccaatgaataagacatcttccaagcatataaacaattgctttggtttccttttgaaaaagcatctacttgcttcagttgggaaggtgcccattccactctgcctttgtcacagagcagggtgctattgtgaggccatctctgagcagtggactcaaaagcattttcaggcatgtcagagaagggaggactcactagaattagcaaacaaaaccaccctgacatcctccttcaggaacacggggagcagaggccaaagcactaaggggagggcgcatacccgagacgattgtatgaagaaaatatggaggaactgttacatgttcggtactaagtcattttcaggggattgaaagactattgctggatttcatgatgctgactggcgttagctgattaacccatgtaaataggcacttaaatagaagcaggaaagggagacaaagactggcttctggacttcctccctgatccccacccttactcatcacctgcagtggccagaattagggaatcagaatcaaaccagtgtaaggcagtgctggctgccattgcctggtcacattgaaattggtggcttcattctagatgtagcttgtgcagatgtagcaggaaaataggaaaacctaccatctcagtgagcaccagctgcctcccaaaggaggggcagccgtgcttatatttttatggttacaatggcacaaaattattatcaacctaactaaaacattccttttctcttttttcctgaattatcatggagttttctaattctctcttttggaatgtagattttttttaaatgctttacgatggaacaggaagaagcgtaaagactatccatgtcatctttgttgagagtcttcgtgactgtaagattgtaaatacagattatttattaactctgttctgcctggaaatttaggcttcatacggaaagtgtttgagagcaagtagttgacatttatcagcaaatctcttgcaagaacagcacaaggaaaatcagtctaataagctgctctgccccttgtgctcagagtggatgttatgggattctttttttctctgttttatcttttcaagtggaattagttggttatccatttgcaaatgttttaaattgcaaagaaagccatgaggtcttcaatactgttttaccccatcccttgtgcatatttccagggagaaggaaagcatatacacttttttctttcatttttccaaaagagaaaaaaatgacaaaaggtgaaacttacatacaaatattacctcatttgttgtgtgactgagtaaagaatttttggatcaagcggaaagagtttaagtgtctaacaaacttaaagctactgtagtacctaaaaagtcagtgttgtacatagcataaaaactctgcagagaagtattcccaataaggaaatagcattgaaatgttaaatacaatttctgaaagttatgttttttttctatcatctggtataccattgctttatttttataaattattttctcattgccattggaatagatatctcagattgtgtagatatgctatttaaataatttatcaggaaatactgcctgtagagttagtatttctatttttatataatgtttgcacactgaattgaagaattgttggttttttcttttttttggttttgttttttttttttttttttttgcttttgacctcccatttttactatttgccaatacctttttctaggaatgtgcttttttttgtacacatttttatccattttacattctaaagcagtgtaagttgtatattactgtttcttatgtacaaggaacaacaataaatcatatggaaattta

SEQ ID NO: 329410 - DNA, 5890 bp, Homo sapiens
tttctagctggaaagttgcgcgccaggcagcggggggcggagagaggagcccagactggcccccacctcccgcttcctgcccggccgccgcccattggccggaggaatccccaggaatgcgagcgcccctttaaaagcgcgcggctcctccgccttgccagccgctgcgcccgagctggcctgcgagttcagggctcctgtcgctctccaggagcaacctctactccggacgcacaggcattccccgcgcccctccagccctcgccgccctcgccaccgctcccggccgccgcgctccggtacacacaggatccctgctgggcaccaacagctccaccatggggctggcctggggactaggcgtcctgttcctgatgcatgtgtgtggcaccaaccgcattccagagtctggcggagacaacagcgtgtttgacatctttgaactcaccggggccgcccgcaaggggtctgggcgccgactggtgaagggccccgacccttccagcccagctttccgcatcgaggatgccaacctgatcccccctgtgcctgatgacaagttccaagacctggtggatgctgtgcgggcagaaaagggtttcctccttctggcatccctgaggcagatgaagaagacccggggcacgctgctggccctggagcggaaagaccactctggccaggtcttcagcgtggtgtccaatggcaaggcgggcaccctggacctcagcctgaccgtccaaggaaagcagcacgtggtgtctgtggaagaagctctcctggcaaccggccagtggaagagcatcaccctgtttgtgcaggaagacagggcccagctgtacatcgactgtgaaaagatggagaatgctgagttggacgtccccatccaaagcgtcttcaccagagacctggccagcatcgccagactccgcatcgcaaaggggggcgtcaatgacaatttccagggggtgctgcagaatgtgaggtttgtctttggaaccacaccagaagacatcctcaggaacaaaggctgctccagctctaccagtgtcctcctcacccttgacaacaacgtggtgaatggttccagccctgccatccgcactaactacattggccacaagacaaaggacttgcaagccatctgcggcatctcctgtgatgagctgtccagcatggtcctggaactcaggggcctgcgcaccattgtgaccacgctgcaggacagcatccgcaaagtgactgaagagaacaaagagttggccaatgagctgaggcggcctcccctatgctatcacaacggagttcagtacagaaataacgaggaatggactgttgatagctgcactgagtgtcactgtcagaactcagttaccatctgcaaaaaggtgtcctgccccatcatgccctgctccaatgccacagttcctgatggagaatgctgtcctcgctgttggcccagcgactctgcggacgatggctggtctccatggtccgagtggacctcctgttctacgagctgtggcaatggaattcagcagcgcggccgctcctgcgatagcctcaacaaccgatgtgagggctcctcggtccagacacggacctgccacattcaggagtgtgacaagagatttaaacaggatggtggctggagccactggtccccgtggtcatcttgttctgtgacatgtggtgatggtgtgatcacaaggatccggctctgcaactctcccagcccccagatgaacgggaaaccctgtgaaggcgaagcgcgggagaccaaagcctgcaagaaagacgcctgccccatcaatggaggctggggtccttggtcaccatgggacatctgttctgtcacctgtggaggaggggtacagaaacgtagtcgtctctgcaacaaccccacaccccagtttggaggcaaggactgcgttggtgatgtaacagaaaaccagatctgcaacaagcaggactgtccaattgatggatgcctgtccaatccctgctttgccggcgtgaagtgtactagctaccctgatggcagctggaaatgtggtgcttgtccccctggttacagtggaaatggcatccagtgcacagatgttgatgagtgcaaagaagtgcctgatgcctgcttcaaccacaatggagagcaccggtgtgagaacacggaccccggctacaactgcctgccctgccccccacgcttcaccggctcacagcccttcggccagggtgtcgaacatgccacggccaacaaacaggtgtgcaagccccgtaacccctgcacggatgggacccacgactgcaacaagaacgccaagtgcaactacctgggccactatagcgaccccatgtaccgctgcgagtgcaagcctggctacgctggcaatggcatcatctgcggggaggacacagacctggatggctggcccaatgagaacctggtgtgcgtggccaatgcgacttaccactgcaaaaaggataattgccccaaccttcccaactcagggcaggaagactatgacaaggatggaattggtgatgcctgtgatgatgacgatgacaatgataaaattccagatgacagggacaactgtccattccattacaacccagctcagtatgactatgacagagatgatgtgggagaccgctgtgacaactgtccctacaaccacaacccagatcaggcagacacagacaacaatggggaaggagacgcctgtgctgcagacattgatggagacggtatcctcaatgaacgggacaactgccagtacgtctacaatgtggaccagagagacactgatatggatggggttggagatcagtgtgacaattgccccttggaacacaatccggatcagctggactctgactcagaccgcattggagatacctgtgacaacaatcaggatattgatgaagatggccaccagaacaatctggacaactgtccctatgtgcccaatgccaaccaggctgaccatgacaaagatggcaagggagatgcctgtgaccacgatgatgacaacgatggcattcctgatgacaaggacaactgcagactcgtgcccaatcccgaccagaaggactctgacggcgatggtcgaggtgatgcctgcaaagatgattttgaccatgacagtgtgccagacatcgatgacatctgtcctgagaatgttgacatcagtgagaccgatttccgccgattccagatgattcctctggaccccaaagggacatcccaaaactgtgctcctgggctcttctgtccaggttatgatgagtttaatgctgtggacttcagtggcaccttcttcatcaacaccgaaagggacgatgactatgctggatttgtctttggctaccagtccagcagccgcttttatgttgtgatgtggaagcaagtcacccagtcctactgggacaccaaccccacgagggctcagggatactcgggcctttctgtgaaagttgtaaactccaccacagggcctggcgagcacctgcggaacgccctgtggcacacaggaaacacccctggccaggtgcgcaccctgtggcatgaccctcgtcacataggctggaaagatttcaccgcctacagatggcgtctcagccacaggccaaagacgggtttcattagagtggtgatgtatgaagggaagaaaatcatggctgactcaggacccatctatgataaaacctatgctggtggtagactagggttgtttgtcttctctcaagaaatggtgttcttctctgacctgaaatacgaatgtagagatccctaatcatcaaattgttgattgaaagactgatcataaaccaatgctggtattgcaccttctggaactatgggcttgagaaaacccccaggatcacttctccttggcttccttcttttctgtgcttgcatcagtgtggactcctagaacgtgcgacctgcctcaagaaaatgcagttttcaaaaacagactcagcattcagcctccaatgaataagacatcttccaagcatataaacaattgctttggtttccttttgaaaaagcatctacttgcttcagttgggaaggtgcccattccactctgcctttgtcacagagcagggtgctattgtgaggccatctctgagcagtggactcaaaagcattttcaggcatgtcagagaagggaggactcactagaattagcaaacaaaaccaccctgacatcctccttcaggaacacggggagcagaggccaaagcactaaggggagggcgcatacccgagacgattgtatgaagaaaatatggaggaactgttacatgttcggtactaagtcattttcaggggattgaaagactattgctggatttcatgatgctgactggcgttagctgattaacccatgtaaataggcacttaaatagaagcaggaaagggagacaaagactggcttctggacttcctccctgatccccacccttactcatcacctgcagtggccagaattagggaatcagaatcaaaccagtgtaaggcagtgctggctgccattgcctggtcacattgaaattggtggcttcattctagatgtagcttgtgcagatgtagcaggaaaataggaaaacctaccatctcagtgagcaccagctgcctcccaaaggaggggcagccgtgcttatatttttatggttacaatggcacaaaattattatcaacctaactaaaacattccttttctcttttttcctgaattatcatggagttttctaattctctcttttggaatgtagattttttttaaatgctttacgatgtaaaatatttattttttacttattctggaagatctggctgaaggattattcatggaacaggaagaagcgtaaagactatccatgtcatctttgttgagagtcttcgtgactgtaagattgtaaatacagattatttattaactctgttctgcctggaaatttaggcttcatacggaaagtgtttgagagcaagtagttgacatttatcagcaaatctcttgcaagaacagcacaaggaaaatcagtctaataagctgctctgccccttgtgctcagagtggatgttatgggattctttttttctctgttttatcttttcaagtggaattagttggttatccatttgcaaatgttttaaattgcaaagaaagccatgaggtcttcaatactgttttaccccatcccttgtgcatatttccagggagaaggaaagcatatacacttttttctttcatttttccaaaagagaaaaaaatgacaaaaggtgaaacttacatacaaatattacctcatttgttgtgtgactgagtaaagaatttttggatcaagcggaaagagtttaagtgtctaacaaacttaaagctactgtagtacctaaaaagtcagtgttgtacatagcataaaaactctgcagagaagtattcccaataaggaaatagcattgaaatgttaaatacaatttctgaaagttatgttttttttctatcatctggtataccattgctttatttttataaattattttctcattgccattggaatagatatctcagattgtgtagatatgctatttaaataatttatcaggaaatactgcctgtagagttagtatttctatttttatataatgtttgcacactgaattgaagaattgttggttttttcttttttttggttttgttttttttttttttttttttgcttttgacctcccatttttactatttgccaatacctttttctaggaatgtgcttttttttgtacacatttttatccattttacattctaaagcagtgtaagttgtatattactgtttcttatgtacaaggaacaacaataaatcatatggaaattta

SEQ ID NO: 329411 - DNA, 6470 bp, Homo sapiens
tttctagctggaaagttgcgcgccaggcagcggggggcggagagaggagcccagactggcccccacctcccgcttcctgcccggccgccgcccattggccggaggaatccccaggaatgcgagcgcccctttaaaagcgcgcggctcctccgccttgccagccgctgcgcccgagctggcctgcgagttcagggctcctgtcgctctccaggagcaacctctactccggacgcacaggcattccccgcgcccctccagccctcgccgccctcgccaccgctcccggccgccgcgctccggtacacacaggatccctgctgggcaccaacagctccaccatggggctggcctggggactaggcgtcctgttcctgatgcatgtgtgtggcaccaaccgcattccagagtctggcggagacaacagcgtgtttgacatctttgaactcaccggggccgcccgcaaggggtctgggcgccgactggtgaagggccccgacccttccagcccagctttccgcatcgaggatgccaacctgatcccccctgtgcctgatgacaagttccaagacctggtggatgctgtgcgggcagaaaagggtttcctccttctggcatccctgaggcagatgaagaagacccggggcacgctgctggccctggagcggaaagaccactctggccaggtcttcagcgtggtgtccaatggcaaggcgggcaccctggacctcagcctgaccgtccaaggaaagcagcacgtggtgtctgtggaagaagctctcctggcaaccggccagtggaagagcatcaccctgtttgtgcaggaagacagggcccagctgtacatcgactgtgaaaagatggagaatgctgagttggacgtccccatccaaagcgtcttcaccagagacctggccagcatcgccagactccgcatcgcaaaggggggcgtcaatgacaatttccagggggtgctgcagaatgtgaggtttgtctttggaaccacaccagaagacatcctcaggaacaaaggctgctccagctctaccagtgtcctcctcacccttgacaacaacgtggtgaatggttccagccctgccatccgcactaactacattggccacaagacaaaggacttgcaagccatctgcggcatctcctgtgatgagctgtccagcatggtcctggaactcaggggcctgcgcaccattgtgaccacgctgcaggacagcatccgcaaagtgactgaagagaacaaagagttggccaatgagctgaggcggcctcccctatgctatcacaacggagttcagtacagaaataacgaggaatggactgttgatagctgcactgagtgtcactgtcagaactcagttaccatctgcaaaaaggtgtcctgccccatcatgccctgctccaatgccacagttcctgatggagaatgctgtcctcgctgttggcccagcgactctgcggacgatggctggtctccatggtccgagtggacctcctgttctacgagctgtggcaatggaattcagcagcgcggccgctcctgcgatagcctcaacaaccgatgtgagggctcctcggtccagacacggacctgccacattcaggagtgtgacaagagatttaaacaggatggtggctggagccactggtccccgtggtcatcttgttctgtgacatgtggtgatggtgtgatcacaaggatccggctctgcaactctcccagcccccagatgaacgggaaaccctgtgaaggcgaagcgcgggagaccaaagcctgcaagaaagacgcctgccccatcaatggaggctggggtccttggtcaccatgggacatctgttctgtcacctgtggaggaggggtacagaaacgtagtcgtctctgcaacaaccccacaccccagtttggaggcaaggactgcgttggtgatgtaacagaaaaccagatctgcaacaagcaggactgtccaattgatggatgcctgtccaatccctgctttgccggcgtgaagtgtactagctaccctgatggcagctggaaatgtggtgcttgtccccctggttacagtggaaatggcatccagtgcacagatgttgatgagtgcaaagaagtgcctgatgcctgcttcaaccacaatggagagcaccggtgtgagaacacggaccccggctacaactgcctgccctgccccccacgcttcaccggctcacagcccttcggccagggtgtcgaacatgccacggccaacaaacaggtgtgcaagccccgtaacccctgcacggatgggacccacgactgcaacaagaacgccaagtgcaactacctgggccactatagcgaccccatgtaccgctgcgagtgcaagcctggctacgctggcaatggcatcatctgcggggaggacacagacctggatggctggcccaatgagaacctggtgtgcgtggccaatgcgacttaccactgcaaaaaggataattgccccaaccttcccaactcagggcaggaagactatgacaaggatggaattggtgatgcctgtgatgatgacgatgacaatgataaaattccagatgacagggacaactgtccattccattacaacccagctcagtatgactatgacagagatgatgtgggagaccgctgtgacaactgtccctacaaccacaacccagatcaggcagacacagacaacaatggggaaggagacgcctgtgctgcagacattgatggagacggtatcctcaatgaacgggacaactgccagtacgtctacaatgtggaccagagagacactgatatggatggggttggagatcagtgtgacaattgccccttggaacacaatccggatcagctggactctgactcagaccgcattggagatacctgtgacaacaatcaggatattgatgaagatggccaccagaacaatctggacaactgtccctatgtgcccaatgccaaccaggctgaccatgacaaagatggcaagggagatgcctgtgaccacgatgatgacaacgatggcattcctgatgacaaggacaactgcagactcgtgcccaatcccgaccagaaggactctgacggcgatggtcgaggtgatgcctgcaaagatgattttgaccatgacagtgtgccagacatcgatgacatctgtcctgagaatgttgacatcagtgagaccgatttccgccgattccagatgattcctctggaccccaaagggacatcccaaaatgaccctaactgggttgtacgccatcagggtaaagaactcgtccagactgtcaactgtgatcctggactcgctgtaggttatgatgagtttaatgctgtggacttcagtggcaccttcttcatcaacaccgaaagggacgatgactatgctggatttgtctttggctaccagtccagcagccgcttttatgttgtgatgtggaagcaagtcacccagtcctactgggacaccaaccccacgagggctcagggatactcgggcctttctgtgaaagttgtaaactccaccacagggcctggcgagcacctgcggaacgccctgtggcacacaggaaacacccctggccagaagcaaagccctggaacagagagagagcttatgggtgcctgactagcactggggatgctgtgctttgaccaagactctgaccagggagtcttagaaagttcccagcatcaccagctgcagcattgaactctgctttgtaaaaacataatagtgttgaaaagggagcttgaccaagaattgccctgcaaatcctaaggtgccttcagccttttcaaacaaaaaaacctccttccctcctctctgtctgctttatatgtgtgctcagtggcacacaacaaatatgagaggacttggaaaaattccccattgcagccctctaacttagatcagctcagtacctttcaagcattgtttctgatggaatgaaatagaaatctttacctgaaggagctgtgtttcaacctttccttttccttttccttcaggtgcgcaccctgtggcatgaccctcgtcacataggctggaaagatttcaccgcctacagatggcgtctcagccacaggccaaagacgggtttcattaggtacgatcatactgattcactttcacttacagtcacactgagggacaaaaagacaaaaagtattaaatagcattgtcactaaacaagattttttttccctgcagagtggtgatgtatgaagggaagaaaatcatggctgactcaggacccatctatgataaaacctatgctggtggtagactagggttgtttgtcttctctcaagaaatggtgttcttctctgacctgaaatacgaatgtagagatccctaatcatcaaattgttgattgaaagactgatcataaaccaatgctggtattgcaccttctggaactatgggcttgagaaaacccccaggatcacttctccttggcttccttcttttctgtgcttgcatcagtgtggactcctagaacgtgcgacctgcctcaagaaaatgcagttttcaaaaacagactcagcattcagcctccaatgaataagacatcttccaagcatataaacaattgctttggtttccttttgaaaaagcatctacttgcttcagttgggaaggtgcccattccactctgcctttgtcacagagcagggtgctattgtgaggccatctctgagcagtggactcaaaagcattttcaggcatgtcagagaagggaggactcactagaattagcaaacaaaaccaccctgacatcctccttcaggaacacggggagcagaggccaaagcactaaggggagggcgcatacccgagacgattgtatgaagaaaatatggaggaactgttacatgttcggtactaagtcattttcaggggattgaaagactattgctggatttcatgatgctgactggcgttagctgattaacccatgtaaataggcacttaaatagaagcaggaaagggagacaaagactggcttctggacttcctccctgatccccacccttactcatcacctgcagtggccagaattagggaatcagaatcaaaccagtgtaaggcagtgctggctgccattgcctggtcacattgaaattggtggcttcattctagatgtagcttgtgcagatgtagcaggaaaataggaaaacctaccatctcagtgagcaccagctgcctcccaaaggaggggcagccgtgcttatatttttatggttacaatggcacaaaattattatcaacctaactaaaacattccttttctcttttttcctgaattatcatggagttttctaattctctcttttggaatgtagattttttttaaatgctttacgatgtaaaatatttattttttacttattctggaagatctggctgaaggattattcatggaacaggaagaagcgtaaagactatccatgtcatctttgttgagagtcttcgtgactgtaagattgtaaatacagattatttattaactctgttctgcctggaaatttaggcttcatacggaaagtgtttgagagcaagtagttgacatttatcagcaaatctcttgcaagaacagcacaaggaaaatcagtctaataagctgctctgccccttgtgctcagagtggatgttatgggattctttttttctctgttttatcttttcaagtggaattagttggttatccatttgcaaatgttttaaattgcaaagaaagccatgaggtcttcaatactgttttaccccatcccttgtgcatatttccagggagaaggaaagcatatacacttttttctttcatttttccaaaagagaaaaaaatgacaaaaggtgaaacttacatacaaatattacctcatttgttgtgtgactgagtaaagaatttttggatcaagcggaaagagtttaagtgtctaacaaacttaaagctactgtagtacctaaaaagtcagtgttgtacatagcataaaaactctgcagagaagtattcccaataaggaaatagcattgaaatgttaaatacaatttctgaaagttatgttttttttctatcatctggtataccattgctttatttttataaattattttctcattgccattggaatagatatctcagattgtgtagatatgctatttaaataatttatcaggaaatactgcctgtagagttagtatttctatttttatataatgtttgcacactgaattgaagaattgttggttttttcttttttttggttttgttttttttttttttttttttgcttttgacctcccatttttactatttgccaatacctttttctaggaatgtgcttttttttgtacacatttttatccattttacattctaaagcagtgtaagttgtatattactgtttcttatgtacaaggaacaacaataaatcatatggaaattta

SEQ ID NO: 329412 - DNA, 5887 bp, Homo sapiens
tttctagctggaaagttgcgcgccaggcagcggggggcggagagaggagcccagactggcccccacctcccgcttcctgcccggccgccgcccattggccggaggaatccccaggaatgcgagcgcccctttaaaagcgcgcggctcctccgccttgccagccgctgcgcccgagctggcctgcgagttcagggctcctgtcgctctccaggagcaacctctactccggacgcacaggcattccccgcgcccctccagccctcgccgccctcgccaccgctcccggccgccgcgctccggtacacacaggatccctgctgggcaccaacagctccaccatggggctggcctggggactaggcgtcctgttcctgatgcatgtgtgtggcaccaaccgcattccagagtctggcggagacaacagcgtgtttgacatctttgaactcaccggggccgcccgcaaggggtctgggcgccgactggtgaagggccccgacccttccagcccagctttccgcatcgaggatgccaacctgatcccccctgtgcctgatgacaagttccaagacctggtggatgctgtgcgggcagaaaagggtttcctccttctggcatccctgaggcagatgaagaagacccggggcacgctgctggccctggagcggaaagaccactctggccaggtcttcagcgtggtgtccaatggcaaggcgggcaccctggacctcagcctgaccgtccaaggaaagcagcacgtggtgtctgtggaagaagctctcctggcaaccggccagtggaagagcatcaccctgtttgtgcaggaagacagggcccagctgtacatcgactgtgaaaagatggagaatgctgagttggacgtccccatccaaagcgtcttcaccagagacctggccagcatcgccagactccgcatcgcaaaggggggcgtcaatgacaatttccagggggtgctgcagaatgtgaggtttgtctttggaaccacaccagaagacatcctcaggaacaaaggctgctccagctctaccagtgtcctcctcacccttgacaacaacgtggtgaatggttccagccctgccatccgcactaactacattggccacaagacaaaggacttgcaagccatctgcggcatctcctgtgatgagctgtccagcatggtcctggaactcaggggcctgcgcaccattgtgaccacgctgcaggacagcatccgcaaagtgactgaagagaacaaagagttggccaatgagctgaggcggcctcccctatgctatcacaacggagttcagtacagaaataacgaggaatggactgttgatagctgcactgagtgtcactgtcagaactcagttaccatctgcaaaaaggtgtcctgccccatcatgccctgctccaatgccacagttcctgatggagaatgctgtcctcgctgttggcccagcgactctgcggacgatggctggtctccatggtccgagtggacctcctgttctacgagctgtggcaatggaattcagcagcgcggccgctcctgcgatagcctcaacaaccgatgtgagggctcctcggtccagacacggacctgccacattcaggagtgtgacaagagatttaaacaggatggtggctggagccactggtccccgtggtcatcttgttctgtgacatgtggtgatggtgtgatcacaaggatccggctctgcaactctcccagcccccagatgaacgggaaaccctgtgaaggcgaagcgcgggagaccaaagcctgcaagaaagacgcctgccccatcaatggaggctggggtccttggtcaccatgggacatctgttctgtcacctgtggaggaggggtacagaaacgtagtcgtctctgcaacaaccccacaccccagtttggaggcaaggactgcgttggtgatgtaacagaaaaccagatctgcaacaagcaggactgtccaattgatggatgcctgtccaatccctgctttgccggcgtgaagtgtactagctaccctgatggcagctggaaatgtggtgcttgtccccctggttacagtggaaatggcatccagtgcacagatgttgatgagtgcaaagaagtgcctgatgcctgcttcaaccacaatggagagcaccggtgtgagaacacggaccccggctacaactgcctgccctgccccccacgcttcaccggctcacagcccttcggccagggtgtcgaacatgccacggccaacaaacaggtgtgcaagccccgtaacccctgcacggatgggacccacgactgcaacaagaacgccaagtgcaactacctgggccactatagcgaccccatgtaccgctgcgagtgcaagcctggctacgctggcaatggcatcatctgcggggaggacacagacctggatggctggcccaatgagaacctggtgtgcgtggccaatgcgacttaccactgcaaaaaggataattgccccaaccttcccaactcagggcaggaagactatgacaaggatggaattggtgatgcctgtgatgatgacgatgacaatgataaaattccagatgacagggacaactgtccattccattacaacccagctcagtatgactatgacagagatgatgtgggagaccgctgtgacaactgtccctacaaccacaacccagatcaggcagacacagacaacaatggggaaggagacgcctgtgctgcagacattgatggagacggtatcctcaatgaacgggacaactgccagtacgtctacaatgtggaccagagagacactgatatggatggggttggagatcagtgtgacaattgccccttggaacacaatccggatcagctggactctgactcagaccgcattggagatacctgtgacaacaatcaggatattgatgaagatggccaccagaacaatctggacaactgtccctatgtgcccaatgccaaccaggctgaccatgacaaagatggcaagggagatgcctgtgaccacgatgatgacaacgatggcattcctgatgacaaggacaactgcagactcgtgcccaatcccgaccagaaggactctgacggcgatggtcgaggtgatgcctgcaaagatgattttgaccatgacagtgtgccagacatcgatgacatctgtcctgagaatgttgacatcagtgagaccgatttccgccgattccagatgattcctctggaccccaaagggacatcccaaaatgaccctaactgggttgtacgccatcagggtaaagaactcgtccagactgtcaactgtgatcctggactcgctgtaggttatgatgagtttaatgctgtggacttcagtggcaccttcttcatcaacaccgaaagggacgatgactatgctggatttgtctttggctaccagtccagcagccgcttttatgttgtgatgtggaagcaagtcacccagtcctactgggacaccaaccccacgagggctcagggatactcgggcctttctgtgaaagttgtaaactccaccacagggcctggcgagcacctgcggaacgccctgtggcacacaggaaacacccctggccaggtgcgcaccctgtggcatgaccctcgtcacataggctggaaagatttcaccgcctacagatggcgtctcagccacaggccaaagacgggtttcattagagtggtgatgtatgaagggaagaaaatcatggctgactcaggacccatctatgataaaacctatgctggtggtagactagggttgtttgtcttctctcaagaaatggtgttcttctctgacctgaaatacgaatgtagagatccctaatcatcaaattgttgattgaaagactgatcataaaccaatgctggtattgcaccttctggaactatgggcttgagaaaacccccaggatcacttctccttggcttccttcttttctgtgcttgcatcagtgtggactcctagaacgtgcgacctgcctcaagaaaatgcagttttcaaaaacagactcagcattcagcctccaatgaataagacatcttccaagcatataaacaattgctttggtttccttttgaaaaagcatctacttgcttcagttgggaaggtgcccattccactctgcctttgtcacagagcagggtgctattgtgaggccatctctgagcagtggactcaaaagcattttcaggcatgtcagagaagggaggactcactagaattagcaaacaaaaccaccctgacatcctccttcaggaacacggggagcagaggccaaagcactaaggggagggcgcatacccgagacgattgtatgaagaaaactattgctggatttcatgatgctgactggcgttagctgattaacccatgtaaataggcacttaaatagaagcaggaaagggagacaaagactggcttctggacttcctccctgatccccacccttactcatcacctgcagtggccagaattagggaatcagaatcaaaccagtgtaaggcagtgctggctgccattgcctggtcacattgaaattggtggcttcattctagatgtagcttgtgcagatgtagcaggaaaataggaaaacctaccatctcagtgagcaccagctgcctcccaaaggaggggcagccgtgcttatatttttatggttacaatggcacaaaattattatcaacctaactaaaacattccttttctcttttttcctgaattatcatggagttttctaattctctcttttggaatgtagattttttttaaatgctttacgatgtaaaatatttattttttacttattctggaagatctggctgaaggattattcatggaacaggaagaagcgtaaagactatccatgtcatctttgttgagagtcttcgtgactgtaagattgtaaatacagattatttattaactctgttctgcctggaaatttaggcttcatacggaaagtgtttgagagcaagtagttgacatttatcagcaaatctcttgcaagaacagcacaaggaaaatcagtctaataagctgctctgccccttgtgctcagagtggatgttatgggattctttttttctctgttttatcttttcaagtggaattagttggttatccatttgcaaatgttttaaattgcaaagaaagccatgaggtcttcaatactgttttaccccatcccttgtgcatatttccagggagaaggaaagcatatacacttttttctttcatttttccaaaagagaaaaaaatgacaaaaggtgaaacttacatacaaatattacctcatttgttgtgtgactgagtaaagaatttttggatcaagcggaaagagtttaagtgtctaacaaacttaaagctactgtagtacctaaaaagtcagtgttgtacatagcataaaaactctgcagagaagtattcccaataaggaaatagcattgaaatgttaaatacaatttctgaaagttatgttttttttctatcatctggtataccattgctttatttttataaattattttctcattgccattggaatagatatctcagattgtgtagatatgctatttaaataatttatcaggaaatactgcctgtagagttagtatttctatttttatataatgtttgcacactgaattgaagaattgttggttttttcttttttttggttttgttttttttttttttttttttgcttttgacctcccatttttactatttgccaatacctttttctaggaatgtgcttttttttgtacacatttttatccattttacattctaaagcagtgtaagttgtatattactgtttcttatgtacaaggaacaacaataaatcatatggaaattta

SEQ ID NO: 329413 - DNA, 6475 bp, Homo sapiens
atcgttccatggcacgttatccctggcttttgttaccagtaaaatgaatgactttgctgagacaatacttagtgtagcaggtacaagttataaaagtgattcattacaactaagataaggaagaaaacaggaaaacagcacttgcccttcacacacacagaaacacacatgcacacacacacaaacacacccttgtcacagctcagaataaccaattccatccagggatcatattagcgatattggcactgtaatggtcgtttttacatttattttctgttccgcattcacttaacatgtgcgttaaaaggaacaaagctagctggaggtagcaaagttttgaacttgaatcagggattgctaagaaaacttacaactaatgaccacagaaagtaagttctttgtcttctgtctgatacagctagatgtgattgtagccgtggtgcctgggcagatggtaaacaaacatgctgtcctcttatgacaatatgtgcagagaaggccccaaacgctggggtgagaggaacaacaaactgactaactcacggccgagttggagccagaaccaacaacagctcggctgccttcacactcatctgtcaaacacatggtgtatggctcccctgacagaaatgactcctataagcttcctcatactcgcgcattcttggaagtctgagactggaaatgcctacccagatatgttaagtcagtaaaggaaaactcatttgcaatgctgagaggagaaagaaaatcaatgaataggagagcatacactgtgggaaggctcagctgtactgagccaggcaaagcatccgattaccccactgctgtacacatcatgacctgggataaacccctgggccgttggcctaagaaatatgttgcttttcatcctgtataactgcaactttgtgccggctcatattatgttctagagagctcatgtacaccatggtgaccatagttaataatactggattgtatgcttaaaatttgctaagagagtagatcttaagtcatcaccaaaaaaagtaactgtaagatgatggagatgtgttaattagcttgacggtggtaatcacaatatatgtgtatatcaaaacatcacattatacaccttaaatgtatataatatttgtcaattatacctcagtaaagccaaaaagaaataaatatattgcttttcaccctctggcaagtggagggccctgaacagagccctctaaagaacagcttgtcctaatcatcacgtacctgatgaacctctgtttcccctgcagccagcgactctgcggacgatggctggtctccatggtccgagtggacctcctgttctacgagctgtggcaatggaattcagcagcgcggccgctcctgcgatagcctcaacaaccgatgtgagggctcctcggtccagacacggacctgccacattcaggagtgtgacaagagatttaaacaggatggtggctggagccactggtccccgtggtcatcttgttctgtgacatgtggtgatggtgtgatcacaaggatccggctctgcaactctcccagcccccagatgaacgggaaaccctgtgaaggcgaagcgcgggagaccaaagcctgcaagaaagacgcctgccccatcaatggaggctggggtccttggtcaccatgggacatctgttctgtcacctgtggaggaggggtacagaaacgtagtcgtctctgcaacaaccccacaccccagtttggaggcaaggactgcgttggtgatgtaacagaaaaccagatctgcaacaagcaggactgtccaattggtgagccacgcagcccaggatgaaacgacccaggagctttgctcttttactgaatgctgcagtcagcattcgaggagattccagcttggttagtcctgagcgatttgattgctctaagatgcaggtggacaacataatcccaacaagttatcggttccctataccctataatatcttacactgtgttaagtgcccagcatggcagtatggcagcttagaccaaccatttactgtgactgtctctctctccttgtctcagatggatgcctgtccaatccctgctttgccggcgtgaagtgtactagctaccctgatggcagctggaaatgtggtgcttgtccccctggttacagtggaaatggcatccagtgcacagatgttgatgagtgcaaagaagtgcctgatgcctgcttcaaccacaatggagagcaccggtgtgagaacacggaccccggctacaactgcctgccctgccccccacgcttcaccggctcacagcccttcggccagggtgtcgaacatgccacggccaacaaacaggtacagtcaactagacgagtaaaccagaggacaggagagctgtccttgaccaaaataactgggagcgggaggaatgtaatttcatacccttcaccaaaaaaaaaagggcgaggagatgaatgtacggtctagttttagaaacgtgattagaaaatccatggtaaatcctgcaggggaaaaacagtcttccatatttaaaaatgctgctctggaataagttgtgagcagatggacttgtaaacgcctaggtgctgagcaaattcaagaaaaataaacataaagcaaagtttgcttatagcctcagggagaatggggagggacagaggtaacccacactcttccaaatggagcctctgtctactcagagatgacagggatctggattcttgtttccatgatatctgaggattctcaaaagctctgtgtaacagcagcatggtgtaccctcaggtgtgcaagccccgtaacccctgcacggatgggacccacgactgcaacaagaacgccaagtgcaactacctgggccactatagcgaccccatgtaccgctgcgagtgcaagcctggctacgctggcaatggcatcatctgcggggaggacacagacctggatggctggcccaatgagaacctggtgtgcgtggccaatgcgacttaccactgcaaaaaggataattgccccaaccttcccaactcagggcaggaagactatgacaaggatggaattggtgatgcctgtgatgatgacgatgacaatgataaaattccagatgacagggacaactgtccattccattacaacccagctcagtatgactatgacagagatgatgtgggagaccgctgtgacaactgtccctacaaccacaacccagatcaggcagacacagacaacaatggggaaggagacgcctgtgctgcagacattgatggagacggtatcctcaatgaacgggacaactgccagtacgtctacaatgtggaccagagagacactgatatggatggggttggagatcagtgtgacaattgccccttggaacacaatccggatcagctggactctgactcagaccgcattggagatacctgtgacaacaatcaggatattgatgaagatggccaccagaacaatctggacaactgtccctatgtgcccaatgccaaccaggctgaccatgacaaagatggcaagggagatgcctgtgaccacgatgatgacaacgatggcattcctgatgacaaggacaactgcagactcgtgcccaatcccgaccagaaggactctgacggcgatggtcgaggtgatgcctgcaaagatgattttgaccatgacagtgtgccagacatcgatgacatctgtcctgagaatgttgacatcagtgagaccgatttccgccgattccagatgattcctctggaccccaaagggacatcccaaaatgaccctaactgggttgtacgccatcagggtaaagaactcgtccagactgtcaactgtgatcctggactcgctgtaggttatgatgagtttaatgctgtggacttcagtggcaccttcttcatcaacaccgaaagggacgatgactatgctggatttgtctttggctaccagtccagcagccgcttttatgttgtgatgtggaagcaagtcacccagtcctactgggacaccaaccccacgagggctcagggatactcgggcctttctgtgaaagttgtaaactccaccacagggcctggcgagcacctgcggaacgccctgtggcacacaggaaacacccctggccaggtgcgcaccctgtggcatgaccctcgtcacataggctggaaagatttcaccgcctacagatggcgtctcagccacaggccaaagacgggtttcattagagtggtgatgtatgaagggaagaaaatcatggctgactcaggacccatctatgataaaacctatgctggtggtagactagggttgtttgtcttctctcaagaaatggtgttcttctctgacctgaaatacgaatgtagagatccctaatcatcaaattgttgattgaaagactgatcataaaccaatgctggtattgcaccttctggaactatgggcttgagaaaacccccaggatcacttctccttggcttccttcttttctgtgcttgcatcagtgtggactcctagaacgtgcgacctgcctcaagaaaatgcagttttcaaaaacagactcagcattcagcctccaatgaataagacatcttccaagcatataaacaattgctttggtttccttttgaaaaagcatctacttgcttcagttgggaaggtgcccattccactctgcctttgtcacagagcagggtgctattgtgaggccatctctgagcagtggactcaaaagcattttcaggcatgtcagagaagggaggactcactagaattagcaaacaaaaccaccctgacatcctccttcaggaacacggggagcagaggccaaagcactaaggggagggcgcatacccgagacgattgtatgaagaaaatatggaggaactgttacatgttcggtactaagtcattttcaggggattgaaagactattgctggatttcatgatgctgactggcgttagctgattaacccatgtaaataggcacttaaatagaagcaggaaagggagacaaagactggcttctggacttcctccctgatccccacccttactcatcacctgcagtggccagaattagggaatcagaatcaaaccagtgtaaggcagtgctggctgccattgcctggtcacattgaaattggtggcttcattctagatgtagcttgtgcagatgtagcaggaaaataggaaaacctaccatctcagtgagcaccagctgcctcccaaaggaggggcagccgtgcttatatttttatggttacaatggcacaaaattattatcaacctaactaaaacattccttttctcttttttcctgaattatcatggagttttctaattctctcttttggaatgtagattttttttaaatgctttacgatgtaaaatatttattttttacttattctggaagatctggctgaaggattattcatggaacaggaagaagcgtaaagactatccatgtcatctttgttgagagtcttcgtgactgtaagattgtaaatacagattatttattaactctgttctgcctggaaatttaggcttcatacggaaagtgtttgagagcaagtagttgacatttatcagcaaatctcttgcaagaacagcacaaggaaaatcagtctaataagctgctctgccccttgtgctcagagtggatgttatgggattctttttttctctgttttatcttttcaagtggaattagttggttatccatttgcaaatgttttaaattgcaaagaaagccatgaggtcttcaatactgttttaccccatcccttgtgcatatttccagggagaaggaaagcatatacacttttttctttcatttttccaaaagagaaaaaaatgacaaaaggtgaaacttacatacaaatattacctcatttgttgtgtgactgagtaaagaatttttggatcaagcggaaagagtttaagtgtctaacaaacttaaagctactgtagtacctaaaaagtcagtgttgtacatagcataaaaactctgcagagaagtattcccaataaggaaatagcattgaaatgttaaatacaatttctgaaagttatgttttttttctatcatctggtataccattgctttatttttataaattattttctcattgccattggaatagatatctcagattgtgtagatatgctatttaaataatttatcaggaaatactgcctgtagagttagtatttctatttttatataatgtttgcacactgaattgaagaattgttggttttttcttttttttggttttgttttttttttttttttttttgcttttgacctcccatttttactatttgccaatacctttttctaggaatgtgcttttttttgtacacatttttatccattttacattctaaagcagtgtaagttgtatattactgtttcttatgtacaaggaacaacaataaatcatatggaaattta

SEQ ID NO: 329414 - DNA, 3413 bp, Homo sapiens
agctcggaccgtcattaggtcatgatgctgtgatgatacatacgtgataaattccagatacaggacaactgtccattccattacaacccagctcagtatgactatgacagagatgatgtgggagaccgctgtgacaactgtccctacaaccacaacccagatcaggcagacacagacaacaatggggaaggagacgcctgtgctgcagacattgatggagacggtatcctcaatgaacgggacaactgccagtacgtctacaatgtggaccagagagacactgatatggatggggttggagatcagtgtgacaattgccccttggaacacaatccggatcagctggactctgactcagaccgcattggagatacctgtgacaacaatcaggatattgatgaagatggccaccagaacaatctggacaactgtccctatgtgcccaatgccaaccaggctgaccatgacaaagatggcaagggagatgcctgtgaccacgatgatgacaacgatggcattcctgatgacaaggacaactgcagactcgtgcccaatcccgaccagaaggactctgacggcgatggtcgaggtgatgcctgcaaagatgattttgaccatgacagtgtgccagacatcgatgacatctgtcctgagaatgttgacatcagtgagaccgatttccgccgattccagatgattcctctggaccccaaagggacatcccaaaatgaccctaactgggttgtacgccatcagggtaaagaactcgtccagactgtcaactgtgatcctggactcgctgtaggttatgatgagtttaatgctgtggacttcagtggcaccttcttcatcaacaccgaaagggacgatgactatgctggatttgtctttggctaccagtccagcagccgcttttatgttgtgatgtggaagcaagtcacccagtcctactgggacaccaaccccacgagggctcagggatactcgggcctttctgtgaaagttgtaaactccaccacagggcctggcgagcacctgcggaacgccctgtggcacacaggaaacacccctggccaggtgcgcaccctgtggcatgaccctcgtcacataggctggaaagatttcaccgcctacagatggcgtctcagccacaggccaaagacgggtttcattagagtggtgatgtatgaagggaagaaaatcatggctgactcaggacccatctatgataaaacctatgctggtggtagactagggttgtttgtcttctctcaagaaatggtgttcttctctgacctgaaatacgaatgtagagatccctaatcatcaaattgttgattgaaagactgatcataaaccaatgctggtattgcaccttctggaactatgggcttgagaaaacccccaggatcacttctccttggcttccttcttttctgtgcttgcatcagtgtggactcctagaacgtgcgacctgcctcaagaaaatgcagttttcaaaaacagactcagcattcagcctccaatgaataagacatcttccaagcatataaacaattgctttggtttccttttgaaaaagcatctacttgcttcagttgggaaggtgcccattccactctgcctttgtcacagagcagggtgctattgtgaggccatctctgagcagtggactcaaaagcattttcaggcatgtcagagaagggaggactcactagaattagcaaacaaaaccaccctgacatcctccttcaggaacacggggagcagaggccaaagcactaaggggagggcgcatacccgagacgattgtatgaagaaaatatggaggaactgttacatgttcggtactaagtcattttcaggggattgaaagactattgctggatttcatgatgctgactggcgttagctgattaacccatgtaaataggcacttaaatagaagcaggaaagggagacaaagactggcttctggacttcctccctgatccccacccttactcatcacctgcagtggccagaattagggaatcagaatcaaaccagtgtaaggcagtgctggctgccattgcctggtcacattgaaattggtggcttcattctagatgtagcttgtgcagatgtagcaggaaaataggaaaacctaccatctcagtgagcaccagctgcctcccaaaggaggggcagccgtgcttatatttttatggttacaatggcacaaaattattatcaacctaactaaaacattccttttctcttttttcctgaattatcatggagttttctaattctctcttttggaatgtagattttttttaaatgctttacgatgtaaaatatttattttttacttattctggaagatctggctgaaggattattcatggaacaggaagaagcgtaaagactatccatgtcatctttgttgagagtcttcgtgactgtaagattgtaaatacagattatttattaactctgttctgcctggaaatttaggcttcatacggaaagtgtttgagagcaagtagttgacatttatcagcaaatctcttgcaagaacagcacaaggaaaatcagtctaataagctgctctgccccttgtgctcagagtggatgttatgggattctttttttctctgttttatcttttcaagtggaattagttggttatccatttgcaaatgttttaaattgcaaagaaagccatgaggtcttcaatactgttttaccccatcccttgtgcatatttccagggagaaggaaagcatatacacttttttctttcatttttccaaaagagaaaaaaatgacaaaaggtgaaacttacatacaaatattacctcatttgttgtgtgactgagtaaagaatttttggatcaagcggaaagagtttaagtgtctaacaaacttaaagctactgtagtacctaaaaagtcagtgttgtacatagcataaaaactctgcagagaagtattcccaataaggaaatagcattgaaatgttaaatacaatttctgaaagttatgttttttttctatcatctggtataccattgctttatttttataaattattttctcattgccattggaatagatatctcagattgtgtagatatgctatttaaataatttatcaggaaatactgcctgtagagttagtatttctatttttatataatgtttgcacactgaattgaagaattgttggttttttcttttttttggttttgttttttttttttttttttttgcttttgacctcccatttttactatttgccaatacctttttctaggaatgtgcttttttttgtacacatttttatccattttacattctaaagcagtgtaagttgtatattactgtttcttatgtacaaggaacaacaataaatcatatggaaattta

SEQ ID NO: 329415 - DNA, 2776 bp, Homo sapiens
agaggatccccggcatcttgctcccatcaggtctgaccaatattacgaccttcatcttgggttagatttaattgtttttgcttttctgatgggacgaagatgcatcttgctgccatcagggtaaagaactcgtccagactgtcaactgtgatcctggactcgctgtaggttatgatgagtttaatgctgtggacttcagtggcaccttcttcatcaacaccgaaagggacgatgactatgctggatttgtctttggctaccagtccagcagccgcttttatgttgtgatgtggaagcaagtcacccagtcctactgggacaccaaccccacgagggctcagggatactcgggcctttctgtgaaagttgtaaactccaccacagggcctggcgagcacctgcggaacgccctgtggcacacaggaaacacccctggccaggtgcgcaccctgtggcatgaccctcgtcacataggctggaaagatttcaccgcctacagatggcgtctcagccacaggccaaagacgggtttcattagagtggtgatgtatgaagggaagaaaatcatggctgactcaggacccatctatgataaaacctatgctggtggtagactagggttgtttgtcttctctcaagaaatggtgttcttctctgacctgaaatacgaatgtagagatccctaatcatcaaattgttgattgaaagactgatcataaaccaatgctggtattgcaccttctggaactatgggcttgagaaaacccccaggatcacttctccttggcttccttcttttctgtgcttgcatcagtgtggactcctagaacgtgcgacctgcctcaagaaaatgcagttttcaaaaacagactcagcattcagcctccaatgaataagacatcttccaagcatataaacaattgctttggtttccttttgaaaaagcatctacttgcttcagttgggaaggtgcccattccactctgcctttgtcacagagcagggtgctattgtgaggccatctctgagcagtggactcaaaagcattttcaggcatgtcagagaagggaggactcactagaattagcaaacaaaaccaccctgacatcctccttcaggaacacggggagcagaggccaaagcactaaggggagggcgcatacccgagacgattgtatgaagaaaatatggaggaactgttacatgttcggtactaagtcattttcaggggattgaaagactattgctggatttcatgatgctgactggcgttagctgattaacccatgtaaataggcacttaaatagaagcaggaaagggagacaaagactggcttctggacttcctccctgatccccacccttactcatcacctgcagtggccagaattagggaatcagaatcaaaccagtgtaaggcagtgctggctgccattgcctggtcacattgaaattggtggcttcattctagatgtagcttgtgcagatgtagcaggaaaataggaaaacctaccatctcagtgagcaccagctgcctcccaaaggaggggcagccgtgcttatatttttatggttacaatggcacaaaattattatcaacctaactaaaacattccttttctcttttttcctgaattatcatggagttttctaattctctcttttggaatgtagattttttttaaatgctttacgatgtaaaatatttattttttacttattctggaagatctggctgaaggattattcatggaacaggaagaagcgtaaagactatccatgtcatctttgttgagagtcttcgtgactgtaagattgtaaatacagattatttattaactctgttctgcctggaaatttaggcttcatacggaaagtgtttgagagcaagtagttgacatttatcagcaaatctcttgcaagaacagcacaaggaaaatcagtctaataagctgctctgccccttgtgctcagagtggatgttatgggattctttttttctctgttttatcttttcaagtggaattagttggttatccatttgcaaatgttttaaattgcaaagaaagccatgaggtcttcaatactgttttaccccatcccttgtgcatatttccagggagaaggaaagcatatacacttttttctttcatttttccaaaagagaaaaaaatgacaaaaggtgaaacttacatacaaatattacctcatttgttgtgtgactgagtaaagaatttttggatcaagcggaaagagtttaagtgtctaacaaacttaaagctactgtagtacctaaaaagtcagtgttgtacatagcataaaaactctgcagagaagtattcccaataaggaaatagcattgaaatgttaaatacaatttctgaaagttatgttttttttctatcatctggtataccattgctttatttttataaattattttctcattgccattggaatagatatctcagattgtgtagatatgctatttaaataatttatcaggaaatactgcctgtagagttagtatttctatttttatataatgtttgcacactgaattgaagaattgttggttttttcttttttttggttttgttttttttttttttttttttgcttttgacctcccatttttactatttgccaatacctttttctaggaatgtgcttttttttgtacacatttttatccattttacattctaaagcagtgtaagttgtatattactgtttcttatgtacaaggaacaacaataaatcatatggaaattta

SEQ ID NO: 329416 - DNA, 2174 bp, Homo sapiens
tcctagaggtaacccggtctcacttctagaatcctcacacatggtgttcttctctgagcctgaaatatgaatgtagatccctaatcatcaaattgttgattgaaagactgatcataaaccaatgctggtattgcaccttctggaactatgggcttgagaaaacccccaggatcacttctccttggcttccttcttttctgtgcttgcatcagtgtggactcctagaacgtgcgacctgcctcaagaaaatgcagttttcaaaaacagactcagcattcagcctccaatgaataagacatcttccaagcatataaacaattgctttggtttccttttgaaaaagcatctacttgcttcagttgggaaggtgcccattccactctgcctttgtcacagagcagggtgctattgtgaggccatctctgagcagtggactcaaaagcattttcaggcatgtcagagaagggaggactcactagaattagcaaacaaaaccaccctgacatcctccttcaggaacacggggagcagaggccaaagcactaaggggagggcgcatacccgagacgattgtatgaagaaaatatggaggaactgttacatgttcggtactaagtcattttcaggggattgaaagactattgctggatttcatgatgctgactggcgttagctgattaacccatgtaaataggcacttaaatagaagcaggaaagggagacaaagactggcttctggacttcctccctgatccccacccttactcatcacctgcagtggccagaattagggaatcagaatcaaaccagtgtaaggcagtgctggctgccattgcctggtcacattgaaattggtggcttcattctagatgtagcttgtgcagatgtagcaggaaaataggaaaacctaccatctcagtgagcaccagctgcctcccaaaggaggggcagccgtgcttatatttttatggttacaatggcacaaaattattatcaacctaactaaaacattccttttctcttttttcctgaattatcatggagttttctaattctctcttttggaatgtagattttttttaaatgctttacgatgtaaaatatttattttttacttattctggaagatctggctgaaggattattcatggaacaggaagaagcgtaaagactatccatgtcatctttgttgagagtcttcgtgactgtaagattgtaaatacagattatttattaactctgttctgcctggaaatttaggcttcatacggaaagtgtttgagagcaagtagttgacatttatcagcaaatctcttgcaagaacagcacaaggaaaatcagtctaataagctgctctgccccttgtgctcagagtggatgttatgggattctttttttctctgttttatcttttcaagtggaattagttggttatccatttgcaaatgttttaaattgcaaagaaagccatgaggtcttcaatactgttttaccccatcccttgtgcatatttccagggagaaggaaagcatatacacttttttctttcatttttccaaaagagaaaaaaatgacaaaaggtgaaacttacatacaaatattacctcatttgttgtgtgactgagtaaagaatttttggatcaagcggaaagagtttaagtgtctaacaaacttaaagctactgtagtacctaaaaagtcagtgttgtacatagcataaaaactctgcagagaagtattcccaataaggaaatagcattgaaatgttaaatacaatttctgaaagttatgttttttttctatcatctggtataccattgctttatttttataaattattttctcattgccattggaatagatatctcagattgtgtagatatgctatttaaataatttatcaggaaatactgcctgtagagttagtatttctatttttatataatgtttgcacactgaattgaagaattgttggttttttcttttttttggttttgttttttttttttttttttttgcttttgacctcccatttttactatttgccaatacctttttctaggaatgtgcttttttttgtacacatttttatccattttacattctaaagcagtgtaagttgtatattactgtttcttatgtacaaggaacaacaataaatcatatggaaattta

SEQ ID NO: 329417 - DNA, 3695 bp, Homo sapiens
tttctagctggaaagttgcgcgccaggcagcggggggcggagagaggagcccagactggcccccacctcccgcttcctgcccggccgccgcccattggccggaggaatccccaggaatgcgagcgcccctttaaaagcgcgcggctcctccgccttgccagccgctgcgcccgagctggcctgcgagttcagggctcctgtcgctctccaggagcaacctctactccggacgcacaggcattccccgcgcccctccagccctcgccgccctcgccaccgctcccggccgccgcgctccggtacacacaggatccctgctgggcaccaacagctccaccatggggctggcctggggactaggcgtcctgttcctgatgcatgtgtgtggcaccaaccgcattccagagtctggcggagacaacagcgtgtttgacatctttgaactcaccggggccgcccgcaaggggtctgggcgccgactggtgaagggccccgacccttccagcccagctttccgcatcgaggatgccaacctgatcccccctgtgcctgatgacaagttccaagacctggtggatgctgtgcgggcagaaaagggtttcctccttctggcatccctgaggcagatgaagaagacccggggcacgctgctggccctggagcggaaagaccactctggccaggtcttcagcgtggtgtccaatggcaaggcgggcaccctggacctcagcctgaccgtccaaggaaagcagcacgtggtgtctgtggaagaagctctcctggcaaccggccagtggaagagcatcaccctgtttgtgcaggaagacagggcccagctgtacatcgactgtgaaaagatggagaatgctgagttggacgtccccatccaaagcgtcttcaccagagacctggccagcatcgccagactccgcatcgcaaaggggggcgtcaatgacaatttccagggggtgctgcagaatgtgaggtttgtctttggaaccacaccagaagacatcctcaggaacaaaggctgctccagctctaccagtgtcctcctcacccttgacaacaacgtggtgaatggttccagccctgccatccgcactaactacattggccacaagacaaaggacttgcaagccatctgcggcatctcctgtgatgagctgtccagcatggtcctggaactcaggggcctgcgcaccattgtgaccacgctgcaggacagcatccgcaaagtgactgaagagaacaaagagttggccaatgagctgaggcggcctcccctatgctatcacaacggagttcagtacagaaataacgaggaatggactgttgatagctgcactgagtgtcactgtcagaactcagttaccatctgcaaaaaggtgtcctgccccatcatgccctgctccaatgccacagttcctgatggagaatgctgtcctcgctgttggcccagcgactctgcggacgatggctggtctccatggtccgagtggacctcctgttctacgagctgtggcaatggaattcagcagcgcggccgctcctgcgatagcctcaacaaccgatgtgagggctcctcggtccagacacggacctgccacattcaggagtgtgacaagagatttaaacaggatggtggctggagccactggtccccgtggtcatcttgttctgtgacatgtggtgatggtgtgatcacaaggatccggctctgcaactctcccagcccccagatgaacgggaaaccctgtgaaggcgaagcgcgggagaccaaagcctgcaagaaagacgcctgccccatcaatggaggctggggtccttggtcaccatgggacatctgttctgtcacctgtggaggaggggtacagaaacgtagtcgtctctgcaacaaccccacaccccagtttggaggcaaggactgcgttggtgatgtaacagaaaaccagatctgcaacaagcaggactgtccaattgatggatgcctgtccaatccctgctttgccggcgtgaagtgtactagctaccctgatggcagctggaaatgtggtgcttgtccccctggttacagtggaaatggcatccagtgcacagatgttgatgagtgcaaagaagtgcctgatgcctgcttcaaccacaatggagagcaccggtgtgagaacacggaccccggctacaactgcctgccctgccccccacgcttcaccggctcacagcccttcggccagggtgtcgaacatgccacggccaacaaacaggtgtgcaagccccgtaacccctgcacggatgggacccacgactgcaacaagaacgccaagtgcaactacctgggccactatagcgaccccatgtaccgctgcgagtgcaagcctggctacgctggcaatggcatcatctgcggggaggacacagacctggatggctggcccaatgagaacctggtgtgcgtggccaatgcgacttaccactgcaaaaaggataattgccccaaccttcccaactcagggcaggaagactatgacaaggatggaattggtgatgcctgtgatgatgacgatgacaatgataaaattccagatgacagggacaactgtccattccattacaacccagctcagtatgactatgacagagatgatgtgggagaccgctgtgacaactgtccctacaaccacaacccagatcaggcagacacagacaacaatggggaaggagacgcctgtgctgcagacattgatggagacggtatcctcaatgaacgggacaactgccagtacgtctacaatgtggaccagagagacactgatatggatggggttggagatcagtgtgacaattgccccttggaacacaatccggatcaggtaggtggatggactcctttcagagtctttcagtaaactgttggaatatccctttcatggcctttgaaaaatgagcttaacaaagttcaaacactttcattactgtggctccctggcttctcatagccaactggaatacgttcatgtaaataatttgcctgatgtgagctccttgcacagagtctcacagatctttagcatgaagatctggtaacttcagtcttaccttctgtaagaagggctactggacttgctcagcatcgtctaccattgttaagacaaattatacaaagcagacatctgtgactgacaactgtacaataatattaatcatatgtaatactaagagatggaaaaataaatgtgcataagcaaaataaccattttcatggctaatgatgtaatctagctataagaaaatcatcaaactaaggatacatccaaaaccaaagtaatttatccctgtcataaacattacccagacagtatacaacacagggaccagtggtctgtttccatcttttcaggacttttcagagaagtcgacgtgtcaacagttttacaactgaaaccttctaaggaaattctctgttataaagtatccagaaaatttcatttaacattaagatgtaaacagttaacatttcatttcatctttagtaattaaatatcactctatttgaccttatttagaaagttttatatgtaaaacatttttaaattatcccttctcagatttttatacgaaaacaaagataaaggaaaaaaacttttaaaatgtaattgctactattgctatctttctgcaggagtgtgtaaatagac

SEQ ID NO: 329418 - DNA, 1970 bp, Homo sapiens
tttctagctggaaagttgcgcgccaggcagcggggggcggagagaggagcccagactggcccccacctcccgcttcctgcccggccgccgcccattggccggaggaatccccaggaatgcgagcgcccctttaaaagcgcgcggctcctccgccttgccagccgctgcgcccgagctggcctgcgagttcagggctcctgtcgctctccaggagcaacctctactccggacgcacaggcattccccgcgcccctccagccctcgccgccctcgccaccgctcccggccgccgcgctccggtacacacaggatccctgctgggcaccaacagctccaccatggggctggcctggggactaggcgtcctgttcctgatgcatgtgtgtggcaccaaccgcattccagagtctggcggagacaacagcgtgtttgacatctttgaactcaccggggccgcccgcaaggggtctgggcgccgactggtgaagggccccgacccttccagcccagctttccgcatcgaggatgccaacctgatcccccctgtgcctgatgacaagttccaagacctggtggatgctgtgcgggcagaaaagggtttcctccttctggcatccctgaggcagatgaagaagacccggggcacgctgctggccctggagcggaaagaccactctggccaggtcttcagcgtggtgtccaatggcaaggcgggcaccctggacctcagcctgaccgtccaaggaaagcagcacgtggtgtctgtggaagaagctctcctggcaaccggccagtggaagagcatcaccctgtttgtgcaggaagacagggcccagctgtacatcgactgtgaaaagatggagaatgctgagttggacgtccccatccaaagcgtcttcaccagagacctggccagcatcgccagactccgcatcgcaaaggggggcgtcaatgacaatttccagggggtgctgcagaatgtgaggtttgtctttggaaccacaccagaagacatcctcaggaacaaaggctgctccagctctaccagtgtcctcctcacccttgacaacaacgtggtgaatggttccagccctgccatccgcactaactacattggccacaagacaaaggacttgcaagccatctgcggcatctcctgtgatgagctgtccagcatggtcctggaactcaggggcctgcgcaccattgtgaccacgctgcaggacagcatccgcaaagtgactgaagagaacaaagagttggccaatgagctgaggcggcctcccctatgctatcacaacggagttcagtacagaaataacgaggaatggactgttgatagctgcactgagtgtcactgtcagaactcagttaccatctgcaaaaaggtgtcctgccccatcatgccctgctccaatgccacagttcctgatggagaatgctgtcctcgctgttggcccagcgactctgcggacgatggctggtctccatggtccgagtggacctcctgttctacgagctgtggcaatggaattcagcagcgcggccgctcctgcgatagcctcaacaaccgatgtgagggctcctcggtccagacacggacctgccacattcaggagtgtgacaagagatttaaacaggatggtggctggagccactggtccccgtggtcatcttgttctgtgacatgtggtgatggtgtgatcacaaggatccggctctgcaactctcccagcccccagatgaacgggaaaccctgtgaaggcgaagcgcgggagaccaaagcctgcaagaaagacgcctgccccatcaatggaggctggggtccttggtcaccatgggacatctgttctgtcacctgtggaggaggggtacagaaacgtagtcgtctctgcaacaaccccacaccccagtttggaggcaaggactgcgttggtgatgctcaaaatctttggtaatcctttgaacag

SEQ ID NO: 329419 - DNA, 1787 bp, Homo sapiens
tttctagctggaaagttgcgcgccaggcagcggggggcggagagaggagcccagactggcccccacctcccgcttcctgcccggccgccgcccattggccggaggaatccccaggaatgcgagcgcccctttaaaagcgcgcggctcctccgccttgccagccgctgcgcccgagctggcctgcgagttcagggctcctgtcgctctccaggagcaacctctactccggacgcacaggcattccccgcgcccctccagccctcgccgccctcgccaccgctcccggccgccgcgctccggtacacacaggatccctgctgggcaccaacagctccaccatggggctggcctggggactaggcgtcctgttcctgatgcatgtgtgtggcaccaaccgcattccagagtctggcggagacaacagcgtgtttgacatctttgaactcaccggggccgcccgcaaggggtctgggcgccgactggtgaagggccccgacccttccagcccagctttccgcatcgaggatgccaacctgatcccccctgtgcctgatgacaagttccaagacctggtggatgctgtgcgggcagaaaagggtttcctccttctggcatccctgaggcagatgaagaagacccggggcacgctgctggccctggagcggaaagaccactctggccaggtcttcagcgtggtgtccaatggcaaggcgggcaccctggacctcagcctgaccgtccaaggaaagcagcacgtggtgtctgtggaagaagctctcctggcaaccggccagtggaagagcatcaccctgtttgtgcaggaagacagggcccagctgtacatcgactgtgaaaagatggagaatgctgagttggacgtccccatccaaagcgtcttcaccagagacctggccagcatcgccagactccgcatcgcaaaggggggcgtcaatgacaatttccaggtgaggcttcttctctgagccctgctccgtgggatcatctgctagacaggtgacctgccaggagggctacaggaaatcctgtctgtaaactaacgcagcagttctcagattttaggcagcatgagcatcacctggagggcttgtgaaagctcaccctgctgcaccccagccccagagtctgggattctgtaaaactgcaactctaacaagtaccaggtgatgctgatgccggtggtctgggaagcacactttgaaaactactcaaggaaacaagaaatggttttcctttagcagtcagcctgttcaagccttagatactccttaggctcttaagaaaagagcttatttcaaatgcattcccccaattttaatcttgtttgaaatggatactttctatgggcagaatcagtaccactttgctattggattcctcatggggatgcagctggtctcacataaaaggttaaaatagcagttagttgttgctgttacagcttcatctgtgccttaacttctagatctttgcaacggtggctttgaactcccacatttaactctttgacactggaaagtgtcattatatcctctaggcttaggatcagattccatttcctgtgtacccaagtaggctgataactgaattctttgtaaaatactcaagacttggcagaagtcacaattaagattttgaagttgtttggcgattaatgttgctgtgttattttgacatagtgatcttaagacagctctttgaagcttttagaacatctattgtatgcttttcctagcatacagacagtctcccccaaccccatccccacc

SEQ ID NO: 329420 - DNA, 1299 bp, Homo sapiens
tttctagctggaaagttgcgcgccaggcagcggggggcggagagaggagcccagactggcccccacctcccgcttcctgcccggccgccgcccattggccggaggaatccccaggaatgcgagcgcccctttaaaagcgcgcggctcctccgccttgccagccgctgcgcccgagctggcctgcgagttcagggctcctgtcgctctccaggagcaacctctactccggacgcacaggcattccccgcgcccctccagccctcgccgccctcgccaccgctcccggccgccgcgctccggtacacacaggatccctgctgggcaccaacagctccaccatggggctggcctggggactaggcgtcctgttcctgatgcatgtgtgtggcaccaaccgcattccagagtctggcggagacaacagcgtgtttgacatctttgaactcaccggggccgcccgcaaggggtctgggcgccgactggtgaagggccccgacccttccagcccagctttccgcatcgaggatgccaacctgatcccccctgtgcctgatgacaagttccaagacctggtggatgctgtgcgggcagaaaagggtttcctccttctggcatccctgaggcagatgaagaagacccggggcacgctgctggccctggagcggaaagaccactctggccaggtcttcagcgtggtgtccaatggcaaggcgggcaccctggacctcagcctgaccgtccaaggaaagcagcacgtggtgtctgtggaagaagctctcctggcaaccggccagtggaagagcatcaccctgtttgtgcaggaagacagggcccagctgtacatcgactgtgaaaagatggagaatgctgagttggacgtccccatccaaagcgtcttcaccagagacctggccagcatcgccagactccgcatcgcaaaggggggcgtcaatgacaatttccagggggtgctgcagaatgtgaggtttgtctttggaaccacaccagaagacatcctcaggaacaaaggctgctccagctcttgaacaatataaaacaagattgctatgtactttccatatctgtactgaaggaaaacttacttgttttagaaaaaccgtttcttgctattttttcctgtcttaatttacatattagtgaaaaaattgcctcatgatatacctcataaggccaaaaaattataatttgatgtcagcatagaatcacaatttcaagaaaataaaagggtcaaaataaaaatgtggcctcgttggcctcagcggtggagctctgcggccg

SEQ ID NO: 329421 - DNA, 364 bp, Homo sapiens
actatgacagagatgatgtgggagaccgctgtgacaactgtccctacaaccacaacccagatcaggcagacacagacaacaatggggaaggagacgcctgtgctgcagacattgatggagacggtaaggtgctgcctgatcagagggcccgcgggagacagggacatgcacagctttccaaacgtacttctgtctagtcctggctattagtatgcactttggtggaaacatccaaggctggagagcccagctcttatttgtcccttgttctcttcaggtatcctcaatgaacgggacaactgccagtacgtctacaatgtggaccagagagacactgatatggatggggttggagatcagtgtg

SEQ ID NO: 329422 - DNA, 570 bp, Homo sapiens
tacctgcatccttcacaccaaatgaaacgtcttctaccactaagaactcaagaggctggttggtaagagtatctatttgaagttttcattttgtttcttgccagctaccagtgtcctcctcacccttgacaacaacgtggtgaatggttccagccctgccatccgcactaactacattggccacaagacaaaggacttgcaagccatctgcggcatctcctgtgatgagctgtccagcatggtcctggaactcaggggcctgcgcaccattgtgaccacgctgcaggacagcatccgcaaagtggtcagtggcctctgcacccagcccgttagcatgaaccctggaaggtttatcgcagatggtcccaaatgactgaaaatgcggggggacactaatgatattctctcccatttagactgaagagaacaaagagttggccaatgagctgaggcggcctcccctatgctatcacaacggagttcagtacagaaataacgaggaatggactgttgatagctgcactgagtgtcactgtcaggtaagggaccttcaccagccagaataagaat

SEQ ID NO: 329423 - DNA, 429 bp, Homo sapiens
ggcacagctgtgtagattgaagaaatgaaaccaaggctcaaagcatttgacaggatgaagggaccaaatgccaacttagacaagatagtgacatttctgacaccagtaataataatagcactttagaattttgctgaactcttgcttttttgacctcaggcgatggtcgaggtgatgcctgcaaagatgattttgaccatgacagtgtgccagacatcgatgacatctgtcctgagaatgttgacatcagtgagaccgatttccgccgattccagatgattcctctggaccccaaagggacatcccaaaatgaccctaactgggttgtacgccatcagggtaaagaactcgtccagactgtcaactgtgatcctggactcgctgtaggtgagtagcgagttcttagatcctaagagactgatgcataca

SEQ ID NO: 329424 - DNA, 7161 bp, Homo sapiens
tttctagctggaaagttgcgcgccaggcagcggggggcggagagaggagcccagactggcccccacctcccgcttcctgcccggccgccgcccattggccggaggaatccccaggaatgcgagcgcccctttaaaagcgcgcggctcctccgccttgccagccgctgcgcccgagctggcctgcgagttcagggctcctgtcgctctccaggagcaacctctactccggacgcacaggcattccccgcgcccctccagccctcgccgccctcgccaccgctcccggccgccgcgctccggtacacacaggatccctgctgggcaccaacagctccaccatggggctggcctggggactaggcgtcctgttcctgatgcatgtgtgtggcaccaaccgcattccagagtctggcggagacaacagcgtgtttgacatctttgaactcaccggggccgcccgcaaggggtctgggcgccgactggtgaagggccccgacccttccagcccagctttccgcatcgaggatgccaacctgatcccccctgtgcctgatgacaagttccaagacctggtggatgctgtgcgggcagaaaagggtttcctccttctggcatccctgaggcagatgaagaagacccggggcacgctgctggccctggagcggaaagaccactctggccaggtcttcagcgtggtgtccaatggcaaggcgggcaccctggacctcagcctgaccgtccaaggaaagcagcacgtggtgtctgtggaagaagctctcctggcaaccggccagtggaagagcatcaccctgtttgtgcaggaagacagggcccagctgtacatcgactgtgaaaagatggagaatgctgagttggacgtccccatccaaagcgtcttcaccagagacctggccagcatcgccagactccgcatcgcaaaggggggcgtcaatgacaatttccagggggtgctgcagaatgtgaggtttgtctttggaaccacaccagaagacatcctcaggaacaaaggctgctccagctctaccagtgtcctcctcacccttgacaacaacgtggtgaatggttccagccctgccatccgcactaactacattggccacaagacaaaggacttgcaagccatctgcggcatctcctgtgatgagctgtccagcatggtcctggaactcaggggcctgcgcaccattgtgaccacgctgcaggacagcatccgcaaagtgactgaagagaacaaagagttggccaatgagctgaggcggcctcccctatgctatcacaacggagttcagtacagaaataacgaggaatggactgttgatagctgcactgagtgtcactgtcagaactcagttaccatctgcaaaaaggtgtcctgccccatcatgccctgctccaatgccacagttcctgatggagaatgctgtcctcgctgttggcccagcgactctgcggacgatggctggtctccatggtccgagtggacctcctgttctacgagctgtggcaatggaattcagcagcgcggccgctcctgcgatagcctcaacaaccgatgtgagggctcctcggtccagacacggacctgccacattcaggagtgtgacaagagatttaaacaggatggtggctggagccactggtccccgtggtcatcttgttctgtgacatgtggtgatggtgtgatcacaaggatccggctctgcaactctcccagcccccagatgaacgggaaaccctgtgaaggcgaagcgcgggagaccaaagcctgcaagaaagacgcctgccccatcaatggaggctggggtccttggtcaccatgggacatctgttctgtcacctgtggaggaggggtacagaaacgtagtcgtctctgcaacaaccccacaccccagtttggaggcaaggactgcgttggtgatgtaacagaaaaccagatctgcaacaagcaggactgtccaattgatggatgcctgtccaatccctgctttgccggcgtgaagtgtactagctaccctgatggcagctggaaatgtggtgcttgtccccctggttacagtggaaatggcatccagtgcacagatgttgatgagtgcaaagaagtgcctgatgcctgcttcaaccacaatggagagcaccggtgtgagaacacggaccccggctacaactgcctgccctgccccccacgcttcaccggctcacagcccttcggccagggtgtcgaacatgccacggccaacaaacaggtgtgcaagccccgtaacccctgcacggatgggacccacgactgcaacaagaacgccaagtgcaactacctgggccactatagcgaccccatgtaccgctgcgagtgcaagcctggctacgctggcaatggcatcatctgcggggaggacacagacctggatggctggcccaatgagaacctggtgtgcgtggccaatgcgacttaccactgcaaaaaggataattgccccaaccttcccaactcagggcaggaagactatgacaaggatggaattggtgatgcctgtgatgatgacgatgacaatgataaaattccagatgacagggacaactgtccattccattacaacccagctcagtatgactatgacagagatgatgtgggagaccgctgtgacaactgtccctacaaccacaacccagatcaggcagacacagacaacaatggggaaggagacgcctgtgctgcagacattgatggagacggtatcctcaatgaacgggacaactgccagtacgtctacaatgtggaccagagagacactgatatggatggggttggagatcagtgtgacaattgccccttggaacacaatccggatcagctggactctgactcagaccgcattggagatacctgtgacaacaatcaggatattgatgaagatggccaccagaacaatctggacaactgtccctatgtgcccaatgccaaccaggctgaccatgacaaagatggcaagggagatgcctgtgaccacgatgatgacaacgatggcattcctgatgacaaggacaactgcagactcgtgcccaatcccgaccagaaggactctgacggcgatggtcgaggtgatgcctgcaaagatgattttgaccatgacagtgtgccagacatcgatgacatctgtcctgagaatgttgacatcagtgagaccgatttccgccgattccagatgattcctctggaccccaaagggacatcccaaaatgaccctaactgggttgtacgccatcagggtaaagaactcgtccagactgtcaactgtgatcctggactcgctgtaggttatgatgagtttaatgctgtggacttcagtggcaccttcttcatcaacaccgaaagggacgatgactatgctggatttgtctttggctaccagtccagcagccgcttttatgttgtgatgtggaagcaagtcacccagtcctactgggacaccaaccccacgagggctcagggatactcgggcctttctgtgaaagttgtaaactccaccacagggcctggcgagcacctgcggaacgccctgtggcacacaggaaacacccctggccaggtgcgcaccctgtggcatgaccctcgtcacataggctggaaagatttcaccgcctacagatggcgtctcagccacaggccaaagacgggtttcattagagtggtgatgtatgaagggaagaaaatcatggctgactcaggacccatctatgataaaacctatgctggtggtagactagggttgtttgtcttctctcaagaaatggtgttcttctctgacctgaaatacgaatgtagagatccctaatcatcaaattgttgattgaaagactgatcataaaccaatgctggtattgcaccttctggaactatgggcttgagaaaacccccaggatcacttctccttggcttccttcttttctgtgcttgcatcagtgtggactcctagaacgtgcgacctgcctcaagaaaatgcagttttcaaaaacagactcagcattcagcctccaatgaataagacatcttccaagcatataaacaattgctttggtttccttttgaaaaagcatctacttgcttcagttgggaaggtgcccattccactctgcctttgtcacagagcagggtgctattgtgaggccatctctgagcagtggactcaaaagcattttcaggcatgtcagagaagggaggactcactagaattagcaaacaaaaccaccctgacatcctccttcaggaacacggggagcagaggccaaagcactaaggggagggcgcatacccgagacgattgtatgaagaaaatatggaggaactgttacatgttcggtactaagtcattttcaggggattgaaagactattgctggatttcatgatgctgactggcgttagctgattaacccatgtaaataggcacttaaatagaagcaggaaagggagacaaagactggcttctggacttcctccctgatccccacccttactcatcacctgcagtggccagaattagggaatcagaatcaaaccagtgtaaggcagtgctggctgccattgcctggtcacattgaaattggtggcttcattctagatgtagcttgtgcagatgtagcaggaaaataggaaaacctaccatctcagtgagcaccagctgcctcccaaaggaggggcagccgtgcttatatttttatggttacaatggcacaaaattattatcaacctaactaaaacattccttttctcttttttcctgaattatcatggagttttctaattctctcttttggaatgtagattttttttaaatgctttacgatgtaaaatatttattttttacttattctggaagatctggctgaaggattattcatggaacaggaagaagcgtaaagactatccatgtcatctttgttgagagtcttcgtgactgtaagattgtaaatacagattatttattaactctgttctgcctggaaatttaggcttcatacggaaagtgtttgagagcaagtagttgacatttatcagcaaatctcttgcaagaacagcacaaggaaaatcagtctaataagctgctctgccccttgtgctcagagtggatgttatgggattctttttttctctgttttatcttttcaagtggaattagttggttatccatttgcaaatgttttaaattgcaaagaaagccatgaggtcttcaatactgttttaccccatcccttgtgcatatttccagggagaaggaaagcatatacacttttttctttcatttttccaaaagagaaaaaaatgacaaaaggtgaaacttacatacaaatattacctcatttgttgtgtgactgagtaaagaatttttggatcaagcggaaagagtttaagtgtctaacaaacttaaagctactgtagtacctaaaaagtcagtgttgtacatagcataaaaactctgcagagaagtattcccaataaggaaatagcattgaaatgttaaatacaatttctgaaagttatgttttttttctatcatctggtataccattgctttatttttataaattattttctcattgccattggaatagatatctcagattgtgtagatatgctatttaaataatttatcaggaaatactgcctgtagagttagtatttctatttttatataatgtttgcacactgaattgaagaattgttggttttttcttttttttggttttgttttttttttttttttttttgcttttgacctcccatttttactatttgccaatacctttttctaggaatgtgcttttttttgtacacatttttatccattttacattctaaagcagtgtaagttgtatattactgtttcttatgtacaaggaacaacaataaatcatatggaaatttatatttatacttactgtatccatgcttatttgttctctactggctttatgtcatgaagtatatgcgtaaataccattcataaatcaatatagcatatacaaaaataaattacagtaagtcatagcaacattcacagtttgtatgtgattgagaaagactgagttgctcaggcctaggcttagaatttgctgcgtttgtggaataaaagaacaaaatgatacattagcctgccatatcaaaaacatataaaagagaaattatccctaagtcaagggcccccataagaataaaatttcttattaaggtcattagatgtcattgaatccttttcaaagtgcagtatgaaaacaaagggaaaaacactgaagcacacgcaactctcacagcgacattttctgacccacgaatgatgccttgggtgggcaacacgattgcatgttgtggagacacttcggaagtaaatgtggatgagggaggagctgtccttgcaatgttgagccaagcattacagatacctcctcttgaagaaggaataataagtttaatcaaaaaagaagactaaaaaatgtaaaatttggaaggaatccataaatgcgtgtgtgtctaaatacaaattatcatgtgaagaaaaggcccaagtgtaccaataagcagaccttgatttttggatgggctaattatgaatgtggaatactgaccagttaatttccagttttaatgaaaacagatcaaagaagaaattttatgagtaggttaaaggtctggctttgaggtctattaaacactagaaaggactggctgggtgagataaaatcttccttgttgattttcactctcattctataaatactcatctttctgagtagccatgatcacatacaaatgtaaattgccaaatcattttatagtaccaaggtgaagaagcaggaactagaaagtgttgataatagctgtggagttaggaaaactgatgtgaaggaaataattctttgaaatggcaaagaattaaataccatcattcattatcagaagagttcaacgtttgaagtgctgggagataattctaattcattcttggatagtgaagcaaaactgattgaaaataccaagataagacagaaaaagtgactggaaagaggagcttttcttccaggcatgttccagtttcaccctaagactgaccttcaaataatcaggttgtactgaaataaaggacttgtt

SEQ ID NO: 329425 - DNA, 6160 bp, Homo sapiens
tttctagctggaaagttgcgcgccaggcagcggggggcggagagaggagcccagactggcccccacctcccgcttcctgcccggccgccgcccattggccggaggaatccccaggaatgcgagcgcccctttaaaagcgcgcggctcctccgccttgccagccgctgcgcccgagctggcctgcgagttcagggctcctgtcgctctccaggagcaacctctactccggacgcacaggcattccccgcgcccctccagccctcgccgccctcgccaccgctcccggccgccgcgctccggtacacacaggatccctgctgggcaccaacagctccaccatggggctggcctggggactaggcgtcctgttcctgatgcatgtgtgtggcaccaaccgcattccagagtctggcggagacaacagcgtgtttgacatctttgaactcaccggggccgcccgcaaggggtctgggcgccgactggtgaagggccccgacccttccagcccagctttccgcatcgaggatgccaacctgatcccccctgtgcctgatgacaagttccaagacctggtggatgctgtgcgggcagaaaagggtttcctccttctggcatccctgaggcagatgaagaagacccggggcacgctgctggccctggagcggaaagaccactctggccaggtcttcagcgtggtgtccaatggcaaggcgggcaccctggacctcagcctgaccgtccaaggaaagcagcacgtggtgtctgtggaagaagctctcctggcaaccggccagtggaagagcatcaccctgtttgtgcaggaagacagggcccagctgtacatcgactgtgaaaagatggagaatgctgagttggacgtccccatccaaagcgtcttcaccagagacctggccagcatcgccagactccgcatcgcaaaggggggcgtcaatgacaatttccagggggtgctgcagaatgtgaggtttgtctttggaaccacaccagaagacatcctcaggaacaaaggctgctccagctctaccagtgtcctcctcacccttgacaacaacgtggtgaatggttccagccctgccatccgcactaactacattggccacaagacaaaggacttgcaagccatctgcggcatctcctgtgatgagctgtccagcatggtcctggaactcaggggcctgcgcaccattgtgaccacgctgcaggacagcatccgcaaagtgactgaagagaacaaagagttggccaatgagctgaggcggcctcccctatgctatcacaacggagttcagtacagaaataacgaggaatggactgttgatagctgcactgagtgtcactgtcagaactcagttaccatctgcaaaaaggtgtcctgccccatcatgccctgctccaatgccacagttcctgatggagaatgctgtcctcgctgttggcccagcgactctgcggacgatggctggtctccatggtccgagtggacctcctgttctacgagctgtggcaatggaattcagcagcgcggccgctcctgcgatagcctcaacaaccgatgtgagggctcctcggtccagacacggacctgccacattcaggagtgtgacaagagatttaaacaggatggtggctggagccactggtccccgtggtcatcttgttctgtgacatgtggtgatggtgtgatcacaaggatccggctctgcaactctcccagcccccagatgaacgggaaaccctgtgaaggcgaagcgcgggagaccaaagcctgcaagaaagacgcctgccccatcaatggaggctggggtccttggtcaccatgggacatctgttctgtcacctgtggaggaggggtacagaaacgtagtcgtctctgcaacaaccccacaccccagtttggaggcaaggactgcgttggtgatgtaacagaaaaccagatctgcaacaagcaggactgtccaattgatggatgcctgtccaatccctgctttgccggcgtgaagtgtactagctaccctgatggcagctggaaatgtggtgcttgtccccctggttacagtggaaatggcatccagtgcacagatgttgatgagtgcaaagaagtgcctgatgcctgcttcaaccacaatggagagcaccggtgtgagaacacggaccccggctacaactgcctgccctgccccccacgcttcaccggctcacagcccttcggccagggtgtcgaacatgccacggccaacaaacaggtgtgcaagccccgtaacccctgcacggatgggacccacgactgcaacaagaacgccaagtgcaactacctgggccactatagcgaccccatgtaccgctgcgagtgcaagcctggctacgctggcaatggcatcatctgcggggaggacacagacctggatggctggcccaatgagaacctggtgtgcgtggccaatgcgacttaccactgcaaaaaggataattgccccaaccttcccaactcagggcaggaagactatgacaaggatggaattggtgatgcctgtgatgatgacgatgacaatgataaaattccagatgacagggacaactgtccattccattacaacccagctcagtatgactatgacagagatgatgtgggagaccgctgtgacaactgtccctacaaccacaacccagatcaggcagacacagacaacaatggggaaggagacgcctgtgctgcagacattgatggagacggtatcctcaatgaacgggacaactgccagtacgtctacaatgtggaccagagagacactgatatggatggggttggagatcagtgtgacaattgccccttggaacacaatccggatcagctggactctgactcagaccgcattggagatacctgtgacaacaatcaggatattgatgaagatggccaccagaacaatctggacaactgtccctatgtgcccaatgccaaccaggctgaccatgacaaagatggcaagggagatgcctgtgaccacgatgatgacaacgatggcattcctgatgacaaggacaactgcagactcgtgcccaatcccgaccagaaggactctgacggcgatggtcgaggtgatgcctgcaaagatgattttgaccatgacagtgtgccagacatcgatgacatctgtcctgagaatgttgacatcagtgagaccgatttccgccgattccagatgattcctctggaccccaaagggacatcccaaaatgaccctaactgggttgtacgccatcagggtaaagaactcgtccagactgtcaactgtgatcctggactcgctgtaggttatgatgagtttaatgctgtggacttcagtggcaccttcttcatcaacaccgaaagggacgatgactatgctggatttgtctttggctaccagtccagcagccgcttttatgttgtgatgtggaagcaagtcacccagtcctactgggacaccaaccccacgagggctcagggatactcgggcctttctgtgaaagttgtaaactccaccacagggcctggcgagcacctgcggaacgccctgtggcacacaggaaacacccctggccaggtgcgcaccctgtggcatgaccctcgtcacataggctggaaagatttcaccgcctacagatggcgtctcagccacaggccaaagacgggtttcattagagtggtgatgtatgaagggaagaaaatcatggctgactcaggacccatctatgataaaacctatgctggtggtagactagggttgtttgtcttctctcaagaaatggtgttcttctctgacctgaaatacgaatgtagagatccctaatcatcaaattgttgattgaaagactgatcataaaccaatgctggtattgcaccttctggaactatgggcttgagaaaacccccaggatcacttctccttggcttccttcttttctgtgcttgcatcagtgtggactcctagaacgtgcgacctgcctcaagaaaatgcagttttcaaaaacagactcagcattcagcctccaatgaataagacatcttccaagcatataaacaattgctttggtttccttttgaaaaagcatctacttgcttcagttgggaaggtgcccattccactctgcctttgtcacagagcagggtgctattgtgaggccatctctgagcagtggactcaaaagcattttcaggcatgtcagagaagggaggactcactagaattagcaaacaaaaccaccctgacatcctccttcaggaacacggggagcagaggccaaagcactaaggggagggcgcatacccgagacgattgtatgaagaaaatatggaggaactgttacatgttcggtactaagtcattttcaggggattgaaagactattgctggatttcatgatgctgactggcgttagctgattaacccatgtaaataggcacttaaatagaagcaggaaagggagacaaagactggcttctggacttcctccctgatccccacccttactcatcacctgcagtggccagaattagggaatcagaatcaaaccagtgtaaggcagtgctggctgccattgcctggtcacattgaaattggtggcttcattctagatgtagcttgtgcagatgtagcaggaaaataggaaaacctaccatctcagtgagcaccagctgcctcccaaaggaggggcagccgtgcttatatttttatggttacaatggcacaaaattattatcaacctaactaaaacattccttttctcttttttcctgaattatcatggagttttctaattctctcttttggaatgtagattttttttaaatgctttacgatgtaaaatatttattttttacttattctggaagatctggctgaaggattattcatggaacaggaagaagcgtaaagactatccatgtcatctttgttgagagtcttcgtgactgtaagattgtaaatacagattatttattaactctgttctgcctggaaatttaggcttcatacggaaagtgtttgagagcaagtagttgacatttatcagcaaatctcttgcaagaacagcacaaggaaaatcagtctaataagctgctctgccccttgtgctcagagtggatgttatgggattctttttttctctgttttatcttttcaagtggaattagttggttatccatttgcaaatgttttaaattgcaaagaaagccatgaggtcttcaatactgttttaccccatcccttgtgcatatttccagggagaaggaaagcatatacacttttttctttcatttttccaaaagagaaaaaaatgacaaaaggtgaaacttacatacaaatattacctcatttgttgtgtgactgagtaaagaatttttggatcaagcggaaagagtttaagtgtctaacaaacttaaagctactgtagtacctaaaaagtcagtgttgtacatagcataaaaactctgcagagaagtattcccaataaggaaatagcattgaaatgttaaatacaatttctgaaagttatgttttttttctatcatctggtataccattgctttatttttataaattattttctcattgccattggaatagatatctcagattgtgtagatatgctatttaaataatttatcaggaaatactgcctgtagagttagtatttctatttttatataatgtttgcacactgaattgaagaattgttggttttttcttttttttggttttgttttttttttttttttttttgcttttgacctcccatttttactatttgccaatacctttttctaggaatgtgcttttttttgtacacatttttatccattttacattctaaagcagtgtaagttgtatattactgtttcttatgtacaaggaacaacaataaatcatatggaaatttatatttatacttactgtatccatgcttatttgttctctactggctttatgtcatgaagtatatgcgtaaataccattcataaatcaatatagcatatacaaaaataaattacagtaagtcatagcaacattcacagtttgtatgtgattgagaaagactgagttgctcaggcctaggcttagaatttgctgcgtttgtggaataaaagaacaaaatgata

SEQ ID NO: 329426 - DNA, 6391 bp, Homo sapiens
tttctagctggaaagttgcgcgccaggcagcggggggcggagagaggagcccagactggcccccacctcccgcttcctgcccggccgccgcccattggccggaggaatccccaggaatgcgagcgcccctttaaaagcgcgcggctcctccgccttgccagccgctgcgcccgagctggcctgcgagttcagggctcctgtcgctctccaggagcaacctctactccggacgcacaggcattccccgcgcccctccagccctcgccgccctcgccaccgctcccggccgccgcgctccggtacacacaggatccctgctgggcaccaacagctccaccatggggctggcctggggactaggcgtcctgttcctgatgcatgtgtgtggcaccaaccgcattccagagtctggcggagacaacagcgtgtttgacatctttgaactcaccggggccgcccgcaaggggtctgggcgccgactggtgaagggccccgacccttccagcccagctttccgcatcgaggatgccaacctgatcccccctgtgcctgatgacaagttccaagacctggtggatgctgtgcgggcagaaaagggtttcctccttctggcatccctgaggcagatgaagaagacccggggcacgctgctggccctggagcggaaagaccactctggccaggtcttcagcgtggtgtccaatggcaaggcgggcaccctggacctcagcctgaccgtccaaggaaagcagcacgtggtgtctgtggaagaagctctcctggcaaccggccagtggaagagcatcaccctgtttgtgcaggaagacagggcccagctgtacatcgactgtgaaaagatggagaatgctgagttggacgtccccatccaaagcgtcttcaccagagacctggccagcatcgccagactccgcatcgcaaaggggggcgtcaatgacaatttccagggggtgctgcagaatgtgaggtttgtctttggaaccacaccagaagacatcctcaggaacaaaggctgctccagctctaccagtgtcctcctcacccttgacaacaacgtggtgaatggttccagccctgccatccgcactaactacattggccacaagacaaaggacttgcaagccatctgcggcatctcctgtgatgagctgtccagcatggtcctggaactcaggggcctgcgcaccattgtgaccacgctgcaggacagcatccgcaaagtgactgaagagaacaaagagttggccaatgagctgaggcggcctcccctatgctatcacaacggagttcagtacagaaataacgaggaatggactgttgatagctgcactgagtgtcactgtcagaactcagttaccatctgcaaaaaggtgtcctgccccatcatgccctgctccaatgccacagttcctgatggagaatgctgtcctcgctgttggcccagcgactctgcggacgatggctggtctccatggtccgagtggacctcctgttctacgagctgtggcaatggaattcagcagcgcggccgctcctgcgatagcctcaacaaccgatgtgagggctcctcggtccagacacggacctgccacattcaggagtgtgacaagagatttaaacaggatggtggctggagccactggtccccgtggtcatcttgttctgtgacatgtggtgatggtgtgatcacaaggatccggctctgcaactctcccagcccccagatgaacgggaaaccctgtgaaggcgaagcgcgggagaccaaagcctgcaagaaagacgcctgccccatcaatggaggctggggtccttggtcaccatgggacatctgttctgtcacctgtggaggaggggtacagaaacgtagtcgtctctgcaacaaccccacaccccagtttggaggcaaggactgcgttggtgatgtaacagaaaaccagatctgcaacaagcaggactgtccaattgatggatgcctgtccaatccctgctttgccggcgtgaagtgtactagctaccctgatggcagctggaaatgtggtgcttgtccccctggttacagtggaaatggcatccagtgcacagatgttgatgagtgcaaagaagtgcctgatgcctgcttcaaccacaatggagagcaccggtgtgagaacacggaccccggctacaactgcctgccctgccccccacgcttcaccggctcacagcccttcggccagggtgtcgaacatgccacggccaacaaacaggtacagtcaactagacgagtaaaccagaggacaggagagctgtccttgaccaaaataactgggagcgggaggaatgtaatttcatacccttcaccaaaaaaaaaagggcgaggagatgaatgtacggtctagttttagaaacgtgattagaaaatccatggtaaatcctgcaggggaaaaacagtcttccatatttaaaaatgctgctctggaataagttgtgagcagatggacttgtaaacgcctaggtgctgagcaaattcaagaaaaataaacataaagcaaagtttgcttatagcctcagggagaatggggagggacagaggtaacccacactcttccaaatggagcctctgtctactcagagatgacagggatctggattcttgtttccatgatatctgaggattctcaaaagctctgtgtaacagcagcatggtgtaccctcaggtgtgcaagccccgtaacccctgcacggatgggacccacgactgcaacaagaacgccaagtgcaactacctgggccactatagcgaccccatgtaccgctgcgagtgcaagcctggctacgctggcaatggcatcatctgcggggaggacacagacctggatggctggcccaatgagaacctggtgtgcgtggccaatgcgacttaccactgcaaaaaggataattgccccaaccttcccaactcagggcaggaagactatgacaaggatggaattggtgatgcctgtgatgatgacgatgacaatgataaaattccagatgacagggacaactgtccattccattacaacccagctcagtatgactatgacagagatgatgtgggagaccgctgtgacaactgtccctacaaccacaacccagatcaggcagacacagacaacaatggggaaggagacgcctgtgctgcagacattgatggagacggtatcctcaatgaacgggacaactgccagtacgtctacaatgtggaccagagagacactgatatggatggggttggagatcagtgtgacaattgccccttggaacacaatccggatcagctggactctgactcagaccgcattggagatacctgtgacaacaatcaggatattgatgaagatggccaccagaacaatctggacaactgtccctatgtgcccaatgccaaccaggctgaccatgacaaagatggcaagggagatgcctgtgaccacgatgatgacaacgatggcattcctgatgacaaggacaactgcagactcgtgcccaatcccgaccagaaggactctgacggcgatggtcgaggtgatgcctgcaaagatgattttgaccatgacagtgtgccagacatcgatgacatctgtcctgagaatgttgacatcagtgagaccgatttccgccgattccagatgattcctctggaccccaaagggacatcccaaaatgaccctaactgggttgtacgccatcagggtaaagaactcgtccagactgtcaactgtgatcctggactcgctgtaggttatgatgagtttaatgctgtggacttcagtggcaccttcttcatcaacaccgaaagggacgatgactatgctggatttgtctttggctaccagtccagcagccgcttttatgttgtgatgtggaagcaagtcacccagtcctactgggacaccaaccccacgagggctcagggatactcgggcctttctgtgaaagttgtaaactccaccacagggcctggcgagcacctgcggaacgccctgtggcacacaggaaacacccctggccaggtgcgcaccctgtggcatgaccctcgtcacataggctggaaagatttcaccgcctacagatggcgtctcagccacaggccaaagacgggtttcattagagtggtgatgtatgaagggaagaaaatcatggctgactcaggacccatctatgataaaacctatgctggtggtagactagggttgtttgtcttctctcaagaaatggtgttcttctctgacctgaaatacgaatgtagagatccctaatcatcaaattgttgattgaaagactgatcataaaccaatgctggtattgcaccttctggaactatgggcttgagaaaacccccaggatcacttctccttggcttccttcttttctgtgcttgcatcagtgtggactcctagaacgtgcgacctgcctcaagaaaatgcagttttcaaaaacagactcagcattcagcctccaatgaataagacatcttccaagcatataaacaattgctttggtttccttttgaaaaagcatctacttgcttcagttgggaaggtgcccattccactctgcctttgtcacagagcagggtgctattgtgaggccatctctgagcagtggactcaaaagcattttcaggcatgtcagagaagggaggactcactagaattagcaaacaaaaccaccctgacatcctccttcaggaacacggggagcagaggccaaagcactaaggggagggcgcatacccgagacgattgtatgaagaaaatatggaggaactgttacatgttcggtactaagtcattttcaggggattgaaagactattgctggatttcatgatgctgactggcgttagctgattaacccatgtaaataggcacttaaatagaagcaggaaagggagacaaagactggcttctggacttcctccctgatccccacccttactcatcacctgcagtggccagaattagggaatcagaatcaaaccagtgtaaggcagtgctggctgccattgcctggtcacattgaaattggtggcttcattctagatgtagcttgtgcagatgtagcaggaaaataggaaaacctaccatctcagtgagcaccagctgcctcccaaaggaggggcagccgtgcttatatttttatggttacaatggcacaaaattattatcaacctaactaaaacattccttttctcttttttcctgaattatcatggagttttctaattctctcttttggaatgtagattttttttaaatgctttacgatgtaaaatatttattttttacttattctggaagatctggctgaaggattattcatggaacaggaagaagcgtaaagactatccatgtcatctttgttgagagtcttcgtgactgtaagattgtaaatacagattatttattaactctgttctgcctggaaatttaggcttcatacggaaagtgtttgagagcaagtagttgacatttatcagcaaatctcttgcaagaacagcacaaggaaaatcagtctaataagctgctctgccccttgtgctcagagtggatgttatgggattctttttttctctgttttatcttttcaagtggaattagttggttatccatttgcaaatgttttaaattgcaaagaaagccatgaggtcttcaatactgttttaccccatcccttgtgcatatttccagggagaaggaaagcatatacacttttttctttcatttttccaaaagagaaaaaaatgacaaaaggtgaaacttacatacaaatattacctcatttgttgtgtgactgagtaaagaatttttggatcaagcggaaagagtttaagtgtctaacaaacttaaagctactgtagtacctaaaaagtcagtgttgtacatagcataaaaactctgcagagaagtattcccaataaggaaatagcattgaaatgttaaatacaatttctgaaagttatgttttttttctatcatctggtataccattgctttatttttataaattattttctcattgccattggaatagatatctcagattgtgtagatatgctatttaaataatttatcaggaaatactgcctgtagagttagtatttctatttttatataatgtttgcacactgaattgaagaattgttggttttttcttttttttggttttgttttttttttttttttttttgcttttgacctcccatttttactatttgccaatacctttttctaggaatgtgcttttttttgtacacatttttatccattttacattctaaagcagtgtaagttgtatattactgtttcttatgtacaaggaacaacaataaatcatatggaaattta

SEQ ID NO: 329427 - DNA, 6957 bp, Homo sapiens
tttctagctggaaagttgcgcgccaggcagcggggggcggagagaggagcccagactggcccccacctcccgcttcctgcccggccgccgcccattggccggaggaatccccaggaatgcgagcgcccctttaaaagcgcgcggctcctccgccttgccagccgctgcgcccgagctggcctgcgagttcagggctcctgtcgctctccaggagcaacctctactccggacgcacaggcattccccgcgcccctccagccctcgccgccctcgccaccgctcccggccgccgcgctccggtacacacaggatccctgctgggcaccaacagctccaccatggggctggcctggggactaggcgtcctgttcctgatgcatgtgtgtggcaccaaccgcattccagagtctggcggagacaacagcgtgtttgacatctttgaactcaccggggccgcccgcaaggggtctgggcgccgactggtgaagggccccgacccttccagcccagctttccgcatcgaggatgccaacctgatcccccctgtgcctgatgacaagttccaagacctggtggatgctgtgcgggcagaaaagggtttcctccttctggcatccctgaggcagatgaagaagacccggggcacgctgctggccctggagcggaaagaccactctggccaggtcttcagcgtggtgtccaatggcaaggcgggcaccctggacctcagcctgaccgtccaaggaaagcagcacgtggtgtctgtggaagaagctctcctggcaaccggccagtggaagagcatcaccctgtttgtgcaggaagacagggcccagctgtacatcgactgtgaaaagatggagaatgctgagttggacgtccccatccaaagcgtcttcaccagagacctggccagcatcgccagactccgcatcgcaaaggggggcgtcaatgacaatttccagggggtgctgcagaatgtgaggtttgtctttggaaccacaccagaagacatcctcaggaacaaaggctgctccagctctaccagtgtcctcctcacccttgacaacaacgtggtgaatggttccagccctgccatccgcactaactacattggccacaagacaaaggacttgcaagccatctgcggcatctcctgtgatgagctgtccagcatggtcctggaactcaggggcctgcgcaccattgtgaccacgctgcaggacagcatccgcaaagtgactgaagagaacaaagagttggccaatgagctgaggcggcctcccctatgctatcacaacggagttcagtacagaaataacgaggaatggactgttgatagctgcactgagtgtcactgtcagaactcagttaccatctgcaaaaaggtgtcctgccccatcatgccctgctccaatgccacagttcctgatggagaatgctgtcctcgctgttggcccagcgactctgcggacgatggctggtctccatggtccgagtggacctcctgttctacgagctgtggcaatggaattcagcagcgcggccgctcctgcgatagcctcaacaaccgatgtgagggctcctcggtccagacacggacctgccacattcaggagtgtgacaagagatttaaacaggatggtggctggagccactggtccccgtggtcatcttgttctgtgacatgtggtgatggtgtgatcacaaggatccggctctgcaactctcccagcccccagatgaacgggaaaccctgtgaaggcgaagcgcgggagaccaaagcctgcaagaaagacgcctgccccagtaagtgtgaggtccgctgcaagggtgagcatgggcagcagctctgcccagctggttgcctggcatctgcagcctgcagttcagtgggtcatagagcaggaaggttacctactagagaaacaaacagaagcaaagtcctgcaggctcagcaacttcttttaatgaaaaacaaactcaccctcttccccagcattctttccatgtgtcagagaagcagaggtttcttgaacgggcttaggagagtctatgacaagggagggatttgaaagttgatcttaattgttgcctgtggttcatcttcttacagtcaatggaggctggggtccttggtcaccatgggacatctgttctgtcacctgtggaggaggggtacagaaacgtagtcgtctctgcaacaaccccacaccccagtttggaggcaaggactgcgttggtgatgtaacagaaaaccagatctgcaacaagcaggactgtccaattggtgagccacgcagcccaggatgaaacgacccaggagctttgctcttttactgaatgctgcagtcagcattcgaggagattccagcttggttagtcctgagcgatttgattgctctaagatgcaggtggacaacataatcccaacaagttatcggttccctataccctataatatcttacactgtgttaagtgcccagcatggcagtatggcagcttagaccaaccatttactgtgactgtctctctctccttgtctcagatggatgcctgtccaatccctgctttgccggcgtgaagtgtactagctaccctgatggcagctggaaatgtggtgcttgtccccctggttacagtggaaatggcatccagtgcacagatgttgatgagtgcaaagaagtgcctgatgcctgcttcaaccacaatggagagcaccggtgtgagaacacggaccccggctacaactgcctgccctgccccccacgcttcaccggctcacagcccttcggccagggtgtcgaacatgccacggccaacaaacaggtacagtcaactagacgagtaaaccagaggacaggagagctgtccttgaccaaaataactgggagcgggaggaatgtaatttcatacccttcaccaaaaaaaaaagggcgaggagatgaatgtacggtctagttttagaaacgtgattagaaaatccatggtaaatcctgcaggggaaaaacagtcttccatatttaaaaatgctgctctggaataagttgtgagcagatggacttgtaaacgcctaggtgctgagcaaattcaagaaaaataaacataaagcaaagtttgcttatagcctcagggagaatggggagggacagaggtaacccacactcttccaaatggagcctctgtctactcagagatgacagggatctggattcttgtttccatgatatctgaggattctcaaaagctctgtgtaacagcagcatggtgtaccctcaggtgtgcaagccccgtaacccctgcacggatgggacccacgactgcaacaagaacgccaagtgcaactacctgggccactatagcgaccccatgtaccgctgcgagtgcaagcctggctacgctggcaatggcatcatctgcggggaggacacagacctggatggctggcccaatgagaacctggtgtgcgtggccaatgcgacttaccactgcaaaaaggataattgccccaaccttcccaactcagggcaggaagactatgacaaggatggaattggtgatgcctgtgatgatgacgatgacaatgataaaattccagatgacagggacaactgtccattccattacaacccagctcagtatgactatgacagagatgatgtgggagaccgctgtgacaactgtccctacaaccacaacccagatcaggcagacacagacaacaatggggaaggagacgcctgtgctgcagacattgatggagacggtatcctcaatgaacgggacaactgccagtacgtctacaatgtggaccagagagacactgatatggatggggttggagatcagtgtgacaattgccccttggaacacaatccggatcagctggactctgactcagaccgcattggagatacctgtgacaacaatcaggatattgatgaagatggccaccagaacaatctggacaactgtccctatgtgcccaatgccaaccaggctgaccatgacaaagatggcaagggagatgcctgtgaccacgatgatgacaacgatggcattcctgatgacaaggacaactgcagactcgtgcccaatcccgaccagaaggactctgacggcgatggtcgaggtgatgcctgcaaagatgattttgaccatgacagtgtgccagacatcgatgacatctgtcctgagaatgttgacatcagtgagaccgatttccgccgattccagatgattcctctggaccccaaagggacatcccaaaatgaccctaactgggttgtacgccatcagggtaaagaactcgtccagactgtcaactgtgatcctggactcgctgtaggttatgatgagtttaatgctgtggacttcagtggcaccttcttcatcaacaccgaaagggacgatgactatgctggatttgtctttggctaccagtccagcagccgcttttatgttgtgatgtggaagcaagtcacccagtcctactgggacaccaaccccacgagggctcagggatactcgggcctttctgtgaaagttgtaaactccaccacagggcctggcgagcacctgcggaacgccctgtggcacacaggaaacacccctggccaggtgcgcaccctgtggcatgaccctcgtcacataggctggaaagatttcaccgcctacagatggcgtctcagccacaggccaaagacgggtttcattagagtggtgatgtatgaagggaagaaaatcatggctgactcaggacccatctatgataaaacctatgctggtggtagactagggttgtttgtcttctctcaagaaatggtgttcttctctgacctgaaatacgaatgtagagatccctaatcatcaaattgttgattgaaagactgatcataaaccaatgctggtattgcaccttctggaactatgggcttgagaaaacccccaggatcacttctccttggcttccttcttttctgtgcttgcatcagtgtggactcctagaacgtgcgacctgcctcaagaaaatgcagttttcaaaaacagactcagcattcagcctccaatgaataagacatcttccaagcatataaacaattgctttggtttccttttgaaaaagcatctacttgcttcagttgggaaggtgcccattccactctgcctttgtcacagagcagggtgctattgtgaggccatctctgagcagtggactcaaaagcattttcaggcatgtcagagaagggaggactcactagaattagcaaacaaaaccaccctgacatcctccttcaggaacacggggagcagaggccaaagcactaaggggagggcgcatacccgagacgattgtatgaagaaaatatggaggaactgttacatgttcggtactaagtcattttcaggggattgaaagactattgctggatttcatgatgctgactggcgttagctgattaacccatgtaaataggcacttaaatagaagcaggaaagggagacaaagactggcttctggacttcctccctgatccccacccttactcatcacctgcagtggccagaattagggaatcagaatcaaaccagtgtaaggcagtgctggctgccattgcctggtcacattgaaattggtggcttcattctagatgtagcttgtgcagatgtagcaggaaaataggaaaacctaccatctcagtgagcaccagctgcctcccaaaggaggggcagccgtgcttatatttttatggttacaatggcacaaaattattatcaacctaactaaaacattccttttctcttttttcctgaattatcatggagttttctaattctctcttttggaatgtagattttttttaaatgctttacgatgtaaaatatttattttttacttattctggaagatctggctgaaggattattcatggaacaggaagaagcgtaaagactatccatgtcatctttgttgagagtcttcgtgactgtaagattgtaaatacagattatttattaactctgttctgcctggaaatttaggcttcatacggaaagtgtttgagagcaagtagttgacatttatcagcaaatctcttgcaagaacagcacaaggaaaatcagtctaataagctgctctgccccttgtgctcagagtggatgttatgggattctttttttctctgttttatcttttcaagtggaattagttggttatccatttgcaaatgttttaaattgcaaagaaagccatgaggtcttcaatactgttttaccccatcccttgtgcatatttccagggagaaggaaagcatatacacttttttctttcatttttccaaaagagaaaaaaatgacaaaaggtgaaacttacatacaaatattacctcatttgttgtgtgactgagtaaagaatttttggatcaagcggaaagagtttaagtgtctaacaaacttaaagctactgtagtacctaaaaagtcagtgttgtacatagcataaaaactctgcagagaagtattcccaataaggaaatagcattgaaatgttaaatacaatttctgaaagttatgttttttttctatcatctggtataccattgctttatttttataaattattttctcattgccattggaatagatatctcagattgtgtagatatgctatttaaataatttatcaggaaatactgcctgtagagttagtatttctatttttatataatgtttgcacactgaattgaagaattgttggttttttcttttttttggttttgttttttttttttttttttttgcttttgacctcccatttttactatttgccaatacctttttctaggaatgtgcttttttttgtacacatttttatccattttacattctaaagcagtgtaagttgtatattactgtttcttatgtacaaggaacaacaataaatcatatggaaattta

SEQ ID NO: 329428 - DNA, 6366 bp, Homo sapiens
tttctagctggaaagttgcgcgccaggcagcggggggcggagagaggagcccagactggcccccacctcccgcttcctgcccggccgccgcccattggccggaggaatccccaggaatgcgagcgcccctttaaaagcgcgcggctcctccgccttgccagccgctgcgcccgagctggcctgcgagttcagggctcctgtcgctctccaggagcaacctctactccggacgcacaggcattccccgcgcccctccagccctcgccgccctcgccaccgctcccggccgccgcgctccggtacacacaggatccctgctgggcaccaacagctccaccatggggctggcctggggactaggcgtcctgttcctgatgcatgtgtgtggcaccaaccgcattccagagtctggcggagacaacagcgtgtttgacatctttgaactcaccggggccgcccgcaaggggtctgggcgccgactggtgaagggccccgacccttccagcccagctttccgcatcgaggatgccaacctgatcccccctgtgcctgatgacaagttccaagacctggtggatgctgtgcgggcagaaaagggtttcctccttctggcatccctgaggcagatgaagaagacccggggcacgctgctggccctggagcggaaagaccactctggccaggtcttcagcgtggtgtccaatggcaaggcgggcaccctggacctcagcctgaccgtccaaggaaagcagcacgtggtgtctgtggaagaagctctcctggcaaccggccagtggaagagcatcaccctgtttgtgcaggaagacagggcccagctgtacatcgactgtgaaaagatggagaatgctgagttggacgtccccatccaaagcgtcttcaccagagacctggccagcatcgccagactccgcatcgcaaaggggggcgtcaatgacaatttccagggggtgctgcagaatgtgaggtttgtctttggaaccacaccagaagacatcctcaggaacaaaggctgctccagctctaccagtgtcctcctcacccttgacaacaacgtggtgaatggttccagccctgccatccgcactaactacattggccacaagacaaaggacttgcaagccatctgcggcatctcctgtgatgagctgtccagcatggtcctggaactcaggggcctgcgcaccattgtgaccacgctgcaggacagcatccgcaaagtgactgaagagaacaaagagttggccaatgagctgaggcggcctcccctatgctatcacaacggagttcagtacagaaataacgaggaatggactgttgatagctgcactgagtgtcactgtcagaactcagttaccatctgcaaaaaggtgtcctgccccatcatgccctgctccaatgccacagttcctgatggagaatgctgtcctcgctgttggcccagcgactctgcggacgatggctggtctccatggtccgagtggacctcctgttctacgagctgtggcaatggaattcagcagcgcggccgctcctgcgatagcctcaacaaccgatgtgagggctcctcggtccagacacggacctgccacattcaggagtgtgacaagagatttaaacaggatggtggctggagccactggtccccgtggtcatcttgttctgtgacatgtggtgatggtgtgatcacaaggatccggctctgcaactctcccagcccccagatgaacgggaaaccctgtgaaggcgaagcgcgggagaccaaagcctgcaagaaagacgcctgccccatcaatggaggctggggtccttggtcaccatgggacatctgttctgtcacctgtggaggaggggtacagaaacgtagtcgtctctgcaacaaccccacaccccagtttggaggcaaggactgcgttggtgatgtaacagaaaaccagatctgcaacaagcaggactgtccaattgatggatgcctgtccaatccctgctttgccggcgtgaagtgtactagctaccctgatggcagctggaaatgtggtgcttgtccccctggttacagtggaaatggcatccagtgcacagatgttgatgagtgcaaagaagtgcctgatgcctgcttcaaccacaatggagagcaccggtgtgagaacacggaccccggctacaactgcctgccctgccccccacgcttcaccggctcacagcccttcggccagggtgtcgaacatgccacggccaacaaacaggtgtgcaagccccgtaacccctgcacggatgggacccacgactgcaacaagaacgccaagtgcaactacctgggccactatagcgaccccatgtaccgctgcgagtgcaagcctggctacgctggcaatggcatcatctgcggggaggacacagacctggatggctggcccaatgagaacctggtgtgcgtggccaatgcgacttaccactgcaaaaaggataattgccccaaccttcccaactcagggcaggaagactatgacaaggatggaattggtgatgcctgtgatgatgacgatgacaatgataaaattccagatgacagggacaactgtccattccattacaacccagctcagtatgactatgacagagatgatgtgggagaccgctgtgacaactgtccctacaaccacaacccagatcaggcagacacagacaacaatggggaaggagacgcctgtgctgcagacattgatggagacggtatcctcaatgaacgggacaactgccagtacgtctacaatgtggaccagagagacactgatatggatggggttggagatcagtgtgacaattgccccttggaacacaatccggatcagctggactctgactcagaccgcattggagatacctgtgacaacaatcaggatattgatgaagatggccaccagaacaatctggacaactgtccctatgtgcccaatgccaaccaggctgaccatgacaaagatggcaagggagatgcctgtgaccacgatgatgacaacgatggcattcctgatgacaaggacaactgcagactcgtgcccaatcccgaccagaaggactctgacggcgatggtcgaggtgatgcctgcaaagatgattttgaccatgacagtgtgccagacatcgatgacatctgtcctgagaatgttgacatcagtgagaccgatttccgccgattccagatgattcctctggaccccaaagggacatcccaaaatgaccctaactgggttgtacgccatcagggtaaagaactcgtccagactgtcaactgtgatcctggactcgctgtaggttatgatgagtttaatgctgtggacttcagtggcaccttcttcatcaacaccgaaagggacgatgactatgctggatttgtctttggctaccagtccagcagccgcttttatgttgtgatgtggaagcaagtcacccagtcctactgggacaccaaccccacgagggctcagggatactcgggcctttctgtgaaagttgtaaactccaccacagggcctggcgagcacctgcggaacgccctgtggcacacaggaaacacccctggccagaagcaaagccctggaacagagagagagcttatgggtgcctgactagcactggggatgctgtgctttgaccaagactctgaccagggagtcttagaaagttcccagcatcaccagctgcagcattgaactctgctttgtaaaaacataatagtgttgaaaagggagcttgaccaagaattgccctgcaaatcctaaggtgccttcagccttttcaaacaaaaaaacctccttccctcctctctgtctgctttatatgtgtgctcagtggcacacaacaaatatgagaggacttggaaaaattccccattgcagccctctaacttagatcagctcagtacctttcaagcattgtttctgatggaatgaaatagaaatctttacctgaaggagctgtgtttcaacctttccttttccttttccttcaggtgcgcaccctgtggcatgaccctcgtcacataggctggaaagatttcaccgcctacagatggcgtctcagccacaggccaaagacgggtttcattagagtggtgatgtatgaagggaagaaaatcatggctgactcaggacccatctatgataaaacctatgctggtggtagactagggttgtttgtcttctctcaagaaatggtgttcttctctgacctgaaatacgaatgtagagatccctaatcatcaaattgttgattgaaagactgatcataaaccaatgctggtattgcaccttctggaactatgggcttgagaaaacccccaggatcacttctccttggcttccttcttttctgtgcttgcatcagtgtggactcctagaacgtgcgacctgcctcaagaaaatgcagttttcaaaaacagactcagcattcagcctccaatgaataagacatcttccaagcatataaacaattgctttggtttccttttgaaaaagcatctacttgcttcagttgggaaggtgcccattccactctgcctttgtcacagagcagggtgctattgtgaggccatctctgagcagtggactcaaaagcattttcaggcatgtcagagaagggaggactcactagaattagcaaacaaaaccaccctgacatcctccttcaggaacacggggagcagaggccaaagcactaaggggagggcgcatacccgagacgattgtatgaagaaaatatggaggaactgttacatgttcggtactaagtcattttcaggggattgaaagactattgctggatttcatgatgctgactggcgttagctgattaacccatgtaaataggcacttaaatagaagcaggaaagggagacaaagactggcttctggacttcctccctgatccccacccttactcatcacctgcagtggccagaattagggaatcagaatcaaaccagtgtaaggcagtgctggctgccattgcctggtcacattgaaattggtggcttcattctagatgtagcttgtgcagatgtagcaggaaaataggaaaacctaccatctcagtgagcaccagctgcctcccaaaggaggggcagccgtgcttatatttttatggttacaatggcacaaaattattatcaacctaactaaaacattccttttctcttttttcctgaattatcatggagttttctaattctctcttttggaatgtagattttttttaaatgctttacgatgtaaaatatttattttttacttattctggaagatctggctgaaggattattcatggaacaggaagaagcgtaaagactatccatgtcatctttgttgagagtcttcgtgactgtaagattgtaaatacagattatttattaactctgttctgcctggaaatttaggcttcatacggaaagtgtttgagagcaagtagttgacatttatcagcaaatctcttgcaagaacagcacaaggaaaatcagtctaataagctgctctgccccttgtgctcagagtggatgttatgggattctttttttctctgttttatcttttcaagtggaattagttggttatccatttgcaaatgttttaaattgcaaagaaagccatgaggtcttcaatactgttttaccccatcccttgtgcatatttccagggagaaggaaagcatatacacttttttctttcatttttccaaaagagaaaaaaatgacaaaaggtgaaacttacatacaaatattacctcatttgttgtgtgactgagtaaagaatttttggatcaagcggaaagagtttaagtgtctaacaaacttaaagctactgtagtacctaaaaagtcagtgttgtacatagcataaaaactctgcagagaagtattcccaataaggaaatagcattgaaatgttaaatacaatttctgaaagttatgttttttttctatcatctggtataccattgctttatttttataaattattttctcattgccattggaatagatatctcagattgtgtagatatgctatttaaataatttatcaggaaatactgcctgtagagttagtatttctatttttatataatgtttgcacactgaattgaagaattgttggttttttcttttttttggttttgttttttttttttttttttttgcttttgacctcccatttttactatttgccaatacctttttctaggaatgtgcttttttttgtacacatttttatccattttacattctaaagcagtgtaagttgtatattactgtttcttatgtacaaggaacaacaataaatcatatggaaattta

SEQ ID NO: 329429 - DNA, 6089 bp, Homo sapiens
tttctagctggaaagttgcgcgccaggcagcggggggcggagagaggagcccagactggcccccacctcccgcttcctgcccggccgccgcccattggccggaggaatccccaggaatgcgagcgcccctttaaaagcgcgcggctcctccgccttgccagccgctgcgcccgagctggcctgcgagttcagggctcctgtcgctctccaggagcaacctctactccggacgcacaggcattccccgcgcccctccagccctcgccgccctcgccaccgctcccggccgccgcgctccggtacacacaggatccctgctgggcaccaacagctccaccatggggctggcctggggactaggcgtcctgttcctgatgcatgtgtgtggcaccaaccgcattccagagtctggcggagacaacagcgtgtttgacatctttgaactcaccggggccgcccgcaaggggtctgggcgccgactggtgaagggccccgacccttccagcccagctttccgcatcgaggatgccaacctgatcccccctgtgcctgatgacaagttccaagacctggtggatgctgtgcgggcagaaaagggtttcctccttctggcatccctgaggcagatgaagaagacccggggcacgctgctggccctggagcggaaagaccactctggccaggtcttcagcgtggtgtccaatggcaaggcgggcaccctggacctcagcctgaccgtccaaggaaagcagcacgtggtgtctgtggaagaagctctcctggcaaccggccagtggaagagcatcaccctgtttgtgcaggaagacagggcccagctgtacatcgactgtgaaaagatggagaatgctgagttggacgtccccatccaaagcgtcttcaccagagacctggccagcatcgccagactccgcatcgcaaaggggggcgtcaatgacaatttccagggggtgctgcagaatgtgaggtttgtctttggaaccacaccagaagacatcctcaggaacaaaggctgctccagctctaccagtgtcctcctcacccttgacaacaacgtggtgaatggttccagccctgccatccgcactaactacattggccacaagacaaaggacttgcaagccatctgcggcatctcctgtgatgagctgtccagcatggtcctggaactcaggggcctgcgcaccattgtgaccacgctgcaggacagcatccgcaaagtgactgaagagaacaaagagttggccaatgagctgaggcggcctcccctatgctatcacaacggagttcagtacagaaataacgaggaatggactgttgatagctgcactgagtgtcactgtcagaactcagttaccatctgcaaaaaggtgtcctgccccatcatgccctgctccaatgccacagttcctgatggagaatgctgtcctcgctgttggcccagcgactctgcggacgatggctggtctccatggtccgagtggacctcctgttctacgagctgtggcaatggaattcagcagcgcggccgctcctgcgatagcctcaacaaccgatgtgagggctcctcggtccagacacggacctgccacattcaggagtgtgacaagagatttaaacaggatggtggctggagccactggtccccgtggtcatcttgttctgtgacatgtggtgatggtgtgatcacaaggatccggctctgcaactctcccagcccccagatgaacgggaaaccctgtgaaggcgaagcgcgggagaccaaagcctgcaagaaagacgcctgccccatcaatggaggctggggtccttggtcaccatgggacatctgttctgtcacctgtggaggaggggtacagaaacgtagtcgtctctgcaacaaccccacaccccagtttggaggcaaggactgcgttggtgatgtaacagaaaaccagatctgcaacaagcaggactgtccaattgatggatgcctgtccaatccctgctttgccggcgtgaagtgtactagctaccctgatggcagctggaaatgtggtgcttgtccccctggttacagtggaaatggcatccagtgcacagatgttgatgagtgcaaagaagtgcctgatgcctgcttcaaccacaatggagagcaccggtgtgagaacacggaccccggctacaactgcctgccctgccccccacgcttcaccggctcacagcccttcggccagggtgtcgaacatgccacggccaacaaacaggtgtgcaagccccgtaacccctgcacggatgggacccacgactgcaacaagaacgccaagtgcaactacctgggccactatagcgaccccatgtaccgctgcgagtgcaagcctggctacgctggcaatggcatcatctgcggggaggacacagacctggatggctggcccaatgagaacctggtgtgcgtggccaatgcgacttaccactgcaaaaaggataattgccccaaccttcccaactcagggcaggaagactatgacaaggatggaattggtgatgcctgtgatgatgacgatgacaatgataaaattccagatgacagggacaactgtccattccattacaacccagctcagtatgactatgacagagatgatgtgggagaccgctgtgacaactgtccctacaaccacaacccagatcaggcagacacagacaacaatggggaaggagacgcctgtgctgcagacattgatggagacggtatcctcaatgaacgggacaactgccagtacgtctacaatgtggaccagagagacactgatatggatggggttggagatcagtgtgacaattgccccttggaacacaatccggatcagctggactctgactcagaccgcattggagatacctgtgacaacaatcaggatattgatgaagatggccaccagaacaatctggacaactgtccctatgtgcccaatgccaaccaggctgaccatgacaaagatggcaagggagatgcctgtgaccacgatgatgacaacgatggcattcctgatgacaaggacaactgcagactcgtgcccaatcccgaccagaaggactctgacggcgatggtcgaggtgatgcctgcaaagatgattttgaccatgacagtgtgccagacatcgatgacatctgtcctgagaatgttgacatcagtgagaccgatttccgccgattccagatgattcctctggaccccaaagggacatcccaaaatgaccctaactgggttgtacgccatcagggtaaagaactcgtccagactgtcaactgtgatcctggactcgctgtaggttatgatgagtttaatgctgtggacttcagtggcaccttcttcatcaacaccgaaagggacgatgactatgctggatttgtctttggctaccagtccagcagccgcttttatgttgtgatgtggaagcaagtcacccagtcctactgggacaccaaccccacgagggctcagggatactcgggcctttctgtgaaagttgtaaactccaccacagggcctggcgagcacctgcggaacgccctgtggcacacaggaaacacccctggccagctgaaggagctgtgtttcaacctttccttttccttttccttcaggtgcgcaccctgtggcatgaccctcgtcacataggctggaaagatttcaccgcctacagatggcgtctcagccacaggccaaagacgggtttcattaggtacgatcatactgattcactttcacttacagtcacactgagggacaaaaagacaaaaagtattaaatagcattgtcactaaacaagattttttttccctgcagagtggtgatgtatgaagggaagaaaatcatggctgactcaggacccatctatgataaaacctatgctggtggtagactagggttgtttgtcttctctcaagaaatggtgttcttctctgacctgaaatacgaatgtagagatccctaatcatcaaattgttgattgaaagactgatcataaaccaatgctggtattgcaccttctggaactatgggcttgagaaaacccccaggatcacttctccttggcttccttcttttctgtgcttgcatcagtgtggactcctagaacgtgcgacctgcctcaagaaaatgcagttttcaaaaacagactcagcattcagcctccaatgaataagacatcttccaagcatataaacaattgctttggtttccttttgaaaaagcatctacttgcttcagttgggaaggtgcccattccactctgcctttgtcacagagcagggtgctattgtgaggccatctctgagcagtggactcaaaagcattttcaggcatgtcagagaagggaggactcactagaattagcaaacaaaaccaccctgacatcctccttcaggaacacggggagcagaggccaaagcactaaggggagggcgcatacccgagacgattgtatgaagaaaatatggaggaactgttacatgttcggtactaagtcattttcaggggattgaaagactattgctggatttcatgatgctgactggcgttagctgattaacccatgtaaataggcacttaaatagaagcaggaaagggagacaaagactggcttctggacttcctccctgatccccacccttactcatcacctgcagtggccagaattagggaatcagaatcaaaccagtgtaaggcagtgctggctgccattgcctggtcacattgaaattggtggcttcattctagatgtagcttgtgcagatgtagcaggaaaataggaaaacctaccatctcagtgagcaccagctgcctcccaaaggaggggcagccgtgcttatatttttatggttacaatggcacaaaattattatcaacctaactaaaacattccttttctcttttttcctgaattatcatggagttttctaattctctcttttggaatgtagattttttttaaatgctttacgatgtaaaatatttattttttacttattctggaagatctggctgaaggattattcatggaacaggaagaagcgtaaagactatccatgtcatctttgttgagagtcttcgtgactgtaagattgtaaatacagattatttattaactctgttctgcctggaaatttaggcttcatacggaaagtgtttgagagcaagtagttgacatttatcagcaaatctcttgcaagaacagcacaaggaaaatcagtctaataagctgctctgccccttgtgctcagagtggatgttatgggattctttttttctctgttttatcttttcaagtggaattagttggttatccatttgcaaatgttttaaattgcaaagaaagccatgaggtcttcaatactgttttaccccatcccttgtgcatatttccagggagaaggaaagcatatacacttttttctttcatttttccaaaagagaaaaaaatgacaaaaggtgaaacttacatacaaatattacctcatttgttgtgtgactgagtaaagaatttttggatcaagcggaaagagtttaagtgtctaacaaacttaaagctactgtagtacctaaaaagtcagtgttgtacatagcataaaaactctgcagagaagtattcccaataaggaaatagcattgaaatgttaaatacaatttctgaaagttatgttttttttctatcatctggtataccattgctttatttttataaattattttctcattgccattggaatagatatctcagattgtgtagatatgctatttaaataatttatcaggaaatactgcctgtagagttagtatttctatttttatataatgtttgcacactgaattgaagaattgttggttttttcttttttttggttttgttttttttttttttttttttgcttttgacctcccatttttactatttgccaatacctttttctaggaatgtgcttttttttgtacacatttttatccattttacattctaaagcagtgtaagttgtatattactgtttcttatgtacaaggaacaacaataaatcatatggaaattta

SEQ ID NO: 329430 - DNA, 5009 bp, Homo sapiens
tttctagctggaaagttgcgcgccaggcagcggggggcggagagaggagcccagactggcccccacctcccgcttcctgcccggccgccgcccattggccggaggaatccccaggaatgcgagcgcccctttaaaagcgcgcggctcctccgccttgccagccgctgcgcccgagctggcctgcgagttcagggctcctgtcgctctccaggagcaacctctactccggacgcacaggcattccccgcgcccctccagccctcgccgccctcgccaccgctcccggccgccgcgctccggtacacacaggatccctgctgggcaccaacagctccaccatggggctggcctggggactaggcgtcctgttcctgatgcatgtgtgtggcaccaaccgcattccagagtctggcggagacaacagcgtgtttgacatctttgaactcaccggggccgcccgcaaggggtctgggcgccgactggtgaagggccccgacccttccagcccagctttccgcatcgaggatgccaacctgatcccccctgtgcctgatgacaagttccaagacctggtggatgctgtgcgggcagaaaagggtttcctccttctggcatccctgaggcagatgaagaagacccggggcacgctgctggccctggagcggaaagaccactctggccaggtcttcagcgtggtgtccaatggcaaggcgggcaccctggacctcagcctgaccgtccaaggaaagcagcacgtggtgtctgtggaagaagctctcctggcaaccggccagtggaagagcatcaccctgtttgtgcaggaagacagggcccagctgtacatcgactgtgaaaagatggagaatgctgagttggacgtccccatccaaagcgtcttcaccagagacctggccagcatcgccagactccgcatcgcaaaggggggcgtcaatgacaatttccagggggtgctgcagaatgtgaggtttgtctttggaaccacaccagaagacatcctcaggaacaaaggctgctccagctctaccagtgtcctcctcacccttgacaacaacgtggtgaatggttccagccctgccatccgcactaactacattggccacaagacaaaggacttgcaagccatctgcggcatctcctgtgatgagctgtccagcatggtcctggaactcaggggcctgcgcaccattgtgaccacgctgcaggacagcatccgcaaagtgactgaagagaacaaagagttggccaatgagctgaggcggcctcccctatgctatcacaacggagttcagtacagaaataacgaggaatggactgttgatagctgcactgagtgtcactgtcagaactcagttaccatctgcaaaaaggtgtcctgccccatcatgccctgctccaatgccacagttcctgatggagaatgctgtcctcgctgttggcccagcgactctgcggacgatggctggtctccatggtccgagtggacctcctgttctacgagctgtggcaatggaattcagcagcgcggccgctcctgcgatagcctcaacaaccgatgtgagggctcctcggtccagacacggacctgccacattcaggagtgtgacaagagatttaaacaggatggtggctggagccactggtccccgtggtcatcttgttctgtgacatgtggtgatggtgtgatcacaaggatccggctctgcaactctcccagcccccagatgaacgggaaaccctgtgaaggcgaagcgcgggagaccaaagcctgcaagaaagacgcctgccccatcaatggaggctggggtccttggtcaccatgggacatctgttctgtcacctgtggaggaggggtacagaaacgtagtcgtctctgcaacaaccccacaccccagtttggaggcaaggactgcgttggtgatgtaacagaaaaccagatctgcaacaagcaggactgtccaattgatggatgcctgtccaatccctgctttgccggcgtgaagtgtactagctaccctgatggcagctggaaatgtggtgcttgtccccctggttacagtggaaatggcatccagtgcacagatgttgatgagtgcaaagaagtgcctgatgcctgcttcaaccacaatggagagcaccggtgtgagaacacggaccccggctacaactgcctgccctgccccccacgcttcaccggctcacagcccttcggccagggtgtcgaacatgccacggccaacaaacaggtgtgcaagccccgtaacccctgcacggatgggacccacgactgcaacaagaacgccaagtgcaactacctgggccactatagcgaccccatgtaccgctgcgagtgcaagcctggctacgctggcaatggcatcatctgcggggaggacacagacctggatggctggcccaatgagaacctggtgtgcgtggccaatgcgacttaccactgcaaaaaggataattgccccaaccttcccaactcagggcaggaagactatgacaaggatggaattggtgatgcctgtgatgatgacgatgacaatgataaaattccagatgacagggacaactgtccattccattacaacccagctcagtatgactatgacagagatgatgtgggagaccgctgtgacaactgtccctacaaccacaacccagatcaggcagacacagacaacaatggggaaggagacgcctgtgctgcagacattgatggagacggtatcctcaatgaacgggacaactgccagtacgtctacaatgtggaccagagagacactgatatggatggggttggagatcagtgtgacaattgccccttggaacacaatccggatcagctggactctgactcagaccgcattggagatacctgtgacaacaatcaggatattgatgaagatggccaccagaacaatctggacaactgtccctatgtgcccaatgccaaccaggctgaccatgacaaagatggcaagggagatgcctgtgaccacgatgatgacaacgatggcattcctgatgacaaggacaactgcagactcgtgcccaatcccgaccagaaggactctgacggcgatggtcgaggtgatgcctgcaaagatgattttgaccatgacagtgtgccagacatcgatgacatctgtcctgagaatgttgacatcagtgagaccgatttccgccgattccagatgattcctctggaccccaaagggacatcccaaaatgaccctaactgggttgtacgccatcagggtaaagaactcgtccagactgtcaactgtgatcctggactcgctgtaggttatgatgagtttaatgctgtggacttcagtggcaccttcttcatcaacaccgaaagggacgatgactatgctggatttgtctttggctaccagtccagcagccgcttttatgttgtgatgtggaagcaagtcacccagtcctactgggacaccaaccccacgagggctcagggatactcgggcctttctgtgaaagttgtaaactccaccacagggcctggcgagcacctgcggaacgccctgtggcacacaggaaacacccctggccaggtgcgcaccctgtggcatgaccctcgtcacataggctggaaagatttcaccgcctacagatggcgtctcagccacaggccaaagacgggtttcattagagtggtgatgtatgaagggaagaaaatcatggctgactcaggacccatctatgataaaacctatgctggtggtagactagggttgtttgtcttctctcaagaaatggtgttcttctctgacctgaaatacgaatgtagagatccctaatcatcaaattgttgattgaaagactgatcataaaccaatgctggtattgcaccttctggaactatgggcttgagaaaacccccaggatcacttctccttggcttccttcttttctgtgcttgcatcagtgtggactcctagaacgtgcgacctgcctcaagaaaatgcagttttcaaaaacagactcagcattcagcctccaatgaataagacatcttccaagcatataaacaattgctttggtttccttttgaaaaagcatctacttgcttcagttgggaaggtgcccattccactctgcctttgtcacagagcagggtgctattgtgaggccatctctgagcagtggactcaaaagcattttcaggcatgtcagagaagggaggactcactagaattagcaaacaaaaccaccctgacatcctccttcaggaacacggggagcagaggccaaagcactaaggggagggcgcatacccgagacgattgtatgaagaaaatatggaggaactgttacatgttcggtactaagtcattttcaggggattgaaagactattgctggatttcatgatgctgactggcgttagctgattaacccatgtaaataggcacttaaatagaagcaggaaagggagacaaagactggcttctggacttcctccctgatccccacccttactcatcacctgcagtggccagaattagggaatcagaatcaaaccagtgtaaggcagtgctggctgccattgcctggtcacattgaaattggtggcttcattctagatgtagcttgtgcagatgtagcaggaaaataggaaaacctaccatctcagtgagcaccagctgcctcccaaaggaggggcagccgtgcttatatttttatggttacaatggcacaaaattattatcaacctaactaaaacattccttttctcttttttcctgaattatcatggagttttctaattctctcttttggaatgtagattttttttaaatgctttacgatgtaaaatatttattttttacttattctggaagatctggctgaaggattattcatggaacaggaagaagcgtaaagactatccatgtcatctttgttgagagtcttcgtgactgtaagattgtaaatacagattatttattaactctg

SEQ ID NO: 329431 - DNA, 4369 bp, Homo sapiens
tagagttcccccccgtccgatggccatgccccgtcccgatggcccctgtgacaacaagatttaaacaggatggtggctggagccactggtccccgtggtcatcttgttctgtgacatgtggtgatggtgtgatcacaaggatccggctctgcaactctcccagcccccagatgaacgggaaaccctgtgaaggcgaagcgcgggagaccaaagcctgcaagaaagacgcctgccccatcaatggaggctggggtccttggtcaccatgggacatctgttctgtcacctgtggaggaggggtacagaaacgtagtcgtctctgcaacaaccccacaccccagtttggaggcaaggactgcgttggtgatgtaacagaaaaccagatctgcaacaagcaggactgtccaattgatggatgcctgtccaatccctgctttgccggcgtgaagtgtactagctaccctgatggcagctggaaatgtggtgcttgtccccctggttacagtggaaatggcatccagtgcacagatgttgatgagtgcaaagaagtgcctgatgcctgcttcaaccacaatggagagcaccggtgtgagaacacggaccccggctacaactgcctgccctgccccccacgcttcaccggctcacagcccttcggccagggtgtcgaacatgccacggccaacaaacaggtgtgcaagccccgtaacccctgcacggatgggacccacgactgcaacaagaacgccaagtgcaactacctgggccactatagcgaccccatgtaccgctgcgagtgcaagcctggctacgctggcaatggcatcatctgcggggaggacacagacctggatggctggcccaatgagaacctggtgtgcgtggccaatgcgacttaccactgcaaaaaggataattgccccaaccttcccaactcagggcaggaagactatgacaaggatggaattggtgatgcctgtgatgatgacgatgacaatgataaaattccagatgacagggacaactgtccattccattacaacccagctcagtatgactatgacagagatgatgtgggagaccgctgtgacaactgtccctacaaccacaacccagatcaggcagacacagacaacaatggggaaggagacgcctgtgctgcagacattgatggagacggtatcctcaatgaacgggacaactgccagtacgtctacaatgtggaccagagagacactgatatggatggggttggagatcagtgtgacaattgccccttggaacacaatccggatcagctggactctgactcagaccgcattggagatacctgtgacaacaatcaggatattgatgaagatggccaccagaacaatctggacaactgtccctatgtgcccaatgccaaccaggctgaccatgacaaagatggcaagggagatgcctgtgaccacgatgatgacaacgatggcattcctgatgacaaggacaactgcagactcgtgcccaatcccgaccagaaggactctgacggcgatggtcgaggtgatgcctgcaaagatgattttgaccatgacagtgtgccagacatcgatgacatctgtcctgagaatgttgacatcagtgagaccgatttccgccgattccagatgattcctctggaccccaaagggacatcccaaaatgaccctaactgggttgtacgccatcagggtaaagaactcgtccagactgtcaactgtgatcctggactcgctgtaggttatgatgagtttaatgctgtggacttcagtggcaccttcttcatcaacaccgaaagggacgatgactatgctggatttgtctttggctaccagtccagcagccgcttttatgttgtgatgtggaagcaagtcacccagtcctactgggacaccaaccccacgagggctcagggatactcgggcctttctgtgaaagttgtaaactccaccacagggcctggcgagcacctgcggaacgccctgtggcacacaggaaacacccctggccaggtgcgcaccctgtggcatgaccctcgtcacataggctggaaagatttcaccgcctacagatggcgtctcagccacaggccaaagacgggtttcattagagtggtgatgtatgaagggaagaaaatcatggctgactcaggacccatctatgataaaacctatgctggtggtagactagggttgtttgtcttctctcaagaaatggtgttcttctctgacctgaaatacgaatgtagagatccctaatcatcaaattgttgattgaaagactgatcataaaccaatgctggtattgcaccttctggaactatgggcttgagaaaacccccaggatcacttctccttggcttccttcttttctgtgcttgcatcagtgtggactcctagaacgtgcgacctgcctcaagaaaatgcagttttcaaaaacagactcagcattcagcctccaatgaataagacatcttccaagcatataaacaattgctttggtttccttttgaaaaagcatctacttgcttcagttgggaaggtgcccattccactctgcctttgtcacagagcagggtgctattgtgaggccatctctgagcagtggactcaaaagcattttcaggcatgtcagagaagggaggactcactagaattagcaaacaaaaccaccctgacatcctccttcaggaacacggggagcagaggccaaagcactaaggggagggcgcatacccgagacgattgtatgaagaaaatatggaggaactgttacatgttcggtactaagtcattttcaggggattgaaagactattgctggatttcatgatgctgactggcgttagctgattaacccatgtaaataggcacttaaatagaagcaggaaagggagacaaagactggcttctggacttcctccctgatccccacccttactcatcacctgcagtggccagaattagggaatcagaatcaaaccagtgtaaggcagtgctggctgccattgcctggtcacattgaaattggtggcttcattctagatgtagcttgtgcagatgtagcaggaaaataggaaaacctaccatctcagtgagcaccagctgcctcccaaaggaggggcagccgtgcttatatttttatggttacaatggcacaaaattattatcaacctaactaaaacattccttttctcttttttcctgaattatcatggagttttctaattctctcttttggaatgtagattttttttaaatgctttacgatgtaaaatatttattttttacttattctggaagatctggctgaaggattattcatggaacaggaagaagcgtaaagactatccatgtcatctttgttgagagtcttcgtgactgtaagattgtaaatacagattatttattaactctgttctgcctggaaatttaggcttcatacggaaagtgtttgagagcaagtagttgacatttatcagcaaatctcttgcaagaacagcacaaggaaaatcagtctaataagctgctctgccccttgtgctcagagtggatgttatgggattctttttttctctgttttatcttttcaagtggaattagttggttatccatttgcaaatgttttaaattgcaaagaaagccatgaggtcttcaatactgttttaccccatcccttgtgcatatttccagggagaaggaaagcatatacacttttttctttcatttttccaaaagagaaaaaaatgacaaaaggtgaaacttacatacaaatattacctcatttgttgtgtgactgagtaaagaatttttggatcaagcggaaagagtttaagtgtctaacaaacttaaagctactgtagtacctaaaaagtcagtgttgtacatagcataaaaactctgcagagaagtattcccaataaggaaatagcattgaaatgttaaatacaatttctgaaagttatgttttttttctatcatctggtataccattgctttatttttataaattattttctcattgccattggaatagatatctcagattgtgtagatatgctatttaaataatttatcaggaaatactgcctgtagagttagtatttctatttttatataatgtttgcacactgaattgaagaattgttggttttttcttttttttggttttgttttttttttttttttttttgcttttgacctcccatttttactatttgccaatacctttttctaggaatgtgcttttttttgtacacatttttatccattttacattctaaagcagtgtaagttgtatattactgtttcttatgtacaaggaacaacaataaatcatatggaaattta

SEQ ID NO: 329432 - DNA, 5434 bp, Homo sapiens
tttctagctggaaagttgcgcgccaggcagcggggggcggagagaggagcccagactggcccccacctcccgcttcctgcccggccgccgcccattggccggaggaatccccaggaatgcgagcgcccctttaaaagcgcgcggctcctccgccttgccagccgctgcgcccgagctggcctgcgagttcagggctcctgtcgctctccaggagcaacctctactccggacgcacaggcattccccgcgcccctccagccctcgccgccctcgccaccgctcccggccgccgcgctccggtacacacaggatccctgctgggcaccaacagctccaccatggggctggcctggggactaggcgtcctgttcctgatgcatgtgtgtggcaccaaccgcattccagagtctggcggagacaacagcgtgtttgacatctttgaactcaccggggccgcccgcaaggggtctgggcgccgactggtgaagggccccgacccttccagcccagctttccgcatcgaggatgccaacctgatcccccctgtgcctgatgacaagttccaagacctggtggatgctgtgcgggcagaaaagggtttcctccttctggcatccctgaggcagatgaagaagacccggggcacgctgctggccctggagcggaaagaccactctggccaggtcttcagcgtggtgtccaatggcaaggcgggcaccctggacctcagcctgaccgtccaaggaaagcagcacgtggtgtctgtggaagaagctctcctggcaaccggccagtggaagagcatcaccctgtttgtgcaggaagacagggcccagctgtacatcgactgtgaaaagatggagaatgctgagttggacgtccccatccaaagcgtcttcaccagagacctggccagcatcgccagactccgcatcgcaaaggggggcgtcaatgacaatttccagggggtgctgcagaatgtgaggtttgtctttggaaccacaccagaagacatcctcaggaacaaaggctgctccagctctaccagtgtcctcctcacccttgacaacaacgtggtgaatggttccagccctgccatccgcactaactacattggccacaagacaaaggacttgcaagccatctgcggcatctcctgtgatgagctgtccagcatggtcctggaactcaggggcctgcgcaccattgtgaccacgctgcaggacagcatccgcaaagtgactgaagagaacaaagagttggccaatgagctgaggcggcctcccctatgctatcacaacggagttcagtacagaaataacgaggaatggactgttgatagctgcactgagtgtcactgtcagaactcagttaccatctgcaaaaaggtgtcctgccccatcatgccctgctccaatgccacagttcctgatggagaatgctgtcctcgctgttggcccagcgactctgcggacgatggctggtctccatggtccgagtggacctcctgttctacgagctgtggcaatggaattcagcagcgcggccgctcctgcgatagcctcaacaaccgatgtgagggctcctcggtccagacacggacctgccacattcaggagtgtgacaagagatttaaacaggatggtggctggagccactggtccccgtggtcatcttgttctgtgacatgtggtgatggtgtgatcacaaggatccggctctgcaactctcccagcccccagatgaacgggaaaccctgtgaaggcgaagcgcgggagaccaaagcctgcaagaaagacgcctgccccatcaatggaggctggggtccttggtcaccatgggacatctgttctgtcacctgtggaggaggggtacagaaacgtagtcgtctctgcaacaaccccacaccccagtttggaggcaaggactgcgttggtgatgtaacagaaaaccagatctgcaacaagcaggactgtccaattgatggatgcctgtccaatccctgctttgccggcgtgaagtgtactagctaccctgatggcagctggaaatgtggtgcttgtccccctggttacagtggaaatggcatccagtgcacagatgttgatgagtgcaaagaagtgcctgatgcctgcttcaaccacaatggagagcaccggtgtgagaacacggaccccggctacaactgcctgccctgccccccacgcttcaccggctcacagcccttcggccagggtgtcgaacatgccacggccaacaaacaggtgtgcaagccccgtaacccctgcacggatgggacccacgactgcaacaagaacgccaagtgcaactacctgggccactatagcgaccccatgtaccgctgcgagtgcaagcctggctacgctggcaatggcatcatctgcggggaggacacagacctggatggctggcccaatgagaacctggtgtgcgtggccaatgcgacttaccactgcaaaaaggataattgccccaaccttcccaactcagggcaggaagactatgacaaggatggaattggtgatgcctgtgatgatgacgatgacaatgataaaattccagatgacagggacaactgtccattccattacaacccagctcagtatgactatgacagagatgatgtgggagaccgctgtgacaactgtccctacaaccacaacccagatcaggcagacacagacaacaatggggaaggagacgcctgtgctgcagacattgatggagacggtatcctcaatgaacgggacaactgccagtacgtctacaatgtggaccagagagacactgatatggatggggttggagatcagtgtgacaattgccccttggaacacaatccggatcagctggactctgactcagaccgcattggagatacctgtgacaacaatcaggatattgatgaagatggccaccagaacaatctggacaactgtccctatgtgcccaatgccaaccaggctgaccatgacaaagatggcaagggagatgcctgtgaccacgatgatgacaacgatggcattcctgatgacaaggacaactgcagactcgtgcccaatcccgaccagaaggactctgacggcgatggtcgaggtgatgcctgcaaagatgattttgaccatgacagtgtgccagacatcgatgacatctgtcctgagaatgttgacatcagtgagaccgatttccgccgattccagatgattcctctggaccccaaagggacatcccaaaatgaccctaactgggttgtacgccatcagggtaaagaactcgtccagactgtcaactgtgatcctggactcgctgtaggttatgatgagtttaatgctgtggacttcagtggcaccttcttcatcaacaccgaaagggacgatgactatgctggatttgtctttggctaccagtccagcagccgcttttatgttgtgatgtggaagcaagtcacccagtcctactgggacaccaaccccacgagggctcagggatactcgggcctttctgtgaaagttgtaaactccaccacagggcctggcgagcacctgcggaacgccctgtggcacacaggaaacacccctggccaggtgcgcaccctgtggcatgaccctcgtcacataggctggaaagatttcaccgcctacagatggcgtctcagccacaggccaaagacgggtttcattagagtggtgatgtatgaagggaagaaaatcatggctgactcaggacccatctatgataaaacctatgctggtggtagactagggttgtttgtcttctctcaagaaatggtgttcttctctgacctgaaatacgaatgtagagatccctaatcatcaaattgttgattgaaagactgatcataaaccaatgctggtattgcaccttctggaactatgggcttgagaaaacccccagggtgtcgaacatgccacggccaacaaacaggtgtgcaagccccgtaacccctgcacggatgggacccacgactgcaacaagaacgccaagtgcaactacctgggccactatagcgaccccatgtaccgctgcgagtgcaagcctggctagctgccattgcctggtcacattgaaattggtggcttcattctagatgtagcttgtgcagatgtagcaggaaaataggaaaacctaccatctcagtgagcaccagctgcctcccaaaggaggggcagccgtgcttatatttttatggttacaatggcacaaaattattatcaacctaactaaaacattccttttctcttttttcctgaattatcatggagttttctaattctctcttttggaatgtagattttttttaaatgctttacgatgtaaaatatttattttttacttattctggaagatctggctgaaggattattcatggaacaggaagaagcgtaaagactatccatgtcatctttgttgagagtcttcgtgactgtaagattgtaaatacagattatttattaactctgttctgcctggaaatttaggcttcatacggaaagtgtttgagagcaagtagttgacatttatcagcaaatctcttgcaagaacagcacaaggaaaatcagtctaataagctgctctgccccttgtgctcagagtggatgttatgggattctttttttctctgttttatcttttcaagtggaattagttggttatccatttgcaaatgttttaaattgcaaagaaagccatgaggtcttcaatactgttttaccccatcccttgtgcatatttccagggagaaggaaagcatatacacttttttctttcatttttccaaaagagaaaaaaatgacaaaaggtgaaacttacatacaaatattacctcatttgttgtgtgactgagtaaagaatttttggatcaagcggaaagagtttaagtgtctaacaaacttaaagctactgtagtacctaaaaagtcagtgttgtacatagcataaaaactctgcagagaagtattcccaataaggaaatagcattgaaatgttaaatacaatttctgaaagttatgttttttttctatcatctggtataccattgctttatttttataaattattttctcattgccattggaatagatatctcagattgtgtagatatgctatttaaataatttatcaggaaatactgcctgtagagttagtatttctatttttatataatgtttgcacactgaattgaagaattgttggttttttcttttttttggttttgttttttttttttttttttttgcttttgacctcccatttttactatttgccaatacctttttctaggaatgtgcttttttttgtacacatttttatccattttacattctaaagcagtgtaagttgtatattactgtttcttatgtacaaggaacaacaataaatcatatggaaattta

SEQ ID NO: 329433 - DNA, 3463 bp, Homo sapiens
tttctagctggaaagttgcgcgccaggcagcggggggcggagagaggagcccagactggcccccacctcccgcttcctgcccggccgccgcccattggccggaggaatccccaggaatgcgagcgcccctttaaaagcgcgcggctcctccgccttgccagccgctgcgcccgagctggcctgcgagttcagggctcctgtcgctctccaggagcaacctctactccggacgcacaggcattccccgcgcccctccagccctcgccgccctcgccaccgctcccggccgccgcgctccggtacacacaggatccctgctgggcaccaacagctccaccatggggctggcctggggactaggcgtcctgttcctgatgcatgtgtgtggcaccaaccgcattccagagtctggcggagacaacagcgtgtttgacatctttgaactcaccggggccgcccgcaaggggtctgggcgccgactggtgaagggccccgacccttccagcccagctttccgcatcgaggatgccaacctgatcccccctgtgcctgatgacaagttccaagacctggtggatgctgtgcgggcagaaaagggtttcctccttctggcatccctgaggcagatgaagaagacccggggcacgctgctggccctggagcggaaagaccactctggccaggtcttcagcgtggtgtccaatggcaaggcgggcaccctggacctcagcctgaccgtccaaggaaagcagcacgtggtgtctgtggaagaagctctcctggcaaccggccagtggaagagcatcaccctgtttgtgcaggaagacagggcccagctgtacatcgactgtgaaaagatggagaatgctgagttggacgtccccatccaaagcgtcttcaccagagacctggccagcatcgccagactccgcatcgcaaaggggggcgtcaatgacaatttccagggggtgctgcagaatgtgaggtttgtctttggaaccacaccagaagacatcctcaggaacaaaggctgctccagctctaccagtgtcctcctcacccttgacaacaacgtggtgaatggttccagccctgccatccgcactaactacattggccacaagacaaaggacttgcaagccatctgcggcatctcctgtgatgagctgtccagcatggtcctggaactcaggggcctgcgcaccattgtgaccacgctgcaggacagcatccgcaaagtgactgaagagaacaaagagttggccaatgagctgaggcggcctcccctatgctatcacaacggagttcagtacagaaataacgaggaatggactgttgatagctgcactgagtgtcactgtcagaactcagttaccatctgcaaaaaggtgtcctgccccatcatgccctgctccaatgccacagttcctgatggagaatgctgtcctcgctgttggcccagcgactctgcggacgatggctggtctccatggtccgagtggacctcctgttctacgagctgtggcaatggaattcagcagcgcggccgctcctgcgatagcctcaacaaccgatgtgagggctcctcggtccagacacggacctgccacattcaggagtgtgacaagagatttaaacaggatggtggctggagccactggtccccgtggtcatcttgttctgtgacatgtggtgatggtgtgatcacaaggatccggctctgcaactctcccagcccccagatgaacgggaaaccctgtgaaggcgaagcgcgggagaccaaagcctgcaagaaagacgcctgccccatcaatggaggctggggtccttggtcaccatgggacatctgttctgtcacctgtggaggaggggtacagaaacgtagtcgtctctgcaacaaccccacaccccagtttggaggcaaggactgcgttggtgatgtaacagaaaaccagatctgcaacaagcaggactgtccaattgatggatgcctgtccaatccctgctttgccggcgtgaagtgtactagctaccctgatggcagctggaaatgtggtgcttgtccccctggttacagtggaaatggcatccagtgcacagatgttgatgagtgcaaagaagtgcctgatgcctgcttcaaccacaatggagagcaccggtgtgagaacacggaccccggctacaactgcctgccctgccccccacgcttcaccggctcacagcccttcggccagggtgtcgaacatgccacggccaacaaacaggtgtgcaagccccgtaacccctgcacggatgggacccacgactgcaacaagaacgccaagtgcaactacctgggccactatagcgaccccatgtaccgctgcgagtgcaagcctggctacgctggcaatggcatcatctgcggggaggacacagacctggatggctggcccaatgagaacctggtgtgcgtggccaatgcgacttaccactgcaaaaaggataattgccccaaccttcccaactcagggcaggaagactatgacaaggatggaattggtgatgcctgtgatgatgacgatgacaatgataaaattccagatgacagggacaactgtccattccattacaacccagctcagtatgactatgacagagatgatgtgggagaccgctgtgacaactgtccctacaaccacaacccagatcaggcagacacagacaacaatggggaaggagacgcctgtgctgcagacattgatggagacggtatcctcaatgaacgggacaactgccagtacgtctacaatgtggaccagagagacactgatatggatggggttggagatcagtgtgacaattgccccttggaacacaatccggatcagctggactctgactcagaccgcattggagatacctgtgacaacaatcaggatattgatgaagatggccaccagaacaatctggacaactgtccctatgtgcccaatgccaaccaggctgaccatgacaaagatggcaagggagatgcctgtgaccacgatgatgacaacgatggcattcctgatgacaaggacaactgcagactcgtgcccaatcccgaccagaaggactctgacggcgatggtcgaggtgatgcctgcaaagatgattttgaccatgacagtgtgccagacatcgatgacatctgtcctgagaatgttgacatcagtgagaccgatttccgccgattccagatgattcctctggaccccaaagggacatcccaaaatgaccctaactgggttgtacgccatcagggtaaagaactcgtccagactgtcaactgtgatcctggactcgctgtaggttatgatgagtttaatgctgtggacttcagtggcaccttcttcatcaacggggaggaacgggacatgaagattggtgtgtaacacctacaccattatcttggaaagatacaacgggagaacggtgcgag

SEQ ID NO: 329434 - DNA, 3119 bp, Homo sapiens
tttctagctggaaagttgcgcgccaggcagcggggggcggagagaggagcccagactggcccccacctcccgcttcctgcccggccgccgcccattggccggaggaatccccaggaatgcgagcgcccctttaaaagcgcgcggctcctccgccttgccagccgctgcgcccgagctggcctgcgagttcagggctcctgtcgctctccaggagcaacctctactccggacgcacaggcattccccgcgcccctccagccctcgccgccctcgccaccgctcccggccgccgcgctccggtacacacaggatccctgctgggcaccaacagctccaccatggggctggcctggggactaggcgtcctgttcctgatgcatgtgtgtggcaccaaccgcattccagagtctggcggagacaacagcgtgtttgacatctttgaactcaccggggccgcccgcaaggggtctgggcgccgactggtgaagggccccgacccttccagcccagctttccgcatcgaggatgccaacctgatcccccctgtgcctgatgacaagttccaagacctggtggatgctgtgcgggcagaaaagggtttcctccttctggcatccctgaggcagatgaagaagacccggggcacgctgctggccctggagcggaaagaccactctggccaggtcttcagcgtggtgtccaatggcaaggcgggcaccctggacctcagcctgaccgtccaaggaaagcagcacgtggtgtctgtggaagaagctctcctggcaaccggccagtggaagagcatcaccctgtttgtgcaggaagacagggcccagctgtacatcgactgtgaaaagatggagaatgctgagttggacgtccccatccaaagcgtcttcaccagagacctggccagcatcgccagactccgcatcgcaaaggggggcgtcaatgacaatttccagggggtgctgcagaatgtgaggtttgtctttggaaccacaccagaagacatcctcaggaacaaaggctgctccagctctaccagtgtcctcctcacccttgacaacaacgtggtgaatggttccagccctgccatccgcactaactacattggccacaagacaaaggacttgcaagccatctgcggcatctcctgtgatgagctgtccagcatggtcctggaactcaggggcctgcgcaccattgtgaccacgctgcaggacagcatccgcaaagtgactgaagagaacaaagagttggccaatgagctgaggcggcctcccctatgctatcacaacggagttcagtacagaaataacgaggaatggactgttgatagctgcactgagtgtcactgtcagaactcagttaccatctgcaaaaaggtgtcctgccccatcatgccctgctccaatgccacagttcctgatggagaatgctgtcctcgctgttggcccagcgactctgcggacgatggctggtctccatggtccgagtggacctcctgttctacgagctgtggcaatggaattcagcagcgcggccgctcctgcgatagcctcaacaaccgatgtgagggctcctcggtccagacacggacctgccacattcaggagtgtgacaagagatttaaacaggatggtggctggagccactggtccccgtggtcatcttgttctgtgacatgtggtgatggtgtgatcacaaggatccggctctgcaactctcccagcccccagatgaacgggaaaccctgtgaaggcgaagcgcgggagaccaaagcctgcaagaaagacgcctgccccatcaatggaggctggggtccttggtcaccatgggacatctgttctgtcacctgtggaggaggggtacagaaacgtagtcgtctctgcaacaaccccacaccccagtttggaggcaaggactgcgttggtgatgtaacagaaaaccagatctgcaacaagcaggactgtccaattgatggatgcctgtccaatccctgctttgccggcgtgaagtgtactagctaccctgatggcagctggaaatgtggtgcttgtccccctggttacagtggaaatggcatccagtgcacagatgttgatgagtgcaaagaagtgcctgatgcctgcttcaaccacaatggagagcaccggtgtgagaacacggaccccggctacaactgcctgccctgccccccacgcttcaccggctcacagcccttcggccagggtgtcgaacatgccacggccaacaaacaggtacagtcaactagacgagtaaaccagaggacaggagagctgtccttgaccaaaataactgggagcgggaggaatgtaatttcatacccttcaccaaaaaaaaaagggcgaggagatgaatgtacggtctagttttagaaacgtgattagaaaatccatggtaaatcctgcaggggaaaaacagtcttccatatttaaaaatgctgctctggaataagttgtgagcagatggacttgtaaacgcctaggtgctgagcaaattcaagaaaaataaacataaagcaaagtttgcttatagcctcagggagaatggggagggacagaggtaacccacactcttccaaatggagcctctgtctactcagagatgacagggatctggattcttgtttccatgatatctgaggattctcaaaagctctgtgtaacagcagcatggtgtaccctcaggtgtgcaagccccgtaacccctgcacggatgggacccacgactgcaacaagaacgccaagtgcaactacctgggccactatagcgaccccatgtaccgctgcgagtgcaagcctggctacgctggcaatggcatcatctgcggggaggacacagacctggatggctggcccaatgagaacctggtgtgcgtggccaatgcgacttaccactgcaaaaaggacaattgccccaaccttccgcaggatccagctccctgcccgaggtcatgactgtcgccacatacagtgctttgacctggagtcgtacctgcagctcaactgtgagcgggggacttggaggtgtcctgtgtgcaacaagacagctttgctggagggcctggaggtggaccagtacatgctgggcat

SEQ ID NO: 329435 - DNA, 2012 bp, Homo sapiens
tttctagctggaaagttgcgcgccaggcagcggggggcggagagaggagcccagactggcccccacctcccgcttcctgcccggccgccgcccattggccggaggaatccccaggaatgcgagcgcccctttaaaagcgcgcggctcctccgccttgccagccgctgcgcccgagctggcctgcgagttcagggctcctgtcgctctccaggagcaacctctactccggacgcacaggcattccccgcgcccctccagccctcgccgccctcgccaccgctcccggccgccgcgctccggtacacacaggatccctgctgggcaccaacagctccaccatggggctggcctggggactaggcgtcctgttcctgatgcatgtgtgtggcaccaaccgcattccagagtctggcggagacaacagcgtgtttgacatctttgaactcaccggggccgcccgcaaggggtctgggcgccgactggtgaagggccccgacccttccagcccagctttccgcatcgaggatgccaacctgatcccccctgtgcctgatgacaagttccaagacctggtggatgctgtgcgggcagaaaagggtttcctccttctggcatccctgaggcagatgaagaagacccggggcacgctgctggccctggagcggaaagaccactctggccaggtcttcagcgtggtgtccaatggcaaggcgggcaccctggacctcagcctgaccgtccaaggaaagcagcacgtggtgtctgtggaagaagctctcctggcaaccggccagtggaagagcatcaccctgtttgtgcaggaagacagggcccagctgtacatcgactgtgaaaagatggagaatgctgagttggacgtccccatccaaagcgtcttcaccagagacctggccagcatcgccagactccgcatcgcaaaggggggcgtcaatgacaatttccagggggtgctgcagaatgtgaggtttgtctttggaaccacaccagaagacatcctcaggaacaaaggctgctccagctctaccagtgtcctcctcacccttgacaacaacgtggtgaatggttccagccctgccatccgcactaactacattggccacaagacaaaggacttgcaagccatctgcggcatctcctgtgatgagctgtccagcatggtcctggaactcaggggcctgcgcaccattgtgaccacgctgcaggacagcatccgcaaagtgactgaagagaacaaagagttggccaatgagctgaggcggcctcccctatgctatcacaacggagttcagtacagaaataacgaggaatggactgttgatagctgcactgagtgtcactgtcagaactcagttaccatctgcaaaaaggtgtcctgccccatcatgccctgctccaatgccacagttcctgatggagaatgctgtcctcgctgttggcccagcgactctgcggacgatggctggtctccatggtccgagtggacctcctgttctacgagctgtggcaatggaattcagcagcgcggccgctcctgcgatagcctcaacaaccgatgtgagggctcctcggtccagacacggacctgccacattcaggagtgtgacaagagatgtaagcatcttagcctctcagggacgtggagaactgacctgtccttgttgtcgtcaccaagggcagctccacagcatgtatattaagaacacgggttctaggatctctggatcccaatcccactgcttagctgtgcacccttgaacacaacttaccctctctgaggctctttcctcatttgcaacttggagataataatagttcttgataagtttatcttgagcattttatttagatactgcatgtaaagcagttagcactgagttttggtttatggtaagcaccctgtaaatgttaggatattaacagcaacccataaaaacagcgaacttatccgttctctggtagaaaacattccatgttgacatttgggcatgtgg

SEQ ID NO: 329436 - DNA, 186 bp, Homo sapiens
cattccactagagcattgacagccctgaccatgttttggcttgtaaaggaaatgttacaggatgtagacttctgtatgcaacatgctcagcagcctgttcccctctcactctcttgccctgcagaactcagttaccatctgcaaaaaggtgtcctgccccatcatgccctgctccaatgccacagt

SEQ ID NO: 329437 - DNA, 486 bp, Homo sapiens
ctgttcctgatgcatgtgtgtggcaccaaccgcattccaggtgagtttgtgtggcacctttaggggaaggagggacaaggaagaggtgctggctatcccaggtgtgccccctcacgtgctgtcctctccctcttgagcctgactggacatcaggacgcagcttcactctgatcctggtatttattcacctctttcagtggttgccaggagttttcaccccaaccctttgtctccacccctaaggactcagccccctactgctggtcccagcctagaaagctcactttgtgttctctcctgtctaacagagtctggcggagacaacagcgtgtttgacatctttgaactcaccggggccgcccgcaaggggtctgggcgccgactggtgaagggccccgacccttccagcccagctttccgcatcgaggatgccaacctgatcccccctgtgcctgatgacaagttccaagacctggtggatgctgt

SEQ ID NO: 329438 - DNA, 553 bp, Homo sapiens
tactgcaacccgcagccacactgaattcccctcactggcctctcctagactctcttggtgactttgcacattctgttctttcagcctgaaacaaccttccctgctgtttccttggtgaggcggttttcagggcttagcccaagcatcacctaatctgtggggattccctgcaccggctcctctctgggctgccctagttctatgccatgcagccctcacagccaggctgggcaggactggttttacttttttgtttgactacccagctaggatggtgttcctggaaggaagggggacgtctcattcctcgctgtgccactgatgtctagcacgcatgcctagcacacagagctgtgtaagggtatgaatagaatacatgacacaggattttattaatcttccagaatgaaaggactggaggccaggcacagtggctcaagcctgtaatcccagcactttgcgaggccgaggcgggcagatcacctggggtcagcagttcaagaccagcctggccaacatggtgaaaccccgtctctactaaaaatacaaaaat

SEQ ID NO: 329439 - DNA, 499 bp, Homo sapiens
aaaaagccaagctccccatacagtgcggcatccctttcttacaacgccctttaaatcaagtttccaaaatggctagaactgagcagtatgatccttacacacacacctgtgtatgatcagacctggaaagcaagggcagggtagtctgcaaattgagaggatgcctccagtggggaggaactcgaaggggagaaggaatggggctgctctagttctggctgctgggttcatgggtgtccatgatattattttaaaatgttcaacaggaataataaagacttttaaagggcccgtcatggaccaatgagtaagttaagttcagtgtgtgatgaaccaaaggtgatactgtatccaactcattgtacataaaggccaggttaaatttttcaaaagccccagggcccccaaatgtgaagtataaaatttggaggccaaaccagggccccaattcctcccggctccacatgggcacaggtagcgccccccaattgcccgcctt

SEQ ID NO: 329440 - DNA, 758 bp, Homo sapiens
ggttaattggtttaatttgcttttccacagcctcctgacactccgcgtgtgcagcctggtgagaaaccctaaccacagcaggtgctgtggagtgccagctgtctgcagtggggaggccctgatgccacctggggaggccgctgaggacccccggggtccggggggcagggcagcagcatgacatttcccagcaggaggccctcgggcatttctcttgacccctccgtcttttaggtgaggaacctgaggagcggacaggctgggcaacttgtcccaggaggcatgcagcaagcccggcaaccctgtggcacccacactgcagtcccattccccataccactgtcgggggcagtggggcgggcgacatgcctgctctagagccaggcaggcgacatgcctgctccagagcccagcaggctagacctggctctccaagcactgtccctggaggacaagcccctgtctatgagatggcgatggcgaggggagccacccccaggcgagaggggcagcgatacccgtgctggtgcaaagagctccagaaactcgccctgttgtttcgtgctcatcatgaccactgccctctatctgcaagagttgcaggcacctcctgggaggtggcagaggagcccttcgcaggtgccatgagggctgaaggggtccgcgcaccccctggagcgagacaggcaaacacgagtcactcccctacccctgacacatcctcctcaccacagggccctggcaatcacgagccctgg

SEQ ID NO: 329441 - DNA, 533 bp, Homo sapiens
ggtgtagaggccctcggtgagcactgaggggagaagcacagagaaggaaggggacaggacccactcaggaaattcaacatccactgagtcaggaaaaccttccccatctgctgtctagctgagagtctttgggaaaccactgtgcctcagcttccctgtctccaaggaaatgattgacatggctgcctgcttcaacaggaacacagggacatgaggaggagaaatgtgggctctggcagcacaggaatagccttcagcaaggacagtgtgctcagaaccctcacctctgtggcaaccaagggtaccttcccaggcctgtctttctctatccagtaaaaatgagattcagggctcaagcagagcctgcgaaggtccaacaactaccattcccaggagacccctggagattatgcgtgaattacatgacaatggcacgtcttaccggctcagaagacttggcgagtgtgcagtgttgggggagggcgtttgctggcagagtcaaggagaggttgaggaggctgtgaggaggaagg

SEQ ID NO: 329442 - DNA, 537 bp, Homo sapiens
tagactaatgtatcgcgacgtgttatcaatctcactgcttctactctgctacccctacaatccattatcctcaaagcagccagaatcatggtactacaatataaatataaactagattatgtcattgcctgctttatactcttccacaacttcccatatttaggtttaaatcttaactcttcaccagaggcccccatgtacccttttgagagcatgttacatcactcctgccctcgattcagacacagattgcctccatttggttcctttaacaggccaagttcattcttacctaagggtcttgagctaacttttcttaatgccacaatattctgctctcagttcttcatgtagctgactcttgctattcacatctcagcttaaaggacaactcctctgagagcatctttaatcatccaatttaaagtagccatctgggagacttatactttggacaagatagagtaacaggaaccagacttatccccctacctgaaacaactataaaaacagacacaatatatggatcaatagtgt

SEQ ID NO: 329443 - DNA, 485 bp, Homo sapiens
gacagtaagacaatagaccattcatctttgtgtcacccaaacaaagaaatattcctttataaccccctttcctccccccacctaatcacatgctactggaactgactgtcttgtgatctactcccatagttggcatagatttaaaaataatcttttttaaattaatctgatagtagttatggaaaggaacaaattgttcaccaattttcatcagctttatcttttcagtccagtaactgagaacttaaaaagactattctagtgattttactatcctgctcagatggcattcaaaaacatttttcacttctcacgtcttggaaaaatttgtaaattcgttaagtctttttgtttgaaagttaatgtgactggaaatattttaatgtaaatatcgggttgggtgcattgtatcattttgctctacaatgactatatcctcatttgggtttatggccagtttataattaaaagtaatctttacttgc

SEQ ID NO: 329444 - DNA, 255 bp, Homo sapiens
gctcagacacttcaggaaacaaatgggtatgatatactacttttgaatgtttacatactctgcaacccagaaatcctacttttggggaatataccccagaaaaacactgatgtgtgtgtaccaagagacatgaataagagcattcacagcaacagtggcagaatactgaggaaaatgaaataggagaacttaactgatcatagatgaggcatattgtggtatattcacacaaatatacaaccgtggaagtaaatg

SEQ ID NO: 329445 - DNA, 327 bp, Homo sapiens
ctgctcccagcaggagggacgggatatgctctgagctcactcagcccttctggcactgactcggttctcatctctcgccttgcatagtatttgtgtggcggtgtggcttatcgctgccctgtcctctgactctggagggtgggggctgtttctgacttacctcttggtggcagcactcaggatgggccttgcctaatgtaggtgctcagaaaattagttgtcgttagttgaacaacagagacagcacagggaagtggtttccctgtggttaaaatataggaccttgaaggctgggtttggatagagaaacgtggggagggtgagatg

SEQ ID NO: 329446 - DNA, 1272 bp, Homo sapiens
  misc_feature (3)..(3): n is a, c, g, or t
  misc_feature (45)..(45): n is a, c, g, or t
ggnggggttgtcttgggccgggcagggcgggtaagttgtcgtagnggcccggtccgtgagggactgctaaggaagaggctgcatggcgcggtagtcccccgagtggaggtcggctgcccctgggaaaccagagagtcggagggagtccatctggagcggccaagtggtgactctcaaaaggaaataggatcatggcagcagatgatgacaatggtgatggaacaagtttatttgatgtcttttctgcttctcctcttaagaacaatgatgaaggctcactggacatatacgctgggttggacagtgctgtttctgacagcgcttccaaatcctgtgtaccatcaagaaattgtttggacttatatgaagagatcctgactgaagaaggaactgcaaaggaggcaacatataatgatttgcaagtagaatatggaaaatgtcaactacaaatgaaagagctgatgaaaaaatttaaagaaatacagacacagaatttcagcttaataaacgaaaaccagtctcttaagaagaatatttcagcacttatcaaaactgccagagtggaaataaaccgcaaggatgaagaaataagtaatcttcaccaaagattgtctgagtttccacattttcgaaataatcataaaactgcaaggacatttgatacagttaaaacaaaagatcttaaatctagatctccacatttggatgattgttcaaagactgatcacagagctaaaagtgatgtttctaaagatgtacatcatagcacttcactgccaaatctggaaaaggaaggaaaaccacattctgataaaaggagtacttcacatttacctacatctgttgagaaacactgcactaatggtgtttggtcacgttctcattatcaggttggcgagggtagctcaaatgaggatagtagaagaggaagaaaagatattagacatagccagtttaacagaggaactgaaagagtacgaaaagacttaagtactggctgtggtgatggtgaaccaaggatattggaggctagtcaaaggctacaaggacatcctgagaaatatggtaaaggtgaaccaaagactgaaagcaaaagttcgaagtttaaaagtaactcagattctgactataaaggtgaacgcattaactcttcttgggagaaagagacccctggagaaaggtcacacagtcgagtagactctcaaagtgacaaaaaactagaaagacaaagtgaaagatcacaaaatataaataggaaagaagttaaatcac

SEQ ID NO: 329447 - DNA, 947 bp, Homo sapiens
  misc_feature (3)..(3): n is a, c, g, or t
  misc_feature (45)..(45): n is a, c, g, or t
ggnggggttgtcttgggccgggcagggcgggtaagttgtcgtagnggcccggtccgtgagggactgctaaggaagaggctgcatggcgcggtagtcccccgagtggaggtcggctgcccctgggaaaccagagagtcggagggagtccatctggagcggccaagtggtgactctcaaaaggaaataggatcatggcagcagatgatgacaatggtgatggaacaagtttatttgatgtcttttctgcttctcctcttaagaacaatgatgaaggctcactggacatatacgctgggttggacagtgctgtttctgacagcgcttccaaatcctgtgtaccatcaagaaattgtttggacttatatgaagagatcctgactgaagaaggaactgcaaaggaggcaacatataatgatttgcaagtagaatatggaaaatgtcaactacaaatgaaagagctgatgaaaaaatttaaagaaatacagacacagaatttcagcttaataaacgaaaaccagtctcttaagaagaatatttcagcacttatcaaaactgccagagtggaaataaaccgcaaggatgaagaaataagtaatcttcaccaaagaaatgatgaccgggaaattttattggagtgtcagaaaagagggccatcatttaaaacatttgcatatttagccgccaagttggataaaaatccaaatcaggtctcagaaagattccagcagctaatgaagctctttgaaaagtcaaaatgcagataagttgctgaattcctgggactcttaactgatattgcatactacacagaagcttcaaattcctcatgttttaaatgagcactagagggagggtttatcacctttttggttaccagatgattatctatatttggttattactcagtgactctctaatttcacatcagcatgttcagcttgtgctag

SEQ ID NO: 329448 - DNA, 4207 bp, Homo sapiens
atggatgtattacaaacagatgtgtctcaaaactttggcttggaattggataccaaaagaaatgataattcagattattgtggtatttctgaaggtatggagatgaaggtggcactttcaacaacagtgagtgaaaccactgaaagcattttgcagccttcaattgaggaagctgatattttgccaataatgctttcagaagataataacccaaaatttgagccttctgttatagttacaccactggttgagagtaagtcgtgtcatctggagccttgcttacctaaagagactctagattcttcacttcagcagactgagttaatggaccacagaatggcaactggtgaaacaaactcagtatatcatgatgatgataactcggttttgagcattgaccttaatcacctgagacctattccagaagccatcagtcctctgaatagtccagtgagacctgtagcaaaagttcttagaaatgaaagcccacctcaagttccagtgtataataacagtcataaagatgtgtttttaccaaattcagctcattctacctctaagagtcagtctgatctcaataaggaaaatcaaaagccaatttacaaatctgacaaatgtacagaagcagacacatgtaagaattcaccattagatgaattagaagaaggagaaattagaagtgatagtgaaacatctaaaccacaagaaagttttgaaaaaaattccaaacgtagagtgtcagctgatgtgcggaagtcaaagactatcccacgacgtgggaaaagtactgtgtgtttagataaagacagtaggaaaacacatgtaagaatccatcagaccaataacaaatggaataaaagacctgataaatctagcagatcttcaaaaacagagaagaaagataaagtgatgagcacttccagcttggaaaaaatagttccaattattgctgtaccctcttctgaacaagagatcatgcacatgttacgaatgataagaaaacatgtaagaaaaaattatatgaaattcaaggcaaaattttcattaatacaatttcacagaattattgagtcagcaattttgagttttacatctttaattaaacatctcaacttacacaaaatctctaagtcagtgactaccttacagaagaatctctgtgatattatagagtctaaacttaagcaagttaaaaagaatggcatagttgatcgtttatttgaacagcaactaccagatatgaaaaaaaaattgtggaagtttgtagatgaccaacttgattatttgtttgcaaagcttaagaaaatcttagtatgtgattccaaaagctttggaagagatagtgatgaaggcaaacttgaaaaaacaagtaaacagaatgcacagtattcaaatagtcagaaaaggagtgtggacaactccaacagagaattgctgaaagaaaaattatcaaaatcagaagaccctgttcattataagtctttagtgggatgtaaaaaatctgaggaaaattatcaagaccaaaataactccagtattaacactgtaaagcatgacattaaaaaaaattttaacatctgctttgataatataaagaactctcaatccgaagagcgctccttggaagtacactgtccaagcaccccaaagtcagaaaaaaacgaaggaagcagcatagaggatgcacagacatcccagcatgcaactttgaagccagaacgaagtttcgagattcttaccgaacagcaagcatcgagccttacttttaatttagtgagtgatgcacaaatgggtgaaatatttaaaagtttgttgcaaggttctgatcttttagacagcagtgttaactgtactgaaaaaagtgagtgggagttaaagactccagagaagcagctgctagagactcttaagtgcgagtctataccagcttgtacaacagaagagctagtttcaggggtggcttctccatgtcctaaaatgattagtgatgataattggtcattattatcatctgaaaaaggtccatctctgtcttcagggctttcattgccggttcatcctgatgtgttggatgaaagttgtatgtttgaagtgtctactaacctacctttaagtaaagataatgtgtgtagtgtagaaaagagcaagccctgcgtttcttccatacttcttgaagatctagcagtctctttaacagtaccatcgcctctgaagtcagatggtcatctcagttttttaaagcctgatatgtcgtccagttcaactcctgaagaagtcattagtgctcattttagtgaagatgccttacttgaggaagaggatgcatctgagcaagatattcatttagctctggagtctgataattcaagcagtaaatcaagttgttcttcttcctggacaagccgatctgttgctccaggctttcagtaccaccctaatctacctatgcatgccgtcataatggaaaagtccaatgatcatttcattgtgaaaatacgacgtgcaacaccatctacctcttctggccttaaacagagtatgatgcctgatgaattattgacatctttgcccagacatggaaaggaagctgatgaaggaccagagaaagaatatatttcatgtcagaacacagtttttaaatctgtggaggaattggaaaactccaacaaaaatgttgatggcagcaagtcaactcatgaagaacagagctctatgatacaaacacaggttcctgatatatatgaatttcttaaagatgcttcagataagatgggtcatagtgatgaagtggctgatgaatgtttcaaattgcatcaagtatgggaaacaaaagtgcctgaaagcattgaagaattgccttcaatggaagaaatctcacactctgttggggaacatcttccaaacacatacgtagatctaacgaaagatccagtcactgaaaccaaaaacttgggggaattcatagaagtaacagttttacatattgatcagttgggatgttctggaggcaatttaaatcagagtgctcaaatattagacaattctttgcaggctgatactgtaggtgcttttattgatttgacacaagatgcttcaagtgaggctaaaagtgaaggtaatcatcctgcattagctgtggaagacttgggatgtggggtgatacaggtagatgaagataattgtaaggaagaaaaggcacaagtggcaaacaggcctttaaaatgcattgttgaggaaacctatatcgacttgaccacagaatctcccagttcatgtgaagtaaaaaaagatgagttaaaatcagagccaggatcaaattgtgataactcggagttgcctgggactttgcataattctcacaaaaagagaagaaacatttctgatctaaatcatcctcataaaaaacaaagaaaggaaacagacttaactaataaggaaaagaccaagaaacctacccaagattcttgtgagaatactgaagctcaccaaaagaaagccagtaagaagaaggcccctcctgtgactaaagatccctcatcattaaaggcaaccccagggattaaggattcatcagcagcacttgccacttctacaagtctttctgcaaaaaatgttattaaaaagaagggagaaattatcattttatggacaagaaatgatgaccgggaaattttattggagtgtcagaaaagagggccatcatttaaaacatttgcatatttagccgccaagttggataaaaatccaaatcaggtctcagaaagattccagcagctaatgaagctctttgaaaagtcaaaatgcaggtagttaatggttacactacaggagactagtgatgtgaatagtgggtgagagacatccagttgagttcctgcttcagtcacaggttggaggatgattgctcgagcaggcatctaaggtgacctcatccacagggacgtgctcagagtgaagcctgctgcagttcagatcagcatggcatctctcctcaaccttctgattgctgatgactctaagataagttgctgaattcctgggactcttaactgatattgcatactacacagaagcttcaaattcctcatgttttaaatgagcactagagggagggtttatcacctttttggttaccagatgattatctatatttggttattactcagtgactctctaatttcacatcagcatgttcagcttgtgctag

SEQ ID NO: 329449 - DNA, 1748 bp, Homo sapiens
  misc_feature (3)..(3): n is a, c, g, or t
  misc_feature (45)..(45): n is a, c, g, or t
ggnggggttgtcttgggccgggcagggcgggtaagttgtcgtagnggcccggtccgtgagggactgctaaggaagaggctgcatggcgcggtagtcccccgagtggaggtcggctgcccctgggaaaccagagagtcggagggagtccatctggagcggccaagtggtgactctcaaaaggaaataggatcatggcagcagatgatgacaatggtgatggaacaagtttatttgatgtcttttctgcttctcctcttaagaacaatgatgaaggctcactggacatatacgctgggttggacagtgctgtttctgacagcgcttccaaatcctgtgtaccatcaagaaattgtttggacttatatgaagagatcctgactgaagaaggaactgcaaaggaggcaacatataatgatttgcaagtagaatatggaaaatgtcaactacaaatgaaagagctgatgaaaaaatttaaagaaatacagacacagaatttcagcttaataaacgaaaaccagtctcttaagaagaatatttcagcacttatcaaaactgccagagtggaaataaaccgcaaggatgaagaaataagtaatcttcaccaaagattgtctgagtttccacattttcgaaataatcataaaactgcaaggacatttgatacagttaaaacaaaagatcttaaatctagatctccacatttggatgattgttcaaagactgatcacagagctaaaagtgatgtttctaaagatgtacatcatagcacttcactgccaaatctggaaaaggaaggaaaaccacattctgataaaaggagtacttcacatttacctacatctgttgagaaacactgcactaatggtgtttggtcacgttctcattatcaggttggcgagggtagctcaaatgaggatagtagaagaggaagaaaagatattagacatagccagtttaacagaggaactgaaagagtacgaaaagacttaagtactggctgtggtgatggtgaaccaaggatattggaggctagtcaaaggctacaaggacatcctgagaaatatggtaaaggtgaaccaaagactgaaagcaaaagttcgaagtttaaaagtaactcagattctgactataaaggtgaacgcattaactcttcttgggagaaagagacccctggagaaaggtcacacagtcgagtagactctcaaagtgacaaaaaactagaaagacaaagtgaaagatcacaaaatataaataggaaagaagttaaatcacaagacaaagaagaaagaaaagttgatcaaaaacctaaatcagtagtaaaggaccaagatcactggagaagatctgaacgagcatcacttcctcattccaagaatgaaataacattttctcataattcaagtaaataccatctagaagagagaagaggatgggaagattgtaaaagagacaagagtgtaaacagtcatagttttcaagatggaagatgtccatcttctctttcaaacagtagaactcacaaaaacattgactctaaggaagttgatgccatgcatcagtgggaaaatacacctttaaaagcagaaagacatagaactgaagataagaggaaaagagaacaagaaagcaaagaagaaaataggcatattagaaatgaaaaaagagtacctacagaacatttgcagaagactaataaggaaactaagaaaaccactactgatttaaagaaacagaatgaaccaaagact

SEQ ID NO: 329450 - DNA, 957 bp, Homo sapiens
aattaaactaaagagcttctgcacagcaaaagaaactatcatcagagtgaacaggcaacctatagaatgggagaacatttttgctatctatccatctgacaaagggctaatatccagaatctataaagaacttaaacaaatttacaagaaaaaaacaaagaaaggaaacagacttaactaataaggaaaagaccaagaaacctacccaagattcttgtgagaatactgaagctcaccaaaagaaagccagtaagaagaaggcccctcctgtgactaaagatccctcatcattaaaggcaaccccagggattaaggattcatcagcagcacttgccacttctacaagtctttctgcaaaaaatgttattaaaaagaagggagaaattatcattttatggacaagaaatgatgaccgggaaattttattggagtgtcagaaaagagggccatcatttaaaacatttgcatatttagccgccaagttggataaaaatccaaatcaggtctcagaaagattccagcagctaatgaagctctttgaaaagtcaaaatgcaggtagttaatggttacactacaggagactagtgatgtgaatagtgggtgagagacatccagttgagttcctgcttcagtcacaggttggaggatgattgctcgagcaggcatctaaggtgacctcatccacagggacgtgctcagagtgaagcctgctgcagttcagatcagcatggcatctctcctcaaccttctgattgctgatgactctaagataagttgctgaattcctgggactcttaactgatattgcatactacacagaagcttcaaattcctcatgttttaaatgagcactagagggagggtttatcacctttttggttaccagatgattatctatatttggttattactcagtgactctctaatttcacatcagcatgttcagcttgtgctag

SEQ ID NO: 329451 - DNA, 948 bp, Homo sapiens
aagctaatgaaccaatgaattaacgaaattcgaggtcggtaacccggtaagaagagcttgtttggtattgagtgttgcctgggactttgcataattctcacaaaaagagaagaaacatttctgatctaaatcatcctcataaaaaacaaagaaaggaaacagacttaactaataaggaaaagaccaagaaacctacccaagattcttgtgagaatactgaagctcaccaaaagaaagccagtaagaagaaggcccctcctgtgactaaagatccctcatcattaaaggcaaccccagggattaaggattcatcagcagcacttgccacttctacaagtctttctgcaaaaaatgttattaaaaagaagggagaaattatcattttatggacaagaaatgatgaccgggaaattttattggagtgtcagaaaagagggccatcatttaaaacatttgcatatttagccgccaagttggataaaaatccaaatcaggtctcagaaagattccagcagctaatgaagctctttgaaaagtcaaaatgcaggtagttaatggttacactacaggagactagtgatgtgaatagtgggtgagagacatccagttgagttcctgcttcagtcacaggttggaggatgattgctcgagcaggcatctaaggtgacctcatccacagggacgtgctcagagtgaagcctgctgcagttcagatcagcatggcatctctcctcaaccttctgattgctgatgactctaagataagttgctgaattcctgggactcttaactgatattgcatactacacagaagcttcaaattcctcatgttttaaatgagcactagagggagggtttatcacctttttggttaccagatgattatctatatttggttattactcagtgactctctaatttcacatcagcatgttcagcttgtgctag

SEQ ID NO: 329452 - DNA, 839 bp, Homo sapiens
  misc_feature (19)..(19): n is a, c, g, or t
gcgggtaagttgtcgtagnggcccggtccgtgagggactgctaaggaagaggctgcatggcgcggtagtcccccgagtggaggtcggctgcccctgggaaaccagagagtcggagggagtccatctggagcggccaagtaggtcggggaagggccgcgcctgacgtctggccgcaggtagccacgttccctccgcccccggtgcagcttcagggcttgcaccctgcgtccctctgtggtccttcgagagggtctgggcggggactatgggtgggcgcgcccaggaattgtcccttcggcctctcgtcctgcccctcccccccaccatccagtctctccttggaatatactcttaaaatctttcggatggagttctttggagaaatgggtttcctggagtgtcaggtgatcattgatgttgattgtttctgaaatgtttatttaggcatcaaaccaacatgcctaaataagtttttcatttctacagcgcctagattcattcctagcacatagtaggccctaactcagatgtgaatgtaggattcgtaggagctgagcatttgtgcttcaggcatcaagttgtctttgactcttcgactcttccttggtctttttccattctccacacctccagcagcaaacctttcgcctctcctcaaggcctttcccccccatctccctcagcgcctctttgactggagggggacagaggctttcatggcagggattctcccatctcccttcctatccccgctatgccctccaattatcttttcctggcgttccgttttacaagagatggccttctttccaaaaacatttatattgtattgaatattc

SEQ ID NO: 329453 - DNA, 4260 bp, Homo sapiens
atggatgtattacaaacagatgtgtctcaaaactttggcttggaattggataccaaaagaaatgataattcagattattgtggtatttctgaaggtatggagatgaaggtggcactttcaacaacagtgagtgaaaccactgaaagcattttgcagccttcaattgaggaagctgatattttgccaataatgctttcagaagataataacccaaaatttgagccttctgttatagttacaccactggttgagagtaagtcgtgtcatctggagccttgcttacctaaagagactctagattcttcacttcagcagactgagttaatggaccacagaatggcaactggtgaaacaaactcagtatatcatgatgatgataactcggttttgagcattgaccttaatcacctgagacctattccagaagccatcagtcctctgaatagtccagtgagacctgtagcaaaagttcttagaaatgaaagcccacctcaagttccagtgtataataacagtcataaagatgtgtttttaccaaattcagctcattctacctctaagagtcagtctgatctcaataaggaaaatcaaaagccaatttacaaatctgacaaatgtacagaagcagacacatgtaagaattcaccattagatgaattagaagaaggagaaattagaagtgatagtgaaacatctaaaccacaagaaagttttgaaaaaaattccaaacgtagagtgtcagctgatgtgcggaagtcaaagactatcccacgacgtgggaaaagtactgtgtgtttagataaagacagtaggaaaacacatgtaagaatccatcagaccaataacaaatggaataaaagacctgataaatctagcagatcttcaaaaacagagaagaaagataaagtgatgagcacttccagcttggaaaaaatagttccaattattgctgtaccctcttctgaacaagagatcatgcacatgttacgaatgataagaaaacatgtaagaaaaaattatatgaaattcaaggcaaaattttcattaatacaatttcacagaattattgagtcagcaattttgagttttacatctttaattaaacatctcaacttacacaaaatctctaagtcagtgactaccttacagaagaatctctgtgatattatagagtctaaacttaagcaagttaaaaagaatggcatagttgatcgtttatttgaacagcaactaccagatatgaaaaaaaaattgtggaagtttgtagatgaccaacttgattatttgtttgcaaagcttaagaaaatcttagtatgtgattccaaaagctttggaagagatagtgatgaaggcaaacttgaaaaaacaagtaaacagaatgcacagtattcaaatagtcagaaaaggagtgtggacaactccaacagagaattgctgaaagaaaaattatcaaaatcagaagaccctgttcattataagtctttagtgggatgtaaaaaatctgaggaaaattatcaagaccaaaataactccagtattaacactgtaaagcatgacattaaaaaaaattttaacatctgctttgataatataaagaactctcaatccgaagagcgctccttggaagtacactgtccaagcaccccaaagtcagaaaaaaacgaaggaagcagcatagaggatgcacagacatcccagcatgcaactttgaagccagaacgaagtttcgagattcttaccgaacagcaagcatcgagccttacttttaatttagtgagtgatgcacaaatgggtgaaatatttaaaagtttgttgcaaggttctgatcttttagacagcagtgttaactgtactgaaaaaagtgagtgggagttaaagactccagagaagcagctgctagagactcttaagtgcgagtctataccagcttgtacaacagaagagctagtttcaggggtggcttctccatgtcctaaaatgattagtgatgataattggtcattattatcatctgaaaaaggtccatctctgtcttcagggctttcattgccggttcatcctgatgtgttggatgaaagttgtatgtttgaagtgtctactaacctacctttaagtaaagataatgtgtgtagtgtagaaaagagcaagccctgcgtttcttccatacttcttgaagatctagcagtctctttaacagtaccatcgcctctgaagtcagatggtcatctcagttttttaaagcctgatatgtcgtccagttcaactcctgaagaagtcattagtgctcattttagtgaagatgccttacttgaggaagaggatgcatctgagcaagatattcatttagctctggagtctgataattcaagcagtaaatcaagttgttcttcttcctggacaagccgatctgttgctccaggctttcagtaccaccctaatctacctatgcatgccgtcataatggaaaagtccaatgatcatttcattgtgaaaatacgacgtgcaacaccatctacctcttctggccttaaacagagtatgatgcctgatgaattattgacatctttgcccagacatggaaaggaagctgatgaaggaccagagaaagaatatatttcatgtcagaacacagtttttaaatctgtggaggaattggaaaactccaacaaaaatgttgatggcagcaagtcaactcatgaagaacagagctctatgatacaaacacaggttcctgatatatatgaatttcttaaagatgcttcagataagatgggtcatagtgatgaagtggctgatgaatgtttcaaattgcatcaagtatgggaaacaaaagtgcctgaaagcattgaagaattgccttcaatggaagaaatctcacactctgttggggaacatcttccaaacacatacgtagatctaacgaaagatccagtcactgaaaccaaaaacttgggggaattcatagaagtaacagttttacatattgatcagttgggatgttctggaggcaatttaaatcagagtgctcaaatattagacaattctttgcaggctgatactgtaggtgcttttattgatttgacacaagatgcttcaagtgaggctaaaagtgaaggtaatcatcctgcattagctgtggaagacttgggatgtggggtgatacaggtagatgaagataattgtaaggaagaaaaggcacaagtggcaaacaggcctttaaaatgcattgttgaggaaacctatatcgacttgaccacagaatctcccagttcatgtgaagtaaaaaaagatgagttaaaatcagagccaggatcaaattgtgataactcggagttgcctgggactttgcataattctcacaaaaagagaagaaacatttctgatctaaatcatcctcataaaaaacaaagaaaggaaacagacttaactaataaggaaaagaccaagaaacctacccaagattcttgtgagaatactgaagctcaccaaaagaaagccagtaagaagaaggcccctcctgtgactaaagatccctcatcattaaaggcaaccccagggattaaggattcatcagcagcacttgccacttctacaagtctttctgcaaaaaatgttattaaaaagaagggagaaattatcattttatggacaagaaatgatgaccgggaaattttattggagtgtcagaaaagagggccatcatttaaaacatttgcatatttagccgccaagttggataaaaatccaaatcaggtctcagaaagattccagcagctaatgaagctctttgaaaagtcaaaatgcaggtagttaatggttacactacaggagactagtaaaataaatgtttgacactgtagttgtgcagttaatggctgttagtcattgaagatgtgaatagtgggtgagagacatccagttgagttcctgcttcagtcacaggttggaggatgattgctcgagcaggcatctaaggtgacctcatccacagggacgtgctcagagtgaagcctgctgcagttcagatcagcatggcatctctcctcaaccttctgattgctgatgactctaagataagttgctgaattcctgggactcttaactgatattgcatactacacagaagcttcaaattcctcatgttttaaatgagcactagagggagggtttatcacctttttggttaccagatgattatctatatttggttattactcagtgactctctaatttcacatcagcatgttcagcttgtgctag

SEQ ID NO: 329454 - DNA, 3993 bp, Homo sapiens
atggatgtattacaaacagatgtgtctcaaaactttggcttggaattggataccaaaagaaatgataattcagattattgtggtatttctgaaggtatggagatgaaggtggcactttcaacaacagtgagtgaaaccactgaaagcattttgcagccttcaattgaggaagctgatattttgccaataatgctttcagaagataataacccaaaatttgagccttctgttatagttacaccactggttgagagtaagtcgtgtcatctggagccttgcttacctaaagagactctagattcttcacttcagcagactgagttaatggaccacagaatggcaactggtgaaacaaactcagtatatcatgatgatgataactcggttttgagcattgaccttaatcacctgagacctattccagaagccatcagtcctctgaatagtccagtgagacctgtagcaaaagttcttagaaatgaaagcccacctcaagttccagtgtataataacagtcataaagatgtgtttttaccaaattcagctcattctacctctaagagtcagtctgatctcaataaggaaaatcaaaagccaatttacaaatctgacaaatgtacagaagcagacacatgtaagaattcaccattagatgaattagaagaaggagaaattagaagtgatagtgaaacatctaaaccacaagaaagttttgaaaaaaattccaaacgtagagtgtcagctgatgtgcggaagtcaaagactatcccacgacgtgggaaaagtactgtgtgtttagataaagacagtaggaaaacacatgtaagaatccatcagaccaataacaaatggaataaaagacctgataaatctagcagatcttcaaaaacagagaagaaagataaagtgatgagcacttccagcttggaaaaaatagttccaattattgctgtaccctcttctgaacaagagatcatgcacatgttacgaatgataagaaaacatgtaagaaaaaattatatgaaattcaaggcaaaattttcattaatacaatttcacagaattattgagtcagcaattttgagttttacatctttaattaaacatctcaacttacacaaaatctctaagtcagtgactaccttacagaagaatctctgtgatattatagagtctaaacttaagcaagttaaaaagaatggcatagttgatcgtttatttgaacagcaactaccagatatgaaaaaaaaattgtggaagtttgtagatgaccaacttgattatttgtttgcaaagcttaagaaaatcttagtatgtgattccaaaagctttggaagagatagtgatgaaggcaaacttgaaaaaacaagtaaacagaatgcacagtattcaaatagtcagaaaaggagtgtggacaactccaacagagaattgctgaaagaaaaattatcaaaatcagaagaccctgttcattataagtctttagtgggatgtaaaaaatctgaggaaaattatcaagaccaaaataactccagtattaacactgtaaagcatgacattaaaaaaaattttaacatctgctttgataatataaagaactctcaatccgaagagcgctccttggaagtacactgtccaagcaccccaaagtcagaaaaaaacgaaggaagcagcatagaggatgcacagacatcccagcatgcaactttgaagccagaacgaagtttcgagattcttaccgaacagcaagcatcgagccttacttttaatttagtgagtgatgcacaaatgggtgaaatatttaaaagtttgttgcaaggttctgatcttttagacagcagtgttaactgtactgaaaaaagtgagtgggagttaaagactccagagaagcagctgctagagactcttaagtgcgagtctataccagcttgtacaacagaagagctagtttcaggggtggcttctccatgtcctaaaatgattagtgatgataattggtcattattatcatctgaaaaaggtccatctctgtcttcagggctttcattgccggttcatcctgatgtgttggatgaaagttgtatgtttgaagtgtctactaacctacctttaagtaaagataatgtgtgtagtgtagaaaagagcaagccctgcgtttcttccatacttcttgaagatctagcagtctctttaacagtaccatcgcctctgaagtcagatggtcatctcagttttttaaagcctgatatgtcgtccagttcaactcctgaagaagtcattagtgctcattttagtgaagatgccttacttgaggaagaggatgcatctgagcaagatattcatttagctctggagtctgataattcaagcagtaaatcaagttgttcttcttcctggacaagccgatctgttgctccaggctttcagtaccaccctaatctacctatgcatgccgtcataatggaaaagtccaatgatcatttcattgtgaaaatacgacgtgcaacaccatctacctcttctggccttaaacagagtatgatgcctgatgaattattgacatctttgcccagacatggaaaggaagctgatgaaggaccagagaaagaatatatttcatgtcagaacacagtttttaaatctgtggaggaattggaaaactccaacaaaaatgttgatggcagcaagtcaactcatgaagaacagagctctatgatacaaacacaggttcctgatatatatgaatttcttaaagatgcttcagataagatgggtcatagtgatgaagtggctgatgaatgtttcaaattgcatcaagtatgggaaacaaaagtgcctgaaagcattgaagaattgccttcaatggaagaaatctcacactctgttggggaacatcttccaaacacatacgtagatctaacgaaagatccagtcactgaaaccaaaaacttgggggaattcatagaagtaacagttttacatattgatcagttgggatgttctggaggcaatttaaatcagagtgctcaaatattagacaattctttgcaggctgatactgtaggtgcttttattgatttgacacaagatgcttcaagtgaggctaaaagtgaaggtaatcatcctgcattagctgtggaagacttgggatgtggggtgatacaggtagatgaagataattgtaaggaagaaaaggcacaagtggcaaacaggcctttaaaatgcattgttgaggaaacctatatcgacttgaccacagaatctcccagttcatgtgaagtaaaaaaagatgagttaaaatcagagccaggatcaaattgtgataactcggagttgcctgggactttgcataattctcacaaaaagagaagaaacatttctgatctaaatcatcctcataaaaaacaaagaaaggaaacagacttaactaataaggaaaagaccaagaaacctacccaagattcttgtgagaatactgaagctcaccaaaagaaagccagtaagaagaaggcccctcctgtgactaaagatccctcatcattaaaggcaaccccagggattaaggattcatcagcagcacttgccacttctacaagtctttctgcaaaaaatgttattaaaaagaagggagaaattatcattttatggacaagaaatgatgaccgggaaattttattggagtgtcagaaaagagggccatcatttaaaacatttgcatatttagccgccaagttggataaaaatccaaatcaggtctcagaaagattccagcagctaatgaagctctttgaaaagtcaaaatgcagataagttgctgaattcctgggactcttaactgatattgcatactacacagaagcttcaaattcctcatgttttaaatgagcactagagggagggtttatcacctttttggttaccagatgattatctatatttggttattactcagtgactctctaatttcacatcagcatgttcagcttgtgctag

SEQ ID NO: 329455 - DNA, 353 bp, Homo sapiens
aacatggtaactgcacaataagcgacagtcaccatcatcagtgttttgcttaatctgatgtgaaaaaaagtcatatcacttagcatggatctacaggctttaggactaaactgaagaagtctgttcctaaagggattttggaagggaatgcaagtgtgttaagcaccattactccaggtcccacagcatgtgctttacatgtgttatctcacacaacaaacctgtgcactacttctgatgctctacactctggggctcagggaaatagcggagtagcttactcagctagcaaggggcaaagggagcttaaagcacaaatctacttatttccaaagcctgggcctcttagggag

SEQ ID NO: 329456 - DNA, 450 bp, Homo sapiens
cccatgatacttctacttgctgattgttcctgctgagtcttatctgtaggacctcttctctctgctgtgtctgcttctgtcaactgtcttaacttcttagttgatctcctcttgttttgtggcctcaaacacctgtatatgttgatgatgctcaaattttcttctcagccaaaacctgttaccaaaactctaggtgcatattgatgtggctgtttgcttgtatgtgcacagaatattagacttctccagttggaaatctgatggtcacctcaagctaaatatgcccccagctaaactcctgaggttagctcagatttgctccttccaaaatctttaccatttcagataatggcatctgtgtctttccagtgctggccagagacctttggtgtcactctggactctgccttctccccctacccctgccaaattccatatctagtcagcaaa

SEQ ID NO: 329457 - DNA, 376 bp, Homo sapiens
taaatatgtcattgtacgtaaatgctccaatttgtttatccattcatctattgatggacatttgggttatttcccctactaatgttccataggttttaattgacttcagctacagcttcccggtaatgaatttactggatttgtatgtttcaagtaaagaaacatttttcataccattgtcattctatcaatatgatcatttaaatgatttaaaatgatattaggctgggcgcggtggctcacgcctgtaatcccagcactttgggaggccgaggcgggtggatcacgaggtcaggagatcaagaccatcttggctaacacggtgaaaccccgtctctactaaaaatacaaaaaattagccaggcgtggtggcagg

SEQ ID NO: 329458 - DNA, 280 bp, Homo sapiens
gtagtcgcttccgcattcatacaagaaacctcatgtctgagggcaagacaggcagggactgccccctgagagcacaagaagaaagtcctgaagcggctgtcgctaagcccagccctgcaggtgcctgggggtctgggcagggggtgtctggggcccagggtccacatggagaagacatgtacgtgtcggccgctgttggcgggggtgatccttggaaggagatcgtccttctgggctcagatgggagaaaagttgagggcaggactgtcaggagatctct

SEQ ID NO: 329459 - DNA, 2287 bp, Homo sapiens
cggcagtgtgtggggagacggacgaggaggccggcgagagtggcggagagggcatcttccgggaacgggacgagttcgtcatccgtgctgaggacatcccttccctcaagctggcgttgcagacggggcgtgaacccccacccatctggcgagtccagaaggcccttctgcagaaattcactccggagatcaaggacggccagaggcagttttgtgccaccagtaattatttggggtattttggggatgcaaaaaatcggtaccagcgcctctatgtaaagttcctggaaaatgtcaataagaaggactacgtgagggtctgtgctcggaaaccctggcatcggcccccagtgccagtcagacgctctgggcaggccaagaaccccgtatctgctgggggtagctctgcacctccccctaaggccccagcaccacctcccaagcctgagacccctgaaaagacgacatctgagaagcccccagagcagactcctgagacggccatgcctgagccccctgcccccgagaagccctccctcctgcggcctgttgagaaggaaaaggagaaggagaaggtgacacgtggagagcggcattgcggggtgagcgggccaccagcggacggcagacacggccagagcggagtctcgccacgggacaacctgccacatcccggctgcccaaagcccggcctaccaaggtgaaggctgaaccgccccctaagaagaggaagaaatggctgaaggaggcaggcggcaacgctacagcaggcgggggcccaccaggcagctcctcggactcggagtcctcccctggagcccccagcgaggacgagcgggcagtacctgggcgtctgctcaaaaccagggcgatgcgggagatgtaccggagctacgtggagatgttggtgagcacagcacttgacccagacatgatccaggccctggaggacacgcatgacgagctgtacctgccccccatgcggaagatagacggcctgctgaatgagcacaagaagaaagtcctgaagcggctgtcgctaagcccagccctgcaggatgctctgcacacgttcccacagctgcaagtggagcagagtggggagggctctccggaagagggggctgtgcggctgcggcctgctggggaaccctacaaccgcaagacgctcagcaagctcaagaggagcgtggtcagagcccaggagttcaaggttgagctggaaaagtcgggatactatacactctaccattcgctccacacactataaataccacaccttcctgcgctgccgggaccagaccctggccatcgagggcggcgccgaggacctgggccaggaggaggtggtccagcagtgcatgcggaaccagccgtggctggaacagctctttgactccttcagtgacctgctggcccaagcacaggcccacagccgctgcgggtgaccccgccccagcttgtgaggggggcgcctcctccatgaaccgagaattgggacagaaccgtgtcctcaggagctaacacctgggctccatcgccggggaaagggggtcatgggtcagggtgtgtctgtgctgccccctccagggcagggttcaaagtccgactccccccctctcccaagccccctccactccctccccattcctcccactgttcggtgtacagagaaattatttatatatatgtataaatgtctatttagtaacggtttccctctccccttgccccgaccccccctccacagccacagcccccgccccctccaccttgtacataatgtataggaaaagtctatgtatggctggggggggtggggtggcttcagagagctgggggaccccttccccccaagtcccccctgcaggccaagatctttgctaaaggccattccctccgcagggcatttggcgtcgggtgggaggggaaaacgcatcttgttaattatttttaatcttatttattgtacatacctggggcaggggcttggggaggtggaggggggagaagggtcccctctctctgcccctcccactccttttctacggcgatttgtctgtgtctggcccccacccactgcccatcccccattgttgtctggatgtggttctattttttatcggtctcctttcccctcctccccgttctcgcccccgccccaccccctgctcccactaccctttgtctcttgctctttcttgggcttctgtacaactcaacttgtatacactgtgtacacacaaccagccaaacgaaaacccaacggcaaacactttaaaaaaag

SEQ ID NO: 329460 - DNA, 1217 bp, Homo sapiens
cggcagtgtgtggggagacggacgaggaggccggcgagagtggcggagagggcatcttccgggaacgggacgagttcgtcatccgtgctgaggacatcccttccctcaagctggcgttgcagacggggcgtgaacccccacccatctggcgagtccagaaggcccttctgcagaaattcactccggagatcaaggacggccagaggcagttttgtgccaccagtaattatttggggtattttggggatgcaaaaaatcggtaccagcgcctctatgtaaagttcctggaaaatgtcaataagaaggactacgtgagggtctgtgctcggaaaccctggcatcggcccccagtgccagtcagacgctctgggcaggccaagaaccccgtatctgctgggggtagctctgcacctccccctaaggccccagcaccacctcccaagcctgagacccctgaaaagacgacatctgagaagcccccagagcagactcctgagacggccatgcctgagccccctgcccccgagaagccctccctcctgcggcctgttgagaaggaaaaggagaaggagaaggtgacacgtggagagcggcattgcggggtgagcgggccaccagcggacggcagacacggccagagcggagtctcgccacgggacaacctgccacatcccggctgcccaaagcccggcctaccaaggtgaaggctgaaccgccccctaagaagaggaagaaatggctgaaggaggcaggcggcaacgctacagcaggcgggggcccaccaggcagctcctcggactcggagtcctcccctggagcccccagcgaggacgagcgggcagtacctgggcgtctgctcaaaaccagggcgatgcgggagatgtaccggagctacgtggagatgttggtgagcacagcacttgacccagacatgatccaggccctggaggacacgcatgacgagctgtacctgccccccatgcggaagatagacggcctgctgaatgagcacaagaagaaagtcctgaagcggctgtcgctaagcccagccctgcaggtgcctgggggtctgggcagggggtgtctggggcccagggtccacatggagaagacatgtacgtgtcggccgctgttggcgggggtgatccttggaaggagatcgtccttctgggctcagatgggagaaaagttgagggcaggactgtcaggagatctct

SEQ ID NO: 329461 - DNA, 262 bp, Homo sapiens
ctggcgttgcagacggggcgtgaacccccacccatctggcgagtccagaaggcccttctgcagaaattcactccggagatcaaggacggccagaggcagttttgtgccaccagtaatgtaagcctgcaaaggggaccaaggacttgggggccccggggcgtggtatctaggagctggggttccccttagtgtggctgtgactcactccacagtgtatctggaagggggccccctgctgccggcaggctccaagcagctgcca

SEQ ID NO: 329462 - DNA, 926 bp, Homo sapiens
cggcagtgtgtggggagacggacgaggaggccggcgagagtggcggagagggcatcttccgggaacgggacgagttcgtcatccgtgctgaggacatcccttccctcaagctggcgttgcagacggggcgtgaacccccacccatctggcgagtccagaaggcccttctgcagaaattcactccggagatcaaggacggccagaggcagttttgtgccaccagtaattatttggggtattttggggatgcaaaaaatcggtaccagcgcctctatgtaaagttcctggaaaatgtcaataagaaggactacgtgagggtctgtgctcggaaaccctggcatcggcccccagtgccagtcagacgctctgggcaggccaagaaccccgtatctgctgggggtagctctgcacctccccctaaggccccagcaccacctcccaagcctgagacccctgaaaagacgacatctgagaagcccccagagcagactcctgagacggccatgcctgagccccctgcccccgagaagccctccctcctgcggcctgttgagaaggaaaaggagaaggagaagcagacacggccagagcggagtctcgccacgggacaacctgccacatcccggctgcccaaagcccggcctaccaaggtgaaggctgaaccgccccctaagaagaggaagaaatggctgaaggaggcaggcggcaacgctacagcaggcgggggcccaccaggcagctcctcggactcggagtcctcccctggagcccccagcgaggacgagcgggcagtacctgggcgtctgctcaaaaccagggcgatgcgggagatgtaccggagctacgtggagatgttggtgagcacagcacttgacccagacatgatccaggccctggaggacacgcatggtgagctgaggcctggg

SEQ ID NO: 329463 - DNA, 2201 bp, Homo sapiens
cggcagtgtgtggggagacggacgaggaggccggcgagagtggcggagagggcatcttccgggaacgggacgagttcgtcatccgtgctgaggacatcccttccctcaagctggcgttgcagacggggcgtgaacccccacccatctggcgagtccagaaggcccttctgcagaaattcactccggagatcaaggacggccagaggcagttttgtgccaccagtaattatttggggtattttggggatgcaaaaaatcggtaccagcgcctctatgtaaagttcctggaaaatgtcaataagaaggactacgtgagggtctgtgctcggaaaccctggcatcggcccccagtgccagtcagacgctctgggcaggccaagaaccccgtatctgctgggggtagctctgcacctccccctaaggccccagcaccacctcccaagcctgagacccctgaaaagacgacatctgagaagcccccagagcagactcctgagacggccatgcctgagccccctgcccccgagaagccctccctcctgcggcctgttgagaaggaaaaggagaaggagaaggtgacacgtggagagcggcattgcggggtgagcgggccaccagcggacggcagacacggccagagcggagtctcgccacgggacaacctgccacatcccggctgcccaaagcccggcctaccaaggtgaaggctgaaccgccccctaagaagaggaagaaatggctgaaggaggcaggcggcaacgctacagcaggcgggggcccaccaggcagctcctcggactcggagtcctcccctggagcccccagcgaggacgagcgggcagtacctgggcgtctgctcaaaaccagggcgatgcgggagatgtaccggagctacgtggagatgttggtgagcacagcacttgacccagacatgatccaggccctggaggacacgcatgacgagctgtacctgccccccatgcggaagatagacggcctgctgaatgagcacaagaagaaagtcctgaagcggctgtcgctaagcccagccctgcaggatgctctgcacacgttcccacagctgcaagtggagcagagtggggagggctctccggaagagggggctgtgcggctgcggcctgctggggaaccctacaaccgcaagacgctcagcaagctcaagaggagcgtggtcagagcccaggagttcaaggttgagctggaaaagtcgggatactatacactctaccattcgctccacacactataaataccacaccttcctgcgctgccgggaccagaccctggccatcgagggcggcgccgaggacctgggccaggaggaggtggtccagcagtgcatgcggaaccagccgtggctggaacagctctttgactccttcagtgacctgctggcccaagcacaggcccacagccgctgcgggtgaccccgccccagcttgtgaggggggcgcctcctccatgaaccgagaattgggacagaaccgtgtcctcaggagctaacacctgggctccatcgccggggaaagggggtcatgggtcagggtgtgtctgtgctgccccctccagggcagggttcaaagtccgactccccccctctcccaagccccctccactccctccccattcctcccactgttcggtgtacagagaaattatttatatatatgtataaatgtctatttagtaacggtttccctctccccttgccccgaccccccctccacagccacagcccccgccccctccaccttgtacataatgtataggaaaagtctatgtatggctggggggggtggggtggcttcagagagctgggggaccccttccccccaagtcccccctgcaggccaagatctttgctaaaggccattccctccgcagggcatttggcgtcgggtgggaggggaaaacgcatcttgttaattatttttaatcttatttattgtacatacctggggcaggggcttggggaggtggaggggggagaagggtcccctctctctgcccctcccactccttttctacggcgatttgtctgtgtctggcccccacccacccctgctcccactaccctttgtctcttgctctttcttgggcttctgtacaactcaacttgtatacactgtgtacacacaaccagccaaacgaaaacccaacggcaaacactttaaaaaaag

SEQ ID NO: 329464 - DNA, 277 bp, Homo sapiens
ctcattgtgtacataggaagttctccattcttttcggcctccagtcagaacacttagatatccaacttattgaaggtgttaatttctgcttaaactctgattcaggatatgagtttggaaatggacatctctcagtattcatggggaatgagctttgatcttcatctcagtatagcattgcactcataaatgtagcaattgtcatatacttaatccactcctgcaaaagactgatcctgtgacatgggagtgagagaggaaagtcacccagagccag

SEQ ID NO: 329465 - DNA, 456 bp, Homo sapiens
cgtgcctgtctggttgtgtatgaccgtgtatgacccatagacactggaagcataattagttccgggtttgcgcactgcagtgctcttacgcgtacaggcactgcaggaggagagtcgctacctacgggcagtcttagccaacgagactggactggctcgcttgctgagccggctgagcggcgtgggactgcggctgaccacctcgctcttcagagactcgcccgccggtgaccacgactacgctctgccggtgggaaagcagaagcaggacctgctggaagaggacgactcggcgggaggagtctgtctccatgtggacaaggataaggtgtcggtggagttctgctcggcgtgcgcccggaaggcgtcgtcttctcttaaaatgtagggtcaagtaatctgctctttatccgcgtatgcgcactggggggtcctctagatctcctcaaaccaagg

SEQ ID NO: 329466 - DNA, 6187 bp, Homo sapiens
actgacttccggctacgccgttgtctgggtggcgcggtcgagtcatcgcagggcctcaccgcttcgttctcccgtccctccccgcgccttggcgcggggggtcgactagccaagtgaggcgggaggcgactcggacctttccctgcatttcgtttcggccagtgccgggggctacccgccctggggcctgggatccttggggcccgtgaggcccactcttagcggccggggcctaccgcggcccgccgctggccctcatgaggcatagcctgaccaagctgctggcagcctcgggcagcaactccccaacccgcagtgagagcccggagccggctgcaacttgttcgctgccctctgacctgacccgggctgcagcgggggaggaggagacggcggcggccggatctcccggccgcaagcagcagtttggcgacgaaggagagttggaagccgggagggggagccgcggcggcgtggccgtgcgcgcgccctcccccgaggagatggaggaggaggcgatcgccagcctcccgggggaagagacggaggatatggactttctgtctgggctggaactggcggatctcctggaccccaggcaaccggactggcacctggaccccgggcttagctcgccggggcctctctcctcgtctggcggaggctcggatagcggcggcctgtggagaggggacgatgacgatgaggccgcggctgctgaaatgcagcgcttctctgacctgctgcaaaggctgttaaacggtatcggaggctgcagcagcagcagtgacagtggcagcgccgaaaagaggcggagaaagtccccaggaggaggcggcggtggcggcagcggtaacgacaacaaccaggcggcgacaaagagtccccggaaggcggcggcggccgctgcccgccttaatcgactgaagaagaaggagtacgtgatggggctggagagtcgagtccggggtctggcagccgagaaccaggagctgcgggccgagaatcgggagctgggcaaacgcgtacaggcactgcaggaggagagtcgctacctacgggcagtcttagccaacgagactggactggctcgcttgctgagccggctgagcggcgtgggactgcggctgaccacctcgctcttcagagactcgcccgccggtgaccacgactacgctctgccggtgggaaagcagaagcaggacctgctggaagaggacgactcggcgggaggagtctgtctccatgtggacaaggataaggtgtcggtggagttctgctcggcgtgcgcccggaaggcgtcgtcttctcttaaaatgtagggtcaagtaatctgctctttatccgcgtttacccctttcaactcccttacaccatgtcaaacttaccttagtgggacatcttcaccggacacatttcagaggagagaaaaaaagtaatattgaatcttaaagtgtttagctaaaagcatgaatgtgacacagtaaccaactcctaatgataacatgtgactattaaatctctctgacagtttcttttttaggtgatttccttcctgccaggctccgttgtaggggttacagaacagtcgttcccgcctcacaacctgtggatacagctgttggggcagaagagacgggaccagctgctggccacatttcctgctttattttaaaaggtagtataagaaatgaggaaaaagaggtaatatcagggcttctgctgttttttatttttaacatgttcataattaaaaagtattttccagcagtccaaagatgtaagttatcttacacataaaatgttttattttgttatttggttatgaaaatggaatccttgttcttgcacaactgtaaatgttttgttgctagataatacgatttgagacctgaattggtctttggtttccagtgcatcacagcatattttgtaaaatcatctactactgcacttgagcatgaatgggtagtagccaaactcacaaattggagtgatgaacctgcttatacctaagggcaggagcaagcccctcacaatgcagctgcatgggtttttagtgcctactgaattatatatatatatacatatatatatatatatataaaccaaaagtagttggaaagattatttgaaatgactaatttgtgctatctttatgaaatatgttaaatgtagcttttttgaaacagaagccttgaattgaaatttaactaatacttgaacattttgtatatatttctttgtatataattttgtgcagtaccaatgacaaaaatatggtgtcataataaaaccaggtttgttgatcttttagttatgggctcaaagaatttattcatctctaacatgatattggaaaataatggatgaaaataggaaaaatgattgttaatgctgactgtgggtcttaaaaggttctggaaagcagtaagttcatttttctaaaaactataacattctgttggagtattttcttccttacgtcaatacttttcctgcattatttgaaattgtgggctggggagaaacagtagtcaaagctttctgaattgagatactttgaaattccaagtgtagatttttagaatgtcattttataaatggcagtttttggaattacttgataagaacttttgaaaatggaaggattagtatggcctatttttaaagctgctttgttaggttccttatgttttattaactgtcttttctcagtttccatttcatttttttttttctagttttggtgacttagtgattttgtcattttttacatcaacttcatggtcttgtttttacatggtaattgcatgtacttaggatctatctaataggggctttaaataaatttggtcatatttatgtgtaagcacattttactgtaaatgtttgggtttctgaatttaaacagatctgtttatttcagtatgtagtaaacaatatcttaaagtgtccgattcactacttgttaattaaaaaagttatgattaatgtgaaactgttgtcttactatttttagaaaattgtgttctggatgattagcacatggataaaggagatttctggaatataaaatggattgtttttgaaatttctaggtttggctctatttactgtaatggttgaaaacaatttagtatttgggtgacccttttgtttttcttctaaatgtgcctctggtaaaatacagaactagactaaagatgtagctttttaatatttgtcttttgatggtggcaggagttcatacattaattgaactaacacatcatattttgacctactatttctatcatattgacttactgtttctgcacttctttgaccagacttatcttaaaaagtccacttttgttaaaatgtagtcacacctctgatataatccaacaagaagtgttcaaaatattttaaatatttgtgcattttataatcactaaattaatctctctctcttctctttgaacagcttagcagtgtctgcaaaaacgaatcttttcctacaacctgttaactgactggactgttggtaacaaagtaattgtgagaaccatgtcggtcaaaaatttggcatctgctgaaaaaaatgaatgccattttcaagttcccaaattacttctatactgatttcactttccagaaatggagatatgaaaagattctctggaatccttgaaagacttaatagagatacatgagactaagttaatcttggaacaaaattatactttttttgtctttcatgggagtgatactcagttattgcatatctttacaataatcaagagcatattctatggaattaacatttagtggactagaattacataagcaggccatcagtgatcacaaggcatatgagtttgtatttatttcctggaacatgagagctaatttggagtacagacagacaccctgctgagtagaatataaaagttaatgtaaagttctgaactataaagagtagtccttttaaatagatgcattgatttgtatatctttgaaaaagttgattatgattaaatgtgtgggtagttaattacaatttagggtaacaaccaggatgtatggattcttgaggttttggcttcttgagctttctcttgagtacttgatactgttttctgaatattttgaggtttctaattaatggtatgctagtttctactgttttatataaaaatttatctagtgttgtataaggactttagtattgtggatgatgggagtggctttttgtggcatatggttgttttaattgaaatattttttcagtttattacaagtgtgaaaaaacactcaaaactctggattgttttatttcatttttgttggattatgttaatacattccttcacgtggtttagattgagtcattttatctcacttacttggaaatgtgcagctgatagaagagggattgggtaggagattggcttttacttcataataaatatacagttggttattgtattattcaaaacttattaaatccattcagtttcttaccattttaagtgtattcagtgcctgtgaagccaggcagcagagtattcccactggcttaaaacttaggcgctgatgctcctacagtacagctagttataattccagaaccaaaggcaccaacattatttggtgaccttaactactactttgatagaacagactgggtaattcactgataatgagtcattacctttttaatatgtgattatctagttcagcattttgaatgtgtagtttaaggtctgatttagtaaaattttaaagctaaataatctgatgactcttgaaagtttaattggtagtatgacatttatgtttttttcccccagactcacagccaatacaaagttttgagactcctaaatgttaatatttttgctgtttttctgagctgtttttttatttacttaccacctaagctgcggatcaaaaagggaattcttccattagaaatttgtagtgttgtgtggccagcacagtatttttcagatttgaatttcagtacctctgtgtagcctcagtactctcaacaccagtcactctttattgtcttaaaatattccatactttttgttgacccaaaattgttgaaaatattttgctcagttttcacaatgaactaattgaaaagtgtagttactgtgttgtaaacatttgtgtagttctgttaatacactgatttgaattttatttatctcaacttcctttagcgtctgcctccaaattttgtctttgctgtatacccactgagatcaattccctagacccctctggctcttagtgtactataatttgggctttataaaatatattgtcttaatttaaatagaatgtgagccctctttttttttttttaagccaaataactacacaaagtaaattataaaagatttaaatagtttgtctacagtgactagactgaaatataaaaattgattgagggtagtttacttcaggtgttagctacaaatgactaaatgtccttaaataatgcagatatctgccctctgaacaaaaattttggcaaagtaaatttgtagcaacagacttaacatgatttattgcttatgttgcccatttctgctaatggaaaagataatttaaaaatatgtggcagaggacagatattagaaatactttttggttacagaaaccattgtaaactcatcctcatttataaatggtattatgctagggagtaattggactaggaatgtttaaagataagtaaggaaacaatgtgtgctcaatcgtcaaagaacttagttatatcattgggctttgaattatctaagttgattacataattctatattcttaaggagtcttaactcggtacttgggttaacgccagaaattacttttaattcattgtttttttcactgggatgagtagaactctgcttttagtaaaagtgacagaatataggtaaaatggatgatttgggatcagagcttttcatcttgatattttagcctgtaaaataaacagctatattgttttgccctttaaatgttatatatatttttctgtctttctttccctagttgtaaaagtaaagcatattctttatagaaaacttggaatatcctgaaaggaatcaagaagaaaagaaaaatcacccttataactctataagccatagaatatccacagtaaacattttggcatgcttcc

SEQ ID NO: 329467 - DNA, 6028 bp, Homo sapiens
actgacttccggctacgccgttgtctgggtggcgcggtcgagtcatcgcagggcctcaccgcttcgttctcccgtccctccccgcgccttggcgcggggggtcgactagccaagtgaggcgggaggcgactcggacctttccctgcatttcgtttcggccagtgccgggggctacccgccctggggcctgggatccttggggcccgtgaggcccactcttagcggccggggcctaccgcggcccgccgctggccctcatgaggcatagcctgaccaagctgctggcagcctcgggcagcaactccccaacccgcagtgagagcccggagccggctgcaacttgttcgctgccctctgacctgacccgggctgcagcgggggaggaggagacggcggcggccggatctcccggccgcaagcagcagtttggcgacgaaggagagttggaagccgggagggggagccgcggcggcgtggccgtgcgcgcgccctcccccgaggagatggaggaggaggcgatcgccagcctcccgggggaagagacggaggatatggactttctgtctgggctggaactggcggatctcctggaccccaggcaaccggactggcacctggaccccgggcttagctcgccggggcctctctcctcgtctggcggaggctcggatagcggcggcctgtggagaggggacgatgacgatgaggccgcggctgctgaaatgcagcgcttctctgacctgctgcaaaggctgttaaacggtatcggaggctgcagcagcagcagtgacagtggcagcgccgaaaagaggcggagaaagtccccaggaggaggcggcggtggcggcagcggtaacgacaacaaccaggcggcgacaaagagtccccggaaggcggcggcggccgctgcccgccttaatcgactgaagaagaaggagtacgtgatggggctggagagtcgagtccggggtctggcagccgagaaccaggagctgcgggccgagaatcgggagctgggcaaacgcgtacaggcactgcaggaggagagtcgctacctacgggcagtcttagccaacgagactggactggctcgcttgctgagccggctgagcggcgtgggactgcggctgaccacctcgctcttcagagactcgcccgccggtgaccacgactacgctctgccggtgggaaagcagaagcaggacctgctggaagaggacgactcggcgggaggagtctgtctccatgtggacaaggataaggtgtcggtggagttctgctcggcgtgcgcccggaaggcgtcgtcttctcttaaaattttcttttttaggtgatttccttcctgccaggctccgttgtaggggttacagaacagtcgttcccgcctcacaacctgtggatacagctgttggggcagaagagacgggaccagctgctggccacatttcctgctttattttaaaaggtagtataagaaatgaggaaaaagaggtaatatcagggcttctgctgttttttatttttaacatgttcataattaaaaagtattttccagcagtccaaagatgtaagttatcttacacataaaatgttttattttgttatttggttatgaaaatggaatccttgttcttgcacaactgtaaatgttttgttgctagataatacgatttgagacctgaattggtctttggtttccagtgcatcacagcatattttgtaaaatcatctactactgcacttgagcatgaatgggtagtagccaaactcacaaattggagtgatgaacctgcttatacctaagggcaggagcaagcccctcacaatgcagctgcatgggtttttagtgcctactgaattatatatatatatacatatatatatatatatataaaccaaaagtagttggaaagattatttgaaatgactaatttgtgctatctttatgaaatatgttaaatgtagcttttttgaaacagaagccttgaattgaaatttaactaatacttgaacattttgtatatatttctttgtatataattttgtgcagtaccaatgacaaaaatatggtgtcataataaaaccaggtttgttgatcttttagttatgggctcaaagaatttattcatctctaacatgatattggaaaataatggatgaaaataggaaaaatgattgttaatgctgactgtgggtcttaaaaggttctggaaagcagtaagttcatttttctaaaaactataacattctgttggagtattttcttccttacgtcaatacttttcctgcattatttgaaattgtgggctggggagaaacagtagtcaaagctttctgaattgagatactttgaaattccaagtgtagatttttagaatgtcattttataaatggcagtttttggaattacttgataagaacttttgaaaatggaaggattagtatggcctatttttaaagctgctttgttaggttccttatgttttattaactgtcttttctcagtttccatttcatttttttttttctagttttggtgacttagtgattttgtcattttttacatcaacttcatggtcttgtttttacatggtaattgcatgtacttaggatctatctaataggggctttaaataaatttggtcatatttatgtgtaagcacattttactgtaaatgtttgggtttctgaatttaaacagatctgtttatttcagtatgtagtaaacaatatcttaaagtgtccgattcactacttgttaattaaaaaagttatgattaatgtgaaactgttgtcttactatttttagaaaattgtgttctggatgattagcacatggataaaggagatttctggaatataaaatggattgtttttgaaatttctaggtttggctctatttactgtaatggttgaaaacaatttagtatttgggtgacccttttgtttttcttctaaatgtgcctctggtaaaatacagaactagactaaagatgtagctttttaatatttgtcttttgatggtggcaggagttcatacattaattgaactaacacatcatattttgacctactatttctatcatattgacttactgtttctgcacttctttgaccagacttatcttaaaaagtccacttttgttaaaatgtagtcacacctctgatataatccaacaagaagtgttcaaaatattttaaatatttgtgcattttataatcactaaattaatctctctctcttctctttgaacagcttagcagtgtctgcaaaaacgaatcttttcctacaacctgttaactgactggactgttggtaacaaagtaattgtgagaaccatgtcggtcaaaaatttggcatctgctgaaaaaaatgaatgccattttcaagttcccaaattacttctatactgatttcactttccagaaatggagatatgaaaagattctctggaatccttgaaagacttaatagagatacatgagactaagttaatcttggaacaaaattatactttttttgtctttcatgggagtgatactcagttattgcatatctttacaaaattgtaacctttggagaattacagtatttcatcaagaaattagagtttttacataatcaagagcatattctatggaattaacatttagtggactagaattacataagcaggccatcagtgatcacaaggcatatgagtttgtatttatttcctggaacatgagagctaatttggagtacagacagacaccctgctgagtagaatataaaagttaatgtaaagttctgaactataaagagtagtccttttaaatagatgcattgatttgtatatctttgaaaaagttgattatgattaaatgtgtgggtagttaattacaatttagggtaacaaccaggatgtatggattcttgaggttttggcttcttgagctttctcttgagtacttgatactgttttctgaatattttgaggtttctaattaatggtatgctagtttctactgttttatataaaaatttatctagtgttgtataaggactttagtattgtggatgatgggagtggctttttgtggcatatggttgttttaattgaaatattttttcagtttattacaagtgtgaaaaaacactcaaaactctggattgttttatttcatttttgttggattatgttaatacattccttcacgtggtttagattgagtcattttatctcacttacttggaaatgtgcagctgatagaagagggattgggtaggagattggcttttacttcataataaatatacagttggttattgtattattcaaaacttattaaatccattcagtttcttaccattttaagtgtattcagtgcctgtgaagccaggcagcagagtattcccactggcttaaaacttaggcgctgatgctcctacagtacagctagttataattccagaaccaaaggcaccaacattatttggtgaccttaactactactttgatagaacagactgggtaattcactgataatgagtcattacctttttaatatgtgattatctagttcagcattttgaatgtgtagtttaaggtctgatttagtaaaattttaaagctaaataatctgatgactcttgaaagtttaattggtagtatgacatttatgtttttttcccccagactcacagccaatacaaagttttgagactcctaaatgttaatatttttgctgtttttctgagctgtttttttatttacttaccacctaagctgcggatcaaaaagggaattcttccattagaaatttgtagtgttgtgtggccagcacagtatttttcagatttgaatttcagtacctctgtgtagcctcagtactctcaacaccagtcactctttattgtcttaaaatattccatactttttgttgacccaaaattgttgaaaatattttgctcagttttcacaatgaactaattgaaaagtgtagttactgtgttgtaaacatttgtgtagttctgttaatacactgatttgaattttatttatctcaacttcctttagcgtctgcctccaaattttgtctttgctgtatacccactgagatcaattccctagacccctctggctcttagtgtactataatttgggctttataaaatatattgtcttaatttaaatagaatgtgagccctctttttttttttttaagccaaataactacacaaagtaaattataaaagatttaaatagtttgtctacagtgactagactgaaatataaaaattgattgagggtagtttacttcaggtgttagctacaaatgactaaatgtccttaaataatgcagatatctgccctctgaacaaaaattttggcaaagtaaatttgtagcaacagacttaacatgatttattgcttatgttgcccatttctgctaatggaaaagataatttaaaaatatgtggcagaggacagatattagaaatactttttggttacagaaaccattgtaaactcatcctcatttataaatggtattatgctagggagtaattggactaggaatgtttaaagataagtaaggaaacaatgtgtgctcaatcgtcaaagaacttagttatatcattgggctttgaattatctaagttgattacataattctatattcttaaggagtcttaactcggtacttgggttaacgccagaaattacttttaattcattgtttttttcactgggatgagtagaactctgcttttagtaaaagtgacagaatataggtaaaatggatgatttgggatcagagcttttcatcttgatattttagcctgtaaaataaacagctatattgttttgccctttaaatgttatatatatttttctgtctttctttccctagttgtaaaagtaaagcatattctttatagaaaacttggaatatcctgaaaggaatcaagaagaaaagaaaaatcacccttataactctataagccatagaatatccacagtaaacattttggcatgcttcc

SEQ ID NO: 329468 - DNA, 5834 bp, Homo sapiens
tcacgtggtttagattgagtcattttatctcacttacttggaaatgtgcagctgatagaagagggattgggtaggagattggcttttacttcataataaatatacagttggttattgtattattcaaaacttattaaatccattcagtttcttaccattttaagtgtattcagtgcctgtgaagccaggcagcaaccggactggcacctggaccccgggcttagctcgccggggcctctctcctcgtctggcggaggctcggatagcggcggcctgtggagaggggacgatgacgatgaggccgcggctgctgaaatgcagcgcttctctgacctgctgcaaaggctgttaaacggtatcggaggctgcagcagcagcagtgacagtggcagcgccgaaaagaggcggagaaagtccccaggaggaggcggcggtggcggcagcggtaacgacaacaaccaggcggcgacaaagagtccccggaaggcggcggcggccgctgcccgccttaatcgactgaagaagaaggagtacgtgatggggctggagagtcgagtccggggtctggcagccgagaaccaggagctgcgggccgagaatcgggagctgggcaaacgcgtacaggcactgcaggaggagagtcgctacctacgggcagtcttagccaacgagactggactggctcgcttgctgagccggctgagcggcgtgggactgcggctgaccacctcgctcttcagagactcgcccgccggtgaccacgactacgctctgccggtgggaaagcagaagcaggacctgctggaagaggacgactcggcgggaggagtctgtctccatgtggacaaggataaggtgtcggtggagttctgctcggcgtgcgcccggaaggcgtcgtcttctcttaaaatgtagggtcaagtaatctgctctttatccgcgtttacccctttcaactcccttacaccatgtcaaacttaccttagtgggacatcttcaccggacacatttcagaggagagaaaaaaagtaatattgaatcttaaagtgtttagctaaaagcatgaatgtgacacagtaaccaactcctaatgataacatgtgactattaaatctctctgacagtttcttttttaggtgatttccttcctgccaggctccgttgtaggggttacagaacagtcgttcccgcctcacaacctgtggatacagctgttggggcagaagagacgggaccagctgctggccacatttcctgctttattttaaaaggtagtataagaaatgaggaaaaagaggtaatatcagggcttctgctgttttttatttttaacatgttcataattaaaaagtattttccagcagtccaaagatgtaagttatcttacacataaaatgttttattttgttatttggttatgaaaatggaatccttgttcttgcacaactgtaaatgttttgttgctagataatacgatttgagacctgaattggtctttggtttccagtgcatcacagcatattttgtaaaatcatctactactgcacttgagcatgaatgggtagtagccaaactcacaaattggagtgatgaacctgcttatacctaagggcaggagcaagcccctcacaatgcagctgcatgggtttttagtgcctactgaattatatatatatatacatatatatatatatatataaaccaaaagtagttggaaagattatttgaaatgactaatttgtgctatctttatgaaatatgttaaatgtagcttttttgaaacagaagccttgaattgaaatttaactaatacttgaacattttgtatatatttctttgtatataattttgtgcagtaccaatgacaaaaatatggtgtcataataaaaccaggtttgttgatcttttagttatgggctcaaagaatttattcatctctaacatgatattggaaaataatggatgaaaataggaaaaatgattgttaatgctgactgtgggtcttaaaaggttctggaaagcagtaagttcatttttctaaaaactataacattctgttggagtattttcttccttacgtcaatacttttcctgcattatttgaaattgtgggctggggagaaacagtagtcaaagctttctgaattgagatactttgaaattccaagtgtagatttttagaatgtcattttataaatggcagtttttggaattacttgataagaacttttgaaaatggaaggattagtatggcctatttttaaagctgctttgttaggttccttatgttttattaactgtcttttctcagtttccatttcatttttttttttctagttttggtgacttagtgattttgtcattttttacatcaacttcatggtcttgtttttacatggtaattgcatgtacttaggatctatctaataggggctttaaataaatttggtcatatttatgtgtaagcacattttactgtaaatgtttgggtttctgaatttaaacagatctgtttatttcagtatgtagtaaacaatatcttaaagtgtccgattcactacttgttaattaaaaaagttatgattaatgtgaaactgttgtcttactatttttagaaaattgtgttctggatgattagcacatggataaaggagatttctggaatataaaatggattgtttttgaaatttctaggtttggctctatttactgtaatggttgaaaacaatttagtatttgggtgacccttttgtttttcttctaaatgtgcctctggtaaaatacagaactagactaaagatgtagctttttaatatttgtcttttgatggtggcaggagttcatacattaattgaactaacacatcatattttgacctactatttctatcatattgacttactgtttctgcacttctttgaccagacttatcttaaaaagtccacttttgttaaaatgtagtcacacctctgatataatccaacaagaagtgttcaaaatattttaaatatttgtgcattttataatcactaaattaatctctctctcttctctttgaacagcttagcagtgtctgcaaaaacgaatcttttcctacaacctgttaactgactggactgttggtaacaaagtaattgtgagaaccatgtcggtcaaaaatttggcatctgctgaaaaaaatgaatgccattttcaagttcccaaattacttctatactgatttcactttccagaaatggagatatgaaaagattctctggaatccttgaaagacttaatagagatacatgagactaagttaatcttggaacaaaattatactttttttgtctttcatgggagtgatactcagttattgcatatctttacaaaattgtaacctttggagaattacagtatttcatcaagaaattagagtttttacataatcaagagcatattctatggaattaacatttagtggactagaattacataagcaggccatcagtgatcacaaggcatatgagtttgtatttatttcctggaacatgagagctaatttggagtacagacagacaccctgctgagtagaatataaaagttaatgtaaagttctgaactataaagagtagtccttttaaatagatgcattgatttgtatatctttgaaaaagttgattatgattaaatgtgtgggtagttaattacaatttagggtaacaaccaggatgtatggattcttgaggttttggcttcttgagctttctcttgagtacttgatactgttttctgaatattttgaggtttctaattaatggtatgctagtttctactgttttatataaaaatttatctagtgttgtataaggactttagtattgtggatgatgggagtggctttttgtggcatatggttgttttaattgaaatattttttcagtttattacaagtgtgaaaaaacactcaaaactctggattgttttatttcatttttgttggattatgttaatacattccttcacgtggtttagattgagtcattttatctcacttacttggaaatgtgcagctgatagaagagggattgggtaggagattggcttttacttcataataaatatacagttggttattgtattattcaaaacttattaaatccattcagtttcttaccattttaagtgtattcagtgcctgtgaagccaggcagcagagtattcccactggcttaaaacttaggcgctgatgctcctacagtacagctagttataattccagaaccaaaggcaccaacattatttggtgaccttaactactactttgatagaacagactgggtaattcactgataatgagtcattacctttttaatatgtgattatctagttcagcattttgaatgtgtagtttaaggtctgatttagtaaaattttaaagctaaataatctgatgactcttgaaagtttaattggtagtatgacatttatgtttttttcccccagactcacagccaatacaaagttttgagactcctaaatgttaatatttttgctgtttttctgagctgtttttttatttacttaccacctaagctgcggatcaaaaagggaattcttccattagaaatttgtagtgttgtgtggccagcacagtatttttcagatttgaatttcagtacctctgtgtagcctcagtactctcaacaccagtcactctttattgtcttaaaatattccatactttttgttgacccaaaattgttgaaaatattttgctcagttttcacaatgaactaattgaaaagtgtagttactgtgttgtaaacatttgtgtagttctgttaatacactgatttgaattttatttatctcaacttcctttagcgtctgcctccaaattttgtctttgctgtatacccactgagatcaattccctagacccctctggctcttagtgtactataatttgggctttataaaatatattgtcttaatttaaatagaatgtgagccctctttttttttttttaagccaaataactacacaaagtaaattataaaagatttaaatagtttgtctacagtgactagactgaaatataaaaattgattgagggtagtttacttcaggtgttagctacaaatgactaaatgtccttaaataatgcagatatctgccctctgaacaaaaattttggcaaagtaaatttgtagcaacagacttaacatgatttattgcttatgttgcccatttctgctaatggaaaagataatttaaaaatatgtggcagaggacagatattagaaatactttttggttacagaaaccattgtaaactcatcctcatttataaatggtattatgctagggagtaattggactaggaatgtttaaagataagtaaggaaacaatgtgtgctcaatcgtcaaagaacttagttatatcattgggctttgaattatctaagttgattacataattctatattcttaaggagtcttaactcggtacttgggttaacgccagaaattacttttaattcattgtttttttcactgggatgagtagaactctgcttttagtaaaagtgacagaatataggtaaaatggatgatttgggatcagagcttttcatcttgatattttagcctgtaaaataaacagctatattgttttgccctttaaatgttatatatatttttctgtctttctttccctagttgtaaaagtaaagcatattctttatagaaaacttggaatatcctgaaaggaatcaagaagaaaagaaaaatcacccttataactctataagccatagaatatccacagtaaacattttggcatgcttcc

SEQ ID NO: 329469 - DNA, 3356 bp, Homo sapiens
actgacttccggctacgccgttgtctgggtggcgcggtcgagtcatcgcagggcctcaccgcttcgttctcccgtccctccccgcgccttggcgcggggggtcgactagccaagtgaggcgggaggcgactcggacctttccctgcatttcgtttcggccagtgccgggggctacccgccctggggcctgggatccttggggcccgtgaggcccactcttagcggccggggcctaccgcggcccgccgctggccctcatgaggcatagcctgaccaagctgctggcagcctcgggcagcaactccccaacccgcagtgagagcccggagccggctgcaacttgttcgctgccctctgacctgacccgggctgcagcgggggaggaggagacggcggcggccggatctcccggccgcaagcagcagtttggcgacgaaggagagttggaagccgggagggggagccgcggcggcgtggccgtgcgcgcgccctcccccgaggagatggaggaggaggcgatcgccagcctcccgggggaagagacggaggatatggactttctgtctgggctggaactggcggatctcctggaccccaggcaaccggactggcacctggaccccgggcttagctcgccggggcctctctcctcgtctggcggaggctcggatagcggcggcctgtggagaggggacgatgacgatgaggccgcggctgctgaaatgcagcgcttctctgacctgctgcaaaggctgttaaacggtatcggaggctgcagcagcagcagtgacagtggcagcgccgaaaagaggcggagaaagtccccaggaggaggcggcggtggcggcagcggtaacgacaacaaccaggcggcgacaaagagtccccggaaggcggcggcggccgctgcccgccttaatcgactgaagaagaaggagtacgtgatggggctggagagtcgagtccggggtctggcagccgagaaccaggagctgcgggccgagaatcgggagctgggcaaacgcgtacaggcactgcaggaggagagtcgctacctacgggcagtcttagccaacgagactggactggctcgcttgctgagccggctgagcggcgtgggactgcggctgaccacctcgctcttcagagactcgcccgccggtgaccacgactacgctctgccggtgggaaagcagaagcaggacctgctggaagaggacgactcggcgggaggagtctgtctccatgtggacaaggataaggtgtcggtggagttctgctcggcgtgcgcccggaaggcgtcgtcttctcttaaaatgtagggtcaagtaatctgctctttatccgcgtttacccctttcaactcccttacaccatgtcaaacttaccttagtgggacatcttcaccggacacatttcagaggagagaaaaaaagtaatattgaatcttaaagtgtttagctaaaagcatgaatgtgacacagtaaccaactcctaatgataacatgtgactattaaatctctctgacagtttcttttttaggtgatttccttcctgccaggctccgttgtaggggttacagaacagtcgttcccgcctcacaacctgtggatacagctgttggggcagaagagacgggaccagctgctggccacatttcctgctttattttaaaaggtagtataagaaatgaggaaaaagaggtaatatcagggcttctgctgttttttatttttaacatgttcataattaaaaagtattttccagcagtccaaagatgtaagttatcttacacataaaatgttttattttgttatttggttatgaaaatggaatccttgttcttgcacaactgtaaatgttttgttgctagataatacgatttgagacctgaattggtctttggtttccagtgcatcacagcatattttgtaaaatcatctactactgcacttgagcatgaatgggtagtagccaaactcacaaattggagtgatgaacctgcttatacctaagggcaggagcaagcccctcacaatgcagctgcatgggtttttagtgcctactgaattatatatatatatacatatatatatatatatataaaccaaaagtagttggaaagattatttgaaatgactaatttgtgctatctttatgaaatatgttaaatgtagcttttttgaaacagaagccttgaattgaaatttaactaatacttgaacattttgtatatatttctttgtatataattttgtgcagtaccaatgacaaaaatatggtgtcataataaaaccaggtttgttgatcttttagttatgggctcaaagaatttattcatctctaacatgatattggaaaataatggatgaaaataggaaaaatgattgttaatgctgactgtgggtcttaaaaggttctggaaagcagtaagttcatttttctaaaaactataacattctgttggagtattttcttccttacgtcaatacttttcctgcattatttgaaattgtgggctggggagaaacagtagtcaaagctttctgaattgagatactttgaaattccaagtgtagatttttagaatgtcattttataaatggcagtttttggaattacttgataagaacttttgaaaatggaaggattagtatggcctatttttaaagctgctttgttaggttccttatgttttattaactgtcttttctcagtttccatttcatttttttttttctagttttggtgacttagtgattttgtcattttttacatcaacttcatggtcttgtttttacatggtaattgcatgtacttaggatctatctaataggggctttaaataaatttggtcatatttatgtgtaagcacattttactgtaaatgtttgggtttctgaatttaaacagatctgtttatttcagtatgtagtaaacaatatcttaaagtgtccgattcactacttgttaattaaaaaagttatgattaaaaaaaaaaaaacaaaaaaaaaacaaaaacaaaaaaaaaaaaaaaccaaaccacacaaacaaaaaaaccacaacacaaaacacaacacccacaaccaacccccacaacaaccaaccacccacacccaccaaccccaaacacccaccccccccccgcaccagtataaaaatgcaggacagagggccgccaaagtagggctgacccagacatcatgcggagcacggacaaggaggacggagaaggggaaagagagtgaagacgaagaagacaaggcgacgcggacgggccaggaacgagagagcgggatgccacaacaacagaaaacgaagccacaacaaccccaccaacacaacaccacacaaa

SEQ ID NO: 329470 - DNA, 5591 bp, Homo sapiens
ggaaggtgggagggaaatctaatttgggccctgtccaccctggaaacagacttgtgctggtcaagaatgtatttaagatgcctcttctggttgaaatagctattaatgtgtccccttattcagacttgcgtgtacctagctcttctgtccccagtgtggacatggccttggatgacatcggttccaactgtacactgaaacctgcttatagagagacagtttggagacagtgaaacaggtgaagttgaatggaagttccgagttgtacaaggtgcaaattggaattccgattttagggcaacttttcagaggttgacagttaagtatttggggcatgcacaaatgtgatagttattttgctggaggtgacaggtatctcttaaatatcaacaatgccttttagttttcagtatgagatatagaaacagtctataatggagtaacattttaatgtctcaccattagagaagttggaaattaacatacatatgagactcctgcgttttagttaattggagaataagaatggctaatgtttctttgaggaccagcagtgattaccctatcactgagattgaataaattgttgaacatctttatttttgttgtattaaaattttaggttaaatttatatatgtatgattagatattgaaggttgtgaaatgtgaatgaaaacgtgtaaagtgaggcttcacaaagaatcttattctctgtgtttcaaaagtatttgtcctattttaaaataattttttaaattgagtggttctggccacttaaatgacacgattggtactattttcctaaggtgggatttattcccttgaatctattaaccagttgtataaattgaattatggtgtccttcagtgtaagaggcattaagaaattctttgtgaaacatcactgcttgataaagtatatacgtatttagcatccttgtttttctttgtgctaaagtggatacagctgttggggcagaagagacgggaccagctgctggccacatttcctgctttattttaaaaggtagtataagaaatgaggaaaaagaggtaatatcagggcttctgctgttttttatttttaacatgttcataattaaaaagtattttccagcagtccaaagatgtaagttatcttacacataaaatgttttattttgttatttggttatgaaaatggaatccttgttcttgcacaactgtaaatgttttgttgctagataatacgatttgagacctgaattggtctttggtttccagtgcatcacagcatattttgtaaaatcatctactactgcacttgagcatgaatgggtagtagccaaactcacaaattggagtgatgaacctgcttatacctaagggcaggagcaagcccctcacaatgcagctgcatgggtttttagtgcctactgaattatatatatatatacatatatatatatatatataaaccaaaagtagttggaaagattatttgaaatgactaatttgtgctatctttatgaaatatgttaaatgtagcttttttgaaacagaagccttgaattgaaatttaactaatacttgaacattttgtatatatttctttgtatataattttgtgcagtaccaatgacaaaaatatggtgtcataataaaaccaggtttgttgatcttttagttatgggctcaaagaatttattcatctctaacatgatattggaaaataatggatgaaaataggaaaaatgattgttaatgctgactgtgggtcttaaaaggttctggaaagcagtaagttcatttttctaaaaactataacattctgttggagtattttcttccttacgtcaatacttttcctgcattatttgaaattgtgggctggggagaaacagtagtcaaagctttctgaattgagatactttgaaattccaagtgtagatttttagaatgtcattttataaatggcagtttttggaattacttgataagaacttttgaaaatggaaggattagtatggcctatttttaaagctgctttgttaggttccttatgttttattaactgtcttttctcagtttccatttcatttttttttttctagttttggtgacttagtgattttgtcattttttacatcaacttcatggtcttgtttttacatggtaattgcatgtacttaggatctatctaataggggctttaaataaatttggtcatatttatgtgtaagcacattttactgtaaatgtttgggtttctgaatttaaacagatctgtttatttcagtatgtagtaaacaatatcttaaagtgtccgattcactacttgttaattaaaaaagttatgattaatgtgaaactgttgtcttactatttttagaaaattgtgttctggatgattagcacatggataaaggagatttctggaatataaaatggattgtttttgaaatttctaggtttggctctatttactgtaatggttgaaaacaatttagtatttgggtgacccttttgtttttcttctaaatgtgcctctggtaaaatacagaactagactaaagatgtagctttttaatatttgtcttttgatggtggcaggagttcatacattaattgaactaacacatcatattttgacctactatttctatcatattgacttactgtttctgcacttctttgaccagacttatcttaaaaagtccacttttgttaaaatgtagtcacacctctgatataatccaacaagaagtgttcaaaatattttaaatatttgtgcattttataatcactaaattaatctctctctcttctctttgaacagcttagcagtgtctgcaaaaacgaatcttttcctacaacctgttaactgactggactgttggtaacaaagtaattgtgagaaccatgtcggtcaaaaatttggcatctgctgaaaaaaatgaatgccattttcaagttcccaaattacttctatactgatttcactttccagaaatggagatatgaaaagattctctggaatccttgaaagacttaatagagatacatgagactaagttaatcttggaacaaaattatactttttttgtctttcatgggagtgatactcagttattgcatatctttacaaaattgtaacctttggagaattacagtatttcatcaagaaattagagtttttacataatcaagagcatattctatggaattaacatttagtggactagaattacataagcaggccatcagtgatcacaaggcatatgagtttgtatttatttcctggaacatgagagctaatttggagtacagacagacaccctgctgagtagaatataaaagttaatgtaaagttctgaactataaagagtagtccttttaaatagatgcattgatttgtatatctttgaaaaagttgattatgattaaatgtgtgggtagttaattacaatttagggtaacaaccaggatgtatggattcttgaggttttggcttcttgagctttctcttgagtacttgatactgttttctgaatattttgaggtttctaattaatggtatgctagtttctactgttttatataaaaatttatctagtgttgtataaggactttagtattgtggatgatgggagtggctttttgtggcatatggttgttttaattgaaatattttttcagtttattacaagtgtgaaaaaacactcaaaactctggattgttttatttcatttttgttggattatgttaatacattccttcacgtggtttagattgagtcattttatctcacttacttggaaatgtgcagctgatagaagagggattgggtaggagattggcttttacttcataataaatatacagttggttattgtattattcaaaacttattaaatccattcagtttcttaccattttaagtgtattcagtgcctgtgaagccaggcagcagagtattcccactggcttaaaacttaggcgctgatgctcctacagtacagctagttataattccagaaccaaaggcaccaacattatttggtgaccttaactactactttgatagaacagactgggtaattcactgataatgagtcattacctttttaatatgtgattatctagttcagcattttgaatgtgtagtttaaggtctgatttagtaaaattttaaagctaaataatctgatgactcttgaaagtttaattggtagtatgacatttatgtttttttcccccagactcacagccaatacaaagttttgagactcctaaatgttaatatttttgctgtttttctgagctgtttttttatttacttaccacctaagctgcggatcaaaaagggaattcttccattagaaatttgtagtgttgtgtggccagcacagtatttttcagatttgaatttcagtacctctgtgtagcctcagtactctcaacaccagtcactctttattgtcttaaaatattccatactttttgttgacccaaaattgttgaaaatattttgctcagttttcacaatgaactaattgaaaagtgtagttactgtgttgtaaacatttgtgtagttctgttaatacactgatttgaattttatttatctcaacttcctttagcgtctgcctccaaattttgtctttgctgtatacccactgagatcaattccctagacccctctggctcttagtgtactataatttgggctttataaaatatattgtcttaatttaaatagaatgtgagccctctttttttttttttaagccaaataactacacaaagtaaattataaaagatttaaatagtttgtctacagtgactagactgaaatataaaaattgattgagggtagtttacttcaggtgttagctacaaatgactaaatgtccttaaataatgcagatatctgccctctgaacaaaaattttggcaaagtaaatttgtagcaacagacttaacatgatttattgcttatgttgcccatttctgctaatggaaaagataatttaaaaatatgtggcagaggacagatattagaaatactttttggttacagaaaccattgtaaactcatcctcatttataaatggtattatgctagggagtaattggactaggaatgtttaaagataagtaaggaaacaatgtgtgctcaatcgtcaaagaacttagttatatcattgggctttgaattatctaagttgattacataattctatattcttaaggagtcttaactcggtacttgggttaacgccagaaattacttttaattcattgtttttttcactgggatgagtagaactctgcttttagtaaaagtgacagaatataggtaaaatggatgatttgggatcagagcttttcatcttgatattttagcctgtaaaataaacagctatattgttttgccctttaaatgttatatatatttttctgtctttctttccctagttgtaaaagtaaagcatattctttatagaaaacttggaatatcctgaaaggaatcaagaagaaaagaaaaatcacccttataactctataagccatagaatatccacagtaaacattttggcatgcttcc

SEQ ID NO: 329471 - DNA, 1415 bp, Homo sapiens
actgacttccggctacgccgttgtctgggtggcgcggtcgagtcatcgcagggcctcaccgcttcgttctcccgtccctccccgcgccttggcgcggggggtcgactagccaagtgaggcgggaggcgactcggacctttccctgcatttcgtttcggccagtgccgggggctacccgccctggggcctgggatccttggggcccgtgaggcccactcttagcggccggggcctaccgcggcccgccgctggccctcatgaggcatagcctgaccaagctgctggcagcctcgggcagcaactccccaacccgcagtgagagcccggagccggctgcaacttgttcgctgccctctgacctgacccgggctgcagcgggggaggaggagacggcggcggccggatctcccggccgcaagcagcagtttggcgacgaaggagagttggaagccgggagggggagccgcggcggcgtggccgtgcgcgcgccctcccccgaggagatggaggaggaggcgatcgccagcctcccgggggaagagacggaggatatggactttctgtctgggctggaactggcggatctcctggaccccaggcaaccggactggcacctggaccccgggcttagctcgccggggcctctctcctcgtctggcggaggctcggatagcggcggcctgtggagaggggacgatgacgatgaggccgcggctgctgaaatgcagcgcttctctgacctgctgcaaaggctgttaaacggtatcggaggctgcagcagcagcagtgacagtggcagcgccgaaaagaggcggagaaagtccccaggaggaggcggcggtggcggcagcggtaacgacaacaaccaggcggcgacaaagagtccccggaaggcggcggcggccgctgcccgccttaatcgactgaagaagaaggagtacgtgatggggctggagagtcgagtccggggtctggcagccgagaaccaggagctgcgggccgagaatcgggagctgggcaaacgcgtacaggcactgcaggaggagagtcgctacctacgggcagtcttagccaacgagactggactggctcgcttgctgagccggctgagcggcgtgggactgcggctgaccacctcgctcttcagagactcgcccgccggtgaccacgactacgctctgccggtgggaaagcagaagcaggacctgctggaagaggacgactcggcgggaggagtctgtctccatgtggacaaggataaggtgtcggtggagttctgctcggcgtgcgcccggaaggcgtcgtcttctcttaaaatgtagggtcaagtaatctgctctttatccgcgtgcgcactgacacgcgatgggttgaatcaagatgaaatagatcaactgaaaagaacagtcactaga

SEQ ID NO: 329472 - DNA, 2994 bp, Homo sapiens
actgacttccggctacgccgttgtctgggtggcgcggtcgagtcatcgcagggcctcaccgcttcgttctcccgtccctccccgcgccttggcgcggggggtcgactagccaagtgaggcgggaggcgactcggacctttccctgcatttcgtttcggccagtgccgggggctacccgccctggggcctgggatccttggggcccgtgaggcccactcttagcggccggggcctaccgcggcccgccgctggccctcatgaggcatagcctgaccaagctgctggcagcctcgggcagcaactccccaacccgcagtgagagcccggagccggctgcaacttgttcgctgccctctgacctgacccgggctgcagcgggggaggaggagacggcggcggccggatctcccggccgcaagcagcagtttggcgacgaaggagagttggaagccgggagggggagccgcggcggcgtggccgtgcgcgcgccctcccccgaggagatggaggaggaggcgatcgccagcctcccgggggaagagacggaggatatggactttctgtctgggctggaactggcggatctcctggaccccaggcaaccggactggcacctggaccccgggcttagctcgccggggcctctctcctcgtctggcggaggctcggatagcggcggcctgtggagaggggacgatgacgatgaggccgcggctgctgaaatgcagcgcttctctgacctgctgcaaaggctgttaaacggtatcggaggctgcagcagcagcagtgacagtggcagcgccgaaaagaggcggagaaagtccccaggaggaggcggcggtggcggcagcggtaacgacaacaaccaggcggcgacaaagagtccccggaaggcggcggcggccgctgcccgccttaatcgactgaagaagaaggagtacgtgatggggctggagagtcgagtccggggtctggcagccgagaaccaggagctgcgggccgagaatcgggagctgggcaaacgcgtacaggcactgcaggaggagagtcgctacctacgggcagtcttagccaacgagactggactggctcgcttgctgagccggctgagcggcgtgggactgcggctgaccacctcgctcttcagagactcgcccgccggtgaccacgactacgctctgccggtgggaaagcagaagcaggacctgctggaagaggacgactcggcgggaggagtctgtctccatgtggacaaggataaggtgtcggtggagttctgctcggcgtgcgcccggaaggcgtcgtcttctcttaaaatgtagggtcaagtaatctgctctttatccgcgtttacccctttcaactcccttacaccatgtcaaacttaccttagtgggacatcttcaccggacacatttcagaggagagaaaaaaagtaatattgaatcttaaagtgtttagctaaaagcatgaatgtgacacagtaaccaactcctaatgataacatgtgactattaaatctctctgacagtttcttttttaggtgatttccttcctgccaggctccgttgtaggggttacagaacagtcgttcccgcctcacaacctgtggatacagctgttggggcagaagagacgggaccagctgctggccacatttcctgctttattttaaaaggtagtataagaaatgaggaaaaagaggtaatatcagggcttctgctgttttttatttttaacatgttcataattaaaaagtattttccagcagtccaaagatgtaagttatcttacacataaaatgttttattttgttatttggttatgaaaatggaatccttgttcttgcacaactgtaaatgttttgttgctagataatacgatttgagacctgaattggtctttggtttccagtgcatcacagcatattttgtaaaatcatctactactgcacttgagcatgaatgggtagtagccaaactcacaaattggagtgatgaacctgcttatacctaagggcaggagcaagcccctcacaatgcagctgcatgggtttttagtgcctactgaattatatatatatatacatatatatatatatatataaaccaaaagtagttggaaagattatttgaaatgactaatttgtgctatctttatgaaatatgttaaatgtagcttttttgaaacagaagccttgaattgaaatttaactaatacttgaacattttgtatatatttctttgtatataattttgtgcagtaccaatgacaaaaatatggtgtcataataaaaccaggtttgttgatcttttagttatgggctcaaagaatttattcatctctaacatgatattggaaaataatggatgaaaataggaaaaatgattgttaatgctgactgtgggtcttaaaaggttctggaaagcagtaagttcatttttctaaaaactataacattctgttggagtattttcttccttacgtcaatacttttcctgcattatttgaaattgtgggctggggagaaacagtagtcaaagctttctgaattgagatactttgaaattccaagtgtagatttttagaatgtcattttataaatggcagtttttggaattacttgataagaacttttgaaaatggaaggattagtatggcctatttttaaagctgctttgttaggttccttatgttttattaactgtcttttctcagtttccatttcatttttttttttctagttttggtgacttagtgattttgtcattttttacatcaacttcatggtcttgtttttacatggtaattgcatgtacttaggatctatctaataggggctttaaataaatttggtcatatttatgtgtaagcacattttactgtaaatgtttgggtttctgaatttaaacagatctgtttatttcagtatgtagtaaacaatatcttaaagtgtccgattcactacttgttaattaaaaaagttatgattaa

SEQ ID NO: 329473 - DNA, 6241 bp, Homo sapiens
actgacttccggctacgccgttgtctgggtggcgcggtcgagtcatcgcagggcctcaccgcttcgttctcccgtccctccccgcgccttggcgcggggggtcgactagccaagtgaggcgggaggcgactcggacctttccctgcatttcgtttcggccagtgccgggggctacccgccctggggcctgggatccttggggcccgtgaggcccactcttagcggccggggcctaccgcggcccgccgctggccctcatgaggcatagcctgaccaagctgctggcagcctcgggcagcaactccccaacccgcagtgagagcccggagccggctgcaacttgttcgctgccctctgacctgacccgggctgcagcgggggaggaggagacggcggcggccggatctcccggccgcaagcagcagtttggcgacgaaggagagttggaagccgggagggggagccgcggcggcgtggccgtgcgcgcgccctcccccgaggagatggaggaggaggcgatcgccagcctcccgggggaagagacggaggatatggactttctgtctgggctggaactggcggatctcctggaccccaggcaaccggactggcacctggaccccgggcttagctcgccggggcctctctcctcgtctggcggaggctcggatagcggcggcctgtggagaggggacgatgacgatgaggccgcggctgctgaaatgcagcgcttctctgacctgctgcaaaggctgttaaacggtatcggaggctgcagcagcagcagtgacagtggcagcgccgaaaagaggcggagaaagtccccaggaggaggcggcggtggcggcagcggtaacgacaacaaccaggcggcgacaaagagtccccggaaggcggcggcggccgctgcccgccttaatcgactgaagaagaaggagtacgtgatggggctggagagtcgagtccggggtctggcagccgagaaccaggagctgcgggccgagaatcgggagctgggcaaacgcgtacaggcactgcaggaggagagtcgctacctacgggcagtcttagccaacgagactggactggctcgcttgctgagccggctgagcggcgtgggactgcggctgaccacctcgctcttcagagactcgcccgccggtgaccacgactacgctctgccggtgggaaagcagaagcaggacctgctggaagaggacgactcggcgggaggagtctgtctccatgtggacaaggataaggtgtcggtggagttctgctcggcgtgcgcccggaaggcgtcgtcttctcttaaaatgtagggtcaagtaatctgctctttatccgcgtttacccctttcaactcccttacaccatgtcaaacttaccttagtgggacatcttcaccggacacatttcagaggagagaaaaaaagtaatattgaatcttaaagtgtttagctaaaagcatgaatgtgacacagtaaccaactcctaatgataacatgtgactattaaatctctctgacagtttcttttttaggtgatttccttcctgccaggctccgttgtaggggttacagaacagtcgttcccgcctcacaacctgtggatacagctgttggggcagaagagacgggaccagctgctggccacatttcctgctttattttaaaaggtagtataagaaatgaggaaaaagaggtaatatcagggcttctgctgttttttatttttaacatgttcataattaaaaagtattttccagcagtccaaagatgtaagttatcttacacataaaatgttttattttgttatttggttatgaaaatggaatccttgttcttgcacaactgtaaatgttttgttgctagataatacgatttgagacctgaattggtctttggtttccagtgcatcacagcatattttgtaaaatcatctactactgcacttgagcatgaatgggtagtagccaaactcacaaattggagtgatgaacctgcttatacctaagggcaggagcaagcccctcacaatgcagctgcatgggtttttagtgcctactgaattatatatatatatacatatatatatatatatataaaccaaaagtagttggaaagattatttgaaatgactaatttgtgctatctttatgaaatatgttaaatgtagcttttttgaaacagaagccttgaattgaaatttaactaatacttgaacattttgtatatatttctttgtatataattttgtgcagtaccaatgacaaaaatatggtgtcataataaaaccaggtttgttgatcttttagttatgggctcaaagaatttattcatctctaacatgatattggaaaataatggatgaaaataggaaaaatgattgttaatgctgactgtgggtcttaaaaggttctggaaagcagtaagttcatttttctaaaaactataacattctgttggagtattttcttccttacgtcaatacttttcctgcattatttgaaattgtgggctggggagaaacagtagtcaaagctttctgaattgagatactttgaaattccaagtgtagatttttagaatgtcattttataaatggcagtttttggaattacttgataagaacttttgaaaatggaaggattagtatggcctatttttaaagctgctttgttaggttccttatgttttattaactgtcttttctcagtttccatttcatttttttttttctagttttggtgacttagtgattttgtcattttttacatcaacttcatggtcttgtttttacatggtaattgcatgtacttaggatctatctaataggggctttaaataaatttggtcatatttatgtgtaagcacattttactgtaaatgtttgggtttctgaatttaaacagatctgtttatttcagtatgtagtaaacaatatcttaaagtgtccgattcactacttgttaattaaaaaagttatgattaatgtgaaactgttgtcttactatttttagaaaattgtgttctggatgattagcacatggataaaggagatttctggaatataaaatggattgtttttgaaatttctaggtttggctctatttactgtaatggttgaaaacaatttagtatttgggtgacccttttgtttttcttctaaatgtgcctctggtaaaatacagaactagactaaagatgtagctttttaatatttgtcttttgatggtggcaggagttcatacattaattgaactaacacatcatattttgacctactatttctatcatattgacttactgtttctgcacttctttgaccagacttatcttaaaaagtccacttttgttaaaatgtagtcacacctctgatataatccaacaagaagtgttcaaaatattttaaatatttgtgcattttataatcactaaattaatctctctctcttctctttgaacagcttagcagtgtctgcaaaaacgaatcttttcctacaacctgttaactgactggactgttggtaacaaagtaattgtgagaaccatgtcggtcaaaaatttggcatctgctgaaaaaaatgaatgccattttcaagttcccaaattacttctatactgatttcactttccagaaatggagatatgaaaagattctctggaatccttgaaagacttaatagagatacatgagactaagttaatcttggaacaaaattatactttttttgtctttcatgggagtgatactcagttattgcatatctttacaaaattgtaacctttggagaattacagtatttcatcaagaaattagagtttttacataatcaagagcatattctatggaattaacatttagtggactagaattacataagcaggccatcagtgatcacaaggcatatgagtttgtatttatttcctggaacatgagagctaatttggagtacagacagacaccctgctgagtagaatataaaagttaatgtaaagttctgaactataaagagtagtccttttaaatagatgcattgatttgtatatctttgaaaaagttgattatgattaaatgtgtgggtagttaattacaatttagggtaacaaccaggatgtatggattcttgaggttttggcttcttgagctttctcttgagtacttgatactgttttctgaatattttgaggtttctaattaatggtatgctagtttctactgttttatataaaaatttatctagtgttgtataaggactttagtattgtggatgatgggagtggctttttgtggcatatggttgttttaattgaaatattttttcagtttattacaagtgtgaaaaaacactcaaaactctggattgttttatttcatttttgttggattatgttaatacattccttcacgtggtttagattgagtcattttatctcacttacttggaaatgtgcagctgatagaagagggattgggtaggagattggcttttacttcataataaatatacagttggttattgtattattcaaaacttattaaatccattcagtttcttaccattttaagtgtattcagtgcctgtgaagccaggcagcagagtattcccactggcttaaaacttaggcgctgatgctcctacagtacagctagttataattccagaaccaaaggcaccaacattatttggtgaccttaactactactttgatagaacagactgggtaattcactgataatgagtcattacctttttaatatgtgattatctagttcagcattttgaatgtgtagtttaaggtctgatttagtaaaattttaaagctaaataatctgatgactcttgaaagtttaattggtagtatgacatttatgtttttttcccccagactcacagccaatacaaagttttgagactcctaaatgttaatatttttgctgtttttctgagctgtttttttatttacttaccacctaagctgcggatcaaaaagggaattcttccattagaaatttgtagtgttgtgtggccagcacagtatttttcagatttgaatttcagtacctctgtgtagcctcagtactctcaacaccagtcactctttattgtcttaaaatattccatactttttgttgacccaaaattgttgaaaatattttgctcagttttcacaatgaactaattgaaaagtgtagttactgtgttgtaaacatttgtgtagttctgttaatacactgatttgaattttatttatctcaacttcctttagcgtctgcctccaaattttgtctttgctgtatacccactgagatcaattccctagacccctctggctcttagtgtactataatttgggctttataaaatatattgtcttaatttaaatagaatgtgagccctctttttttttttttaagccaaataactacacaaagtaaattataaaagatttaaatagtttgtctacagtgactagactgaaatataaaaattgattgagggtagtttacttcaggtgttagctacaaatgactaaatgtccttaaataatgcagatatctgccctctgaacaaaaattttggcaaagtaaatttgtagcaacagacttaacatgatttattgcttatgttgcccatttctgctaatggaaaagataatttaaaaatatgtggcagaggacagatattagaaatactttttggttacagaaaccattgtaaactcatcctcatttataaatggtattatgctagggagtaattggactaggaatgtttaaagataagtaaggaaacaatgtgtgctcaatcgtcaaagaacttagttatatcattgggctttgaattatctaagttgattacataattctatattcttaaggagtcttaactcggtacttgggttaacgccagaaattacttttaattcattgtttttttcactgggatgagtagaactctgcttttagtaaaagtgacagaatataggtaaaatggatgatttgggatcagagcttttcatcttgatattttagcctgtaaaataaacagctatattgttttgccctttaaatgttatatatatttttctgtctttctttccctagttgtaaaagtaaagcatattctttatagaaaacttggaatatcctgaaaggaatcaagaagaaaagaaaaatcacccttataactctataagccatagaatatccacagtaaacattttggcatgcttcc

SEQ ID NO: 329474 - DNA, 6473 bp, Homo sapiens
actgacttccggctacgccgttgtctgggtggcgcggtcgagtcatcgcagggcctcaccgcttcgttctcccgtccctccccgcgccttggcgcggggggtcgactagccaagtgaggcgggaggcgactcggacctttccctgcatttcgtttcggccagtgccgggggctacccgccctggggcctgggatccttggggcccgtgaggcccactcttagcggccggggcctaccgcggcccgccgctggccctcatgaggcatagcctgaccaagctgctggcagcctcgggcagcaactccccaacccgcagtgagagcccggagccggctgcaacttgttcgctgccctctgacctgacccgggctgcagcgggggaggaggagacggcggcggccggatctcccggccgcaagcagcagtttggcgacgaaggagagttggaagccgggagggggagccgcggcggcgtggccgtgcgcgcgccctcccccgaggagatggaggaggaggcgatcgccagcctcccgggggaagagacggaggatatggactttctgtctgggctggaactggcggatctcctggaccccaggcaaccggactggcacctggaccccgggcttagctcgccggggcctctctcctcgtctggcggaggctcggatagcggcggcctgtggagaggggacgatgacgatgaggccgcggctgctgaaatgcagcgcttctctgacctgctgcaaaggctgttaaacggtatcggaggctgcagcagcagcagtgacagtggcagcgccgaaaagaggcggagaaagtccccaggaggaggcggcggtggcggcagcggtaacgacaacaaccaggcggcgacaaagagtccccggaaggcggcggcggccgctgcccgccttaatcgactgaagaagaaggagtacgtgatggggctggagagtcgagtccggggtctggcagccgagaaccaggagctgcgggccgagaatcgggagctgggcaaacgcgtacaggcactgcaggaggagagtcgctacctacgggcagtcttagccaacgagactggactggctcgcttgctgagccggctgagcggcgtgggactgcggctgaccacctcgctcttcagagactcgcccgccggtgaccacgactacgctctgccggtgggaaagcagaagcaggacctgctggaagaggacgactcggcgggaggagtctgtctccatgtggacaaggataaggtgtcggtggagttctgctcggcgtgcgcccggaaggcgtcgtcttctcttaaaatgtagggtcaagtaatctgctctttatccgcgtttacccctttcaactcccttacaccatgtcaaacttaccttagtgggacatcttcaccggacacatttcagaggagagaaaaaaagtaatattgaatcttaaagtgtttagctaaaagcatgaatgtgacacagtaaccaactcctaatgataacatgtgactattaaatctctctgacagtttcttttttaggtgatttccttcctgccaggctccgttgtaggggttacagaacagtcgttcccgcctcacaacctgtggatacagctgttggggcagaagagacgggaccagctgctggccacatttcctgctttattttaaaaggtagtataagaaatgaggaaaaagaggtaatatcagggcttctgctgttttttatttttaacatgttcataattaaaaagtattttccagcagtccaaagatgtaagttatcttacacataaaatgttttattttgttatttggttatgaaaatggaatccttgttcttgcacaactgtaaatgttttgttgctagataatacgatttgagacctgaattggtctttggtttccagtgcatcacagcatattttgtaaaatcatctactactgcacttgagcatgaatgggtagtagccaaactcacaaattggagtgatgaacctgcttatacctaagggcaggagcaagcccctcacaatgcagctgcatgggtttttagtgcctactgaattatatatatatatacatatatatatatatatataaaccaaaagtagttggaaagattatttgaaatgactaatttgtgctatctttatgaaatatgttaaatgtagcttttttgaaacagaagccttgaattgaaatttaactaatacttgaacattttgtatatatttctttgtatataattttgtgcagtaccaatgacaaaaatatggtgtcataataaaaccaggtttgttgatcttttagttatgggctcaaagaatttattcatctctaacatgatattggaaaataatggatgaaaataggaaaaatgattgttaatgctgactgtgggtcttaaaaggttctggaaagcagtaagttcatttttctaaaaactataacattctgttggagtattttcttccttacgtcaatacttttcctgcattatttgaaattgtgggctggggagaaacagtagtcaaagctttctgaattgagatactttgaaattccaagtgtagatttttagaatgtcattttataaatggcagtttttggaattacttgataagaacttttgaaaatggaaggattagtatggcctatttttaaagctgctttgttaggttccttatgttttattaactgtcttttctcagtttccatttcatttttttttttctagttttggtgacttagtgattttgtcattttttacatcaacttcatggtcttgtttttacatggtaattgcatgtacttaggatctatctaataggggctttaaataaatttggtcatatttatgtgtaagcacattttactgtaaatgtttgggtttctgaatttaaacagatctgtttatttcagtatgtagtaaacaatatcttaaagtgtccgattcactacttgttaattaaaaaagttatgattaatgtgaaactgttgtcttactatttttagaaaattgtgttctggatgattagcacatggataaaggagatttctggaatataaaatggattgtttttgaaatttctaggtttggctctatttactgtaatggttgaaaacaatttagtatttgggtgacccttttgtttttcttctaaatgtgcctctggtaaaatacagaactagactaaagatgtagctttttaatatttgtcttttgatggtggcaggagttcatacattaattgaactaacacatcatattttgacctactatttctatcatattgacttactgtttctgcacttctttgaccagacttatcttaaaaagtccacttttgttaaaatgtagtcacacctctgatataatccaacaagaagtgttcaaaatattttaaatatttgtgcattttataatcactaaattaatctctctctcttctctttgaacagcttagcagtgtctgcaaaaacgaatcttttcctacaacctgttaactgactggactgttggtaacaaagtaattgtgagaaccatgtcggtcaaaaatttggcatctgctgaaaaaaatgaatgccattttcaagttcccaaattacttctatactgatttcactttccagaaatggagatatgaaaagattctctggaatccttgaaagacttaatagagatacatgagactaagttaatcttggaacaaaattatactttttttgtctttcatgggagtgatactcagttattgcatatctttacaaaattgtaacctttggagaattacagtatttcatcaagaaattagagtttttacataatcaagagcatattctatggaattaacatttagtggactagaattacataagcaggccatcagtgatcacaaggcatatgagtttgtatttatttcctggaacatgagagctaatttggagtacagacagacaccctgctgagtagaatataaaagttaatgtaaagttctgaactataaagagtagtccttttaaatagatgcattgatttgtatatctttgaaaaagttgattatgattaaatgtgtgggtagttaattacaatttagggtaacaaccaggatgtatggattcttgaggttttggcttcttgagctttctcttgagtacttgatactgttttctgaatattttgaggtttctaattaatggtatgctagtttctactgttttatataaaaatttatctagtgttgtataaggactttagtattgtggatgatgggagtggctttttgtggcatatggttgttttaattgaaatattttttcagtttattacaagtgtgaaaaaacactcaaaactctggattgttttatttcatttttgttggattatgttaatacattccttcacgtggtttagattgagtcattttatctcacttacttggaaatgtgcagctgatagaagagggattgggtaggagattggcttttacttcataataaatatacagttggttattgtattattcaaaacttattaaatccattcagtttcttaccattttaagtgtattcagtgcctgtgaagccaggcagcagagtattcccactggcttaaaacttaggcgctgatgctcctacagtacagctagttataattccagaaccaaaggcaccaacattatttggtgaccttaactactactttgatagaacagactgggtaattcactgataatgagtcattacctttttaatatgtgattatctagttcagcattttgaatgtgtagtttaaggtctgatttagtaaaattttaaagctaaataatctgatgactcttgaaagtttaattggtagtatgacatttatgtttttttcccccagactcacagccaatacaaagttttgagactcctaaatgttaatatttttgctgtttttctgagctgtttttttatttacttaccacctaagctgcggatcaaaaagggaattcttccattagaaatttgtagtgttgtgtggccagcacagtatttttcagatttgaatttcagtacctctgtgtagcctcagtactctcaacaccagtcactctttattgtcttaaaatattccatactttttgttgacccaaaattgttgaaaatattttgctcagttttcacaatgaactaattgaaaagtgtagttactgtgttgtaaacatttgtgtagttctgttaatacactgatttgaattttatttatctcaacttcctttagcgtctgcctccaaattttgtctttgctgtatacccactgagatcaattccctagacccctctggctcttagtgtactataatttgggctttataaaatatattgtcttaatttaaatagaatgtgagccctctttttttttttttaagccaaataactacacaaagtaaattataaaagatttaaatagtttgtctacagtgactagactgaaatataaaaattgattgagggtagtttacttcaggtgttagctacaaatgactaaatgtccttaaataatgcagatatctgccctctgaacaaaaattttggcaaagtaaatttgtagcaacagacttaacatgatttattgcttatgttgcccatttctgctaatggaaaagataatttaaaaatatgtggcagaggacagatattagaaatactttttggttacagaaaccattgtaaactcatcctcatttataaatggtattatgctagggagtaattggactaggaatgtttaaagataagtaaggaaacaatgtgtgctcaatcgtcaaagaacttagttatatcattgggctttgaattatctaagttgattacataattctatattcttaaggagtcttaactcggtacttgggttaacgccagaaattacttttaattcattgtttttttcactgggatgagtagaactctgcttttagtaaaagtgacagaatataggtaaaatggatgatttgggatcagagcttttcatcttgatattttagcctgtaaaataaacagctatattgttttgccctttaaatgttatatatatttttctgtctttctttccctagttgtaaaagtaaagcatattctttatagaaaacttggaatatcctgaaaggaatcaagaagaaaagaaaaatcacccttataactctataagccatagaatatccacagtaaacattttggcatgcttcctttcagtctcttgtgcacatagattcttttgcctcataactgggatcattttttatataagtttggtagataatatattttatgtgcctgttgaaagaacaaatcatctttgctttctgaaaaattgagattgtattttattaatttcacatgagtttttcatctttggcagcacagctttatgtttttctttaaacagaagctaaaggccagtttcactcacaaagatgcc

SEQ ID NO: 329475 - DNA, 6419 bp, Homo sapiens
actgacttccggctacgccgttgtctgggtggcgcggtcgagtcatcgcagggcctcaccgcttcgttctcccgtccctccccgcgccttggcgcggggggtcgactagccaagtgaggcgggaggcgactcggacctttccctgcatttcgtttcggccagtgccgggggctacccgccctggggcctgggatccttggggcccgtgaggcccactcttagcggccggggcctaccgcggcccgccgctggccctcatgaggcatagcctgaccaagctgctggcagcctcgggcagcaactccccaacccgcagtgagagcccggagccggctgcaacttgttcgctgccctctgacctgacccgggctgcagcgggggaggaggagacggcggcggccggatctcccggccgcaagcagcagtttggcgacgaaggagagttggaagccgggagggggagccgcggcggcgtggccgtgcgcgcgccctcccccgaggagatggaggaggaggcgatcgccagcctcccgggggaagagacggaggatatggactttctgtctgggctggaactggcggatctcctggaccccaggcaaccggactggcacctggaccccgggcttagctcgccggggcctctctcctcgtctggcggaggctcggatagcggcggcctgtggagaggggacgatgacgatgaggccgcggctgctgaaatgcagcgcttctctgacctgctgcaaaggctgttaaacggtatcggaggctgcagcagcagcagtgacagtggcagcgccgaaaagaggcggagaaagtccccaggaggaggcggcggtggcggcagcggtaacgacaacaaccaggcggcgacaaagagtccccggaaggcggcggcggccgctgcccgccttaatcgactgaagaagaaggagtacgtgatggggctggagagtcgagtccggggtctggcagccgagaaccaggagctgcgggccgagaatcgggagctgggcaaacgcgtacaggcactgcaggaggagagtcgctacctacgggcagtcttagccaacgagactggactggctcgcttgctgagccggctgagcggcgtgggactgcggctgaccacctcgctcttcagagactcgcccgccggtgaccacgactacgctctgccggtgggaaagcagaagcaggacctgctggaagaggacgactcggcgggaggagtctgtctccatgtggacaaggataaggtgtcggtggagttctgctcggcgtgcgcccggaaggcgtcgtcttctcttaaaatgtagggtcaagtaatctgctctttatccgcgtttacccctttcaactcccttacaccatgtcaaacttaccttagtgggacatcttcaccggacacatttcagaggagagaaaaaaagtaatattgaatcttaaagtgtttagctaaaagcatgaatgtgacacagtaaccaactcctaatgataacatgtgactattaaatctctctgacagtttcttttttaggtgatttccttcctgccaggctccgttgtaggggttacagaacagtcgttcccgcctcacaacctgtggatacagctgttggggcagaagagacgggaccagctgctggccacatttcctgctttattttaaaaggtagtataagaaatgaggaaaaagaggtaatatcagggcttctgctgttttttatttttaacatgttcataattaaaaagtattttccagcagtccaaagatgtaagttatcttacacataaaatgttttattttgttatttggttatgaaaatggaatccttgttcttgcacaactgtaaatgttttgttgctagataatacgatttgagacctgaattggtctttggtttccagtgcatcacagcatattttgtaaaatcatctactactgcacttgagcatgaatgggtagtagccaaactcacaaattggagtgatgaacctgcttatacctaagggcaggagcaagcccctcacaatgcagctgcatgggtttttagtgcctactgaattatatatatatatacatatatatatatatatataaaccaaaagtagttggaaagattatttgaaatgactaatttgtgctatctttatgaaatatgttaaatgtagcttttttgaaacagaagccttgaattgaaatttaactaatacttgaacattttgtatatatttctttgtatataattttgtgcagtaccaatgacaaaaatatggtgtcataataaaaccaggtttgttgatcttttagttatgggctcaaagaatttattcatctctaacatgatattggaaaataatggatgaaaataggaaaaatgattgttaatgctgactgtgggtcttaaaaggttctggaaagcagtaagttcatttttctaaaaactataacattctgttggagtattttcttccttacgtcaatacttttcctgcattatttgaaattgtgggctggggagaaacagtagtcaaagctttctgaattgagatactttgaaattccaagtgtagatttttagaatgtcattttataaatggcagtttttggaattacttgataagaacttttgaaaatggaaggattagtatggcctatttttaaagctgctttgttaggttccttatgttttattaactgtcttttctcagtttccatttcatttttttttttctagttttggtgacttagtgattttgtcattttttacatcaacttcatggtcttgtttttacatggtaattgcatgtacttaggatctatctaataggggctttaaataaatttggtcatatttatgtgtaagcacattttactgtaaatgtttgggtttctgaatttaaacagatctgtttatttcagtatgtagtaaacaatatcttaaagtgtccgattcactacttgttaattaaaaaagttatgattaatgtgaaactgttgtcttactatttttagaaaattgtgttctggatgattagcacatggataaaggagatttctggaatataaaatggattgtttttgaaatttctaggtttggctctatttactgtaatggttgaaaacaatttagtatttgggtgacccttttgtttttcttctaaatgtgcctctggtaaaatacagaactagactaaagatgtagctttttaatatttgtcttttgatggtggcaggagttcatacattaattgaactaacacatcatattttgacctactatttctatcatattgacttactgtttctgcacttctttgaccagacttatcttaaaaagtccacttttgttaaaatgtagtcacacctctgatataatccaacaagaagtgttcaaaatattttaaatatttgtgcattttataatcactaaattaatctctctctcttctctttgaacagcttagcagtgtctgcaaaaacgaatcttttcctacaacctgttaactgactggactgttggtaacaaagtaattgtgagaaccatgtcggtcaaaaatttggcatctgctgaaaaaaatgaatgccattttcaagttcccaaattacttctatactgatttcactttccagaaatggagatatgaaaagattctctggaatccttgaaagacttaatagagatacatgagactaagttaatcttggaacaaaattatactttttttgtctttcatgggagtgatactcagttattgcatatctttacaaaattgtaacctttggagaattacagtatttcatcaagaaattagagtttttacataatcaagagcatattctatggaattaacatttagtggactagaattacataagcaggccatcagtgatcacaaggcatatgagtttgtatttatttcctggaacatgagagctaatttggagtacagacagacaccctgctgagtagaatataaaagttaatgtaaagttctgaactataaagagtagtccttttaaatagatgcattgatttgtatatctttgaaaaagttgattatgattaaatgtgtgggtagttaattacaatttagggtaacaaccaggatgtatggattcttgaggttttggcttcttgagctttctcttgagtacttgatactgttttctgaatattttgaggtttctaattaatggtatgctagtttctactgttttatataaaaatttatctagtgttgtataaggactttagtattgtggatgatgggagtggctttttgtggcatatggttgttttaattgaaatattttttcagtttattacaagtgtgaaaaaacactcaaaactctggattgttttatttcatttttgttggattatgttaatacattccttcacgtggtttagattgagtcattttatctcacttacttggaaatgtgcagctgatagaagagggattgggtaggagattggcttttacttcataataaatatacagttggttattgtattattcaaaacttattaaatccattcagtttcttaccattttaagtgtattcagtgcctgtgaagccaggcagcagagtattcccactggcttaaaacttaggcgctgatgctcctacagtacagctagttataattccagaaccaaaggcaccaacattatttggtgaccttaactactactttgatagaacagactgggtaattcactgataatgagtcattacctttttaatatgtgattatctagttcagcattttgaatgtgtagtttaaggtctgatttagtaaaattttaaagctaaataatctgatgactcttgaaagtttaattggtagtatgacatttatgtttttttcccccagactcacagccaatacaaagttttgagactcctaaatgttaatatttttgctgtttttctgagctgtttttttatttacttaccacctaagctgcggatcaaaaagggaattcttccattagaaatttgtagtgttgtgtggccagcacagtatttttcagatttgaatttcagtacctctgtgtagcctcagtactctcaacaccagtcactctttattgtcttaaaatattccatactttttgttgacccaaaattgttgaaaatattttgctcagttttcacaatgaactaattgaaaagtgtagttactgtgttgtaaacatttgtgtagttctgttaatacactgatttgaattttatttatctcaacttcctttagcgtctgcctccaaattttgtctttgctgtatacccactgagatcaattccctagacccctctggctcttagtgtactataatttgggctttataaaatatattgtcttaatttaaatagaatgtgagccctctttttttttttttaagccaaataactacacaaagtaaattataaaagatttaaatagtttgtctacagtgactagactgaaatataaaaattgattgagggtagtttacttcaggtgttagctacaggcaaagtaaatttgtagcaacagacttaacatgatttattgcttatgttgcccatttctgctaatggaaaagataatttaaaaatatgtggcagaggacagatattagaaatactttttggttacagaaaccattgtaaactcatcctcatttataaatggtattatgctagggagtaattggactaggaatgtttaaagataagtaaggaaacaatgtgtgctcaatcgtcaaagaacttagttatatcattgggctttgaattatctaagttgattacataattctatattcttaaggagtcttaactcggtacttgggttaacgccagaaattacttttaattcattgtttttttcactgggatgagtagaactctgcttttagtaaaagtgacagaatataggtaaaatggatgatttgggatcagagcttttcatcttgatattttagcctgtaaaataaacagctatattgttttgccctttaaatgttatatatatttttctgtctttctttccctagttgtaaaagtaaagcatattctttatagaaaacttggaatatcctgaaaggaatcaagaagaaaagaaaaatcacccttataactctataagccatagaatatccacagtaaacattttggcatgcttcctttcagtctcttgtgcacatagattcttttgcctcataactgggatcattttttatataagtttggtagataatatattttatgtgcctgttgaaagaacaaatcatctttgctttctgaaaaattgagattgtattttattaatttcacatgagtttttcatctttggcagcacagctttatgtttttctttaaacagaagctaaaggccagtttcactcacaaagatgcc

SEQ ID NO: 329476 - DNA, 2316 bp, Homo sapiens
actgacttccggctacgccgttgtctgggtggcgcggtcgagtcatcgcagggcctcaccgcttcgttctcccgtccctccccgcgccttggcgcggggggtcgactagccaagtgaggcgggaggcgactcggacctttccctgcatttcgtttcggccagtgccgggggctacccgccctggggcctgggatccttggggcccgtgaggcccactcttagcggccggggcctaccgcggcccgccgctggccctcatgaggcatagcctgaccaagctgctggcagcctcgggcagcaactccccaacccgcagtgagagcccggagccggctgcaacttgttcgctgccctctgacctgacccgggctgcagcgggggaggaggagacggcggcggccggatctcccggccgcaagcagcagtttggcgacgaaggagagttggaagccgggagggggagccgcggcggcgtggccgtgcgcgcgccctcccccgaggagatggaggaggaggcgatcgccagcctcccgggggaagagacggaggatatggactttctgtctgggctggaactggcggatctcctggaccccaggcaaccggactggcacctggaccccgggcttagctcgccggggcctctctcctcgtctggcggaggctcggatagcggcggcctgtggagaggggacgatgacgatgaggccgcggctgctgaaatgcagcgcttctctgacctgctgcaaaggctgttaaacggtatcggaggctgcagcagcagcagtgacagtggcagcgccgaaaagaggcggagaaagtccccaggaggaggcggcggtggcggcagcggtaacgacaacaaccaggcggcgacaaagagtccccggaaggcggcggcggccgctgcccgccttaatcgactgaagaagaaggagtacgtgatggggctggagagtcgagtccggggtctggcagccgagaaccaggagctgcgggccgagaatcgggagctgggcaaacgcgtacaggcactgcaggaggagagtcgctacctacgggcagtcttagccaacgagactggactggctcgcttgctgagccggctgagcggcgtgggactgcggctgaccacctcgctcttcagagactcgcccgccggtgaccacgactacgctctgccggtgggaaagcagaagcaggacctgctggaagaggacgactcggcgggaggagtctgtctccatgtggacaaggataaggtgtcggtggagttctgctcggcgtgcgcccggaaggcgtcgtcttctcttaaaatgtagggtcaagtaatctgctctttatccgcgtttacccctttcaactcccttacaccatgtcaaacttaccttagtgggacatcttcaccggacacatttcagaggagagaaaaaaagtaatattgaatcttaaagtgtttagctaaaagcatgaatgtgacacagtaaccaactcctaatgataacatgtgactattaaatctctctgacagtttcttttttaggtgatttccttcctgccaggctccgttgtaggggttacagaacagtcgttcccgcctcacaacctgtggatacagctgttggggcagaagagacgggaccagctgctggccacatttcctgctttattttaaaaggtagtataagaaatgaggaaaaagaggtaatatcagggcttctgctgttttttatttttaacatgttcataattaaaaagtattttccagcagtccaaagatgtaagttatcttacacataaaatgttttattttgttatttggttatgaaaatggaatccttgttcttgcacaactgtaaatgttttgttgctagataatacgatttgagacctgaattggtctttggtttccagtgcatcacagcatattttgtaaaatcatctactactgcacttgagcatgaatgggtagtagccaaactcacaaattggagtgatgaacctgcttatacctaagggcaggagcaagcccctcacaatgcagctgcatgggtttttagtgcctactgaattatatatatatatacatatatatatatatatataaaccaaaagtagttggaaagattatttgaaatgactaatttgtgctatctttatgaaatatgttaaatgtagcttttttgaaacagaagccttgaattgaaatttaactaatacttgaacattttgtatatatttctttgtatataattttgtgcagtaccaatgacaaaaatatggtgtcataataaaaccaggtttgttgatctttta

SEQ ID NO: 329477 - DNA, 1390 bp, Homo sapiens
actgacttccggctacgccgttgtctgggtggcgcggtcgagtcatcgcagggcctcaccgcttcgttctcccgtccctccccgcgccttggcgcggggggtcgactagccaagtgaggcgggaggcgactcggacctttccctgcatttcgtttcggccagtgccgggggctacccgccctggggcctgggatccttggggcccgtgaggcccactcttagcggccggggcctaccgcggcccgccgctggccctcatgaggcatagcctgaccaagctgctggcagcctcgggcagcaactccccaacccgcagtgagagcccggagccggctgcaacttgttcgctgccctctgacctgacccgggctgcagcgggggaggaggagacggcggcggccggatctcccggccgcaagcagcagtttggcgacgaaggagagttggaagccgggagggggagccgcggcggcgtggccgtgcgcgcgccctcccccgaggagatggaggaggaggcgatcgccagcctcccgggggaagagacggaggatatggactttctgtctgggctggaactggcggatctcctggaccccaggcaaccggactggcacctggaccccgggcttagctcgccggggcctctctcctcgtctggcggaggctcggatagcggcggcctgtggagaggggacgatgacgatgaggccgcggctgctgaaatgcagcgcttctctgacctgctgcaaaggctgttaaacggtatcggaggctgcagcagcagcagtgacagtggcagcgccgaaaagaggcggagaaagtccccaggaggaggcggcggtggcggcagcggtaacgacaacaaccaggcggcgacaaagagtccccggaaggcggcggcggccgctgcccgccttaatcgactgaagaagaaggagtacgtgatggggctggagagtcgagtccggggtctggcagccgagaaccaggagctgcgggccgagaatcgggagctgggcaaacgcgtacaggcactgcaggaggagagtcgctacctacgggcagtcttagccaacgagactggactggctcgcttgctgagccggctgagcggcgtgggactgcggctgaccacctcgctcttcagagactcgcccgccggtgaccacgactacgctctgccggtgggaaagcagaagcaggacctgctggaagaggacgactcggcgggaggagtctgtctccatgtggacaaggataaggtgtcggtggagttctgctcggcgtgcgcccggaaggcgtcgtcttctcttaaaatgtagggtcaagtaatctgctctttatccgcgtatgcgcactggggggtcctctagatctcctcaaaccaagg

SEQ ID NO: 329478 - DNA, 609 bp, Homo sapiens
aattgccgcaaggagaataaaatattcaggaatagagctaacaagggaagtgaagggcctcttcaaggagaactacaaaccactgctccaggaactcagagaggatacaagcagatgggagaacattccatgctcatggatagaaagaatcaatatcacgaaaatgaccatactgcccaaaacaatttatagattcaatgctatttccattaaatcactgacattcttcacagaattagaaaaaactattttaaaattcatatggaatcaaaaaagagctcggatagccaggacattcctaagcaaaaagaacaaagctggaggcatcacattacccaacttcaaactatactactaatagcaaaaaaatgtgcaatttatatgacaaagtactaatctagctaatacacaaaaataccttaaggactgattttttaaaaaatagccaataaaaaacaaacaaaggacataaaaaggctatctactgaataaaataaattcaatctcactcaaaaattaataaacattggaacaagattttatatttatctatctgataaataaaagtaaaccatattttcaaaaggttcgataagagccattctcaca

SEQ ID NO: 329479 - DNA, 1008 bp, Homo sapiens
cccccgagtcccggggcccaggcgcctcgtgatgtcaccgcagcttgatacaaagagcccttcggcccacgcgggtctcccggcaacgggcgggggcggggccgcgccttccactggtgcccagaagtgcgagcggcagcggcgcggccgcgattgttcctgcgcttcggggctgcccgccgcgtccccgcgcgccgccgacccgcgcccgctggcttccgcgcctctgccggggagcggcccgcggatgcgcaccccgccagctctcgggagccagggcagcgaggtcacaggccccacctttgctgatggcgagctcatccccagggaacccggcttttttcccgaggacgaggaggaggctatgacgctggcgccacctgagggcccccaggagttgtacacagacagccccatggagagcactcagagcctggaggggtctgtcgggagtcctgccgagaaggacgggggacttgggggcctgtttctgccagaagacaagtccctggtccacactccatccatgacgacctcagacctttctacacactccaccacctcgctcatcagcaatgaggagcagtttgaagactatggggagggtgacgatgtggactgtgcccccagcagcccttgccccgatgatgagaccaggaccaacgtctactcggacctggggtcttcggtgtcttccagtgcggggcagacgcctaggaaaatgcggcacgtgtacaacagcgaattgctagatgtttactgctctcaatgctgcaagaaaatcaacctgctcaatgacttggaagcccgactgaaaaacctgaaggccaacagccccaaccgaaagatctccagcacggcctttggacggcagctcatgcacagcagcaacttcagcagcagcaatggcagcaccgaagacctgttccgggacagcattgactcttgcgacaatgacatcacagagaaggtgagctcctggaagacggtgacgagactgaatgcatg

SEQ ID NO: 329480 - DNA, 8205 bp, Homo sapiens
gcggccgcgaccccgacggcttcctgcgcgtggagcgcgtcgcggcgctcggactgcgcttcggccagggcgaggaggtggaaaaacttgtgaaatatttggatcccaacgacctggggagaatcaacttcaaggacttttgccggggggtgttcgccatgaaagggtgcgaggagctgctgaaggatgtgctgtcggtggagagcgcggggacgctgccgtgcgcgccagagatcccagactgcgtggagcagggcagcgaggtcacaggccccacctttgctgatggcgagctcatccccagggaacccggcttttttcccgaggacgaggaggaggctatgacgctggcgccacctgagggcccccaggagttgtacacagacagccccatggagagcactcagagcctggaggggtctgtcgggagtcctgccgagaaggacgggggacttgggggcctgtttctgccagaagacaagtccctggtccacactccatccatgacgacctcagacctttctacacactccaccacctcgctcatcagcaatgaggagcagtttgaagactatggggagggtgacgatgtggactgtgcccccagcagcccttgccccgatgatgagaccaggaccaacgtctactcggacctggggtcttcggtgtcttccagtgcggggcagacgcctaggaaaatgcggcacgtgtacaacagcgaattgctagatgtttactgctctcaatgctgcaagaaaatcaacctgctcaatgacttggaagcccgactgaaaaacctgaaggccaacagccccaaccgaaagatctccagcacggcctttggacggcagctcatgcacagcagcaacttcagcagcagcaatggcagcaccgaagacctgttccgggacagcattgactcttgcgacaatgacatcacagagaaggtaagcttcctggaaaagaaggtgacagagctggagaatgacagcctgaccaatggggacctgaagagcaagctgaagcaagagaacacacagctggtgcacagggtgcatgagctggaggagatggtgaaggatcaggagaccacggccgagcaggctctggaggaggaggcgcggcgccaccgcgaggcctacggcaagctggagagggagaaggctaccgaggtggagctgctcaatgccagggtgcagcagttggaggaagaaaatacagagcttagaacaacagtgactcggctcaagtctcaaacagagaaactggatgaggagcggcagcgcatgtctgaccgtctggaggacaccagcctgcggctcaaagatgagatggacctgtacaagcgcatgatggacaagctgcgacagaaccgccttgagttccagaaggagcgggaggcgacgcaggagctcatcgaggacttgcggaaggagctggagcacctgcagatgtacaagctggactgcgagcggccaggcaggggccgcagtgcctcctctggcctaggcgagttcaatgccagggcccgcgaggtggagctcgagcacgaggtcaagcggctcaagcaggagaattataagctgcgggatcagaacgacgacttgaatgggcagattttgagcctcagcctctacgaagcaaaaaacctctttgctgcccagactaaagcccagtctctggctgcggagatagacaccgcctcgcgcgatgagctaatggaagccctgaaggagcaggaggagatcaacttccggctgaggcagtacatggacaagattatcctcgccatcctggaccacaatccctccatcctcgagatcaaacactaaggcacggggctggctgcagagcagccttaggaccctgggaccaagggcagaccctgcccaaggatgcaggcctaagccgggcctcacactcacactgtaaatgtctctctggccaccatgcgttacgtgtacccgtgtatatgtggggaggctgtgcacacgagcgaggggtgagtggccgtggctgtgggcagcatccacacggttagccgtgcatgcactttgtggcccctttgcaaggggcagagggtactggaagtgggaggaggcaaggtctgctatcaggagttactgtaaaaacaagaactggaagctcgtgtttccggtactgggtaaaatgattctacctctggggataaggattcacattcgctctagtacgatgggctctttcaccccactcctagtccccttgggagtgggagcaaaattgtgatctttcctaggagtttgaatgccccatatttgtgtcctcgccagctctttggccacctttcaagccccagtgttcaagctcagagaggatgaaggggcatctggagggtccatgagatggggccctcaccaaatgccttggccaccggccagcagccctctgtgatgtgtgtgcagagtgaacagaggactcaggtttcatagcagctagtgcggggcatcctcatcctgtacctatagagttcgtgcactcccccatccatgctacctacctccccgtttctgtttcagttttaagacaatgaagcagcattcactgcgtcattgtaacatgaagggataaaaatgaaggagaaggagggtttgggatgggtgtctaaggcaggagttgacatcgggcaaccaaagaaatgagttttggggaggaacacaactcccatcccagtcagtttccttcccatggctgcatcttaagatggatgcacggagaaaccgtctgcctggctccctgtcttcattctccacgcagcctggtgatggcaggcctgggtttggatttcagaatcctagctccgggctccactcgtgtggcagcaagactgcttcgttccagcgtttagaaacacacctgtatttgattctcagccaggggagcactcgctgcactggtgggaggcggttgggaaagttgcaggaaaaccttagtcttccatccttctgacccatggtggaaattcacaccatggatttttaatggatctttgttctaggcagctgggaatagacatggtacttaccttagagttttccaatttatctcaattttatatggcttgtgattcattttcttaatccaaatatatataaacgtgtgtggtcttattcttccccctgcagtttcttgctttcttcagcacatcttatagtatgagaaggaaggtttgggcatgttgggaagggcggtggagggggagttgcagaaagagagggcagtgagggtgaggagaggggatctggggacttgggtgtgacacctgcttgacagaggcagggctgtggccaggaccaaccttcaattccattccaatcagcctttgcatttgttggatctcgtggcttctttttaatcttttgttggggattagtttcatgctgcacataatggggttgcactggtctgacccaggactttggagccacccacactgggaagactaggctaggcagtcggtcttctaggagtttctcagccccttaggacgcgggtctccttgggctcccccaagggttctgcgaagaggcagtggaagaaggcatgaggagagggtctcttgagaatttgccaataggaaggagtggccacggctgaaaggaacaagacagatcctgacatagctttggcctgggtgttaggtcagaaggagtactggtgcgtgggggccttaccccagggttgagtattttatatgtaaaatgttatctgccctttggctgcattggaatttcagagaaggctgcagaggcctgggttacacagcctgagtcacaacgtgggaaggaatctctgccacgggaaaggtgggcggaagcagctggcagcctggggcgtgcttcaggctcctccctctaaggggcgccatgggaacaggctccggagggagccggcgtctgaaaggcccccgggacctgctgcagtgccagaggggcctctggagcaggcctggcttttaaatggggggctgaattccagctcacacacacctcaagtccaaccttactttcttcagccagaatacatttcttgtaaaacctggcttgttgcttggcttttaaagatggtgtatgtttgtaaaaatattcttctgggctcaaaagctagcttgagggggcagatgccccaggtgtcccagctccacagcccctggcagatcccagaccccttggtggcaggtcccagagcctaggtggtaggagcttgatctttgtttctgcccttacccctcagtagtggggctgcgaggtagtagacaggatgcccagttaagtttgaatttcagatagaaaataattttagaataaatatgttctatctaatacatgggacagatgttatttttagagataggatcttgctctgttgcccaggctggagtgtagtggtatgatcatagctcaccacaaccttgaactcccaggctcaagcgatcctcccgccttaactgcctgagtagctgggactacaggcatgcaccaccacgcccagctaatttttcttattttttgtagagacagggtctcactgtgttgcctcactcgagctgctgacctcaagtgatcctcccacctcagcctgccaaagcactgggattacaggcatgagccaccatgcctggccaggacatatttgaaatggggagattttaaaaattctgatgattagactgaatcctcagacgttctggtttgattgttgtgggtgtagcccaggcatgggattttttaaagagctgctcaggtaattccaatttaattgcgtgtcctacttgggttttttgtttgtttttattgtttttgctaaacctggcaaccctaccgagtagggattagcagtaacttatctgaaatttagaggtgttttgggggtggggcgagggtttctgtagtagactcagattttacatggccctgagctgcccttgcgttcagttggaagccacgcaaaatgaactgaaccaggagtgagcttcgtgtacattatctattagaaaatgaagtaccttctggttcagctagtccctgtgcgttgagaggctttaagaaacttctagtaaaaatgtttttttcttttagctttgaattggccagagtttatcctagattattttattttaaattggtagaattctttgcgaactgtcacagagaaattccttttcatgactttatttctgacctattaaaacatgaacaggccaggcatggtggctcacgcctgtaatcctagcacttgggaggcagtggcaggcggatcacttgagctcaggagtcctaaaccagcctgggcaacatagtgataccttgtctctaccaaaagttaaaaaaaaaaaaaaaaaagctcaagaacctgcacgagggcctaaaacagtgggctcagctttggctgtgcattggaatcacctggggagatttgtaagcttctgctgtctgggctgaacccccagaggttcggattgaattggtgtggggtgtggtccaggcatcgagatgtgtaaagacctccccaggtgatgatatgcagtccgaggttgagactgccctgtcctgcaaggtcgttggccagaggtagaggaaactggtcaaagtggctgttgggcttgtcaagcccgtggctgaatgacagtgagctctcttgctgggagggttccttttcctgttgttgaatggtcctggcctgcaggatgggaggccagatgccttcaggagctggtggatccagctgttctcaccagcctggaggttagcagaccagagtgggtgggcaggaccttggcctggtgcccctggaatcagtgggtggcatgtgttgggatatactggctacaggctcatctcaaagagcaggtagaacagagtcagcagggaactgacaggtggggctgtccccctgaaagcagccgcagaaacagctgccacctatttgcatagctgagcaggaggacatactgtctttgtgggttttgcttctggtctgtttcctgactgggttgataaagggagtcccagctcgttccctgttagccaaaccagcatcctgctcacacaccggacactccaggtgctagtccactggtgctggtgttcaggggagttgggggggggggcgcggggacagaagcgcgggttcttggttccaatgagggacttagcagaagcctccaggggccagcagggccaggtgaaacttgggagaaatgaagccctctgtgtcctgtgtgtgtggtggggtttaatgcattagcaaatttaaacttaaaaactaactctaggccgggcacggtggctcacacctgtaatcccagcactttgggaggccaaggcaggtggattgcctgagctcaggagttcgagaccagcctggacaacatggtgaaactcttgtctttatttttttaaaaaaacaaaaagtaactttcgatgtgatcataccaggaaagttttgcgtggtcaccatgccaagaaaatgactttggttgcccagcagatccacagcgactctttctcaagggctactgtggattctagattgaggaaaggggccacttaggactcagtgctggtatcctccacagtcctttctcccagactctggccctccctttgggacccaggaaatcccctctagggtgacgctgctggctaggaagactgaggtctgctgcgccaaggggcctcaagttagaagggccatgccgtcagtggatgactttgagcgctgatcctagggacctgccaggtcctcacttcctgccctgggtgcacacatgaatggggcagccagcaggaagcgggagaggctggaaccaggagcctgccctacctgcatggcaggacaactctgaggcccttctgccatattctctgctacccaccagagaaaataggctgccttctagaaagatttgtttctaaaagcgtagaccctggggaagtataatgtcaccatgctcaccaggcgaggtttcccatatgacctccctgccccgacctcgtcaggttgctcctttccccatctgtaaggtagagatgtctgccccggagctaccagctggggatggcatccaggccatgtctcctgcaggatccaagtgctgttgtccccagggtgaccctgcctcctgctggggcccatccgctttgctgtgctgcacaggctgttttcatctgcatggtttggggtctttgtccttgtgccttttcttccccatcgccactgtacaggattttccacattgcccactgcctccttttctacatcgtctcatctccctggaatcagtgggtggcatgtgttgggatatactggctacaggctcatctcaaagagcaggtagaacagagtcagcagggaactgacaggtggggctgtccccctgaaagcagccacagaaacagctgccacctatttgcatagctgagcaggaggacatactgtctttgtgggtttgcttctggtctgtttcctgactgggttgataaagggagtcccagctcgttccctgttagccaaaccagcatcctgctcacacaccggacactccaggtgctagtccactggtgctggtgttcaggggagttggggggggggtgcggggacagaagcgcgggttcttggttccaatgagggacttagcagaagcctccaggggccagcagggccaggtgaaactgggagaaatgaagccctctgtgtcctgtgtgtgtggtggggtttaatgcattagcaaatttaaacttaaaaactaactctaggccgggcacggtggctcacacctgtaatcccagcactttgggaggccaaggcaggtggattgcctgagctcaggagttcgagaccagcctggacaacatggtgaaagtcttgtcttatgttttaaaaaagcaaaaactaactttcgatgtgatcataccaggaaagtttgtgcggtggtcaccatgccaaagaaaatgacttgggtgtgccagcagatccacagcgactcttgctccagagggctacggggattcccagattggcggaagggcgcgccttaggactcaagggcgggattcccccaagctttttcccaaaatctggcccccttgggaccagaaatcctctagggggagcggcgcttgaaacggtgttgtgcccaggcccataaaggcgcgcacagaaacg

SEQ ID NO: 329481 - DNA, 7600 bp, Homo sapiens
gcggccgcgaccccgacggcttcctgcgcgtggagcgcgtcgcggcgctcggactgcgcttcggccagggcgaggaggtggaaaaacttgtgaaatatttggatcccaacgacctggggagaatcaacttcaaggacttttgccggggggtgttcgccatgaaagggtgcgaggagctgctgaaggatgtgctgtcggtggagagcgcggggacgctgccgtgcgcgccagagatcccagactgcgtggagcagggcagcgaggtcacaggccccacctttgctgatggcgagctcatccccagggaacccggcttttttcccgaggacgaggaggaggctatgacgctggcgccacctgagggcccccaggagttgtacacagacagccccatggagagcactcagagcctggaggggtctgtcgggagtcctgccgagaaggacgggggacttgggggcctgtttctgccagaagacaagtccctggtccacactccatccatgacgacctcagacctttctacacactccaccacctcgctcatcagcaatgaggagcagtttgaagactatggggagggtgacgatgtggactgtgcccccagcagcccttgccccgatgatgagaccaggaccaacgtctactcggacctggggtcttcggtgtcttccagtgcggggcagacgcctaggaaaatgcggcacgtgtacaacagcgaattgctagatgtttactgctctcaatgctgcaagaaaatcaacctgctcaatgacttggaagcccgactgaaaaacctgaaggccaacagccccaaccgaaagatctccagcacggcctttggacggcagctcatgcacagcagcaacttcagcagcagcaatggcagcaccgaagacctgttccgggacagcattgactcttgcgacaatgacatcacagagaaggtaagcttcctggaaaagaaggtgacagagctggagaatgacagcctgaccaatggggacctgaagagcaagctgaagcaagagaacacacagctggtgcacagggtgcatgagctggaggagatggtgaaggatcaggagaccacggccgagcaggctctggaggaggaggcgcggcgccaccgcgaggcctacggcaagctggagagggagaaggctaccgaggtggagctgctcaatgccagggtgcagcagttggaggaagaaaatacagagcttagaacaacagtgactcggctcaagtctcaaacagagaaactggatgaggagcggcagcgcatgtctgaccgtctggaggacaccagcctgcggctcaaagatgagatggacctgtacaagcgcatgatggacaagctgcgacagaaccgccttgagttccagaaggagcgggaggcgacgcaggagctcatcgaggacttgcggaaggagctggagcacctgcagatgtacaagctggactgcgagcggccaggcaggggccgcagtgcctcctctggcctaggcgagttcaatgccagggcccgcgaggtggagctcgagcacgaggtcaagcggctcaagcaggagaattataagctgcgggatcagaacgacgacttgaatgggcagattttgagcctcagcctctacgaagcaaaaaacctctttgctgcccagactaaagcccagtctctggctgcggagatagacaccgcctcgcgcgatgagctaatggaagccctgaaggagcaggaggagatcaacttccggctgaggcagtacatggacaagattatcctcgccatcctggaccacaatccctccatcctcgagatcaaacactaaggcacggggctggctgcagagcagccttaggaccctgggaccaagggcagaccctgcccaaggatgcaggcctaagccgggcctcacactcacactgtaaatgtctctctggccaccatgcgttacgtgtacccgtgtatatgtggggaggctgtgcacacgagcgaggggtgagtggccgtggctgtgggcagcatccacacggttagccgtgcatgcactttgtggcccctttgcaaggggcagagggtactggaagtgggaggaggcaaggtctgctatcaggagttactgtaaaaacaagaactggaagctcgtgtttccggtactgggtaaaatgattctacctctggggataaggattcacattcgctctagtacgatgggctctttcaccccactcctagtccccttgggagtgggagcaaaattgtgatctttcctaggagtttgaatgccccatatttgtgtcctcgccagctctttggccacctttcaagccccagtgttcaagctcagagaggatgaaggggcatctggagggtccatgagatggggccctcaccaaatgccttggccaccggccagcagccctctgtgatgtgtgtgcagagtgaacagaggactcaggtttcatagcagctagtgcggggcatcctcatcctgtacctatagagttcgtgcactcccccatccatgctacctacctccccgtttctgtttcagttttaagacaatgaagcagcattcactgcgtcattgtaacatgaagggataaaaatgaaggagaaggagggtttgggatgggtgtctaaggcaggagttgacatcgggcaaccaaagaaatgagttttggggaggaacacaactcccatcccagtcagtttccttcccatggctgcatcttaagatggatgcacggagaaaccgtctgcctggctccctgtcttcattctccacgcagcctggtgatggcaggcctgggtttggatttcagaatcctagctccgggctccactcgtgtggcagcaagactgcttcgttccagcgtttagaaacacacctgtatttgattctcagccaggggagcactcgctgcactggtgggaggcggttgggaaagttgcaggaaaaccttagtcttccatccttctgacccatggtggaaattcacaccatggatttttaatggatctttgttctaggcagctgggaatagacatggtacttaccttagagttttccaatttatctcaattttatatggcttgtgattcattttcttaatccaaatatatataaacgtgtgtggtcttattcttccccctgcagtttcttgctttcttcagcacatcttatagtatgagaaggaaggtttgggcatgttgggaagggcggtggagggggagttgcagaaagagagggcagtgagggtgaggagaggggatctggggacttgggtgtgacacctgcttgacagaggcagggctgtggccaggaccaaccttcaattccattccaatcagcctttgcatttgttggatctcgtggcttctttttaatcttttgttggggattagtttcatgctgcacataatggggttgcactggtctgacccaggactttggagccacccacactgggaagactaggctaggcagtcggtcttctaggagtttctcagccccttaggacgcgggtctccttgggctcccccaagggttctgcgaagaggcagtggaagaaggcatgaggagagggtctcttgagaatttgccaataggaaggagtggccacggctgaaaggaacaagacagatcctgacatagctttggcctgggtgttaggtcagaaggagtactggtgcgtgggggccttaccccagggttgagtattttatatgtaaaatgttatctgccctttggctgcattggaatttcagagaaggctgcagaggcctgggttacacagcctgagtcacaacgtgggaaggaatctctgccacgggaaaggtgggcggaagcagctggcagcctggggcgtgcttcaggctcctccctctaaggggcgccatgggaacaggctccggagggagccggcgtctgaaaggcccccgggacctgctgcagtgccagaggggcctctggagcaggcctggcttttaaatggggggctgaattccagctcacacacacctcaagtccaaccttactttcttcagccagaatacatttcttgtaaaacctggcttgttgcttggcttttaaagatggtgtatgtttgtaaaaatattcttctgggctcaaaagctagcttgagggggcagatgccccaggtgtcccagctccacagcccctggcagatcccagaccccttggtggcaggtcccagagcctaggtggtaggagcttgatctttgtttctgcccttacccctcagtagtggggctgcgaggtagtagacaggatgcccagttaagtttgaatttcagatagaaaataattttagaataaatatgttctatctaatacatgggacagatgttatttttagagataggatcttgctctgttgcccaggctggagtgtagtggtatgatcatagctcaccacaaccttgaactcccaggctcaagcgatcctcccgccttaactgcctgagtagctgggactacaggcatgcaccaccacgcccagctaatttttcttattttttgtagagacagggtctcactgtgttgcctcactcgactcaggagtcctaaaccagcctgggcaacatagtgataccttgtctctaccaaaagttaaaaaaaaaaaaaaaaaagctcaagaacctgcacgagggcctaaaacagtgggctcagctttggctgtgcattggaatcacctggggagatttgtaagcttctgctgtctgggctgaacccccagaggttcggattgaattggtgtggggtgtggtccaggcatcgagatgtgtaaagacctccccaggtgatgatatgcagtccgaggttgagactgccctgtcctgcaaggtcgttggccagaggtagaggaaactggtcaaagtggctgttgggcttgtcaagcccgtggctgaatgacagtgagctctcttgctgggagggttccttttcctgttgttgaatggtcctggcctgcaggatgggaggccagatgccttcaggagctggtggatccagctgttctcaccagcctggaggttagcagaccagagtgggtgggcaggaccttggcctggtgcccctggaatcagtgggtggcatgtgttgggatatactggctacaggctcatctcaaagagcaggtagaacagagtcagcagggaactgacaggtggggctgtccccctgaaagcagccgcagaaacagctgccacctatttgcatagctgagcaggaggacatactgtctttgtgggttttgcttctggtctgtttcctgactgggttgataaagggagtcccagctcgttccctgttagccaaaccagcatcctgctcacacaccggacactccaggtgctagtccactggtgctggtgttcaggggagttgggggggggggcgcggggacagaagcgcgggttcttggttccaatgagggacttagcagaagcctccaggggccagcagggccaggtgaaacttgggagaaatgaagccctctgtgtcctgtgtgtgtggtggggtttaatgcattagcaaatttaaacttaaaaactaactctaggccgggcacggtggctcacacctgtaatcccagcactttgggaggccaaggcaggtggattgcctgagctcaggagttcgagaccagcctggacaacatggtgaaactcttgtctttatttttttaaaaaaacaaaaagtaactttcgatgtgatcataccaggaaagttttgcgtggtcaccatgccaagaaaatgactttggttgcccagcagatccacagcgactctttctcaagggctactgtggattctagattgaggaaaggggccacttaggactcagtgctggtatcctccacagtcctttctcccagactctggccctccctttgggacccaggaaatcccctctagggtgacgctgctggctaggaagactgaggtctgctgcgccaaggggcctcaagttagaagggccatgccgtcagtggatgactttgagcgctgatcctagggacctgccaggtcctcacttcctgccctgggtgcacacatgaatggggcagccagcaggaagcgggagaggctggaaccaggagcctgccctacctgcatggcaggacaactctgaggcccttctgccatattctctgctacccaccagagaaaataggctgccttctagaaagatttgtttctaaaagcgtagaccctggggaagtataatgtcaccatgctcaccaggcgaggtttcccatatgacctccctgccccgacctcgtcaggttgctcctttccccatctgtaaggtagagatgtctgccccggagctaccagctggggatggcatccaggccatgtctcctgcaggatccaagtgctgttgtccccagggtgaccctgcctcctgctggggcccatccgctttgctgtgctgcacaggctgttttcatctgcatggtttggggtctttgtccttgtgccttttcttccccatcgccactgtacaggattttccacattgcccactgcctccttttctacatcgtctcatctccctggcctttcccgagccctgtaaatgtgtactttttcaacgtgcctcccccaggtgaggccagctctcccgggcacattcgtccacaaggatcaggccccacttacccttggctcgctcagcctgtagacttggtaactttgtacagaatctttcattattgtcttaagcatggggggctaggacccacttagtccctcctccagcctgcagctaatttaggagccttgcattccagaaaagggcaactttgtgtaaagcagcttctcccacagagctttccctgcattgttagtgatgtcgggcaaagcatcactctttaacctggggcattggccccagcagggatatcatgggaccgcagccgctccgtgcactgtctctgcccccagaggaagccctgtccatggttcctggtgcacggccacaggcctgccttgaggccaccacatctggtgtctagaacagctgcgggccccacttgggcagaaggaagaggtgctagctgctgcccctgcctgctgtgaacacctgcccagcccttccttgtctgctgaggtgctcagaccagagtgccattaaataccaactgatgtcacggagcggacggtgcattgccaaggactcacagctgtgggctcccttccagctcctcccactttcttggctgggtcttctgaggcctacgtggaatgaactacacatgtggcctcatgcccaagggtttgttagatggcctctgactctgtgggattcaacttgacttttttgccccaggaggctctgtctggaaacaggcttagctttagtgctggggtgggacctgccctgtgggccccagggaggggacagtgggggtgaggccctgaggctgtccagggtctgagctctttgcctccaacctgcttctgccccaaaaggaacaggctgttggtggcaggctcctcccggggagctgtactgtacagaccaaggtgtaaataaacagtttgctcttctaaaaaaaaaa

SEQ ID NO: 329482 - DNA, 8344 bp, Homo sapiens
cccccgagtcccggggcccaggcgcctcgtgatgtcaccgcagcttgatacaaagagcccttcggcccacgcgggtctcccggcaacgggcgggggcggggccgcgccttccactggtgcccagaagtgcgagcggcagcggcgcggccgcgattgttcctgcgcttcggggctgcccgccgcgtccccgcgcgccgccgacccgcgcccgctggcttccgcgcctctgccggggagcggcccgcggatgcgcaccccgccagctctcgggagccagggcagcgaggtcacaggccccacctttgctgatggcgagctcatccccagggaacccggcttttttcccgaggacgaggaggaggctatgacgctggcgccacctgagggcccccaggagttgtacacagacagccccatggagagcactcagagcctggaggggtctgtcgggagtcctgccgagaaggacgggggacttgggggcctgtttctgccagaagacaagtccctggtccacactccatccatgacgacctcagacctttctacacactccaccacctcgctcatcagcaatgaggagcagtttgaagactatggggagggtgacgatgtggactgtgcccccagcagcccttgccccgatgatgagaccaggaccaacgtctactcggacctggggtcttcggtgtcttccagtgcggggcagacgcctaggaaaatgcggcacgtgtacaacagcgaattgctagatgtttactgctctcaatgctgcaagaaaatcaacctgctcaatgacttggaagcccgactgaaaaacctgaaggccaacagccccaaccgaaagatctccagcacggcctttggacggcagctcatgcacagcagcaacttcagcagcagcaatggcagcaccgaagacctgttccgggacagcattgactcttgcgacaatgacatcacagagaaggtaagcttcctggaaaagaaggtgacagagctggagaatgacagcctgaccaatggggacctgaagagcaagctgaagcaagagaacacacagctggtgcacagggtgcatgagctggaggagatggtgaaggatcaggagaccacggccgagcaggctctggaggaggaggcgcggcgccaccgcgaggcctacggcaagctggagagggagaaggctaccgaggtggagctgctcaatgccagggtgcagcagttggaggaagaaaatacagagcttagaacaacagtgactcggctcaagtctcaaacagagaaactggatgaggagcggcagcgcatgtctgaccgtctggaggacaccagcctgcggctcaaagatgagatggacctgtacaagcgcatgatggacaagctgcgacagaaccgccttgagttccagaaggagcgggaggcgacgcaggagctcatcgaggacttgcggaaggagctggagcacctgcagatgtacaagctggactgcgagcggccaggcaggggccgcagtgcctcctctggcctaggcgagttcaatgccagggcccgcgaggtggagctcgagcacgaggtcaagcggctcaagcaggagaattataagctgcgggatcagaacgacgacttgaatgggcagattttgagcctcagcctctacgaagcaaaaaacctctttgctgcccagactaaagcccagtctctggctgcggagatagacaccgcctcgcgcgatgagctaatggaagccctgaaggagcaggaggagatcaacttccggctgaggcagtacatggacaagattatcctcgccatcctggaccacaatccctccatcctcgagatcaaacactaaggcacggggctggctgcagagcagccttaggaccctgggaccaagggcagaccctgcccaaggatgcaggcctaagccgggcctcacactcacactgtaaatgtctctctggccaccatgcgttacgtgtacccgtgtatatgtggggaggctgtgcacacgagcgaggggtgagtggccgtggctgtgggcagcatccacacggttagccgtgcatgcactttgtggcccctttgcaaggggcagagggtactggaagtgggaggaggcaaggtctgctatcaggagttactgtaaaaacaagaactggaagctcgtgtttccggtactgggtaaaatgattctacctctggggataaggattcacattcgctctagtacgatgggctctttcaccccactcctagtccccttgggagtgggagcaaaattgtgatctttcctaggagtttgaatgccccatatttgtgtcctcgccagctctttggccacctttcaagccccagtgttcaagctcagagaggatgaaggggcatctggagggtccatgagatggggccctcaccaaatgccttggccaccggccagcagccctctgtgatgtgtgtgcagagtgaacagaggactcaggtttcatagcagctagtgcggggcatcctcatcctgtacctatagagttcgtgcactcccccatccatgctacctacctccccgtttctgtttcagttttaagacaatgaagcagcattcactgcgtcattgtaacatgaagggataaaaatgaaggagaaggagggtttgggatgggtgtctaaggcaggagttgacatcgggcaaccaaagaaatgagttttggggaggaacacaactcccatcccagtcagtttccttcccatggctgcatcttaagatggatgcacggagaaaccgtctgcctggctccctgtcttcattctccacgcagcctggtgatggcaggcctgggtttggatttcagaatcctagctccgggctccactcgtgtggcagcaagactgcttcgttccagcgtttagaaacacacctgtatttgattctcagccaggggagcactcgctgcactggtgggaggcggttgggaaagttgcaggaaaaccttagtcttccatccttctgacccatggtggaaattcacaccatggatttttaatggatctttgttctaggcagctgggaatagacatggtacttaccttagagttttccaatttatctcaattttatatggcttgtgattcattttcttaatccaaatatatataaacgtgtgtggtcttattcttccccctgcagtttcttgctttcttcagcacatcttatagtatgagaaggaaggtttgggcatgttgggaagggcggtggagggggagttgcagaaagagagggcagtgagggtgaggagaggggatctggggacttgggtgtgacacctgcttgacagaggcagggctgtggccaggaccaaccttcaattccattccaatcagcctttgcatttgttggatctcgtggcttctttttaatcttttgttggggattagtttcatgctgcacataatggggttgcactggtctgacccaggactttggagccacccacactgggaagactaggctaggcagtcggtcttctaggagtttctcagccccttaggacgcgggtctccttgggctcccccaagggttctgcgaagaggcagtggaagaaggcatgaggagagggtctcttgagaatttgccaataggaaggagtggccacggctgaaaggaacaagacagatcctgacatagctttggcctgggtgttaggtcagaaggagtactggtgcgtgggggccttaccccagggttgagtattttatatgtaaaatgttatctgccctttggctgcattggaatttcagagaaggctgcagaggcctgggttacacagcctgagtcacaacgtgggaaggaatctctgccacgggaaaggtgggcggaagcagctggcagcctggggcgtgcttcaggctcctccctctaaggggcgccatgggaacaggctccggagggagccggcgtctgaaaggcccccgggacctgctgcagtgccagaggggcctctggagcaggcctggcttttaaatggggggctgaattccagctcacacacacctcaagtccaaccttactttcttcagccagaatacatttcttgtaaaacctggcttgttgcttggcttttaaagatggtgtatgtttgtaaaaatattcttctgggctcaaaagctagcttgagggggcagatgccccaggtgtcccagctccacagcccctggcagatcccagaccccttggtggcaggtcccagagcctaggtggtaggagcttgatctttgtttctgcccttacccctcagtagtggggctgcgaggtagtagacaggatgcccagttaagtttgaatttcagatagaaaataattttagaataaatatgttctatctaatacatgggacagatgttatttttagagataggatcttgctctgttgcccaggctggagtgtagtggtatgatcatagctcaccacaaccttgaactcccaggctcaagcgatcctcccgccttaactgcctgagtagctgggactacaggcatgcaccaccacgcccagctaatttttcttattttttgtagagacagggtctcactgtgttgcctcactcgagctgctgacctcaagtgatcctcccacctcagcctgccaaagcactgggattacaggcatgagccaccatgcctggccaggacatatttgaaatggggagattttaaaaattctgatgattagactgaatcctcagacgttctggtttgattgttgtgggtgtagcccaggcatgggattttttaaagagctgctcaggtaattccaatttaattgcgtgtcctacttgggttttttgtttgtttttattgtttttgctaaacctggcaaccctaccgagtagggattagcagtaacttatctgaaatttagaggtgttttgggggtggggcgagggtttctgtagtagactcagattttacatggccctgagctgcccttgcgttcagttggaagccacgcaaaatgaactgaaccaggagtgagcttcgtgtacattatctattagaaaatgaagtaccttctggttcagctagtccctgtgcgttgagaggctttaagaaacttctagtaaaaatgtttttttcttttagctttgaattggccagagtttatcctagattattttattttaaattggtagaattctttgcgaactgtcacagagaaattccttttcatgactttatttctgacctattaaaacatgaacaggccaggcatggtggctcacgcctgtaatcctagcacttgggaggcagtggcaggcggatcacttgagctcaggagtcctaaaccagcctgggcaacatagtgataccttgtctctaccaaaagttaaaaaaaaaaaaaaaaaagctcaagaacctgcacgagggcctaaaacagtgggctcagctttggctgtgcattggaatcacctggggagatttgtaagcttctgctgtctgggctgaacccccagaggttcggattgaattggtgtggggtgtggtccaggcatcgagatgtgtaaagacctccccaggtgatgatatgcagtccgaggttgagactgccctgtcctgcaaggtcgttggccagaggtagaggaaactggtcaaagtggctgttgggcttgtcaagcccgtggctgaatgacagtgagctctcttgctgggagggttccttttcctgttgttgaatggtcctggcctgcaggatgggaggccagatgccttcaggagctggtggatccagctgttctcaccagcctggaggttagcagaccagagtgggtgggcaggaccttggcctggtgcccctggaatcagtgggtggcatgtgttgggatatactggctacaggctcatctcaaagagcaggtagaacagagtcagcagggaactgacaggtggggctgtccccctgaaagcagccgcagaaacagctgccacctatttgcatagctgagcaggaggacatactgtctttgtgggttttgcttctggtctgtttcctgactgggttgataaagggagtcccagctcgttccctgttagccaaaccagcatcctgctcacacaccggacactccaggtgctagtccactggtgctggtgttcaggggagttgggggggggggcgcggggacagaagcgcgggttcttggttccaatgagggacttagcagaagcctccaggggccagcagggccaggtgaaacttgggagaaatgaagccctctgtgtcctgtgtgtgtggtggggtttaatgcattagcaaatttaaacttaaaaactaactctaggccgggcacggtggctcacacctgtaatcccagcactttgggaggccaaggcaggtggattgcctgagctcaggagttcgagaccagcctggacaacatggtgaaactcttgtctttatttttttaaaaaaacaaaaagtaactttcgatgtgatcataccaggaaagttttgcgtggtcaccatgccaagaaaatgactttggttgcccagcagatccacagcgactctttctcaagggctactgtggattctagattgaggaaaggggccacttaggactcagtgctggtatcctccacagtcctttctcccagactctggccctccctttgggacccaggaaatcccctctagggtgacgctgctggctaggaagactgaggtctgctgcgccaaggggcctcaagttagaagggccatgccgtcagtggatgactttgagcgctgatcctagggacctgccaggtcctcacttcctgccctgggtgcacacatgaatggggcagccagcaggaagcgggagaggctggaaccaggagcctgccctacctgcatggcaggacaactctgaggcccttctgccatattctctgctacccaccagagaaaataggctgccttctagaaagatttgtttctaaaagcgtagaccctggggaagtataatgtcaccatgctcaccaggcgaggtttcccatatgacctccctgccccgacctcgtcaggttgctcctttccccatctgtaaggtagagatgtctgccccggagctaccagctggggatggcatccaggccatgtctcctgcaggatccaagtgctgttgtccccagggtgaccctgcctcctgctggggcccatccgctttgctgtgctgcacaggctgttttcatctgcatggtttggggtctttgtccttgtgccttttcttccccatcgccactgtacaggattttccacattgcccactgcctccttttctacatcgtctcatctccctggcctttcccgagccctgtaaatgtgtactttttcaacgtgcctcccccaggtgaggccagctctcccgggcacattcgtccacaaggatcaggccccacttacccttggctcgctcagcctgtagacttggtaactttgtacagaatctttcattattgtcttaagcatggggggctaggacccacttagtccctcctccagcctgcagctaatttaggagccttgcattccagaaaagggcaactttgtgtaaagcagcttctcccacagagctttccctgcattgttagtgatgtcgggcaaagcatcactctttaacctggggcattggccccagcagggatatcatgggaccgcagccgctccgtgcactgtctctgcccccagaggaagccctgtccatggttcctggtgcacggccacaggcctgccttgaggccaccacatctggtgtctagaacagctgcgggccccacttgggcagaaggaagaggtgctagctgctgcccctgcctgctgtgaacacctgcccagcccttccttgtctgctgaggtgctcagaccagagtgccattaaataccaactgatgtcacggagcggacggtgcattgccaaggactcacagctgtgggctcccttccagctcctcccactttcttggctgggtcttctgaggcctacgtggaatgaactacacatgtggcctcatgcccaagggtttgttagatggcctctgactctgtgggattcaacttgacttttttgccccaggaggctctgtctggaaacaggcttagctttagtgctggggtgggacctgccctgtgggccccagggaggggacagtgggggtgaggccctgaggctgtccagggtctgagctctttgcctccaacctgcttctgccccaaaaggaacaggctgttggtggcaggctcctcccggggagctgtactgtacagaccaaggtgtaaataaacagtttgctcttctaaaaaaaaaa

SEQ ID NO: 329483 - DNA, 6772 bp, Homo sapiens
aaagcctacccttcctgccacaccagagtatgcttatgaaagatcaggcctccaaaatgccccggctgcattgtaacatgaattacaagacactctgtcactgagcctcaccctctgcctgggacacggggtgaagagctgacctctgtcctcaaggagctcccagctaatggaagccctgaaggagcaggaggagatcaacttccggctgaggcagtacatggacaagattatcctcgccatcctggaccacaatccctccatcctcgagatcaaacactaaggcacggggctggctgcagagcagccttaggaccctgggaccaagggcagaccctgcccaaggatgcaggcctaagccgggcctcacactcacactgtaaatgtctctctggccaccatgcgttacgtgtacccgtgtatatgtggggaggctgtgcacacgagcgaggggtgagtggccgtggctgtgggcagcatccacacggttagccgtgcatgcactttgtggcccctttgcaaggggcagagggtactggaagtgggaggaggcaaggtctgctatcaggagttactgtaaaaacaagaactggaagctcgtgtttccggtactgggtaaaatgattctacctctggggataaggattcacattcgctctagtacgatgggctctttcaccccactcctagtccccttgggagtgggagcaaaattgtgatctttcctaggagtttgaatgccccatatttgtgtcctcgccagctctttggccacctttcaagccccagtgttcaagctcagagaggatgaaggggcatctggagggtccatgagatggggccctcaccaaatgccttggccaccggccagcagccctctgtgatgtgtgtgcagagtgaacagaggactcaggtttcatagcagctagtgcggggcatcctcatcctgtacctatagagttcgtgcactcccccatccatgctacctacctccccgtttctgtttcagttttaagacaatgaagcagcattcactgcgtcattgtaacatgaagggataaaaatgaaggagaaggagggtttgggatgggtgtctaaggcaggagttgacatcgggcaaccaaagaaatgagttttggggaggaacacaactcccatcccagtcagtttccttcccatggctgcatcttaagatggatgcacggagaaaccgtctgcctggctccctgtcttcattctccacgcagcctggtgatggcaggcctgggtttggatttcagaatcctagctccgggctccactcgtgtggcagcaagactgcttcgttccagcgtttagaaacacacctgtatttgattctcagccaggggagcactcgctgcactggtgggaggcggttgggaaagttgcaggaaaaccttagtcttccatccttctgacccatggtggaaattcacaccatggatttttaatggatctttgttctaggcagctgggaatagacatggtacttaccttagagttttccaatttatctcaattttatatggcttgtgattcattttcttaatccaaatatatataaacgtgtgtggtcttattcttccccctgcagtttcttgctttcttcagcacatcttatagtatgagaaggaaggtttgggcatgttgggaagggcggtggagggggagttgcagaaagagagggcagtgagggtgaggagaggggatctggggacttgggtgtgacacctgcttgacagaggcagggctgtggccaggaccaaccttcaattccattccaatcagcctttgcatttgttggatctcgtggcttctttttaatcttttgttggggattagtttcatgctgcacataatggggttgcactggtctgacccaggactttggagccacccacactgggaagactaggctaggcagtcggtcttctaggagtttctcagccccttaggacgcgggtctccttgggctcccccaagggttctgcgaagaggcagtggaagaaggcatgaggagagggtctcttgagaatttgccaataggaaggagtggccacggctgaaaggaacaagacagatcctgacatagctttggcctgggtgttaggtcagaaggagtactggtgcgtgggggccttaccccagggttgagtattttatatgtaaaatgttatctgccctttggctgcattggaatttcagagaaggctgcagaggcctgggttacacagcctgagtcacaacgtgggaaggaatctctgccacgggaaaggtgggcggaagcagctggcagcctggggcgtgcttcaggctcctccctctaaggggcgccatgggaacaggctccggagggagccggcgtctgaaaggcccccgggacctgctgcagtgccagaggggcctctggagcaggcctggcttttaaatggggggctgaattccagctcacacacacctcaagtccaaccttactttcttcagccagaatacatttcttgtaaaacctggcttgttgcttggcttttaaagatggtgtatgtttgtaaaaatattcttctgggctcaaaagctagcttgagggggcagatgccccaggtgtcccagctccacagcccctggcagatcccagaccccttggtggcaggtcccagagcctaggtggtaggagcttgatctttgtttctgcccttacccctcagtagtggggctgcgaggtagtagacaggatgcccagttaagtttgaatttcagatagaaaataattttagaataaatatgttctatctaatacatgggacagatgttatttttagagataggatcttgctctgttgcccaggctggagtgtagtggtatgatcatagctcaccacaaccttgaactcccaggctcaagcgatcctcccgccttaactgcctgagtagctgggactacaggcatgcaccaccacgcccagctaatttttcttattttttgtagagacagggtctcactgtgttgcctcactcgagctgctgacctcaagtgatcctcccacctcagcctgccaaagcactgggattacaggcatgagccaccatgcctggccaggacatatttgaaatggggagattttaaaaattctgatgattagactgaatcctcagacgttctggtttgattgttgtgggtgtagcccaggcatgggattttttaaagagctgctcaggtaattccaatttaattgcgtgtcctacttgggttttttgtttgtttttattgtttttgctaaacctggcaaccctaccgagtagggattagcagtaacttatctgaaatttagaggtgttttgggggtggggcgagggtttctgtagtagactcagattttacatggccctgagctgcccttgcgttcagttggaagccacgcaaaatgaactgaaccaggagtgagcttcgtgtacattatctattagaaaatgaagtaccttctggttcagctagtccctgtgcgttgagaggctttaagaaacttctagtaaaaatgtttttttcttttagctttgaattggccagagtttatcctagattattttattttaaattggtagaattctttgcgaactgtcacagagaaattccttttcatgactttatttctgacctattaaaacatgaacaggccaggcatggtggctcacgcctgtaatcctagcacttgggaggcagtggcaggcggatcacttgagctcaggagtcctaaaccagcctgggcaacatagtgataccttgtctctaccaaaagttaaaaaaaaaaaaaaaaaagctcaagaacctgcacgagggcctaaaacagtgggctcagctttggctgtgcattggaatcacctggggagatttgtaagcttctgctgtctgggctgaacccccagaggttcggattgaattggtgtggggtgtggtccaggcatcgagatgtgtaaagacctccccaggtgatgatatgcagtccgaggttgagactgccctgtcctgcaaggtcgttggccagaggtagaggaaactggtcaaagtggctgttgggcttgtcaagcccgtggctgaatgacagtgagctctcttgctgggagggttccttttcctgttgttgaatggtcctggcctgcaggatgggaggccagatgccttcaggagctggtggatccagctgttctcaccagcctggaggttagcagaccagagtgggtgggcaggaccttggcctggtgcccctggaatcagtgggtggcatgtgttgggatatactggctacaggctcatctcaaagagcaggtagaacagagtcagcagggaactgacaggtggggctgtccccctgaaagcagccgcagaaacagctgccacctatttgcatagctgagcaggaggacatactgtctttgtgggttttgcttctggtctgtttcctgactgggttgataaagggagtcccagctcgttccctgttagccaaaccagcatcctgctcacacaccggacactccaggtgctagtccactggtgctggtgttcaggggagttgggggggggggcgcggggacagaagcgcgggttcttggttccaatgagggacttagcagaagcctccaggggccagcagggccaggtgaaacttgggagaaatgaagccctctgtgtcctgtgtgtgtggtggggtttaatgcattagcaaatttaaacttaaaaactaactctaggccgggcacggtggctcacacctgtaatcccagcactttgggaggccaaggcaggtggattgcctgagctcaggagttcgagaccagcctggacaacatggtgaaactcttgtctttatttttttaaaaaaacaaaaagtaactttcgatgtgatcataccaggaaagttttgcgtggtcaccatgccaagaaaatgactttggttgcccagcagatccacagcgactctttctcaagggctactgtggattctagattgaggaaaggggccacttaggactcagtgctggtatcctccacagtcctttctcccagactctggccctccctttgggacccaggaaatcccctctagggtgacgctgctggctaggaagactgaggtctgctgcgccaaggggcctcaagttagaagggccatgccgtcagtggatgactttgagcgctgatcctagggacctgccaggtcctcacttcctgccctgggtgcacacatgaatggggcagccagcaggaagcgggagaggctggaaccaggagcctgccctacctgcatggcaggacaactctgaggcccttctgccatattctctgctacccaccagagaaaataggctgccttctagaaagatttgtttctaaaagcgtagaccctggggaagtataatgtcaccatgctcaccaggcgaggtttcccatatgacctccctgccccgacctcgtcaggttgctcctttccccatctgtaaggtagagatgtctgccccggagctaccagctggggatggcatccaggccatgtctcctgcaggatccaagtgctgttgtccccagggtgaccctgcctcctgctggggcccatccgctttgctgtgctgcacaggctgttttcatctgcatggtttggggtctttgtccttgtgccttttcttccccatcgccactgtacaggattttccacattgcccactgcctccttttctacatcgtctcatctccctggcctttcccgagccctgtaaatgtgtactttttcaacgtgcctcccccaggtgaggccagctctcccgggcacattcgtccacaaggatcaggccccacttacccttggctcgctcagcctgtagacttggtaactttgtacagaatctttcattattgtcttaagcatggggggctaggacccacttagtccctcctccagcctgcagctaatttaggagccttgcattccagaaaagggcaactttgtgtaaagcagcttctcccacagagctttccctgcattgttagtgatgtcgggcaaagcatcactctttaacctggggcattggccccagcagggatatcatgggaccgcagccgctccgtgcactgtctctgcccccagaggaagccctgtccatggttcctggtgcacggccacaggcctgccttgaggccaccacatctggtgtctagaacagctgcgggccccacttgggcagaaggaagaggtgctagctgctgcccctgcctgctgtgaacacctgcccagcccttccttgtctgctgaggtgctcagaccagagtgccattaaataccaactgatgtcacggagcggacggtgcattgccaaggactcacagctgtgggctcccttccagctcctcccactttcttggctgggtcttctgaggcctacgtggaatgaactacacatgtggcctcatgcccaagggtttgttagatggcctctgactctgtgggattcaacttgacttttttgccccaggaggctctgtctggaaacaggcttagctttagtgctggggtgggacctgccctgtgggccccagggaggggacagtgggggtgaggccctgaggctgtccagggtctgagctctttgcctccaacctgcttctgccccaaaaggaacaggctgttggtggcaggctcctcccggggagctgtactgtacagaccaaggtgtaaataaacagtttgctcttctaaaaaaaaaa

SEQ ID NO: 329484 - DNA, 5088 bp, Homo sapiens
cagaaacacacacaaaacaaaaaacaccaataagggctagcgcaagtgacgagccctgcgtgtgaatcggacgaggcagaggcagggctgtggccaggaccaaccttcaattccattccaatcagcctttgcatttgttggatctcgtggcttctttttaatcttttgttggggattagtttcatgctgcacataatggggttgcactggtctgacccaggactttggagccacccacactgggaagactaggctaggcagtcggtcttctaggagtttctcagccccttaggacgcgggtctccttgggctcccccaagggttctgcgaagaggcagtggaagaaggcatgaggagagggtctcttgagaatttgccaataggaaggagtggccacggctgaaaggaacaagacagatcctgacatagctttggcctgggtgttaggtcagaaggagtactggtgcgtgggggccttaccccagggttgagtattttatatgtaaaatgttatctgccctttggctgcattggaatttcagagaaggctgcagaggcctgggttacacagcctgagtcacaacgtgggaaggaatctctgccacgggaaaggtgggcggaagcagctggcagcctggggcgtgcttcaggctcctccctctaaggggcgccatgggaacaggctccggagggagccggcgtctgaaaggcccccgggacctgctgcagtgccagaggggcctctggagcaggcctggcttttaaatggggggctgaattccagctcacacacacctcaagtccaaccttactttcttcagccagaatacatttcttgtaaaacctggcttgttgcttggcttttaaagatggtgtatgtttgtaaaaatattcttctgggctcaaaagctagcttgagggggcagatgccccaggtgtcccagctccacagcccctggcagatcccagaccccttggtggcaggtcccagagcctaggtggtaggagcttgatctttgtttctgcccttacccctcagtagtggggctgcgaggtagtagacaggatgcccagttaagtttgaatttcagatagaaaataattttagaataaatatgttctatctaatacatgggacagatgttatttttagagataggatcttgctctgttgcccaggctggagtgtagtggtatgatcatagctcaccacaaccttgaactcccaggctcaagcgatcctcccgccttaactgcctgagtagctgggactacaggcatgcaccaccacgcccagctaatttttcttattttttgtagagacagggtctcactgtgttgcctcactcgagctgctgacctcaagtgatcctcccacctcagcctgccaaagcactgggattacaggcatgagccaccatgcctggccaggacatatttgaaatggggagattttaaaaattctgatgattagactgaatcctcagacgttctggtttgattgttgtgggtgtagcccaggcatgggattttttaaagagctgctcaggtaattccaatttaattgcgtgtcctacttgggttttttgtttgtttttattgtttttgctaaacctggcaaccctaccgagtagggattagcagtaacttatctgaaatttagaggtgttttgggggtggggcgagggtttctgtagtagactcagattttacatggccctgagctgcccttgcgttcagttggaagccacgcaaaatgaactgaaccaggagtgagcttcgtgtacattatctattagaaaatgaagtaccttctggttcagctagtccctgtgcgttgagaggctttaagaaacttctagtaaaaatgtttttttcttttagctttgaattggccagagtttatcctagattattttattttaaattggtagaattctttgcgaactgtcacagagaaattccttttcatgactttatttctgacctattaaaacatgaacaggccaggcatggtggctcacgcctgtaatcctagcacttgggaggcagtggcaggcggatcacttgagctcaggagtcctaaaccagcctgggcaacatagtgataccttgtctctaccaaaagttaaaaaaaaaaaaaaaaaagctcaagaacctgcacgagggcctaaaacagtgggctcagctttggctgtgcattggaatcacctggggagatttgtaagcttctgctgtctgggctgaacccccagaggttcggattgaattggtgtggggtgtggtccaggcatcgagatgtgtaaagacctccccaggtgatgatatgcagtccgaggttgagactgccctgtcctgcaaggtcgttggccagaggtagaggaaactggtcaaagtggctgttgggcttgtcaagcccgtggctgaatgacagtgagctctcttgctgggagggttccttttcctgttgttgaatggtcctggcctgcaggatgggaggccagatgccttcaggagctggtggatccagctgttctcaccagcctggaggttagcagaccagagtgggtgggcaggaccttggcctggtgcccctggaatcagtgggtggcatgtgttgggatatactggctacaggctcatctcaaagagcaggtagaacagagtcagcagggaactgacaggtggggctgtccccctgaaagcagccgcagaaacagctgccacctatttgcatagctgagcaggaggacatactgtctttgtgggttttgcttctggtctgtttcctgactgggttgataaagggagtcccagctcgttccctgttagccaaaccagcatcctgctcacacaccggacactccaggtgctagtccactggtgctggtgttcaggggagttgggggggggggcgcggggacagaagcgcgggttcttggttccaatgagggacttagcagaagcctccaggggccagcagggccaggtgaaacttgggagaaatgaagccctctgtgtcctgtgtgtgtggtggggtttaatgcattagcaaatttaaacttaaaaactaactctaggccgggcacggtggctcacacctgtaatcccagcactttgggaggccaaggcaggtggattgcctgagctcaggagttcgagaccagcctggacaacatggtgaaactcttgtctttatttttttaaaaaaacaaaaagtaactttcgatgtgatcataccaggaaagttttgcgtggtcaccatgccaagaaaatgactttggttgcccagcagatccacagcgactctttctcaagggctactgtggattctagattgaggaaaggggccacttaggactcagtgctggtatcctccacagtcctttctcccagactctggccctccctttgggacccaggaaatcccctctagggtgacgctgctggctaggaagactgaggtctgctgcgccaaggggcctcaagttagaagggccatgccgtcagtggatgactttgagcgctgatcctagggacctgccaggtcctcacttcctgccctgggtgcacacatgaatggggcagccagcaggaagcgggagaggctggaaccaggagcctgccctacctgcatggcaggacaactctgaggcccttctgccatattctctgctacccaccagagaaaataggctgccttctagaaagatttgtttctaaaagcgtagaccctggggaagtataatgtcaccatgctcaccaggcgaggtttcccatatgacctccctgccccgacctcgtcaggttgctcctttccccatctgtaaggtagagatgtctgccccggagctaccagctggggatggcatccaggccatgtctcctgcaggatccaagtgctgttgtccccagggtgaccctgcctcctgctggggcccatccgctttgctgtgctgcacaggctgttttcatctgcatggtttggggtctttgtccttgtgccttttcttccccatcgccactgtacaggattttccacattgcccactgcctccttttctacatcgtctcatctccctggcctttcccgagccctgtaaatgtgtactttttcaacgtgcctcccccaggtgaggccagctctcccgggcacattcgtccacaaggatcaggccccacttacccttggctcgctcagcctgtagacttggtaactttgtacagaatctttcattattgtcttaagcatggggggctaggacccacttagtccctcctccagcctgcagctaatttaggagccttgcattccagaaaagggcaactttgtgtaaagcagcttctcccacagagctttccctgcattgttagtgatgtcgggcaaagcatcactctttaacctggggcattggccccagcagggatatcatgggaccgcagccgctccgtgcactgtctctgcccccagaggaagccctgtccatggttcctggtgcacggccacaggcctgccttgaggccaccacatctggtgtctagaacagctgcgggccccacttgggcagaaggaagaggtgctagctgctgcccctgcctgctgtgaacacctgcccagcccttccttgtctgctgaggtgctcagaccagagtgccattaaataccaactgatgtcacggagcggacggtgcattgccaaggactcacagctgtgggctcccttccagctcctcccactttcttggctgggtcttctgaggcctacgtggaatgaactacacatgtggcctcatgcccaagggtttgttagatggcctctgactctgtgggattcaacttgacttttttgccccaggaggctctgtctggaaacaggcttagctttagtgctggggtgggacctgccctgtgggccccagggaggggacagtgggggtgaggccctgaggctgtccagggtctgagctctttgcctccaacctgcttctgccccaaaaggaacaggctgttggtggcaggctcctcccggggagctgtactgtacagaccaaggtgtaaataaacagtttgctcttctaaaaaaaaaa

SEQ ID NO: 329485 - DNA, 3178 bp, Homo sapiens
cccccgagtcccggggcccaggcgcctcgtgatgtcaccgcagcttgatacaaagagcccttcggcccacgcgggtctcccggcaacgggcgggggcggggccgcgccttccactggtgcccagaagtgcgagcggcagcggcgcggccgcgattgttcctgcgcttcggggctgcccgccgcgtccccgcgcgccgccgacccgcgcccgctggcttccgcgcctctgccggggagcggcccgcggatgcgcaccccgccagctctcgggagccagggcagcgaggtcacaggccccacctttgctgatggcgagctcatccccagggaacccggcttttttcccgaggacgaggaggaggctatgacgctggcgccacctgagggcccccaggagttgtacacagacagccccatggagagcactcagagcctggaggggtctgtcgggagtcctgccgagaaggacgggggacttgggggcctgtttctgccagaagacaagtccctggtccacactccatccatgacgacctcagacctttctacacactccaccacctcgctcatcagcaatgaggagcagtttgaagactatggggagggtgacgatgtggactgtgcccccagcagcccttgccccgatgatgagaccaggaccaacgtctactcggacctggggtcttcggtgtcttccagtgcggggcagacgcctaggaaaatgcggcacgtgtacaacagcgaattgctagatgtttactgctctcaatgctgcaagaaaatcaacctgctcaatgacttggaagcccgactgaaaaacctgaaggccaacagccccaaccgaaagatctccagcacggcctttggacggcagctcatgcacagcagcaacttcagcagcagcaatggcagcaccgaagacctgttccgggacagcattgactcttgcgacaatgacatcacagagaaggtaagcttcctggaaaagaaggtgacagagctggagaatgacagcctgaccaatggggacctgaagagcaagctgaagcaagagaacacacagctggtgcacagggtgcatgagctggaggagatggtgaaggatcaggagaccacggccgagcaggctctggaggaggaggcgcggcgccaccgcgaggcctacggcaagctggagagggagaaggctaccgaggtggagctgctcaatgccagggtgcagcagttggaggaagaaaatacagagcttagaacaacagtgactcggctcaagtctcaaacagagaaactggatgaggagcggcagcgcatgtctgaccgtctggaggacaccagcctgcggctcaaagatgagatggacctgtacaagcgcatgatggacaagctgcgacagaaccgccttgagttccagaaggagcgggaggcgacgcaggagctcatcgaggacttgcggaaggagctggagcacctgcagatgtacaagctggactgcgagcggccaggcaggggccgcagtgcctcctctggcctaggcgagttcaatgccagggcccgcgaggtggagctcgagcacgaggtcaagcggctcaagcaggagaattataagctgcgggatcagaacgacgacttgaatgggcagattttgagcctcagcctctacgaagcaaaaaacctctttgctgcccagactaaagcccagtctctggctgcggagatagacaccgcctcgcgcgatgagctaatggaagccctgaaggagcaggaggagatcaacttccggctgaggcagtacatggacaagattatcctcgccatcctggaccacaatccctccatcctcgagatcaaacactaaggcacggggctggctgcagagcagccttaggaccctgggaccaagggcagaccctgcccaaggatgcaggcctaagccgggcctcacactcacactgtaaatgtctctctggccaccatgcgttacgtgtacccgtgtatatgtggggaggctgtgcacacgagcgaggggtgagtggccgtggctgtgggcagcatccacacggttagccgtgcatgcactttgtggcccctttgcaaggggcagagggtactggaagtgggaggaggcaaggtctgctatcaggagttactgtaaaaacaagaactggaagctcgtgtttccggtactgggtaaaatgattctacctctggggataaggattcacattcgctctagtacgatgggctctttcaccccactcctagtccccttgggagtgggagcaaaattgtgatctttcctaggagtttgaatgccccatatttgtgtcctcgccagctctttggccacctttcaagccccagtgttcaagctcagagaggatgaaggggcatctggagggtccatgagatggggccctcaccaaatgccttggccaccggccagcagccctctgtgatgtgtgtgcagagtgaacagaggactcaggtttcatagcagctagtgcggggcatcctcatcctgtacctatagagttcgtgcactcccccatccatgctacctacctccccgtttctgtttcagttttaagacaatgaagcagcattcactgcgtcattgtaacatgaagggataaaaatgaaggagaaggagggtttgggatgggtgtctaaggcaggagttgacatcgggcaaccaaagaaatgagttttggggaggaacacaactcccatcccagtcagtttccttcccatggctgcatcttaagatggatgcacggagaaaccgtctgcctggctccctgtcttcattctccacgcagcctggtgatggcaggcctgggtttggatttcagaatcctagctccgggctccactcgtgtggcagcaagactgcttcgttccagcgtttagaaacacacctgtatttgattctcagccaggggagcactcgctgcactggtgggaggcggttgggaaagttgcaggaaaaccttagtcttccatccttctgacccatggtggaaattcacaccatggatttttaatggatctttgttctaggcagctgggaatagacatggtacttaccttagagttttccaatttatctcaattttatatggcttgtgattcattttcttaatccaaatatatataaacgtgtgtggtcttattcttc

SEQ ID NO: 329486 - DNA, 872 bp, Homo sapiens
  misc_feature (13)..(13): n is a, c, g, or t
agcggcggaaagnacaactataggctaggtacgaggcctgggtgttggaccacttagtccctcctccagcctgcagctaatttaggagccttgcattccagaaaagggcaactttgtgtaaagcagcttctcccacagagctttccctgcattgttagtgatgtcgggcaaagcatcactctttaacctggggcattggccccagcagggatatcatgggaccgcagccgctccgtgcactgtctctgcccccagaggaagccctgtccatggttcctggtgcacggccacaggcctgccttgaggccaccacatctggtgtctagaacagctgcgggccccacttgggcagaaggaagaggtgctagctgctgcccctgcctgctgtgaacacctgcccagcccttccttgtctgctgaggtgctcagaccagagtgccattaaataccaactgatgtcacggagcggacggtgcattgccaaggactcacagctgtgggctcccttccagctcctcccactttcttggctgggtcttctgaggcctacgtggaatgaactacacatgtggcctcatgcccaagggtttgttagatggcctctgactctgtgggattcaacttgacttttttgccccaggaggctctgtctggaaacaggcttagctttagtgctggggtgggacctgccctgtgggccccagggaggggacagtgggggtgaggccctgaggctgtccagggtctgagctctttgcctccaacctgcttctgccccaaaaggaacaggctgttggtggcaggctcctcccggggagctgtactgtacagaccaaggtgtaaataaacagtttgctcttctaaaaaaaaaa

SEQ ID NO: 329487 - DNA, 2866 bp, Homo sapiens
  misc_feature (2495)..(2495): n is a, c, g, or t
  misc_feature (2500)..(2500): n is a, c, g, or t
  misc_feature (2555)..(2555): n is a, c, g, or t
  misc_feature (2564)..(2564): n is a, c, g, or t
  misc_feature (2570)..(2570): n is a, c, g, or t
  misc_feature (2584)..(2584): n is a, c, g, or t
  misc_feature (2596)..(2596): n is a, c, g, or t
  misc_feature (2601)..(2601): n is a, c, g, or t
  misc_feature (2620)..(2620): n is a, c, g, or t
  misc_feature (2635)..(2635): n is a, c, g, or t
  misc_feature (2642)..(2642): n is a, c, g, or t
  misc_feature (2644)..(2644): n is a, c, g, or t
  misc_feature (2666)..(2666): n is a, c, g, or t
  misc_feature (2672)..(2672): n is a, c, g, or t
  misc_feature (2685)..(2685): n is a, c, g, or t
  misc_feature (2693)..(2693): n is a, c, g, or t
  misc_feature (2695)..(2695): n is a, c, g, or t
  misc_feature (2706)..(2706): n is a, c, g, or t
  misc_feature (2708)..(2708): n is a, c, g, or t
  misc_feature (2714)..(2714): n is a, c, g, or t
  misc_feature (2725)..(2725): n is a, c, g, or t
  misc_feature (2735)..(2735): n is a, c, g, or t
  misc_feature (2745)..(2745): n is a, c, g, or t
  misc_feature (2748)..(2748): n is a, c, g, or t
  misc_feature (2778)..(2778): n is a, c, g, or t
  misc_feature (2781)..(2781): n is a, c, g, or t
  misc_feature (2785)..(2786): n is a, c, g, or t
  misc_feature (2851)..(2851): n is a, c, g, or t
cccccgagtcccggggcccaggcgcctcgtgatgtcaccgcagcttgatacaaagagcccttcggcccacgcgggtctcccggcaacgggcgggggcggggccgcgccttccactggtgcccagaagtgcgagcggcagcggcgcggccgcgattgttcctgcgcttcggggctgcccgccgcgtccccgcgcgccgccgacccgcgcccgctggcttccgcgcctctgccggggagcggcccgcggatgcgcaccccgccagctctcgggagccagggcagcgaggtcacaggccccacctttgctgatggcgagctcatccccagggaacccggcttttttcccgaggacgaggaggaggctatgacgctggcgccacctgagggcccccaggagttgtacacagacagccccatggagagcactcagagcctggaggggtctgtcgggagtcctgccgagaaggacgggggacttgggggcctgtttctgccagaagacaagtccctggtccacactccatccatgacgacctcagacctttctacacactccaccacctcgctcatcagcaatgaggagcagtttgaagactatggggagggtgacgatgtggactgtgcccccagcagcccttgccccgatgatgagaccaggaccaacgtctactcggacctggggtcttcggtgtcttccagtgcggggcagacgcctaggaaaatgcggcacgtgtacaacagcgaattgctagatgtttactgctctcaatgctgcaagaaaatcaacctgctcaatgacttggaagcccgactgaaaaacctgaaggccaacagccccaaccgaaagatctccagcacggcctttggacggcagctcatgcacagcagcaacttcagcagcagcaatggcagcaccgaagacctgttccgggacagcattgactcttgcgacaatgacatcacagagaaggtaagcttcctggaaaagaaggtgacagagctggagaatgacagcctgaccaatggggacctgaagagcaagctgaagcaagagaacacacagctggtgcacagggtgcatgagctggaggagatggtgaaggatcaggagaccacggccgagcaggctctggaggaggaggcgcggcgccaccgcgaggcctacggcaagctggagagggagaaggctaccgaggtggagctgctcaatgccagggtgcagcagttggaggaagaaaatacagagcttagaacaacagtgactcggctcaagtctcaaacagagaaactggatgaggagcggcagcgcatgtctgaccgtctggaggacaccagcctgcggctcaaagatgagatggacctgtacaagcgcatgatggacaagctgcgacagaaccgccttgagttccagaaggagcgggaggcgacgcaggagctcatcgaggacttgcggaaggagctggagcacctgcagatgtacaagctggactgcgagcggccaggcaggggccgcagtgcctcctctggcctaggcgagttcaatgccagggcccgcgaggtggagctcgagcacgaggtcaagcggctcaagcaggagaattataagctgcgggatcagaacgacgacttgaatgggcagattttgagcctcagcctctacgaagcaaaaaacctctttgctgcccagactaaagcccagtctctggctgcggagatagacaccgcctcgcgcgatgagctaatggaagccctgaaggagcaggaggagatcaacttccggctgaggcagtacatggacaagattatcctcgccatcctggaccacaatccctccatcctcgagatcaaacactaaggcacggggctggctgcagagcagccttaggaccctgggaccaagggcagaccctgcccaaggatgcaggcctaagccgggcctcacactcacactgtaaatgtctctctggccaccatgcgttacgtgtacccgtgtatatgtggggaggctgtgcacacgagcgaggggtgagtggccgtggctgtgggcagcatccacacggttagccgtgcatgcactttgtggcccctttgcaaggggcagagggtactggaagtgggaggaggcaaggtctgctatcaggagttactgtaaaaacaagaactggaagctcgtgtttccggtactgggtaaaatgattctacctctggggataaggattcacattcgctctagtacgatgggctctttcaccccactcctagtccccttgggagtgggagcaaaattgtgatctttcctaggagtttgaatgccccatatttgtgtcctcgccagctctttggccacctttcaagccccagtgttcaagctcagagaggatgaaggggcatctggagggtccatgagatggggccctcaccaaatgccttggccaccggccagcagcccctgctgctgtagtgctgctgctgtcagcagctgcaacagcagcgcncctcnagcgcttctctagtagcccagccgtagctgccgcgcgcgccaatccgtctagtanagtgcctanaagtantagcagctgtcgcntgccacagtccnccccnagtcccagtgccgtacccntacccctcccccgcnttgtcgngnttgtcagcgtgttgtaagcacnaaaggnaagcccagcccantgtcactngncgcgtcagtgngntaaacnagtgcaagcgngcaatataanaagtgcaagngcngcaagggcgggcgcctttgcgcgcaatggnccncctnntaagcgccagcgcagcgttgcacaaatcgcgcgccaaacccaaaagcaaaaatgcagcttttttngcgcgcaggcaaaca

SEQ ID NO: 329488 - DNA, 2193 bp, Homo sapiens
cccccgagtcccggggcccaggcgcctcgtgatgtcaccgcagcttgatacaaagagcccttcggcccacgcgggtctcccggcaacgggcgggggcggggccgcgccttccactggtgcccagaagtgcgagcggcagcggcgcggccgcgattgttcctgcgcttcggggctgcccgccgcgtccccgcgcgccgccgacccgcgcccgctggcttccgcgcctctgccggggagcggcccgcggatgcgcaccccgccagctctcgggagccagggcagcgaggtcacaggccccacctttgctgatggcgagctcatccccagggaacccggcttttttcccgaggacgaggaggaggctatgacgctggcgccacctgagggcccccaggagttgtacacagacagccccatggagagcactcagagcctggaggggtctgtcgggagtcctgccgagaaggacgggggacttgggggcctgtttctgccagaagacaagtccctggtccacactccatccatgacgacctcagacctttctacacactccaccacctcgctcatcagcaatgaggagcagtttgaagactatggggagggtgacgatgtggactgtgcccccagcagcccttgccccgatgatgagaccaggaccaacgtctactcggacctggggtcttcggtgtcttccagtgcggggcagacgcctaggaaaatgcggcacgtgtacaacagcgaattgctagatgtttactgctctcaatgctgcaagaaaatcaacctgctcaatgacttggaagcccgactgaaaaacctgaaggccaacagccccaaccgaaagatctccagcacggcctttggacggcagctcatgcacagcagcaacttcagcagcagcaatggcagcaccgaagacctgttccgggacagcattgactcttgcgacaatgacatcacagagaaggtaagcttcctggaaaagaaggtgacagagctggagaatgacagcctgaccaatggggacctgaagagcaagctgaagcaagagaacacacagctggtgcacagggtgcatgagctggaggagatggtgaaggatcaggagaccacggccgagcaggctctggaggaggaggcgcggcgccaccgcgaggcctacggcaagctggagagggagaaggctaccgaggtggagctgctcaatgccagggtgcagcagttggaggaagaaaatacagagcttagaacaacagtgactcggctcaagtctcaaacagagaaactggatgaggagcggcagcgcatgtctgaccgtctggaggacaccagcctgcggctcaaagatgagatggacctgtacaagcgcatgatggacaagctgcgacagaaccgccttgagttccagaaggagcgggaggcgacgcaggagctcatcgaggacttgcggaaggagctggagcacctgcagatgtacaagctggactgcgagcggccaggcaggggccgcagtgcctcctctggcctaggcgagttcaatgccagggcccgcgaggtggagctcgagcacgaggtcaagcggctcaagcaggagaattataagctgcgggatcagaacgacgacttgaatgggcagattttgagcctcagcctctacgaagcaactaatggaagccctgaaggagcaggaggagatcaacttccggctgaggcagtacatggacaagattatcctcgccatcctggaccacaatccctccatcctcgagatcaaacactaaggcacggggctggctgcagagcagccttaggaccctgggaccaagggcagaccctgcccaaggatgcaggcctaagccgggcctcacactcacactgtaaatgtctctctggccaccatgcgttacgtgtacccgtgtatatgtggggaggctgtgcacacgagcgaggggtgagtggccgtggctgtgggcagcatccacacggttagccgtgcatgcactttgtggcccctttgcaaggggcagagggtactggaagtgggaggaggcaaggtctgctatcaggagttactgtaaaaacaagaactggaagcaaaaacacaaaaaacaagcagaaagagagcagagacagaagaacaacaaacaaggggggcggcgccggctccaaaaagatatcaccccacaggag

SEQ ID NO: 329489 - DNA, 6793 bp, Homo sapiens
aagcttggcacgaggcgagcacgaggtcaagcggctcaagcaggagaattataagctgcgggatcagaacgacgacttgaatgggcagattttgagcctcagcctctacgaagcaaaaaacctctttgctgcccagactaaagcccagtctctggctgcggagatagacaccgcctcgcgcgatgagctaatggaagccctgaaggagcaggaggagatcaacttccggctgaggcagtacatggacaagattatcctcgccatcctggaccacaatccctccatcctcgagatcaaacactaaggcacggggctggctgcagagcagccttaggaccctgggaccaagggcagaccctgcccaaggatgcaggcctaagccgggcctcacactcacactgtaaatgtctctctggccaccatgcgttacgtgtacccgtgtatatgtggggaggctgtgcacacgagcgaggggtgagtggccgtggctgtgggcagcatccacacggttagccgtgcatgcactttgtggcccctttgcaaggggcagagggtactggaagtgggaggaggcaaggtctgctatcaggagttactgtaaaaacaagaactggaagctcgtgtttccggtactgggtaaaatgattctacctctggggataaggattcacattcgctctagtacgatgggctctttcaccccactcctagtccccttgggagtgggagcaaaattgtgatctttcctaggagtttgaatgccccatatttgtgtcctcgccagctctttggccacctttcaagccccagtgttcaagctcagagaggatgaaggggcatctggagggtccatgagatggggccctcaccaaatgccttggccaccggccagcagccctctgtgatgtgtgtgcagagtgaacagaggactcaggtttcatagcagctagtgcggggcatcctcatcctgtacctatagagttcgtgcactcccccatccatgctacctacctccccgtttctgtttcagttttaagacaatgaagcagcattcactgcgtcattgtaacatgaagggataaaaatgaaggagaaggagggtttgggatgggtgtctaaggcaggagttgacatcgggcaaccaaagaaatgagttttggggaggaacacaactcccatcccagtcagtttccttcccatggctgcatcttaagatggatgcacggagaaaccgtctgcctggctccctgtcttcattctccacgcagcctggtgatggcaggcctgggtttggatttcagaatcctagctccgggctccactcgtgtggcagcaagactgcttcgttccagcgtttagaaacacacctgtatttgattctcagccaggggagcactcgctgcactggtgggaggcggttgggaaagttgcaggaaaaccttagtcttccatccttctgacccatggtggaaattcacaccatggatttttaatggatctttgttctaggcagctgggaatagacatggtacttaccttagagttttccaatttatctcaattttatatggcttgtgattcattttcttaatccaaatatatataaacgtgtgtggtcttattcttccccctgcagtttcttgctttcttcagcacatcttatagtatgagaaggaaggtttgggcatgttgggaagggcggtggagggggagttgcagaaagagagggcagtgagggtgaggagaggggatctggggacttgggtgtgacacctgcttgacagaggcagggctgtggccaggaccaaccttcaattccattccaatcagcctttgcatttgttggatctcgtggcttctttttaatcttttgttggggattagtttcatgctgcacataatggggttgcactggtctgacccaggactttggagccacccacactgggaagactaggctaggcagtcggtcttctaggagtttctcagccccttaggacgcgggtctccttgggctcccccaagggttctgcgaagaggcagtggaagaaggcatgaggagagggtctcttgagaatttgccaataggaaggagtggccacggctgaaaggaacaagacagatcctgacatagctttggcctgggtgttaggtcagaaggagtactggtgcgtgggggccttaccccagggttgagtattttatatgtaaaatgttatctgccctttggctgcattggaatttcagagaaggctgcagaggcctgggttacacagcctgagtcacaacgtgggaaggaatctctgccacgggaaaggtgggcggaagcagctggcagcctggggcgtgcttcaggctcctccctctaaggggcgccatgggaacaggctccggagggagccggcgtctgaaaggcccccgggacctgctgcagtgccagaggggcctctggagcaggcctggcttttaaatggggggctgaattccagctcacacacacctcaagtccaaccttactttcttcagccagaatacatttcttgtaaaacctggcttgttgcttggcttttaaagatggtgtatgtttgtaaaaatattcttctgggctcaaaagctagcttgagggggcagatgccccaggtgtcccagctccacagcccctggcagatcccagaccccttggtggcaggtcccagagcctaggtggtaggagcttgatctttgtttctgcccttacccctcagtagtggggctgcgaggtagtagacaggatgcccagttaagtttgaatttcagatagaaaataattttagaataaatatgttctatctaatacatgggacagatgttatttttagagataggatcttgctctgttgcccaggctggagtgtagtggtatgatcatagctcaccacaaccttgaactcccaggctcaagcgatcctcccgccttaactgcctgagtagctgggactacaggcatgcaccaccacgcccagctaatttttcttattttttgtagagacagggtctcactgtgttgcctcactcgagctgctgacctcaagtgatcctcccacctcagcctgccaaagcactgggattacaggcatgagccaccatgcctggccaggacatatttgaaatggggagattttaaaaattctgatgattagactgaatcctcagacgttctggtttgattgttgtgggtgtagcccaggcatgggattttttaaagagctgctcaggtaattccaatttaattgcgtgtcctacttgggttttttgtttgtttttattgtttttgctaaacctggcaaccctaccgagtagggattagcagtaacttatctgaaatttagaggtgttttgggggtggggcgagggtttctgtagtagactcagattttacatggccctgagctgcccttgcgttcagttggaagccacgcaaaatgaactgaaccaggagtgagcttcgtgtacattatctattagaaaatgaagtaccttctggttcagctagtccctgtgcgttgagaggctttaagaaacttctagtaaaaatgtttttttcttttagctttgaattggccagagtttatcctagattattttattttaaattggtagaattctttgcgaactgtcacagagaaattccttttcatgactttatttctgacctattaaaacatgaacaggccaggcatggtggctcacgcctgtaatcctagcacttgggaggcagtggcaggcggatcacttgagctcaggagtcctaaaccagcctgggcaacatagtgataccttgtctctaccaaaagttaaaaaaaaaaaaaaaaaagctcaagaacctgcacgagggcctaaaacagtgggctcagctttggctgtgcattggaatcacctggggagatttgtaagcttctgctgtctgggctgaacccccagaggttcggattgaattggtgtggggtgtggtccaggcatcgagatgtgtaaagacctccccaggtgatgatatgcagtccgaggttgagactgccctgtcctgcaaggtcgttggccagaggtagaggaaactggtcaaagtggctgttgggcttgtcaagcccgtggctgaatgacagtgagctctcttgctgggagggttccttttcctgttgttgaatggtcctggcctgcaggatgggaggccagatgccttcaggagctggtggatccagctgttctcaccagcctggaggttagcagaccagagtgggtgggcaggaccttggcctggtgcccctggaatcagtgggtggcatgtgttgggatatactggctacaggctcatctcaaagagcaggtagaacagagtcagcagggaactgacaggtggggctgtccccctgaaagcagccgcagaaacagctgccacctatttgcatagctgagcaggaggacatactgtctttgtgggttttgcttctggtctgtttcctgactgggttgataaagggagtcccagctcgttccctgttagccaaaccagcatcctgctcacacaccggacactccaggtgctagtccactggtgctggtgttcaggggagttgggggggggggcgcggggacagaagcgcgggttcttggttccaatgagggacttagcagaagcctccaggggccagcagggccaggtgaaacttgggagaaatgaagccctctgtgtcctgtgtgtgtggtggggtttaatgcattagcaaatttaaacttaaaaactaactctaggccgggcacggtggctcacacctgtaatcccagcactttgggaggccaaggcaggtggattgcctgagctcaggagttcgagaccagcctggacaacatggtgaaactcttgtctttatttttttaaaaaaacaaaaagtaactttcgatgtgatcataccaggaaagttttgcgtggtcaccatgccaagaaaatgactttggttgcccagcagatccacagcgactctttctcaagggctactgtggattctagattgaggaaaggggccacttaggactcagtgctggtatcctccacagtcctttctcccagactctggccctccctttgggacccaggaaatcccctctagggtgacgctgctggctaggaagactgaggtctgctgcgccaaggggcctcaagttagaagggccatgccgtcagtggatgactttgagcgctgatcctagggacctgccaggtcctcacttcctgccctgggtgcacacatgaatggggcagccagcaggaagcgggagaggctggaaccaggagcctgccctacctgcatggcaggacaactctgaggcccttctgccatattctctgctacccaccagagaaaataggctgccttctagaaagatttgtttctaaaagcgtagaccctggggaagtataatgtcaccatgctcaccaggcgaggtttcccatatgacctccctgccccgacctcgtcaggttgctcctttccccatctgtaaggtagagatgtctgccccggagctaccagctggggatggcatccaggccatgtctcctgcaggatccaagtgctgttgtccccagggtgaccctgcctcctgctggggcccatccgctttgctgtgctgcacaggctgttttcatctgcatggtttggggtctttgtccttgtgccttttcttccccatcgccactgtacaggattttccacattgcccactgcctccttttctacatcgtctcatctccctggcctttcccgagccctgtaaatgtgtactttttcaacgtgcctcccccaggtgaggccagctctcccgggcacattcgtccacaaggatcaggccccacttacccttggctcgctcagcctgtagacttggtaactttgtacagaatctttcattattgtcttaagcatggggggctaggacccacttagtccctcctccagcctgcagctaatttaggagccttgcattccagaaaagggcaactttgtgtaaagcagcttctcccacagagctttccctgcattgttagtgatgtcgggcaaagcatcactctttaacctggggcattggccccagcagggatatcatgggaccgcagccgctccgtgcactgtctctgcccccagaggaagccctgtccatggttcctggtgcacggccacaggcctgccttgaggccaccacatctggtgtctagaacagctgcgggccccacttgggcagaaggaagaggtgctagctgctgcccctgcctgctgtgaacacctgcccagcccttccttgtctgctgaggtgctcagaccagagtgccattaaataccaactgatgtcacggagcggacggtgcattgccaaggactcacagctgtgggctcccttccagctcctcccactttcttggctgggtcttctgaggcctacgtggaatgaactacacatgtggcctcatgcccaagggtttgttagatggcctctgactctgtgggattcaacttgacttttttgccccaggaggctctgtctggaaacaggcttagctttagtgctggggtgggacctgccctgtgggccccagggaggggacagtgggggtgaggccctgaggctgtccagggtctgagctctttgcctccaacctgcttctgccccaaaaggaacaggctgttggtggcaggctcctcccggggagctgtactgtacagaccaaggtgtaaataaacagtttgctcttctaaaaaaaaaa

SEQ ID NO: 329490 - DNA, 2853 bp, Homo sapiens
cccccgagtcccggggcccaggcgcctcgtgatgtcaccgcagcttgatacaaagagcccttcggcccacgcgggtctcccggcaacgggcgggggcggggccgcgccttccactggtgcccagaagtgcgagcggcagcggcgcggccgcgattgttcctgcgcttcggggctgcccgccgcgtccccgcgcgccgccgacccgcgcccgctggcttccgcgcctctgccggggagcggcccgcggatgcgcaccccgccagctctcgggagccagggcagcgaggtcacaggccccacctttgctgatggcgagctcatccccagggaacccggcttttttcccgaggacgaggaggaggctatgacgctggcgccacctgagggcccccaggagttgtacacagacagccccatggagagcactcagagcctggaggggtctgtcgggagtcctgccgagaaggacgggggacttgggggcctgtttctgccagaagacaagtccctggtccacactccatccatgacgacctcagacctttctacacactccaccacctcgctcatcagcaatgaggagcagtttgaagactatggggagggtgacgatgtggactgtgcccccagcagcccttgccccgatgatgagaccaggaccaacgtctactcggacctggggtcttcggtgtcttccagtgcggggcagacgcctaggaaaatgcggcacgtgtacaacagcgaattgctagatgtttactgctctcaatgctgcaagaaaatcaacctgctcaatgacttggaagcccgactgaaaaacctgaaggccaacagccccaaccgaaagatctccagcacggcctttggacggcagctcatgcacagcagcaacttcagcagcagcaatggcagcaccgaagacctgttccgggacagcattgactcttgcgacaatgacatcacagagaaggtaagcttcctggaaaagaaggtgacagagctggagaatgacagcctgaccaatggggacctgaagagcaagctgaagcaagagaacacacagctggtgcacagggtgcatgagctggaggagatggtgaaggatcaggagaccacggccgagcaggctctggaggaggaggcgcggcgccaccgcgaggcctacggcaagctggagagggagaaggctaccgaggtggagctgctcaatgccagggtgcagcagttggaggaagaaaatacagagcttagaacaacagtgactcggctcaagtctcaaacagagaaactggatgaggagcggcagcgcatgtctgaccgtctggaggacaccagcctgcggctcaaagatgagatggacctgtacaagcgcatgatggacaagctgcgacagaaccgccttgagttccagaaggagcgggaggcgacgcaggagctcatcgaggacttgcggaaggagctggagcacctgcagatgtacaagctggactgcgagcggccaggcaggggccgcagtgcctcctctggcctaggcgagttcaatgccagggcccgcgaggtggagctcgagcacgaggtcaagcggctcaagcaggagaattataagctgcgggatcagaacgacgacttgaatgggcagattttgagcctcagcctctacgaagcaaaaaacctctttgctgcccagactaaagcccagtctctggctgcggagatagacaccgcctcgcgcgatgagctaatggaagccctgaaggagcaggaggagatcaacttccggctgaggcagtacatggacaagattatcctcgccatcctggaccacaatccctccatcctcgagatcaaacactaaggcacggggctggctgcagagcagccttaggaccctgggaccaagggcagaccctgcccaaggatgcaggcctaagccgggcctcacactcacactgtaaatgtctctctggccaccatgcgttacgtgtacccgtgtatatgtggggaggctgtgcacacgagcgaggggtgagtggccgtggctgtgggcagcatccacacggttagccgtgcatgcactttgtggcccctttgcaaggggcagagggtactggaagtgggaggaggcaaggtctgctatcaggagttactgtaaaaacaagaactggaagctcgtgtttccggtactgggtaaaatgattctacctctggggataaggattcacattcgctctagtacgatgggctctttcaccccactcctagtccccttgggagtgggagcaaaattgtgatctttcctaggagtttgaatgccccatatttgtgtcctcgccagctctttggccacctttcaagccccagtgttcaagctcagagaggatgaaggggcatctggagggtccatgagatggggccctcaccaaatgccttggccaccggccagcagccctctgtgatgtgtgtgcagagtgaacagaggactcaggtttcatagcagctagtgcggggcatcctcatcctgtacctatagagttcgtgcactcccccatccatgctacctacctccccgtttctgtttcagttttaagacaatgaagcagcattcactgcgtcattgtaacatgaagggataaaaatgaaggagaaggagggtttgggatgggtgtctaaggcaggagttgacatcgggcaaccaaagaaatgagttttggggaggaacacaactcccatcccagtcagtttccttcccatggctgcatcttaagatggatgcacggagaaaccgtctgcctggctccctgccatcaccaggctgcgtggagaatgaagacgtcgagcgccgcaaatttagta

SEQ ID NO: 329491 - DNA, 2036 bp, Homo sapiens
  misc_feature (1849)..(1849): n is a, c, g, or t
gcggccgcgaccccgacggcttcctgcgcgtggagcgcgtcgcggcgctcggactgcgcttcggccagggcgaggaggtggaaaaacttgtgaaatatttggatcccaacgacctggggagaatcaacttcaaggacttttgccggggggtgttcgccatgaaagggtgcgaggagctgctgaaggatgtgctgtcggtggagagcgcggggacgctgccgtgcgcgccagagatcccagactgcgtggagcagagaccgggtctagctatgttgcccaggatggtctcaaactcctggcctcaagcaagtctcccagctgggcctcccaaggcactgggactacagtcatgagcaacctctcctagccctgttttcttgtaataaagtaaatgcagtgttcattttagtaacaaaacaggtcttcactgggagggagaaatgaggaaatttgaccccgcgtggctgaggcctggaatgagctccatgggcaggctccaggaatgatgtaattttgcctcctctcaaggctggcctcaaggaggcctgattccagccctctttgtctggggctgccctgaacctgtaagaatccttctgaccagatcctccagacactgcaaattctcacccaggttgctcagaatcctggaaagagctcaggtttgagtcaaacgggctgagtgtgggttctgcttgaccactttctgtgtgtcatttggcaagtcgcttcacctctctgagcctttttcatttctgcctatctaaaatcagagtcgtcagcctgattttcagtgttgtggtgagaatgcaatggattaatgtttctaaaggttcctgaggagacaggtcccccagtcagtagtacctatgcctgcattctctgtaccactcagaaccctcaggggaatcattcaggacacaggggacagaattccctccccttcccattcccaaagtcaccagcctgcctccacctgcacccacactttcagcttgctgctgggatggtgagtggcatgaccctgctctgacacaggccatgccctccaatcccagctcctcacccgcacaccgcctgaacactggatcccagcccctcctgccaactcaagcactcgccttcacaaacagcccctcacccacagcacccgcaccacgcccctgctgggtcctttccattcgcttctggagctgacataataatgcccttcccatgggcagggaagcacccgcttgaccacacatcctggctttctttcctttggtctatttcctccaaagactggtctcaactccctttcttgcctccctttctctctgttgccactcccaatgatgtcttggcccctctgttctgctgaaacacttctcacagtcaccagggacttctttttgagacaggggtctcactctgtcacccaggctggagtgcagtggtgcagtcctgactcactgcagcctccaacacctgggttcaagcaatcctcccacctcagtctcccaggtagctgggaccacaggcatctgccatcatccccagctatttttattttttgtagagatgggggtcttgttctgttccccaggctggagtgcagtagtgcagtcctagtttgctgcagcctcaaactcctggcctcaagcaatcctccaatctcagacccccaaagtgctggtatggcaggcatgagccaccttgcctggccaccaggaacttctcactggccaaatccaagcatcagttctctagtcacatttttacatagtgatggtgtgtggtgaatagatcagggtaattagcatatccaccatctccggcatttatcatttcttcattttgggaacantcgatagtctcctagctactgaaaactctgtattattgttaatgatagtcatcttacagtgatgtagaacaatggaacttatccctcctctagaactgtaactctgtacttttaacaaacgtctccctactctccttcccctgccattctcagcctctagtgtcctctgctccattcacattttact

SEQ ID NO: 329492 - DNA, 1538 bp, Homo sapiens
cccccgagtcccggggcccaggcgcctcgtgatgtcaccgcagcttgatacaaagagcccttcggcccacgcgggtctcccggcaacgggcgggggcggggccgcgccttccactggtgcccagaagtgcgagcggcagcggcgcggccgcgattgttcctgcgcttcggggctgcccgccgcgtccccgcgcgccgccgacccgcgcccgctggcttccgcgcctctgccggggagcggcccgcggatgcgcaccccgccagctctcgggagccagggcagcgaggtcacaggccccacctttgctgatggcgagctcatccccagggaacccggcttttttcccgaggacgaggaggaggctatgacgctggcgccacctgagggcccccaggagttgtacacagacagccccatggagagcactcagagcctggaggggtctgtcgggagtcctgccgagaaggacgggggacttgggggcctgtttctgccagaagacaagtccctggtccacactccatccatgacgacctcagacctttctacacactccaccacctcgctcatcagcaatgaggagcagtttgaagactatggggagggtgacgatgtggactgtgcccccagcagcccttgccccgatgatgagaccaggaccaacgtctactcggacctggggtcttcggtgtcttccagtgcggggcagacgcctaggaaaatgcggcacgtgtacaacagcgaattgctagatgtttactgctctcaatgctgcaagaaaatcaacctgctcaatgacttggaagcccgactgaaaaacctgaaggccaacagccccaaccgaaagatctccagcacggcctttggacggcagctcatgcacagcagcaacttcagcagcagcaatggcagcaccgaagacctgttccgggacagcattgactcttgcgacaatgacatcacagagaaggtaagcttcctggaaaagaaggtgacagagctggagaatgacagcctgaccaatggggacctgaagagcaagctgaagcaagagaacacacagctggtgcacagggtgcatgagctggaggagatggtgaaggatcaggagaccacggccgagcaggctctggaggaggaggcgcggcgccaccgcgaggcctacggcaagctggagagggagaaggctaccgaggtggagctgctcaatgccagggtgcagcagttggaggaagaaaatacagagcttagaacaacagtgactcggctcaagtctcaaacagagaaactggatgaggagcggcagcgcatgtctgaccgtctggaggacaccagcctgcggctcaaagatgagatggacctgtacaagcgcatgatgggagcaagactgggcatcttcgtcccatcaggctctcctttaagggtaagaataagccctttcaccttccctgtgttttcaacttgcagcagattctccgtgttcactttcaggttctccagagacgacctgttgtaaacgtcactgatgggagcagaca

SEQ ID NO: 329493 - DNA, 6737 bp, Homo sapiens
aagcttggcacgaggcgagcacgaggtcaagcggctcaagcaggagaattataagctgcgggatcagaacgacgacttgaatgggcagattttgagcctcagcctctacgaagcaaaaaacctctttgctgcccagactaaagcccagtctctggctgcggagatagacaccgcctcgcgcgatgagctaatggaagccctgaaggagcaggaggagatcaacttccggctgaggcagtacatggacaagattatcctcgccatcctggaccacaatccctccatcctcgagatcaaacactaaggcacggggctggctgcagagcagccttaggaccctgggaccaagggcagaccctgcccaaggatgcaggcctaagccgggcctcacactcacactgtaaatgtctctctggccaccatgcgttacgtgtacccgtgtatatgtggggaggctgtgcacacgagcgaggggtgagtggccgtggctgtgggcagcatccacacggttagccgtgcatgcactttgtggcccctttgcaaggggcagagggtactggaagtgggaggaggcaaggtctgctatcaggagttactctggggataaggattcacattcgctctagtacgatgggctctttcaccccactcctagtccccttgggagtgggagcaaaattgtgatctttcctaggagtttgaatgccccatatttgtgtcctcgccagctctttggccacctttcaagccccagtgttcaagctcagagaggatgaaggggcatctggagggtccatgagatggggccctcaccaaatgccttggccaccggccagcagccctctgtgatgtgtgtgcagagtgaacagaggactcaggtttcatagcagctagtgcggggcatcctcatcctgtacctatagagttcgtgcactcccccatccatgctacctacctccccgtttctgtttcagttttaagacaatgaagcagcattcactgcgtcattgtaacatgaagggataaaaatgaaggagaaggagggtttgggatgggtgtctaaggcaggagttgacatcgggcaaccaaagaaatgagttttggggaggaacacaactcccatcccagtcagtttccttcccatggctgcatcttaagatggatgcacggagaaaccgtctgcctggctccctgtcttcattctccacgcagcctggtgatggcaggcctgggtttggatttcagaatcctagctccgggctccactcgtgtggcagcaagactgcttcgttccagcgtttagaaacacacctgtatttgattctcagccaggggagcactcgctgcactggtgggaggcggttgggaaagttgcaggaaaaccttagtcttccatccttctgacccatggtggaaattcacaccatggatttttaatggatctttgttctaggcagctgggaatagacatggtacttaccttagagttttccaatttatctcaattttatatggcttgtgattcattttcttaatccaaatatatataaacgtgtgtggtcttattcttccccctgcagtttcttgctttcttcagcacatcttatagtatgagaaggaaggtttgggcatgttgggaagggcggtggagggggagttgcagaaagagagggcagtgagggtgaggagaggggatctggggacttgggtgtgacacctgcttgacagaggcagggctgtggccaggaccaaccttcaattccattccaatcagcctttgcatttgttggatctcgtggcttctttttaatcttttgttggggattagtttcatgctgcacataatggggttgcactggtctgacccaggactttggagccacccacactgggaagactaggctaggcagtcggtcttctaggagtttctcagccccttaggacgcgggtctccttgggctcccccaagggttctgcgaagaggcagtggaagaaggcatgaggagagggtctcttgagaatttgccaataggaaggagtggccacggctgaaaggaacaagacagatcctgacatagctttggcctgggtgttaggtcagaaggagtactggtgcgtgggggccttaccccagggttgagtattttatatgtaaaatgttatctgccctttggctgcattggaatttcagagaaggctgcagaggcctgggttacacagcctgagtcacaacgtgggaaggaatctctgccacgggaaaggtgggcggaagcagctggcagcctggggcgtgcttcaggctcctccctctaaggggcgccatgggaacaggctccggagggagccggcgtctgaaaggcccccgggacctgctgcagtgccagaggggcctctggagcaggcctggcttttaaatggggggctgaattccagctcacacacacctcaagtccaaccttactttcttcagccagaatacatttcttgtaaaacctggcttgttgcttggcttttaaagatggtgtatgtttgtaaaaatattcttctgggctcaaaagctagcttgagggggcagatgccccaggtgtcccagctccacagcccctggcagatcccagaccccttggtggcaggtcccagagcctaggtggtaggagcttgatctttgtttctgcccttacccctcagtagtggggctgcgaggtagtagacaggatgcccagttaagtttgaatttcagatagaaaataattttagaataaatatgttctatctaatacatgggacagatgttatttttagagataggatcttgctctgttgcccaggctggagtgtagtggtatgatcatagctcaccacaaccttgaactcccaggctcaagcgatcctcccgccttaactgcctgagtagctgggactacaggcatgcaccaccacgcccagctaatttttcttattttttgtagagacagggtctcactgtgttgcctcactcgagctgctgacctcaagtgatcctcccacctcagcctgccaaagcactgggattacaggcatgagccaccatgcctggccaggacatatttgaaatggggagattttaaaaattctgatgattagactgaatcctcagacgttctggtttgattgttgtgggtgtagcccaggcatgggattttttaaagagctgctcaggtaattccaatttaattgcgtgtcctacttgggttttttgtttgtttttattgtttttgctaaacctggcaaccctaccgagtagggattagcagtaacttatctgaaatttagaggtgttttgggggtggggcgagggtttctgtagtagactcagattttacatggccctgagctgcccttgcgttcagttggaagccacgcaaaatgaactgaaccaggagtgagcttcgtgtacattatctattagaaaatgaagtaccttctggttcagctagtccctgtgcgttgagaggctttaagaaacttctagtaaaaatgtttttttcttttagctttgaattggccagagtttatcctagattattttattttaaattggtagaattctttgcgaactgtcacagagaaattccttttcatgactttatttctgacctattaaaacatgaacaggccaggcatggtggctcacgcctgtaatcctagcacttgggaggcagtggcaggcggatcacttgagctcaggagtcctaaaccagcctgggcaacatagtgataccttgtctctaccaaaagttaaaaaaaaaaaaaaaaaagctcaagaacctgcacgagggcctaaaacagtgggctcagctttggctgtgcattggaatcacctggggagatttgtaagcttctgctgtctgggctgaacccccagaggttcggattgaattggtgtggggtgtggtccaggcatcgagatgtgtaaagacctccccaggtgatgatatgcagtccgaggttgagactgccctgtcctgcaaggtcgttggccagaggtagaggaaactggtcaaagtggctgttgggcttgtcaagcccgtggctgaatgacagtgagctctcttgctgggagggttccttttcctgttgttgaatggtcctggcctgcaggatgggaggccagatgccttcaggagctggtggatccagctgttctcaccagcctggaggttagcagaccagagtgggtgggcaggaccttggcctggtgcccctggaatcagtgggtggcatgtgttgggatatactggctacaggctcatctcaaagagcaggtagaacagagtcagcagggaactgacaggtggggctgtccccctgaaagcagccgcagaaacagctgccacctatttgcatagctgagcaggaggacatactgtctttgtgggttttgcttctggtctgtttcctgactgggttgataaagggagtcccagctcgttccctgttagccaaaccagcatcctgctcacacaccggacactccaggtgctagtccactggtgctggtgttcaggggagttgggggggggggcgcggggacagaagcgcgggttcttggttccaatgagggacttagcagaagcctccaggggccagcagggccaggtgaaacttgggagaaatgaagccctctgtgtcctgtgtgtgtggtggggtttaatgcattagcaaatttaaacttaaaaactaactctaggccgggcacggtggctcacacctgtaatcccagcactttgggaggccaaggcaggtggattgcctgagctcaggagttcgagaccagcctggacaacatggtgaaactcttgtctttatttttttaaaaaaacaaaaagtaactttcgatgtgatcataccaggaaagttttgcgtggtcaccatgccaagaaaatgactttggttgcccagcagatccacagcgactctttctcaagggctactgtggattctagattgaggaaaggggccacttaggactcagtgctggtatcctccacagtcctttctcccagactctggccctccctttgggacccaggaaatcccctctagggtgacgctgctggctaggaagactgaggtctgctgcgccaaggggcctcaagttagaagggccatgccgtcagtggatgactttgagcgctgatcctagggacctgccaggtcctcacttcctgccctgggtgcacacatgaatggggcagccagcaggaagcgggagaggctggaaccaggagcctgccctacctgcatggcaggacaactctgaggcccttctgccatattctctgctacccaccagagaaaataggctgccttctagaaagatttgtttctaaaagcgtagaccctggggaagtataatgtcaccatgctcaccaggcgaggtttcccatatgacctccctgccccgacctcgtcaggttgctcctttccccatctgtaaggtagagatgtctgccccggagctaccagctggggatggcatccaggccatgtctcctgcaggatccaagtgctgttgtccccagggtgaccctgcctcctgctggggcccatccgctttgctgtgctgcacaggctgttttcatctgcatggtttggggtctttgtccttgtgccttttcttccccatcgccactgtacaggattttccacattgcccactgcctccttttctacatcgtctcatctccctggcctttcccgagccctgtaaatgtgtactttttcaacgtgcctcccccaggtgaggccagctctcccgggcacattcgtccacaaggatcaggccccacttacccttggctcgctcagcctgtagacttggtaactttgtacagaatctttcattattgtcttaagcatggggggctaggacccacttagtccctcctccagcctgcagctaatttaggagccttgcattccagaaaagggcaactttgtgtaaagcagcttctcccacagagctttccctgcattgttagtgatgtcgggcaaagcatcactctttaacctggggcattggccccagcagggatatcatgggaccgcagccgctccgtgcactgtctctgcccccagaggaagccctgtccatggttcctggtgcacggccacaggcctgccttgaggccaccacatctggtgtctagaacagctgcgggccccacttgggcagaaggaagaggtgctagctgctgcccctgcctgctgtgaacacctgcccagcccttccttgtctgctgaggtgctcagaccagagtgccattaaataccaactgatgtcacggagcggacggtgcattgccaaggactcacagctgtgggctcccttccagctcctcccactttcttggctgggtcttctgaggcctacgtggaatgaactacacatgtggcctcatgcccaagggtttgttagatggcctctgactctgtgggattcaacttgacttttttgccccaggaggctctgtctggaaacaggcttagctttagtgctggggtgggacctgccctgtgggccccagggaggggacagtgggggtgaggccctgaggctgtccagggtctgagctctttgcctccaacctgcttctgccccaaaaggaacaggctgttggtggcaggctcctcccggggagctgtactgtacagaccaaggtgtaaataaacagtttgctcttctaaaaaaaaaa

SEQ ID NO: 329494 - DNA, 8273 bp, Homo sapiens
cccccgagtcccggggcccaggcgcctcgtgatgtcaccgcagcttgatacaaagagcccttcggcccacgcgggtctcccggcaacgggcgggggcggggccgcgccttccactggtgcccagaagtgcgagcggcagcggcgcggccgcgattgttcctgcgcttcggggctgcccgccgcgtccccgcgcgccgccgacccgcgcccgctggcttccgcgcctctgccggggagcggcccgcggatgcgcaccccgccagctctcgggagccagggcagcgaggtcacaggccccacctttgctgatggcgagctcatccccagggaacccggcttttttcccgaggacgaggaggaggctatgacgctggcgccacctgagggcccccaggagttgtacacagacagccccatggagagcactcagagcctggaggggtctgtcgggagtcctgccgagaaggacgggggacttgggggcctgtttctgccagaagacaagtccctggtccacactccatccatgacgacctcagacctttctacacactccaccacctcgctcatcagcaatgaggagcagtttgaagactatggggagggtgacgatgtggactgtgcccccagcagcccttgccccgatgatgagaccaggaccaacgtctactcggacctggggtcttcggtgtcttccagtgcggggcagacgcctaggaaaatgcggcacgtgtacaacagcgaattgctagatgtttactgctctcaatgctgcaagaaaatcaacctgctcaatgacttggaagcccgactgaaaaacctgaaggccaacagccccaaccgaaagatctccagcacggcctttggacggcagctcatgcacagcagcaacttcagcagcagcaatggcagcaccgaagacctgttccgggacagcattgactcttgcgacaatgacatcacagagaaggtaagcttcctggaaaagaaggtgacagagctggagaatgacagcctgaccaatggggacctgaagagcaagctgaagcaagagaacacacagctggtgcacagggtgcatgagctggaggagatggtgaaggatcaggagaccacggccgagcaggctctggaggaggaggcgcggcgccaccgcgaggcctacggcaagctggagagggagaaggctaccgaggtggagctgctcaatgccagggtgcagcagttggaggaagaaaatacagagcttagaacaacagtgactcggctcaagtctcaaacagagaaactggatgaggagcggcagcgcatgtctgaccgtctggaggacaccagcctgcggctcaaagatgagatggacctgtacaagcgcatgatggacaagctgcgacagaaccgccttgagttccagaaggagcgggaggcgacgcaggagctcatcgaggacttgcggaaggagctggagcacctgcagatgtacaagctggactgcgagcggccaggcaggggccgcagtgcctcctctggcctaggcgagttcaatgccagggcccgcgaggtggagctcgagcacgaggtcaagcggctcaagcaggagaattataagctgcgggatcagaacgacgacttgaatgggcagattttgagcctcagcctctacgaagcaactaatggaagccctgaaggagcaggaggagatcaacttccggctgaggcagtacatggacaagattatcctcgccatcctggaccacaatccctccatcctcgagatcaaacactaaggcacggggctggctgcagagcagccttaggaccctgggaccaagggcagaccctgcccaaggatgcaggcctaagccgggcctcacactcacactgtaaatgtctctctggccaccatgcgttacgtgtacccgtgtatatgtggggaggctgtgcacacgagcgaggggtgagtggccgtggctgtgggcagcatccacacggttagccgtgcatgcactttgtggcccctttgcaaggggcagagggtactggaagtgggaggaggcaaggtctgctatcaggagttactgtaaaaacaagaactggaagctcgtgtttccggtactgggtaaaatgattctacctctggggataaggattcacattcgctctagtacgatgggctctttcaccccactcctagtccccttgggagtgggagcaaaattgtgatctttcctaggagtttgaatgccccatatttgtgtcctcgccagctctttggccacctttcaagccccagtgttcaagctcagagaggatgaaggggcatctggagggtccatgagatggggccctcaccaaatgccttggccaccggccagcagccctctgtgatgtgtgtgcagagtgaacagaggactcaggtttcatagcagctagtgcggggcatcctcatcctgtacctatagagttcgtgcactcccccatccatgctacctacctccccgtttctgtttcagttttaagacaatgaagcagcattcactgcgtcattgtaacatgaagggataaaaatgaaggagaaggagggtttgggatgggtgtctaaggcaggagttgacatcgggcaaccaaagaaatgagttttggggaggaacacaactcccatcccagtcagtttccttcccatggctgcatcttaagatggatgcacggagaaaccgtctgcctggctccctgtcttcattctccacgcagcctggtgatggcaggcctgggtttggatttcagaatcctagctccgggctccactcgtgtggcagcaagactgcttcgttccagcgtttagaaacacacctgtatttgattctcagccaggggagcactcgctgcactggtgggaggcggttgggaaagttgcaggaaaaccttagtcttccatccttctgacccatggtggaaattcacaccatggatttttaatggatctttgttctaggcagctgggaatagacatggtacttaccttagagttttccaatttatctcaattttatatggcttgtgattcattttcttaatccaaatatatataaacgtgtgtggtcttattcttccccctgcagtttcttgctttcttcagcacatcttatagtatgagaaggaaggtttgggcatgttgggaagggcggtggagggggagttgcagaaagagagggcagtgagggtgaggagaggggatctggggacttgggtgtgacacctgcttgacagaggcagggctgtggccaggaccaaccttcaattccattccaatcagcctttgcatttgttggatctcgtggcttctttttaatcttttgttggggattagtttcatgctgcacataatggggttgcactggtctgacccaggactttggagccacccacactgggaagactaggctaggcagtcggtcttctaggagtttctcagccccttaggacgcgggtctccttgggctcccccaagggttctgcgaagaggcagtggaagaaggcatgaggagagggtctcttgagaatttgccaataggaaggagtggccacggctgaaaggaacaagacagatcctgacatagctttggcctgggtgttaggtcagaaggagtactggtgcgtgggggccttaccccagggttgagtattttatatgtaaaatgttatctgccctttggctgcattggaatttcagagaaggctgcagaggcctgggttacacagcctgagtcacaacgtgggaaggaatctctgccacgggaaaggtgggcggaagcagctggcagcctggggcgtgcttcaggctcctccctctaaggggcgccatgggaacaggctccggagggagccggcgtctgaaaggcccccgggacctgctgcagtgccagaggggcctctggagcaggcctggcttttaaatggggggctgaattccagctcacacacacctcaagtccaaccttactttcttcagccagaatacatttcttgtaaaacctggcttgttgcttggcttttaaagatggtgtatgtttgtaaaaatattcttctgggctcaaaagctagcttgagggggcagatgccccaggtgtcccagctccacagcccctggcagatcccagaccccttggtggcaggtcccagagcctaggtggtaggagcttgatctttgtttctgcccttacccctcagtagtggggctgcgaggtagtagacaggatgcccagttaagtttgaatttcagatagaaaataattttagaataaatatgttctatctaatacatgggacagatgttatttttagagataggatcttgctctgttgcccaggctggagtgtagtggtatgatcatagctcaccacaaccttgaactcccaggctcaagcgatcctcccgccttaactgcctgagtagctgggactacaggcatgcaccaccacgcccagctaatttttcttattttttgtagagacagggtctcactgtgttgcctcactcgagctgctgacctcaagtgatcctcccacctcagcctgccaaagcactgggattacaggcatgagccaccatgcctggccaggacatatttgaaatggggagattttaaaaattctgatgattagactgaatcctcagacgttctggtttgattgttgtgggtgtagcccaggcatgggattttttaaagagctgctcaggtaattccaatttaattgcgtgtcctacttgggttttttgtttgtttttattgtttttgctaaacctggcaaccctaccgagtagggattagcagtaacttatctgaaatttagaggtgttttgggggtggggcgagggtttctgtagtagactcagattttacatggccctgagctgcccttgcgttcagttggaagccacgcaaaatgaactgaaccaggagtgagcttcgtgtacattatctattagaaaatgaagtaccttctggttcagctagtccctgtgcgttgagaggctttaagaaacttctagtaaaaatgtttttttcttttagctttgaattggccagagtttatcctagattattttattttaaattggtagaattctttgcgaactgtcacagagaaattccttttcatgactttatttctgacctattaaaacatgaacaggccaggcatggtggctcacgcctgtaatcctagcacttgggaggcagtggcaggcggatcacttgagctcaggagtcctaaaccagcctgggcaacatagtgataccttgtctctaccaaaagttaaaaaaaaaaaaaaaaaagctcaagaacctgcacgagggcctaaaacagtgggctcagctttggctgtgcattggaatcacctggggagatttgtaagcttctgctgtctgggctgaacccccagaggttcggattgaattggtgtggggtgtggtccaggcatcgagatgtgtaaagacctccccaggtgatgatatgcagtccgaggttgagactgccctgtcctgcaaggtcgttggccagaggtagaggaaactggtcaaagtggctgttgggcttgtcaagcccgtggctgaatgacagtgagctctcttgctgggagggttccttttcctgttgttgaatggtcctggcctgcaggatgggaggccagatgccttcaggagctggtggatccagctgttctcaccagcctggaggttagcagaccagagtgggtgggcaggaccttggcctggtgcccctggaatcagtgggtggcatgtgttgggatatactggctacaggctcatctcaaagagcaggtagaacagagtcagcagggaactgacaggtggggctgtccccctgaaagcagccgcagaaacagctgccacctatttgcatagctgagcaggaggacatactgtctttgtgggttttgcttctggtctgtttcctgactgggttgataaagggagtcccagctcgttccctgttagccaaaccagcatcctgctcacacaccggacactccaggtgctagtccactggtgctggtgttcaggggagttgggggggggggcgcggggacagaagcgcgggttcttggttccaatgagggacttagcagaagcctccaggggccagcagggccaggtgaaacttgggagaaatgaagccctctgtgtcctgtgtgtgtggtggggtttaatgcattagcaaatttaaacttaaaaactaactctaggccgggcacggtggctcacacctgtaatcccagcactttgggaggccaaggcaggtggattgcctgagctcaggagttcgagaccagcctggacaacatggtgaaactcttgtctttatttttttaaaaaaacaaaaagtaactttcgatgtgatcataccaggaaagttttgcgtggtcaccatgccaagaaaatgactttggttgcccagcagatccacagcgactctttctcaagggctactgtggattctagattgaggaaaggggccacttaggactcagtgctggtatcctccacagtcctttctcccagactctggccctccctttgggacccaggaaatcccctctagggtgacgctgctggctaggaagactgaggtctgctgcgccaaggggcctcaagttagaagggccatgccgtcagtggatgactttgagcgctgatcctagggacctgccaggtcctcacttcctgccctgggtgcacacatgaatggggcagccagcaggaagcgggagaggctggaaccaggagcctgccctacctgcatggcaggacaactctgaggcccttctgccatattctctgctacccaccagagaaaataggctgccttctagaaagatttgtttctaaaagcgtagaccctggggaagtataatgtcaccatgctcaccaggcgaggtttcccatatgacctccctgccccgacctcgtcaggttgctcctttccccatctgtaaggtagagatgtctgccccggagctaccagctggggatggcatccaggccatgtctcctgcaggatccaagtgctgttgtccccagggtgaccctgcctcctgctggggcccatccgctttgctgtgctgcacaggctgttttcatctgcatggtttggggtctttgtccttgtgccttttcttccccatcgccactgtacaggattttccacattgcccactgcctccttttctacatcgtctcatctccctggcctttcccgagccctgtaaatgtgtactttttcaacgtgcctcccccaggtgaggccagctctcccgggcacattcgtccacaaggatcaggccccacttacccttggctcgctcagcctgtagacttggtaactttgtacagaatctttcattattgtcttaagcatggggggctaggacccacttagtccctcctccagcctgcagctaatttaggagccttgcattccagaaaagggcaactttgtgtaaagcagcttctcccacagagctttccctgcattgttagtgatgtcgggcaaagcatcactctttaacctggggcattggccccagcagggatatcatgggaccgcagccgctccgtgcactgtctctgcccccagaggaagccctgtccatggttcctggtgcacggccacaggcctgccttgaggccaccacatctggtgtctagaacagctgcgggccccacttgggcagaaggaagaggtgctagctgctgcccctgcctgctgtgaacacctgcccagcccttccttgtctgctgaggtgctcagaccagagtgccattaaataccaactgatgtcacggagcggacggtgcattgccaaggactcacagctgtgggctcccttccagctcctcccactttcttggctgggtcttctgaggcctacgtggaatgaactacacatgtggcctcatgcccaagggtttgttagatggcctctgactctgtgggattcaacttgacttttttgccccaggaggctctgtctggaaacaggcttagctttagtgctggggtgggacctgccctgtgggccccagggaggggacagtgggggtgaggccctgaggctgtccagggtctgagctctttgcctccaacctgcttctgccccaaaaggaacaggctgttggtggcaggctcctcccggggagctgtactgtacagaccaaggtgtaaataaacagtttgctcttctaaaaaaaaaa

SEQ ID NO: 329495 - DNA, 8321 bp, Homo sapiens
gcggccgcgaccccgacggcttcctgcgcgtggagcgcgtcgcggcgctcggactgcgcttcggccagggcgaggaggtggaaaaacttgtgaaatatttggatcccaacgacctggggagaatcaacttcaaggacttttgccggggggtgttcgccatgaaagggtgcgaggagctgctgaaggatgtgctgtcggtggagagcgcggggacgctgccgtgcgcgccagagatcccagactgcgtggagcagggcagcgaggtcacaggccccacctttgctgatggcgagctcatccccagggaacccggcttttttcccgaggacgaggaggaggctatgacgctggcgccacctgagggcccccaggagttgtacacagacagccccatggagagcactcagagcctggaggggtctgtcgggagtcctgccgagaaggacgggggacttgggggcctgtttctgccagaagacaagtccctggtccacactccatccatgacgacctcagacctttctacacactccaccacctcgctcatcagcaatgaggagcagtttgaagactatggggagggtgacgatgtggactgtgcccccagcagcccttgccccgatgatgagaccaggaccaacgtctactcggacctggggtcttcggtgtcttccagtgcggggcagacgcctaggaaaatgcggcacgtgtacaacagcgaattgctagatgtttactgctctcaatgctgcaagaaaatcaacctgctcaatgacttggaagcccgactgaaaaacctgaaggccaacagccccaaccgaaagatctccagcacggcctttggacggcagctcatgcacagcagcaacttcagcagcagcaatggcagcaccgaagacctgttccgggacagcattgactcttgcgacaatgacatcacagagaaggtaagcttcctggaaaagaaggtgacagagctggagaatgacagcctgaccaatggggacctgaagagcaagctgaagcaagagaacacacagctggtgcacagggtgcatgagctggaggagatggtgaaggatcaggagaccacggccgagcaggctctggaggaggaggcgcggcgccaccgcgaggcctacggcaagctggagagggagaaggctaccgaggtggagctgctcaatgccagggtgcagcagttggaggaagaaaatacagagcttagaacaacagtgactcggctcaagtctcaaacagagaaactggatgaggagcggcagcgcatgtctgaccgtctggaggacaccagcctgcggctcaaagatgagatggacctgtacaagcgcatgatggacaagctgcgacagaaccgccttgagttccagaaggagcgggaggcgacgcaggagctcatcgaggacttgcggaaggagctggagcacctgcagatgtacaagctggactgcgagcggccaggcaggggccgcagtgcctcctctggcctaggcgagttcaatgccagggcccgcgaggtggagctcgagcacgaggtcaagcggctcaagcaggagaattataagctgcgggatcagaacgacgacttgaatgggcagattttgagcctcagcctctacgaagcaaaaaacctctttgctgcccagactaaagcccagtctctggctgcggagatagacaccgcctcgcgcgatgagctaatggaagccctgaaggagcaggaggagatcaacttccggctgaggcagtacatggacaagattatcctcgccatcctggaccacaatccctccatcctcgagatcaaacactaaggcacggggctggctgcagagcagccttaggaccctgggaccaagggcagaccctgcccaaggatgcaggcctaagccgggcctcacactcacactgtaaatgtctctctggccaccatgcgttacgtgtacccgtgtatatgtggggaggctgtgcacacgagcgaggggtgagtggccgtggctgtgggcagcatccacacggttagccgtgcatgcactttgtggcccctttgcaaggggcagagggtactggaagtgggaggaggcaaggtctgctatcaggagttactgtaaaaacaagaactggaagctcgtgtttccggtactgggtaaaatgattctacctctggggataaggattcacattcgctctagtacgatgggctctttcaccccactcctagtccccttgggagtgggagcaaaattgtgatctttcctaggagtttgaatgccccatatttgtgtcctcgccagctctttggccacctttcaagccccagtgttcaagctcagagaggatgaaggggcatctggagggtccatgagatggggccctcaccaaatgccttggccaccggccagcagccctctgtgatgtgtgtgcagagtgaacagaggactcaggtttcatagcagctagtgcggggcatcctcatcctgtacctatagagttcgtgcactcccccatccatgctacctacctccccgtttctgtttcagttttaagacaatgaagcagcattcactgcgtcattgtaacatgaagggataaaaatgaaggagaaggagggtttgggatgggtgtctaaggcaggagttgacatcgggcaaccaaagaaatgagttttggggaggaacacaactcccatcccagtcagtttccttcccatggctgcatcttaagatggatgcacggagaaaccgtctgcctggctccctgtcttcattctccacgcagcctggtgatggcaggcctgggtttggatttcagaatcctagctccgggctccactcgtgtggcagcaagactgcttcgttccagcgtttagaaacacacctgtatttgattctcagccaggggagcactcgctgcactggtgggaggcggttgggaaagttgcaggaaaaccttagtcttccatccttctgacccatggtggaaattcacaccatggatttttaatggatctttgttctaggcagctgggaatagacatggtacttaccttagagttttccaatttatctcaattttatatggcttgtgattcattttcttaatccaaatatatataaacgtgtgtggtcttattcttccccctgcagtttcttgctttcttcagcacatcttatagtatgagaaggaaggtttgggcatgttgggaagggcggtggagggggagttgcagaaagagagggcagtgagggtgaggagaggggatctggggacttgggtgtgacacctgcttgacagaggcagggctgtggccaggaccaaccttcaattccattccaatcagcctttgcatttgttggatctcgtggcttctttttaatcttttgttggggattagtttcatgctgcacataatggggttgcactggtctgacccaggactttggagccacccacactgggaagactaggctaggcagtcggtcttctaggagtttctcagccccttaggacgcgggtctccttgggctcccccaagggttctgcgaagaggcagtggaagaaggcatgaggagagggtctcttgagaatttgccaataggaaggagtggccacggctgaaaggaacaagacagatcctgacatagctttggcctgggtgttaggtcagaaggagtactggtgcgtgggggccttaccccagggttgagtattttatatgtaaaatgttatctgccctttggctgcattggaatttcagagaaggctgcagaggcctgggttacacagcctgagtcacaacgtgggaaggaatctctgccacgggaaaggtgggcggaagcagctggcagcctggggcgtgcttcaggctcctccctctaaggggcgccatgggaacaggctccggagggagccggcgtctgaaaggcccccgggacctgctgcagtgccagaggggcctctggagcaggcctggcttttaaatggggggctgaattccagctcacacacacctcaagtccaaccttactttcttcagccagaatacatttcttgtaaaacctggcttgttgcttggcttttaaagatggtgtatgtttgtaaaaatattcttctgggctcaaaagctagcttgagggggcagatgccccaggtgtcccagctccacagcccctggcagatcccagaccccttggtggcaggtcccagagcctaggtggtaggagcttgatctttgtttctgcccttacccctcagtagtggggctgcgaggtagtagacaggatgcccagttaagtttgaatttcagatagaaaataattttagaataaatatgttctatctaatacatgggacagatgttatttttagagataggatcttgctctgttgcccaggctggagtgtagtggtatgatcatagctcaccacaaccttgaactcccaggctcaagcgatcctcccgccttaactgcctgagtagctgggactacaggcatgcaccaccacgcccagctaatttttcttattttttgtagagacagggtctcactgtgttgcctcactcgagctgctgacctcaagtgatcctcccacctcagcctgccaaagcactgggattacaggcatgagccaccatgcctggccaggacatatttgaaatggggagattttaaaaattctgatgattagactgaatcctcagacgttctggtttgattgttgtgggtgtagcccaggcatgggattttttaaagagctgctcaggtaattccaatttaattgcgtgtcctacttgggttttttgtttgtttttattgtttttgctaaacctggcaaccctaccgagtagggattagcagtaacttatctgaaatttagaggtgttttgggggtggggcgagggtttctgtagtagactcagattttacatggccctgagctgcccttgcgttcagttggaagccacgcaaaatgaactgaaccaggagtgagcttcgtgtacattatctattagaaaatgaagtaccttctggttcagctagtccctgtgcgttgagaggctttaagaaacttctagtaaaaatgtttttttcttttagctttgaattggccagagtttatcctagattattttattttaaattggtagaattctttgcgaactgtcacagagaaattccttttcatgactttatttctgacctattaaaacatgaacaggccaggcatggtggctcacgcctgtaatcctagcacttgggaggcagtggcaggcggatcacttgagctcaggagtcctaaaccagcctgggcaacatagtgataccttgtctctaccaaaagttaaaaaaaaaaaaaaaaaagctcaagaacctgcacgagggcctaaaacagtgggctcagctttggctgtgcattggaatcacctggggagatttgtaagcttctgctgtctgggctgaacccccagaggttcggattgaattggtgtggggtgtggtccaggcatcgagatgtgtaaagacctccccaggtgatgatatgcagtccgaggttgagactgccctgtcctgcaaggtcgttggccagaggtagaggaaactggtcaaagtggctgttgggcttgtcaagcccgtggctgaatgacagtgagctctcttgctgggagggttccttttcctgttgttgaatggtcctggcctgcaggatgggaggccagatgccttcaggagctggtggatccagctgttctcaccagcctggaggttagcagaccagagtgggtgggcaggaccttggcctggtgcccctggaatcagtgggtggcatgtgttgggatatactggctacaggctcatctcaaagagcaggtagaacagagtcagcagggaactgacaggtggggctgtccccctgaaagcagccgcagaaacagctgccacctatttgcatagctgagcaggaggacatactgtctttgtgggttttgcttctggtctgtttcctgactgggttgataaagggagtcccagctcgttccctgttagccaaaccagcatcctgctcacacaccggacactccaggtgctagtccactggtgctggtgttcaggggagttgggggggggggcgcggggacagaagcgcgggttcttggttccaatgagggacttagcagaagcctccaggggccagcagggccaggtgaaacttgggagaaatgaagccctctgtgtcctgtgtgtgtggtggggtttaatgcattagcaaatttaaacttaaaaactaactctaggccgggcacggtggctcacacctgtaatcccagcactttgggaggccaaggcaggtggattgcctgagctcaggagttcgagaccagcctggacaacatggtgaaactcttgtctttatttttttaaaaaaacaaaaagtaactttcgatgtgatcataccaggaaagttttgcgtggtcaccatgccaagaaaatgactttggttgcccagcagatccacagcgactctttctcaagggctactgtggattctagattgaggaaaggggccacttaggactcagtgctggtatcctccacagtcctttctcccagactctggccctccctttgggacccaggaaatcccctctagggtgacgctgctggctaggaagactgaggtctgctgcgccaaggggcctcaagttagaagggccatgccgtcagtggatgactttgagcgctgatcctagggacctgccaggtcctcacttcctgccctgggtgcacacatgaatggggcagccagcaggaagcgggagaggctggaaccaggagcctgccctacctgcatggcaggacaactctgaggcccttctgccatattctctgctacccaccagagaaaataggctgccttctagaaagatttgtttctaaaagcgtagaccctggggaagtataatgtcaccatgctcaccaggcgaggtttcccatatgacctccctgccccgacctcgtcaggttgctcctttccccatctgtaaggtagagatgtctgccccggagctaccagctggggatggcatccaggccatgtctcctgcaggatccaagtgctgttgtccccagggtgaccctgcctcctgctggggcccatccgctttgctgtgctgcacaggctgttttcatctgcatggtttggggtctttgtccttgtgccttttcttccccatcgccactgtacaggattttccacattgcccactgcctccttttctacatcgtctcatctccctggcctttcccgagccctgtaaatgtgtactttttcaacgtgcctcccccaggtgaggccagctctcccgggcacattcgtccacaaggatcaggccccacttacccttggctcgctcagcctgtagacttggtaactttgtacagaatctttcattattgtcttaagcatggggggctaggacccacttagtccctcctccagcctgcagctaatttaggagccttgcattccagaaaagggcaactttgtgtaaagcagcttctcccacagagctttccctgcattgttagtgatgtcgggcaaagcatcactctttaacctggggcattggccccagcagggatatcatgggaccgcagccgctccgtgcactgtctctgcccccagaggaagccctgtccatggttcctggtgcacggccacaggcctgccttgaggccaccacatctggtgtctagaacagctgcgggccccacttgggcagaaggaagaggtgctagctgctgcccctgcctgctgtgaacacctgcccagcccttccttgtctgctgaggtgctcagaccagagtgccattaaataccaactgatgtcacggagcggacggtgcattgccaaggactcacagctgtgggctcccttccagctcctcccactttcttggctgggtcttctgaggcctacgtggaatgaactacacatgtggcctcatgcccaagggtttgttagatggcctctgactctgtgggattcaacttgacttttttgccccaggaggctctgtctggaaacaggcttagctttagtgctggggtgggacctgccctgtgggccccagggaggggacagtgggggtgaggccctgaggctgtccagggtctgagctctttgcctccaacctgcttctgccccaaaaggaacaggctgttggtggcaggctcctcccggggagctgtactgtacagaccaaggtgtaaataaacagtttgctcttctaaaaaaaaaa

SEQ ID NO: 329496 - DNA, 866 bp, Homo sapiens
attctggagctggaataatacgtatctggaaattttgtgtaatggtttccttaaatagaccctttattcttggtcccctctaaagtctagcagagacataagtcaggctcttctcaaatagggactctgttcaatcaactcacgccaagaccattgattgggaacatccaacatggggaggcaggctctgggtctggtgtttgcagggggtcccggaggggctcatggacaggaaacaaaggagatgcaagcaatactcacggaggcacctacaaggggatggggtcatttgaactgggtcttaaagggagagtggtctggagtgaccagaagatagaggaggggagaactaaataaaaatgtattcattcattcataactttctgagtgttcaatgagggaaggatgtgaagctcggtgccagaaacacagtgtgaaccaggaaaacggaaatggcccccgcccttgtgtagtgtgaaacctcatgggatagacagatgaggaacacacaggcaaatgcaaaccaccagccatgtcagtgctgaaagggaggccccaggtttctgccccccataagtggggagccaggccagggccctgccaagccctcccagcccagctggcccactggctcctcaggcctgggagagaacaacgacagtggtctgaagatagaggggaactagcgacccatgtgcacctgccacattctaggaacagagctactacagcttcagggttaagcgcataattctggtgttcaaatcctagtttctcccctacccagccctgtagccctaagcaagttaccaaactccacaatgcctcagatgcaaggcggggctcacactcctgtttattccatc

SEQ ID NO: 329497 - DNA, 6016 bp, Homo sapiens
attaaagttggccttatcataaatttcccaatagtatgcctatttcaagtggttctgaaaatgtttgagaatgatgaagatctcttgttatagacagtttttttttcagagcagtattttaagtgcaaagtgtttttttgttgttgttgttgttgggaaaataagaatcttccatattgtagtgtagacagaggacaagtgctcttttgttctcaaacattctattttttcaagtgtattttacccacttatgtgactgagtctgagcctttgctaagggtactgcagctggattatgtagtggaaccaggtccagaaaaagaattgctaaagaatgcaagtaaacaggatgtcagatgttatccttagcctatttccctaaacatagctttttggctgcaaagtaaaatgccattcttctagcttctgcttatacacagtgatggctgacagcaggcataatcttcgtttgcttggcacgttgtcaccatgcaactcaacgtgttttgcaaggaatgatcgtgacacaccatctctgggagatactatgaggacatccggctatttcttggaagaattttctgtctaccttctttgagccctgttgtgccagcacatctccccatgaggctcagatctgtctgacctaagagccagttggcatcgtcctcctaacagaagccagattttcactggggctagactatttattgacagtgttttcccagactggcccatgagtgtctcatttccaaggtcccctgaagtgctggctcacctctgtttcccaaagcacttgcttgcttgtctctcctccctccccagcatccttttcactttcttcccttataacttcttgcactctgtgtgcgtgtgtgtgtatgcgtgtgtgcatgtgcgtttcttctttttttttatcctaacgaatttgttttgcaggttttgaaaaggaaaaaccagcgttatccaggattgttaaattaattcttatctgtttccacatcttggaccgtgatctctgtggttttaaaatcccatattttgagtgggttccgctgttgtttaagaaaagttgctttaaacctttgctctgcaagcacccgaagagaactcataaaaaggaagacaacagcagatgcaatcgcggatgtggcttagtccttgcagctgccccagagtgctgtttggagtgtaccgtcctcagtaatgaatccagaagaacaaatcgtgacatggcttatatctttgggagttttagagtcccctaaaaagaccatctgtgatccggaggagtttttaaagtcctcgctgaaaaatggggtagttctgtgcaaactgatcaacagactcatgcctggctctgtggaaaagttttgtctggatccccaaactgaagctgactgcatcaacaacatcaatgacttcctgaaaggatgtgcaaccctccaagtggaaatatttgatcctgatgacctttattcaggggtcaatttctccaaggtactgagtactcttttagctgtcaacaaagcaacagaagatcagctatcagaaagaccatgtggacgttcctcttctcttagtgctgctaatacttctcagacaaacccacagggagcagtttctagcacagtttcagggctgcaaaggcagtcaaagacagtggagatgacggaaaatggaagtcatcagttgatagtaaaagcaagattcaactttaagcagactaatgaggatgaactgtcagtttgtaagggggacatcatttacgtcacacgagttgaagaaggaggctggtgggaaggcacattaaatgggagaacaggctggttccccagtaattatgtccgtgaaattaaatccagtgagagacctctctccccaaaagccgtcaaaggatttgaaactgctccacttaccaagaattattatactgtggtgttacagaacatcctggacactgaaaaagaatatgctaaagaacttcagtctcttcttgttacttacttaagacccctgcagtccaataacaatctgagtactgtggaggttacatctttactgggaaacttcgaggaagtatgcacatttcaacagacactctgccaagccttggaagaatgttcaaagtttccagaaaaccagcacaaagtaggaggttgtctactgagtctcatgcctcattttaaatctatgtatctggcttactgtgcaaaccatccttcagctgtaaatgtgctcactcagcacagtgatgagttggaacaattcatggaaaatcaaggtgcatcgagcccaggtatcctcattttaacaacaaacctcagcaaaccattcatgcgactggagaaatatgttactctcttgcaagagttagaacggcatatggaggatactcatccagatcatcaggatattctgaaagcaatcgtagcattcaaaactctcatggggcaatgtcaagatctgaggaagagaaaacagctggagttacagatactgtccgaacctattcaggcatgggaaggagaagatattaaaaacttgggaaatgtgatttttatgtcacaagtaatggtgcagtatggagcatgtgaggaaaaagaggagcggtaccttatgttattttcaaatgtcctgataatgttatctgcaagtcctcggatgagtggctttatctatcagggaaaaataccaatagcaggaacggtggtgactagattagatgaaattgaagggaatgactgcacatttgaaatcactggtaacacagtggagagaattgtggtccattgtaacaacaaccaggacttccaggaatggttggagcagctgaacagactgatcagaggacctgcctcttgcagttcattatccaaaacctcatcgtcatcatgtagtgctcattcttcttttagctctaccggacagccccgaggacccttggagcctcctcaaattataaaaccgtggagtttaagttgtctacgacctgcacctccacttagaccatcagcagcactaggttataaagagaggatgtcttatatcttaaaggagtctagtaaaagccctaaaacgatgaagaaatttcttcataaaaggaagactgagagaaaaccatcggaggaggaatatgtgattaggaaaagtacagctgctctggaagaggatgctcaaatccttaaagtgatcgaagcctactgcaccagcgcaaattttcaacaaggccatggctcaagtactcgaaaagattccattccacaagtcctactccctgaggaagagaaactcatcattgaagaaaccagaagcaacggccagaccatcatggaagaaaagagccttgttgatactgtttacgccttgaaggacgaggtcagagaactgaagcaggaaaataaaagaatgaagcaatgcctggaagaagaactgaaatcaagaagggacctagaaaagctggtgcggaggcttttgaagcaaacagatgagtgtattcgaggcgagtccagtagcaagacctcaattcttccataaccatcactgtgccactgggtggagtgtgccttcagggcatcttgaaatgtcccgctgaatgatttgactcagtttgctcacttctttggcttttgttttgtgtttgagtctctctctctctctccctctctcttctctttctctccccgctgtgtgcatatgtgtgtgcgtgcacgtgcgcgcttgggcatttgctgttgtttggttattggttggttgttcattttttttttcaacaggtgaaaaagcaggaagtggtggtagagatggcctcagagtcttttccattcagtaagaaagagaaagggaatgcaggccagttacttaaaaggtcttcagattgccttcagttcacagtgcctctgcaacagccattgccctcaggtcacattctttgggctggctgcccttgcaaagcagctggccaaggcttattaaatgtgaacccaacttttccccagggctttcctgtacctgcaagcctcttagtacttaatttaccgaaggcaaatcttccagactatggcttgagtaggatgaaagacaaacacatctgcccaatgatccagctgcccttccttagaccatcacatgcctcccctcaatcacaggttttaaaattactgccctatgttgtctataagaccaagaaaactgtagtacccttattccttttgtgtcatgtaaattgtaactcaggggggcagaagctctggtcacccacaccaacaccaaatccatcagcaaattctactggacaatcctcccttttagtagcagagttgaccgccttttcccattgcatgataggtttctttccctcattctgcctagtgtgtaagttttctatttccccagtacttttagccaaccttaccaagtggtgtgtaaactagtatgtatgtgctttgcttactttttaaaaaaatgtagttagactgtgaggagttactttatgtacgttgcatattcaaactgtgatgttttatccttcaaaacaatctgcattaagaagatattgtgccctactagacagctttcattcactttattactctctcatatatgctgtgagaagttgtaatattaattggcctctttgggtgggactctaagcagtatttgcagaaatatgcttctggtccaacttgtacatccagaacaaaagggcccctctagtagctgtgtgctggattattcaggactgattaactcaagttgctcattgaatcacatcatccactttatcccagaaactagaactgtgagaaaccaggtttagaagacagtcacagaacagcacacatccaaattcagcgccattgaaagttggcctaaggctcagtgccactcacccctccctccccaaaagacaagagaaatttggccagatggggaaggtcactggaaattgaggccaaagggctgatcagaattgcctttataatatatttgatggatgcctataaatgtgggttttgcaaatattgtttaaaaaccaaacttgaagccaggcatggtggcccacacctgtggtcccagctactcaggaggctgaggtgggaggatcatttgagcccaggaggtcaaggctgcagtgagctgtgatgacaccactgcactccaacctaggtaacagagagacacctctgtctctgaaaaaacaaaacttgaagtttgaaacccccagcttgctgaggagccctttttatttttggtactgagagtctcaaggtcccatagctacatggtacagggctgttgtctgcttgctgcacagcagaaattacaccatccacaggaaatggactatttttgcagtccaacatcagccaaccacacacagccgtgtttggaagctgaagagtaaagaaatttctaggaatggctgttgttctgttttttagcacagccatttagatataacatccttcacttaaaaattaaaaacatcagtactaccaccaccaccaacaacatcaacacagatcttcacatctgcccattctgtggttagtcaatggcttgcaataaatgtgcaaactgcatctataggaaacatttttgtgattacggaatactttagttgattgctgaaaatattgaaaggtcttcattttacagtgatgagtacatatgcatgtttcggggacttggcccttctgatgaggggccctcggtactctggataacgaagcttgtgcagagtggtaaccatgcttacacactaaactataatataaaggaaatgaagccatgttaatctgagagcagtgtcgccatagttgtgttgtttacaatactctataaatgggttcctgttgccctgtaattaaactgctgcccgtagaggcctttcagttccttttctgtccttccccttcttaacacaagctcaaattttctaacttgtttttattttgaagacttttaaaatggacattttcaatacataaaaataaacagtgctttataaaaa

SEQ ID NO: 329498 - DNA, 705 bp, Homo sapiens
acccctttatttgggactaaagtccaggtgcccatagcacatggaccagtcaactcaaccaaccacacacagccgtgtttggaagctgaagagtaaagaaatttctaggaatggctgttgttctgttttttagcacagccatttagatataacatccttcacttaaaaattaaaaacatcagtactaccaccaccaccaacaacatcaacacagatcttcacatctgcccattctgtggttagtcaatggcttgcaataaatgtgcaaactgcatctataggaaacatttttgtgattacggaatactttagttgattgctgaaaatattgaaaggtcttcattttacagtgatgagtacatatgcatgtttcggggacttggcccttctgatgaggggccctcggtactctggataacgaagcttgtgcagagtggtaaccatgcttacacactaaactataatataaaggaaatgaagccatgttaatctgagagcagtgtcgccatagttgtgttgtttacaatactctataaatgggttcctgttgccctgtaattaaactgctgcccgtagaggcctttcagttccttttctgtccttccccttcttaacacaagctcaaattttctaacttgtttttattttgaagacttttaaaatggacattttcaatacataaaaataaacagtgctttataaaaa

SEQ ID NO: 329499 - DNA, 4761 bp, Homo sapiens
agtttcgccctggtggcggccgcgctcagggcagggtcccagctccggctgggttgatctgttcccgcagccttggcacaggcttgcccgcccgctcgccggccccgtgactcgggagggcgaacggcttccaggaggcggcggcggcgcggctggagtgagggagcagctggaggacaggcgggcagcggccgagccagatatttgatcctgatgacctttattcaggggtcaatttctccaaggtactgagtactcttttagctgtcaacaaagcaacagaagatcagctatcagaaagaccatgtggacgttcctcttctcttagtgctgctaatacttctcagacaaacccacagggagcagtttctagcacagtttcagggctgcaaaggcagtcaaagacagtggagatgacggaaaatggaagtcatcagttgatagtaaaagcaagattcaactttaagcagactaatgaggatgaactgtcagtttgtaagggggacatcatttacgtcacacgagttgaagaaggaggctggtgggaaggcacattaaatgggagaacaggctggttccccagtaattatgtccgtgaaattaaatccagtgagagacctctctccccaaaagccgtcaaaggatttgaaactgctccacttaccaagaattattatactgtggtgttacagaacatcctggacactgaaaaagaatatgctaaagaacttcagtctcttcttgttacttacttaagacccctgcagtccaataacaatctgagtactgtggaggttacatctttactgggaaacttcgaggaagtatgcacatttcaacagacactctgccaagccttggaagaatgttcaaagtttccagaaaaccagcacaaagtaggaggttgtctactgagtctcatgcctcattttaaatctatgtatctggcttactgtgcaaaccatccttcagctgtaaatgtgctcactcagcacagtgatgagttggaacaattcatggaaaatcaaggtgcatcgagcccaggtatcctcattttaacaacaaacctcagcaaaccattcatgcgactggagaaatatgttactctcttgcaagagttagaacggcatatggaggatactcatccagatcatcaggatattctgaaagcaatcgtagcattcaaaactctcatggggcaatgtcaagatctgaggaagagaaaacagctggagttacagatactgtccgaacctattcaggcatgggaaggagaagatattaaaaacttgggaaatgtgatttttatgtcacaagtaatggtgcagtatggagcatgtgaggaaaaagaggagcggtaccttatgttattttcaaatgtcctgataatgttatctgcaagtcctcggatgagtggctttatctatcagggaaaaataccaatagcaggaacggtggtgactagattagatgaaattgaagggaatgactgcacatttgaaatcactggtaacacagtggagagaattgtggtccattgtaacaacaaccaggacttccaggaatggttggagcagctgaacagactgatcagaggacctgcctcttgcagttcattatccaaaacctcatcgtcatcatgtagtgctcattcttcttttagctctaccggacagccccgaggacccttggagcctcctcaaattataaaaccgtggagtttaagttgtctacgacctgcacctccacttagaccatcagcagcactaggttataaagagaggatgtcttatatcttaaaggagtctagtaaaagccctaaaacgatgaagaaatttcttcataaaaggaagactgagagaaaaccatcggaggaggaatatgtgattaggaaaagtacagctgctctggaagaggatgctcaaatccttaaagtgatcgaagcctactgcaccagcgcaaattttcaacaaggccatggctcaagtactcgaaaagattccattccacaagtcctactccctgaggaagagaaactcatcattgaagaaaccagaagcaacggccagaccatcatggaagaaaagagccttgttgatactgtttacgccttgaaggacgaggtcagagaactgaagcaggaaaataaaagaatgaagcaatgcctggaagaagaactgaaatcaagaagggacctagaaaagctggtgcggaggcttttgaagcaaacagatgagtgtattcgaggcgagtccagtagcaagacctcaattcttccataaccatcactgtgccactgggtggagtgtgccttcagggcatcttgaaatgtcccgctgaatgatttgactcagtttgctcacttctttggcttttgttttgtgtttgagtctctctctctctctccctctctcttctctttctctccccgctgtgtgcatatgtgtgtgcgtgcacgtgcgcgcttgggcatttgctgttgtttggttattggttggttgttcattttttttttcaacaggtgaaaaagcaggaagtggtggtagagatggcctcagagtcttttccattcagtaagaaagagaaagggaatgcaggccagttacttaaaaggtcttcagattgccttcagttcacagtgcctctgcaacagccattgccctcaggtcacattctttgggctggctgcccttgcaaagcagctggccaaggcttattaaatgtgaacccaacttttccccagggctttcctgtacctgcaagcctcttagtacttaatttaccgaaggcaaatcttccagactatggcttgagtaggatgaaagacaaacacatctgcccaatgatccagctgcccttccttagaccatcacatgcctcccctcaatcacaggttttaaaattactgccctatgttgtctataagaccaagaaaactgtagtacccttattccttttgtgtcatgtaaattgtaactcaggggggcagaagctctggtcacccacaccaacaccaaatccatcagcaaattctactggacaatcctcccttttagtagcagagttgaccgccttttcccattgcatgataggtttctttccctcattctgcctagtgtgtaagttttctatttccccagtacttttagccaaccttaccaagtggtgtgtaaactagtatgtatgtgctttgcttactttttaaaaaaatgtagttagactgtgaggagttactttatgtacgttgcatattcaaactgtgatgttttatccttcaaaacaatctgcattaagaagatattgtgccctactagacagctttcattcactttattactctctcatatatgctgtgagaagttgtaatattaattggcctctttgggtgggactctaagcagtatttgcagaaatatgcttctggtccaacttgtacatccagaacaaaagggcccctctagtagctgtgtgctggattattcaggactgattaactcaagttgctcattgaatcacatcatccactttatcccagaaactagaactgtgagaaaccaggtttagaagacagtcacagaacagcacacatccaaattcagcgccattgaaagttggcctaaggctcagtgccactcacccctccctccccaaaagacaagagaaatttggccagatggggaaggtcactggaaattgaggccaaagggctgatcagaattgcctttataatatatttgatggatgcctataaatgtgggttttgcaaatattgtttaaaaaccaaacttgaagccaggcatggtggcccacacctgtggtcccagctactcaggaggctgaggtgggaggatcatttgagcccaggaggtcaaggctgcagtgagctgtgatgacaccactgcactccaacctaggtaacagagagacacctctgtctctgaaaaaacaaaacttgaagtttgaaacccccagcttgctgaggagccctttttatttttggtactgagagtctcaaggtcccatagctacatggtacagggctgttgtctgcttgctgcacagcagaaattacaccatccacaggaaatggactatttttgcagtccaacatcagccaaccacacacagccgtgtttggaagctgaagagtaaagaaatttctaggaatggctgttgttctgttttttagcacagccatttagatataacatccttcacttaaaaattaaaaacatcagtactaccaccaccaccaacaacatcaacacagatcttcacatctgcccattctgtggttagtcaatggcttgcaataaatgtgcaaactgcatctataggaaacatttttgtgattacggaatactttagttgattgctgaaaatattgaaaggtcttcattttacagtgatgagtacatatgcatgtttcggggacttggcccttctgatgaggggccctcggtactctggataacgaagcttgtgcagagtggtaaccatgcttacacactaaactataatataaaggaaatgaagccatgttaatctgagagcagtgtcgccatagttgtgttgtttacaatactctataaatgggttcctgttgccctgtaattaaactgctgcccgtagaggcctttcagttccttttctgtccttccccttcttaacacaagctcaaattttctaacttgtttttattttgaagacttttaaaatggacattttcaatacataaaaataaacagtgctttataaaaa

SEQ ID NO: 329500 - DNA, 6475 bp, Homo sapiens
  misc_feature (6058)..(6058): n is a, c, g, or t
attaaagttggccttatcataaatttcccaatagtatgcctatttcaagtggttctgaaaatgtttgagaatgatgaagatctcttgttatagacagtttttttttcagagcagtattttaagtgcaaagtgtttttttgttgttgttgttgttgggaaaataagaatcttccatattgtagtgtagacagaggacaagtgctcttttgttctcaaacattctattttttcaagtgtattttacccacttatgtgactgagtctgagcctttgctaagggtactgcagctggattatgtagtggaaccaggtccagaaaaagaattgctaaagaatgcaagtaaacaggatgtcagatgttatccttagcctatttccctaaacatagctttttggctgcaaagtaaaatgccattcttctagcttctgcttatacacagtgatggctgacagcaggcataatcttcgtttgcttggcacgttgtcaccatgcaactcaacgtgttttgcaaggaatgatcgtgacacaccatctctgggagatactatgaggacatccggctatttcttggaagaattttctgtctaccttctttgagccctgttgtgccagcacatctccccatgaggctcagatctgtctgacctaagagccagttggcatcgtcctcctaacagaagccagattttcactggggctagactatttattgacagtgttttcccagactggcccatgagtgtctcatttccaaggtcccctgaagtgctggctcacctctgtttcccaaagcacttgcttgcttgtctctcctccctccccagcatccttttcactttcttcccttataacttcttgcactctgtgtgcgtgtgtgtgtatgcgtgtgtgcatgtgcgtttcttctttttttttatcctaacgaatttgttttgcaggttttgaaaaggaaaaaccagcgttatccaggattgttaaattaattcttatctgtttccacatcttggaccgtgatctctgtggttttaaaatcccatattttgagtgggttccgctgttgtttaagaaaagttgctttaaacctttgctctgcaagcacccgaagagaactcataaaaaggaagacaacagcagatgcaatcgcggatgtggcttagtccttgcagctgccccagagtgctgtttggagtgtaccgtcctcagtaatgaatccagaagaacaaatcgtgacatggcttatatctttgggagttttagagtcccctaaaaagaccatctgtgatccggaggagtttttaaagtcctcgctgaaaaatggggtagttctgtgcaaactgatcaacagactcatgcctggctctgtggaaaagttttgtctggatccccaaactgaagctgactgcatcaacaacatcaatgacttcctgaaaggatgtgcaaccctccaagtggaaatatttgatcctgatgacctttattcaggggtcaatttctccaaggtactgagtactcttttagctgtcaacaaagcaacagaagatcagctatcagaaagaccatgtggacgttcctcttctcttagtgctgctaatacttctcagacaaacccacagggagcagtttctagcacagtttcagggctgcaaaggcagtcaaagacagtggagatgacggaaaatggaagtcatcagttgatagtaaaagcaagattcaactttaagcagactaatgaggatgaactgtcagtttgtaagggggacatcatttacgtcacacgagttgaagaaggaggctggtgggaaggcacattaaatgggagaacaggctggttccccagtaattatgtccgtgaaattaaatccagtgagagacctctctccccaaaagccgtcaaaggatttgaaactgctccacttaccaagaattattatactgtggtgttacagaacatcctggacactgaaaaagaatatgctaaagaacttcagtctcttcttgttacttacttaagacccctgcagtccaataacaatctgagtactgtggaggttacatctttactgggaaacttcgaggaagtatgcacatttcaacagacactctgccaagccttggaagaatgttcaaagtttccagaaaaccagcacaaagtaggaggttgtctactgagtctcatgcctcattttaaatctatgtatctggcttactgtgcaaaccatccttcagctgtaaatgtgctcactcagcacagtgatgagttggaacaattcatggaaaatcaaggtgcatcgagcccaggtatcctcattttaacaacaaacctcagcaaaccattcatgcgactggagaaatatgttactctcttgcaagagttagaacggcatatggaggatactcatccagatcatcaggatattctgaaagcaatcgtagcattcaaaactctcatggggcaatgtcaagatctgaggaagagaaaacagctggagttacagatactgtccgaacctattcaggcatgggaaggagaagatattaaaaacttgggaaatgtgatttttatgtcacaagtaatggtgcagtatggagcatgtgaggaaaaagaggagcggtaccttatgttattttcaaatgtcctgataatgttatctgcaagtcctcggatgagtggctttatctatcagggaaaaataccaatagcaggaacggtggtgactagattagatgaaattgaagggaatgactgcacatttgaaatcactggtaacacagtggagagaattgtggtccattgtaacaacaaccaggacttccaggaatggttggagcagctgaacagactgatcagaggacctgcctcttgcagttcattatccaaaacctcatcgtcatcatgtagtgctcattcttcttttagctctaccggacagccccgaggacccttggagcctcctcaaattataaaaccgtggagtttaagttgtctacgacctgcacctccacttagaccatcagcagcactaggttataaagagaggatgtcttatatcttaaaggagtctagtaaaagccctaaaacgatgaagaaatttcttcataaaaggaagactgagagaaaaccatcggaggaggaatatgtgattaggaaaagtacagctgctctggaagaggatgctcaaatccttaaagtgatcgaagcctactgcaccagcgcaaattttcaacaaggccatggctcaagtactcgaaaagattccattccacaagtcctactccctgaggaagagaaactcatcattgaagaaaccagaagcaacggccagaccatcatggaagaaaagagccttgttgatactgtttacgccttgaaggacgaggtcagagaactgaagcaggaaaataaaagaatgaagcaatgcctggaagaagaactgaaatcaagaagggacctagaaaagctggtgcggaggcttttgaagcaaacagatgagtgtattcgaggcgagtccagtagcaagacctcaattcttccataaccatcactgtgccactgggtggagtgtgccttcagggcatcttgaaatgtcccgctgaatgatttgactcagtttgctcacttctttggcttttgttttgtgtttgagtctctctctctctctccctctctcttctctttctctccccgctgtgtgcatatgtgtgtgcgtgcacgtgcgcgcttgggcatttgctgttgtttggttattggttggttgttcattttttttttcaacaggtgaaaaagcaggaagtggtggtagagatggcctcagagtcttttccattcagtaagaaagagaaagggaatgcaggccagttacttaaaaggtcttcagattgccttcagttcacagtgcctctgcaacagccattgccctcaggtcacattctttgggctggctgcccttgcaaagcagctggccaaggcttattaaatgtgaacccaacttttccccagggctttcctgtacctgcaagcctcttagtacttaatttaccgaaggcaaatcttccagactatggcttgagtaggatgaaagacaaacacatctgcccaatgatccagctgcccttccttagaccatcacatgcctcccctcaatcacaggttttaaaattactgccctatgttgtctataagaccaagaaaactgtagtacccttattccttttgtgtcatgtaaattgtaactcaggggggcagaagctctggtcacccacaccaacaccaaatccatcagcaaattctactggacaatcctcccttttagtagcagagttgaccgccttttcccattgcatgataggtttctttccctcattctgcctagtgtgtaagttttctatttccccagtacttttagccaaccttaccaagtggtgtgtaaactagtatgtatgtgctttgcttactttttaaaaaaatgtagttagactgtgaggagttactttatgtacgttgcatattcaaactgtgatgttttatccttcaaaacaatctgcattaagaagatattgtgccctactagacagctttcattcactttattactctctcatatatgctgtgagaagttgtaatattaattggcctctttgggtgggactctaagcagtatttgcagaaatatgcttctggtccaacttgtacatccagaacaaaagggcccctctagtagctgtgtgctggattattcaggactgattaactcaagttgctcattgaatcacatcatccactttatcccagaaactagaactgtgagaaaccaggtttagaagacagtcacagaacagcacacatccaaattcagcgccattgaaagttggcctaaggctcagtgccactcacccctccctccccaaaagacaagagaaatttggccagatggggaaggtcactggaaattgaggccaaagggctgatcagaattgcctttataatatatttgatggatgcctataaatgtgggttttgcaaatattgtttaaaaaccaaacttgaagccaggcatggtggcccacacctgtggtcccagctactcaggaggctgaggtgggaggatcatttgagcccaggaggtcaaggctgcagtgagctgtgatgacaccactgcactccaacctaggtaacagagagacacctctgtctctgaaaaaacaaaacttgaagtttgaaacccccagcttgctgaggagccctttttatttttggtactgagagtctcaaggtcccatagctacatggtacagggctgttgtctgcttgctgcacagcagaaattacaccatccacaggaaatggactatttttgcagtccaacatcagccaaccacacacagccgtgtttggaagctgaagagtaaagaaatttctaggaatggctgttgttctgttttttagcacagccatttagatataacatccttcacttaaaaattaaaaacatcagtactaccaccaccaccaacaacatcaacacagatcttcacatctgcccattctgtggttagtcaatggcttgcaataaatgtgcaaactgcatctataggaaacatttttgtgattacggaatactttagttgattgctgaaaatattgaaaggtcttcattttacagtgatgagtacatatgcatgtttcggggacttggcccttctgatgaggggccctcggtactctggataacgaagcttgtgcagagtggtaaccatgcttacacactaaactataatataaaggaaatgaagccatgttaatctgagagcagtgtcgccatagttgtgttgtttacaatactctataaatgggttcctgttgccctgtaattaaactgctgcccgtagaggcctttcagttccttttctgtccttccccttcttaacacaagctcaaattttctaacttgtttttattttgaagacttttaaaatggacattttcaatacataaaaataaacagtgctttataaaaaaaaaaaaaaaaaaaaaaaaaaaaaaaaaaaaaaaaaaaaaanaaaaaaaaaaaacactaaacccaaactattaacacctactcatcctctacactcctagtttccccttacttcgccttcttccacaccattcgctctttaaaaccctttccttcactcgaaaaactccctttttaccatatccccttcgcatcaacctctatttctttttagctcctctctaatcctctgctcctttacaccctctcatatatttcagacactccattattttttacatcaagtacctactcttctacgaacctcgttttatctccacaattcttacactctcatcgcatttctctcttttcgcacaatctttcctttcaacaacttcccctctttacatattttctatcctgtttactctctacctcctttttataccactccttatactcctttttccctcgttcc

SEQ ID NO: 329501 - DNA, 1693 bp, Homo sapiens
agtttcgccctggtggcggccgcgctcagggcagggtcccagctccggctgggttgatctgttcccgcagccttggcacaggcttgcccgcccgctcgccggccccgtgactcgggagggcgaacggcttccaggaggcggcggcggcgcggctggagtgagggagcagctggaggacaggcgggcagcggccgagccagatatttgatcctgatgacctttattcaggggtcaatttctccaaggtactgagtactcttttagctgtcaacaaagcaacagaagatcagctatcagaaagaccatgtggacgttcctcttctcttagtgctgctaatacttctcagacaaacccacagggagcagtttctagcacagtttcagggctgcaaaggcagtcaaagacagtggagatgacggaaaatggaagtcatcagttgatagtaaaagcaagattcaactttaagcagactaatgaggatgaactgtcagtttgtaagggggacatcatttacgtcacacgagttgaagaaggaggctggtgggaaggcacattaaatgggagaacaggctggttccccaaaagacaagagaaatttggccagatggggaaggtcactggaaattgaggccaaagggctgatcagaattgcctttataatatatttgatggatgcctataaatgtgggttttgcaaatattgtttaaaaaccaaacttgaagccaggcatggtggcccacacctgtggtcccagctactcaggaggctgaggtgggaggatcatttgagcccaggaggtcaaggctgcagtgagctgtgatgacaccactgcactccaacctaggtaacagagagacacctctgtctctgaaaaaacaaaacttgaagtttgaaacccccagcttgctgaggagccctttttatttttggtactgagagtctcaaggtcccatagctacatggtacagggctgttgtctgcttgctgcacagcagaaattacaccatccacaggaaatggactatttttgcagtccaacatcagccaaccacacacagccgtgtttggaagctgaagagtaaagaaatttctaggaatggctgttgttctgttttttagcacagccatttagatataacatccttcacttaaaaattaaaaacatcagtactaccaccaccaccaacaacatcaacacagatcttcacatctgcccattctgtggttagtcaatggcttgcaataaatgtgcaaactgcatctataggaaacatttttgtgattacggaatactttagttgattgctgaaaatattgaaaggtcttcattttacagtgatgagtacatatgcatgtttcggggacttggcccttctgatgaggggccctcggtactctggataacgaagcttgtgcagagtggtaaccatgcttacacactaaactataatataaaggaaatgaagccatgttaatctgagagcagtgtcgccatagttgtgttgtttacaatactctataaatgggttcctgttgccctgtaattaaactgctgcccgtagaggcctttcagttccttttctgtccttccccttcttaacacaagctcaaattttctaacttgtttttattttgaagacttttaaaatggacattttcaatacataaaaataaacagtgctttataaaaa

SEQ ID NO: 329502 - DNA, 800 bp, Homo sapiens
ggccggaccgacagcatagaatgtcttcctctacggggtcgttctggcttttttgttagaaacttggtctgaggatgtttcttccctgtccattaccattcgatgttcttttattcagagcaatgtttctgtattctgaaactggaaactgaaccagtttgtttctcctagtcaccaagcatactttcctgggtctagccagggaatggctgttgttctgttttttagcacagccatttagatataacatccttcacttaaaaattaaaaacatcagtactaccaccaccaccaacaacatcaacacagatcttcacatctgcccattctgtggttagtcaatggcttgcaataaatgtgcaaactgcatctataggaaacatttttgtgattacggaatactttagttgattgctgaaaatattgaaaggtcttcattttacagtgatgagtacatatgcatgtttcggggacttggcccttctgatgaggggccctcggtactctggataacgaagcttgtgcagagtggtaaccatgcttacacactaaactataatataaaggaaatgaagccatgttaatctgagagcagtgtcgccatagttgtgttgtttacaatactctataaatgggttcctgttgccctgtaattaaactgctgcccgtagaggcctttcagttccttttctgtccttccccttcttaacacaagctcaaattttctaacttgtttttattttgaagacttttaaaatggacattttcaatacataaaaataaacagtgctttataaaaa

SEQ ID NO: 329503 - DNA, 951 bp, Homo sapiens
acgatccatcgtggacacggtctaatatccagaacaaaaggaacttaaacaaatggacaagaaaaatccccattaaaaagtgggcaaaggacaagaacagacacttctgaaaagaagacctcatacagccaacaaacatatgaaaaaaagctcaacagcggccaggcatggtggcccacacctgtggtcccagctactcaggaggctgaggtgggaggatcatttgagcccaggaggtcaaggctgcagtgagctgtgatgacaccactgcactccaacctaggtaacagagagacacctctgtctctgaaaaaacaaaacttgaagtttgaaacccccagcttgctgaggagccctttttatttttggtactgagagtctcaaggtcccatagctacatggtacagggctgttgtctgcttgctgcacagcagaaattacaccaacaacatcaacacagatcttcacatctgcccattctgtggttagtcaatggcttgcaataaatgtgcaaactgcatctataggaaacatttttgtgattacggaatactttagttgattgctgaaaatattgaaaggtcttcattttacagtgatgagtacatatgcatgtttcggggacttggcccttctgatgaggggccctcggtactctggataacgaagcttgtgcagagtggtaaccatgcttacacactaaactataatataaaggaaatgaagccatgttaatctgagagcagtgtcgccatagttgtgttgtttacaatactctataaatgggttcctgttgccctgtaattaaactgctgcccgtagaggcctttcagttccttttctgtccttccccttcttaacacaagctcaaattttctaacttgtttttattttgaagacttttaaaatggacattttcaatacataaaaataaacagtgctttataaaaa

SEQ ID NO: 329504 - DNA, 263 bp, Homo sapiens
atcggaggaggaatatgtgattaggaaaagtatgtgttttgtactttctgaaagttgtttatggataaattaacatgagaatcttcttttatgtgaggatttatttgaaagcagatgattggagcaattttttcttgacatcgtcttttacatataaagaagaatgcatggaaagctttggtcacttcttaaacatttgaataagcttcttacggctgcacttcatgtcatcttaggcagatgtcatctgtatcatttttgtg

SEQ ID NO: 329505 - DNA, 315 bp, Homo sapiens
agttaaattagaagaggatcagggcagggaagaagaatccaaaaggtttcccagagacaggcaggagaatcgacaggctgctttgtcatagatgctgagggagggaaggtcgaggaaagaaagagagtcagtgatgaaagctgccccgaggatgagcaggaggagcccttggaagggcccccctctgtttgataatcaacaaatctttccccatcataggaaaataaaagaatgaagcaatgcctggaagaagaactgaaatcaagaagggacctagaaaagctggtgcggaggcttttgaagcaaacagatgag

SEQ ID NO: 329506 - DNA, 400 bp, Homo sapiens
gacggaaaatggaagtcatcagttgatagtaaaagcaagattcaactttaagcagactaatgaggatgaactgtcagtttgtaagggggacatcatttacgtcacacgagttgaagaaggaggctggtgggaaggcacattaaatgggagaacaggctggttccccagtaattatgtccgtgaaattaaatccagtggtaagtgaagtttttaaaaggctttttgattgtgactcttgtactttcttggtattcttactgaaaattgtgtagttttaattggttaacagaagctgtttatacttgtatgtgtatgccaaaaataagagtagaacagaactgggaaaaatctgtgattagatattttgaaacaaattgtatttagattacattaaggcagc

SEQ ID NO: 329507 - DNA, 7326 bp, Homo sapiens
  misc_feature (6058)..(6058): n is a, c, g, or t
  misc_feature (7313)..(7313): n is a, c, g, or t
attaaagttggccttatcataaatttcccaatagtatgcctatttcaagtggttctgaaaatgtttgagaatgatgaagatctcttgttatagacagtttttttttcagagcagtattttaagtgcaaagtgtttttttgttgttgttgttgttgggaaaataagaatcttccatattgtagtgtagacagaggacaagtgctcttttgttctcaaacattctattttttcaagtgtattttacccacttatgtgactgagtctgagcctttgctaagggtactgcagctggattatgtagtggaaccaggtccagaaaaagaattgctaaagaatgcaagtaaacaggatgtcagatgttatccttagcctatttccctaaacatagctttttggctgcaaagtaaaatgccattcttctagcttctgcttatacacagtgatggctgacagcaggcataatcttcgtttgcttggcacgttgtcaccatgcaactcaacgtgttttgcaaggaatgatcgtgacacaccatctctgggagatactatgaggacatccggctatttcttggaagaattttctgtctaccttctttgagccctgttgtgccagcacatctccccatgaggctcagatctgtctgacctaagagccagttggcatcgtcctcctaacagaagccagattttcactggggctagactatttattgacagtgttttcccagactggcccatgagtgtctcatttccaaggtcccctgaagtgctggctcacctctgtttcccaaagcacttgcttgcttgtctctcctccctccccagcatccttttcactttcttcccttataacttcttgcactctgtgtgcgtgtgtgtgtatgcgtgtgtgcatgtgcgtttcttctttttttttatcctaacgaatttgttttgcaggttttgaaaaggaaaaaccagcgttatccaggattgttaaattaattcttatctgtttccacatcttggaccgtgatctctgtggttttaaaatcccatattttgagtgggttccgctgttgtttaagaaaagttgctttaaacctttgctctgcaagcacccgaagagaactcataaaaaggaagacaacagcagatgcaatcgcggatgtggcttagtccttgcagctgccccagagtgctgtttggagtgtaccgtcctcagtaatgaatccagaagaacaaatcgtgacatggcttatatctttgggagttttagagtcccctaaaaagaccatctgtgatccggaggagtttttaaagtcctcgctgaaaaatggggtagttctgtgcaaactgatcaacagactcatgcctggctctgtggaaaagttttgtctggatccccaaactgaagctgactgcatcaacaacatcaatgacttcctgaaaggatgtgcaaccctccaagtggaaatatttgatcctgatgacctttattcaggggtcaatttctccaaggtactgagtactcttttagctgtcaacaaagcaacagaagatcagctatcagaaagaccatgtggacgttcctcttctcttagtgctgctaatacttctcagacaaacccacagggagcagtttctagcacagtttcagggctgcaaaggcagtcaaagacagtggagatgacggaaaatggaagtcatcagttgatagtaaaagcaagattcaactttaagcagactaatgaggatgaactgtcagtttgtaagggggacatcatttacgtcacacgagttgaagaaggaggctggtgggaaggcacattaaatgggagaacaggctggttccccagtaattatgtccgtgaaattaaatccagtgagagacctctctccccaaaagccgtcaaaggatttgaaactgctccacttaccaagaattattatactgtggtgttacagaacatcctggacactgaaaaagaatatgctaaagaacttcagtctcttcttgttacttacttaagacccctgcagtccaataacaatctgagtactgtggaggttacatctttactgggaaacttcgaggaagtatgcacatttcaacagacactctgccaagccttggaagaatgttcaaagtttccagaaaaccagcacaaagtaggaggttgtctactgagtctcatgcctcattttaaatctatgtatctggcttactgtgcaaaccatccttcagctgtaaatgtgctcactcagcacagtgatgagttggaacaattcatggaaaatcaaggtgcatcgagcccaggtatcctcattttaacaacaaacctcagcaaaccattcatgcgactggagaaatatgttactctcttgcaagagttagaacggcatatggaggatactcatccagatcatcaggatattctgaaagcaatcgtagcattcaaaactctcatggggcaatgtcaagatctgaggaagagaaaacagctggagttacagatactgtccgaacctattcaggcatgggaaggagaagatattaaaaacttgggaaatgtgatttttatgtcacaagtaatggtgcagtatggagcatgtgaggaaaaagaggagcggtaccttatgttattttcaaatgtcctgataatgttatctgcaagtcctcggatgagtggctttatctatcagggaaaaataccaatagcaggaacggtggtgactagattagatgaaattgaagggaatgactgcacatttgaaatcactggtaacacagtggagagaattgtggtccattgtaacaacaaccaggacttccaggaatggttggagcagctgaacagactgatcagaggacctgcctcttgcagttcattatccaaaacctcatcgtcatcatgtagtgctcattcttcttttagctctaccggacagccccgaggacccttggagcctcctcaaattataaaaccgtggagtttaagttgtctacgacctgcacctccacttagaccatcagcagcactaggttataaagagaggatgtcttatatcttaaaggagtctagtaaaagccctaaaacgatgaagaaatttcttcataaaaggaagactgagagaaaaccatcggaggaggaatatgtgattaggaaaagtacagctgctctggaagaggatgctcaaatccttaaagtgatcgaagcctactgcaccagcgcaaattttcaacaaggccatggctcaagtactcgaaaagattccattccacaagtcctactccctgaggaagagaaactcatcattgaagaaaccagaagcaacggccagaccatcatggaagaaaagagccttgttgatactgtttacgccttgaaggacgaggtcagagaactgaagcaggaaaataaaagaatgaagcaatgcctggaagaagaactgaaatcaagaagggacctagaaaagctggtgcggaggcttttgaagcaaacagatgagtgtattcgaggcgagtccagtagcaagacctcaattcttccataaccatcactgtgccactgggtggagtgtgccttcagggcatcttgaaatgtcccgctgaatgatttgactcagtttgctcacttctttggcttttgttttgtgtttgagtctctctctctctctccctctctcttctctttctctccccgctgtgtgcatatgtgtgtgcgtgcacgtgcgcgcttgggcatttgctgttgtttggttattggttggttgttcattttttttttcaacaggtgaaaaagcaggaagtggtggtagagatggcctcagagtcttttccattcagtaagaaagagaaagggaatgcaggccagttacttaaaaggtcttcagattgccttcagttcacagtgcctctgcaacagccattgccctcaggtcacattctttgggctggctgcccttgcaaagcagctggccaaggcttattaaatgtgaacccaacttttccccagggctttcctgtacctgcaagcctcttagtacttaatttaccgaaggcaaatcttccagactatggcttgagtaggatgaaagacaaacacatctgcccaatgatccagctgcccttccttagaccatcacatgcctcccctcaatcacaggttttaaaattactgccctatgttgtctataagaccaagaaaactgtagtacccttattccttttgtgtcatgtaaattgtaactcaggggggcagaagctctggtcacccacaccaacaccaaatccatcagcaaattctactggacaatcctcccttttagtagcagagttgaccgccttttcccattgcatgataggtttctttccctcattctgcctagtgtgtaagttttctatttccccagtacttttagccaaccttaccaagtggtgtgtaaactagtatgtatgtgctttgcttactttttaaaaaaatgtagttagactgtgaggagttactttatgtacgttgcatattcaaactgtgatgttttatccttcaaaacaatctgcattaagaagatattgtgccctactagacagctttcattcactttattactctctcatatatgctgtgagaagttgtaatattaattggcctctttgggtgggactctaagcagtatttgcagaaatatgcttctggtccaacttgtacatccagaacaaaagggcccctctagtagctgtgtgctggattattcaggactgattaactcaagttgctcattgaatcacatcatccactttatcccagaaactagaactgtgagaaaccaggtttagaagacagtcacagaacagcacacatccaaattcagcgccattgaaagttggcctaaggctcagtgccactcacccctccctccccaaaagacaagagaaatttggccagatggggaaggtcactggaaattgaggccaaagggctgatcagaattgcctttataatatatttgatggatgcctataaatgtgggttttgcaaatattgtttaaaaaccaaacttgaagccaggcatggtggcccacacctgtggtcccagctactcaggaggctgaggtgggaggatcatttgagcccaggaggtcaaggctgcagtgagctgtgatgacaccactgcactccaacctaggtaacagagagacacctctgtctctgaaaaaacaaaacttgaagtttgaaacccccagcttgctgaggagccctttttatttttggtactgagagtctcaaggtcccatagctacatggtacagggctgttgtctgcttgctgcacagcagaaattacaccatccacaggaaatggactatttttgcagtccaacatcagccaaccacacacagccgtgtttggaagctgaagagtaaagaaatttctaggaatggctgttgttctgttttttagcacagccatttagatataacatccttcacttaaaaattaaaaacatcagtactaccaccaccaccaacaacatcaacacagatcttcacatctgcccattctgtggttagtcaatggcttgcaataaatgtgcaaactgcatctataggaaacatttttgtgattacggaatactttagttgattgctgaaaatattgaaaggtcttcattttacagtgatgagtacatatgcatgtttcggggacttggcccttctgatgaggggccctcggtactctggataacgaagcttgtgcagagtggtaaccatgcttacacactaaactataatataaaggaaatgaagccatgttaatctgagagcagtgtcgccatagttgtgttgtttacaatactctataaatgggttcctgttgccctgtaattaaactgctgcccgtagaggcctttcagttccttttctgtccttccccttcttaacacaagctcaaattttctaacttgtttttattttgaagacttttaaaatggacattttcaatacataaaaataaacagtgctttataaaaaaaaaaaaaaaaaaaaaaaaaaaaaaaaaaaaaaaaaaaaaanaaaaaaaaaaaagaaaacaaaaaaaaaaacaaaaaaaaaaaaaaaagaaaaagaaagcagagaagaaacaaagaagagaaaaatgagagcaccacgacagacccatgagacgcagaaaacacaccagcagagaagaaatgagggaaaaaacgaggcacgcaagagagagacacacaacgaaggaaaaaccacccagtagagaagaagcgaaagagaggaaccaaagagtcggagacacacaagaaagagggagaagaaggaagcaaacaagaacaaaaaaaaagcagacaacagcaggagacggacacaaaagaaggaaaacaaaaacgagcgcagacacaagccagcaccggaacagcagaagaaagagagaaaacacaagaacacaagagcaggaacaaaagagcaaaagcgaaaaaagaataacaaataaaaagaaaggaagggacaaataaaaaataagaggagtagggggtgagaataggacttaatagaagaagagagaagggatatgggagcagattagaaaacgaagaaaagaatagataggagagagagaggatagggaagggaggaagagatacagagggagtcagaacaggaagaggaaagacgagagaagataaagaataaagagagtgggacaaaaaagaggagaaagaaagaaggaagagaaaggaagagaacaggaagaaagagggagagggacaaaggagaaaaaacgaaaagaacagaaaaaggagaaggaggaggggagaaagacggaaaacaaagaaaacagcagaaagaggagggggaaaaggagaagaacagaaaagagagaaaaagggaggagaggggaaagaaatacagaaaggggaagcggaagcggcaaagacggaaacaaaagagggaggggaacagagagggaacggacgccagcgccgaagacaagcagcgacggagaagaaaaggaacaaacacaggcataaggggaggagaaaagcgagaagagaagaagaagagggcagagagaaacggagaaaaaagaggcacaagaaaaaaggaaacgaaatggaaacgatacacaaaggagggagcagagacgagaacccaggagaccagagaaaacgagagaagaagaaagacgacagaagaacaaacaaagaagaaaggagaacagaggaggggacagaagacggcagagaagtggagagcgacgaacggagatagagcagagagggagcacgagcagagggaagaaacggagagaaanaacaaagcaaaga

SEQ ID NO: 329508 - DNA, 2829 bp, Homo sapiens
attaaagttggccttatcataaatttcccaatagtatgcctatttcaagtggttctgaaaatgtttgagaatgatgaagatctcttgttatagacagtttttttttcagagcagtattttaagtgcaaagtgtttttttgttgttgttgttgttgggaaaataagaatcttccatattgtagtgtagacagaggacaagtgctcttttgttctcaaacattctattttttcaagtgtattttacccacttatgtgactgagtctgagcctttgctaagggtactgcagctggattatgtagtggaaccaggtccagaaaaagaattgctaaagaatgcaagtaaacaggatgtcagatgttatccttagcctatttccctaaacatagctttttggctgcaaagtaaaatgccattcttctagcttctgcttatacacagtgatggctgacagcaggcataatcttcgtttgcttggcacgttgtcaccatgcaactcaacgtgttttgcaaggaatgatcgtgacacaccatctctgggagatactatgaggacatccggctatttcttggaagaattttctgtctaccttctttgagccctgttgtgccagcacatctccccatgaggctcagatctgtctgacctaagagccagttggcatcgtcctcctaacagaagccagattttcactggggctagactatttattgacagtgttttcccagactggcccatgagtgtctcatttccaaggtcccctgaagtgctggctcacctctgtttcccaaagcacttgcttgcttgtctctcctccctccccagcatccttttcactttcttcccttataacttcttgcactctgtgtgcgtgtgtgtgtatgcgtgtgtgcatgtgcgtttcttctttttttttatcctaacgaatttgttttgcaggttttgaaaaggaaaaaccagcgttatccaggattgttaaattaattcttatctgtttccacatcttggaccgtgatctctgtggttttaaaatcccatattttgagtgggttccgctgttgtttaagaaaagttgctttaaacctttgctctgcaagcacccgaagagaactcataaaaaggaagacaacagcagatgcaatcgcggatgtggcttagtccttgcagctgccccagagtgctgtttggagtgtaccgtcctcagtaatgaatccagaagaacaaatcgtgacatggcttatatctttgggagttttagagtcccctaaaaagaccatctgtgatccggaggagtttttaaagtcctcgctgaaaaatggggtagttctgtgcaaactgatcaacagactcatgcctggctctgtggaaaagttttgtctggatccccaaactgaagctgactgcatcaacaacatcaatgacttcctgaaaggatgtgcaaccctccaagtggaaatatttgatcctgatgacctttattcaggggtcaatttctccaaggtactgagtactcttttagctgtcaacaaagcaacagaagatcagctatcagaaagaccatgtggacgttcctcttctcttagtgctgctaatacttctcagacaaacccacagggagcagtttctagcacagtttcagggctgcaaaggcagtcaaagacagtggagatgacggaaaatggaagtcatcagttgatagtaaaagcaagattcaactttaagcagactaatgaggatgaactgtcagtttgtaagggggacatcatttacgtcacacgagttgaagaaggaggctggtgggaaggcacattaaatgggagaacaggctggttccccagtaattatgtccgtgaaattaaatccagtggctggtctcaaactcctgggctccagcgatcctcctgccctggccttccaaagtgctgggattacagagatggagttccgctcttgttgctcgggctggagtgcaatggcgcgatctcagctcaccacacctctgtctctgaaaaaacaaaacttgaagtttgaaacccccagcttgctgaggagccctttttatttttggtactgagagtctcaaggtcccatagctacatggtacagggctgttgtctgcttgctgcacagcagaaattacaccatccacaggaaatggactatttttgcagtccaacatcagccaaccacacacagccgtgtttggaagctgaagagtaaagaaatttctaggaatggctgttgttctgttttttagcacagccatttagatataacatccttcacttaaaaattaaaaacatcagtactaccaccaccaccaacaacatcaacacagatcttcacatctgcccattctgtggttagtcaatggcttgcaataaatgtgcaaactgcatctataggaaacatttttgtgattacggaatactttagttgattgctgaaaatattgaaaggtcttcattttacagtgatgagtacatatgcatgtttcggggacttggcccttctgatgaggggccctcggtactctggataacgaagcttgtgcagagtggtaaccatgcttacacactaaactataatataaaggaaatgaagccatgttaatctgagagcagtgtcgccatagttgtgttgtttacaatactctataaatgggttcctgttgccctgtaattaaactgctgcccgtagaggcctttcagttccttttctgtccttccccttcttaacacaagctcaaattttctaacttgtttttattttgaagacttttaaaatggacattttcaatacataaaaataaacagtgctttataaaaa

SEQ ID NO: 329509 - DNA, 2293 bp, Homo sapiens
attaaagttggccttatcataaatttcccaatagtatgcctatttcaagtggttctgaaaatgtttgagaatgatgaagatctcttgttatagacagtttttttttcagagcagtattttaagtgcaaagtgtttttttgttgttgttgttgttgggaaaataagaatcttccatattgtagtgtagacagaggacaagtgctcttttgttctcaaacattctattttttcaagtgtattttacccacttatgtgactgagtctgagcctttgctaagggtactgcagctggattatgtagtggaaccaggtccagaaaaagaattgctaaagaatgcaagtaaacaggatgtcagatgttatccttagcctatttccctaaacatagctttttggctgcaaagtaaaatgccattcttctagcttctgcttatacacagtgatggctgacagcaggcataatcttcgtttgcttggcacgttgtcaccatgcaactcaacgtgttttgcaaggaatgatcgtgacacaccatctctgggagatactatgaggacatccggctatttcttggaagaattttctgtctaccttctttgagccctgttgtgccagcacatctccccatgaggctcagatctgtctgacctaagagccagttggcatcgtcctcctaacagaagccagattttcactggggctagactatttattgacagtgttttcccagactggcccatgagtgtctcatttccaaggtcccctgaagtgctggctcacctctgtttcccaaagcacttgcttgcttgtctctcctccctccccagcatccttttcactttcttcccttataacttcttgcactctgtgtgcgtgtgtgtgtatgcgtgtgtgcatgtgcgtttcttctttttttttatcctaacgaatttgttttgcaggttttgaaaaggaaaaaccagcgttatccaggattgttaaattaattcttatctgtttccacatcttggaccgtgatctctgtggttttaaaatcccatattttgagtgggttccgctgttgtttaagaaaagttgctttaaacctttgctctgcaagcacccgaagagaactcataaaaaggaagacaacagcagatgcaatcgcggatgtggcttagtccttgcagctgccccagagtgctgtttggagtgtaccgtcctcagtaatgaatccagaagaacaaatcgtgacatggcttatatctttgggagttttagagtcccctaaaaagaccatctgtgatccggaggagtttttaaagtcctcgctgaaaaatggggtagttctgtgcaaactgatcaacagactcatgcctggctctgtggaaaagttttgtctggatccccaaactgaagctgactgcatcaacaacatcaatgacttcctgaaaggatgtgcaaccctccaagtggaaatatttgatcctgatgacctttattcaggggtcaatttctccaaggtactgagtactcttttagctgtcaacaaagcaacagaagatcagctatcagaaagaccatgtggacgttcctcttctcttagtgctgctaatacttctcagacaaacccacagggagcagtttctagcacagtttcagggctgcaaaggcagtcaaagacagtggagatgacggaaaatggaagtcatcagttgatagtaaaagcaagattcaactttaagcagactaatgaggatgaactgtcagtttgtaagggggacatcatttacgtcacacgagttgaagaaggaggctggtgggaaggcacattaaatgggagaacaggctggttccccagtaattatgtccgtgaaattaaatccagtgagagacctctctccccaaaagccgtcaaaggatttgaaactgctccacttaccaagaattattatactgtggtgttacagaacatcctggacactgaaaaagaatatgctaaagaacttcagtctcttcttgttacttacttaagacccctgcagtccaataacaagtaagatgtttattttaaatccctcactaagtaaagcaacataatgtcaacatatggaatcattattcttatgtcactgaataattgattttgccctttagaagaatttccacagatcacaggttgccaagaacatggtcagggcaacagaaattatgcaagatattgcttttggagagcttggctttctttctcttctggctgtgaaaggaatgagcagatctgtgtttcttcctgtcacaatttttatcttgtacatt

SEQ ID NO: 329510 - DNA, 572 bp, Homo sapiens
agttctttacccgttgtagagcccttaggtcccacactggggtcccccaggacaccaggccccctgcgtagaatttggtcttgtcattgggatcctggtacagcaaaggccccaacactggcgccgtgacagctatccatgcccttcgtcgtccttcagcacagatcatctttaggagtgtaaacataggcctccgcatcttctgtgggtttctccacctgcacttctgtgcattgtcttaaaggagctacagtttaccttagatgggaatgtgagtgtggccaccacttgattcagatgtgttcatattgcatttctacatcttggccgctaagcacatgtgcccttcatcttatatatacgtttctgaagatgcttctgtttatactattccaactcttactgaagcagcagtgttagaatgtcagccagatgctatagtctgaagtaatgtcatgagaccgttttagaaatttacctgccactttcacaagcccaggaggcggaggcaggagtattgctgagcccaggagttgaagactgcaatgagctatgatcgcgtcactgcaccc

SEQ ID NO: 329511 - DNA, 2070 bp, Homo sapiens
  misc_feature (2048)..(2048): n is a, c, g, or t
gttgttgccaggggccgggggagggggaaaagggtcattgtttaatgggaatagagtttcagttttgcaagatgaaaaagttctggagattggttgcacaaaaatgtgaatatacttaatactactgaactgtatatacttaaagtggataaaatggtaagaaaaatagagcaacaatatttcactaagtaggcagtttacactgaatatccttggggacatcagaatatccttgagaatattaaaatacagcatcttcaaacaaaagtaagttaaaggactatctttgatgcagcctcccagttctctatatcagggtccagcaaactggcccaagagccaaatctggccaaccgcttgtttttatacagtctgtgagcaaagactgttgtttacattttttaattgttgaaaaaaaatcagaattataaaacttaattacatcaaaattacaagaaattcaagtgtcagtgtccataaataaagttttattggaacacagtcacattcattcatttttttttttattttgagacggagttttgctcttgttggccatgctggagtgcaatggtgtgatcttggctcaccgcaacctccgcctcccgggttcaagtgattctcctgcctcagcctcccaagtagctgggattagaggcatgcgccaccacgcccggctaattttgtatttttagtagagacagggtttctccatgtcggtcaggctggtctcgaactcctgacctcaggtgatccacctgccttggccttccaaagtgctgggattacaggcatgagccaccgcacccggcctcatactcattcttatgtgtgtcatgtatcgctgcttttatgctacagtagcagaatggagtaattgggacagagaccatatagcctacaaatcctaaaatatttgctgcttggccattaataaaacatttaaagtcagactattacaaaagttgccaggtccctcacagcatcatctttgatagctttaaatgcctaattggcagccttgtcatggactagtagggactattatcattctgttctcttatgtttggtggggattcttatttccttactccctactgtgacactttaaccagttccagaaaactcattcttggtgagcttcagttgtggctgaaatccctttagcaatttctataggctcttgtattgttaagaaccagacatctcttgggccagccaagcaattgggaccacctaagcaatttggaccacccatggctgggcttggtcagcctctaagatggacagggatctcataagaattcaagtaaggaatttgagtaaagacaattaaaatttaaagaaaaattttaattcagtttcctgagtttggaaattagttccaagacagatctgggaatgtcagcgcaagagtttgtgtcatccatcctagtataccacctttaacattttttaattcctctgtgtgtttgttcagtgccttcctcattgttgactcaacctttactttacctcctagcttagtctgcattctgcttccccttcaattttcagctattcataattaaatgttgcttgttgccccagtgtatgagatagtgcccaaaggtatttatttcatgttttccagctttcttgcatttcacagattctatttattttgcatttcatagactttattccttagtgtaagaatttcagtggcataactctgccctgcttgggagtcactttttgaatcttttaatgatatataatggcacttggaaagtgtcccccacacctgatactttctgctttggactacaaggcagatcgtattctaaaaatcattgctgtctaggactgcttcccagaactatgttctccagaactataggtggaacagtttaccttagatgggaatgtgagtgtggccaccacttgattcagatgtgttcatattgcatttctacatcttggccgctaagcacatgtgcccttcatcttatatatacgtttctgaagatgcatgaataggtccccccaacctggacctttggaanaaataaaactttatttaatcca

SEQ ID NO: 329512 - DNA, 2210 bp, Homo sapiens
gttgttgccaggggccgggggagggggaaaagggtcattgtttaatgggaatagagtttcagttttgcaagatgaaaaagttctggagattggttgcacaaaaatgtgaatatacttaatactactgaactgtatatacttaaagtggataaaatggtaagaaaaatagagcaacaatatttcactaagtaggcagtttacactgaatatccttggggacatcagaatatccttgagaatattaaaatacagcatcttcaaacaaaagtaagttaaaggactatctttgatgcagcctcccagttctctatatcagggtccagcaaactggcccaagagccaaatctggccaaccgcttgtttttatacagtctgtgagcaaagactgttgtttacattttttaattgttgaaaaaaaatcagaattataaaacttaattacatcaaaattacaagaaattcaagtgtcagtgtccataaataaagttttattggaacacagtcacattcattcatttttttttttattttgagacggagttttgctcttgttggccatgctggagtgcaatggtgtgatcttggctcaccgcaacctccgcctcccgggttcaagtgattctcctgcctcagcctcccaagtagctgggattagaggcatgcgccaccacgcccggctaattttgtatttttagtagagacagggtttctccatgtcggtcaggctggtctcgaactcctgacctcaggtgatccacctgccttggccttccaaagtgctgggattacaggcatgagccaccgcacccggcctcatactcattcttatgtgtgtcatgtatcgctgcttttatgctacagtagcagaatggagtaattgggacagagaccatatagcctacaaatcctaaaatatttgctgcttggccattaataaaacatttaaagtcagactattacaaaagttgccaggtccctcacagcatcatctttgatagctttaaatgcctaattggcagccttgtcatggactagtagggactattatcattctgttctcttatgtttggtggggattcttatttccttactccctactgtgacactttaaccagttccagaaaactcattcttggtgagcttcagttgtggctgaaatccctttagcaatttctataggctcttgtattgttaagaaccagacatctcttgggccagccaagcaattgggaccacctaagcaatttggaccacccatggctgggcttggtcagcctctaagatggacagggatctcataagaattcaagtaaggaatttgagtaaagacaattaaaatttaaagaaaaattttaattcagtttcctgagtttggaaattagttccaagacagatctgggaatgtcagcgcaagagtttgtgtcatccatcctagtataccacctttaacattttttaattcctctgtgtgtttgttcagtgccttcctcattgttgactcaacctttactttacctcctagcttagtctgcattctgcttccccttcaattttcagctattcataattaaatgttgcttgttgccccagtgtatgagatagtgcccaaaggtatttatttcatgttttccagctttcttgcatttcacagattctatttattttgcatttcatagactttattccttagtgtaagaatttcagtggcataactctgccctgcttgggagtcactttttgaatcttttaatgatatataatggcacttggaaagtgtcccccacacctgatactttctgctttggactacaaggcagatcgtattctaaaaatcattgctgtctaggactgcttcccagaactatgttctccagaactataggtggaacagtttaccttagatgggaatgtgagtgtggccaccacttgattcagatgtgttcatattgcatttctacatcttggccgctaagcacatgtgcccttcatcttatatatacgtttctgaagatgcttctgtttatactattccaactcttactgaagcagcagtgttagaatgtcagccagatgctatagtctgaagtaatgtcatgagaccgttttagaaatttacctgccactttcacaagcccaggaggcggaggcaggagtattgctgagcccaggagttgaagactgcaatgagctatgatcgcgtcactgcaccc

SEQ ID NO: 329513 - DNA, 407 bp, Homo sapiens
tccccaagcagagtttagttcagccttttattgctccattaataaataccaacagatagctgagatatttggcatttaaggaaagcctccaacaaggagagatggagagacagagagagggagaagaaaaagaaagcagaaggaaaaaggaagaaggattaaagaagagggaagaagaagaacaagaggaagaggaggaggaagaagaagaagaagaagaaggatgacgacaacgacaacaacaacaacaacaagaagcagccaccaccgccgctgccacctccaggtagaaacaaaaacaaaatagagactagaagactattaagacaaatggacaaatgaaaaataaatagtgcctcaagaagaataggatggagatagtatatgcataaaaaagaatgtggtat

SEQ ID NO: 329514 - DNA, 2409 bp, Homo sapiens
atacttacctggcaggggagataccatgatcacgaaggtggttttcccagggcgaggcttatccattgcactccggatgtgctgacccctgcgatttccccaaatgtgggaaactcgactgcataatttgtggtagtgggggactgcgttcgcgctttccttcccaggcctcggggccgggaggcggagagtcaagtgaagtgccaatgtgaaatttcgggaacacctttctcaaatggggagaagctgaggcctcacagcctcccgcaaccagagcagagaccatatagctgccctcagctgcactgtggcaaggcttttgcttccaaatacaagctgtataggcacatggccacccactcagcccagaaaccccaccagtgtatgtactgtgataagatgtttcaccgcaaggaccatctgcggaaccatctgcagacccatgatcctaacaaagaggccctccactgctctgagtgcggtaagaattacaatacgaagctgggctaccggcgccacctggccatgcatgctgccagcagcggtgacctcagctgcaaggtgtgcctgcagacctttgagagtacccaggccctgctagagcacctgaaggcccactcacgccgggtagcaggcggtgccaaggagaagaagcacccctgtgaccactgcgaccggcggttctatactcgtaaggatgtacggcggcacctagtggtgcacacaggccgtaaggacttcctgtgccagtactgtgcccagcggtttggccgtaaggaccacctgacgcgtcatgtcaagaagagccactcgcaggagctgctcaagatcaagacagagcccgtggacatgttaggcctactcagctgcagctccacagtcagtgtgaaggaagagctgagccctgtgctgtgcatggcctctcgggacgtaatggggaccaaggccttccctggcatgttgcccatgggcatgtatggtgcccacatccctaccatgcccagcacgggcgtgccacactccctggtgcacaacacgctgcccatgggtatgagctaccctctggaatcctcacctatctcttccccagctcagctccctccaaaataccagcttggatctacctcatacttgcccgacaaattgcccaaagtggaggtggatagttttctggcggagcttcctggaagcctgtctctctcatccgctgaaccccagcccgcctcacctcagccggcggcagctgcggccctcctagatgaagcactgcttgccaagagccccgccaacctctctgaggccctctgcgctgctaatgtggacttctcccacctactgggctttcttccactcaacctgcccccgtgtaacccacctggggccacaggaggcctggtcatgggctactcccaggctgaggcacagcccctgcttaccactttgcaagctcagcctcaagattccccaggagctgggggaccactgaactttgggcctctgcactccttgcctcctgtcttcacgtctggcctgagtagcaccaccctgcctcgtttccatcaagcattccagtagcccccacagaggccctcagctcagtttttggctctgttatggagccttagtacccaccccgtctgtgtcccccatgaaggcagctgagctttcagagctgggttcaaaaaaaaaaattccagtgtctgtatacaggagcacttggtttgggggttcaggctctaggatcgattccagaaggagccttgagccccaaccccgtgaaaagatctcataccgtaggacttcaggtattatttacttttatttttttgacctgaatcgggagccacacttggccctcttcctctccaaagcgccagaacctccttctctttggagaatggggaggcctcttggagacacagagggtttcaccttggatgacctctagagaaattgcccaagaagcccaccttctggtcccaacctgcagaccccacagcagtcagttggtcaggccctgctgtagaaggtcacttggctccattgcctgcttccaaccaatgggcaggagagaaggcctttatttctcgcccacccattcctcctgtaccagcacctccgttttcagtcagtgttgtccagcaacggtaccgtttacacagtcacctcagacacaccatttcacctcccttgccaagctgttagccttagagtgattgcagtgaacactgtttacacaccgtgaatccattcccatcagtccattccagttggcaccagcctgaaccatttggtacctggtgttaactggagtcctgtttacaaggtggagtcggggcttgctgacttctcttcatttgaggtcacatttttcccccgtggggaaataaactgactttggactgcttc

SEQ ID NO: 329515 - DNA, 6060 bp, Homo sapiens
atcagagagcagcaggcatcatggcccataacaggggacggacagactggggagaaatatgtctcagtttcagctttcaaagaggaccatacagagtttttagcaagcattcctgtttgggatatggagccctaataatacaagagagtataggaaagtggctctctgcttaagagagaactctggcccaggagatggtgcctggagggaggtaaagtaaggggctctttaaaggggatgtgccgagggttagttgtgagggaaaaggggaagactgcattctgggggagatgttgggaaaggaaggaaactcactctgaggcctgagaagtaacattaaagaggaaaaaaagaagtactattcaggcctcatgcggaaaaagaggcagacacagccgagacctcagagaaggcactgcatgtattcagagcacacattttgtatcagccactttcaagagtattatttcatttaatcctctatacgaatcttacaggtgaagagattgttttctgaaagctgcgttggaggctgtgacagagctgagagcctgtgtggagcggatggggaggctttctcaataacatggccctttgccattagccttgccatgaccacatttttcaccagcgtccccccctggattcaagatgcaaagcaggaggaggaagtgggctggaaactagttcccaggcctcggggccgggaggcggagagtcaagtgaagtgccaatgtgaaatttcgggaacacctttctcaaatggggagaagctgaggcctcacagcctcccgcaaccagagcagagaccatatagctgccctcagctgcactgtggcaaggcttttgcttccaaatacaagctgtataggcacatggccacccactcagcccagaaaccccaccagtgtatgtactgtgataagatgtttcaccgcaaggaccatctgcggaaccatctgcagacccatgatcctaacaaagaggccctccactgctctgagtgcggtaagaattacaatacgaagctgggctaccggcgccacctggccatgcatgctgccagcagcggtgacctcagctgcaaggtgtgcctgcagacctttgagagtacccaggccctgctagagcacctgaaggcccactcacgccgggtagcaggcggtgccaaggagaagaagcacccctgtgaccactgcgaccggcggttctatactcgtaaggatgtacggcggcacctagtggtgcacacaggccgtaaggacttcctgtgccagtactgtgcccagcggtttggccgtaaggaccacctgacgcgtcatgtcaagaagagccactcgcaggagctgctcaagatcaagacagagcccgtggacatgttaggcctactcagctgcagctccacagtcagtgtgaaggaagagctgagccctgtgctgtgcatggcctctcgggacgtaatggggaccaaggccttccctggcatgttgcccatgggcatgtatggtgcccacatccctaccatgcccagcacgggcgtgccacactccctggtgcacaacacgctgcccatgggtatgagctaccctctggaatcctcacctatctcttccccagctcagctccctccaaaataccagcttggatctacctcatacttgcccgacaaattgcccaaagtggaggtggatagttttctggcggagcttcctggaagcctgtctctctcatccgctgaaccccagcccgcctcacctcagccggcggcagctgcggccctcctagatgaagcactgcttgccaagagccccgccaacctctctgaggccctctgcgctgctaatgtggacttctcccacctactgggctttcttccactcaacctgcccccgtgtaacccacctggggccacaggaggcctggtcatgggctactcccaggctgaggcacagcccctgcttaccactttgcaagctcagcctcaagattccccaggagctgggggaccactgaactttgggcctctgcactccttgcctcctgtcttcacgtctggcctgagtagcaccaccctgcctcgtttccatcaagcattccagtagcccccacagaggccctcagctcagtttttggctctgttatggagccttagtacccaccccgtctgtgtcccccatgaaggcagctgagctttcagagctgggttcaaaaaaaaaaattccagtgtctgtatacaggagcacttggtttgggggttcaggctctaggatcgattccagaaggagccttgagccccaaccccgtgaaaagatctcataccgtaggacttcaggtattatttacttttatttttttgacctgaatcgggagccacacttggccctcttcctctccaaagcgccagaacctccttctctttggagaatggggaggcctcttggagacacagagggtttcaccttggatgacctctagagaaattgcccaagaagcccaccttctggtcccaacctgcagaccccacagcagtcagttggtcaggccctgctgtagaaggtcacttggctccattgcctgcttccaaccaatgggcaggagagaaggcctttatttctcgcccacccattcctcctgtaccagcacctccgttttcagtcagtgttgtccagcaacggtaccgtttacacagtcacctcagacacaccatttcacctcccttgccaagctgttagccttagagtgattgcagtgaacactgtttacacaccgtgaatccattcccatcagtccattccagttggcaccagcctgaaccatttggtacctggtgttaactggagtcctgtttacaaggtggagtcggggcttgctgacttctcttcatttgaggtcacatttttcccccgtggggaaataaactgactttggactgcttcagtctctgccatcttccatgactgcatttgttcctgcctgcctcggcggtatccacagaagacaggcaagaggattggagcagttttctcacaggtctgcaattctgtttttctccaagtacattatgaccccctcatccttctcttgaactggagaggggaagaaatgaaaggcatgcccacgtccgtcacctccccatcccctagtccccaccttgaacatcatgagctgttgttattagtcttggaagcagagtctgggttggtgtggatagcaaaggaggaagtctgagcccctcattggtcttcctcccacctgtcccttttccgggaagttgtggaattgttggaagaagagtttgcagaaggttaggaatgggtagatagctaagtcctaatctatgggtacattgttgtgtcccaaaccaaaattttccttatccacaatgtcccttctgtctcttccactttacagtggactcggccactgtgcataggcttctctgctctccatcaaatcacttccactttcctgtgcccccacccccgcctccagttttccgctagtatccggcaaggtttcttgcaacaaatgattagttcttttcttctgactcgtggggctccctgctgcagagagcacagcccttgcctggagcccaggaaccccatccttgcttcatctcagttcttcatgggcttcactcttcccactcacggaagggaggtagctcagggacctccactgtgggacccttgagacgcttccactctgattcagaaacacacttctacctctttactgttaactcttaacagatgcagtcagcagtttctgggcacttctctcagtaggtgcctcatgctgacttctccagtagggtttcaggacaaactaccaaggaattgcctcagcctcctaccagtcctccctcacccaccttctgtctaggttcacttggtttgtcatcaggaactgagcaggtccaggactcagctttctgcttcagcctaagccagtactccttgtttgaggtaaaagccttaaaatttagctccctagctcttgattagaagcaatttggagtaagtgtgttttgatttaggcagggtagcttgggatacctttttaaaaacaccagatattaaaatgtctggcaaggttagaatcagactagatgatttgcttctaaaaattagtttcagtgagtcccagggactaattaaggtttattttaaaaagtgtctaccttggtacgcagccacctcctgcatgctgtgcatgttattgggacttgtattataggcgatggtatgtgagaatccagttgggactcgctgttgccatcctctttgttgtatctggttttcatcactagactcagcaacccttctcaccttaactgccaccttccctacactctcagtttacagaggccactgggcctctggctgcagaatacaaagtcccgggctgttagaggagtcctttcctctctgcctgccctttcctgtccctccctcgaattctctctccccgtaagtgatgctggaaaagtcataggactggcaaagcaactgtttaaaccctttgtaaccggggccttgcccccacctcctgtcttttctccttgccttccccactcctgtgtcctcccatctatcctgtctttcctttcctcctctcagtgtcctcagcacccacaaggaattttcctatcactgtgaactttgctggtacagaggaataatatctgccttcacctttttttttttggaccatagctagccagtcatttcttaaacctcccttcctaaaatctggggggtcggggggaaagaaaaaaaaagccttagtggcctggttgttcaaaggataagaatagctttatcctgcactcagtacccgaactcacttcagtatgcttactgaggccatgagaacctgaggggcatctgcccaggacaggagccatggcatatgacaaagaccaatgagggaccaggaaaaaaagtgatgtcccctttccctgccacctccagcctctgccagcaatgagctgtccccctcccaccctacacagtagctggtcagggctgagtacagtcctgggggtaaggggatgacatgcccaggtgtcagctcaaaggatctctgcatcatcttgaggtgggaggcagggaaaggagcgccaatgaggttccctgcaacccccgccctccagcccaccgcccaaccttttacaaatggcattttcttaattgaaaatccgggaagcaggtgtgattacttttttgctcgtagatattgtcctaagttggaattctcccactgccctaaaactttccctagtagtcctttaaactcccccctccctttttggtagctgttttctccgtcctctctccacctgccctcttatctaggagctgtttgtaagcacgatttttttaacaggttatattgtacaggatcaatattttgctttttaacaaggatatttatgtaataagaaactttgccttaggcaggtgttggccagaaaagtccagattcctctgggatcccaccctggcctctcctggaactctgaacctgctgtggaaggaattggccatgaccttcacctctggagagtagggtctatggcgagggaaaagggtgttcaccatgataacctagtgcctccatagaggggtttggaaaaattccagtccgatttctttgtgtgtcagctgacttccttagctgattgttcccacttgcacctctccacctttggcactagaactcctgagacaccacttctcatgcttctccctccctaccagcggtcaaggctttggagccactcttttgtaactccagattatttaaagagaaaagtacaagacagaaatcttctagcactttgtaaacacagtgaataacctcttggagtatttttggctttatataaaacaaggtttttaattgtaaagtataagtgccattagaaaatgcacagggcatatctttgttaaagtagatttttcaatgttttacagaattacattttcaaaaaaaggtttttataatgaagttgtttattaaaaacttctgaatgatgtgttaaaaaaaaat

SEQ ID NO: 329516 - DNA, 5599 bp, Homo sapiens
caatggcccgaccgccgccactaccggggcctgagggggcctggcggagcccgagcgcggcccggcccgcagcgtggggccccgagcgcggtgaagagattgttttctgaaagctgcgttggaggctgtgacagagctgagagcctgtgtggagcggatggggaggctttctcaataacatggccctttgccattagccttgccatgaccacatttttcaccagcgtccccccctggattcaagatgcaaagcaggaggaggaagtgggctggaaactagttcccaggcctcggggccgggaggcggagagtcaagtgaagtgccaatgtgaaatttcgggaacacctttctcaaatggggagaagctgaggcctcacagcctcccgcaaccagagcagagaccatatagctgccctcagctgcactgtggcaaggcttttgcttccaaatacaagctgtataggcacatggccacccactcagcccagaaaccccaccagtgtatgtactgtgataagatgtttcaccgcaaggaccatctgcggaaccatctgcagacccatgatcctaacaaagaggccctccactgctctgagtgcggtaagaattacaatacgaagctgggctaccggcgccacctggccatgcatgctgccagcagcggtgacctcagctgcaaggtgtgcctgcagacctttgagagtacccaggccctgctagagcacctgaaggcccactcacgccgggtagcaggcggtgccaaggagaagaagcacccctgtgaccactgcgaccggcggttctatactcgtaaggatgtacggcggcacctagtggtgcacacaggccgtaaggacttcctgtgccagtactgtgcccagcggtttggccgtaaggaccacctgacgcgtcatgtcaagaagagccactcgcaggagctgctcaagatcaagacagagcccgtggacatgttaggcctactcagctgcagctccacagtcagtgtgaaggaagagctgagccctgtgctgtgcatggcctctcgggacgtaatggggaccaaggccttccctggcatgttgcccatgggcatgtatggtgcccacatccctaccatgcccagcacgggcgtgccacactccctggtgcacaacacgctgcccatgggtatgagctaccctctggaatcctcacctatctcttccccagctcagctccctccaaaataccagcttggatctacctcatacttgcccgacaaattgcccaaagtggaggtggatagttttctggcggagcttcctggaagcctgtctctctcatccgctgaaccccagcccgcctcacctcagccggcggcagctgcggccctcctagatgaagcactgcttgccaagagccccgccaacctctctgaggccctctgcgctgctaatgtggacttctcccacctactgggctttcttccactcaacctgcccccgtgtaacccacctggggccacaggaggcctggtcatgggctactcccaggctgaggcacagcccctgcttaccactttgcaagctcagcctcaagattccccaggagctgggggaccactgaactttgggcctctgcactccttgcctcctgtcttcacgtctggcctgagtagcaccaccctgcctcgtttccatcaagcattccagtagcccccacagaggccctcagctcagtttttggctctgttatggagccttagtacccaccccgtctgtgtcccccatgaaggcagctgagctttcagagctgggttcaaaaaaaaaaattccagtgtctgtatacaggagcacttggtttgggggttcaggctctaggatcgattccagaaggagccttgagccccaaccccgtgaaaagatctcataccgtaggacttcaggtattatttacttttatttttttgacctgaatcgggagccacacttggccctcttcctctccaaagcgccagaacctccttctctttggagaatggggaggcctcttggagacacagagggtttcaccttggatgacctctagagaaattgcccaagaagcccaccttctggtcccaacctgcagaccccacagcagtcagttggtcaggccctgctgtagaaggtcacttggctccattgcctgcttccaaccaatgggcaggagagaaggcctttatttctcgcccacccattcctcctgtaccagcacctccgttttcagtcagtgttgtccagcaacggtaccgtttacacagtcacctcagacacaccatttcacctcccttgccaagctgttagccttagagtgattgcagtgaacactgtttacacaccgtgaatccattcccatcagtccattccagttggcaccagcctgaaccatttggtacctggtgttaactggagtcctgtttacaaggtggagtcggggcttgctgacttctcttcatttgaggtcacatttttcccccgtggggaaataaactgactttggactgcttcagtctctgccatcttccatgactgcatttgttcctgcctgcctcggcggtatccacagaagacaggcaagaggattggagcagttttctcacaggtctgcaattctgtttttctccaagtacattatgaccccctcatccttctcttgaactggagaggggaagaaatgaaaggcatgcccacgtccgtcacctccccatcccctagtccccaccttgaacatcatgagctgttgttattagtcttggaagcagagtctgggttggtgtggatagcaaaggaggaagtctgagcccctcattggtcttcctcccacctgtcccttttccgggaagttgtggaattgttggaagaagagtttgcagaaggttaggaatgggtagatagctaagtcctaatctatgggtacattgttgtgtcccaaaccaaaattttccttatccacaatgtcccttctgtctcttccactttacagtggactcggccactgtgcataggcttctctgctctccatcaaatcacttccactttcctgtgcccccacccccgcctccagttttccgctagtatccggcaaggtttcttgcaacaaatgattagttcttttcttctgactcgtggggctccctgctgcagagagcacagcccttgcctggagcccaggaaccccatccttgcttcatctcagttcttcatgggcttcactcttcccactcacggaagggaggtagctcagggacctccactgtgggacccttgagacgcttccactctgattcagaaacacacttctacctctttactgttaactcttaacagatgcagtcagcagtttctgggcacttctctcagtaggtgcctcatgctgacttctccagtagggtttcaggacaaactaccaaggaattgcctcagcctcctaccagtcctccctcacccaccttctgtctaggttcacttggtttgtcatcaggaactgagcaggtccaggactcagctttctgcttcagcctaagccagtactccttgtttgaggtaaaagccttaaaatttagctccctagctcttgattagaagcaatttggagtaagtgtgttttgatttaggcagggtagcttgggatacctttttaaaaacaccagatattaaaatgtctggcaaggttagaatcagactagatgatttgcttctaaaaattagtttcagtgagtcccagggactaattaaggtttattttaaaaagtgtctaccttggtacgcagccacctcctgcatgctgtgcatgttattgggacttgtattataggcgatggtatgtgagaatccagttgggactcgctgttgccatcctctttgttgtatctggttttcatcactagactcagcaacccttctcaccttaactgccaccttccctacactctcagtttacagaggccactgggcctctggctgcagaatacaaagtcccgggctgttagaggagtcctttcctctctgcctgccctttcctgtccctccctcgaattctctctccccgtaagtgatgctggaaaagtcataggactggcaaagcaactgtttaaaccctttgtaaccggggccttgcccccacctcctgtcttttctccttgccttccccactcctgtgtcctcccatctatcctgtctttcctttcctcctctcagtgtcctcagcacccacaaggaattttcctatcactgtgaactttgctggtacagaggaataatatctgccttcacctttttttttttggaccatagctagccagtcatttcttaaacctcccttcctaaaatctggggggtcggggggaaagaaaaaaaaagccttagtggcctggttgttcaaaggataagaatagctttatcctgcactcagtacccgaactcacttcagtatgcttactgaggccatgagaacctgaggggcatctgcccaggacaggagccatggcatatgacaaagaccaatgagggaccaggaaaaaaagtgatgtcccctttccctgccacctccagcctctgccagcaatgagctgtccccctcccaccctacacagtagctggtcagggctgagtacagtcctgggggtaaggggatgacatgcccaggtgtcagctcaaaggatctctgcatcatcttgaggtgggaggcagggaaaggagcgccaatgaggttccctgcaacccccgccctccagcccaccgcccaaccttttacaaatggcattttcttaattgaaaatccgggaagcaggtgtgattacttttttgctcgtagatattgtcctaagttggaattctcccactgccctaaaactttccctagtagtcctttaaactcccccctccctttttggtagctgttttctccgtcctctctccacctgccctcttatctaggagctgtttgtaagcacgatttttttaacaggttatattgtacaggatcaatattttgctttttaacaaggatatttatgtaataagaaactttgccttaggcaggtgttggccagaaaagtccagattcctctgggatcccaccctggcctctcctggaactctgaacctgctgtggaaggaattggccatgaccttcacctctggagagtagggtctatggcgagggaaaagggtgttcaccatgataacctagtgcctccatagaggggtttggaaaaattccagtccgatttctttgtgtgtcagctgacttccttagctgattgttcccacttgcacctctccacctttggcactagaactcctgagacaccagtaactccagattatttaaagagaaaagtacaagacagaaatcttctagcactttgtaaacacagtgaataacctcttggagtatttttggctttatataaaacaaggtttttaattgtaaagtataagtgccattagaaaatgcacagggcatatctttgttaaagtagatttttcaatgttttacagaattacattttcaaaaaaaggtttttataatgaagttgtttattaaaaacttctgaatgatgtgttaaaaaaaaat

SEQ ID NO: 329517 - DNA, 5653 bp, Homo sapiens
caatggcccgaccgccgccactaccggggcctgagggggcctggcggagcccgagcgcggcccggcccgcagcgtggggccccgagcgcggtgaagagattgttttctgaaagctgcgttggaggctgtgacagagctgagagcctgtgtggagcggatggggaggctttctcaataacatggccctttgccattagccttgccatgaccacatttttcaccagcgtccccccctggattcaagatgcaaagcaggaggaggaagtgggctggaaactagttcccaggcctcggggccgggaggcggagagtcaagtgaagtgccaatgtgaaatttcgggaacacctttctcaaatggggagaagctgaggcctcacagcctcccgcaaccagagcagagaccatatagctgccctcagctgcactgtggcaaggcttttgcttccaaatacaagctgtataggcacatggccacccactcagcccagaaaccccaccagtgtatgtactgtgataagatgtttcaccgcaaggaccatctgcggaaccatctgcagacccatgatcctaacaaagaggccctccactgctctgagtgcggtaagaattacaatacgaagctgggctaccggcgccacctggccatgcatgctgccagcagcggtgacctcagctgcaaggtgtgcctgcagacctttgagagtacccaggccctgctagagcacctgaaggcccactcacgccgggtagcaggcggtgccaaggagaagaagcacccctgtgaccactgcgaccggcggttctatactcgtaaggatgtacggcggcacctagtggtgcacacaggccgtaaggacttcctgtgccagtactgtgcccagcggtttggccgtaaggaccacctgacgcgtcatgtcaagaagagccactcgcaggagctgctcaagatcaagacagagcccgtggacatgttaggcctactcagctgcagctccacagtcagtgtgaaggaagagctgagccctgtgctgtgcatggcctctcgggacgtaatggggaccaaggccttccctggcatgttgcccatgggcatgtatggtgcccacatccctaccatgcccagcacgggcgtgccacactccctggtgcacaacacgctgcccatgggtatgagctaccctctggaatcctcacctatctcttccccagctcagctccctccaaaataccagcttggatctacctcatacttgcccgacaaattgcccaaagtggaggtggatagttttctggcggagcttcctggaagcctgtctctctcatccgctgaaccccagcccgcctcacctcagccggcggcagctgcggccctcctagatgaagcactgcttgccaagagccccgccaacctctctgaggccctctgcgctgctaatgtggacttctcccacctactgggctttcttccactcaacctgcccccgtgtaacccacctggggccacaggaggcctggtcatgggctactcccaggctgaggcacagcccctgcttaccactttgcaagctcagcctcaagattccccaggagctgggggaccactgaactttgggcctctgcactccttgcctcctgtcttcacgtctggcctgagtagcaccaccctgcctcgtttccatcaagcattccagtagcccccacagaggccctcagctcagtttttggctctgttatggagccttagtacccaccccgtctgtgtcccccatgaaggcagctgagctttcagagctgggttcaaaaaaaaaaattccagtgtctgtatacaggagcacttggtttgggggttcaggctctaggatcgattccagaaggagccttgagccccaaccccgtgaaaagatctcataccgtaggacttcaggtattatttacttttatttttttgacctgaatcgggagccacacttggccctcttcctctccaaagcgccagaacctccttctctttggagaatggggaggcctcttggagacacagagggtttcaccttggatgacctctagagaaattgcccaagaagcccaccttctggtcccaacctgcagaccccacagcagtcagttggtcaggccctgctgtagaaggtcacttggctccattgcctgcttccaaccaatgggcaggagagaaggcctttatttctcgcccacccattcctcctgtaccagcacctccgttttcagtcagtgttgtccagcaacggtaccgtttacacagtcacctcagacacaccatttcacctcccttgccaagctgttagccttagagtgattgcagtgaacactgtttacacaccgtgaatccattcccatcagtccattccagttggcaccagcctgaaccatttggtacctggtgttaactggagtcctgtttacaaggtggagtcggggcttgctgacttctcttcatttgaggtcacatttttcccccgtggggaaataaactgactttggactgcttcagtctctgccatcttccatgactgcatttgttcctgcctgcctcggcggtatccacagaagacaggcaagaggattggagcagttttctcacaggtctgcaattctgtttttctccaagtacattatgaccccctcatccttctcttgaactggagaggggaagaaatgaaaggcatgcccacgtccgtcacctccccatcccctagtccccaccttgaacatcatgagctgttgttattagtcttggaagcagagtctgggttggtgtggatagcaaaggaggaagtctgagcccctcattggtcttcctcccacctgtcccttttccgggaagttgtggaattgttggaagaagagtttgcagaaggttaggaatgggtagatagctaagtcctaatctatgggtacattgttgtgtcccaaaccaaaattttccttatccacaatgtcccttctgtctcttccactttacagtggactcggccactgtgcataggcttctctgctctccatcaaatcacttccactttcctgtgcccccacccccgcctccagttttccgctagtatccggcaaggtttcttgcaacaaatgattagttcttttcttctgactcgtggggctccctgctgcagagagcacagcccttgcctggagcccaggaaccccatccttgcttcatctcagttcttcatgggcttcactcttcccactcacggaagggaggtagctcagggacctccactgtgggacccttgagacgcttccactctgattcagaaacacacttctacctctttactgttaactcttaacagatgcagtcagcagtttctgggcacttctctcagtaggtgcctcatgctgacttctccagtagggtttcaggacaaactaccaaggaattgcctcagcctcctaccagtcctccctcacccaccttctgtctaggttcacttggtttgtcatcaggaactgagcaggtccaggactcagctttctgcttcagcctaagccagtactccttgtttgaggtaaaagccttaaaatttagctccctagctcttgattagaagcaatttggagtaagtgtgttttgatttaggcagggtagcttgggatacctttttaaaaacaccagatattaaaatgtctggcaaggttagaatcagactagatgatttgcttctaaaaattagtttcagtgagtcccagggactaattaaggtttattttaaaaagtgtctaccttggtacgcagccacctcctgcatgctgtgcatgttattgggacttgtattataggcgatggtatgtgagaatccagttgggactcgctgttgccatcctctttgttgtatctggttttcatcactagactcagcaacccttctcaccttaactgccaccttccctacactctcagtttacagaggccactgggcctctggctgcagaatacaaagtcccgggctgttagaggagtcctttcctctctgcctgccctttcctgtccctccctcgaattctctctccccgtaagtgatgctggaaaagtcataggactggcaaagcaactgtttaaaccctttgtaaccggggccttgcccccacctcctgtcttttctccttgccttccccactcctgtgtcctcccatctatcctgtctttcctttcctcctctcagtgtcctcagcacccacaaggaattttcctatcactgtgaactttgctggtacagaggaataatatctgccttcacctttttttttttggaccatagctagccagtcatttcttaaacctcccttcctaaaatctggggggtcggggggaaagaaaaaaaaagccttagtggcctggttgttcaaaggataagaatagctttatcctgcactcagtacccgaactcacttcagtatgcttactgaggccatgagaacctgaggggcatctgcccaggacaggagccatggcatatgacaaagaccaatgagggaccaggaaaaaaagtgatgtcccctttccctgccacctccagcctctgccagcaatgagctgtccccctcccaccctacacagtagctggtcagggctgagtacagtcctgggggtaaggggatgacatgcccaggtgtcagctcaaaggatctctgcatcatcttgaggtgggaggcagggaaaggagcgccaatgaggttccctgcaacccccgccctccagcccaccgcccaaccttttacaaatggcattttcttaattgaaaatccgggaagcaggtgtgattacttttttgctcgtagatattgtcctaagttggaattctcccactgccctaaaactttccctagtagtcctttaaactcccccctccctttttggtagctgttttctccgtcctctctccacctgccctcttatctaggagctgtttgtaagcacgatttttttaacaggttatattgtacaggatcaatattttgctttttaacaaggatatttatgtaataagaaactttgccttaggcaggtgttggccagaaaagtccagattcctctgggatcccaccctggcctctcctggaactctgaacctgctgtggaaggaattggccatgaccttcacctctggagagtagggtctatggcgagggaaaagggtgttcaccatgataacctagtgcctccatagaggggtttggaaaaattccagtccgatttctttgtgtgtcagctgacttccttagctgattgttcccacttgcacctctccacctttggcactagaactcctgagacaccacttctcatgcttctccctccctaccagcggtcaaggctttggagccactcttttgtaactccagattatttaaagagaaaagtacaagacagaaatcttctagcactttgtaaacacagtgaataacctcttggagtatttttggctttatataaaacaaggtttttaattgtaaagtataagtgccattagaaaatgcacagggcatatctttgttaaagtagatttttcaatgttttacagaattacattttcaaaaaaaggtttttataatgaagttgtttattaaaaacttctgaatgatgtgttaaaaaaaaat

SEQ ID NO: 329518 - DNA, 5279 bp, Homo sapiens
caatggcccgaccgccgccactaccggggcctgagggggcctggcggagcccgagcgcggcccggcccgcagcgtggggccccgagcgcggcacatggccacccactcagcccagaaaccccaccagtgtatgtactgtgataagatgtttcaccgcaaggaccatctgcggaaccatctgcagacccatgatcctaacaaagaggccctccactgctctgagtgcggtaagaattacaatacgaagctgggctaccggcgccacctggccatgcatgctgccagcagcggtgacctcagctgcaaggtgtgcctgcagacctttgagagtacccaggccctgctagagcacctgaaggcccactcacgccgggtagcaggcggtgccaaggagaagaagcacccctgtgaccactgcgaccggcggttctatactcgtaaggatgtacggcggcacctagtggtgcacacaggccgtaaggacttcctgtgccagtactgtgcccagcggtttggccgtaaggaccacctgacgcgtcatgtcaagaagagccactcgcaggagctgctcaagatcaagacagagcccgtggacatgttaggcctactcagctgcagctccacagtcagtgtgaaggaagagctgagccctgtgctgtgcatggcctctcgggacgtaatggggaccaaggccttccctggcatgttgcccatgggcatgtatggtgcccacatccctaccatgcccagcacgggcgtgccacactccctggtgcacaacacgctgcccatgggtatgagctaccctctggaatcctcacctatctcttccccagctcagctccctccaaaataccagcttggatctacctcatacttgcccgacaaattgcccaaagtggaggtggatagttttctggcggagcttcctggaagcctgtctctctcatccgctgaaccccagcccgcctcacctcagccggcggcagctgcggccctcctagatgaagcactgcttgccaagagccccgccaacctctctgaggccctctgcgctgctaatgtggacttctcccacctactgggctttcttccactcaacctgcccccgtgtaacccacctggggccacaggaggcctggtcatgggctactcccaggctgaggcacagcccctgcttaccactttgcaagctcagcctcaagattccccaggagctgggggaccactgaactttgggcctctgcactccttgcctcctgtcttcacgtctggcctgagtagcaccaccctgcctcgtttccatcaagcattccagtagcccccacagaggccctcagctcagtttttggctctgttatggagccttagtacccaccccgtctgtgtcccccatgaaggcagctgagctttcagagctgggttcaaaaaaaaaaattccagtgtctgtatacaggagcacttggtttgggggttcaggctctaggatcgattccagaaggagccttgagccccaaccccgtgaaaagatctcataccgtaggacttcaggtattatttacttttatttttttgacctgaatcgggagccacacttggccctcttcctctccaaagcgccagaacctccttctctttggagaatggggaggcctcttggagacacagagggtttcaccttggatgacctctagagaaattgcccaagaagcccaccttctggtcccaacctgcagaccccacagcagtcagttggtcaggccctgctgtagaaggtcacttggctccattgcctgcttccaaccaatgggcaggagagaaggcctttatttctcgcccacccattcctcctgtaccagcacctccgttttcagtcagtgttgtccagcaacggtaccgtttacacagtcacctcagacacaccatttcacctcccttgccaagctgttagccttagagtgattgcagtgaacactgtttacacaccgtgaatccattcccatcagtccattccagttggcaccagcctgaaccatttggtacctggtgttaactggagtcctgtttacaaggtggagtcggggcttgctgacttctcttcatttgaggtcacatttttcccccgtggggaaataaactgactttggactgcttcagtctctgccatcttccatgactgcatttgttcctgcctgcctcggcggtatccacagaagacaggcaagaggattggagcagttttctcacaggtctgcaattctgtttttctccaagtacattatgaccccctcatccttctcttgaactggagaggggaagaaatgaaaggcatgcccacgtccgtcacctccccatcccctagtccccaccttgaacatcatgagctgttgttattagtcttggaagcagagtctgggttggtgtggatagcaaaggaggaagtctgagcccctcattggtcttcctcccacctgtcccttttccgggaagttgtggaattgttggaagaagagtttgcagaaggttaggaatgggtagatagctaagtcctaatctatgggtacattgttgtgtcccaaaccaaaattttccttatccacaatgtcccttctgtctcttccactttacagtggactcggccactgtgcataggcttctctgctctccatcaaatcacttccactttcctgtgcccccacccccgcctccagttttccgctagtatccggcaaggtttcttgcaacaaatgattagttcttttcttctgactcgtggggctccctgctgcagagagcacagcccttgcctggagcccaggaaccccatccttgcttcatctcagttcttcatgggcttcactcttcccactcacggaagggaggtagctcagggacctccactgtgggacccttgagacgcttccactctgattcagaaacacacttctacctctttactgttaactcttaacagatgcagtcagcagtttctgggcacttctctcagtaggtgcctcatgctgacttctccagtagggtttcaggacaaactaccaaggaattgcctcagcctcctaccagtcctccctcacccaccttctgtctaggttcacttggtttgtcatcaggaactgagcaggtccaggactcagctttctgcttcagcctaagccagtactccttgtttgaggtaaaagccttaaaatttagctccctagctcttgattagaagcaatttggagtaagtgtgttttgatttaggcagggtagcttgggatacctttttaaaaacaccagatattaaaatgtctggcaaggttagaatcagactagatgatttgcttctaaaaattagtttcagtgagtcccagggactaattaaggtttattttaaaaagtgtctaccttggtacgcagccacctcctgcatgctgtgcatgttattgggacttgtattataggcgatggtatgtgagaatccagttgggactcgctgttgccatcctctttgttgtatctggttttcatcactagactcagcaacccttctcaccttaactgccaccttccctacactctcagtttacagaggccactgggcctctggctgcagaatacaaagtcccgggctgttagaggagtcctttcctctctgcctgccctttcctgtccctccctcgaattctctctccccgtaagtgatgctggaaaagtcataggactggcaaagcaactgtttaaaccctttgtaaccggggccttgcccccacctcctgtcttttctccttgccttccccactcctgtgtcctcccatctatcctgtctttcctttcctcctctcagtgtcctcagcacccacaaggaattttcctatcactgtgaactttgctggtacagaggaataatatctgccttcacctttttttttttggaccatagctagccagtcatttcttaaacctcccttcctaaaatctggggggtcggggggaaagaaaaaaaaagccttagtggcctggttgttcaaaggataagaatagctttatcctgcactcagtacccgaactcacttcagtatgcttactgaggccatgagaacctgaggggcatctgcccaggacaggagccatggcatatgacaaagaccaatgagggaccaggaaaaaaagtgatgtcccctttccctgccacctccagcctctgccagcaatgagctgtccccctcccaccctacacagtagctggtcagggctgagtacagtcctgggggtaaggggatgacatgcccaggtgtcagctcaaaggatctctgcatcatcttgaggtgggaggcagggaaaggagcgccaatgaggttccctgcaacccccgccctccagcccaccgcccaaccttttacaaatggcattttcttaattgaaaatccgggaagcaggtgtgattacttttttgctcgtagatattgtcctaagttggaattctcccactgccctaaaactttccctagtagtcctttaaactcccccctccctttttggtagctgttttctccgtcctctctccacctgccctcttatctaggagctgtttgtaagcacgatttttttaacaggttatattgtacaggatcaatattttgctttttaacaaggatatttatgtaataagaaactttgccttaggcaggtgttggccagaaaagtccagattcctctgggatcccaccctggcctctcctggaactctgaacctgctgtggaaggaattggccatgaccttcacctctggagagtagggtctatggcgagggaaaagggtgttcaccatgataacctagtgcctccatagaggggtttggaaaaattccagtccgatttctttgtgtgtcagctgacttccttagctgattgttcccacttgcacctctccacctttggcactagaactcctgagacaccacttctcatgcttctccctccctaccagcggtcaaggctttggagccactcttttgtaactccagattatttaaagagaaaagtacaagacagaaatcttctagcactttgtaaacacagtgaataacctcttggagtatttttggctttatataaaacaaggtttttaattgtaaagtataagtgccattagaaaatgcacagggcatatctttgttaaagtagatttttcaatgttttacagaattacattttcaaaaaaaggtttttataatgaagttgtttattaaaaacttctgaatgatgtgttaaaaaaaaat

SEQ ID NO: 329519 - DNA, 4904 bp, Homo sapiens
caatggcccgaccgccgccactaccggggcctgagggggcctggcggagcccgagcgcggcccggcccgcagcgtggggccccgagcgcggtgaagagattgttttctgaaagctgcgttggaggctgtgacagagctgagagcctgtgtggagcggatggggaggctttctcaataacatggccctttgccattagccttgccatgaccacatttttcaccagcgtccccccctggattcaagatgcaaagcaggaggaggaagtgggctggaaactagttcccaggcctcggggccgggaggcggagagtcaagtgaagtgccaatgtgaaatttcgggaacacctttctcaaatggggagaagctgaggcctcacagcctcccgcaaccagagcagagaccatatagctgccctcagctgcactgtggcaaggcttttgcttccaaatacaagctgtataggcacatggccacccactcagcccagaaaccccaccagtgtatgtactgtgataagatgtttcaccgcaaggaccatctgcggaaccatctgcagacccatgatcctaacaaagaggccctccactgctctgagtgcggtaagaattacaatacgaagctgggctaccggcgccacctggccatgcatgctgccagcagcggtgacctcagctgcaaggtgtgcctgcagacctttgagagtacccaggccctgctagagcacctgaaggcccactcacgccgggtagcaggcggtgccaaggagaagaagcacccctgtgaccactgcgaccggcggttctatactcgtaaggatgtacggcggcacctagtggtgcacacaggccgtaaggacttcctgtgccagtactgtgcccagcggtttggccgtaaggaccacctgacgcgtcatgtcaagaagagccactcgcaggagctgctcaagatcaagacagagcccgtggacatgttaggcctactcagctgcagctccacagtcagtgtgaaggaagagctgagccctgtgctgtgcatggcctctcgggacgtaatggggaccaaggccttccctggcatgttgcccatgggcatgtatggtgcccacatccctaccatgcccagcacgggcgtgccacactccctggtgcacaacacgctgcccatgggtatgagctaccctctggaatcctcacctatctcttccccagctcagctccctccaaaataccagcttggatctacctcatacttgcccgacaaattgcccaaagtggaggtggatagttttctggcggagcttcctggaagcctgtctctctcatccgctgaaccccagcccgcctcacctcagccggcggcagctgcggccctcctagatgaagcactgcttgccaagagccccgccaacctctctgaggccctctgcgctgctaatgtggacttctcccacctactgggctttcttccactcaacctgcccccgtgtaacccacctggggccacaggaggcctggtcatgggctactcccaggctgaggcacagcccctgcttaccactttgcaagctcagcctcaagattccccaggagctgggggaccactgaactttgggcctctgcactccttgcctcctgtcttcacgtctggcctgagtagcaccaccctgcctcgtttccatcaagcattccagtagcccccacagaggccctcagctcagtttttggctctgttatggagccttagtacccaccccgtctgtgtcccccatgaaggcagctgagctttcagagctgggttcaaaaaaaaaaattccagtgtctgtatacaggagcacttggtttgggggttcaggctctaggatcgattccagaaggagccttgagccccaaccccgtgaaaagatctcataccgtaggacttcaggtattatttacttttatttttttgacctgaatcgggagccacacttggccctcttcctctccaaagcgccagaacctccttctctttggagaatggggaggcctcttggagacacagagggtttcaccttggatgacctctagagaaattgcccaagaagcccaccttctggtcccaacctgcagaccccacagcagtcagttggtcaggccctgctgtagaaggtcacttggctccattgcctgcttccaaccaatgggcaggagagaaggcctttatttctcgcccacccattcctcctgtaccagcacctccgttttcagtcagtgttgtccagcaacggtaccgtttacacagtcacctcagacacaccatttcacctcccttgccaagctgttagccttagagtgattgcagtgaacactgtttacacaccgtgaatccattcccatcagtccattccagttggcaccagcctgaaccatttggtacctggtgttaactggagtcctgtttacaaggtggagtcggggcttgctgacttctcttcatttgaggtcacatttttcccccgtggggaaataaactgactttggactgcttcagtctctgccatcttccatgactgcatttgttcctgcctgcctcggcggtatccacagaagacaggcaagaggattggagcagttttctcacaggtctgcaattctgtttttctccaagtacattatgaccccctcatccttctcttgaactggagaggggaagaaatgaaaggcatgcccacgtccgtcacctccccatcccctagtccccaccttgaacatcatgagctgttgttattagtcttggaagcagagtctgggttggtgtggatagcaaaggaggaagtctgagcccctcattggtcttcctcccacctgtcccttttccgggaagttgtggaattgttggaagaagagtttgcagaaggttaggaatgggtagatagctaagtcctaatctatgggtacattgttgtgtcccaaaccaaaattttccttatccacaatgtcccttctgtctcttccactttacagtggactcggccactgtgcataggcttctctgctctccatcaaatcacttccactttcctgtgcccccacccccgcctccagttttccgctagtatccggcaaggtttcttgcaacaaatgattagttcttttcttctgactcgtggggctccctgctgcagagagcacagcccttgcctggagcccaggaaccccatccttgcttcatctcagttcttcatgggcttcactcttcccactcacggaagggaggtagctcagggacctccactgtgggacccttgagacgcttccactctgattcagaaacacacttctacctctttactgttaactcttaacagatgcagtcagcagtttctgggcacttctctcagtaggtgcctcatgctgacttctccagtagggtttcaggacaaactaccaaggaattgcctcagcctcctaccagtcctccctcacccaccttctgtctaggttcacttggtttgtcatcaggaactgagcaggtccaggactcagctttctgcttcagcctaagccagtactccttgtttgaggtaaaagccttaaaatttagctccctagctcttgattagaagcaatttggagtaagtgtgttttgatttaggcagggtagcttgggatacctttttaaaaacaccagatattaaaatgtctggcaaggttagaatcagactagatgatttgcttctaaaaattagtttcagtgagtcccagggactaattaaggtttattttaaaaagtgtctaccttggtacgcagccacctcctgcatgctgtgcatgttattgggacttgtattataggcgatggtatgtgagaatccagttgggactcgctgttgccatcctctttgttgtatctggttttcatcactagactcagcaacccttctcaccttaactgccaccttccctacactctcagtttacagaggccactgggcctctggctgcagaatacaaagtcccgggctgttagaggagtcctttcctctctgcctgccctttcctgtccctccctcgaattctctctccccgtaagtgatgctggaaaagtcataggactggcaaagcaactgtttaaaccctttgtaaccggggccttgcccccacctcctgtcttttctccttgccttccccactcctgtgtcctcccatctatcctgtctttcctttcctcctctcagtgtcctcagcacccacaaggaattttcctatcactgtgaactttgctggtacagaggaataatatctgccttcacctttttttttttggaccatagctagccagtcatttcttaaacctcccttcctaaaatctggggggtcggggggaaagaaaaaaaaagccttagtggcctggttgttcaaaggataagaatagctttatcctgcactcagtacccgaactcacttcagtatgcttactgaggccatgagaacctgaggggcatctgcccaggacaggagccatggcatatgacaaagaccaatgagggaccaggaaaaaaagtgatgtcccctttccctgccacctccagcctctgccagcaatgagctgtccccctcccaccctacacagtagctggtcagggctgagtacagtcctgggggtaaggggatgacatgcccaggtgtcagctcaaaggatctctgcatcatcttgaggtgggaggcagggaaaggagcgccaatgaggttccctgcaacccccgccctccagcccaccgcccaaccttttgctaataggttttgttctgttgagactactgtaaaaaagtgtgcttaccttcttgctgtttcaaactgtcctaagacaaaactaaacgagtgctccactggttacgcttttattgctaaactcaggggcctt

SEQ ID NO: 329520 - DNA, 1071 bp, Homo sapiens
cctagtgtgacgtgaaagcaaagttttaaaatttttttctcctctgcaagaaaatatatttcagaaaatctctatctcaaaaatgaagcaattaagaactgtctggctgtgaggatctggcctcaacttgacttaaagcaacaacttcagttacatatcaagatgtgcgtgagaatgaacctgctctgctcagccaacgtgctgagtgacttgatgtttgtaataaataaataaataaacaacaaacaggttgtcatgaaatatcctttgtaattataaacacaggaaactttctgagatgcaagtgggtgttaaatggttcagcaaagccaagccagagcagttggtgtgctttgaaatgaagcaacattggaaaaatgaaatctactgaaagatcactacgtgtttcaaagaactgactagaaccagaactcttcagaaaagaatgtgctaaaggtttgtccttgagaagtttccaagccaagacactcctaggagcacttcccattgaggccgaaaggctcatccacttacagcgattcatgggaaaagaggacagcaccctcatctttggtccaagaacacaatcctgagtgacacaggattgccctgaaagtcaacagcatccgtcttacaaaaatcaacaacactcgcttttcaaacttccaaagaatttactggtctggtttggccttttggtgccacattccattccagaaccccagctaaaatgttctcaagggctgaccagagattcctcctcctttctctgggctggtacaacttgaccgctgcttgacatcaaggtcaactggagactgggaacagttatgtaactgtgttgtaaattgaattagagctgtacatgagcccagaccaagtaaccagtgcagctccaggcaagagcagcaacatgtcccccagagacagcattggaggaacagcttactggggaatggaaaaagggtatcacagggtaaaaaagaaaccatctctttccagtccttctaaagtctgggcagttggctgcccatcacatgtggaataagaggggggcttaagtgcagaggg

SEQ ID NO: 329521 - DNA, 334 bp, Homo sapiens
agatgggatttcaccatgttggtcaggctcaaactcctgacctcaaatgatctgcctcccttggccttccaaagtgctgggattacagacgtgagccactgcaccacatccagaaccagtgttttgttaatcttttgtggatgtttggtattttttgtttgtttgttacagtttagttctgctctgatgtttgttacttcttttcttctgctgggtttgggttcagtttattcttgtttctctagttccttgaagtgtgaccttagattttctgtttgtgctccttcagatgttttggtgtgggttttttttttttttttttgagatgagtctc

SEQ ID NO: 329522 - DNA, 321 bp, Homo sapiens
gccacgcgtgtccgcacaatataatttcattcgacacaacacccagacgtcctcccctttggagacaaggcaggaatggaaagaagagcgaacagcaccagcgtttgagtgaactcctgtcttggacagtgaatccatctcacccccttaagaaatgtcctgcaagaaggacagtcaacaaccccggggactcggatctgcaactcgacctgcgctgggacattaccccacgcaccccggaggagccccaggagaggaagtcccagggaaaacctttaccccgaccctaccaaacacaaaataaaatacctttttcctaca

SEQ ID NO: 329523 - DNA, 349 bp, Homo sapiens
ggtgaagagcttctctccaaagtctccagcatatttttggttttcatgaatttttcagagagcatctgtttttaagtaagtagaaacatactcagggaaaataaggcctgttagaagaagttcaagtcaaagtctataaacatgccctctttgcatgtatgctaaaggaaatttaataccatcaacacttgattatttcctagagtgagagaatccaaaatagcatatcgaaaacaactttcttatctatccctgcaccatgcaaaactactggttctcacaagtccactacggaagccaacagttattttgtttctcattacaaatagctgcacccaatgcccatggg

SEQ ID NO: 329524 - DNA, 2537 bp, Homo sapiens
ggcacgaggcgccctgcagattgtctcttgttgcgtaagtttttttgaccgtcactcgtgtcagcttcaaagtcagatagatttttctcccagcatgttctacttccgaggctgtggccgttgggtcgcggtttccttcaccaagcagcaatttccgttggcacggttgagcagtgacagcgcggcgccccggactccgcacttcgacgtgatagtcattggtggaggacatgccgggactgaggcagccaccgccgccgctcggtgcggctctcggactctgctcctcactcaccgcgtggacacgatcggtcagatgtcatgtaatccttcctttggtggcatcggaaagggacatttaatgagggaagtagatgccttggatggcctgtgttctcgcatctgtgaccagtctggtgtacattataaagtattaaaccggcgtaagggaccagctgtgtggggtctgagagctcagattgataggaaactctataaacagaacatgcagaaagaaatcttgaatacaccactgcttactgttcaggagggagctgtagaagatcttattcttacagaaccagagcctgaacacactgggaaatgccgtgtcagtggggttgttttggtggatggaagcacagtatatgcagagagtgtgattctgactactgggacatttctgagaggcatgattgtaattggattggagacgcatccagcaggacgtttaggggatcagccttctataggattggctcagacactggagaagttagggtttgtggtgggaaggttgaagactgggactccaccccgaattgccaaagagtccattaatttcagtattctaaacaagcatataccggacaatccatccataccattcagctttaccaatgagacagtatggattaagccagaagatcagctgccatgttacttgactcacaccaaccctagagtggatgagattgtccttaagaaccttcaccttaatagtcatgttaaagaaacgacaagaggacctcgatactgtccctccattgaatcaaaagttttgcgttttccaaaccgtctacatcaggtttggttggaacctgaaggaatggattctgaccttatctacccacaggggttatctatgacgctaccagctgagttacaagagaaaatgatcacatgcatcagaggcttggagaaagctaaagtgattcagccaggctacggtgttcagtatgattacttagatccccgtcagatcaccccttccttggagactcatttggttcaacgactcttctttgctggacagatcaatggcaccactggttatgaggaagctgcagctcaaggtgtgatagccggaatcaacgccagtcttcgggtcagtcgcaagcctccctttgtggttagccgaacagaaggttacataggagtcttgattgatgacctcactactctgggcaccagtgaaccataccgcatgtttaccagccgagtagagttccgtttgtcactgcgccctgataatgctgacagccggctcacactgcgagggtataaagacgctggctgtgtgtcccaacaacgatatgaaagagcttgttggatgaagtcttctttagaagaaggcatttctgtgttgaaatctattgagtttttgagctctaaatggaaaaaattaatcccagaggcttctataagtactagtagaagtctgcctgtcagagctctcgatgttctgaagtatgaggaagttgacatggattcattagccaaggctgttccagagcccttgaagaagtatactaaatgtagagagctggctgaaagactgaaaatagaagccacttatgaatcagtgttgttccatcaactacaagaaataaagggagttcagcaagatgaagctctccaactgccaaaagacctagattatttgactatcagggatgtgtctttgtcccatgaagttcgagagaaactacattttagtcgtccacagacgatcggggctgctagtcgcatacccggagtaacacctgccgccatcatcaatctgctgagatttgtgaagaccactcaacgaagacagtcggctatgaatgaatcatccaagactgatcaatacttatgtgatgcagacagacttcaagagagagagttatagctttcaattcataaaagatttttaaagagcatataaataatttgatcaatacaacagtatagataaaagaattatttagcacatgttaaaatagctttattaggttactatgggtttgccattaatttctgagtgggacagaaattataattgtgctttttcgtgtatatgaaaaaactagtcgtaaacaatttgtactctttctttaaggagctgtaatacaaataactttgtgcagtgttcatcaaagagagagacagtgaacctaaaactgaacctggaataaaactcaacatgcagatttgcctactcatagggactttgcctattaagtctaccaaattaaaagtcttatcattcagcg

SEQ ID NO: 329525 - DNA, 2653 bp, Homo sapiens
ggcacgaggcgccctgcagattgtctcttgttgcgtaagtttttttgaccgtcactcgtgtcagcttcaaagtcagatagatttttctcccagcatgttctacttccgaggctgtggccgttgggtcgcggtttccttcaccaagcagcaatttccgttggcacggttgagcagtgacagcgcggcgccccggactccgcacttcgacgtgatagtcattggtggaggacatgccgggactgaggcagccaccgccgccgctcggtgcggctctcggactctgctcctcactcaccgcgtggacacgatcggtcagatgtcatgtaatccttcctttggtggcatcggaaagggacatttaatgagggaagtagatgccttggatggcctgtgttctcgcatctgtgaccagtctggtgtacattataaagtattaaaccggcgtaagggaccagctgtgtggggtctgagagctcagattgataggaaactctataaacagaacatgcagaaagaaatcttgaatacaccactgcttactgttcaggagggagctgtagaagatcttattcttacagaaccagagcctgaacacactgggaaatgccgtgtcagtggggttgttttggtggatggaagcacagtatatgcagagagtgtgattctgactactgggacatttctgagaggcatgattgtaattggattggagacgcatccagcaggacgtttaggggatcagccttctataggattggctcagacactggagaagttagggtttgtggtgggaaggttgaagactgggactccaccccgaattgccaaagagtccattaatttcagtattctaaacaagcatataccggacaatccatccataccattcagctttaccaatgagacagtatggattaagccagaagatcagctgccatgttacttgactcacaccaaccctagagtggatgagattgtccttaagaaccttcaccttaatagtcatgttaaagaaacgacaagaggacctcgatactgtccctccattgaatcaaaagttttgcgttttccaaaccgtctacatcaggtttggttggaacctgaaggaatggattctgaccttatctacccacaggggttatctatgacgctaccagctgagttacaagagaaaatgatcacatgcatcagaggcttggagaaagctaaagtgattcagccaggctacggtgttcagtatgattacttagatccccgtcagatcaccccttccttggagactcatttggttcaacgactcttctttgctggacagatcaatggcaccactggttatgaggaagctgcagctcaaagtgttgctctgttgccaggctggagtgcagtgatatgatctcccagcttcaagcgatcctcctgcctcagccctccctagtagctgggactgcaggcatgcaccacaacacccagggtgtgatagccggaatcaacgccagtcttcgggtcagtcgcaagcctccctttgtggttagccgaacagaaggttacataggagtcttgattgatgacctcactactctgggcaccagtgaaccataccgcatgtttaccagccgagtagagttccgtttgtcactgcgccctgataatgctgacagccggctcacactgcgagggtataaagacgctggctgtgtgtcccaacaacgatatgaaagagcttgttggatgaagtcttctttagaagaaggcatttctgtgttgaaatctattgagtttttgagctctaaatggaaaaaattaatcccagaggcttctataagtactagtagaagtctgcctgtcagagctctcgatgttctgaagtatgaggaagttgacatggattcattagccaaggctgttccagagcccttgaagaagtatactaaatgtagagagctggctgaaagactgaaaatagaagccacttatgaatcagtgttgttccatcaactacaagaaataaagggagttcagcaagatgaagctctccaactgccaaaagacctagattatttgactatcagggatgtgtctttgtcccatgaagttcgagagaaactacattttagtcgtccacagacgatcggggctgctagtcgcatacccggagtaacacctgccgccatcatcaatctgctgagatttgtgaagaccactcaacgaagacagtcggctatgaatgaatcatccaagactgatcaatacttatgtgatgcagacagacttcaagagagagagttatagctttcaattcataaaagatttttaaagagcatataaataatttgatcaatacaacagtatagataaaagaattatttagcacatgttaaaatagctttattaggttactatgggtttgccattaatttctgagtgggacagaaattataattgtgctttttcgtgtatatgaaaaaactagtcgtaaacaatttgtactctttctttaaggagctgtaatacaaataactttgtgcagtgttcatcaaagagagagacagtgaacctaaaactgaacctggaataaaactcaacatgcagatttgcctactcatagggactttgcctattaagtctaccaaattaaaagtcttatcattcagcg

SEQ ID NO: 329526 - DNA, 2664 bp, Homo sapiens
ggcacgaggcgccctgcagattgtctcttgttgcgtcagatgtcatgtaatccttcctttggtggcatcggaaagggacatttaatgagggaagtagatgccttggatggcctgtgttctcgcatctgtgaccagtctggtgtacattataaagtattaaaccggcgtaagggaccagctgtgtggggtctgagagctcagattgataggaaactctataaacagaacatgcagaaagaaatcttgaatacaccactgcttactgttcaggagggagctgtagaagatcttattcttacagaaccagagcctgaacacactgggaaatgccgtgtcagtggggttgttttggtggatggaagcacagtatatgcagagagtgtgattctgactactgggacatttctgagaggcatgattgtaattggattggagacgcatccagcaggacgtttaggggatcagccttctataggattggctcagacactggagaagttagggtttgtggtgggaaggttgaagactgggactccaccccgaattgccaaagagtccattaatttcagtattctaaacaagcatataccggacaatccatccataccattcagctttaccaatgagacagtatggattaagccagaagatcagctgccatgttacttgactcacaccaaccctagagtggatgagattgtccttaagaaccttcaccttaatagtcatgttaaagaaacgacaagaggacctcgatactgtccctccattgaatcaaaagttttgcgttttccaaaccgtctacatcaggtttggttggaacctgaaggaatggattctgaccttatctacccacaggggttatctatgacgctaccagctgagttacaagagaaaatgatcacatgcatcagaggcttggagaaagctaaagtgattcagccagacggagttttgctcttgttgcccaggatggagtgcaatggtgcgatctcggctcaccacaacctccccctgccaggctacggtgttcagtatgattacttagatccccgtcagatcaccccttccttggagactcatttggttcaacgactcttctttgctggacagatcaatggcaccactggttatgaggaagctgcagctcaaggtgtgatagccggaatcaacgccagtcttcgggtcagtcgcaagcctccctttgtggttagccgaacagaaggttacataggagtcttgattgatgacctcactactctgggcaccagtgaaccataccgcatgtttaccagccgagtagagttccgtttgtcactgcgccctgataatgctgacagccggctcacactgcgagggtataaagacgctggctgtgtgtcccaacaacgatatgaaagagcttgttggatgaagtcttctttagaagaaggcatttctgtgttgaaatctattgagtttttgagctctaaatggaaaaaattaatcccagaggcttctataagtactagtagaagtctgcctgtcagagctctcgatgttctgaagtatgaggaagttgacatggattcattagccaaggctgttccagagcccttgaagaagtatactaaatgtagagagctggctgaaagactgaaaatagaagccacttatgaatcagtgttgttccatcaactacaagaaataaagggagttcagcaagatgaagctctccaactgccaaaagacctagattatttgactatcagggatgtgtctttgtcccatgaagttcgagagaaactacattttagtcgtccacagacgatcggggctgctagtcgcatacccggagtaacacctgccgccatcatcaatctgctgagatttgtgaagaccactcaacgaagacagtcggctatgaatgaatcatccaagactgatcaatacttatgtgatgcagacagacttcaagagagagagttatagctttcaattcataaaagatttttaaagagcatataaataatttgatcaatacaacagtatagataaaagaattatttagcacatgttaaaatagctttattaggttactatgggtttgccattaatttctgagtgggacagaaattataattgtgctttttcgtgtatatgaaaaaactagtcgtaaacaatttgtactctttctttaaggagctgtaatacaaataactttgtgcagtgttcatcaaagagagagacagtgaacctaaaactgaacctggaataaaactcaacatgcagatttgcctactcatagggactttgcctattaagtctaccaaattaaaagtcttatcattcagcgagaagaagggaccaaagaaaaaaaaggatgggctcgttgggcctaagggggaggctctggggggcgggttcctgtatgggggggaattactggtccctccttcagtgactcgctgggttcgggccgtggggtggggggagggggttcagggtgcttaagggggggagagggggtttcccccaaggtggggggtaaccgcaggagagacttgtggagcaaaggcgcacataggcccaggacccggaaagggcgcgtcgcgtggtgtttacatgacgcccccccccggggggggtgcaaaaagggcgctcgaggaagggggcgaggcgccg

SEQ ID NO: 329527 - DNA, 3391 bp, Homo sapiens
agcgcgggtgctgtggaacttggcgtaggacgcaggctgcttccttcccgcctcccccggtctgaagcgggggacctcttcctttcctcaaagtcagatgtcatgtaatccttcctttggtggcatcggaaagggacatttaatgagggaagtagatgccttggatggcctgtgttctcgcatctgtgaccagtctggtgtacattataaagtattaaaccggcgtaagggaccagctgtgtggggtctgagagctcagattgataggaaactctataaacagaacatgcagaaagaaatcttgaatacaccactgcttactgttcaggagggagctgtagaagatcttattcttacagaaccagagcctgaacacactgggaaatgccgtgtcagtggggttgttttggtggatggaagcacagtatatgcagagagtgtgattctgactactgggacatttctgagaggcatgattgtaattggattggagacgcatccagcaggacgtttaggggatcagccttctataggattggctcagacactggagaagttagggtttgtggtgggaaggttgaagactgggactccaccccgaattgccaaagagtccattaatttcagtattctaaacaagcatataccggacaatccatccataccattcagctttaccaatgagacagtatggattaagccagaagatcagctgccatgttacttgactcacaccaaccctagagtggatgagattgtccttaagaaccttcaccttaatagtcatgttaaagaaacgacaagaggacctcgatactgtccctccattgaatcaaaagttttgcgttttccaaaccgtctacatcaggtttggttggaacctgaaggaatggattctgaccttatctacccacaggggttatctatgacgctaccagctgagttacaagagaaaatgatcacatgcatcagaggcttggagaaagctaaagtgattcagccagacggagttttgctcttgttgcccaggatggagtgcaatggtgcgatctcggctcaccacaacctccccctgccaggctacggtgttcagtatgattacttagatccccgtcagatcaccccttccttggagactcatttggttcaacgactcttctttgctggacagatcaatggcaccactggttatgaggaagctgcagctcaaggtgtgatagccggaatcaacgccagtcttcgggtcagtcgcaagcctccctttgtggttagccgaacagaaggttacataggagtcttgattgatgacctcactactctgggcaccagtgaaccataccgcatgtttaccagccgagtagagttccgtttgtcactgcgccctgataatgctgacagccggctcacactgcgagggtataaagacgctggctgtgtgtcccaacaacgatatgaaagagcttgttggatgaagtcttctttagaagaaggcatttctgtgttgaaatctattgagtttttgagctctaaatggaaaaaattaatcccagaggcttctataagtactagtagaagtctgcctgtcagagctctcgatgttctgaagtatgaggaagttgacatggattcattagccaaggctgttccagagcccttgaagaagtatactaaatgtagagagctggctgaaagactgaaaatagaagccacttatgaatcagtgttgttccatcaactacaagaaataaagggagttcagcaagatgaagctctccaactgccaaaagacctagattatttgactatcagggatgtgtctttgtcccatgaagttcgagagaaactacattttagtcgtccacagacgatcggggctgctagtcgcatacccggagtaacacctgccgccatcatcaatctgctgagatttgtgaagaccactcaacgaagacagtcggctatgaatgaatcatccaagactgatcaatacttatgtgatgcagacagacttcaagagagagagttatagctttcaattcataaaagatttttaaagagcatataaataatttgatcaatacaacagtatagataaaagaattatttagcacatgttaaaatagctttattaggttactatgggtttgccattaatttctgagtgggacagaaattataattgtgctttttcgtgtatatgaaaaaactagtcgtaaacaatttgtactctttctttaaggagctgtaatacaaataactttgtgcagtgttcatcaaagagagagacagtgaacctaaaactgaacctggaataaaactcaacatgcagatttgcctactcatagggactttgcctattaagtctaccaaattaaaagtcttatcattcagcgtgttttgagagttaataatcttttgcttggttatactaggctaggaagcaatatcaaagcccttaaattctcaagactaaagacttgagattatataaaattatccagaatcattcagctaatactattggaatatagtatgtagggtgaaagttgacagaaatctgtacttcttcaggaaatcctcactggtaattgttttgaacattaatgaaagccctataaaatagaaagattggaaatcaccattgtttcctattatccacagtgtggatggatacttatttggtgacctagttatgggagaattgagtaacgttagttattttatatcataccataaaaatattttcttaagaaattgtcatggccatcatttcttaataatgaagacaggtccatagtaactggtgagtggtgtttccctgtttttaagtcagaatgacagaaaaaacagaatagtggtagtacccctcttcctctccagtacttcaatggtatgtcttcacaggggttagagtgggataatcagctgggccttttgactcagatacctcagatacctcaaccattctaaatagactaagggatgaatacagccaaatgggccagacagccctgcttgtctctggaattccaacccagatctctggtgtcagcctagggagaagctcccgtgtcaccttcgggccaaagcaggtactcaggagagttctaagggccccaaagtcactttggctacagatgtgtatgttaagcctgattatgggtgtgaggcaaccaagtatcttgttactataattgcatatggccacttggaggtagcttagttttcttgggtttattttatctaattttagtctttccagaaagcagtaagattagtagcaagtaaaaagtatttgtagtgctggataatttaggaatgatgaatattttttaatacttgattcagtgatttcaaaaggtcgtaacttttagtcatagctactcctggg

SEQ ID NO: 329528 - DNA, 890 bp, Homo sapiens
tggtagtattggttatggttcattgtccggagagtatattgttgaagaggcttctataagtactagtagaagtctacctgtcagagctctcgatgttctgaagtatgaggaagttgacatggattcattagccaaggctgttccagagcccttgaagaagtatactaaatgtagagagctggctgaaagactgaaaatagaagccacttatgaatcagtgttgttccatcaactacaagaaataaagggagttcagcaagatgaagctctccaactgccaaaagacctagattatttgactatcagggatgtgtctttgtcccatgaagttcgagagaaactacattttagtcgtccacagacgatcggggctgctagtcgcatacccggagtaacacctgccgccatcatcaatctgctgagatttgtgaagaccactcaacgaagacagtcggctatgaatgaatcatccaagactgatcaatacttatgtgatgcagacagacttcaagagagagagttatagctttcaattcataaaagatttttaaagagcatataaataatttgatcaatacaacagtatagataaaagaattatttagcacatgttaaaatagctttattaggttactatgggtttgccattaatttctgagtgggacagaaattataattgtgctttttcgtgtatatgaaaaaactagtcgtaaacaatttgtactctttctttaaggagctgtaatacaaataactttgtgcagtgttcatcaaagagagagacagtgaacctaaaactgaacctggaataaaactcaacatgcagatttgcctactcatagggactttgcctattaagtctaccaaattaaaagtcttatcattcagcg

SEQ ID NO: 329529 - DNA, 2540 bp, Homo sapiens
ggcacgaggcgccctgcagattgtctcttgttgcgtaagtttttttgaccgtcactcgtgtcagcttcaaagtcagatagatttttctcccagcatgttctacttccgaggctgtggccgttgggtcgcggtttccttcaccaagcagcaatttccgttggcacggttgagcagtgacagcgcggcgccccggactccgcacttcgacgtgatagtcattggtggaggacatgccgggactgaggcagccaccgccgccgctcggtgcggctctcggactctgctcctcactcaccgcgtggacacgatcggtcagatgtcatgtaatccttcctttggtggcatcggaaagggacatttaatgagggaagtagatgccttggatggcctgtgttctcgcatctgtgaccagtctggtgtacattataaagtattaaaccggcgtaagggaccagctgtgtggggtctgagagctcagattgataggaaactctataaacagaacatgcagaaagaaatcttgaatacaccactgcttactgttcaggagggagctgtagaagatcttattcttacagaaccagagcctgaacacactgggaaatgccgtgtcagtggggttgttttggtggatggaagcacagtatatgcagagagtgtgattctgactactgggacatttctgagaggcatgattgtaattggattggagacgcatccagcaggacgtttaggggatcagccttctataggattggctcagacactggagaagttagggtttgtggtgggaaggttgaagactgggactccaccccgaattgccaaagagtccattaatttcagtattctaaacaagcatataccggacaatccatccataccattcagctttaccaatgagacagtatggattaagccagaagatcagctgccatgttacttgactcacaccaaccctagagtggatgagattgtccttaagaaccttcaccttaatagtcatgttaaagaaacgacaagaggacctcgatactgtccctccattgaatcaaaagttttgcgttttccaaaccgtctacatcaggtttggttggaacctgaaggaatggattctgaccttatctacccacaggggttatctatgacgctaccagctgagttacaagagaaaatgatcacatgcatcagaggcttggagaaagctaaagtgattcagccaggctacggtgttcagtatgattacttagatccccgtcagatcaccccttccttggagactcatttggttcaacgactcttctttgctggacagatcaatggcaccactggttatgaggaagctgcagctcaaggtgtgatagccggaatcaacgccagtcttcgggtcagtcgcaagcctccctttgtggttagccgaacagaaggttacataggagtcttgattgatgacctcactactctgggcaccagtgaaccataccgcatgtttaccagccgagtagagttccgtttgtcactgcgccctgataatgctgacagccggctcacactgcgagggtataaagacgctggctgtgtgtcccaacaacgatatgaaagagcttgttggatgaagtcttctttagaagaaggcatttctgtgttgaaatctattgagtttttgagctctaaatggaaaaaattaatcccagaggcttctataagtactagtagaagtctgcctgtcaggcgtggtggcagacatcttaatcccagctacttgggaggcagaggcaggagaatcgtttgaacctgggaagcggaggttgcagtgagccgagatcaagccattgcacccaaacctgagggacaagagtgagacttctctcaaaaaaaaagaaaagactcatacaagctctcgatgttctgaagtatgaggaagttgacatggattcattagccaaggctgttccagagcccttgaagaagtatactaaatgtagagagctggctgaaagactgaaaatagaagatcggggctgctagtcgcatacccggagtaacacctgccgccatcatcaatctgctgagatttgtgaagaccactcaacgaagacagtcggctatgaatgaatcatccaagactgatcaatacttatgtgatgcagacagacttcaagagagagagttatagctttcaattcataaaagatttttaaagagcatataaataatttgatcaatacaacagtatagataaaagaattatttagcacatgttaaaatagctttattaggttactatgggtttgccattaatttctgagtgggacagaaattataattgtgctttttcgtgtatatgaaaaaactagtcgtaaacaatttgtactctttctttaaggagctgtaatacaaataactttgtgcagtgttcatcaaagagagagacagtgaacctaaaactgaacctggaataaaactcaacatgcagatttgcctactcatagggactttgcctattaagtctaccaaattaaaagtcttatcattcagcg

SEQ ID NO: 329530 - DNA, 740 bp, Homo sapiens
atttcggggctcggtacccctggctgtacatgagtattgattttgttgaccagccacttatgaatcagtgttgttccatcaactacaagaaataaagggagttcagcaagatgaagctctccaactgccaaaagacctagattatttgactatcagggatgtgtctttgtcccatgaagttcgagagaaactacattttagtcgtccacagacgatcggggctgctagtcgcatacccggagtaacacctgccgccatcatcaatctgctgagatttgtgaagaccactcaacgaagacagtcggctatgaatgaatcatccaagactgatcaatacttatgtgatgcagacagacttcaagagagagagttatagctttcaattcataaaagatttttaaagagcatataaataatttgatcaatacaacagtatagataaaagaattatttagcacatgttaaaatagctttattaggttactatgggtttgccattaatttctgagtgggacagaaattataattgtgctttttcgtgtatatgaaaaaactagtcgtaaacaatttgtactctttctttaaggagctgtaatacaaataactttgtgcagtgttcatcaaagagagagacagtgaacctaaaactgaacctggaataaaactcaacatgcagatttgcctactcatagggactttgcctattaagtctaccaaattaaaagtcttatcattcagcg

SEQ ID NO: 329531 - DNA, 3333 bp, Homo sapiens
ggcacgaggcgccctgcagattgtctcttgttgcgtcagatgtcatgtaatccttcctttggtggcatcggaaagggacatttaatgagggaagtagatgccttggatggcctgtgttctcgcatctgtgaccagtctggtgtacattataaagtattaaaccggcgtaagggaccagctgtgtggggtctgagagctcagattgataggaaactctataaacagaacatgcagaaagaaatcttgaatacaccactgcttactgttcaggagggagctgtagaagatcttattcttacagaaccagagcctgaacacactgggaaatgccgtgtcagtggggttgttttggtggatggaagcacagtatatgcagagagtgtgattctgactactgggacatttctgagaggcatgattgtaattggattggagacgcatccagcaggacgtttaggggatcagccttctataggattggctcagacactggagaagttagggtttgtggtgggaaggttgaagactgggactccaccccgaattgccaaagagtccattaatttcagtattctaaacaagcatataccggacaatccatccataccattcagctttaccaatgagacagtatggattaagccagaagatcagctgccatgttacttgactcacaccaaccctagagtggatgagattgtccttaagaaccttcaccttaatagtcatgttaaagaaacgacaagaggacctcgatactgtccctccattgaatcaaaagttttgcgttttccaaaccgtctacatcaggtttggttggaacctgaaggaatggattctgaccttatctacccacaggggttatctatgacgctaccagctgagttacaagagaaaatgatcacatgcatcagaggcttggagaaagctaaagtgattcagccagacggagttttgctcttgttgcccaggatggagtgcaatggtgcgatctcggctcaccacaacctccccctgccaggctacggtgttcagtatgattacttagatccccgtcagatcaccccttccttggagactcatttggttcaacgactcttctttgctggacagatcaatggcaccactggttatgaggaagctgcagctcaaggtgtgatagccggaatcaacgccagtcttcgggtcagtcgcaagcctccctttgtggttagccgaacagaaggttacataggagtcttgattgatgacctcactactctgggcaccagtgaaccataccgcatgtttaccagccgagtagagttccgtttgtcactgcgccctgataatgctgacagccggctcacactgcgagggtataaagacgctggctgtgtgtcccaacaacgatatgaaagagcttgttggatgaagtcttctttagaagaaggcatttctgtgttgaaatctattgagtttttgagctctaaatggaaaaaattaatcccagaggcttctataagtactagtagaagtctgcctgtcagagctctcgatgttctgaagtatgaggaagttgacatggattcattagccaaggctgttccagagcccttgaagaagtatactaaatgtagagagctggctgaaagactgaaaatagaagccacttatgaatcagtgttgttccatcaactacaagaaataaagggagttcagcaagatgaagctctccaactgccaaaagacctagattatttgactatcagggatgtgtctttgtcccatgaagttcgagagaaactacattttagtcgtccacagacgatcggggctgctagtcgcatacccggagtaacacctgccgccatcatcaatctgctgagatttgtgaagaccactcaacgaagacagtcggctatgaatgaatcatccaagactgatcaatacttatgtgatgcagacagacttcaagagagagagttatagctttcaattcataaaagatttttaaagagcatataaataatttgatcaatacaacagtatagataaaagaattatttagcacatgttaaaatagctttattaggttactatgggtttgccattaatttctgagtgggacagaaattataattgtgctttttcgtgtatatgaaaaaactagtcgtaaacaatttgtactctttctttaaggagctgtaatacaaataactttgtgcagtgttcatcaaagagagagacagtgaacctaaaactgaacctggaataaaactcaacatgcagatttgcctactcatagggactttgcctattaagtctaccaaattaaaagtcttatcattcagcgtgttttgagagttaataatcttttgcttggttatactaggctaggaagcaatatcaaagcccttaaattctcaagactaaagacttgagattatataaaattatccagaatcattcagctaatactattggaatatagtatgtagggtgaaagttgacagaaatctgtacttcttcaggaaatcctcactggtaattgttttgaacattaatgaaagccctataaaatagaaagattggaaatcaccattgtttcctattatccacagtgtggatggatacttatttggtgacctagttatgggagaattgagtaacgttagttattttatatcataccataaaaatattttcttaagaaattgtcatggccatcatttcttaataatgaagacaggtccatagtaactggtgagtggtgtttccctgtttttaagtcagaatgacagaaaaaacagaatagtggtagtacccctcttcctctccagtacttcaatggtatgtcttcacaggggttagagtgggataatcagctgggccttttgactcagatacctcagatacctcaaccattctaaatagactaagggatgaatacagccaaatgggccagacagccctgcttgtctctggaattccaacccagatctctggtgtcagcctagggagaagctcccgtgtcaccttcgggccaaagcaggtactcaggagagttctaagggccccaaagtcactttggctacagatgtgtatgttaagcctgattatgggtgtgaggcaaccaagtatcttgttactataattgcatatggccacttggaggtagcttagttttcttgggtttattttatctaattttagtctttccagaaagcagtaagattagtagcaagtaaaaagtatttgtagtgctggataatttaggaatgatgaatattttttaatacttgattcagtgatttcaaaaggtcgtaacttttagtcatagctactcctggg

SEQ ID NO: 329532 - DNA, 2701 bp, Homo sapiens
ggcacgaggcgccctgcagattgtctcttgttgcgtaagtttttttgaccgtcactcgtgtcagcttcaaagtcagatagatttttctcccagcatgttctacttccgaggctgtggccgttgggtcgcggtttccttcaccaagcagcaatttccgttggcacggttgagcagtgacagcgcggcgccccggactccgcacttcgacgtgatagtcattggtggaggacatgccgggactgaggcagccaccgccgccgctcggtgcggctctcggactctgctcctcactcaccgcgtggacacgatcggtcagatgtcatgtaatccttcctttggtggcatcggaaagggacatttaatgagggaagtagatgccttggatggcctgtgttctcgcatctgtgaccagtctggtgtacattataaagtattaaaccggcgtaagggaccagctgtgtggggtctgagagctcagattgataggaaactctataaacagaacatgcagaaagaaatcttgaatacaccactgcttactgttcaggagggagctgtagaagatcttattcttacagaaccagagcctgaacacactgggaaatgccgtgtcagtggggttgttttggtggatggaagcacagtatatgcagagagtgtgattctgactactgggacatttctgagaggcatgattgtaattggattggagacgcatccagcaggacgtttaggggatcagccttctataggattggctcagacactggagaagttagggtttgtggtgggaaggttgaagactgggactccaccccgaattgccaaagagtccattaatttcagtattctaaacaagcatataccggacaatccatccataccattcagctttaccaatgagacagtatggattaagccagaagatcagctgccatgttacttgactcacaccaaccctagagtggatgagattgtccttaagaaccttcaccttaatagtcatgttaaagaaacgacaagaggacctcgatactgtccctccattgaatcaaaagttttgcgttttccaaaccgtctacatcaggtttggttggaacctgaaggaatggattctgaccttatctacccacaggggttatctatgacgctaccagctgagttacaagagaaaatgatcacatgcatcagaggcttggagaaagctaaagtgattcagccaggctacggtgttcagtatgattacttagatccccgtcagatcaccccttccttggagactcatttggttcaacgactcttctttgctggacagatcaatggcaccactggttatgaggaagctgcagctcaaggtgtgatagccggaatcaacgccagtcttcgggtcagtcgcaagcctccctttgtggttagccgaacagaaggttacataggagtcttgattgatgacctcactactctgggcaccagtgaaccataccgcatgtttaccagccgagtagagttccgtttgtcactgcgccctgataatgctgacagccggctcacactgcgagggtataaagacgctggctgtgtgtcccaacaacgatatgaaagagcttgttggatgaagtcttctttagaagaaggcatttctgtgttgaaatctattgagtttttgagctctaaatggaaaaaattaatcccagaggcttctataagtactagtagaagtctgcctgtcaggcgtggtggcagacatcttaatcccagctacttgggaggcagaggcaggagaatcgtttgaacctgggaagcggaggttgcagtgagccgagatcaagccattgcacccaaacctgagggacaagagtgagacttctctcaaaaaaaaagaaaagactcatacaagctctcgatgttctgaagtatgaggaagttgacatggattcattagccaaggctgttccagagcccttgaagaagtatactaaatgtagagagctggctgaaagactgaaaatagaagccacttatgaatcagtgttgttccatcaactacaagaaataaagggagttcagcaagatgaagctctccaactgccaaaagacctagattatttgactatcagggatgtgtctttgtcccatgaagttcgagagaaactacattttagtcgtccacagacgatcggggctgctagtcgcatacccggagtaacacctgccgccatcatcaatctgctgagatttgtgaagaccactcaacgaagacagtcggctatgaatgaatcatccaagactgatcaatacttatgtgatgcagacagacttcaagagagagagttatagctttcaattcataaaagatttttaaagagcatataaataatttgatcaatacaacagtatagataaaagaattatttagcacatgttaaaatagctttattaggttactatgggtttgccattaatttctgagtgggacagaaattataattgtgctttttcgtgtatatgaaaaaactagtcgtaaacaatttgtactctttctttaaggagctgtaatacaaataactttgtgcagtgttcatcaaagagagagacagtgaacctaaaactgaacctggaataaaactcaacatgcagatttgcctactcatagggactttgcctattaagtctaccaaattaaaagtcttatcattcagcg

SEQ ID NO: 329533 - DNA, 2376 bp, Homo sapiens
ggcacgaggcgccctgcagattgtctcttgttgcgtaagtttttttgaccgtcactcgtgtcagcttcaaagtcagatagatttttctcccagcatgttctacttccgaggctgtggccgttgggtcgcggtttccttcaccaagcagcaatttccgttggcacggttgagcagtgacagcgcggcgccccggactccgcacttcgacgtgatagtcattggtggaggacatgccgggactgaggcagccaccgccgccgctcggtgcggctctcggactctgctcctcactcaccgcgtggacacgatcggtcagatgtcatgtaatccttcctttggtggcatcggaaagggacatttaatgagggaagtagatgccttggatggcctgtgttctcgcatctgtgaccagtctggtgtacattataaagtattaaaccggcgtaagggaccagctgtgtggggtctgagagctcagattgataggaaactctataaacagaacatgcagaaagaaatcttgaatacaccactgcttactgttcaggagggagctgtagaagatcttattcttacagaaccagagcctgaacacactgggaaatgccgtgtcagtggggttgttttggtggatggaagcacagtatatgcagagagtgtgattctgactactgggacatttctgagaggcatgattgtaattggattggagacgcatccagcaggacgtttaggggatcagccttctataggattggctcagacactggagaagttagggtttgtggtgggaaggttgaagactgggactccaccccgaattgccaaagagtccattaatttcagtattctaaacaagcatataccggacaatccatccataccattcagctttaccaatgagacagtatggattaagccagaagatcagctgccatgttacttgactcacaccaaccctagagtggatgagattgtccttaagaaccttcaccttaatagtcatgttaaagaaacgacaagaggacctcgatactgtccctccattgaatcaaaagttttgcgttttccaaaccgtctacatcaggtttggttggaacctgaaggaatggattctgaccttatctacccacaggggttatctatgacgctaccagctgagttacaagagaaaatgatcacatgcatcagaggcttggagaaagctaaagtgattcagccaggctacggtgttcagtatgattacttagatccccgtcagatcaccccttccttggagactcatttggttcaacgactcttctttgctggacagatcaatggcaccactggttatgaggaagctgcagctcaaggtgtgatagccggaatcaacgccagtcttcgggtcagtcgcaagcctccctttgtggttagccgaacagaaggttacataggagtcttgattgatgacctcactactctgggcaccagtgaaccataccgcatgtttaccagccgagtagagttccgtttgtcactgcgccctgataatgctgacagccggctcacactgcgagggtataaagacgctggctgtgtgtcccaacaacgatatgaaagagcttgttggatgaagtcttctttagaagaaggcatttctgtgttgaaatctattgagtttttgagctctaaatggaaaaaattaatcccagaggcttctataagtactagtagaagtctgcctgtcagagctctcgatgttctgaagtatgaggaagttgacatggattcattagccaaggctgttccagagcccttgaagaagtatactaaatgtagagagctggctgaaagactgaaaatagaagatcggggctgctagtcgcatacccggagtaacacctgccgccatcatcaatctgctgagatttgtgaagaccactcaacgaagacagtcggctatgaatgaatcatccaagactgatcaatacttatgtgatgcagacagacttcaagagagagagttatagctttcaattcataaaagatttttaaagagcatataaataatttgatcaatacaacagtatagataaaagaattatttagcacatgttaaaatagctttattaggttactatgggtttgccattaatttctgagtgggacagaaattataattgtgctttttcgtgtatatgaaaaaactagtcgtaaacaatttgtactctttctttaaggagctgtaatacaaataactttgtgcagtgttcatcaaagagagagacagtgaacctaaaactgaacctggaataaaactcaacatgcagatttgcctactcatagggactttgcctattaagtctaccaaattaaaagtcttatcattcagcg

SEQ ID NO: 329534 - DNA, 838 bp, Homo sapiens
ggcacgaggcgccctgcagattgtctcttgttgcgtaagtttttttgaccgtcactcgtgtcagcttcaaagtcagatagatttttctcccagcatgttctacttccgaggctgtggccgttgggtcgcggtttccttcaccaagcagcaatttccgttggcacggttgagcagtgacagcgcggcgccccggactccgcacttcgacgtgatagtcattggtggaggacatgccgggactgaggcagccaccgccgccgctcggtgcggctctcggactctgctcctcactcaccgcgtggacacgatcggtcagatgtcatgtaatccttcctttggtggcatcggaaagggacatttaatgagggaagtagatgccttggatggcctgtgttctcgcatctgtgaccagtctggtgtacattataaagtattaaaccggcgtaagggaccagctgtgtggggtctgagagctcagattgataggaaactctataaacagaacatgcagaaagaaatcttgaatacaccactgcttactgttcaggagggagctgtagaagatcttattcttacagaaccagagcctgaacacactgggaaatgccgtgtcagtggggttgttttgggctggagtgcagtggcatgatcacagctcgctgtagcctcgaccacctggacccaagtgatcttcctgcctcagcctcctgtgtagctgggaccacaggcatgtgtcaccacccctggctaatttattatttttttttgtagagatgggggtctcactatgttgccaggactggtcttgaaccccagggctccagtgatcttcctgccc

SEQ ID NO: 329535 - DNA, 1164 bp, Homo sapiens
atgcttcaaaataaaattaataccgaattacaaacaaaggtagcaatgttaaaggctactgttctgtggctgggaaagcaggtacaaagtttgcaattgtagcagcaattgcactgtcatttcaatcatattcatatttgtgtgaccaatttggaatagaaccaaagtgaatatccatggaaccttgtaaaagctcatttgcagggagcttttacatccaatattacttttgatatcagtaacttacagagtaaaattcttaacttgaataagcaaactcaaaaataacagccctttttagaagcttaaacagaattccagcagggcttagaaagcctcaaccctggccgggtgcggtggctcacgcctataatcccagcactttgggaggccgaggcgggcagatcacgaggtcagaagatcgagaccatcctggctaaaacagtgaaaccccatctctactaaaaatacaaaaaaattagctgggtgtggtggcgggcacctgtggtcccagctaatcaggaggctgaggtgggagaatgacgtgaacccgggaggcagagcttgcagtgagccaagatggcgccactgcactccagcctgggtgacagagcgagactccatctcaaaaataaaaaaaaaaaaaaaaaaaggcctcaacccttgggggacctatctttaaaaagattattcaaagggccccttttatattaaaattttccaacaaataaggggggaaagggtcccgggattttggccgacaaagaacagtccataaaacggccgggtgtatgaacccccaccaaccgcggggtcattgtgtaaaaacgcttctgcaacagcccgtggaaaaattagcgcctttgtatgtatccgatatgaatgggccgcaaaacacccagagggggggcgacaacattgttggcagacggcccacacaggatatggtgagggggtgtctggtacaacaaactcttacgagtttaatcccccagtgtggggagggcctctttgagttgtgagaacaaatcagacggaagaacgttggttcactccatgggaaacgcgagcgattattgtggcgacaactgtgacaaaacagctgtgactgtgccccacaaaaaagagaatattgtgtgggggcggccacatatgttgccccag

SEQ ID NO: 329536 - DNA, 1387 bp, Homo sapiens
gcggggctggtgggccagaggccagacggagaggccccgccgaggtgagcgaggctccaaccggtcactggtgggtcctggcactggcgggtcgcaacgctgtgggcgttccaggaggtggtcgtggcgaacctggcagctgcgggcatcatggtgggaggcttgaagaggaaacactctgatttggaagaggaggaggagaggtgggagtggagtccagcaggccttcagagctaccagcaagccctgctccgcatctccctagacaaagtccagcgcagcctgggcccccgagcacccagcctccgcaggcatgtcctcatccataacaccctccaacagctgcaggctgcacttcgcctggctcccgcccctgccctgccccccgagcccctcttcctgggcgaggaggatttctccctgtcagccaccattggctctatcctcagggagctggacacctccatggatgggactgagccccctcagaatccagtgactccccttggcctccagaatgaagtgccaccccagcctgatccagtcttcttagaagctctgagctcccggtacttgggggactctggcctggatgacttctttctggacattgacacatctgcggtagaaaaggagcctgcacgggccccaccagagcctcctcacaacctcttctgtgccccaggttcttgggagtggaatgaactggatcacatcatggaaatcattctggggtcctaaaactgtgatagaggggatcgatccttcctcatgtcatcttcggtggcctggatccctgaatgcaactctgggtgtgtgtttttgtgggggctcgaagcagtgactatggcctcctttgttcccatttcagggttccacaaactgtcttgcatgtgtgtgtgtgtctggttaccccgaccttctgtgaaggtgggtcttcctgaattaatttatctattccaaatgccttaacgagactctgtttctgggagtctgattttccacttacacatttcttccacctttcctgctagttcccactcccctgtgaccactggggcctcagggaagataaagaaagctgggcctgtcgaaggatgacagggatgtgctgccaggttgctatagaaacccaggctctgcctcttgcaccttgagggggtgggaggggctggtgtcctccctccaggctgaaccccacttcctcggcaggaccccagtctcagcagcctcctgatttcataaccaggccggaccacgtgcaatagggtggaaaccaaactgctccatgccgggttatttaaaagaaaggcagagtttgtggtggcttttttttttttttttggattgtttgtaatttttttaaataaaagtattttggaaggag

SEQ ID NO: 329537 - DNA, 1330 bp, Homo sapiens
gcggggctggtgggccagaggccagacggagaggccccgccgaggtgagcgaggctccaaccggtcactggtgggtcctggcactggcgggtcgcaacgctgtgggcgttccaggaggtggtcgtggcgaacctggcagctgcgggcatcatggtgggaggcttgaagaggaaacactctgatttggaagaggaggaggagaggtgggagtggagtccagcaggccttcagagctaccagcaagccctgctccgcatctccctagacaaagtccagcgcagcctgggcccccgagcacccagcctccgcaggcatgtcctcatccataacaccctccaacagctgcaggctgcacttcgcctggctcccgcccctgccctgccccccgagcccctcttcctgggcgaggaggatttctccctgtcagccaccattggctctatcctcagggagctggacacctccatggatgggactgagccccctcagaatccagtgactccccttggcctccagaatgaagtgccaccccagcctgatccagtcttcttagaagctctgagctcccggtacttgggggactctggcctggatgacttctttctggacattgacacatctgcggtagaaaaggagcctgcacgggccccaccagagcctcctcacaacctcttctgtgccccaggttcttgggagtggaatgaactggatcacatcatggaaatcattctggggtcctaaaactgtgatagaggggatcgatccttcctcatgtcatcttcggtggcctggatccctgaatgcaactctgggtgtgtgtttttgtgggggctcgaagcagtgactatggcctcctttgttcccatttcagggttccacaaactgtcttgcatgtgtgtgtgtgtctggttaccccgaccttctgtgaaggtgggtcttcctgaattaatttatctattccaaatgccttaacgagactctgtttctgggagtctgattttccacttacacatttcttccacctttcctgctagttcccactcccctgtgaccactggggcctcagggaagataaagaaagctgggcctgtcgaaggatgacagggatgtgctgccaggttgctatagaaacccaggctctgcctcttgcaccaggaccccagtctcagcagcctcctgatttcataaccaggccggaccacgtgcaatagggtggaaaccaaactgctccatgccgggttatttaaaagaaaggcagagtttgtggtggcttttttttttttttttggattgtttgtaatttttttaaataaaagtattttggaaggag

SEQ ID NO: 329538 - DNA, 1135 bp, Homo sapiens
gcggggctggtgggccagaggccagacggagaggccccgccgaggtgagcgaggctccaaccggtcactggtgggtcctggcactggcgggtcgcaacgctgtgggcgttccaggaggtggtcgtggcgaacctggcagctgcgggcatcatggtgggaggcttgaagaggaaacactctgatttggaagaggaggaggagaggtgggagtggagtccagcaggccttcagagctaccagcaagccctgctccgcatctccctagacaaagtccagcgcagcctgggcccccgagcacccagcctccgcaggcatgtcctcatccataacaccctccaacagctgcaggctgcacttcgcctggctcccgcccctgccctgccccccgagcccctcttcctgggcgaggaggatttctccctgtcagccaccattggctctatcctcagggagctggacacctccatggatgggactgagccccctcagaatccagtgactccccttggcctccagaatgaagtgccaccccagcctgatccagtcttcttagaagctctgagctcccggtacttgggggactctggcctggatgacttctttctggacattgacacatctgcggtagaaaaggagcctgcacgggccccaccagagcctcctcacaacctcttctgtgccccaggttcttgggagtggaatgaactggatcacatcatggaaatcattctggggtcctaaaactgtgatagaggggatcgatccttcctcatgtcatcttcggtggcctggatccctgaatgcaactctgggtgtgtgtttttgtgggggctcgaagcagtgactatggcctcctttgttcccatttcagggttccacaaactgtcttgcatgtgtgtgtgtgtctggttaccccgaccttctgtgaaggtgggtcttcctgaattaatttatctacaggaccccagtctcagcagcctcctgatttcataaccaggccggaccacgtgcaatagggtggaaaccaaactgctccatgccgggttatttaaaagaaaggcagagtttgtggtggcttttttttttttttttggattgtttgtaatttttttaaataaaagtattttggaaggag

SEQ ID NO: 329539 - DNA, 1579 bp, Homo sapiens
acgtggcatctccttgacagaggtggtgagaagtatttttttacagtccctattttacagatgaggaaactgaggccctgagaattgactcattcagatcacttcccatgatcacgcagctgagcagtttccaatacagaattcagatttggggttccctacttcgaatccaggtctctgtgctccacacttgtctttcgtgctccatgtttgaagaaattaatattgtggaagaacagttttaaggcttagaggaacttgagttaggatccgtacttggcagatgaggaaattgattctcatggatgtaaattcactgtttgaggccacaacaggggcatcatggtgggaggcttgaagaggaaacactctgatttggaagaggaggaggagaggtgggagtggagtccagcaggccttcagagctaccagcaagccctgctccgcatctccctagacaaagtccagcgcagcctgggcccccgagcacccagcctccgcaggcatgtcctcatccataacaccctccaacagctgcaggctgcacttcgcctggctcccgcccctgccctgccccccgagcccctcttcctgggcgaggaggatttctccctgtcagccaccattggctctatcctcagggagctggacacctccatggatgggactgagccccctcagaatccagtgactccccttggcctccagaatgaagtgccaccccagcctgatccagtcttcttagaagctctgagctcccggtacttgggggactctggcctggatgacttctttctggacattgacacatctgcggtagaaaaggagcctgcacgggccccaccagagcctcctcacaacctcttctgtgccccaggttcttgggagtggaatgaactggatcacatcatggaaatcattctggggtcctaaaactgtgatagaggggatcgatccttcctcatgtcatcttcggtggcctggatccctgaatgcaactctgggtgtgtgtttttgtgggggctcgaagcagtgactatggcctcctttgttcccatttcagggttccacaaactgtcttgcatgtgtgtgtgtgtctggttaccccgaccttctgtgaaggtgggtcttcctgaattaatttatctattccaaatgccttaacgagactctgtttctgggagtctgattttccacttacacatttcttccacctttcctgctagttcccactcccctgtgaccactggggcctcagggaagataaagaaagctgggcctgtcgaaggatgacagggatgtgctgccaggttgctatagaaacccaggctctgcctcttgcaccttgagggggtgggaggggctggtgtcctccctccaggctgaaccccacttcctcggcaggaccccagtctcagcagcctcctgatttcataaccaggccggaccacgtgcaatagggtggaaaccaaactgctccatgccgggttatttaaaagaaaggcagagtttgtggtggcttttttttttttttttggattgtttgtaatttttttaaataaaagtattttggaaggag

SEQ ID NO: 329540 - DNA, 1550 bp, Homo sapiens
gcggggctggtgggccagaggccagacggagaggccccgccgaggtgagcgaggctccaaccggtcactggtgggtcctggcactggcgggtcgcaacgctgtgggcgttccaggaggtggtcgtggcgaacctggcagctgcggtctctgtgctccacacttgtctttcgtgctccatgtttgaagaaattaatattgtggaagaacagttttaaggcttagaggaacttgagttaggatccgtacttggcagatgaggaaattgattctcatggatgtaaattcactgtttgaggccacaacaggggcatcatggtgggaggcttgaagaggaaacactctgatttggaagaggaggaggagaggtgggagtggagtccagcaggccttcagagctaccagcaagccctgctccgcatctccctagacaaagtccagcgcagcctgggcccccgagcacccagcctccgcaggcatgtcctcatccataacaccctccaacagctgcaggctgcacttcgcctggctcccgcccctgccctgccccccgagcccctcttcctgggcgaggaggatttctccctgtcagccaccattggctctatcctcagggagctggacacctccatggatgggactgagccccctcagaatccagtgactccccttggcctccagaatgaagtgccaccccagcctgatccagtcttcttagaagctctgagctcccggtacttgggggactctggcctggatgacttctttctggacattgacacatctgcggtagaaaaggagcctgcacgggccccaccagagcctcctcacaacctcttctgtgccccaggttcttgggagtggaatgaactggatcacatcatggaaatcattctggggtcctaaaactgtgatagaggggatcgatccttcctcatgtcatcttcggtggcctggatccctgaatgcaactctgggtgtgtgtttttgtgggggctcgaagcagtgactatggcctcctttgttcccatttcagggttccacaaactgtcttgcatgtgtgtgtgtgtctggttaccccgaccttctgtgaaggtgggtcttcctgaattaatttatctattccaaatgccttaacgagactctgtttctgggagtctgattttccacttacacatttcttccacctttcctgctagttcccactcccctgtgaccactggggcctcagggaagataaagaaagctgggcctgtcgaaggatgacagggatgtgctgccaggttgctatagaaacccaggctctgcctcttgcaccttgagggggtgggaggggctggtgtcctccctccaggctgaaccccacttcctcggcaggaccccagtctcagcagcctcctgatttcataaccaggccggaccacgtgcaatagggtggaaaccaaactgctccatgccgggttatttaaaagaaaggcagagtttgtggtggcttttttttttttttttggattgtttgtaatttttttaaataaaagtattttggaaggag

SEQ ID NO: 329541 - DNA, 1246 bp, Homo sapiens
gcggggctggtgggccagaggccagacggagaggccccgccgaggtgagcgaggctccaaccggtcactggtgggtcctggcactggcgggtcgcaacgctgtgggcgttccaggaggtggtcgtggcgaacctggcagctgcgggcatcatggtgggaggcttgaagaggaaacactctgatttggaagaggaggaggagaggtgggagtggagtccagcaggccttcagagctaccagcaagccctgctccgcatctccctagacaaagtccagcgcagcctgggcccccgagcacccagcctccgcaggcatgtcctcatccataacaccctccaacagctgcaggctgcacttcgcctggctcccgcccctgccctgccccccgagcccctcttcctgggcgaggaggatttctccctgtcagccaccattggctctatcctcagggagctggacacctccatggatgggactgagccccctcagaatccagtgactccccttggcctccagaatgaagtgccaccccagcctgatccagtcttcttagaagctctgagctcccggtacttgggggactctggcctggatgacttctttctggacattgacacatctgcggtagaaaaggagcctgcacgggccccaccagagcctcctcacaacctcttctgtgccccaggttcttgggagtggaatgaactggatcacatcatggaaatcattctggggtcctaaaactgtgatagaggggatcgatccttcctcatgtcatcttcggtggcctggatccctgaatgcaactctgggtgtgtgtttttgtgggggctcgaagcagtgactatggcctcctttgttcccatttcagggttccacaaactgtcttgcatgtgtgtgtgtgtctggttaccccgaccttctgtgaagataaagaaagctgggcctgtcgaaggatgacagggatgtgctgccaggttgctatagaaacccaggctctgcctcttgcaccttgagggggtgggaggggctggtgtcctccctccaggctgaaccccacttcctcggcaggaccccagtctcagcagcctcctgatttcataaccaggccggaccacgtgcaatagggtggaaaccaaactgctccatgccgggttatttaaaagaaaggcagagtttgtggtggcttttttttttttttttggattgtttgtaatttttttaaataaaagtattttggaaggag

SEQ ID NO: 329542 - DNA, 466 bp, Homo sapiens
catacagcctctgtttcaactactaatctctgctgttgtaccatacaaggacctatagacaatacgtaaataaaactttatttatacaaacaggcaacagactggatttagtctgtaggttgtagtttgttcaggcctcttctagaaaagcaagctataatatgattatcttatatattgttacccagaattcctccagcaggaaggtttcacagtgtgactaacaggtctgctgaattaagagaaaactcttatagataagaaggtgcctatagtgatattccattggctcagaatccaaagcctactgagagtattgtcaatgccaactctactttatatagactggaaatggcatgactgaatttgaagggtctgcaacaaagtagagaaatgttaggttctcctgcctttttactgagccattagccatttgaattttttgtttgttttttgtttgcttgtt

SEQ ID NO: 329543 - DNA, 303 bp, Homo sapiens
accccacacagaaagagagagagagagagcctttcacccaaggttacatttttcaataagtatcacatctgctgtcaatatcacttaactaattagggcccagggttctaaatcacaatttcagaatgggttataaatacagagaagtgtcttagtatgctcagcagtttttaatctttcacaagagattatgaaacaaccttgtgtacaatcgaaaaagacataaatctcttgttctgctgtaaaattatttataatagtctttcttttttttcttcctattagtctttccctatcttctgt

SEQ ID NO: 329544 - DNA, 219 bp, Homo sapiens
gggattacaggcgtgaactaccgcgcctggcctggaatggcttttgatgttctcctatgtgcacatgtgggtgaataaacaccaacaaagtccttatgttacctgaagagttgctctcttcttaatatttaagtcgtatttatttaaatactttaatagttgtacactattaaagtattattaggtcaaaatcaaggaagtacaaaagggtatgctgtg

SEQ ID NO: 329545 - DNA, 449 bp, Homo sapiens
ctttttctcgagatctcccaactcccggtttacggtcaggaagaatctataacatgaactcctgcttaaaaacaagggtatagatcccatattcaggtcttagactgggaagaagagaaggcagtcaaaaatattaaatatatgaatttcagtaaattcagttggggatgccatttcagctttgcagtcagttactccagaatgtgtcaatgtatggcaaagcatgtgacagcaggatctctgcaccctctccatttaccagctgtggtggatctcttagccacatctctgtttataatgtgcttattgaaaactaatgtattacttttattatcatagctaccatttactgaatatttacattgtgctaacactggttcagatggcttccatcatatttacctgatttaatcctcacaacaaccttatgtgctaggtccagttattac

SEQ ID NO: 329546 - DNA, 299 bp, Homo sapiens
cttttagggttgggagggcagaggagaaacggcaggtggcactgcggatatttttacacaggataatgtgacctgcccagcctgcacctgcgctcagcatcatcagagttccgtttcttatacttaattaggctacacaaccaattttacgattttaccattttgaaatcacgtgggagttaccaaaatggttaatttaaaacggttttacccagactttggggggcagtcttgattcttaaatggctttgatggctttgataaacaccctgggcccttcctccaaaaaatacacactc

SEQ ID NO: 329547 - DNA, 263 bp, Homo sapiens
cagtgttttgtggaaataaaacttgtaataaagtcagtgccaggagttagttcatactgggctaagctgcatagcaccccccaccccctttttgagccctgatgtgggtggcatgttgtaagtggctgaataatgaagattatttgaataaagacaataaaggccaggaggagggtggcagcaatagaaaggagaaagatcggagattttggaaagagaaatgaaaggccatagtggtatgctgtaggttgtattctagtttt

SEQ ID NO: 329548 - DNA, 344 bp, Homo sapiens
ggttgcatttgctggtgattctaaaaaagagtgctaaaaggaagttactgagggcctaaaccatattattttactgtggatgttctgctgtataactgtttccttatttccacttgttacagacctcgtttatacatcagaaaccccattttctgccatattctgtttattctgctaattacaattatggggaacatcttcatctcaggttcctgttgatgggcacatacaggaactcagaggaaaaaaaatcagctgtgttcttagtctcattgtcttcaaatcctcagttgaatgtaccaggatattacagtgaaactggcaccttataaacctcttcaggg

SEQ ID NO: 329549 - DNA, 339 bp, Homo sapiens
ctcagcctcccaagtagctgggactacaggcatgtaccaccatgcctggctaagttgtttattttgtaaagatggatcttgctgtgttgcccaggctggtctcaaactcatggcctaagtgatcctctcacttaggcatcccaaagtgctgggattatgggcacgagccactgtgcctggtcctttctttttttttcttatgtgtgctatgtgttacatatgtttgtcttttattttgctgatttagtgaggaaaaacaggttttcttgaaggataaaaatctgtatttattccaaaagataattagtaaaattagtttaatttggtttaatttttgtt

SEQ ID NO: 329550 - DNA, 379 bp, Homo sapiens
ctgggattacaggtgcccaccaccatgcccagctaagtttttgtatttttagaagagatgggttttcgtcatgttggccaggctggtctcaaactcccggcctcaggtgatctgcctacctcagcctcccaaaatgctggaattacaggcgtgaggccctgcgactggccaacttctccgtttttattggtaataccaacttctttctaatttccttgaccagaaattttagagtacttttattcttcccctgatgctggggatgtcctttactctatttcattgactgtaagcctagttcagacttttatcacctaattcctggaaaaatgcaacaaagtggctggctggggaataattctggctcaaacgtcttccc

SEQ ID NO: 329551 - DNA, 791 bp, Homo sapiens
gttgtcgactgtgcacacaggctgaagatccagaggaggaaagggagggatactaaaagctttatacagttgaggtatttcctgtggttgtgttagctattgctgtgtaacaaattaccccaaaacttggtggactgaaacaccacttactggctgggcacggtggctcacgcctgttaccccagcactttggtaggccaaggcaggcaggtcacatgaggccaggagttcaagaccagcctggccaacatggtgaaaccccataaattagtcgggcatggtggcatgcacctgtagtcccaagtagctgactctggaggctgaggcatgagaatcacttgaacccaggaggcagaggttggactgagctgagactgcaccactgcactccagcctgggtgacagagtgagactgtctcaaaaaataaaaagaaaaaagaaacaccacttactatttaagtttttgtgggtcaggaatcagtgcagcttagctgggtcctctgattctgtgtttctcacaaggctgcagtcatctcagagattcacttcctagttcactcgtggttattggctggatttggttcctctcaggctattagattgaggcctcagttcctcataagctgatgtccagaagcttctccatagagcatctcacaacatggcagtgtgcttcatcagatgaacaagtaggggagtgatatggtttagatctgtatccctgcccaaatcttgtgtcgaatggtaatgcccgtgttggaggtgggtcctggtgggggggtgactggatc

SEQ ID NO: 329552 - DNA, 220 bp, Homo sapiens
tagggacacggcagtgagctcagacattctcccagagcccacagagtagtgagggagacataaaagaaaggggtgaggccaggcgtggtggctcacgcctgtaatcccaacagtttgggaggccgaggcaggcggatcacaaggtcaagagatcgagaccatcttggccaacatggtgaaaccctgtctctactaaaaatacaaaaattagctgggtgtg

SEQ ID NO: 329553 - DNA, 263 bp, Homo sapiens
attaatgaaataacagaagtgatttccatcatggctcagttgccttgcctctcctccctgaatccaggaatctatgttctcagccccaggacaaccacacaatttaaaacctgttctacaatgccacctccctatctgttgctagaagcctgctcccagcagttatgtgggccatccccctgcctctgcatgagatcccctctctttagcccagcctactctgccttatccccactctccctttcccaaactcagggaaagag

SEQ ID NO: 329554 - DNA, 592 bp, Homo sapiens
ttagatgagaggtaaaaacaagctatattttcagttttaaaactacctacatatgcttctgacatcaatgtccataaataaaaattctagatccttatactttaacagcacaaaaagataaaaatcagtttggacttttcatctttactacagtctataaacaatcattcccaaagatagccagtcagatcattctttatgatcattaccaaccagaataaacctatgtttaatctgtgcataactgtagtcacaattaactggaaagtttataaataagtctcagctacttgggaggctgaggtgagaggatagctttcagtctaggagtctgagtccagcctgagaaagagagagaaattccatctttaaaaaacgaggggggccgggtgcggtggctcacaccttggtaatcccagcactttgggaagccaaggtgggcggatcacctgagcacaggagtttgagaccagcctgggcaacatggcaaaaccctgtctctacaaaaaaaaaaaggaaggaaagaaaaagaaaagtttagcagggcatgggtggctcatgcctacagtcccagcaactggggaggctgagg

SEQ ID NO: 329555 - DNA, 411 bp, Homo sapiens
cggccacagactggaaatgaccctgatagagttagcacgctatgcaaacagctttacgcgctattgctgtgacagttcagacaatggatgcacagtgtaatccaagggaccggtgtttccctttgggcaaatgtcacagaatccagagctggaagtatcagttgaaaaaataaattctgagattcactgtgttacggaataacgtctctctagtagttcagactacactgatttcagatagggtcagagcaagaatttagagcagcaacaaatgaggcttgaataaacctcagaagttgtctagatagatctgcaaaggcgactgtggtctccaaagttagatgagaggtaaaaacaagctatattttcagttttaaaactacctacatatgcttctgacatcaatgtcca

SEQ ID NO: 329556 - DNA, 2064 bp, Homo sapiens
gactatcgttcattgaagttgttgatacaaatgttgaacaggagaaaaaccagtagcttgccaacttggcacctcattctctagcttgacagtaatctcttatctagtagtttttagatatggttatttaatcaaatatcactagcttctaattttgttataattcattcatgtatacagacaatgaagaatcatctttcttcattcaacacatttattgggaaccaatcattgtccaaggcaatatgctaggcattgtgtaatagaaagcgattaagcttttacccctgtcctctttggcctgcaaagagcaggtaagattcatgcacagacaaatgtagtaccaggtaaatagtgaggccaaacacaagaggcaggtcaaagggctttggattcagaggatggagaagctctttctaggctggtgaaatatttgcagaatgagtaggctcataagtggaggtgaggtacaggctaagctgctgtaagaaagagtccaaaatgcaaaggatttaccacaatgcagttaatttttctcacaacggtcgaggtaggcaggtggtccaagtccagttaatcagccctcctcaacacaaggcttccccttgtaagctcaggatgaccgctccagttctcatcatctcccaggcagaaaaacgggagaaagagaactagacgtaccacccagtcattttaaggacatagccaggccaggtgcagtgactcacatctgtaatccaagcactttgggaggtcgaggctggaggatagcttgaagccaggagtttgagaccagcttggataagaaagcaagaccttgtctctacaaaaaatttaaaaattaaccatgtgtggtggtgtgcacctatagtcccagctactcaggaggctgaggtggaaggatcacttgagcacaggagttggaggatacagtgagccatgatcacaccacctcactccagcctgggcaacatagtgagaccccatctctttaaaaaacaaaacaaaaaaacatcaccaggaagttgcttacatgtcttctattcctataacatcggcctgagcttagtcacatggccacacccagcagaaagaactctaggaaatatggtcttatgctaggtaaccccaaacccagctaaaactgttgcttttgaagaagggtgaaacagacaatgtggaggagaattaccagtctgccacaaagagaaagaattctatgtgaggaaaacgctctagaagagggagctgattaattagttatatctcagccgagaggatgttatgagaaacacagatttgggtttaatagaaaaacttagaacccttcaagaaggaatgggcggacttgagagtgtcctccgcttctgaaaatgatcaagaaaaatggtaagaatgtacacctcaagggtggatggtaaaggtcagcctttaagcctcaatggcggtgtggttgtaggtggggtgggggtggaggccccgaagacaggcagactaccacagtagccccgatggaagcagtgagaatgaactggaaggagcggctgtgggagcgacaacgtgatgagaataaacccggcttggctctgccctgtgcacacacaggtgagctgtgtgctcccggatgtgtcagctggtatatgcgtctgtcagaaggcagctggggagcactgttagctcagagactaagaggcagacccaggaagcccttctttgcattggtcagggtttgctgcattttcccaagcccaggaaatggaacccagttcttcttctttctgtgtaaaataataagcatcacaataggctgtgctcatgagaacgcattttgtttccacagaaatgttttttctcactctgtcctgattttgatttctgttaaactcagtaaacacattaccaaattttaaaataaggtgacttgttttccccaactcacagttcaccaaaggtatttcatctgtttgttctgaaaatgcagctgctgtctagatttatgtgtgctctgacaagaaatgttttgtgtaacaataaaaatcatttcctttgatgaaaaaaaaaaaa

SEQ ID NO: 329557 - DNA, 2153 bp, Homo sapiens
tccacaaattcaatggacgatagtccaaataacccttgtgcccgtggaaaacacaacggggagcccaaaaaaaaaaaaaaactagataagagagtcaaaaatcaaaaagatctgtacaaatgttgaacaggagaaaaaccagtagcttgccaacttggcacctcattctctagcttgacagtaatctcttatctagtagtttttagatatggttatttaatcaaatatcactagcttctaattttgttataattcattcatgtatacagacaatgaagaatcatctttcttcattcaacacatttattgggaaccaatcattgtccaaggcaatatgctaggcattgtgtaatagaaagcgattaagcttttacccctgtcctctttggcctgcaaagagcaggtaagattcatgcacagacaaatgtagtaccaggtaaatagtgaggccaaacacaagaggcaggtcaaagggctttggattcagaggatggagaagctctttctaggctggtgaaatatttgcagaatgagtaggctcataagtggaggtgaggtacaggctaagctgctgtaagaaagagtccaaaatgcaaaggatttaccacaatgcagttaatttttctcacaacggtcgaggtaggcaggtggtccaagtccagttaatcagccctcctcaacacaaggcttccccttgtaagctcaggatgaccgctccagttctcatcatctcccaggcagaaaaacgggagaaagagaactagacgtaccacccagtcattttaaggacatagccaggccaggtgcagtgactcacatctgtaatccaagcactttgggaggtcgaggctggaggatagcttgaagccaggagtttgagaccagcttggataagaaagcaagaccttgtctctacaaaaaatttaaaaattaaccatgtgtggtggtgtgcacctatagtcccagctactcaggaggctgaggtggaaggatcacttgagcacaggagttggaggatacagtgagccatgatcacaccacctcactccagcctgggcaacatagtgagaccccatctctttaaaaaacaaaacaaaaaaacatcaccaggaagttgcttacatgtcttctattcctataacatcggcctgagcttagtcacatggccacacccagcagaaagaactctaggaaatatggtcttatgctaggtaaccccaaacccagctaaaactgttgcttttgaagaagggtgaaacagacaatgtggaggagaattaccagtctgccacaaagagaaagaattctatgtgaggaaaacgctctagaagagggagctgattaattagttatatctcagccgagaggatgttatgagaaacacagatttgggtttaatagaaaaacttagaacccttcaagaaggaatgggcggacttgagagtgtcctccgcttctgaaaatgatcaagaaaaatggtaagaatgtacacctcaagggtggatggtaaaggtcagcctttaagcctcaatggcggtgtggttgtaggtggggtgggggtggaggccccgaagacaggcagactaccacagtagccccgatggaagcagtgagaatgaactggaaggagcggctgtgggagcgacaacgtgatgagaataaacccggcttggctctgccctgtgcacacacaggtgagctgtgtgctcccggatgtgtcagctggtatatgcgtctgtcagaaggcagctggggagcactgttagctcagagactaagaggcagacccaggaagcccttctttgcattggtcagggtttgctgcattttcccaagcccaggaaatggaacccagttcttcttctttctgtgtaaaataataagcatcacaataggctgtgctcatgagaacgcattttgtttccacagaaatgttttttctcactctgtcctgattttgatttctgttaaactcagtaaacacattaccaaattttaaaataaggtgacttgttttccccaactcacagttcaccaaaggtatttcatctgtttgttctgaaaatgcagctgctgtctagatttatgtgtgctctgacaagaaatgttttgtgtaacaataaaaatcatttcctttgatgaaaaaaaaaaaa

SEQ ID NO: 329558 - DNA, 1695 bp, Homo sapiens
  misc_feature (1679)..(1680): n is a, c, g, or t
  misc_feature (1687)..(1687): n is a, c, g, or t
gactatcgttcattgaagttgttgatacaaatgttgaacaggagaaaaaccagtagcttgccaacttggcacctcattctctagcttgacagtaatctcttatctagtagtttttagatatggttatttaatcaaatatcactagcttctaattttgttataattcattcatgtatacagacaatgaagaatcatctttcttcattcaacacatttattgggaaccaatcattgtccaaggcaatatgctaggcattgtgtaatagaaagcgattaagcttttacccctgtcctctttggcctgcaaagagcaggtaagattcatgcacagacaaatgtagtaccaggtaaatagtgaggccaaacacaagaggcaggtcaaagggctttggattcagaggatggagaagctctttctaggctggtgaaatatttgcagaatgagtaggctcataagtggaggtgaggtacaggctaagctgctgtaagaaagagtccaaaatgcaaaggatttaccacaatgcagttaatttttctcacaacggtcgaggtaggcaggtggtccaagtccagttaatcagccctcctcaacacaaggcttccccttgtaagctcaggatgaccgctccagttctcatcatctcccaggcagaaaaacgggagaaagagaactagacgtaccacccagtcattttaaggacatagccaggccaggtgcagtgactcacatctgtaatccaagcactttgggaggtcgaggctggaggatagcttgaagccaggagtttgagaccagcttggataagaaagcaagaccttgtctctacaaaaaatttaaaaattaaccatgtgtggtggtgtgcacctatagtcccagctactcaggaggctgaggtggaaggatcacttgagcacaggagttggaggatacagtgagccatgatcacaccacctcactccagcctgggcaacatagtgagaccccatctctttaaaaaacaaaacaaaaaaacatcaccaggaagttgcttacatgtcttctattcctataacatcggcctgagcttagtcacatggccacacccagcagaaagaactctaggaaatatggtcttatgctaggtaaccccaaacccagctaaaactgttgcttttgaagaagggtgaaacagacaatgtggaggagaattaccagtctgccacaaagagaaagaattctatgtgaggaaaacgctctagaagagggagctgattaattagttatatctcagccgagaggatgttatgagaaacacagatttgggtttaatagaaaaacttagaacccttcaagaaggaatgggcggacttgagagtgtcctccgcttctgaaaatgatcaagaaaaatggtaagaatgtacacctcaagggtggatggtaaaggtcagcctttaagcctcaatggcggtgtggttgtaggtggggtgggggtggaggccccgaagacaggcagactaccacagtagccccgatggaagcagtgagaatgaactggaaggagcggctgtgggagcgacaacgtgatgagaataaacccggcttggctctgccctgtgcacacacaggtgagctgtgtgctcccggatgtgtcagctggtatatgcgtctgtcagaaggcagctggggagcactaagcganngggatcntctagaat

SEQ ID NO: 329559 - DNA, 1377 bp, Homo sapiens
tgagccactgcgtctggccttctaagcactgatcttgtgatctccctggacctgggtgacagagcgagactccatctcaaaaaaaaaaaaaaaaaaaaagcacactgtcgattggctcttagagcatatttttaatacaaaatctgtctttgtgaatagagaatagggacgtattttttaaaattgctaccaatcccaaggagcaaggagcatcgatgctttgacttttctgcagggcaggtgacttggcctagctggttttgggtggtgagtgcagtgagtgggccatgacacagtacacgccatgttcacctgtttcccaaaatgtttaggtttttcccctccagtaaatgtgactgtctctccccgttctgaagaaagccatacaacgacggtttctggtggcaatgggagcgtgttccaggcgggcccgcagcttcaggcactggctaacttagaagccaggagggggtctataggtgctgctctctcatcccgggatgtcagtgggctgcctgtttatgctcagtcaggagagcctaggaggctgacccaggcacaggtggcagcgtttcctggagagaatgctttggaacactcttcagaccaggacacctgggacagcctgaggagcccgggtttctgcagccctttgtcatctggtggtggagcagagtccctgccgcctggggggcctggacatgcagaggcaggacacctcggcaaggtttgtgacttccacctgaaccaccagcagcccagccccaccagcgtcctgcctacagaggtggcagcccctccgcttgagaaaattttgtctgtggatagcgtggcagtggactgtgcctacaggactgtgcccaagccagggcctcagcctggcccacatggatcactattgactgaagggtgtctcagaagcctttcgggggacttgaaccggttcccctgtgggatggaggtgcactctggccagagagaactggagagcgtggttgctgtcggcgaagccatggcttttgaaatttccaatgggagccatgagttactgtctcagggacagaagcagatttttattcagacttccgatgggcttatcttgtcccctccaggtacaatagtgtctcaggaggaggacattgtcacagtgactgatgcagaggggcgtgcctgcggatgggcccgctagaaggagttcctctagaagctgtggagtcggtcgtcaccgtggagccagagccctcacagtgaagtggagtcagatcctagattcgtctgattttatccagagaaggtctatggcaagcaatgtatatttttctaatgtgaatattgcacagatgaaccttttatttataaagaataatgtctttctgc

SEQ ID NO: 329560 - DNA, 842 bp, Homo sapiens
acccgggttcgagtccccgcctcggccgccatggcggatgcggagccggaggctgggggcggcagcgaggatggcggcggcggcggcggccggctcctccgggccagagcggcagcgtcgcacgtgtggccccgctgggccccgagcagctgcggcaggtcctggagcaggtgacgaaggcgcagccgccgccgccgccgccccccttcgtgctgcgggacgcggcgcggcggctgcgggacgcgggccaacaggccgccctgcagcggggccggggcaccgagcccccgcgcctgccgcgcctgctcccgccccaggtgaggcgtcgggagggacgtggggaaactgaggcccgaagggggccgacgccccgcggcggggtagctgcttgtccggggaggccagtatccgcccgggttaagactcagggcgtccccaggctgagcttcttagggacggcgttcggcccccacctgtcaccaccctggcattttcaccccaggagcctcactctaggagcggttgctcacgctgggccctgtgcctggaacgccctcgtgccttctctgccttcacagccctgctgggggcttttgcgtgctccctagctcttcttacaggcctttcaccgctggttcagcctttgtggagcacttagagaccgtgttcccagcactccccactatgtgcaggaggtgaagccttgaacacacttgctgaagaacgaacataaggcaggttctgggattgacgggggctgctttagagtgggtggtcccgtaggccagacactggagctgaaacataaatgaattaaaaggaaccaacttagcttttcagtt

SEQ ID NO: 329561 - DNA, 3026 bp, Homo sapiens
aaacacattacatcaacttttatatgtaagatgtaatttagaaaaaatgtcaataatggttttatgacgagactgaaattgcagacatgttcataagcacaatgcttcttttctctttcttgtctttctgtacgtaagcaactagaagccatttgtgtcaaggtaacgtctggagaaacaaaaggtcaggaaaggccaatgctcctaccgaccacaatccagccccaaactgcaagaaagagccagctgccccgggggaattcctgcctggtggggctccatatcgccagccctcagctgctcagggtacagccgcttgtgagaaccgagccacagtcctgcttcctaagtgacttatgccaacctcctgctcaggggtttgtacagagaccactgccagccctccaggtggtccctgcaaagagagtcccagcccccaaggctccagatgaacagggctccatgttgacccctttgtctgcctctgacccgctggcagtaacatctctttcatccagttcagcacatccatttatttccaacttgcatacaagacatactgagaaactaaaaaaatcgttaaaagtaaagacacgttctggacgggtatctcgacctcccaaatataaagctaaagattataagttcataaaaacagaggatctggcggatggtcatctgtcagattctgatgattactcagaactctgtgtggaagaagatgaagatcagagggagaggcacgcactctttgacttatcgagctgctccctgaggcccaaaagctttaagtgtcagacttgtgaaaagtcatatatagggaaggggggactggcccgacattttaaacttaacccaggccacggccagttggaccccgagatggtgctgtctgagaaagccagtggaagcaccctccgggggtgcacggaggaaaggacgctcagcctgacctccctggggctgtccatgccagcggatccatgtgagggaggggcccgctcctgcttggtgacagagtcagcacgcggtggcctgcagttcctccagcagtgtgaccgggaggatctggtggaattggctctgcctcagctggctcaggttgtgaccgtgtatgagtttcttctgatgaaggttgaaaaagatcatctagcaaagccttttttcccagctatatataaggaatttgaagagttgcataaaatggttaagaaaatgtgccaagattacctcagtagttctggtctgtgttcccaggagaccctggaaataaacaatgataaggttgctgagtcattaggaatcacagaattcctacggaagaaagaaatacacccagacaaccttggacccaagcacctcagccgagacatggatggggagcagctagagggagctagcagcgagaagagggaacgtgaggctgcggaggagggactggcctcagtgaaaaggcccagaagagaagccctgtccaacgataccactgaatctcttgctgccaacagcagaggccgggagaagcccaggcccttgcatgctttggccgctggtttttcccctccagtaaatgtgactgtctctccccgttctgaagaaagccatacaacgacggtttctggtggcaatgggagcgtgttccaggcgggcccgcagcttcaggcactggctaacttagaagccaggagggggtctataggtgctgctctctcatcccgggatgtcagtgggctgcctgtttatgctcagtcaggagagcctaggaggctgacccaggcacaggtggcagcgtttcctggagagaatgctttggaacactcttcagaccaggacacctgggacagcctgaggagcccgggtttctgcagccctttgtcatctggtggtggagcagagtccctgccgcctggggggcctggacatgcagaggcaggacacctcggcaaggtttgtgacttccacctgaaccaccagcagcccagccccaccagcgtcctgcctacagaggtggcagcccctccgcttgagaaaattttgtctgtggatagcgtggcagtggactgtgcctacaggactgtgcccaagccagggcctcagcctggcccacatggatcactattgactgaagggtgtctcagaagcctttcgggggacttgaaccggttcccctgtgggatggaggtgcactctggccagagagaactggagagcgtggttgctgtcggcgaagccatggcttttgaaatttccaatgggagccatgagttactgtctcagggacagaagcagatttttattcagacttccgatgggcttatcttgtcccctccaggtacaatagtgtctcaggaggaggacattgtcacagtgactgatgcagaggggcgtgcctgcggatgggcccgctagaaggagttcctctagaagctgtggagtcggtcgtcaccgtggagccagagccctcacagtgaagtggagtcagatcctagattcgtctgattttatccagagaaggtctatggcaagcaatgtatatttttctaatgtgaatattgcacagatgaaccttttatttataaagaataatgtctttctgccctgctgtctacatttttctatggagcttgtcataataatagcagatattacctgatcaggaatccctgtggcgcgtctgacgctcatgagtttttcatgatggtgatgagtagcactgcactgtcacctgatgattggccctgctccgtttcccttctctcctgggagatatgctgcttttccaccagacttgctccatactagaagcttcttttgggttcaattaaaaagaaaataagctagtcattctgggcagcattttattgatagaagggggaaaaagtcatttctacttgcatgattttttaaattaaattaaattaaattaatttaattatttttgagaccaagtcttactctgtagcccaagctggagtgcagtggcgcgatcttggctcactgcaacctctgccgcctgggctcaagcg

SEQ ID NO: 329562 - DNA, 2310 bp, Homo sapiens
tttcaggtgtgagccacggcgcccggccactaaaaggtttttatggggtatataaagcatgattgttttattttacttttgggtgtgcaacactgtctagaatggtcagtctgtagacgttgaagagacattgccatctgaaccagaaaatggagctcttttgcgatcagagagataccaaggacctagaagacgcgcatgctcagagacccttgcagagtcccgcacagctgtcctccagcagagaagagctgctcagctacctggtggccctgctgcggcaggggagcagagggcgtcgccaagcaaagccaggctcaaggagttcctccagcagtgtgaccgggaggatctggtggaattggctctgcctcagctggctcaggttgtgaccgtgtatgagtttcttctgatgaaggttgaaaaagatcatctagcaaagccttttttcccagctatatataaggaatttgaagagttgcataaaatggttaagaaaatgtgccaagattacctcagtagttctggtctgtgttcccaggagaccctggaaataaacaatgataaggttgctgagtcattaggaatcacagaattcctacggaagaaagaaatacacccagacaaccttggacccaagcacctcagccgagacatggatggggagcagctagagggagctagcagcgagaagagggaacgtgaggctgcggaggagggactggcctcagtgaaaaggcccagaagagaagccctgtccaacgataccactgaatctcttgctgccaacagcagaggccgggagaagcccaggcccttgcatgctttggccgctggtttttcccctccagtaaatgtgactgtctctccccgttctgaagaaagccatacaacgacggtttctggtggcaatgggagcgtgttccaggcgggcccgcagcttcaggcactggctaacttagaagccaggagggggtctataggtgctgctctctcatcccgggatgtcagtgggctgcctgtttatgctcagtcaggagagcctaggaggctgacccaggcacaggtggcagcgtttcctggagagaatgctttggaacactcttcagaccaggacacctgggacagcctgaggagcccgggtttctgcagccctttgtcatctggtggtggagcagagtccctgccgcctggggggcctggacatgcagaggcaggacacctcggcaaggtttgtgacttccacctgaaccaccagcagcccagccccaccagcgtcctgcctacagaggtggcagcccctccgcttgagaaaattttgtctgtggatagcgtggcagtggactgtgcctacaggactgtgcccaagccagggcctcagcctggcccacatggatcactattgactgaagggtgtctcagaagcctttcgggggacttgaaccggttcccctgtgggatggaggtgcactctggccagagagaactggagagcgtggttgctgtcggcgaagccatggcttttgaaatttccaatgggagccatgagttactgtctcagggacagaagcagatttttattcagacttccgatgggcttatcttgtcccctccaggtacaatagtgtctcaggaggaggacattgtcacagtgactgatgcagaggggcgtgcctgcggatgggcccgctagaaggagttcctctagaagctgtggagtcggtcgtcaccgtggagccagagccctcacagtgaagtggagtcagatcctagattcgtctgattttatccagagaaggtctatggcaagcaatgtatatttttctaatgtgaatattgcacagatgaaccttttatttataaagaataatgtctttctgccctgctgtctacatttttctatggagcttgtcataataatagcagatattacctgatcaggaatccctgtggcgcgtctgacgctcatgagtttttcatgatggtgatgagtagcactgcactgtcacctgatgattggccctgctccgtttcccttctctcctgggagatatgctgcttttccaccagacttgctccatactagaagcttcttttgggttcaattaaaaagaaaataagctagtcattctgggcagcattttattgatagaagggggaaaaagtcatttctacttgcatgattttttaaattaaattaaattaaattaatttaattatttttgagaccaagtcttactctgtagcccaagctggagtgcagtggcgcgatcttggctcactgcaacctctgccgcctgggctcaagcg

SEQ ID NO: 329563 - DNA, 1551 bp, Homo sapiens
ttaattctatgaagtcgtttaattcttgcatgtgaatgtgcttctgggggtgtgtgctgtttgggtgaagtttattctcttggcccatttcttttcaggttgctgagtcattaggaatcacagaattcctacggaagaaagaaatacacccagacaaccttggacccaagcacctcagccgagacatggatggggagcagctagagggagctagcagcgagaagagggaacgtgaggtgggcatggctgaagtgggtgccaggtgactgtgcacggtgaattagcgtggtttggcttcttctgttcacaccaggaagaggaggtagcggtttgcctattccttcctattctagctgattgggtcttctcttcacaggctgcggaggagggactggcctcagtgaaaaggcccagaagagaagccctgtccaacgataccactgaatctcttgctgccaacagcagaggccgggagaagcccaggcccttgcatgctttggccgctggtttttcccctccagtaaatgtgactgtctctccccgttctgaagaaagccatacaacgacggtttctggtggcaatgggagcgtgttccaggcgggcccgcagcttcaggcactggctaacttagaagccaggagggggtctataggtgctgctctctcatcccgggatgtcagtgggctgcctgtttatgctcagtcaggagagcctaggaggctgacccaggcacaggtggcagcgtttcctggagagaatgctttggaacactcttcagaccaggacacctgggacagcctgaggagcccgggtttctgcagccctttgtcatctggtggtggagcagagtccctgccgcctggggggcctggacatgcagaggcaggacacctcggcaaggtttgtgacttccacctgaaccaccagcagcccagccccaccagcgtcctgcctacagaggtggcagcccctccgcttgagaaaattttgtctgtggatagcgtggcagtggactgtgcctacaggactgtgcccaagccagggcctcagcctggcccacatggatcactattgactgaagggtgtctcagaagcctttcgggggacttgaaccggttcccctgtgggatggaggtgcactctggccagagagaactggagagcgtggttgctgtcggcgaagccatggcttttgaaatttccaatgggagccatgagttactgtctcagggacagaagcagatttttattcagacttccgatgggcttatcttgtcccctccaggtacaatagtgtctcaggaggaggacattgtcacagtgactgatgcagaggggcgtgcctgcggatgggcccgctagaaggagttcctctagaagctgtggagtcggtcgtcaccgtggagccagagccctcacagtgaagtggagtcagatcctagattcgtctgattttatccagagaaggtctatggcaagcaatgtatatttttctaatgtgaatattgcacagatgaaccttttatttataaagaataatgtctttctgc

SEQ ID NO: 329564 - DNA, 2650 bp, Homo sapiens
acccgggttcgagtccccgcctcggccgccatggcggatgcggagccggaggctgggggcggcagcgaggatggcggcggcggcggcggccggctcctccgggccagagcggcagcgtcgcacgtgtggccccgctgggccccgagcagctgcggcaggtcctggagcaggtgacgaaggcgcagccgccgccgccgccgccccccttcgtgctgcgggacgcggcgcggcggctgcgggacgcgggccaacaggccgccctgcagcggggccggggcaccgagcccccgcgcctgccgcgcctgctcccgccccagcaactagaagccatttgtgtcaaggtaacgtctggagaaacaaaaggtcaggaaaggccaatgctcctaccgaccacaatccagccccaaactgcaagaaagagccagctgccccgggggaattcctgcctggtggggctccatatcgccagccctcagctgctcagggtacagccgcttgtgagaaccgagccacagtcctgcttcctaagtgacttatgccaacctcctgctcaggggtttgtacagagaccactgccagccctccaggtggtccctgcaaagagagtcccagcccccaaggctccagatgaacagggctccatgttgacccctttgtctgcctctgacccgctggcagtaacatctctttcatccagttcagcacatccatttatttccaacttgcatacaagacatactgagaaactaaaaaaatcgttaaaagtaaagacacgttctggacgggtatctcgacctcccaaatataaagctaaagattataagttcataaaaacagaggatctggcggatggtcatctgtcagattctgatgattactcagaactctgtgtggaagaagatgaagatcagagggagaggcacgcactctttgacttatcgagctgctccctgaggcccaaaagctttaagtgtcagacttgtgaaaagtcatatatagggaaggggggactggcccgacattttaaacttaacccaggccacggccagttggaccccgagatggtgctgtctgagaaagccagtggaagcaccctccgggggtgcacggaggaaaggacgctcagcctgacctccctggggctgtccatgccagcggatccatgtgagggaggggcccgctcctgcttggtgacagagtcagcacgcggtggcctgcagaatggtcagtctgtagacgttgaagagacattgccatctgaaccagaaaatggagctcttttgcgatcagagagataccaaggacctagaagacgcgcatgctcagagacccttgcagagtcccgcacagctgtcctccagcagagaagagctgctcagctacctggtggccctgctgcggcaggggagcagagggcgtcgccaagcaaagccaggctcaaggagttcctccagcagtgtgaccgggaggatctggtggaattggctctgcctcagctggctcaggttgtgaccgtgtatgagtttcttctgatgaaggttgaaaaagatcatctagcaaagccttttttcccagctatatataaggaatttgaagagttgcataaaatggttaagaaaatgtgccaagattacctcagtagttctggtctgtgttcccaggagaccctggaaataaacaatgataaggttgctgagtcattaggaatcacagaattcctacggaagaaagaaatacacccagacaaccttggacccaagcacctcagccgagacatggatggggagcagctagagggagctagcagcgagaagagggaacgtgaggctgcggaggagggactggcctcagtgaaaaggcccagaagagaagccctgtccaacgataccactgaatctcttgctgccaacagcagaggccgggagaagcccaggcccttgcatgctttggccgctggtacaatagtgtctcaggaggaggacattgtcacagtgactgatgcagaggggcgtgcctgcggatgggcccgctagaaggagttcctctagaagctgtggagtcggtcgtcaccgtggagccagagccctcacagtgaagtggagtcagatcctagattcgtctgattttatccagagaaggtctatggcaagcaatgtatatttttctaatgtgaatattgcacagatgaaccttttatttataaagaataatgtctttctgccctgctgtctacatttttctatggagcttgtcataataatagcagatattacctgatcaggaatccctgtggcgcgtctgacgctcatgagtttttcatgatggtgatgagtagcactgcactgtcacctgatgattggccctgctccgtttcccttctctcctgggagatatgctgcttttccaccagacttgctccatactagaagcttcttttgggttcaattaaaaagaaaataagctagtcattctgggcagcattttattgatagaagggggaaaaagtcatttctacttgcatgattttttaaattaaattaaattaaattaatttaattatttttgagaccaagtcttactctgtagcccaagctggagtgcagtggcgcgatcttggctcactgcaacctctgccgcctgggctcaagcg

SEQ ID NO: 329565 - DNA, 3205 bp, Homo sapiens
acccgggttcgagtccccgcctcggccgccatggcggatgcggagccggaggctgggggcggcagcgaggatggcggcggcggcggcggccggctcctccgggccagagcggcagcgtcgcacgtgtggccccgctgggccccgagcagctgcggcaggtcctggagcaggtgacgaaggcgcagccgccgccgccgccgccccccttcgtgctgcgggacgcggcgcggcggctgcgggacgcgggccaacaggccgccctgcagcggggccggggcaccgagcccccgcgcctgccgcgcctgctcccgccccagcaactagaagccatttgtgtcaaggtaacgtctggagaaacaaaaggtcaggaaaggccaatgctcctaccgaccacaatccagccccaaactgcaagaaagagccagctgccccgggggaattcctgcctggtggggctccatatcgccagccctcagctgctcagggtacagccgcttgtgagaaccgagccacagtcctgcttcctaagtgacttatgccaacctcctgctcaggggtttgtacagagaccactgccagccctccaggtggtccctgcaaagagagtcccagcccccaaggctccagatgaacagggctccatgttgacccctttgtctgcctctgacccgctggcagtaacatctctttcatccagttcagcacatccatttatttccaacttgcatacaagacatactgagaaactaaaaaaatcgttaaaagtaaagacacgttctggacgggtatctcgacctcccaaatataaagctaaagattataagttcataaaaacagaggatctggcggatggtcatctgtcagattctgatgattactcagaactctgtgtggaagaagatgaagatcagagggagaggcacgcactctttgacttatcgagctgctccctgaggcccaaaagctttaagtgtcagacttgtgaaaagtcatatatagggaaggggggactggcccgacattttaaacttaacccaggccacggccagttggaccccgagatggtgctgtctgagaaagccagtggaagcaccctccgggggtgcacggaggaaaggacgctcagcctgacctccctggggctgtccatgccagcggatccatgtgagggaggggcccgctcctgcttggtgacagagtcagcacgcggtggcctgcagttcctccagcagtgtgaccgggaggatctggtggaattggctctgcctcagctggctcaggttgtgaccgtgtatgagtttcttctgatgaaggttgaaaaagatcatctagcaaagccttttttcccagctatatataaggaatttgaagagttgcataaaatggttaagaaaatgtgccaagattacctcagtagttctggtctgtgttcccaggagaccctggaaataaacaatgataaggttgctgagtcattaggaatcacagaattcctacggaagaaagaaatacacccagacaaccttggacccaagcacctcagccgagacatggatggggagcagctagagggagctagcagcgagaagagggaacgtgaggctgcggaggagggactggcctcagtgaaaaggcccagaagagaagccctgtccaacgataccactgaatctcttgctgccaacagcagaggccgggagaagcccaggcccttgcatgctttggccgctggtttttcccctccagtaaatgtgactgtctctccccgttctgaagaaagccatacaacgacggtttctggtggcaatgggagcgtgttccaggcgggcccgcagcttcaggcactggctaacttagaagccaggagggggtctataggtgctgctctctcatcccgggatgtcagtgggctgcctgtttatgctcagtcaggagagcctaggaggctgacccaggcacaggtggcagcgtttcctggagagaatgctttggaacactcttcagaccaggacacctgggacagcctgaggagcccgggtttctgcagccctttgtcatctggtggtggagcagagtccctgccgcctggggggcctggacatgcagaggcaggacacctcggcaaggtttgtgacttccacctgaaccaccagcagcccagccccaccagcgtcctgcctacagaggtggcagcccctccgcttgagaaaattttgtctgtggatagcgtggcagtggactgtgcctacaggactgtgcccaagccagggcctcagcctggcccacatggatcactattgactgaagggtgtctcagaagcctttcgggggacttgaaccggttcccctgtgggatggaggtgcactctggccagagagaactggagagcgtggttgctgtcggcgaagccatggcttttgaaatttccaatgggagccatgagttactgtctcagggacagaagcagatttttattcagacttccgatgggcttatcttgtcccctccaggtacaatagtgtctcaggaggaggacattgtcacagtgactgatgcagaggggcgtgcctgcggatgggcccgctagaaggagttcctctagaagctgtggagtcggtcgtcaccgtggagccagagccctcacagtgaagtggagtcagatcctagattcgtctgattttatccagagaaggtctatggcaagcaatgtatatttttctaatgtgaatattgcacagatgaaccttttatttataaagaataatgtctttctgccctgctgtctacatttttctatggagcttgtcataataatagcagatattacctgatcaggaatccctgtggcgcgtctgacgctcatgagtttttcatgatggtgatgagtagcactgcactgtcacctgatgattggccctgctccgtttcccttctctcctgggagatatgctgcttttccaccagacttgctccatactagaagcttcttttgggttcaattaaaaagaaaataagctagtcattctgggcagcattttattgatagaagggggaaaaagtcatttctacttgcatgattttttaaattaaattaaattaaattaatttaattatttttgagaccaagtcttactctgtagcccaagctggagtgcagtggcgcgatcttggctcactgcaacctctgccgcctgggctcaagcg

SEQ ID NO: 329566 - DNA, 3430 bp, Homo sapiens
acccgggttcgagtccccgcctcggccgccatggcggatgcggagccggaggctgggggcggcagcgaggatggcggcggcggcggcggccggctcctccgggccagagcggcagcgtcgcacgtgtggccccgctgggccccgagcagctgcggcaggtcctggagcaggtgacgaaggcgcagccgccgccgccgccgccccccttcgtgctgcgggacgcggcgcggcggctgcgggacgcgggccaacaggccgccctgcagcggggccggggcaccgagcccccgcgcctgccgcgcctgctcccgccccagcaactagaagccatttgtgtcaaggtaacgtctggagaaacaaaaggtcaggaaaggccaatgctcctaccgaccacaatccagccccaaactgcaagaaagagccagctgccccgggggaattcctgcctggtggggctccatatcgccagccctcagctgctcagggtacagccgcttgtgagaaccgagccacagtcctgcttcctaagtgacttatgccaacctcctgctcaggggtttgtacagagaccactgccagccctccaggtggtccctgcaaagagagtcccagcccccaaggctccagatgaacagggctccatgttgacccctttgtctgcctctgacccgctggcagtaacatctctttcatccagttcagcacatccatttatttccaacttgcatacaagacatactgagaaactaaaaaaatcgttaaaagtaaagacacgttctggacgggtatctcgacctcccaaatataaagctaaagattataagttcataaaaacagaggatctggcggatggtcatctgtcagattctgatgattactcagaactctgtgtggaagaagatgaagatcagagggagaggcacgcactctttgacttatcgagctgctccctgaggcccaaaagctttaagtgtcagacttgtgaaaagtcatatatagggaaggggggactggcccgacattttaaacttaacccaggccacggccagttggaccccgagatggtgctgtctgagaaagccagtggaagcaccctccgggggtgcacggaggaaaggacgctcagcctgacctccctggggctgtccatgccagcggatccatgtgagggaggggcccgctcctgcttggtgacagagtcagcacgcggtggcctgcagaatggtcagtctgtagacgttgaagagacattgccatctgaaccagaaaatggagctcttttgcgatcagagagataccaaggacctagaagacgcgcatgctcagagacccttgcagagtcccgcacagctgtcctccagcagagaagagctgctcagctacctggtggccctgctgcggcaggggagcagagggcgtcgccaagcaaagccaggctcaaggagttcctccagcagtgtgaccgggaggatctggtggaattggctctgcctcagctggctcaggttgtgaccgtgtatgagtttcttctgatgaaggttgaaaaagatcatctagcaaagccttttttcccagctatatataaggaatttgaagagttgcataaaatggttaagaaaatgtgccaagattacctcagtagttctggtctgtgttcccaggagaccctggaaataaacaatgataaggttgctgagtcattaggaatcacagaattcctacggaagaaagaaatacacccagacaaccttggacccaagcacctcagccgagacatggatggggagcagctagagggagctagcagcgagaagagggaacgtgaggctgcggaggagggactggcctcagtgaaaaggcccagaagagaagccctgtccaacgataccactgaatctcttgctgccaacagcagaggccgggagaagcccaggcccttgcatgctttggccgctggtttttcccctccagtaaatgtgactgtctctccccgttctgaagaaagccatacaacgacggtttctggtggcaatgggagcgtgttccaggcgggcccgcagcttcaggcactggctaacttagaagccaggagggggtctataggtgctgctctctcatcccgggatgtcagtgggctgcctgtttatgctcagtcaggagagcctaggaggctgacccaggcacaggtggcagcgtttcctggagagaatgctttggaacactcttcagaccaggacacctgggacagcctgaggagcccgggtttctgcagccctttgtcatctggtggtggagcagagtccctgccgcctggggggcctggacatgcagaggcaggacacctcggcaaggtttgtgacttccacctgaaccaccagcagcccagccccaccagcgtcctgcctacagaggtggcagcccctccgcttgagaaaattttgtctgtggatagcgtggcagtggactgtgcctacaggactgtgcccaagccagggcctcagcctggcccacatggatcactattgactgaagggtgtctcagaagcctttcgggggacttgaaccggttcccctgtgggatggaggtgcactctggccagagagaactggagagcgtggttgctgtcggcgaagccatggcttttgaaatttccaatgggagccatgagttactgtctcagggacagaagcagatttttattcagacttccgatgggcttatcttgtcccctccaggtacaatagtgtctcaggaggaggacattgtcacagtgactgatgcagaggggcgtgcctgcggatgggcccgctagaaggagttcctctagaagctgtggagtcggtcgtcaccgtggagccagagccctcacagtgaagtggagtcagatcctagattcgtctgattttatccagagaaggtctatggcaagcaatgtatatttttctaatgtgaatattgcacagatgaaccttttatttataaagaataatgtctttctgccctgctgtctacatttttctatggagcttgtcataataatagcagatattacctgatcaggaatccctgtggcgcgtctgacgctcatgagtttttcatgatggtgatgagtagcactgcactgtcacctgatgattggccctgctccgtttcccttctctcctgggagatatgctgcttttccaccagacttgctccatactagaagcttcttttgggttcaattaaaaagaaaataagctagtcattctgggcagcattttattgatagaagggggaaaaagtcatttctacttgcatgattttttaaattaaattaaattaaattaatttaattatttttgagaccaagtcttactctgtagcccaagctggagtgcagtggcgcgatcttggctcactgcaacctctgccgcctgggctcaagcg

SEQ ID NO: 329567 - DNA, 2221 bp, Homo sapiens
acccgggttcgagtccccgcctcggccgccatggcggatgcggagccggaggctgggggcggcagcgaggatggcggcggcggcggcggccggctcctccgggccagagcggcagcgtcgcacgtgtggccccgctgggccccgagcagctgcggcaggtcctggagcaggtgacgaaggcgcagccgccgccgccgccgccccccttcgtgctgcgggacgcggcgcggcggctgcgggacgcgggccaacaggccgccctgcagcggggccggggcaccgagcccccgcgcctgccgcgcctgctcccgccccagcaactagaagccatttgtgtcaaggtaacgtctggagaaacaaaaggtcaggaaaggccaatgctcctaccgaccacaatccagccccaaactgcaagaaagagccagctgccccgggggaattcctgcctggtggggctccatatcgccagccctcagctgctcagggtacagccgcttgtgagaaccgagccacagtcctgcttcctaagtgacttatgccaacctcctgctcaggggtttgtacagagaccactgccagccctccaggtggtccctgcaaagagagtcccagcccccaaggctccagatgaacagggctccatgttgacccctttgtctgcctctgacccgctggcagtaacatctctttcatccagttcagcacatccatttatttccaacttgcatacaagacatactgagaaactaaaaaaatcgttaaaagtaaagacacgttctggacgggtatctcgacctcccaaatataaagctaaagattataagttcataaaaacagaggatctggcggatggtcatctgtcagattctgatgattactcagaactctgtgtggaagaagatgaagatcagagggagaggcacgcactctttgacttatcgagctgctccctgaggcccaaaagctttaagtgtcagacttgtgaaaagtcatatatagggaaggggggactggcccgacattttaaacttaacccaggccacggccagttggaccccgagatggtgctgtctgagaaagccagtggaagcaccctccgggggtgcacggaggaaaggacgctcagcctgacctccctggggctgtccatgccagcggatccatgtgagggaggggcccgctcctgcttggtgacagagtcagcacgcggtggcctgcagaatggtcagtctgtagacgttgaagagacattgccatctgaaccagaaaatggagctcttttgcgatcagagagataccaaggacctagaagacgcgcatgctcagagacccttgcagagtcccgcacagctgtcctccagcagagaagagctgctcagctacctggtggccctgctgcggcaggggagcagagggcgtcgccaagcaaagccaggctcaaggagttcctccagcagtgtgaccgggaggatctggtggaattggctctgcctcagctggctcaggttgtgaccgtgtatgagtttcttctgatgaaggttgaaaaagatcatctagcaaagccttttttcccagctatatataaggaatttgaagagttgcataaaatggttaagaaaatgtgccaagattacctcagtagttctggtctgtgttcccaggagaccctggaaataaacaatgataaggttgctgagtcattaggaatcacagaattcctacggaagaaagaaatacacccagacaaccttggacccaagcacctcagccgagacatggatggggagcagctagagggagctagcagcgagaagagggaacgtgaggctgcggaggagggactggcctcagtgaaaaggcccagaagagaagccctgtccaacgataccactgaatctcttgctgccaacagcagaggccgggagaagcccaggcccttgcatgctttggccgctggtacaatagtgtctcaggaggaggacattgtcacagtgactgatgcagaggggcgtgcctgcggatgggcccgctagaaggagttcctctagaagctgtggagtcggtcgtcaccgtggagccagagccctcacagtgaagtggagtcagatcctagattcgtctgattttatccagagaaggtctatggcaagcaatgtatatttttctaatgtgaatattgcacagatgaaccttttatttataaagaataatgtctttctgc

SEQ ID NO: 329568 - DNA, 519 bp, Homo sapiens
attacaagtgagaatgagcatgtggccatgagaccagggaaggcaggaaagtggattcgataaaccagtgacatcaaagagcacctgtcaggtgggtacaatgagaaacactggcagaactcagcagctttcaaactgcccaatttccagggttggctcagagcatgcatatctgataacaaaaatgcacagagcattgcagctcttaagaggcttcctaaactattggtccaagcatgttccttatcacaccttttcttgttttaattttttaaaaaagctgtaccagacacacagaatataatcccataaaaaccttccttggttagaaaagttgcttttctttcaattcattgcctttcaaaactatattaacaaaacacaacaaagatcagttaaaaaaagacataattaaaaaaatctcattaaccaccaagattaaggtttgcatcttaaacagtattcacacagtttcacaaaaagctacatgaatgtgggagggagcactcaagagacaga

SEQ ID NO: 329569 - DNA, 429 bp, Homo sapiens
tctcagatactatacacaagattactctcattaactcagtccttatttatcttaaagctttctgattcaaagtgtggtcctcagaccagcagcatctcaccacctaggatcttgttggaaaatctcaagggctaatatgattaggcaatcagaaaaccctattttaacacaattccgggtgatccagaggtatactgaaatatgaaatcactccattaaggccatcaatgaaaatctgctactataaagtcaataatgaatataaacccagacttgcctgggagtattcagtcctatttttgataatcagaacactcagaagtgacagggtctctacttgcttcatacaccagatgtaccctgcacatactaggtactaagtaaatgtcaggcaatgctctaggctcgggtgttagagtggtaaccagt

SEQ ID NO: 329570 - DNA, 332 bp, Homo sapiens
cttttttttgtgtgtgaaatatcataaaagtgaacacaacatcccaaccccacagttggttgggatgacagaagcattgtaggttggcagggaatatccatattcagaatacatacaccctttttggaaggggtacgatgaaatcaatccttcatgatgtggctggctggtcttcctagggaatagtgttacatcagggctttgcttttagcctctgctattggaggattatgtatttagaagtagcagtcaccagatcagacttggtgaggaagagtccttttggtggttttaaaatttgttcaaaattctttgtcgacgccccttcaaaa

SEQ ID NO: 329571 - DNA, 429 bp, Homo sapiens
tttattcctccgtggcacatggtcttactgctatggtaattacaacatactgtcacgaatgttatttgcttaaatatccataaatctagactgttcttctcaagagaagcagtatctggtagtgcaaaggcactagattggaagcagaaactgaatttgagatctaaatcatgaacttcctagttgctcaactgatctaatgacttgtttctgcatctgtaaaatgagaataatacatgggattgttacaaaggtcaaatcaggtaatatacatgaagctttgtatatactgaaaatatagtacaaatgtagggtggtattgttatcagggtgggtgtttaatatggctcatcgtatgagtgaacacacgagttctcatgattcatgctgaatttagggtctgcccaagggagatggcagtggtgctat

SEQ ID NO: 329572 - DNA, 326 bp, Homo sapiens
ctttcctgtgtcactttctctaatttctaatttctctaatttctaattctctaatttctaattctctaatttctaatttgtgctttctgggatcatctccgaaataaactatctgtaccaatgtcttatggtttcctttgaaaggaatcactaagattgttccttttctctttgtgttgattttaaatgtattcacaaattctttgacaatcttccttttaagagatagagcttaattcccctctccataagtataggctggacttgatgcatttctaattaatagaatagggcagaagtgatggtgtgtggcctctcagactagt

SEQ ID NO: 329573 - DNA, 615 bp, Homo sapiens
tacatcaatatagaaatggattttaaaattggaataaattttaaagattgcctccatctccaatgatgctgattcccagacagaatgtgtagaaagtcgcactgtgatctagtctgaatgcagtctctaaactgctatgcaagtgctctttcaatcatattacaagcactggtcactttttatattagtagaatgcacttctttaattcaaatacctatgtttctggagctaaatgtattatctatattacaaatggaactttcagatttttatcttcatgctagtcctgtcttgctatttgctacctaatggatgaatcacagagattagttcatcttcatctttcgagatctaatagtatgtgaaaacatgactccacatggtaggtgctcaattaatgcttgtttattgcctatatattcttctgagataaatcattgaaggagtggctatgtggtcatcaaagcaggtctcttttataccaaagctatagtaaacaggtcacacattgatgactggaaaatttctctttctattcatgggaggagaggaaatctaactggggattgagatgaaaagaagaaaaaaaggattgaatcctcttttaatatcta

SEQ ID NO: 329574 - DNA, 470 bp, Homo sapiens
tagcatattgattcacttacagtacatacagtataatactacttattttcccaaagtgaccatctgtccagcttgccagcttgtcagctatcatcattcctctgagcttcagatcctcgcccgtaaaatagggagagatacagggttattgtaacaagtagaataaatgacacacaaatcattctaatagagtgcctggtacttcccttatatacccttccaagatcactcctcactccacccttgttccctcgatgatcttatgctttaattgtgagaggcaaaaacaaatacaaaaggaaataaaggatgaagcagtgggcggagaatgtagactagtggaaataaacttgacaggaagcctcctaaattctagtagtcctagttttgctaccaaacagctatgataccttgcttggatcacaaagtctttctatatctacatattgtccatcaaatgaaggtttaat

SEQ ID NO: 329575 - DNA, 898 bp, Homo sapiens
gtgactttgggctccacgtcgcaagctcattatcctcacctaatttggcataaaatgcttatgttacaaagctgtgcaagctttgcatcctagaactttactatggtgtataaagttgtaaacagaaagctcttctatcagtttttggccgttttcagatagtgaaagtgctctgaaatgctgacgttaccttggaggagaaaatattagatgtcaccattttagtttaaattattggacacactaatttcaccagaatgtccttatagaaatagttattggttaagacagtatgagagtgtgtaatgcatagaacgggtgcttgaaagtgaatgccctaactaaatcctttgctaagcacagagaaaatctaatagcactgtttctgctggcacacaattaggattctgatgttgctgtcaattttcagcacagcccattcataaatgtaatgggatctcttttctcacaatctaggccagggatgtccaatattttcactttccttggccacattggaagaagaattgccttgggccacacataaaatacactaacactaacgatagctgatgagaaaaaaaaaaaaaaaaaacctgccaaaaaaaaatctcacaacgttttaagaaagtttatgaatttgtgttgggctgcattcaaagtcatcctgggccacatacagcccagaggccatggattgaccaagtttgatctagggggttttcctttcatttttttcaatatttgtattcggagtataaaaagtatctggctattaaacaaaaaaaaggttgctcatctttaccactcagtaaaaagcattagaaagaaaaagcctacaagttaactttaggttatgcttttaaactcagaaaaatactaatatcctgaaattttc

SEQ ID NO: 329576 - DNA, 602 bp, Homo sapiens
gtctaactgcagagtagaagctggaccctggagttaccaacactcctccccaacagttcttagcaccccgcaggctgggcgctgtggctcacgcctgtaatcccagcactttgggagggcaaggcaggcggattacctggggtcaggagttcatgaccagcctggccaacatggtgaaaccccgtctctactaaaaaaatacgtaaaaattagccaggcgtggtggcacacgcctgtaaacccagctacttgggaggctgaggcaggagaattgcttgagcccgggagagggaggttgcagtgaggcgagatcatgccactgcactccagcctggctgacagagcaagactcccctgtctcaaaaaaaataaaaaaaaacagttcgtagggccccataccccacaacccctgtctcctgcacttaactcccacctgggtcagagaacagccaattcaccagtgaggtagaagtgaacccagaagaaatagccacttgattttaaaattcccagctccattccgtggccttctccccactagacacagcagtcccaggcctcctgttccctcctcacctagaggcagccgggacggaggggga

SEQ ID NO: 329577 - DNA, 422 bp, Homo sapiens
catttcacacaaagatattacaaaatgacaacggcatgaattatcggaatgatggaactatcttctaaaagggtagtaaactcaggttaactcccaaacagaatacacacctattaccttactagtaagagtaataaccaccaattattgagcaccagccacagtgctaagtgctctacctatattgtcttatctaatcctgaaaacacgatcttcctttaatggtagttgtctttatttttaaaatgagaaacctgagctctgcagaggttaataacttgccaagctgttcccagtacccaatctcacatacagatctctgctaagccatgaggccacaaaacagaagctatgtttttggtctggagaaatattctccacctggaagacaacccttacccacaaaaaggcagtagcccaag

SEQ ID NO: 329578 - DNA, 202 bp, Homo sapiens
ggcctgtctttaccttctgacactcctgacttctttccttttgaaacctctctaccactggctcctttaactctgagctctgttggtgttcctgcccctctctcagccattccttctcagtcttttgctgcttcctcttactttgcccatttactaattttggttctcatttcctctatgtttagtctctatgagcaatggc

SEQ ID NO: 329579 - DNA, 304 bp, Homo sapiens
agtttcattattataaagagcaatgctccagatatttttgcatacacagctcttctttactcttgaaatactttgtagaataattagaactcacttggttgcaaattgcaaagctcattggagtagcctaagtgaaagcagttatgttaataagcacatagggcagtcacgaagatacaatgtgcaagacacatagaaattggaaagttgtcagacaatccccctcacccttctctggtctcttatttccttcagacttttgctgcccataccttgttccctgctcccttataactttggcctg

SEQ ID NO: 329580 - DNA, 610 bp, Homo sapiens
aaagctcagcattaaatttgtgactcacctctagcaaatatataacacttaatgatgtgactgtcctgattctaaaactttttctcttggttttttactttttaaataaaaacacatttaacttaccttcttatttgtgcgatgtaatggtcattttaagtttctttttaacgacaagttgaaggattgcttaattaattaacaaataacattaaaacttatgtgcctatagaagatgctgaactataccaaattttgccaggaaatagaattcaaaaggattaatatagttttgggttaataaaatggaatcaaaaatgtaatgtcagcagggcacggtggctcacgcctgtaatcccaacactttgggaggccgaggtgggtggatcacgaggtcaggagatcgagaccatcctggctaacacggtgaaaccccgtctccactaaaaatacaaaaaattagccaggcttggtggcgggcgccttgtagtcccagctacttgggaggctgaggcaggagaatggcgtgaacccaggaggcggagcttgcagtgagccgagatcacgcaactgccctccagtctgggcgacagagcaagactccatctca

SEQ ID NO: 329581 - DNA, 546 bp, Homo sapiens
cttccctctagtgtgtaacctccatgagggtatggcaggtggccttgtttacagacaatggccagagcctaaggcagtatctgacacatggctatcactcattttgaattcatctctactaccactgacactgttctggcctttatcctcttatcctcttttggctgggtcattctttcagtctctctcctaactggtcttcctggctttcatttctcatcctgccaggctctcttccacgctgctactactgcgatttttttcaaacactcacctctgatgtcattcttctgctgctaatgcacaacagatccatacaggataaaatgcaaacatctcagatggcacagaaggccctgcaccacctggctcctcctagtgtgccctttcccacacaaacctacatctgaagcatttctaactgcttgcagttgcctcacacaccatactgtttcacacttccactgctatttttagggtagaacatgcaggaatagagtctggaaattctttcagaattactcaaattctagaatggcacatgca

SEQ ID NO: 329582 - DNA, 959 bp, Homo sapiens
ggagtatgagtaggcatacaataatgtcacttccttagttaggaaaacaatgctatcagttaatgcctgaccatatagcatattggctagacttagagtatattgtaaatttttacccgtattatgtcagaattataagaaagttaatcgttttttctgggggggaatgaagtcttgttctgtcacccatgctggagtgcagtggcacgatctcagctcactacaacctctgcctcccaagttcaagcaattctcctgcctcagcctcccgagtagttgggactacaggcatgtgccaccacacccagctaattttttgtatttttagtagaggcagggtttcaccctgttggccaggatggtctcgatctcctgacctcatgatctgcccagcctcagcctcccaaagtgctgggattacaggcgtgagccaccgcgcccggccctccaccattcttgataattataaagagcctgatgaagatatctcaattcctgtctcagtagcatagtttgcatgatatcaaggaggaggaagttaaaagtttcatgtttacttctgacatactaacattacatcttcaagttaaaaacattttagaagtaagttcatgaatttatattttctgaaacattttcagattcttaagagaaacattttcattaacccttgccagtacatttattattaggttctataaattccatattaattgttttacataggccaaagtctcctgctattgtcactcaaccatttctctgtatcattcattcctaccatatacttaggtttaagttaacagaaatatgttgtagtttttactgtaaataagacacataatcgcctggttggaaggtagtgagttatcttaattgattgttcagtcagttacagatcgaactctttgttctcgtcttccccccgcttctcactgctgcacttgactagtctgaaa

SEQ ID NO: 329583 - DNA, 325 bp, Homo sapiens
tggtaggaagcaacacagaggggttagaaatatgatctttttgattcctagtccagcgcctataatataatactatatgtgatctagaatatgaacttctagatctaggggcataaaataaaatcaagcccccttctaaagagattatactactatatctgctgatataaatgtggacattcatttttccagggctggtctcgaactcctggcctcaaatgatccacctgcctcagcctcccaaactgttgggattacgggcgtgagccaccaagcctggccagaatagtacttcattgtgtataaataccacggtgctataacg

SEQ ID NO: 329584 - DNA, 2740 bp, Homo sapiens
tagccccggtgtggggatccgtgcgcggatgtcccggcgagtcccgggctgaaagaggcggctccgggcggcgcgaagcgctggtggcgggcccgggctgcggcgtgtgcgcgcccgccagctgctccggagatacggaattgcattttgtgaaaaaagaacaagaattttctgcaaggatcatatctaagtgcactttttgctgatacttcatttctaatcttgtagaaaatttcagctgtagcccttggactagaagctgaaataacagaagctgtgtacgatgcattagggtattgaagaaaattaacttttgaattaaatatttggaatataaggaaataaggaaagttgactgaaaatggggcggaagaaaatacaaatcacacgcataatggatgaaaggaaccgacaggtcacttttacaaagagaaagtttggattaatgaagaaagcctatgaacttagtgtgctctgtgactgtgaaatagcactcatcattttcaacagctctaacaaactgtttcaatatgctagcactgatatggacaaagttcttctcaagtatacagaatataatgaacctcatgaaagcagaaccaactcggatattgttgaggctctgaacaagaaggaacacagagggtgcgacagcccagaccctgatacttcatatgtgctaactccacatacagaagaaaaatataaaaaaattaatgaggaatttgataatatgatgcggaatcataaaatcgcacctggtctgccacctcagaacttttcaatgtctgtcacagttccagtgaccagccccaatgctttgtcctacactaacccagggagttcactggtgtccccatctttggcagccagctcaacgttaacagattcaagcatgctctctccacctcaaaccacattacatagaaatgtgtctcctggagctcctcagagaccaccaagtactggcaatgcaggtgggatgttgagcactacagacctcacagtgccaaatggagctggaagcagtccagtggggaatggatttgtaaactcaagagcttctccaaatttgattggagctactggtgcaaatagcttaggcaaagtcatgcctacaaagtctccccctccaccaggtggtggtaatcttggaatgaacagtaggaaaccagatcttcgagttgtcatccccccttcaagcaagggcatgatgcctccactaaacacccaaaggatcagtagttctcaagccactcaacctcttgctaccccagtcgtgtctgtgacaaccccaagcttgcctccgcaaggacttgtgtactcagcaatgccgactgcctacaacactgattattcactgaccagcgctgacctgtcagcccttcaaggcttcaactcgccaggaatgctgtcgctgggacaggtgtcggcctggcagcagcaccacctaggacaagcagccctcagctctcttgttgctggagggcagttatctcagggttccaatttatccattaataccaaccaaaacatcagcatcaagtccgaaccgatttcacctcctcgggatcgtatgaccccatcgggcttccagcagcagcagcagcagcagcagcagcagcagccgccgccaccaccgcagccccagccacaacccccgcagccccagccccgacaggaaatggggcgctcccctgtggacagtctgagcagctctagtagctcctatgatggcagtgatcgggaggatccacggggcgacttccattctccaattgtgcttggccgacccccaaacactgaggacagagaaagcccttctgtaaagcgaatgaggatggacgcgtgggtgacctaaggcttccaagctgatgtttgtacttttgtgttactgcagtgacctgccctacatatctaaatcggtaaataaggacatgagttaaatatatttatatgtacatacatatatatatccctttacatatatatgtatgtgggtgtgagtgtgtgtgtatgtgtgggtgtgtgttacatacacagaatcaggcacttacctgcaaactccttgtaggtctgcagatgtgtgtcccatggcagacaaagcaccctgtaggcacagacaagtctggcacttccttggactacttgtttcgtaaagataaccagtttttgcagagaaacgtgtacccatatataattctcccacactagcttgcagaaacctagagggccccctacttgttttatttaactgtgcagtgactgtagttacttaagagaaaatgctttgtagaacagagcagtagaaaagcaggaaccaagaaagcaatactgtacataaaatgtcatttatattttccaacctggcatgggtgtctgttgcaaaggggtgcatgggaaagggctgttgatattaaaaacaaacaaaacaaaaaagccccacacataactgttttgcacgtgcaaaaatgtattgggtcaagaagtgatctttagctaataaagaaagagaatagaaaacacgcatgagatattcagaaaatactagcctagaaatatagagcattaacaaagtaaaattaatatattaagttataattggaatatgtcagaagtttctttttacattcatatcttaaaaattaaagaaactgattttagctcatgtatattttatatgaaagaaaacacccttatgaattgatgactatatataaaattatattcactacttttg

SEQ ID NO: 329585 - DNA, 5734 bp, Homo sapiens
tagccccggtgtggggatccgtgcgcggatgtcccggcgagtcccgggctgaaagaggcggctccgggcggcgcgaagcgctggtggcgggcccgggctgcggcgtgtgcgcgcccgccagctgctccggagatacggaattgcattttgtgaaaaaagaacaagaattttctgcaaggatcatatctaagtgcactttttgctgatacttcatttctagacattgagtctcactctaccccccaggctgaagtgcagtggtgtgatctcggttcactgcaacctccgcctccaggttcaagtgattctcgtacctcagcctcccgagtagctgggattacaggcgcctgccaccatgcctggctgatatttatatttttagtagagatggagtttcaccatgttggccaggctggtctcgaactctggacctcagatcttgtagaaaatttcagctgtagcccttggactagaagctgaaataacagaagctgtgtacgatgcattagggtattgaagaaaattaacttttgaattaaatatttggaatataaggaaataaggaaagttgactgaaaatggggcggaagaaaatacaaatcacacgcataatggatgaaaggaaccgacaggtcacttttacaaagagaaagtttggattaatgaagaaagcctatgaacttagtgtgctctgtgactgtgaaatagcactcatcattttcaacagctctaacaaactgtttcaatatgctagcactgatatggacaaagttcttctcaagtatacagaatataatgaacctcatgaaagcagaaccaactcggatattgttgaggctctgaacaagaaggaacacagagggtgcgacagcccagaccctgatacttcatatgtgctaactccacatacagaagaaaaatataaaaaaattaatgaggaatttgataatatgatgcggaatcataaaatcgcacctggtctgccacctcagaacttttcaatgtctgtcacagttccagtgaccagccccaatgctttgtcctacactaacccagggagttcactggtgtccccatctttggcagccagctcaacgttaacagattcaagcatgctctctccacctcaaaccacattacatagaaatgtgtctcctggagctcctcagagaccaccaagtactggcaatgcaggtgggatgttgagcactacagacctcacagtgccaaatggagctggaagcagtccagtggggaatggatttgtaaactcaagagcttctccaaatttgattggagctactggtgcaaatagcttaggcaaagtcatgcctacaaagtctccccctccaccaggtggtggtaatcttggaatgaacagtaggaaaccagatcttcgagttgtcatccccccttcaagcaagggcatgatgcctccactatcggaggaagaggaattggagttgaacacccaaaggatcagtagttctcaagccactcaacctcttgctaccccagtcgtgtctgtgacaaccccaagcttgcctccgcaaggacttgtgtactcagcaatgccgactgcctacaacactgattattcactgaccagcgctgacctgtcagcccttcaaggcttcaactcgccaggaatgctgtcgctgggacaggtgtcggcctggcagcagcaccacctaggacaagcagccctcagctctcttgttgctggagggcagttatctcagggttccaatttatccattaataccaaccaaaacatcagcatcaagtccgaaccgatttcacctcctcgggatcgtatgaccccatcgggcttccagcagcagcagcagcagcagcagcagcagcagccgccgccaccaccgcagccccagccacaacccccgcagccccagccccgacaggaaatggggcgctcccctgtggacagtctgagcagctctagtagctcctatgatggcagtgatcgggaggatccacggggcgacttccattctccaattgtgcttggccgacccccaaacactgaggacagagaaagcccttctgtaaagcgaatgaggatggacgcgtgggtgacctaaggcttccaagctgatgtttgtacttttgtgttactgcagtgacctgccctacatatctaaatcggtaaataaggacatgagttaaatatatttatatgtacatacatatatatatccctttacatatatatgtatgtgggtgtgagtgtgtgtgtatgtgtgggtgtgtgttacatacacagaatcaggcacttacctgcaaactccttgtaggtctgcagatgtgtgtcccatggcagacaaagcaccctgtaggcacagacaagtctggcacttccttggactacttgtttcgtaaagataaccagtttttgcagagaaacgtgtacccatatataattctcccacactagcttgcagaaacctagagggccccctacttgttttatttaactgtgcagtgactgtagttacttaagagaaaatgctttgtagaacagagcagtagaaaagcaggaaccaagaaagcaatactgtacataaaatgtcatttatattttccaacctggcatgggtgtctgttgcaaaggggtgcatgggaaagggctgttgatattaaaaacaaacaaaacaaaaaagccccacacataactgttttgcacgtgcaaaaatgtattgggtcaagaagtgatctttagctaataaagaaagagaatagaaaacacgcatgagatattcagaaaatactagcctagaaatatagagcattaacaaagtaaaattaatatattaagttataattggaatatgtcagaagtttctttttacattcatatcttaaaaattaaagaaactgattttagctcatgtatattttatatgaaagaaaacacccttatgaattgatgactatatataaaattatattcactacttttgaacacattctgctatgaattatttatataagccaaagctatatgttgtaacttttttttagagaatagctttatcttggtttaactctttagttttattttaagaggggaaaacaaaaatatcttgcaagcagaaccttggaaaaaaaaagccatgaacacttattctaaatgtaaattaaaagttgagccaaactctttgtgtatatagcatcttaaatatattatcacctttgatgtaagtacctatgtattgtatggtcaccagattaaaaagtatatttttgtggattgccgccaatctggggggaaaaggcgaggtcctttattaagtattcactgtttaatatttactattttgttaaatatactgtactttggattttaattattagcccagttttttcagaggattgtataaaggggtttctcccctcactggtggtgaatgtgtgatgttacattgtaatctttgtgctgtatgggttgagcatcattatatattttgtatgtgtacataaatagcaaagtggcaaaaaaaattggtgttaagttcatcctgcataagtataaaatgtgttgtaacagattttataaggcattatttaaaacttgccttttgtgaggaaaaaatgtagtagaaaaagctgacctaatttaattaatattagagaaaatggcaaaatagtagatgagcacaaaggttttataagtggtaaatgattaggggaaaataatcatggggaaagggatcttttttccttgaccctctgaaaacagaacgatgcagctggttacaaaatcctaccgttatcagctcttctgcacattgcagtgatgctttggtatgcggggagaaacactcttagggtgctggtccttggcatgactcttgccattctaattggaattagtgccaccctcagcttggattttgaacaaggccttattctttcaggaagacaactaatggatgatagcaagttcatccacttactgggcttgtgccatgagcaaaattcaaagtcctgtatatctttcattgtagatttttaaatactccttttcctaaaaaactcaagggtttaaaaattgctattttatattttaaatgatattgagcagctacctacaatttctatgtacattttgttccccccccaccgcccccccccaaattacgttccttttgacgttttcctcatctgctgtttgtgacaagtcatcagccagatttcctgactgacacatacgtatgatcagtgcaggagagacctgcgcaccacaggctgcaaactggaggttctgttctcatggcagtttgggcagtaacttttgagagaggccaaaaaaaggaggatgacatgctgtctcctctcttcagtatagacattaggctcttattcagaaaggatttttctttaaaaatgtacttactttactgaactacttacaggcacatttcttcataaggccacacctaatccaaacaagacagtctcccaacactgaagttccaaaataatccttaccactttgtaaaccatttatagctttgaaagtgttaagtgattccttcgttattatttatgcatgttcatgaacttctgctgtacattggaataggagttaacacattcacatttactgtctattttcttgtgtgccttatgagatggcttttctgactgtatctcaatagtctttctttctatgcaggtttataatcagtacaactactgttttctaaaatactactactcaaggctcggagtttgtatttaaattacactgaccaagtaacaatgtattccatttcaggaactgaatatttgactgttaacctttttcccatacgtccagtgtggcatggagcatatggacttgacagacatctctcacccagacgcccacgtgtgaacacacccacatccacatctctgggtggaaaccagcctagagtggggacgacgctaatggtgttgctttagaaccgtcttttcttacccttttagactcgtgttttgtatgagacaccattgcaagaaaattttatccctccagaagtattttattactaaagaacaaaagcaaaaaaagcttaaattgcactggttaaagtacagtttccaacagctgtccttcctcagtactctaatggccactccaccgcgagtggaagtcactgttgtgtgtacacaggtggtcccaatcaaaactccatcttttgagcccaattatgtccattttgttatagactaaatcaggggtttgttctacaagaacaatacatgttttaccctttcctttaactagaaggataactagtaatgcatcaacataatttctgtattaaccatcatgcgcacaagaaatacatagtaaataaggaagctgaaaactcctggcattggatcttaagctagatgattagaatgtgaaaaagattttacaaatgtaaaacttctatttctctgtagaaactttcttcactttgctgtgcaagaagacactgctttgctatatttaaaatggcttttttaaaagagatttatgtatttggtaaatgtttgtagtcaacagttcacacaagaagctgtacacggtttgatcatgtaaaaccgtttggcggcacaagctggactttgttgccatccttgagatgaaccttttaagaaaaataagttaatctcaatttttccctgaatgtgttgtttttcttcattatacaataaatataatagtgaactttta

SEQ ID NO: 329586 - DNA, 5680 bp, Homo sapiens
tagccccggtgtggggatccgtgcgcggatgtcccggcgagtcccgggctgaaagaggcggctccgggcggcgcgaagcgctggtggcgggcccgggctgcggcgtgtgcgcgcccgccagctgctccggagatacggaattgcattttgtgaaaaaagaacaagaattttctgcaaggatcatatctaagtgcactttttgctgatacttcatttctagacattgagtctcactctaccccccaggctgaagtgcagtggtgtgatctcggttcactgcaacctccgcctccaggttcaagtgattctcgtacctcagcctcccgagtagctgggattacaggcgcctgccaccatgcctggctgatatttatatttttagtagagatggagtttcaccatgttggccaggctggtctcgaactctggacctcagatcttgtagaaaatttcagctgtagcccttggactagaagctgaaataacagaagctgtgtacgatgcattagggtattgaagaaaattaacttttgaattaaatatttggaatataaggaaataaggaaagttgactgaaaatggggcggaagaaaatacaaatcacacgcataatggatgaaaggaaccgacaggtcacttttacaaagagaaagtttggattaatgaagaaagcctatgaacttagtgtgctctgtgactgtgaaatagcactcatcattttcaacagctctaacaaactgtttcaatatgctagcactgatatggacaaagttcttctcaagtatacagaatataatgaacctcatgaaagcagaaccaactcggatattgttgaggctctgaacaagaaggaacacagagggtgcgacagcccagaccctgatacttcatatgtgctaactccacatacagaagaaaaatataaaaaaattaatgaggaatttgataatatgatgcggaatcataaaatcgcacctggtctgccacctcagaacttttcaatgtctgtcacagttccagtgaccagccccaatgctttgtcctacactaacccagggagttcactggtgtccccatctttggcagccagctcaacgttaacagattcaagcatgctctctccacctcaaaccacattacatagaaatgtgtctcctggagctcctcagagaccaccaagtactggcaatgcaggtgggatgttgagcactacagacctcacagtgccaaatggagctggaagcagtccagtggggaatggatttgtaaactcaagagcttctccaaatttgattggagctactggtgcaaatagcttaggcaaagtcatgcctacaaagtctccccctccaccaggtggtggtaatcttggaatgaacagtaggaaaccagatcttcgagttgtcatccccccttcaagcaagggcatgatgcctccactatcggaggaagaggaattggagttgaacacccaaaggatcagtagttctcaagccactcaacctcttgctaccccagtcgtgtctgtgacaaccccaagcttgcctccgcaaggacttgtgtactcagcaatgccgactgcctacaacactgattattcactgaccagcgctgacctgtcagcccttcaaggcttcaactcgccaggaatgctgtcgctgggacaggtgtcggcctggcagcagcaccacctaggacaagcagccctcagctctcttgttgctggagggcagttatctcagggttccaatttatccattaataccaaccaaaacatcagcatcaagtccgaaccgatttcacctcctcgggatcgtatgaccccatcgggcttccagcagcagcagcagcagcagcagcagcagcagccgccgccaccaccgcagccccagccacaacccccgcagccccagccccgacaggaaatggggcgctcccctgtggacagtctgagcagctctagtagctcctatgatggcagtgatcgggaggatccacggggcgacttccattctccaattgtgcttggccgacccccaaacactgaggacagagaaagcccttctgtaaagcgaatgaggatggacgcgtgggtgacctaaggcttccaagctgatgtttgtacttttgtgttactgcagtgacctgccctacatatctaaatcggtaaataaggacatgagttaaatatatttatatgtacatacatatatatatccctttacatatatatgtatgtgggtgtgagtgtgtgtgtatgtgtgggtgtgtgttacatacacagaatcaggcacttacctgcaaactccttgtaggtctgcagatgtgtgtcccatggcagacaaagcaccctgtaggcacagacaagtctggcacttccttggactacttgtttcgtaaagataaccagtttttgcagagaaacgtgtacccatatataattctcccacactagcttgcagaaacctagagggccccctacttgttttatttaactgtgcagtgactgtagttacttaagagaaaatgctttgtagaacagagcagtagaaaagcaggaaccaagaaagcaatactgtacataaaatgtcatttatattttccaacctggcatgggtgtctgttgcaaaggggtgcatgggaaagggctgttgatattaaaaacaaacaaaacaaaaaagccccacacataactgttttgcacgtgcaaaaatgtattgggtcaagaagtgatctttagctaataaagaaagagaatagaaaacacgcatgagatattcagaaaatactagcctagaaatatagagcattaacaaagtaaaattaatatattaagttataattggaatatgtcagaagtttctttttacattcatatcttaaaaattaaagaaactgattttagctcatgtatattttatatgaaagaaaacacccttatgaattgatgactatatataaaattatattcactacttttgaacacattctgctatgaattatttatataagccaaagctatatgttgtaacttttttttagagaatagctttatcttggtttaactctttagttttattttaagaggggaaaacaaaaatatcttgcaagcagaaccttggaaaaaaaaagccatgaacacttattctaaatgtaaattaaaagttgagccaaactctttgtgtatatagcatcttaaatatattatcacctttgatgtaagtacctatgtattgtatggtcaccagattaaaaagtatatttttgtggattgccgccaatctggggggaaaaggcgaggtcctttattaagtattcactgtttaatatttactattttgttaaatatactgtactttggattttaattattagcccagttttttcagaggattgtataaaggggtttctcccctcactggtggtgaatgtgtgatgttacattgtaatctttgtgctgtatgggttgagcatcattatatattttgtatgtgtacataaatagcaaagtggcaaaaaaaattggtgttaagttcatcctgcataagtataaaatgtgttgtaacagattttataaggcattatttaaaacttgccttttgtgaggaaaaaatgtagtagaaaaagctgacctaatttaattaatattagagaaaatggcaaaatagtagatgagcacaaaggttttataagtggtaaatgattaggggaaaataatcatggggaaagggatcttttttccttgaccctctgaaaacagaacgatgcagctggttacaaaatcctaccgttatcagctcttctgcacattgcagtgatgctttggtatgcggggagaaacactcttagggtgctggtccttggcatgactcttgccattctaattggaattagtgccaccctcagcttggattttgaacaaggccttattctttcaggaagacaactaatggatgatagcaagttcatccacttactgggcttgtgccatgagcaaaattcaaagtcctgtatatctttcattgtagatttttaaatactccttttcctaaaaaactcaagggtttaaaaattgctattttatattttaaatgatattgagcagctacctacaatttctatgtacattttgttccccccccaccgcccccccccaaattacgttccttttgacgttttcctcatctgctgtttgtgacaagtcatcagccagatttcctgactgacacatacgtatgatcagtgcaggagagacctgcgcaccacaggctgcaaactggaggttctgttctcatggcagtttgggcagtaacttttgagagaggccaaaaaaaggaggatgacatgctgtctcctctcttcagtatagacattaggctcttattcagaaaggatttttctttaaaaatgtacttactttactgaactacttacaggcacatttcttcataaggccacacctaatccaaacaagacagtctcccaacactgaagttccttccttcgttattatttatgcatgttcatgaacttctgctgtacattggaataggagttaacacattcacatttactgtctattttcttgtgtgccttatgagatggcttttctgactgtatctcaatagtctttctttctatgcaggtttataatcagtacaactactgttttctaaaatactactactcaaggctcggagtttgtatttaaattacactgaccaagtaacaatgtattccatttcaggaactgaatatttgactgttaacctttttcccatacgtccagtgtggcatggagcatatggacttgacagacatctctcacccagacgcccacgtgtgaacacacccacatccacatctctgggtggaaaccagcctagagtggggacgacgctaatggtgttgctttagaaccgtcttttcttacccttttagactcgtgttttgtatgagacaccattgcaagaaaattttatccctccagaagtattttattactaaagaacaaaagcaaaaaaagcttaaattgcactggttaaagtacagtttccaacagctgtccttcctcagtactctaatggccactccaccgcgagtggaagtcactgttgtgtgtacacaggtggtcccaatcaaaactccatcttttgagcccaattatgtccattttgttatagactaaatcaggggtttgttctacaagaacaatacatgttttaccctttcctttaactagaaggataactagtaatgcatcaacataatttctgtattaaccatcatgcgcacaagaaatacatagtaaataaggaagctgaaaactcctggcattggatcttaagctagatgattagaatgtgaaaaagattttacaaatgtaaaacttctatttctctgtagaaactttcttcactttgctgtgcaagaagacactgctttgctatatttaaaatggcttttttaaaagagatttatgtatttggtaaatgtttgtagtcaacagttcacacaagaagctgtacacggtttgatcatgtaaaaccgtttggcggcacaagctggactttgttgccatccttgagatgaaccttttaagaaaaataagttaatctcaatttttccctgaatgtgttgtttttcttcattatacaataaatataatagtgaactttta

SEQ ID NO: 329587 - DNA, 5451 bp, Homo sapiens
ggcgagcagcctccccgggcgcgcaccgcttggggccggggggcggtggtggacgtcgcctccttgaaagttgaaggagttctcgggagaccccggagaaggaattgcattttgtgaaaaaagaacaagaattttctgcaaggatcatatctaagtgcactttttgctgatacttcatttctaatcttgtagaaaatttcagctgtagcccttggactagaagctgaaataacagaagctgtgtacgatgcattagggtattgaagaaaattaacttttgaattaaatatttggaatataaggaaataaggaaagttgactgaaaatggggcggaagaaaatacaaatcacacgcataatggatgaaaggaaccgacaggtcacttttacaaagagaaagtttggattaatgaagaaagcctatgaacttagtgtgctctgtgactgtgaaatagcactcatcattttcaacagctctaacaaactgtttcaatatgctagcactgatatggacaaagttcttctcaagtatacagaatataatgaacctcatgaaagcagaaccaactcggatattgttgagactttaagaaagaaaggccttaatggttgtgagagccctgatgctgacgattactttgagcacagtccactctcggaggacagattcagcaaactaaatgaagatagtgattttattttcaaacgaggccctcctggtctgccacctcagaacttttcaatgtctgtcacagttccagtgaccagccccaatgctttgtcctacactaacccagggagttcactggtgtccccatctttggcagccagctcaacgttaacagattcaagcatgctctctccacctcaaaccacattacatagaaatgtgtctcctggagctcctcagagaccaccaagtactggcaatgcaggtgggatgttgagcactacagacctcacagtgccaaatggagctggaagcagtccagtggggaatggatttgtaaactcaagagcttctccaaatttgattggagctactggtgcaaatagcttaggcaaagtcatgcctacaaagtctccccctccaccaggtggtggtaatcttggaatgaacagtaggaaaccagatcttcgagttgtcatccccccttcaagcaagggcatgatgcctccactaaacacccaaaggatcagtagttctcaagccactcaacctcttgctaccccagtcgtgtctgtgacaaccccaagcttgcctccgcaaggacttgtgtactcagcaatgccgactgcctacaacactgattattcactgaccagcgctgacctgtcagcccttcaaggcttcaactcgccaggaatgctgtcgctgggacaggtgtcggcctggcagcagcaccacctaggacaagcagccctcagctctcttgttgctggagggcagttatctcagggttccaatttatccattaataccaaccaaaacatcagcatcaagtccgaaccgatttcacctcctcgggatcgtatgaccccatcgggcttccagcagcagcagcagcagcagcagcagcagcagccgccgccaccaccgcagccccagccacaacccccgcagccccagccccgacaggaaatggggcgctcccctgtggacagtctgagcagctctagtagctcctatgatggcagtgatcgggaggatccacggggcgacttccattctccaattgtgcttggccgacccccaaacactgaggacagagaaagcccttctgtaaagcgaatgaggatggacgcgtgggtgacctaaggcttccaagctgatgtttgtacttttgtgttactgcagtgacctgccctacatatctaaatcggtaaataaggacatgagttaaatatatttatatgtacatacatatatatatccctttacatatatatgtatgtgggtgtgagtgtgtgtgtatgtgtgggtgtgtgttacatacacagaatcaggcacttacctgcaaactccttgtaggtctgcagatgtgtgtcccatggcagacaaagcaccctgtaggcacagacaagtctggcacttccttggactacttgtttcgtaaagataaccagtttttgcagagaaacgtgtacccatatataattctcccacactagcttgcagaaacctagagggccccctacttgttttatttaactgtgcagtgactgtagttacttaagagaaaatgctttgtagaacagagcagtagaaaagcaggaaccaagaaagcaatactgtacataaaatgtcatttatattttccaacctggcatgggtgtctgttgcaaaggggtgcatgggaaagggctgttgatattaaaaacaaacaaaacaaaaaagccccacacataactgttttgcacgtgcaaaaatgtattgggtcaagaagtgatctttagctaataaagaaagagaatagaaaacacgcatgagatattcagaaaatactagcctagaaatatagagcattaacaaagtaaaattaatatattaagttataattggaatatgtcagaagtttctttttacattcatatcttaaaaattaaagaaactgattttagctcatgtatattttatatgaaagaaaacacccttatgaattgatgactatatataaaattatattcactacttttgaacacattctgctatgaattatttatataagccaaagctatatgttgtaacttttttttagagaatagctttatcttggtttaactctttagttttattttaagaggggaaaacaaaaatatcttgcaagcagaaccttggaaaaaaaaagccatgaacacttattctaaatgtaaattaaaagttgagccaaactctttgtgtatatagcatcttaaatatattatcacctttgatgtaagtacctatgtattgtatggtcaccagattaaaaagtatatttttgtggattgccgccaatctggggggaaaaggcgaggtcctttattaagtattcactgtttaatatttactattttgttaaatatactgtactttggattttaattattagcccagttttttcagaggattgtataaaggggtttctcccctcactggtggtgaatgtgtgatgttacattgtaatctttgtgctgtatgggttgagcatcattatatattttgtatgtgtacataaatagcaaagtggcaaaaaaaattggtgttaagttcatcctgcataagtataaaatgtgttgtaacagattttataaggcattatttaaaacttgccttttgtgaggaaaaaatgtagtagaaaaagctgacctaatttaattaatattagagaaaatggcaaaatagtagatgagcacaaaggttttataagtggtaaatgattaggggaaaataatcatggggaaagggatcttttttccttgaccctctgaaaacagaacgatgcagctggttacaaaatcctaccgttatcagctcttctgcacattgcagtgatgctttggtatgcggggagaaacactcttagggtgctggtccttggcatgactcttgccattctaattggaattagtgccaccctcagcttggattttgaacaaggccttattctttcaggaagacaactaatggatgatagcaagttcatccacttactgggcttgtgccatgagcaaaattcaaagtcctgtatatctttcattgtagatttttaaatactccttttcctaaaaaactcaagggtttaaaaattgctattttatattttaaatgatattgagcagctacctacaatttctatgtacattttgttccccccccaccgcccccccccaaattacgttccttttgacgttttcctcatctgctgtttgtgacaagtcatcagccagatttcctgactgacacatacgtatgatcagtgcaggagagacctgcgcaccacaggctgcaaactggaggttctgttctcatggcagtttgggcagtaacttttgagagaggccaaaaaaaggaggatgacatgctgtctcctctcttcagtatagacattaggctcttattcagaaaggatttttctttaaaaatgtacttactttactgaactacttacaggcacatttcttcataaggccacacctaatccaaacaagacagtctcccaacactgaagttccaaaataatccttaccactttgtaaaccatttatagctttgaaagtgttaagtgattccttcgttattatttatgcatgttcatgaacttctgctgtacattggaataggagttaacacattcacatttactgtctattttcttgtgtgccttatgagatggcttttctgactgtatctcaatagtctttctttctatgcaggtttataatcagtacaactactgttttctaaaatactactactcaaggctcggagtttgtatttaaattacactgaccaagtaacaatgtattccatttcaggaactgaatatttgactgttaacctttttcccatacgtccagtgtggcatggagcatatggacttgacagacatctctcacccagacgcccacgtgtgaacacacccacatccacatctctgggtggaaaccagcctagagtggggacgacgctaatggtgttgctttagaaccgtcttttcttacccttttagactcgtgttttgtatgagacaccattgcaagaaaattttatccctccagaagtattttattactaaagaacaaaagcaaaaaaagcttaaattgcactggttaaagtacagtttccaacagctgtccttcctcagtactctaatggccactccaccgcgagtggaagtcactgttgtgtgtacacaggtggtcccaatcaaaactccatcttttgagcccaattatgtccattttgttatagactaaatcaggggtttgttctacaagaacaatacatgttttaccctttcctttaactagaaggataactagtaatgcatcaacataatttctgtattaaccatcatgcgcacaagaaatacatagtaaataaggaagctgaaaactcctggcattggatcttaagctagatgattagaatgtgaaaaagattttacaaatgtaaaacttctatttctctgtagaaactttcttcactttgctgtgcaagaagacactgctttgctatatttaaaatggcttttttaaaagagatttatgtatttggtaaatgtttgtagtcaacagttcacacaagaagctgtacacggtttgatcatgtaaaaccgtttggcggcacaagctggactttgttgccatccttgagatgaaccttttaagaaaaataagttaatctcaatttttccctgaatgtgttgtttttcttcattatacaataaatataatagtgaactttta

SEQ ID NO: 329588 - DNA, 5671 bp, Homo sapiens
tagccccggtgtggggatccgtgcgcggatgtcccggcgagtcccgggctgaaagaggcggctccgggcggcgcgaagcgctggtggcgggcccgggctgcggcgtgtgcgcgcccgccagctgctccggagatacggaattgcattttgtgaaaaaagaacaagaattttctgcaaggatcatatctaagtgcactttttgctgatacttcatttctagacattgagtctcactctaccccccaggctgaagtgcagtggtgtgatctcggttcactgcaacctccgcctccaggttcaagtgattctcgtacctcagcctcccgagtagctgggattacaggcgcctgccaccatgcctggctgatatttatatttttagtagagatggagtttcaccatgttggccaggctggtctcgaactctggacctcagatcttgtagaaaatttcagctgtagcccttggactagaagctgaaataacagaagctgtgtacgatgcattagggtattgaagaaaattaacttttgaattaaatatttggaatataaggaaataaggaaagttgactgaaaatggggcggaagaaaatacaaatcacacgcataatggatgaaaggaaccgacaggtcacttttacaaagagaaagtttggattaatgaagaaagcctatgaacttagtgtgctctgtgactgtgaaatagcactcatcattttcaacagctctaacaaactgtttcaatatgctagcactgatatggacaaagttcttctcaagtatacagaatataatgaacctcatgaaagcagaaccaactcggatattgttgaggctctgaacaagaaggaacacagagggtgcgacagcccagaccctgatacttcatatgtgctaactccacatacagaagaaaaatataaaaaaattaatgaggaatttgataatatgatgcggaatcataaaatcgcacctggtctgccacctcagaacttttcaatgtctgtcacagttccagtgaccagccccaatgctttgtcctacactaacccagggagttcactggtgtccccatctttggcagccagctcaacgttaacagattcaagcatgctctctccacctcaaaccacattacatagaaatgtgtctcctggagctcctcagagaccaccaagtactggcaatgcaggtgggatgttgagcactacagacctcacagtgccaaatggagctggaagcagtccagtggggaatggatttgtaaactcaagagcttctccaaatttgattggagctactggtgcaaatagcttaggcaaagtcatgcctacaaagtctccccctccaccaggtggtggtaatcttggaatgaacagtaggaaaccagatcttcgagttgtcatccccccttcaagcaagggcatgatgcctccactatcggaggaagaggaattggagttgaacacccaaaggatcagtagttctcaagccactcaacctcttgctaccccagtcgtgtctgtgacaaccccaagcttgcctccgcaaggacttgtgtactcagcaatgccgactgcctacaacactgattattcactgaccagcgctgacctgtcagcccttcaaggcttcaactcgccaggaatgctgtcgctgggacaggtgtcggcctggcagcagcaccacctaggacaagcagccctcagctctcttgttgctggagggcagttatctcagggttccaatttatccattaataccaaccaaaacatcagcatcaagtccgaaccgatttcacctcctcgggatcgtatgaccccatcgggcttccagcagcagcagcagcagcagcagcagcagcagccgccgccaccaccgcagccccagccacaacccccgcagccccagccccgacaggaaatggggcgctcccctgtggacagtctgagcagctctagtagctcctatgatggcagtgatcgggaggatccacggggcgacttccattctccaattgtgcttggccgacccccaaacactgaggacagagaaagcccttctgtaaagcgaatgaggatggacgcgtgggtgacctaaggcttccaagctgatgtttgtacttttgtgttactgcagtgacctgccctacatatctaaatcggtaaataaggacatgagttaaatatatttatatgtacatacatatatatatccctttacatatatatgtatgtgggtgtgagtgtgtgtgtatgtgtgggtgtgtgttacatacacagaatcaggcacttacctgcaaactccttgtaggtctgcagatgtgtgtcccatggcagacaaagcaccctgtaggcacagacaagtctggcacttccttggactacttgtttcgtaaagataaccagtttttgcagagaaacgtgtacccatatataattctcccacactagcttgcagaaacctagagggccccctacttgttttatttaactgtgcagtgactgtagttacttaagagaaaatgctttgtagaacagagcagtagaaaagcaggaaccaagaaagcaatactgtacataaaatgtcatttatattttccaacctggcatgggtgtctgttgcaaaggggtgcatgggaaagggctgttgatattaaaaacaaacaaaacaaaaaagccccacacataactgttttgcacgtgcaaaaatgtattgggtcaagaagtgatctttagctaataaagaaagagaatagaaaacacgcatgagatattcagaaaatactagcctagaaatatagagcattaacaaagtaaaattaatatattaagttataattggaatatgtcagaagtttctttttacattcatatcttaaaaattaaagaaactgattttagctcatgtatattttatatgaaagaaaacacccttatgaattgatgactatatataaaattatattcactacttttgaacacattctgctatgaattatttatataagccaaagctatatgttgtaacttttttttagagaatagctttatcttggtttaactctttagttttattttaagaggggaaaacaaaaatatcttgcaagcagaaccttggaaaaaaaaagccatgaacacttattctaaatgtaaattaaaagttgagccaaactctttgtgtatatagcatcttaaatatattatcacctttgatgtaagtacctatgtattgtatggtcaccagattaaaaagtatatttttgtggattgccgccaatctggggggaaaaggcgaggtcctttattaagtattcactgtttaatatttactattttgttaaatatactgtactttggattttaattattagcccagttttttcagaggattgtataaaggggtttctcccctcactggtggtgaatgtgtgatgttacattgtaatctttgtgctgtatgggttgagcatcattatatattttgtatgtgtacataaatagcaaagtggcaaaaaaaattggtgttaagttcatcctgcataagtataaaatgtgttgtaacagattttataaggcattatttaaaacttgccttttgtgaggaaaaaatgtagtagaaaaagctgacctaatttaattaatattagagaaaatggcaaaatagtagatgagcacaaaggttttataagtggtaaatgattaggggaaaataatcatggggaaagggatcttttttccttgaccctctgaaaacagaacgatgcagctggttacaaaatcctaccgttatcagctcttctgcacattgcagtgatgctttggtatgcggggagaaacactcttagggtgctggtccttggcatgactcttgccattctaattggaattagtgccaccctcagcttggattttgaacaaggccttattctttcaggaagacaactaatggatgatagcaagttcatccacttactgggcttgtgccatgagcaaaattcaaagtcctgtatatctttcattgtagatttttaaatactccttttcctaaaaaactcaagggtttaaaaattgctattttatattttaaatgatattgagcagctacctacaatttctatgtacattttgttccccccccaccgcccccccccaaattacgttccttttgacgttttcctcatctgctgtttgtgacaagtcatcagccagatttcctgactgacacatacgtatgatcagtgcaggagagacctgcgcaccacaggctgcaaactggaggttctgttctcatggcagtttgggcagtaacttttgagagaggccaaaaaaaggaggatgacatgctgtctcctctcttcagtatagacattaggctcttattcagaaaggatttttctttaaaaatgtacttactttactgaactacttacaggcacatttcttcataaggccacacctaatccaaacaagacagtctcccaacactgaagttccaaaataatccttaccactttgtaaaccatttatagctttgaaagtgttaagtgattccttcgttattatttatgcatgttcatgaacttctgctgtacattggaataggagttaacacattcacatttactgtctattttcttgtgtgccttatgagatggcttttctgactgtatctcaatagtctttctttctatgcaggtttataatcagtacaactactgttttctaccatttcaggaactgaatatttgactgttaacctttttcccatacgtccagtgtggcatggagcatatggacttgacagacatctctcacccagacgcccacgtgtgaacacacccacatccacatctctgggtggaaaccagcctagagtggggacgacgctaatggtgttgctttagaaccgtcttttcttacccttttagactcgtgttttgtatgagacaccattgcaagaaaattttatccctccagaagtattttattactaaagaacaaaagcaaaaaaagcttaaattgcactggttaaagtacagtttccaacagctgtccttcctcagtactctaatggccactccaccgcgagtggaagtcactgttgtgtgtacacaggtggtcccaatcaaaactccatcttttgagcccaattatgtccattttgttatagactaaatcaggggtttgttctacaagaacaatacatgttttaccctttcctttaactagaaggataactagtaatgcatcaacataatttctgtattaaccatcatgcgcacaagaaatacatagtaaataaggaagctgaaaactcctggcattggatcttaagctagatgattagaatgtgaaaaagattttacaaatgtaaaacttctatttctctgtagaaactttcttcactttgctgtgcaagaagacactgctttgctatatttaaaatggcttttttaaaagagatttatgtatttggtaaatgtttgtagtcaacagttcacacaagaagctgtacacggtttgatcatgtaaaaccgtttggcggcacaagctggactttgttgccatccttgagatgaaccttttaagaaaaataagttaatctcaatttttccctgaatgtgttgtttttcttcattatacaataaatataatagtgaactttta

SEQ ID NO: 329589 - DNA, 5639 bp, Homo sapiens
tagccccggtgtggggatccgtgcgcggatgtcccggcgagtcccgggctgaaagaggcggctccgggcggcgcgaagcgctggtggcgggcccgggctgcggcgtgtgcgcgcccgccagctgctccggagatacggaattgcattttgtgaaaaaagaacaagaattttctgcaaggatcatatctaagtgcactttttgctgatacttcatttctaatcttgtagaaaatttcagctgtagcccttggactagaagctgaaataacagaagctgtgtacgatgcattagggtattgaagaaaattaacttttgaattaaatatttggaatataaggaaataaggaaagttgactgaaaatggggcggaagaaaatacaaatcacacgcataatggatgaaaggaaccgacaggtcacttttacaaagagaaagtttggattaatgaagaaagcctatgaacttagtgtgctctgtgactgtgaaatagcactcatcattttcaacagctctaacaaactgtttcaatatgctagcactgatatggacaaagttcttctcaagtatacagaatataatgaacctcatgaaagcagaaccaactcggatattgttgagactttaagaaagaaaggccttaatggttgtgagagccctgatgctgacgattactttgagcacagtccactctcggaggacagattcagcaaactaaatgaagatagtgattttattttcaaacgaggccctgtaagtacttttactttacctctactttttatttgttgatcctttttgttaacttcattatttaggctgctctgaacaagaaggaacacagagggtgcgacagcccagaccctgatacttcatatgtgctaactccacatacagaagaaaaatataaaaaaattaatgaggaatttgataatatgatgcggaatcataaaatcgcacctggtctgccacctcagaacttttcaatgtctgtcacagttccagtgaccagccccaatgctttgtcctacactaacccagggagttcactggtgtccccatctttggcagccagctcaacgttaacagattcaagcatgctctctccacctcaaaccacattacatagaaatgtgtctcctggagctcctcagagaccaccaagtactggcaatgcaggtgggatgttgagcactacagacctcacagtgccaaatggagctggaagcagtccagtggggaatggatttgtaaactcaagagcttctccaaatttgattggagctactggtgcaaatagcttaggcaaagtcatgcctacaaagtctccccctccaccaggtggtggtaatcttggaatgaacagtaggaaaccagatcttcgagttgtcatccccccttcaagcaagggcatgatgcctccactaaacacccaaaggatcagtagttctcaagccactcaacctcttgctaccccagtcgtgtctgtgacaaccccaagcttgcctccgcaaggacttgtgtactcagcaatgccgactgcctacaacactgattattcactgaccagcgctgacctgtcagcccttcaaggcttcaactcgccaggaatgctgtcgctgggacaggtgtcggcctggcagcagcaccacctaggacaagcagccctcagctctcttgttgctggagggcagttatctcagggttccaatttatccattaataccaacccatcgggcttccagcagcagcagcagcagcagcagcagcagcagccgccgccaccaccgcagccccagccacaacccccgcagccccagccccgacaggaaatggggcgctcccctgtggacagtctgagcagctctagtagctcctatgatggcagtgatcgggaggatccacggggcgacttccattctccaattgtgcttggccgacccccaaacactgaggacagagaaagcccttctgtaaagcgaatgaggatggacgcgtgggtgacctaaggcttccaagctgatgtttgtacttttgtgttactgcagtgacctgccctacatatctaaatcggtaaataaggacatgagttaaatatatttatatgtacatacatatatatatccctttacatatatatgtatgtgggtgtgagtgtgtgtgtatgtgtgggtgtgtgttacatacacagaatcaggcacttacctgcaaactccttgtaggtctgcagatgtgtgtcccatggcagacaaagcaccctgtaggcacagacaagtctggcacttccttggactacttgtttcgtaaagataaccagtttttgcagagaaacgtgtacccatatataattctcccacactagcttgcagaaacctagagggccccctacttgttttatttaactgtgcagtgactgtagttacttaagagaaaatgctttgtagaacagagcagtagaaaagcaggaaccaagaaagcaatactgtacataaaatgtcatttatattttccaacctggcatgggtgtctgttgcaaaggggtgcatgggaaagggctgttgatattaaaaacaaacaaaacaaaaaagccccacacataactgttttgcacgtgcaaaaatgtattgggtcaagaagtgatctttagctaataaagaaagagaatagaaaacacgcatgagatattcagaaaatactagcctagaaatatagagcattaacaaagtaaaattaatatattaagttataattggaatatgtcagaagtttctttttacattcatatcttaaaaattaaagaaactgattttagctcatgtatattttatatgaaagaaaacacccttatgaattgatgactatatataaaattatattcactacttttgaacacattctgctatgaattatttatataagccaaagctatatgttgtaacttttttttagagaatagctttatcttggtttaactctttagttttattttaagaggggaaaacaaaaatatcttgcaagcagaaccttggaaaaaaaaagccatgaacacttattctaaatgtaaattaaaagttgagccaaactctttgtgtatatagcatcttaaatatattatcacctttgatgtaagtacctatgtattgtatggtcaccagattaaaaagtatatttttgtggattgccgccaatctggggggaaaaggcgaggtcctttattaagtattcactgtttaatatttactattttgttaaatatactgtactttggattttaattattagcccagttttttcagaggattgtataaaggggtttctcccctcactggtggtgaatgtgtgatgttacattgtaatctttgtgctgtatgggttgagcatcattatatattttgtatgtgtacataaatagcaaagtggcaaaaaaaattggtgttaagttcatcctgcataagtataaaatgtgttgtaacagattttataaggcattatttaaaacttgccttttgtgaggaaaaaatgtagtagaaaaagctgacctaatttaattaatattagagaaaatggcaaaatagtagatgagcacaaaggttttataagtggtaaatgattaggggaaaataatcatggggaaagggatcttttttccttgaccctctgaaaacagaacgatgcagctggttacaaaatcctaccgttatcagctcttctgcacattgcagtgatgctttggtatgcggggagaaacactcttagggtgctggtccttggcatgactcttgccattctaattggaattagtgccaccctcagcttggattttgaacaaggccttattctttcaggaagacaactaatggatgatagcaagttcatccacttactgggcttgtgccatgagcaaaattcaaagtcctgtatatctttcattgtagatttttaaatactccttttcctaaaaaactcaagggtttaaaaattgctattttatattttaaatgatattgagcagctacctacaatttctatgtacattttgttccccccccaccgcccccccccaaattacgttccttttgacgttttcctcatctgctgtttgtgacaagtcatcagccagatttcctgactgacacatacgtatgatcagtgcaggagagacctgcgcaccacaggctgcaaactggaggttctgttctcatggcagtttgggcagtaacttttgagagaggccaaaaaaaggaggatgacatgctgtctcctctcttcagtatagacattaggctcttattcagaaaggatttttctttaaaaatgtacttactttactgaactacttacaggcacatttcttcataaggccacacctaatccaaacaagacagtctcccaacactgaagttccaaaataatccttaccactttgtaaaccatttatagctttgaaagtgttaagtgattccttcgttattatttatgcatgttcatgaacttctgctgtacattggaataggagttaacacattcacatttactgtctattttcttgtgtgccttatgagatggcttttctgactgtatctcaatagtctttctttctatgcaggtttataatcagtacaactactgttttctaaaatactactactcaaggctcggagtttgtatttaaattacactgaccaagtaacaatgtattccatttcaggaactgaatatttgactgttaacctttttcccatacgtccagtgtggcatggagcatatggacttgacagacatctctcacccagacgcccacgtgtgaacacacccacatccacatctctgggtggaaaccagcctagagtggggacgacgctaatggtgttgctttagaaccgtcttttcttacccttttagactcgtgttttgtatgagacaccattgcaagaaaattttatccctccagaagtattttattactaaagaacaaaagcaaaaaaagcttaaattgcactggttaaagtacagtttccaacagctgtccttcctcagtactctaatggccactccaccgcgagtggaagtcactgttgtgtgtacacaggtggtcccaatcaaaactccatcttttgagcccaattatgtccattttgttatagactaaatcaggggtttgttctacaagaacaatacatgttttaccctttcctttaactagaaggataactagtaatgcatcaacataatttctgtattaaccatcatgcgcacaagaaatacatagtaaataaggaagctgaaaactcctggcattggatcttaagctagatgattagaatgtgaaaaagattttacaaatgtaaaacttctatttctctgtagaaactttcttcactttgctgtgcaagaagacactgctttgctatatttaaaatggcttttttaaaagagatttatgtatttggtaaatgtttgtagtcaacagttcacacaagaagctgtacacggtttgatcatgtaaaaccgtttggcggcacaagctggactttgttgccatccttgagatgaaccttttaagaaaaataagttaatctcaatttttccctgaatgtgttgtttttcttcattatacaataaatataatagtgaactttta

SEQ ID NO: 329590 - DNA, 4348 bp, Homo sapiens
agttttcacatcatcagtgcttcagaaaatgacagtcatatgaaactgtgaaaaatgtcacttaaattgaaagtgatttttaagtcaacataaataccacatcagaacacattttctcttttttgatctcacagaacacccaaaggatcagtagttctcaagccactcaacctcttgctaccccagtcgtgtctgtgacaaccccaagcttgcctccgcaaggacttgtgtactcagcaatgccgactgcctacaacactgattattcactgaccagcgctgacctgtcagcccttcaaggcttcaactcgccaggaatgctgtcgctgggacaggtgtcggcctggcagcagcaccacctaggacaagcagccctcagctctcttgttgctggagggcagttatctcagggttccaatttatccattaataccaacccatcgggcttccagcagcagcagcagcagcagcagcagcagcagccgccgccaccaccgcagccccagccacaacccccgcagccccagccccgacaggaaatggggcgctcccctgtggacagtctgagcagctctagtagctcctatgatggcagtgatcgggaggatccacggggcgacttccattctccaattgtgcttggccgacccccaaacactgaggacagagaaagcccttctgtaaagcgaatgaggatggacgcgtgggtgacctaaggcttccaagctgatgtttgtacttttgtgttactgcagtgacctgccctacatatctaaatcggtaaataaggacatgagttaaatatatttatatgtacatacatatatatatccctttacatatatatgtatgtgggtgtgagtgtgtgtgtatgtgtgggtgtgtgttacatacacagaatcaggcacttacctgcaaactccttgtaggtctgcagatgtgtgtcccatggcagacaaagcaccctgtaggcacagacaagtctggcacttccttggactacttgtttcgtaaagataaccagtttttgcagagaaacgtgtacccatatataattctcccacactagcttgcagaaacctagagggccccctacttgttttatttaactgtgcagtgactgtagttacttaagagaaaatgctttgtagaacagagcagtagaaaagcaggaaccaagaaagcaatactgtacataaaatgtcatttatattttccaacctggcatgggtgtctgttgcaaaggggtgcatgggaaagggctgttgatattaaaaacaaacaaaacaaaaaagccccacacataactgttttgcacgtgcaaaaatgtattgggtcaagaagtgatctttagctaataaagaaagagaatagaaaacacgcatgagatattcagaaaatactagcctagaaatatagagcattaacaaagtaaaattaatatattaagttataattggaatatgtcagaagtttctttttacattcatatcttaaaaattaaagaaactgattttagctcatgtatattttatatgaaagaaaacacccttatgaattgatgactatatataaaattatattcactacttttgaacacattctgctatgaattatttatataagccaaagctatatgttgtaacttttttttagagaatagctttatcttggtttaactctttagttttattttaagaggggaaaacaaaaatatcttgcaagcagaaccttggaaaaaaaaagccatgaacacttattctaaatgtaaattaaaagttgagccaaactctttgtgtatatagcatcttaaatatattatcacctttgatgtaagtacctatgtattgtatggtcaccagattaaaaagtatatttttgtggattgccgccaatctggggggaaaaggcgaggtcctttattaagtattcactgtttaatatttactattttgttaaatatactgtactttggattttaattattagcccagttttttcagaggattgtataaaggggtttctcccctcactggtggtgaatgtgtgatgttacattgtaatctttgtgctgtatgggttgagcatcattatatattttgtatgtgtacataaatagcaaagtggcaaaaaaaattggtgttaagttcatcctgcataagtataaaatgtgttgtaacagattttataaggcattatttaaaacttgccttttgtgaggaaaaaatgtagtagaaaaagctgacctaatttaattaatattagagaaaatggcaaaatagtagatgagcacaaaggttttataagtggtaaatgattaggggaaaataatcatggggaaagggatcttttttccttgaccctctgaaaacagaacgatgcagctggttacaaaatcctaccgttatcagctcttctgcacattgcagtgatgctttggtatgcggggagaaacactcttagggtgctggtccttggcatgactcttgccattctaattggaattagtgccaccctcagcttggattttgaacaaggccttattctttcaggaagacaactaatggatgatagcaagttcatccacttactgggcttgtgccatgagcaaaattcaaagtcctgtatatctttcattgtagatttttaaatactccttttcctaaaaaactcaagggtttaaaaattgctattttatattttaaatgatattgagcagctacctacaatttctatgtacattttgttccccccccaccgcccccccccaaattacgttccttttgacgttttcctcatctgctgtttgtgacaagtcatcagccagatttcctgactgacacatacgtatgatcagtgcaggagagacctgcgcaccacaggctgcaaactggaggttctgttctcatggcagtttgggcagtaacttttgagagaggccaaaaaaaggaggatgacatgctgtctcctctcttcagtatagacattaggctcttattcagaaaggatttttctttaaaaatgtacttactttactgaactacttacaggcacatttcttcataaggccacacctaatccaaacaagacagtctcccaacactgaagttccaaaataatccttaccactttgtaaaccatttatagctttgaaagtgttaagtgattccttcgttattatttatgcatgttcatgaacttctgctgtacattggaataggagttaacacattcacatttactgtctattttcttgtgtgccttatgagatggcttttctgactgtatctcaatagtctttctttctatgcaggtttataatcagtacaactactgttttctaaaatactactactcaaggctcggagtttgtatttaaattacactgaccaagtaacaatgtattccatttcaggaactgaatatttgactgttaacctttttcccatacgtccagtgtggcatggagcatatggacttgacagacatctctcacccagacgcccacgtgtgaacacacccacatccacatctctgggtggaaaccagcctagagtggggacgacgctaatggtgttgctttagaaccgtcttttcttacccttttagactcgtgttttgtatgagacaccattgcaagaaaattttatccctccagaagtattttattactaaagaacaaaagcaaaaaaagcttaaattgcactggttaaagtacagtttccaacagctgtccttcctcagtactctaatggccactccaccgcgagtggaagtcactgttgtgtgtacacaggtggtcccaatcaaaactccatcttttgagcccaattatgtccattttgttatagactaaatcaggggtttgttctacaagaacaatacatgttttaccctttcctttaactagaaggataactagtaatgcatcaacataatttctgtattaaccatcatgcgcacaagaaatacatagtaaataaggaagctgaaaactcctggcattggatcttaagctagatgattagaatgtgaaaaagattttacaaatgtaaaacttctatttctctgtagaaactttcttcactttgctgtgcaagaagacactgctttgctatatttaaaatggcttttttaaaagagatttatgtatttggtaaatgtttgtagtcaacagttcacacaagaagctgtacacggtttgatcatgtaaaaccgtttggcggcacaagctggactttgttgccatccttgagatgaaccttttaagaaaaataagttaatctcaatttttccctgaatgtgttgtttttcttcattatacaataaatataatagtgaactttta

SEQ ID NO: 329591 - DNA, 3067 bp, Homo sapiens
tagccccggtgtggggatccgtgcgcggatgtcccggcgagtcccgggctgaaagaggcggctccgggcggcgcgaagcgctggtggcgggcccgggctgcggcgtgtgcgcgcccgccagctgctccggagatacggaattgcattttgtgaaaaaagaacaagaattttctgcaaggatcatatctaagtgcactttttgctgatacttcatttctaatcttgtagaaaatttcagctgtagcccttggactagaagctgaaataacagaagctgtgtacgatgcattagggtattgaagaaaattaacttttgaattaaatatttggaatataaggaaataaggaaagttgactgaaaatggggcggaagaaaatacaaatcacacgcataatggatgaaaggaaccgacaggtcacttttacaaagagaaagtttggattaatgaagaaagcctatgaacttagtgtgctctgtgactgtgaaatagcactcatcattttcaacagctctaacaaactgtttcaatatgctagcactgatatggacaaagttcttctcaagtatacagaatataatgaacctcatgaaagcagaaccaactcggatattgttgagactttaagaaagaaaggccttaatggttgtgagagccctgatgctgacgattactttgagcacagtccactctcggaggacagattcagcaaactaaatgaagatagtgattttattttcaaacgaggccctgtaagtacttttactttacctctactttttatttgttgatcctttttgttaacttcattatttaggctgctctgaacaagaaggaacacagagggtgcgacagcccagaccctgatacttcatatgtgctaactccacatacagaagaaaaatataaaaaaattaatgaggaatttgataatatgatgcggaatcataaaatcgcacctggtctgccacctcagaacttttcaatgtctgtcacagttccagtgaccagccccaatgctttgtcctacactaacccagggagttcactggtgtccccatctttggcagccagctcaacgttaacagattcaagcatgctctctccacctcaaaccacattacatagaaatgtgtctcctggagctcctcagagaccaccaagtactggcaatgcaggtgggatgttgagcactacagacctcacagtgccaaatggagctggaagcagtccagtggggaatggatttgtaaactcaagagcttctccaaatttgattggagctactggtgcaaatagcttaggcaaagtcatgcctacaaagtctccccctccaccaggtggtggtaatcttggaatgaacagtaggaaaccagatcttcgagttgtcatccccccttcaagcaagggcatgatgcctccactaaacacccaaaggatcagtagttctcaagccactcaacctcttgctaccccagtcgtgtctgtgacaaccccaagcttgcctccgcaaggacttgtgtactcagcaatgccgactgcctacaacactgattattcactgaccagcgctgacctgtcagcccttcaaggcttcaactcgccaggaatgctgtcgctgggacaggtgtcggcctggcagcagcaccacctaggacaagcagccctcagctctcttgttgctggagggcagttatctcagggttccaatttatccattaataccaaccaaaacatcagcatcaagtccgaaccgatttcacctcctcgggatcgtatgaccccatcgggcttccagcagcagcagcagcagcagcagcagcagcagccgccgccaccaccgcagccccagccacaacccccgcagccccagccccgacaggaaatggggcgctcccctgtggacagtctgagcagctctagtagctcctatgatggcagtgatcgggaggatccacggggcgacttccattctccaattgtgcttggccgacccccaaacactgaggacagagaaagcccttctgtaaagcgaatgaggatggacgcgtgggtgacctaaggcttccaagctgatgtttgtacttttgtgttactgcagtgacctgccctacatatctaaatcgccatttcaggaactgaatatttgactgttaacctttttcccatacgtccagtgtggcatggagcatatggacttgacagacatctctcacccagacgcccacgtgtgaacacacccacatccacatctctgggtggaaaccagcctagagtggggacgacgctaatggtgttgctttagaaccgtcttttcttacccttttagactcgtgttttgtatgagacaccattgcaagaaaattttatccctccagaagtattttattactaaagaacaaaagcaaaaaaagcttaaattgcactggttaaagtacagtttccaacagctgtccttcctcagtactctaatggccactccaccgcgagtggaagtcactgttgtgtgtacacaggtggtcccaatcaaaactccatcttttgagcccaattatgtccattttgttatagactaaatcaggggtttgttctacaagaacaatacatgttttaccctttcctttaactagaaggataactagtaatgcatcaacataatttctgtattaaccatcatgcgcacaagaaatacatagtaaataaggaagctgaaaactcctggcattggatcttaagctagatgattagaatgtgaaaaagattttacaaatgtaaaacttctatttctctgtagaaactttcttcactttgctgtgcaagaagacactgctttgctatatttaaaatggcttttttaaaagagatttatgtatttggtaaatgtttgtagtcaacagttcacacaagaagctgtacacggtttgatcatgtaaaaccgtttggcggcacaagctggactttgttgccatccttgagatgaaccttttaagaaaaataagttaatctcaatttttccctgaatgtgttgtttttcttcattatacaataaatataatagtgaactttta

SEQ ID NO: 329592 - DNA, 1525 bp, Homo sapiens
tagccccggtgtggggatccgtgcgcggatgtcccggcgagtcccgggctgaaagaggcggctccgggcggcgcgaagcgctggtggcgggcccgggctgcggcgtgtgcgcgcccgccagctgctccggagatacggaattgcattttgtgaaaaaagaacaagaattttctgcaaggatcatatctaagtgcactttttgctgatacttcatttctaatcttgtagaaaatttcagctgtagcccttggactagaagctgaaataacagaagctgtgtacgatgcattagggtattgaagaaaattaacttttgaattaaatatttggaatataaggaaataaggaaagttgactgaaaatggggcggaagaaaatacaaatcacacgcataatggatgaaaggaaccgacaggtcacttttacaaagagaaagtttggattaatgaagaaagcctatgaacttagtgtgctctgtgactgtgaaatagcactcatcattttcaacagctctaacaaactgtttcaatatgctagcactgatatggacaaagttcttctcaagtatacagaatataatgaacctcatgaaagcagaaccaactcggatattgttgagactttaagaaagaaaggccttaatggttgtgagagccctgatgctgacgattactttgagcacagtccactctcggaggacagattcagcaaactaaatgaagatagtgattttattttcaaacgaggccctgtaagtacttttactttacctctactttttatttgttgatcctttttgttaacttcattatttaggctgctctgaacaagaaggaacacagagggtgcgacagcccagaccctgatacttcatatgtgctaactccacatacagaagaaaaatataaaaaaattaatgaggaatttgataatatgatgcggaatcataaaatcgcatgaccagccccaatgctttgtcctacactaacccagggagttcactggtgtccccatctttggcagccagctcaacgttaacagattcaagcatgctctctccacctcaaaccacattacatagaaatgtgtctcctggagctcctcagagaccaccaagtactggcaatgcaggtgggatgttgagcactacagacctcacagtgccaaatggagctggaagcagtccagtggggaatggatttgtaaactcaagagcttctccaaatttgattggagctactggtgcaaatagcttaggcaaagtcatgcctacaaagtctccccctccaccaggtggtggtaatcttggaatgaacagtaggaaaccagatcttcgagttgtcatccccccttcaagcaagggcatgatgcctccactagtaagttgaacctttcttcaacttcattctttaaaacacatattttatacatagtcaatctgtagcttcctttggaattttctgtgccaccgtagaatctacacctattcctaataaatatttccattcaaaattaaaaaaaaaaa

SEQ ID NO: 329593 - DNA, 411 bp, Homo sapiens
gagtcaagaacaataatgcatctcaaatttttttcttttttaaggaattgcattttgtgaaaaaagaacaagaattttctgcaaggatcatatctaagtgcactttttgctgatacttcatttctagtaagacattttttcttttctatgttaagtagatacaatggaaatgtattttaaaaatcaggctgttcttgtgagattgaatggcagttattttagaggttttcttgggggcgaggggggcttaatttagacccagttgaggaaatttgtaaaattcggttgaaatgcgtaatattgtgtagtggcagtttctcttatattttgtctgacgctgctgaaatcatctcatattttttcatctttcacacttcttccatattctctatcagttaacctctatttgaa

SEQ ID NO: 329594 - DNA, 761 bp, Homo sapiens
gtgaacattttaaactatttaaaacaagtttagtttattgaaactagtaagttcaataggctatacgcacagtacagataaatataaagcataacatgatacagaggataggaaaatgggacctaggaaaccaatttttgaatctcgcgatgcaaagaatattactgaacatttgagtaatacttcctgaagaaaaaggattcgtaatagtagagatactcagttggctgacgttttgttttattccaaataaatgactttttaaaatttaattttcatttaacagtatttgtggagctttctgctaggaatggtgttgagtgctagaattttgtataatgtatatttaattcagctttggagtcaagaacaataatgcatctcaaatttttttcttttttaaggaattgcattttgtgaaaaaagaacaagaattttctgcaaggatcatatctaagtgcactttttgctgatacttcatttctagtaagacattttttcttttctatgttaagtagatacaatggaaatgtattttaaaaatcaggctgttcttgtgagattgaatggcagttattttagaggttttcttgggggcgaggggggcttaatttagacccagttgaggaaatttgtaaaattcggttgaaatgcgtaatattgtgtagtggcagtttctcttatattttgtctgacgctgctgaaatcatctcatattttttcatctttcacacttcttccatattctctatcagttaacc

SEQ ID NO: 329595 - DNA, 730 bp, Homo sapiens
tagccccggtgtggggatccgtgcgcggatgtcccggcgagtcccgggctgaaagaggcggctccgggcggcgcgaagcgctggtggcgggcccgggctgcggcgtgtgcgcgcccgccagctgctccggagatacggaattgcattttgtgaaaaaagaacaagaattttctgcaaggatcatatctaagtgcactttttgctgatacttcatttctaatcttgtagaaaatttcagctgtagcccttggactagaagctgaaataacagaagctgtgtacgatgcattagggtattgaagaaaattaacttttgaattaaatatttggaatataaggaaataaggaaagttgactgaaaatggggcggaagaaaatacaaatcacacgcataatggatgaaaggaaccgacaggtcacttttacaaagagaaagtttggattaatgaagaaagcctatgaacttagtgtgctctgtgactgtgaaatagcactcatcattttcaacagctctaacaaactgtttcaatatgctagcactgatatggacaaagttcttctcaagtatacagaatataatgaacctcatgaaagcagaaccaactcggatattgttgaggtaacacatatctagtaatacgtgaattgcaagtaatactgaaatattttgtttaatagcattaactgtcagaatgacttgtacatctaaaacataaattaggtgtatatg

SEQ ID NO: 329596 - DNA, 5828 bp, Homo sapiens
tagccccggtgtggggatccgtgcgcggatgtcccggcgagtcccgggctgaaagaggcggctccgggcggcgcgaagcgctggtggcgggcccgggctgcggcgtgtgcgcgcccgccagctgctccggagatacggaattgcattttgtgaaaaaagaacaagaattttctgcaaggatcatatctaagtgcactttttgctgatacttcatttctagacattgagtctcactctaccccccaggctgaagtgcagtggtgtgatctcggttcactgcaacctccgcctccaggttcaagtgattctcgtacctcagcctcccgagtagctgggattacaggcgcctgccaccatgcctggctgatatttatatttttagtagagatggagtttcaccatgttggccaggctggtctcgaactctggacctcagatcttgtagaaaatttcagctgtagcccttggactagaagctgaaataacagaagctgtgtacgatgcattagggtattgaagaaaattaacttttgaattaaatatttggaatataaggaaataaggaaagttgactgaaaatggggcggaagaaaatacaaatcacacgcataatggatgaaaggaaccgacaggtcacttttacaaagagaaagtttggattaatgaagaaagcctatgaacttagtgtgctctgtgactgtgaaatagcactcatcattttcaacagctctaacaaactgtttcaatatgctagcactgatatggacaaagttcttctcaagtatacagaatataatgaacctcatgaaagcagaaccaactcggatattgttgaggctctgaacaagaaggaacacagagggtgcgacagcccagaccctgatacttcatatgtgctaactccacatacagaagaaaaatataaaaaaattaatgaggaatttgataatatgatgcggaatcataaaatcgcacctggtctgccacctcagaacttttcaatgtctgtcacagttccagtgaccagccccaatgctttgtcctacactaacccagggagttcactggtgtccccatctttggcagccagctcaacgttaacagattcaagcatgctctctccacctcaaaccacattacatagaaatgtgtctcctggagctcctcagagaccaccaagtactggcaatgcaggtgggatgttgagcactacagacctcacagtgccaaatggagctggaagcagtccagtggggaatggatttgtaaactcaagagcttctccaaatttgattggagctactggtgcaaatagcttaggcaaagtcatgcctacaaagtctccccctccaccaggtggtggtaatcttggaatgaacagtaggaaaccagatcttcgagttgtcatccccccttcaagcaagggcatgatgcctccactatcggaggaagaggaattggagttgaacacccaaaggatcagtagttctcaagccactcaacctcttgctaccccagtcgtgtctgtgacaaccccaagcttgcctccgcaaggacttgtgtactcagcaatgccgactgcctacaacactgattattcactgaccagcgctgacctgtcagcccttcaaggcttcaactcgccaggaatgctgtcgctgggacaggtgtcggcctggcagcagcaccacctaggacaagcagccctcagctctcttgttgctggagggcagttatctcagggttccaatttatccattaataccaaccaaaacatcagcatcaagtccgaaccgatttcacctcctcgggatcgtatgaccccatcgggcttccagcagcagcagcagcagcagcagcagcagcagccgccgccaccaccgcagccccagccacaacccccgcagccccagccccgacaggaaatggggcgctcccctgtggacagtctgagcagctctagtagctcctatgatggcagtgatcgggaggatccacggggcgacttccattctccaattgtgcttggccgacccccaaacactgaggacagagaaagcccttctgtaaagcgaatgaggatggacgcgtgggtgacctaaggcttccaagctgatgtttgtacttttgtgttactgcagtgacctgccctacatatctaaatcggtaaataaggacatgagttaaatatatttatatgtacatacatatatatatccctttacatatatatgtatgtgggtgtgagtgtgtgtgtatgtgtgggtgtgtgttacatacacagaatcaggcacttacctgcaaactccttgtaggtctgcagatgtgtgtcccatggcagacaaagcaccctgtaggcacagacaagtctggcacttccttggactacttgtttcgtaaagataaccagtttttgcagagaaacgtgtacccatatataattctcccacactagcttgcagaaacctagagggccccctacttgttttatttaactgtgcagtgactgtagttacttaagagaaaatgctttgtagaacagagcagtagaaaagcaggaaccaagaaagcaatactgtacataaaatgtcatttatattttccaacctggcatgggtgtctgttgcaaaggggtgcatgggaaagggctgttgatattaaaaacaaacaaaacaaaaaagccccacacataactgttttgcacgtgcaaaaatgtattgggtcaagaagtgatctttagctaataaagaaagagaatagaaaacacgcatgagatattcagaaaatactagcctagaaatatagagcattaacaaagtaaaattaatatattaagttataattggaatatgtcagaagtttctttttacattcatatcttaaaaattaaagaaactgattttagctcatgtatattttatatgaaagaaaacacccttatgaattgatgactatatataaaattatattcactacttttgaacacattctgctatgaattatttatataagccaaagctatatgttgtaacttttttttagagaatagctttatcttggtttaactctttagttttattttaagaggggaaaacaaaaatatcttgcaagcagaaccttggaaaaaaaaagccatgaacacttattctaaatgtaaattaaaagttgagccaaactctttgtgtatatagcatcttaaatatattatcacctttgatgtaagtacctatgtattgtatggtcaccagattaaaaagtatatttttgtggattgccgccaatctggggggaaaaggcgaggtcctttattaagtattcactgtttaatatttactattttgttaaatatactgtactttggattttaattattagcccagttttttcagaggattgtataaaggggtttctcccctcactggtggtgaatgtgtgatgttacattgtaatctttgtgctgtatgggttgagcatcattatatattttgtatgtgtacataaatagcaaagtggcaaaaaaaattggtgttaagttcatcctgcataagtataaaatgtgttgtaacagattttataaggcattatttaaaacttgccttttgtgaggaaaaaatgtagtagaaaaagctgacctaatttaattaatattagagaaaatggcaaaatagtagatgagcacaaaggttttataagtggtaaatgattaggggaaaataatcatggggaaagggatcttttttccttgaccctctgaaaacagaacgatgcagctggttacaaaatcctaccgttatcagctcttctgcacattgcagtgatgctttggtatgcggggagaaacactcttagggtgctggtccttggcatgactcttgccattctaattggaattagtgccaccctcagcttggattttgaacaaggccttattctttcaggaagacaactaatggatgatagcaagttcatccacttactgggcttgtgccatgagcaaaattcaaagtcctgtatatctttcattgtagatttttaaatactccttttcctaaaaaactcaagggtttaaaaattgctattttatattttaaatgatattgagcagctacctacaatttctatgtacattttgttccccccccaccgcccccccccaaattacgttccttttgacgttttcctcatctgctgtttgtgacaagtcatcagccagatttcctgactgacacatacgtatgatcagtgcaggagagacctgcgcaccacaggctgcaaactggaggttctgttctcatggcagtttgggcagtaacttttgagagaggccaaaaaaaggaggatgacatgctgtctcctctcttcagtatagacattaggctcttattcagaaaggatttttctttaaaaatgtacttactttactgaactacttacaggcacatttcttcataaggccacacctaatccaaacaagacagtctcccaacactgaagttccaaaataatccttaccactttgtaaaccatttatagctttgaaagtgttaagtgattccttcgttattatttatgcatgttcatgaacttctgctgtacattggaataggagttaacacattcacatttactgtctattttcttgtgtgccttatgagatggcttttctgactgtatctcaatagtctttctttctatgcaggtttataatcagtacaactactgttttctaaaatactactactcaaggctcggagtttgtatttaaattacactgaccaagtaacaatgtattccatttcaggaactgaatatttgactgttaacctttttcccatacgtccagtgtggcatggagcatatggacttgacagacatctctcacccagacgcccacgtgtgaacacacccacatccacatctctgggtggaaaccagcctagagtggggacgacgctaatggtgttgctttagaaccgtcttttcttacccttttagactcgtgttttgtatgagacaccattgcaagaaaattttatccctccagaagtattttattactaaagaacaaaagcaaaaaaagcttaaattgcactggttaaagtacagtttccaacagctgtccttcctcagtactctaatggccactccaccgcgagtggaagtcactgttgtgtgtacacaggtggtcccaatcaaaactccatcttttgagcccaattatgtccattttgttatagactaaatcaggggtttgttctacaagaacaatacatgttttaccctttcctttaactagaaggataactagtaatgcatcaacataatttctgtattaaccatcatgcgcacaagaaatacatagtaaataaggaagctgaaaactcctggcattggatcttaagctagatgattagaatgtgaaaaagattttacaaatgtaaaacttctatttctctgtagaaactttcttcactttgctgtgcaagaagacactgctttgctatatttaaaatggcttttttaaaagagatttatgtatttggtaaatgtttgtagtcaacagttcacacaagaagctgtacacggtttgatcatgtaaaaccgtttggcggcacaagctggactttgttgccatccttgagatgaaccttttaagaaaaataagttaatctcaatttttccctgaatgtgttgtttttcttcattatacaataaatataatagtgaacttttaaaaaaatggtgacgacaatgctaaaggttgttgtaaactgtttgtctcccgcactcactccagtaaagacggactggctcttcctgtgcgtcga

SEQ ID NO: 329597 - DNA, 5493 bp, Homo sapiens
tagccccggtgtggggatccgtgcgcggatgtcccggcgagtcccgggctgaaagaggcggctccgggcggcgcgaagcgctggtggcgggcccgggctgcggcgtgtgcgcgcccgccagctgctccggagatacggaattgcattttgtgaaaaaagaacaagaattttctgcaaggatcatatctaagtgcactttttgctgatacttcatttctaatcttgtagaaaatttcagctgtagcccttggactagaagctgaaataacagaagctgtgtacgatgcattagggtattgaagaaaattaacttttgaattaaatatttggaatataaggaaataaggaaagttgactgaaaatggggcggaagaaaatacaaatcacacgcataatggatgaaaggaaccgacaggtcacttttacaaagagaaagtttggattaatgaagaaagcctatgaacttagtgtgctctgtgactgtgaaatagcactcatcattttcaacagctctaacaaactgtttcaatatgctagcactgatatggacaaagttcttctcaagtatacagaatataatgaacctcatgaaagcagaaccaactcggatattgttgaggctctgaacaagaaggaacacagagggtgcgacagcccagaccctgatacttcatatgtgctaactccacatacagaagaaaaatataaaaaaattaatgaggaatttgataatatgatgcggaatcataaaatcgcacctggtctgccacctcagaacttttcaatgtctgtcacagttccagtgaccagccccaatgctttgtcctacactaacccagggagttcactggtgtccccatctttggcagccagctcaacgttaacagattcaagcatgctctctccacctcaaaccacattacatagaaatgtgtctcctggagctcctcagagaccaccaagtactggcaatgcaggtgggatgttgagcactacagacctcacagtgccaaatggagctggaagcagtccagtggggaatggatttgtaaactcaagagcttctccaaatttgattggagctactggtgcaaatagcttaggcaaagtcatgcctacaaagtctccccctccaccaggtggtggtaatcttggaatgaacagtaggaaaccagatcttcgagttgtcatccccccttcaagcaagggcatgatgcctccactaaacacccaaaggatcagtagttctcaagccactcaacctcttgctaccccagtcgtgtctgtgacaaccccaagcttgcctccgcaaggacttgtgtactcagcaatgccgactgcctacaacactgattattcactgaccagcgctgacctgtcagcccttcaaggcttcaactcgccaggaatgctgtcgctgggacaggtgtcggcctggcagcagcaccacctaggacaagcagccctcagctctcttgttgctggagggcagttatctcagggttccaatttatccattaataccaaccaaaacatcagcatcaagtccgaaccgatttcacctcctcgggatcgtatgaccccatcgggcttccagcagcagcagcagcagcagcagcagcagcagccgccgccaccaccgcagccccagccacaacccccgcagccccagccccgacaggaaatggggcgctcccctgtggacagtctgagcagctctagtagctcctatgatggcagtgatcgggaggatccacggggcgacttccattctccaattgtgcttggccgacccccaaacactgaggacagagaaagcccttctgtaaagcgaatgaggatggacgcgtgggtgacctaaggcttccaagctgatgtttgtacttttgtgttactgcagtgacctgccctacatatctaaatcggtaaataaggacatgagttaaatatatttatatgtacatacatatatatatccctttacatatatatgtatgtgggtgtgagtgtgtgtgtatgtgtgggtgtgtgttacatacacagaatcaggcacttacctgcaaactccttgtaggtctgcagatgtgtgtcccatggcagacaaagcaccctgtaggcacagacaagtctggcacttccttggactacttgtttcgtaaagataaccagtttttgcagagaaacgtgtacccatatataattctcccacactagcttgcagaaacctagagggccccctacttgttttatttaactgtgcagtgactgtagttacttaagagaaaatgctttgtagaacagagcagtagaaaagcaggaaccaagaaagcaatactgtacataaaatgtcatttatattttccaacctggcatgggtgtctgttgcaaaggggtgcatgggaaagggctgttgatattaaaaacaaacaaaacaaaaaagccccacacataactgttttgcacgtgcaaaaatgtattgggtcaagaagtgatctttagctaataaagaaagagaatagaaaacacgcatgagatattcagaaaatactagcctagaaatatagagcattaacaaagtaaaattaatatattaagttataattggaatatgtcagaagtttctttttacattcatatcttaaaaattaaagaaactgattttagctcatgtatattttatatgaaagaaaacacccttatgaattgatgactatatataaaattatattcactacttttgaacacattctgctatgaattatttatataagccaaagctatatgttgtaacttttttttagagaatagctttatcttggtttaactctttagttttattttaagaggggaaaacaaaaatatcttgcaagcagaaccttggaaaaaaaaagccatgaacacttattctaaatgtaaattaaaagttgagccaaactctttgtgtatatagcatcttaaatatattatcacctttgatgtaagtacctatgtattgtatggtcaccagattaaaaagtatatttttgtggattgccgccaatctggggggaaaaggcgaggtcctttattaagtattcactgtttaatatttactattttgttaaatatactgtactttggattttaattattagcccagttttttcagaggattgtataaaggggtttctcccctcactggtggtgaatgtgtgatgttacattgtaatctttgtgctgtatgggttgagcatcattatatattttgtatgtgtacataaatagcaaagtggcaaaaaaaattggtgttaagttcatcctgcataagtataaaatgtgttgtaacagattttataaggcattatttaaaacttgccttttgtgaggaaaaaatgtagtagaaaaagctgacctaatttaattaatattagagaaaatggcaaaatagtagatgagcacaaaggttttataagtggtaaatgattaggggaaaataatcatggggaaagggatcttttttccttgaccctctgaaaacagaacgatgcagctggttacaaaatcctaccgttatcagctcttctgcacattgcagtgatgctttggtatgcggggagaaacactcttagggtgctggtccttggcatgactcttgccattctaattggaattagtgccaccctcagcttggattttgaacaaggccttattctttcaggaagacaactaatggatgatagcaagttcatccacttactgggcttgtgccatgagcaaaattcaaagtcctgtatatctttcattgtagatttttaaatactccttttcctaaaaaactcaagggtttaaaaattgctattttatattttaaatgatattgagcagctacctacaatttctatgtacattttgttccccccccaccgcccccccccaaattacgttccttttgacgttttcctcatctgctgtttgtgacaagtcatcagccagatttcctgactgacacatacgtatgatcagtgcaggagagacctgcgcaccacaggctgcaaactggaggttctgttctcatggcagtttgggcagtaacttttgagagaggccaaaaaaaggaggatgacatgctgtctcctctcttcagtatagacattaggctcttattcagaaaggatttttctttaaaaatgtacttactttactgaactacttacaggcacatttcttcataaggccacacctaatccaaacaagacagtctcccaacactgaagttccaaaataatccttaccactttgtaaaccatttatagctttgaaagtgttaagtgattccttcgttattatttatgcatgttcatgaacttctgctgtacattggaataggagttaacacattcacatttactgtctattttcttgtgtgccttatgagatggcttttctgactgtatctcaatagtctttctttctatgcaggtttataatcagtacaactactgttttctaaaatactactactcaaggctcggagtttgtatttaaattacactgaccaagtaacaatgtattccatttcaggaactgaatatttgactgttaacctttttcccatacgtccagtgtggcatggagcatatggacttgacagacatctctcacccagacgcccacgtgtgaacacacccacatccacatctctgggtggaaaccagcctagagtggggacgacgctaatggtgttgctttagaaccgtcttttcttacccttttagactcgtgttttgtatgagacaccattgcaagaaaattttatccctccagaagtattttattactaaagaacaaaagcaaaaaaagcttaaattgcactggttaaagtacagtttccaacagctgtccttcctcagtactctaatggccactccaccgcgagtggaagtcactgttgtgtgtacacaggtggtcccaatcaaaactccatcttttgagcccaattatgtccattttgttatagactaaatcaggggtttgttctacaagaacaatacatgttttaccctttcctttaactagaaggataactagtaatgcatcaacataatttctgtattaaccatcatgcgcacaagaaatacatagtaaataaggaagctgaaaactcctggcattggatcttaagctagatgattagaatgtgaaaaagattttacaaatgtaaaacttctatttctctgtagaaactttcttcactttgctgtgcaagaagacactgctttgctatatttaaaatggcttttttaaaagagatttatgtatttggtaaatgtttgtagtcaacagttcacacaagaagctgtacacggtttgatcatgtaaaaccgtttggcggcacaagctggactttgttgccatccttgagatgaaccttttaagaaaaataagttaatctcaatttttccctgaatgtgttgtttttcttcattatacaataaatataatagtgaactttta

SEQ ID NO: 329598 - DNA, 5681 bp, Homo sapiens
tagccccggtgtggggatccgtgcgcggatgtcccggcgagtcccgggctgaaagaggcggctccgggcggcgcgaagcgctggtggcgggcccgggctgcggcgtgtgcgcgcccgccagctgctccggagatacggaattgcattttgtgaaaaaagaacaagaattttctgcaaggatcatatctaagtgcactttttgctgatacttcatttctagacattgagtctcactctaccccccaggctgaagtgcagtggtgtgatctcggttcactgcaacctccgcctccaggttcaagtgattctcgtacctcagcctcccgagtagctgggattacaggcgcctgccaccatgcctggctgatatttatatttttagtagagatggagtttcaccatgttggccaggctggtctcgaactctggacctcagatcttgtagaaaatttcagctgtagcccttggactagaagctgaaataacagaagctgtgtacgatgcattagggtattgaagaaaattaacttttgaattaaatatttggaatataaggaaataaggaaagttgactgaaaatggggcggaagaaaatacaaatcacacgcataatggatgaaaggaaccgacaggtcacttttacaaagagaaagtttggattaatgaagaaagcctatgaacttagtgtgctctgtgactgtgaaatagcactcatcattttcaacagctctaacaaactgtttcaatatgctagcactgatatggacaaagttcttctcaagtatacagaatataatgaacctcatgaaagcagaaccaactcggatattgttgaggctctgaacaagaaggaacacagagggtgcgacagcccagaccctgatacttcatatgtgctaactccacatacagaagaaaaatataaaaaaattaatgaggaatttgataatatgatgcggaatcataaaatcgcacctggtctgccacctcagaacttttcaatgtctgtcacagttccagtgaccagccccaatgctttgtcctacactaacccagggagttcactggtgtccccatctttggcagccagctcaacgttaacagattcaagcatgctctctccacctcaaaccacattacatagaaatgtgtctcctggagctcctcagagaccaccaagtactggcaatgcaggtgggatgttgagcactacagacctcacagtgccaaatggagctggaagcagtccagtggggaatggatttgtaaactcaagagcttctccaaatttgattggagctactggtgcaaatagcttaggcaaagtcatgcctacaaagtctccccctccaccaggtggtggtaatcttggaatgaacagtaggaaaccagatcttcgagttgtcatccccccttcaagcaagggcatgatgcctccactatcggaggaagaggaattggagttgaacacccaaaggatcagtagttctcaagccactcaacctcttgctaccccagtcgtgtctgtgacaaccccaagcttgcctccgcaaggacttgtgtactcagcaatgccgactgcctacaacactgattattcactgaccagcgctgacctgtcagcccttcaaggcttcaactcgccaggaatgctgtcgctgggacaggtgtcggcctggcagcagcaccacctaggacaagcagccctcagctctcttgttgctggagggcagttatctcagggttccaatttatccattaataccaaccaaaacatcagcatcaagtccgaaccgatttcacctcctcgggatcgtatgaccccatcgggcttccagcagcagcagcagcagcagcagcagcagcagccgccgccaccaccgcagccccagccacaacccccgcagccccagccccgacaggaaatggggcgctcccctgtggacagtctgagcagctctagtagctcctatgatggcagtgatcgggaggatccacggggcgacttccattctccaattgtgcttggccgacccccaaacactgaggacagagaaagcccttctgtaaagcgaatgaggatggacgcgtgggtgacctaaggcttccaagctgatgtttgtacttttgtgttactgcagtgacctgccctacatatctaaatcggtaaataaggacatgagttaaatatatttatatgtacatacatatatatatccctttacatatatatgtatgtgggtgtgagtgtgtgtgtatgtgtgggtgtgtgttacatacacagaatcaggcacttacctgcaaactccttgtaggtctgcagatgtgtgtcccatggcagacaaagcaccctgtaggcacagacaagtctggcacttccttggactacttgtttcgtaaagataaccagtttttgcagagaaacgtgtacccatatataattctcccacactagcttgcagaaacctagagggccccctacttgttttatttaactgtgcagtgactgtagttacttaagagaaaatgctttgtagaacagagcagtagaaaagcaggaaccaagaaagcaatactgtacataaaatgtcatttatattttccaacctggcatgggtgtctgttgcaaaggggtgcatgggaaagggctgttgatattaaaaacaaacaaaacaaaaaagccccacacataactgttttgcacgtgcaaaaatgtattgggtcaagaagtgatctttagctaataaagaaagagaatagaaaacacgcatgagatattcagaaaatactagcctagaaatatagagcattaacaaagtaaaattaatatattaagttataattggaatatgtcagaagtttctttttacattcatatcttaaaaattaaagaaactgattttagctcatgtatattttatatgaaagaaaacacccttatgaattgatgactatatataaaattatattcactacttttgaacacattctgctatgaattatttatataagccaaagctatatgttgtaacttttttttagagaatagctttatcttggtttaactctttagttttattttaagaggggaaaacaaaaatatcttgcaagcagaaccttggaaaaaaaaagccatgaacacttattctaaatgtaaattaaaagttgagccaaactctttgtgtatatagcatcttaaatatattatcacctttgatgtaagtacctatgtattgtatggtcaccagattaaaaagtatatttttgtggattgccgccaatctggggggaaaaggcgaggtcctttattaagtattcactgtttaatatttactattttgttaaatatactgtactttggattttaattattagcccagttttttcagaggattgtataaaggggtttctcccctcactggtggtgaatgtgtgatgttacattgtaatctttgtgctgtatgggttgagcatcattatatattttgtatgtgtacataaatagcaaagtggcaaaaaaaattggtgttaagttcatcctgcataagtataaaatgtgttgtaacagattttataaggcattatttaaaacttgccttttgtgaggaaaaaatgtagtagaaaaagctgacctaatttaattaatattagagaaaatggcaaaatagtagatgagcacaaaggttttataagtggtaaatgattaggggaaaataatcatggggaaagggatcttttttccttgaccctctgaaaacagaacgatgcagctggttacaaaatcctaccgttatcagctcttctgcacattgcagtgatgctttggtatgcggggagaaacactcttagggtgctggtccttggcatgactcttgccattctaattggaattagtgccaccctcagcttggattttgaacaaggccttattctttcaggaagacaactaatggatgatagcaagttcatccacttactgggcttgtgccatgagcaaaattcaaagtcctgtatatctttcattgtagatttttaaatactccttttcctaaaaaactcaagggtttaaaaattgctattttatattttaaatgatattgagcagctacctacaatttctatgtacattttgttccccccccaccgcccccccccaaattacgttccttttgacgttttcctcatctgctgtttgtgacaagtcatcagccagatttcctgactgacacatacgtatgatcagtgcaggagagacctgcgcaccacaggctgcaaactggaggttctgttctcatggcagtttgggcagtaacttttgagagaggccaaaaaaaggaggatgacatgctgtctcctctcttcagtatagacattaggctcttattcagaaaggatttttctttaaaaatgtacttactttactgaactacttacaggcacatttcttcataaggccacacctaatccaaacaagacagtctcccaacactgaagttccaaaataatccttaccactttgtaaaccatttatagctttgaaagtgttaagtgattccttcgttattatttatgcatgttcatgaacttctgctgtacattggaataggagttaacacattcacatttactgtctattttcttgtgtgccttatgagatggcttttctgactgtatctcaatagtctttctttctatgcaggtttataatcagtacaactactgttttctaaaatactactactcaaggctcggagtttgtatttaaattacactgaccaagtaacaatgtattccatttcaggaactgaatatttgactgttaacctttttcccatacgtccagtgtggcatggagcatatggacttgacagacatctctcacccagacgcccacgtgtgaacacacccacatccacatctctgggtggaaaccagcctagagtggggacgacgctaatggtgttgctttagaaccgtcttttcttacccttttagactcgtgttttgtatgagacaccattgcaagaaaattttatccctccagaagtattttattactaaagaacaaaagcaaaaaaagcttaaattgcactggttaaagtacagtttccaacagctgtccttcctcagtactctaatggccactccaccgcgagtggaagtcactgttgtgtgtacacaggtggtcccaatcgggtttgttctacaagaacaatacatgttttaccctttcctttaactagaaggataactagtaatgcatcaacataatttctgtattaaccatcatgcgcacaagaaatacatagtaaataaggaagctgaaaactcctggcattggatcttaagctagatgattagaatgtgaaaaagattttacaaatgtaaaacttctatttctctgtagaaactttcttcactttgctgtgcaagaagacactgctttgctatatttaaaatggcttttttaaaagagatttatgtatttggtaaatgtttgtagtcaacagttcacacaagaagctgtacacggtttgatcatgtaaaaccgtttggcggcacaagctggactttgttgccatccttgagatgaaccttttaagaaaaataagttaatctcaatttttccctgaatgtgttgtttttcttcattatacaataaatataatagtgaactttta

SEQ ID NO: 329599 - DNA, 3515 bp, Homo sapiens
tagccccggtgtggggatccgtgcgcggatgtcccggcgagtcccgggctgaaagaggcggctccgggcggcgcgaagcgctggtggcgggcccgggctgcggcgtgtgcgcgcccgccagctgctccggagatacggaattgcattttgtgaaaaaagaacaagaattttctgcaaggatcatatctaagtgcactttttgctgatacttcatttctagacattgagtctcactctaccccccaggctgaagtgcagtggtgtgatctcggttcactgcaacctccgcctccaggttcaagtgattctcgtacctcagcctcccgagtagctgggattacaggcgcctgccaccatgcctggctgatatttatatttttagtagagatggagtttcaccatgttggccaggctggtctcgaactctggacctcagatcttgtagaaaatttcagctgtagcccttggactagaagctgaaataacagaagctgtgtacgatgcattagggtattgaagaaaattaacttttgaattaaatatttggaatataaggaaataaggaaagttgactgaaaatggggcggaagaaaatacaaatcacacgcataatggatgaaaggaaccgacaggtcacttttacaaagagaaagtttggattaatgaagaaagcctatgaacttagtgtgctctgtgactgtgaaatagcactcatcattttcaacagctctaacaaactgtttcaatatgctagcactgatatggacaaagttcttctcaagtatacagaatataatgaacctcatgaaagcagaaccaactcggatattgttgaggctctgaacaagaaggaacacagagggtgcgacagcccagaccctgatacttcatatgtgctaactccacatacagaagaaaaatataaaaaaattaatgaggaatttgataatatgatgcggaatcataaaatcgcacctggtctgccacctcagaacttttcaatgtctgtcacagttccagtgaccagccccaatgctttgtcctacactaacccagggagttcactggtgtccccatctttggcagccagctcaacgttaacagattcaagcatgctctctccacctcaaaccacattacatagaaatgtgtctcctggagctcctcagagaccaccaagtactggcaatgcaggtgggatgttgagcactacagacctcacagtgccaaatggagctggaagcagtccagtggggaatggatttgtaaactcaagagcttctccaaatttgattggagctactggtgcaaatagcttaggcaaagtcatgcctacaaagtctccccctccaccaggtggtggtaatcttggaatgaacagtaggaaaccagatcttcgagttgtcatccccccttcaagcaagggcatgatgcctccactatcggaggaagaggaattggagttgaacacccaaaggatcagtagttctcaagccactcaacctcttgctaccccagtcgtgtctgtgacaaccccaagcttgcctccgcaaggacttgtgtactcagcaatgccgactgcctacaacactgattattcactgaccagcgctgacctgtcagcccttcaaggcttcaactcgccaggaatgctgtcgctgggacaggtgtcggcctggcagcagcaccacctaggacaagcagccctcagctctcttgttgctggagggcagttatctcagggttccaatttatccattaataccaaccaaaacatcagcatcaagtccgaaccgatttcacctcctcgggatcgtatgaccccatcgggcttccagcagcagcagcagcagcagcagcagcagcagccgccgccaccaccgcagccccagccacaacccccgcagccccagccccgacaggaaatggggcgctcccctgtggacagtctgagcagctctagtagctcctatgatggcagtgatcgggaggatccacggggcgacttccattctccaattgtgcttggccgacccccaaacactgaggacagagaaagcccttctgtaaagcgaatgaggatggacgcgtgggtgacctaaggcttccaagctgatgtttgtacttttgtgttactgcagtgacctgccctacatatctaaatcggtaaataaggacatgagttaaatatatttatatgtacatacatatatatatccctttacatatatatgtatgtgggtgtgagtgtgtgtgtatgtgtgggtgtgtgttacatacacagaatcaggcacttacctgcaaactccttgtaggtctgcagatgtgtgtcccatggcagacaaagcaccctgtaggcacagacaagtctggcacttccttggactacttgtttcgtaaagataaccagtttttgcagagaaacgtgtacccatatataattctcccacactagcttgcagaaacctagagggccccctacttgttttatttaactgtgcagtgactgtagttacttaagagaaaatgctttgtagaacagagcagtagaaaagcaggaaccaagaaagcaatactgtacataaaatgtcatttatattttccaacctggcatgggtgtctgttgcaaaggggtgcatgggaaagggctgttgatattaaaaacaaacaaaacaaaaaagccccacacataactgttttgcacgtgcaaaaatgtattgggtcaagaagtgatctttagctaataaagaaagagaatagaaaacacgcatgagatattcagaaaatactagcctagaaatatagagcattaacaaagtaaaattaatatattaagttataattggaatatgtcagaagtttctttttacattcatatcttaaaaattaaagaaactgattttagctcatgtatattttatatgaaagaaaacacccttatgaattgatgactatatataaaattatattcactacttttgaacacattctgctatgaattatttatataagccaaagctatatgttgtaacttttttttagagaatagctttatcttggtttaactctttagttttattttaagaggggaaaacaaaaatatcttgcaagcagaaccttggaaaaaaaaagccatgaacacttattctaaatgtaaattaaaagttgagccaaactctttgtgtatatagcatcttaaatatattatcacctttgatgtaagtacctatgtattgtatggtcaccagattaaaaagtatatttttgtggattgccgccaatctggggggaaaaggcgaggtcctttattaagtattcactgtttaatatttactattttgttaaatatactgtactttggattttaattattagcccagttttttcagaggattgtataaaggggtttctcccctcactggtggtgaatgtgtgatgttacattgtaatctttgtgctgtatgggttgagcatcattatatattttgtatgtgtacataaatagcaaagtggca

SEQ ID NO: 329600 - DNA, 403 bp, Homo sapiens
ctctgcattaatattctgaagctatatacttatactcacttatccatttttaagttgacatctagtttgataagttgcataaggacataatttccaacttgttataaatatccagatttataaataaaactgttaatcattcccttacattgataaaaatctctctaggtatcacagagatttgaaaaacattactttttttaaaaaaaaaagaacaagcctggtggtgacaaaatctctcagcattagcttgtctgtaaagaattttatttctccttcacttatgaagcttagtttggctggatatgaaattctgggttgaaaattcttttctttaagaatgttgaatattggcccccactctcttctcgcttgtagagtttctgccgagagatccgctgtt

SEQ ID NO: 329601 - DNA, 216 bp, Homo sapiens
atcaatattcaatttgtctagtgacttaatgtgactccttgctattgaaaggaaaatggagtcgctctcattggcccctcttcttcattgcccagttcagctgcagaaaccctcaaagtgctgccctcaactttgggaggtgacccagaggggacacctcccccccacccccaagaccccaaagcaaactctggggcagggggtactgtgcagact

SEQ ID NO: 329602 - DNA, 376 bp, Homo sapiens
cctcctgagtagctgggactacatgcatgtgctacagcacacaacttgtttcatattttttagtgtacaaatttttcacctccttggttaaatttattcctaggtattttattctttcagatgctattgtaaacggaatcactttcttaatttccttttcagattgattatgattgttcattgctgatgaagagaaacacaactgatttttgcatggtgatcttataacctacagctttgctacattcatttcatagttctagtagttttcttgtagattctttgggatcttctatatttaggatcatattatctgtgaagagagactgttttacttcttttccaatttgaatgcattttagttctttttcctgtt

SEQ ID NO: 329603 - DNA, 417 bp, Homo sapiens
aagagagtctttctgagctccttcatggtctgagagttgagattcacatgaaaatcacaaagtgtaactatgatgctatccttttattctttgggagtgggacttgtagttattatgtaggcatcacatttctaataatctttgatcctgaaagaagcagaagtaaaaatcaagacaaaactgcaaagcagaaggtgtgcttatttttggctaagaggaagaggagggaaggcgtgttgacctcacagggcagggagagaaggagtcttatccctgggagatgctgggagcaggggcttcaaaagacctgtgcttttgcagtgagaacattctgcagagacacacctggaagctgatgaaagtaggtgtacatcttttagggcagggacttctgtttgtttttctaatcgcttagaa

SEQ ID NO: 329604 - DNA, 308 bp, Homo sapiens
ggtatgagttccgaaggaaatgtttaaatagctcttggaagcgttagggtttgaagatttcagatcagaggtggaaagtggcccacagaacagcagcatcaacatcacctgtttcagagcaatgcttttcaaattctaatatgcatacacattacctggagatcttgttaacatgaagatgttgactgaggtctgcggagtggcctgagagtctacatttctgagaagctctcaggtgatgctggagctactaatgtgtgtaccccactttgaataagaaggatctaggagatgtgtggagagtgagt

SEQ ID NO: 329605 - DNA, 527 bp, Homo sapiens
caactaacctggtatgcccaccctcaaggcttcagagataacctcacttctttggacaagctttagctcaagatctcacttccttaaaccttttccctagccgtctccttcaatacgtggacaatcttctcctttgcagcccctctctagaagactctcaaactcacacagttactctcttaaaactttctctccatcaaagggtatagagtctccccctccgaagctcaactttccacctccatagtaacttacctaggagttcaactttcccctgggacccgggctatgacccctgccctagcagcactaatagataatctgccctcgccctcctccaaaagcgaagttctttccttcctagaactagcaggcttttttagaatatggattcccaactttgccctcctagctcacccactctatgaagcagccaaaggccctctcagtgagcctctaaatccctcacgtaacatactccccaacttctgcaaacttcaaaccgctcttgtcactgcaccagctct

SEQ ID NO: 329606 - DNA, 3989 bp, Homo sapiens
gacggccgcccgggcaggtcggtgtgaggagctgtgaaattagttgtaactgaaaatgtctgacggtctggataatgaagagaaacccccggctcctccactgaggatgaatagtacaccgggattcttcagcactcaaccacagctcctaccacttcccatggcccctgaagagaagaataagaaagccaggcttcgctctatcttcccaggaggaggggataaaaccaataagaagaaggagaaagagcgcccagagatctctcttccttcagactttgagcatacgattcatgtggggtttgatgcagtcaccggggaattcactggaattccagagcaatgggcacgattactccaaacttccaacataacaaaattggaacagaagaagaacccacaagctgttctagatgttctcaaattctatgattccaaagaaacagtcaacaaccagaaatacatgagctttacatcaggagataaaagtgcacatggatacatagcagcccatccttcgagtacaaaaacagcatctgagcctccattggcccctcctgtgtctgaagaagaagatgaagaggaagaagaagaagatgaaaatgagccaccaccagttatcgcaccaagaccagagcatacaaaatcaatctatactcgttctgtggttgaatccattgcttcaccagcagtaccaaataaagaggtcacaccaccctctgctgaaaatgccaattccagtactttgtacagaaacacagatcggcaaagaaaaaaatccaagatgacagatgaggagatcttagagaagctaagaagcatagtgagtgttgggcgatcctaagaagaaatatacacggtttgagaagattggacaaggtgcttcaggcaccgtgtacacagcaatggatgtggccacaggacaggaggtggccattaagcagatgaatcttcagcagcagcccaagaaagagctgattattaatgagatcctggtcatgagggaaaacaagaacccaaacattgtgaattacttggacagttacctcgtgggagatgagctgtgggttgttatggaatacttggctggaggctccttgacagatgtggtgacagaaacttgcatggatgaaggccaaattgcagctgtgtgccgtgagtgtctgcaggctctggagttcttgcattcgaaccaggtcattcacagagacatcaagagtgacaatattctgttgggaatggatggctctgtcaagctaactgactttggattctgtgcacagataaccccagagcagagcaaacggagcaccatggtaggaaccccatactggatggcaccagaggttgtgacacgaaaggcctatgggcccaaggttgacatctggtccctgggcatcatggccatcgaaatgattgaaggggagcctccatacctcaatgaaaaccctctgagagccttgtacctcattgccaccaatgggaccccagaacttcagaacccagagaagctgtcagctatcttccgggactttctgaaccgctgtctcgagatggatgtggagaagagaggttcagctaaagagctgctacagattattacagcatcctttcctgaaactggccaaaccgttatctagcttgacaccactgatcatggcagctaaagaagcaatgaagagtaaccgttaacatcactgctgtggcctcatactcttttttccattttctacaagaagccttttagtatatgaaaattattactctttttggggttaaagaaatggtctgcataacctgaatggaaggagcaaatgactattctctgaagacaaccaagagaaaattgcaaaaagacaagtatgacttttatatgaaccccttctttagggtccagaaggaattgtggactgaatcactagccttaggtctttcagcaaacagcctatcagggccatttatcatgtgtgagatttgcattttactttgctgactttgttgtaatagatcccattcattgtcccctttgggtatttccaatacttgaatggcagattggagtttttcagagtatgtgtttcatctgctagtctttctctccttcatagcttttcttttcctggacttgctccttttgagttgcttttgcgtttctcatgcctaggcaagtgtaatagaaattatgtagctccttatgttggcaaaggagctctatatagtttcactttgtataaaagttaggaccagctgttgttacatgtaatattttagttcagaacttgacctgaaggaagggaagaaaagtatgtgatttttaccttttttaacaaatgtgaaaaagtcagttttagaaatttcgtggtagtaagttcggcatttgttacatgtatagagagaagactaataatctctatttataactaaatcattgagatagaaaaagattcccattgactgtagacttcttcccattttgtcttcccttctgcctgtttccccttcaggcttggctctaggaaccaaagtgatttgttgttgttccaacctgggctttgtgactttggttagtgccactaccttcttccctcctttcccccttcaatttggaaataaatttctgtatatgttgcaattttaggtttaggtttgttctttttctttttcattaatcctctctcacctcacagataccccctcccatggcaaataatataataaccagtgaattttcaggaatttaaaaattagcttttttccacttaaaggagaaaaatatttgggactagcagcagaggcagtaagagatgtgaaccttggtgagctctgatacagtgagaagagattatactcatgaaagagaatgttagtgttacagagaagcagccgatagcaaatcaactgtagagacttggcggcggtggcattgccccaggtcgtcagcagtgtggtattatctatgagaacttgagcgacagagtatttcttgatgaatttatagatcatttgagatgttgagttactttagtttagttttgttttgttttttcaaataagtagagactattgtaaaaaacgagaaaggaaaatgaaatgtgcgtgttgatagcaataatttgtttcttttaaagattctaaaaggtctgagacctgtagcattaattatttgagtgccctcccttctcccctcccctcccttttctcttctcttttttcctctcctctccttctcctttattcattgttttgcttttggagtaggtgttgttcaagtatctgtggtttggttctggcattttgttcccaccatccccttcccccattaacttcccccctgcttgccatcctgcagtagtataaatcatgaataaaaaataattttgctgttgtagtatacattggagaaactggcaggttttatttccattattttatttccactatatctatgataagatgcaattataaggagagaagtgactgttttttattgataaggcaagattttcagaaaaatgagtaaaataattaatgaaacatatttagagcacttaatggtctctgttttcaatataattcttgatttcatttttctctgggaatatattggccttctacagctattactgaattatagaaactggtttatttctggcagaaagctgcagtgccacctgagttccaaattttaccattctttgtaaacagttggatggattatgataaagaagatgctaccaatgaaatagaaaaccaacgagatgagaagactgtgatcctcatgtactcagaggcacttccctcctaagtcaaagaccatcctcactgactatgtgccaacgcctcgtttcaggcttgtgactcaacaaagggcttttccattgatagaagcagtttgggatttgtagttgcgacttcttcgatagttacctgcacgtccattgctggcaactgacttgtcattaaaacctggctctttggttaaggaaaaa

SEQ ID NO: 329607 - DNA, 643 bp, Homo sapiens
ttttacccacacccctgatgtctcttctgtatggaaaatgcaatcagtgatgaagggccgaaaaaacatcttgccagctgtagctcttttacagagcacaaagtgggaggaagcaatgaatataaatgtgttgggcgataacatctatgttatccccaacaccagtgattgctccacgcccagagcacacaaaatctgtatacacacggtctgtgattgaaccacttcctgtcactccaactcgggacgtggctacatctcccatttcacctactgaaaataacaccactccaccagatgctttgacccggaatactgagaagcagaagaagaagcctaaaatgtctgatgaggagatcttggagaaattacgaagcatagtgagtgttgggcgataacatcgtgatgttatccccaacactacatacagcaaattttggtatttttaatagcgatggggtttcaccatgttggccaggatggtctcgaactcctgatctcaagtgatccgcccacctcagcctcccaaaatgtttggattacaggcatgagccaccacccctggcctggaccctctttttgacatgtgtgagcataggcagcaagcaaggccgtgcagagaaggggtgcttccagactgccc

SEQ ID NO: 329608 - DNA, 547 bp, Homo sapiens
caggatcccgttatcgcccaacacattttctggtgatacccaagaaacatatatcccagatttctgtggcagaagatgatgatgaaagtcttcttggacacttaatgattgtggcaagaaatgtgctgctgatctgggcctgaataagggttatcgaatggtggtgaatgaaggttcagatggtggacagtctgtctatcacgttcatctccatgttcttggaggtcggcaaatgcattggcctcctggctaagcacgtgttggggataacatcacatgttatccccaacaccagtgattgctccacgcccagagcacacaaaatctgtatacacacggtctgtgattgaaccacttcctgtcactccaactcgggacgtggctacatctcccatttcacctactgaaaataacaccactccaccagatgctttgacccggaatactgagaagcagaagaagaagcctaaaatgtctgatgaggagatcttggagaaattacgaagcatagtgagtgttgggcgataacatcacgaatcctctaagc

SEQ ID NO: 329609 - DNA, 3298 bp, Homo sapiens
gccacgaaggccacagacgccttcccccttggactctcattcccttttccacggagccccgcgctttcgtgagccccctcgaggaacctggtctccgcatccagttaccacctcctgcctcagaggccatctgagcccttcgcacctcgcccctcagtccccccttgcccccccgcggagatcgcctcgctccctcccgcccccccatcatcccttccctcgcagttcccctgtcctgaggggagccccgccacggcagcgacagcgggcaggagggagaaagtgaaggttgggcgacacttggccctcactcccggctaggcggcacccaccgccgggaggaggaggaggagccgagaggagctgagcgagcgcggaagtagctgctgctggtggtgacaatgtcaaataacggcctagacattcaagacaaacccccagcccctccgatgagaaataccagcactatgattggagccggcagcaaagatgctggaaccctaaaccatggttctaaacctctgcctccaaacccagaggagaagaaaaagaaggaccgattttaccgatccattttacctggagataaaacaaataaaaagaaagagaaagagcggccagagatttctctcccttcagattttgaacacacaattcatgtcggttttgatgctgtcacaggggagtttacgggaatgccagagcagtgggcccgcttgcttcagacatcaaatatcactaagtcggagcagaagaaaaacccgcaggctgttctggatgtgttggagttttacaactcgaagaagacatccaacagccagaaatacatgagctttacagataagtcagctgaggattacaattcttctaatgccttgaatgtgaaggctgtgtctgagactcctgcagtgccaccagtttcagaagatgaggatgatgatgatgatgatgttatccccaacaccagtgattgctccacgcccagagcacacaaaatctgtatacacacggtctgtgattgaaccacttcctgtcactccaactcgggacgtggctacatctcccatttcacctactgaaaataacaccactccaccagatgctttgacccggaatactgagaagcagaagaagaagcctaaaatgtctgatgaggagatcttggagaaattacgaagcatagtgagtgttgggcgatcctaagaagaaatatacacggtttgagaagattggacaaggtgcttcaggcaccgtgtacacagcaatggatgtggccacaggacaggaggtggccattaagcagatgaatcttcagcagcagcccaagaaagagctgattattaatgagatcctggtcatgagggaaaacaagaacccaaacattgtgaattacttggacagttacctcgtgggagatgagctgtgggttgttatggaatacttggctggaggctccttgacagatgtggtgacagaaacttgcatggatgaaggccaaattgcagctgtgtgccgtgagtgtctgcaggctctggagttcttgcattcgaaccaggtcattcacagagacatcaagagtgacaatattctgttgggaatggatggctctgtcaagctaactgactttggattctgtgcacagataaccccagagcagagcaaacggagcaccatggtaggaaccccatactggatggcaccagaggttgtgacacgaaaggcctatgggcccaaggttgacatctggtccctgggcatcatggccatcgaaatgattgaaggggagcctccatacctcaatgaaaaccctctgagagccttgtacctcattgccaccaatgggaccccagaacttcagaacccagagaagctgtcagctatcttccgggactttctgaaccgctgtctcgagatggatgtggagaagagaggttcagctaaagagctgctacagcatcaattcctgaagattgccaagcccctctccagcctcactccactgattgctgcagctaaggaggcaacaaagaacaatcactaaaaccacactcaccccagcctcattgtgccaagccttctgtgagataaatgcacatttcagaaattccaactcctgatgccctcttctccttgccttgcttctcccatttcctgatctagcactcctcaagactttgatccttggaaaccgtgtgtccagcattgaagagaactgcaactgaatgactaatcagatgatggccatttctaaataaggaatttcctcccaattcatggatatgagggtggtttatgattaagggtttatataaataaatgtttctagtcttccgtgtgtcaaaatcctcacctccttcataaccatctcccacaattaattcttgactatataaatttatggtttgataatattatcaatttgtaatcaattgagatttctttagtgcttgcttttctgtgactcaactgcccagacacctcattgtacttgaaaactggaacagcttgggaatgccatggggtttgataatctgccagggacatgaagaggctcagcttcctggaccatgactttggctcagctgatcctgacatgggagaacaaccacatttttctttgtgtgtgcttctagcagctgttcgggaggaccttgacccaatagtgttcccatgctgtttcttgtgaaatgctctcggctatgtagcagcttttgattccctgcataccctaggctgctgcccctatcctgtcccttgtttataacattgagaggttttctagggcacatactgagtgagagcagtgttgagaagtcggggaaaatggtgactacttttagagcaaggctgggcatcagcacctgtccagctctacttgtgtgatgtttcaggaactcagcccctttttctgcctaggataaggagctgaaagattaacttggatcttctaatggtccaaatcttttggtcacaataaagagtctccaaattagagactgcatgttagttctggatggatttggtggcctgacatgataccctgccagctgtgaggggaccccgtttttaagatgcatggccaagctctctgcaaatggaaatgcttacactgggtgttggggatgtttgctacctcctgctatttttgtggttttggttctcccactatggtaggacccctggccagcattgtggcttgtcatgtcagccccattgactaccttctcatgctctgaggtactactgcctctgcagcacaaatttctatttctgtcaataaaaggagatgaaaatattc

SEQ ID NO: 329610 - DNA, 3227 bp, Homo sapiens
gcgagagcgcgagcgtgctgcacctcgggagctggcggctgagctgccaggagcccagcccagctgaatcgagcggagccggtggagcaggggccttgtgggtacccggttgggcagggagaggtgcggctctgcgacggaaacaatcgccagagatgccggggctagccttccccaccaggttggtggcgatacaaaaattgaaactggcctcagttgttgctctcaaatgcagatcaaggaatgtggacgctcatgtgtagctgctgctggtggtgacaatgtcaaataacggcctagacattcaagacaaacccccagcccctccgatgagaaataccagcactatgattggagccggcagcaaagatgctggaaccctaaaccatggttctaaacctctgcctccaaacccagaggagaagaaaaagaaggaccgattttaccgatccattttacctggagataaaacaaataaaaagaaagagaaagagcggccagagatttctctcccttcagattttgaacacacaattcatgtcggttttgatgctgtcacaggggagtttacgggaatgccagagcagtgggcccgcttgcttcagacatcaaatatcactaagtcggagcagaagaaaaacccgcaggctgttctggatgtgttggagttttacaactcgaagaagacatccaacagccagaaatacatgagctttacagataagtcagctgaggattacaattcttctaatgccttgaatgtgaaggctgtgtctgagactcctgcagtgccaccagtttcagaagatgaggatgatgatgatgatgatgttatccccaacaccagtgattgctccacgcccagagcacacaaaatctgtatacacacggtctgtgattgaaccacttcctgtcactccaactcgggacgtggctacatctcccatttcacctactgaaaataacaccactccaccagatgctttgacccggaatactgagaagcagaagaagaagcctaaaatgtctgatgaggagatcttggagaaattacgaagcatagtgagtgttgggcgatcctaagaagaaatatacacggtttgagaagattggacaaggtgcttcaggcaccgtgtacacagcaatggatgtggccacaggacaggaggtggccattaagcagatgaatcttcagcagcagcccaagaaagagctgattattaatgagatcctggtcatgagggaaaacaagaacccaaacattgtgaattacttggacagttacctcgtgggagatgagctgtgggttgttatggaatacttggctggaggctccttgacagatgtggtgacagaaacttgcatggatgaaggccaaattgcagctgtgtgccgtgagtgtctgcaggctctggagttcttgcattcgaaccaggtcattcacagagacatcaagagtgacaatattctgttgggaatggatggctctgtcaagctaactgactttggattctgtgcacagataaccccagagcagagcaaacggagcaccatggtaggaaccccatactggatggcaccagaggttgtgacacgaaaggcctatgggcccaaggttgacatctggtccctgggcatcatggccatcgaaatgattgaaggggagcctccatacctcaatgaaaaccctctgagagccttgtacctcattgccaccaatgggaccccagaacttcagaacccagagaagctgtcagctatcttccgggactttctgaaccgctgtctcgagatggatgtggagaagagaggttcagctaaagagctgctacaggtgagaaaactgaggtttcaagtgtttagtaacttttccatgatagctgcatcaattcctgaagattgccaagcccctctccagcctcactccactgattgctgcagctaaggaggcaacaaagaacaatcactaaaaccacactcaccccagcctcattgtgccaagccttctgtgagataaatgcacatttcagaaattccaactcctgatgccctcttctccttgccttgcttctcccatttcctgatctagcactcctcaagactttgatccttggaaaccgtgtgtccagcattgaagagaactgcaactgaatgactaatcagatgatggccatttctaaataaggaatttcctcccaattcatggatatgagggtggtttatgattaagggtttatataaataaatgtttctagtcttccgtgtgtcaaaatcctcacctccttcataaccatctcccacaattaattcttgactatataaatttatggtttgataatattatcaatttgtaatcaattgagatttctttagtgcttgcttttctgtgactcaactgcccagacacctcattgtacttgaaaactggaacagcttgggaatgccatggggtttgataatctgccagggacatgaagaggctcagcttcctggaccatgactttggctcagctgatcctgacatgggagaacaaccacatttttctttgtgtgtgcttctagcagctgttcgggaggaccttgacccaatagtgttcccatgctgtttcttgtgaaatgctctcggctatgtagcagcttttgattccctgcataccctaggctgctgcccctatcctgtcccttgtttataacattgagaggttttctagggcacatactgagtgagagcagtgttgagaagtcggggaaaatggtgactacttttagagcaaggctgggcatcagcacctgtccagctctacttgtgtgatgtttcaggaactcagcccctttttctgcctaggataaggagctgaaagattaacttggatcttctaatggtccaaatcttttggtcacaataaagagtctccaaattagagactgcatgttagttctggatggatttggtggcctgacatgataccctgccagctgtgaggggaccccgtttttaagatgcatggccaagctctctgcaaatggaaatgcttacactgggtgttggggatgtttgctacctcctgctatttttgtggttttggttctcccactatggtaggacccctggccagcattgtggcttgtcatgtcagccccattgactaccttctcatgctctgaggtactactgcctctgcagcacaaatttctatttctgtcaataaaaggagatgaaaatattc

SEQ ID NO: 329611 - DNA, 3098 bp, Homo sapiens
atggatagaatggtgctatctgagctgttataatgttggcctcatgcctagctttatattgcagcacgtctgaggcattggtttttcatccttccaaacttttggtctacagagactattagaagattaagtagctgctgctggtggtgacaatgtcaaataacggcctagacattcaagacaaacccccagcccctccgatgagaaataccagcactatgattggagccggcagcaaagatgctggaaccctaaaccatggttctaaacctctgcctccaaacccagaggagaagaaaaagaaggaccgattttaccgatccattttacctggagataaaacaaataaaaagaaagagaaagagcggccagagatttctctcccttcagattttgaacacacaattcatgtcggttttgatgctgtcacaggggagtttacgggaatgccagagcagtgggcccgcttgcttcagacatcaaatatcactaagtcggagcagaagaaaaacccgcaggctgttctggatgtgttggagttttacaactcgaagaagacatccaacagccagaaatacatgagctttacagataagtcagctgaggattacaattcttctaatgccttgaatgtgaaggctgtgtctgagactcctgcagtgccaccagtttcagaagatgaggatgatgatgatgatgatgttatccccaacaccagtgattgctccacgcccagagcacacaaaatctgtatacacacggtctgtgattgaaccacttcctgtcactccaactcgggacgtggctacatctcccatttcacctactgaaaataacaccactccaccagatgctttgacccggaatactgagaagcagaagaagaagcctaaaatgtctgatgaggagatcttggagaaattacgaagcatagtgagtgttgggcgatcctaagaagaaatatacacggtttgagaagattggacaaggtgcttcaggcaccgtgtacacagcaatggatgtggccacaggacaggaggtggccattaagcagatgaatcttcagcagcagcccaagaaagagctgattattaatgagatcctggtcatgagggaaaacaagaacccaaacattgtgaattacttggacagttacctcgtgggagatgagctgtgggttgttatggaatacttggctggaggctccttgacagatgtggtgacagaaacttgcatggatgaaggccaaattgcagctgtgtgccgtgagtgtctgcaggctctggagttcttgcattcgaaccaggtcattcacagagacatcaagagtgacaatattctgttgggaatggatggctctgtcaagctaactgactttggattctgtgcacagataaccccagagcagagcaaacggagcaccatggtaggaaccccatactggatggcaccagaggttgtgacacgaaaggcctatgggcccaaggttgacatctggtccctgggcatcatggccatcgaaatgattgaaggggagcctccatacctcaatgaaaaccctctgagagccttgtacctcattgccaccaatgggaccccagaacttcagaacccagagaagctgtcagctatcttccgggactttctgaaccgctgtctcgagatggatgtggagaagagaggttcagctaaagagctgctacaggtgagaaaactgaggtttcaagtgtttagtaacttttccatgatagctgcatcaattcctgaagattgccaagcccctctccagcctcactccactgattgctgcagctaaggaggcaacaaagaacaatcactaaaaccacactcaccccagcctcattgtgccaagccttctgtgagataaatgcacatttcagaaattccaactcctgatgccctcttctccttgccttgcttctcccatttcctgatctagcactcctcaagactttgatccttggaaaccgtgtgtccagcattgaagagaactgcaactgaatgactaatcagatgatggccatttctaaataaggaatttcctcccaattcatggatatgagggtggtttatgattaagggtttatataaataaatgtttctagtcttccgtgtgtcaaaatcctcacctccttcataaccatctcccacaattaattcttgactatataaatttatggtttgataatattatcaatttgtaatcaattgagatttctttagtgcttgcttttctgtgactcaactgcccagacacctcattgtacttgaaaactggaacagcttgggaatgccatggggtttgataatctgccagggacatgaagaggctcagcttcctggaccatgactttggctcagctgatcctgacatgggagaacaaccacatttttctttgtgtgtgcttctagcagctgttcgggaggaccttgacccaatagtgttcccatgctgtttcttgtgaaatgctctcggctatgtagcagcttttgattccctgcataccctaggctgctgcccctatcctgtcccttgtttataacattgagaggttttctagggcacatactgagtgagagcagtgttgagaagtcggggaaaatggtgactacttttagagcaaggctgggcatcagcacctgtccagctctacttgtgtgatgtttcaggaactcagcccctttttctgcctaggataaggagctgaaagattaacttggatcttctaatggtccaaatcttttggtcacaataaagagtctccaaattagagactgcatgttagttctggatggatttggtggcctgacatgataccctgccagctgtgaggggaccccgtttttaagatgcatggccaagctctctgcaaatggaaatgcttacactgggtgttggggatgtttgctacctcctgctatttttgtggttttggttctcccactatggtaggacccctggccagcattgtggcttgtcatgtcagccccattgactaccttctcatgctctgaggtactactgcctctgcagcacaaatttctatttctgtcaataaaaggagatgaaaatattc

SEQ ID NO: 329612 - DNA, 3279 bp, Homo sapiens
gccacgaaggccacagacgccttcccccttggactctcattcccttttccacggagccccgcgctttcgtgagccccctcgaggaacctggtctccgcatccagttaccacctcctgcctcagaggccatctgagcccttcgcacctcgcccctcagtccccccttgcccccccgcggagatcgcctcgctccctcccgcccccccatcatcccttccctcgcagttcccctgtcctgaggggagccccgccacggcagcgacagcgggcaggagggagaaagtgaaggttgggcgacacttggccctcactcccggctaggcggcacccaccgccgggaggaggaggaggagccgagaggagctgagcgagcgcggaagtagctgctgctggtggtgacaatgtcaaataacggcctagacattcaagacaaacccccagcccctccgatgagaaataccagcactatgattggagccggcagcaaagatgctggaaccctaaaccatggttctaaacctctgcctccaaacccagaggagaagaaaaagaaggaccgattttaccgatccattttacctggagataaaacaaataaaaagaaagagaaagagcggccagagatttctctcccttcagattttgaacacacaattcatgtcggttttgatgctgtcacaggggagtttacgggaatgccagagcagtgggcccgcttgcttcagacatcaaatatcactaagtcggagcagaagaaaaacccgcaggctgttctggatgtgttggagttttacaactcgaagaagacatccaacagccagataagtcagctgaggattacaattcttctaatgccttgaatgtgaaggctgtgtctgagactcctgcagtgccaccagtttcagaagatgaggatgatgatgatgatgatgttatccccaacaccagtgattgctccacgcccagagcacacaaaatctgtatacacacggtctgtgattgaaccacttcctgtcactccaactcgggacgtggctacatctcccatttcacctactgaaaataacaccactccaccagatgctttgacccggaatactgagaagcagaagaagaagcctaaaatgtctgatgaggagatcttggagaaattacgaagcatagtgagtgttgggcgatcctaagaagaaatatacacggtttgagaagattggacaaggtgcttcaggcaccgtgtacacagcaatggatgtggccacaggacaggaggtggccattaagcagatgaatcttcagcagcagcccaagaaagagctgattattaatgagatcctggtcatgagggaaaacaagaacccaaacattgtgaattacttggacagttacctcgtgggagatgagctgtgggttgttatggaatacttggctggaggctccttgacagatgtggtgacagaaacttgcatggatgaaggccaaattgcagctgtgtgccgtgagtgtctgcaggctctggagttcttgcattcgaaccaggtcattcacagagacatcaagagtgacaatattctgttgggaatggatggctctgtcaagctaactgactttggattctgtgcacagataaccccagagcagagcaaacggagcaccatggtaggaaccccatactggatggcaccagaggttgtgacacgaaaggcctatgggcccaaggttgacatctggtccctgggcatcatggccatcgaaatgattgaaggggagcctccatacctcaatgaaaaccctctgagagccttgtacctcattgccaccaatgggaccccagaacttcagaacccagagaagctgtcagctatcttccgggactttctgaaccgctgtctcgagatggatgtggagaagagaggttcagctaaagagctgctacagcatcaattcctgaagattgccaagcccctctccagcctcactccactgattgctgcagctaaggaggcaacaaagaacaatcactaaaaccacactcaccccagcctcattgtgccaagccttctgtgagataaatgcacatttcagaaattccaactcctgatgccctcttctccttgccttgcttctcccatttcctgatctagcactcctcaagactttgatccttggaaaccgtgtgtccagcattgaagagaactgcaactgaatgactaatcagatgatggccatttctaaataaggaatttcctcccaattcatggatatgagggtggtttatgattaagggtttatataaataaatgtttctagtcttccgtgtgtcaaaatcctcacctccttcataaccatctcccacaattaattcttgactatataaatttatggtttgataatattatcaatttgtaatcaattgagatttctttagtgcttgcttttctgtgactcaactgcccagacacctcattgtacttgaaaactggaacagcttgggaatgccatggggtttgataatctgccagggacatgaagaggctcagcttcctggaccatgactttggctcagctgatcctgacatgggagaacaaccacatttttctttgtgtgtgcttctagcagctgttcgggaggaccttgacccaatagtgttcccatgctgtttcttgtgaaatgctctcggctatgtagcagcttttgattccctgcataccctaggctgctgcccctatcctgtcccttgtttataacattgagaggttttctagggcacatactgagtgagagcagtgttgagaagtcggggaaaatggtgactacttttagagcaaggctgggcatcagcacctgtccagctctacttgtgtgatgtttcaggaactcagcccctttttctgcctaggataaggagctgaaagattaacttggatcttctaatggtccaaatcttttggtcacaataaagagtctccaaattagagactgcatgttagttctggatggatttggtggcctgacatgataccctgccagctgtgaggggaccccgtttttaagatgcatggccaagctctctgcaaatggaaatgcttacactgggtgttggggatgtttgctacctcctgctatttttgtggttttggttctcccactatggtaggacccctggccagcattgtggcttgtcatgtcagccccattgactaccttctcatgctctgaggtactactgcctctgcagcacaaatttctatttctgtcaataaaaggagatgaaaatattc

SEQ ID NO: 329613 - DNA, 3448 bp, Homo sapiens
  misc_feature (3312)..(3312): n is a, c, g, or t
gccacgaaggccacagacgccttcccccttggactctcattcccttttccacggagccccgcgctttcgtgagccccctcgaggaacctggtctccgcatccagttaccacctcctgcctcagaggccatctgagcccttcgcacctcgcccctcagtccccccttgcccccccgcggagatcgcctcgctccctcccgcccccccatcatcccttccctcgcagttcccctgtcctgaggggagccccgccacggcagcgacagcgggcaggagggagaaagtgaaggttgggcgacacttggccctcactcccggctaggcggcacccaccgccgggaggaggaggaggagccgagaggagctgagcgagcgcggaagtagctgctgctggtggtgacaatgtcaaataacggcctagacattcaagacaaacccccagcccctccgatgagaaataccagcactatgattggagccggcagcaaagatgctggaaccctaaaccatggttctaaacctctgcctccaaacccagaggagaagaaaaagaaggaccgattttaccgatccattttacctggagataaaacaaataaaaagaaagagaaagagcggccagagatttctctcccttcagattttgaacacacaattcatgtcggttttgatgctgtcacaggggagtttacgggaatgccagagcagtgggcccgcttgcttcagacatcaaatatcactaagtcggagcagaagaaaaacccgcaggctgttctggatgtgttggagttttacaactcgaagaagacatccaacagccagaaatacatgagctttacagataagtcagctgaggattacaattcttctaatgccttgaatgtgaaggctgtgtctgagactcctgcagtgccaccagtttcagaagatgaggatgatgatgatgatgatgttatccccaacaccagtgattgctccacgcccagagcacacaaaatctgtatacacacggtctgtgattgaaccacttcctgtcactccaactcgggacgtggctacatctcccatttcacctactgaaaataacaccactccaccagatgctttgacccggaatactgagaagcagaagaagaagcctaaaatgtctgatgaggagatcttggagaaattacgaagcatagtgagtgttgggcgatcctaagaagaaatatacacggtttgagaagattggacaaggtgcttcaggcaccgtgtacacagcaatggatgtggccacaggacaggaggtggccattaagcagatgaatcttcagcagcagcccaagaaagagctgattattaatgagatcctggtcatgagggaaaacaagaacccaaacattgtgaattacttggacagttacctcgtgggagatgagctgtgggttgttatggaatacttggctggaggctccttgacagatgtggtgacagaaacttgcatggatgaaggccaaattgcagctgtgtgccgtgagtgtctgcaggctctggagttcttgcattcgaaccaggtcattcacagagacatcaagagtgacaatattctgttgggaatggatggctctgtcaagctaactgactttggattctgtgcacagataaccccagagcagagcaaacggagcaccatggtaggaaccccatactggatggcaccagaggttgtgacacgaaaggcctatgggcccaaggttgacatctggtccctgggcatcatggccatcgaaatgattgaaggggagcctccatacctcaatgaaaaccctctgagagccttgtacctcattgccaccaatgggaccccagaacttcagaacccagagaagctgtcagctatcttccgggactttctgaaccgctgtctcgagatggatgtggagaagagaggttcagctaaagagctgctacagcatcaattcctgaagattgccaagcccctctccagcctcactccactgattgctgcagctaaggaggcaacaaagaacaatcactaaaaccacactcaccccagcctcattgtgccaagccttctgtgagataaatgcacatttcagaaattccaactcctgatgccctcttctccttgccttgcttctcccatttcctgatctagcactcctcaagactttgatccttggaaaccgtgtgtccagcattgaagagaactgcaactgaatgactaatcagatgatggccatttctaaataaggaatttcctcccaattcatggatatgagggtggtttatgattaagggtttatataaataaatgtttctagtcttccgtgtgtcaaaatcctcacctccttcataaccatctcccacaattaattcttgactatataaatttatggtttgataatattatcaatttgtaatcaattgagatttctttagtgcttgcttttctgtgactcaactgcccagacacctcattgtacttgaaaactggaacagcttgggaatgccatggggtttgataatctgccagggacatgaagaggctcagcttcctggaccatgactttggctcagctgatcctgacatgggagaacaaccacatttttctttgtgtgtgcttctagcagctgttcgggaggaccttgacccaatagtgttcccatgctgtttcttgtgaaatgctctcggctatgtagcagcttttgattccctgcataccctaggctgctgcccctatcctgtcccttgtttataacattgagaggttttctagggcacatactgagtgagagcagtgttgagaagtcggggaaaatggtgactacttttagagcaaggctgggcatcagcacctgtccagctctacttgtgtgatgtttcaggaactcagcccctttttctgcctaggataaggagctgaaagattaacttggatcttctaatggtccaaatcttttggtcacaataaagagtctccaaattagagactgcatgttagttctggatggatttggtggcctgacatgataccctgccagctgtgaggggaccccgtttttaagatgcatggccaagctctctgcaaatggaaatgcttacactgggtgttggggatgtttgctacctcctgctatttttgtggttttggttctcccactatggtaggacccctggccagcattgtggcttgtcatgtcagccccattgactaccttctcatgctctgaggtactactgcctctgcagcacaaatttctatttctgtcaataaaaggagatgaaaatattcaaaaaaaaaaaaanaaaaaaaaaaaaaaaactcgagactagttctctctctccgagatggatgtggagaagagaggttcagctaaagagctgctacagcatcaattcctgaagattgccaagcccctctccagcctcactccactgattg

SEQ ID NO: 329614 - DNA, 3639 bp, Homo sapiens
gccacgaaggccacagacgccttcccccttggactctcattcccttttccacggagccccgcgctttcgtgagccccctcgaggaacctggtctccgcatccagttaccacctcctgcctcagaggccatctgagcccttcgcacctcgcccctcagtccccccttgcccccccgcggagatcgcctcgctccctcccgcccccccatcatcccttccctcgcagttcccctgtcctgaggggagccccgccacggcagcgacagcgggcaggagggagaaagtgaaggttgggcgacacttggccctcactcccggctaggcggcacccaccgccgggaggaggaggaggagccgagaggagctgagcgagcgcggaagtagctgctgctggtggtgacaatgtcaaataacggcctagacattcaagacaaacccccagcccctccgatgagaaataccagcactatgattggagccggcagcaaagatgctggaaccctaaaccatggttctaaacctctgcctccaaacccagaggagaagaaaaagaaggaccgattttaccgatccattttacctggagataaaacaaataaaaagaaagagaaagagcggccagagatttctctcccttcagattttgaacacacaattcatgtcggttttgatgctgtcacaggggagtttacgggaatgccagagcagtgggcccgcttgcttcagacatcaaatatcactaagtcggagcagaagaaaaacccgcaggctgttctggatgtgttggagttttacaactcgaagaagacatccaacagccagaaatacatgagctttacagataagtcagctgaggattacaattcttctaatgccttgaatgtgaaggctgtgtctgagactcctgcagtgccaccagtttcagaagatgaggatgatgatgatgatgatgttatccccaacaccagtgattgctccacgcccagagcacacaaaatctgtatacacacggtctgtgattgaaccacttcctgtcactccaactcgggacgtggctacatctcccatttcacctactgaaaataacaccactccaccagatgctttgacccggaatactgagaagcagaagaagaagcctaaaatgtctgatgaggagatcttggagaaattacgaagcatagtgagtgttgggcgatcctaagaagaaatatacacggtttgagaagattggacaaggtgcttcaggcaccgtgtacacagcaatggatgtggccacaggacaggaggtggccattaagcagatgaatcttcagcagcagcccaagaaagagctgattattaatgagatcctggtcatgagggaaaacaagaacccaaacattgtgaattacttggacagttacctcgtgggagatgagctgtgggttgttatggaatacttggctggaggctccttgacagatgtggtgacagaaacttgcatggatgaaggccaaattgcagctgtgtgccgtgagtgtctgcaggctctggagttcttgcattcgaaccaggtcattcacagagacatcaagagtgacaatattctgttgggaatggatggctctgtcaagctaactgactttggattctgtgcacagataaccccagagcagagcaaacggagcaccatggtaggaaccccatactggatggcaccagaggttgtgacacgaaaggcctatgggcccaaggttgacatctggtccctgggcatcatggccatcgaaatgattgaaggggagcctccatacctcaatgaaaaccctctgagagccttgtacctcattgccaccaatgggaccccagaacttcagaacccagagaagctgtcagctatcttccgggactttctgaaccgctgtctcgagatggatgtggagaagagaggttcagctaaagagctgctacagcatcaattcctgaagattgccaagcccctctccagcctcactccactgattgctgcagctaaggaggcaacaaagaacaatcactaaaaccacactcaccccagcctcattgtgccaagccttctgtgagataaatgcacatttcagaaattccaactcctgatgccctcttctccttgccttgcttctcccatttcctgatctagcactcctcaagactttgatccttggaaaccgtgtgtccagcattgaagagaactgcaactgaatgactaatcagatgatggccatttctaaataaggaatttcctcccaattcatggatatgagggtggtttatgattaagggtttatataaataaatgtttctagtcttccgtgtgtcaaaatcctcacctccttcataaccatctcccacaattaattcttgactatataaatttatggtttgataatattatcaatttgtaatcaattgagatttctttagtgcttgcttttctgtgactcaactgcccagacacctcattgtacttgaaaactggaacagcttgggaatgccatggggtttgataatctgccagggacatgaagaggctcagcttcctggaccatgactttggctcagctgatcctgacatgggagaacaaccacatttttctttgtgtgtgcttctagcagctgttcgggaggaccttgacccaatagtgttcccatgctgtttcttgtgaaatgctctcggctatgtagcagcttttgattccctgcataccctaggctgctgcccctatcctgtcccttgtttataacattgagaggttttctagggcacatactgagtgagagcagtgttgagaagtcggggaaaatggtgactacttttagagcaaggctgggcatcagcacctgtccagctctacttgtgtgatgtttcaggaactcagcccctttttctgcctaggataaggagctgaaagattaacttggatcttctaatggtccaaatcttttggtcacaataaagagtctccaaattagagactgcatgttagttctggatggattttggttctcccactatggtaggacccctggccagcattgtggcttgtcatgtcagccccattgactaccttctcatgctctgaggtactactgcctctgcagcacaaatttctatttctgtcaataaaaggagatgaaaatattctattggagtatgcctttcttttttctcttcgttttttctttccttttctaattttttatatgaaataatgagtagtttcttcctgaaccatttgagagtggtaagttgcagatagaatgcccctttaccactatatacctgaatgtgtattctttctttttaacacttttattttaaatataaattaagagaaatgggccaaaaccatttgtattgtttaaagaataattataaacacacttgtatccaccaaatcaagaaatggaacactgacagtaagaaccttctctatcttgtccttcctttctcattatagcccccacctaagaggtaaccaccatcttgacttttatttaaataactttcttgcttttctgtatactttcatcacattcaggtgtgttccaatacaagtagattttagttcggccagtttttgaactttaaataaacatatcataatagataaaaact

SEQ ID NO: 329615 - DNA, 3165 bp, Homo sapiens
gccacgaaggccacagacgccttcccccttggactctcattcccttttccacggagccccgcgctttcgtgagccccctcgaggaacctggtctccgcatccagttaccacctcctgcctcagaggccatctgagcccttcgcacctcgcccctcagtccccccttgcccccccgcggagatcgcctcgctccctcccgcccccccatcatcccttccctcgcagttcccctgtcctgaggggagccccgccacggcagcgacagcgggcaggagggagaaagtgaaggttgggcgacacttggccctcactcccggctaggcggcacccaccgccgggaggaggaggaggagccgagaggagctgagcgagcgcggaagtagctgctgctggtggtgacaatgtcaaataacggcctagacattcaagacaaacccccagcccctccgatgagaaataccagcactatgattggagccggcagcaaagatgctggaaccctaaaccatggttctaaacctctgcctccaaacccagaggagaagaaaaagaaggaccgattttaccgatccattttacctggagataaaacaaataaaaagaaagagaaagagcggccagagatttctctcccttcagattttgaacacacaattcatgtcggttttgatgctgtcacaggggagtttacgggaatgccagagcagtgggcccgcttgcttcagacatcaaatatcactaagtcggagcagaagaaaaacccgcaggctgttctggatgtgttggagttttacaactcgaagaagacatccaacagccagaaatacatgagctttacagataagtcagctgaggattacaattcttctaatgccttgaatgtgaaggctgtgtctgagactcctgcagtgccaccagtttcagaagatgaggatgatgatgatgatgatgttatccccaacaccagtgattgctccacgcccagagcacacaaaatctgtatacacacggtctgtgattgaaccacttcctgtcactccaactcgggacgtggctacatctcccatttcacctactgaaaataacaccactccaccagatgctttgacccggaatactgagaagcagaagaagaagcctaaaatgtctgatgaggagatcttggagaaattacgaagcatagtgagtgttgggcgatcctaagaagaaatatacacggtttgagaagattggacaaggtgcttcaggcaccgtgtacacagcaatggatgtggccacaggacaggaggtggccattaagcagatgaatcttcagcagcagcccaagaaagagctgattattaatgagatcctggtcatgagggaaaacaagaacccaaacattgtgaattacttggacagttacctcgtgggagatgagctgtgggttgttatggaatacttggctggaggctccttgacagatgtggtgacagaaacttgcatggatgaaggccaaattgcagctgtgtgccgtgagtgtctgcaggctctggagttcttgcattcgaaccaggtcattcacagagacatcaagagtgacaatattctgttgggaatggatggctctgtcaagctaactgactttggattctgtgcacagataaccccagagcagagcaaacggagcaccatggtaggaaccccatactggatggcaccagaggttgtgacacgaaaggcctatgggcccaaggttgacatctggtccctgggcatcatggccatcgaaatgattgaaggggagcctccatacctcaatgaaaaccctctgagagccttgtacctcattgccaccaatgggaccccagaacttcagaacccagagaagctgtcagctatcttccgggactttctgaaccgctgtctcgagatggatgtggagaagagaggttcagctaaagagctgctacagcatcaattcctgaagattgccaagcccctctccagcctcactccactgattgctgcagctaaggaggcaacaaagaacaatcactaaaaccacactcaccccagcctcattgtgccaagccttctgtgagataaatgcacatttcagaaattccaactcctgatgccctcttctccttgccttgcttctcccatttcctgatctagcactcctcaagactttgatccttggaaaccgtgtgtccagcattgaagagaactgcaactgaatgactaatcagatgatggccatttctaaataaggaatttcctcccaattcatggatatgagggtggtttatgattaagggtttatataaataaatgtttctagtcttccgtgtgtcaaaatcctcacctccttcataaccatctcccacaattaattcttgactatataaatttatggtttgataatattatcaatttgtaatcaattgagatttctttagtgcttgcttttctgtgactcaactgcccagacacctcattgtacttgaaaactggaacagcttgggaatgccatggggtttgataatctgccagggacatgaagaggctcagcttcctggaccatgactttggctcagctgatcctgacatgggagaacaaccacatttttctttgtgtgtgcttctagcagctgttcgggaggaccttgacccaatagtgttcccatgctgtttcttgtgaaatgctctcggctatgtagcagcttttgattccctgcataccctaggctgctgcccctatcctgtcccttgtttataacattgagaggttttctagggcacatactgagtgagagcagtgttgagaagtcggggaaaatggtgactacttttagagcaaggctgggcatcagcacctgtccagctctacttgtgtgatgtttcaggaactcagcccctttttctgcctaggataaggagctgaaagattaacttggatcttctaatggtccaaatcttttggtcacaataaagagtctccaaattagagactgcatgttagttctggatggattttggttctcccactatggtaggacccctggccagcattgtggcttgtcatgtcagccccattgactaccttctcatgctctgaggtactactgcctctgcagcacaaatttctatttctgtcaataaaaggagatgaaaatattc

SEQ ID NO: 329616 - DNA, 2655 bp, Homo sapiens
aaataagatatgctggcccacccccaaacacattctgaaattctccgcagggcccctttctccccacctgtcacccccccagttgaaaatcatagatctaatcttatcccttttatagatgaagagtttgaagccacaagaaattagagccacgtgccaagggtgatggaggagaggagagaagcaagcaggaacaggaaattaatatatattgagcatctgttatatgatatgcagttggctaagtactttacatgaactaatcaatttaaattatcttgtattctcttatgtccactttacaaatgaggaaagtgaagctcaaagaagttaaataactttcttaagatcctacctagtaggtactaggtagaagtaccaggttggaattcaggtctcctggccactagagcctacattctctgtactacctcttatagcttcttaaatgtgagaatggatgctgcagggagaggattatttttactgctcttgtttttgacactcacagattgtgtgtagaactgcatttgacaaatatcactttattgaacactgtgtttttttccctctttctccgccaccttactgttcagtgcttcaggcaccgtgtacacagcaatggatgtggccacaggacaggaggtggccattaagcagatgaatcttcagcagcagcccaagaaagagctgattattaatgagatcctggtcatgagggaaaacaagaacccaaacattgtgaattacttggacagttacctcgtgggagatgagctgtgggttgttatggaatacttggctggaggctccttgacagatgtggtgacagaaacttgcatggatgaaggccaaattgcagctgtgtgccgtgagtgtctgcaggctctggagttcttgcattcgaaccaggtcattcacagagacatcaagagtgacaatattctgttgggaatggatggctctgtcaagctaactgactttggattctgtgcacagataaccccagagcagagcaaacggagcaccatggtaggaaccccatactggatggcaccagaggttgtgacacgaaaggcctatgggcccaaggttgacatctggtccctgggcatcatggccatcgaaatgattgaaggggagcctccatacctcaatgaaaaccctctgagagccttgtacctcattgccaccaatgggaccccagaacttcagaacccagagaagctgtcagctatcttccgggactttctgaaccgctgtctcgagatggatgtggagaagagaggttcagctaaagagctgctacagcatcaattcctgaagattgccaagcccctctccagcctcactccactgattgctgcagctaaggaggcaacaaagaacaatcactaaaaccacactcaccccagcctcattgtgccaagccttctgtgagataaatgcacatttcagaaattccaactcctgatgccctcttctccttgccttgcttctcccatttcctgatctagcactcctcaagactttgatccttggaaaccgtgtgtccagcattgaagagaactgcaactgaatgactaatcagatgatggccatttctaaataaggaatttcctcccaattcatggatatgagggtggtttatgattaagggtttatataaataaatgtttctagtcttccgtgtgtcaaaatcctcacctccttcataaccatctcccacaattaattcttgactatataaatttatggtttgataatattatcaatttgtaatcaattgagatttctttagtgcttgcttttctgtgactcaactgcccagacacctcattgtacttgaaaactggaacagcttgggaatgccatggggtttgataatctgccagggacatgaagaggctcagcttcctggaccatgactttggctcagctgatcctgacatgggagaacaaccacatttttctttgtgtgtgcttctagcagctgttcgggaggaccttgacccaatagtgttcccatgctgtttcttgtgaaatgctctcggctatgtagcagcttttgattccctgcataccctaggctgctgcccctatcctgtcccttgtttataacattgagaggttttctagggcacatactgagtgagagcagtgttgagaagtcggggaaaatggtgactacttttagagcaaggctgggcatcagcacctgtccagctctacttgtgtgatgtttcaggaactcagcccctttttctgcctaggataaggagctgaaagattaacttggatcttctaatggtccaaatcttttggtcacaataaagagtctccaaattagagactgcatgttagttctggatggatttggtggcctgacatgataccctgccagctgtgaggggaccccgtttttaagatgcatggccaagctctctgcaaatggaaatgcttacactgggtgttggggatgtttgctacctcctgctatttttgtggttttggttctcccactatggtaggacccctggccagcattgtggcttgtcatgtcagccccattgactaccttctcatgctctgaggtactactgcctctgcagcacaaatttctatttctgtcaataaaaggagatgaaaatattc

SEQ ID NO: 329617 - DNA, 1417 bp, Homo sapiens
  misc_feature (43)..(44): n is a, c, g, or t
tcactcactatacctacgagacgacgaagaccatcccaaaaannggcgagccgtacatgcaatcccgctgagccatcaattcctgaagattgccaagcccctctccagcctcactccactgattgctgcagctaaggaggcaacaaagaacaatcactaaaaccacactcaccccagcctcattgtgccaagccttctgtgagataaatgcacatttcagaaattccaactcctgatgccctcttctccttgccttgcttctcccatttcctgatctagcactcctcaagactttgatccttggaaaccgtgtgtccagcattgaagagaactgcaactgaatgactaatcagatgatggccatttctaaataaggaatttcctcccaattcatggatatgagggtggtttatgattaagggtttatataaataaatgtttctagtcttccgtgtgtcaaaatcctcacctccttcataaccatctcccacaattaattcttgactatataaatttatggtttgataatattatcaatttgtaatcaattgagatttctttagtgcttgcttttctgtgactcaactgcccagacacctcattgtacttgaaaactggaacagcttgggaatgccatggggtttgataatctgccagggacatgaagaggctcagcttcctggaccatgactttggctcagctgatcctgacatgggagaacaaccacatttttctttgtgtgtgcttctagcagctgttcgggaggaccttgacccaatagtgttcccatgctgtttcttgtgaaatgctctcggctatgtagcagcttttgattccctgcataccctaggctgctgcccctatcctgtcccttgtttataacattgagaggttttctagggcacatactgagtgagagcagtgttgagaagtcggggaaaatggtgactacttttagagcaaggctgggcatcagcacctgtccagctctacttgtgtgatgtttcaggaactcagcccctttttctgcctaggataaggagctgaaagattaacttggatcttctaatggtccaaatcttttggtcacaataaagagtctccaaattagagactgcatgttagttctggatggatttggtggcctgacatgataccctgccagctgtgaggggaccccgtttttaagatgcatggccaagctctctgcaaatggaaatgcttacactgggtgttggggatgtttgctacctcctgctatttttgtggttttggttctcccactatggtaggacccctggccagcattgtggcttgtcatgtcagccccattgactaccttctcatgctctgaggtactactgcctctgcagcacaaatttctatttctgtcaataaaaggagatgaaaatattc

SEQ ID NO: 329618 - DNA, 1405 bp, Homo sapiens
cccgccccccacggcaccacctgcaacagtaaaattctgtccacatccacctgcctgtagccatcaattcctgaagattgccaagcccctctccagcctcactccactgattgctgcagctaaggaggcaacaaagaacaatcactaaaaccacactcaccccagcctcattgtgccaagccttctgtgagataaatgcacatttcagaaattccaactcctgatgccctcttctccttgccttgcttctcccatttcctgatctagcactcctcaagactttgatccttggaaaccgtgtgtccagcattgaagagaactgcaactgaatgactaatcagatgatggccatttctaaataaggaatttcctcccaattcatggatatgagggtggtttatgattaagggtttatataaataaatgtttctagtcttccgtgtgtcaaaatcctcacctccttcataaccatctcccacaattaattcttgactatataaatttatggtttgataatattatcaatttgtaatcaattgagatttctttagtgcttgcttttctgtgactcaactgcccagacacctcattgtacttgaaaactggaacagcttgggaatgccatggggtttgataatctgccagggacatgaagaggctcagcttcctggaccatgactttggctcagctgatcctgacatgggagaacaaccacatttttctttgtgtgtgcttctagcagctgttcgggaggaccttgacccaatagtgttcccatgctgtttcttgtgaaatgctctcggctatgtagcagcttttgattccctgcataccctaggctgctgcccctatcctgtcccttgtttataacattgagaggttttctagggcacatactgagtgagagcagtgttgagaagtcggggaaaatggtgactacttttagagcaaggctgggcatcagcacctgtccagctctacttgtgtgatgtttcaggaactcagcccctttttctgcctaggataaggagctgaaagattaacttggatcttctaatggtccaaatcttttggtcacaataaagagtctccaaattagagactgcatgttagttctggatggatttggtggcctgacatgataccctgccagctgtgaggggaccccgtttttaagatgcatggccaagctctctgcaaatggaaatgcttacactgggtgttggggatgtttgctacctcctgctatttttgtggttttggttctcccactatggtaggacccctggccagcattgtggcttgtcatgtcagccccattgactaccttctcatgctctgaggtactactgcctctgcagcacaaatttctatttctgtcaataaaaggagatgaaaatattc

SEQ ID NO: 329619 - DNA, 1410 bp, Homo sapiens
  misc_feature (33)..(33): n is a, c, g, or t
  misc_feature (51)..(51): n is a, c, g, or t
  misc_feature (63)..(63): n is a, c, g, or t
acgtcctaacagtctactcagcaagaagaaaangttcgtttgttaacctcnctgaagacctcncagcatcaattcctgaagattgccaagcccctctccagcctcactccactgattgctgcagctaaggaggcaacaaagaacaatcactaaaaccacactcaccccagcctcattgtgccaagccttctgtgagataaatgcacatttcagaaattccaactcctgatgccctcttctccttgccttgcttctcccatttcctgatctagcactcctcaagactttgatccttggaaaccgtgtgtccagcattgaagagaactgcaactgaatgactaatcagatgatggccatttctaaataaggaatttcctcccaattcatggatatgagggtggtttatgattaagggtttatataaataaatgtttctagtcttccgtgtgtcaaaatcctcacctccttcataaccatctcccacaattaattcttgactatataaatttatggtttgataatattatcaatttgtaatcaattgagatttctttagtgcttgcttttctgtgactcaactgcccagacacctcattgtacttgaaaactggaacagcttgggaatgccatggggtttgataatctgccagggacatgaagaggctcagcttcctggaccatgactttggctcagctgatcctgacatgggagaacaaccacatttttctttgtgtgtgcttctagcagctgttcgggaggaccttgacccaatagtgttcccatgctgtttcttgtgaaatgctctcggctatgtagcagcttttgattccctgcataccctaggctgctgcccctatcctgtcccttgtttataacattgagaggttttctagggcacatactgagtgagagcagtgttgagaagtcggggaaaatggtgactacttttagagcaaggctgggcatcagcacctgtccagctctacttgtgtgatgtttcaggaactcagcccctttttctgcctaggataaggagctgaaagattaacttggatcttctaatggtccaaatcttttggtcacaataaagagtctccaaattagagactgcatgttagttctggatggatttggtggcctgacatgataccctgccagctgtgaggggaccccgtttttaagatgcatggccaagctctctgcaaatggaaatgcttacactgggtgttggggatgtttgctacctcctgctatttttgtggttttggttctcccactatggtaggacccctggccagcattgtggcttgtcatgtcagccccattgactaccttctcatgctctgaggtactactgcctctgcagcacaaatttctatttctgtcaataaaaggagatgaaaatattc

SEQ ID NO: 329620 - DNA, 1424 bp, Homo sapiens
acgggcgacaacaccatagccgcccgggggtttgcaaaaaaatttgaatatctgcattgaactctctgacccatgccttgcatcaattcctgaagattgccaagcccctctccagcctcactccactgattgctgcagctaaggaggcaacaaagaacaatcactaaaaccacactcaccccagcctcattgtgccaagccttctgtgagataaatgcacatttcagaaattccaactcctgatgccctcttctccttgccttgcttctcccatttcctgatctagcactcctcaagactttgatccttggaaaccgtgtgtccagcattgaagagaactgcaactgaatgactaatcagatgatggccatttctaaataaggaatttcctcccaattcatggatatgagggtggtttatgattaagggtttatataaataaatgtttctagtcttccgtgtgtcaaaatcctcacctccttcataaccatctcccacaattaattcttgactatataaatttatggtttgataatattatcaatttgtaatcaattgagatttctttagtgcttgcttttctgtgactcaactgcccagacacctcattgtacttgaaaactggaacagcttgggaatgccatggggtttgataatctgccagggacatgaagaggctcagcttcctggaccatgactttggctcagctgatcctgacatgggagaacaaccacatttttctttgtgtgtgcttctagcagctgttcgggaggaccttgacccaatagtgttcccatgctgtttcttgtgaaatgctctcggctatgtagcagcttttgattccctgcataccctaggctgctgcccctatcctgtcccttgtttataacattgagaggttttctagggcacatactgagtgagagcagtgttgagaagtcggggaaaatggtgactacttttagagcaaggctgggcatcagcacctgtccagctctacttgtgtgatgtttcaggaactcagcccctttttctgcctaggataaggagctgaaagattaacttggatcttctaatggtccaaatcttttggtcacaataaagagtctccaaattagagactgcatgttagttctggatggatttggtggcctgacatgataccctgccagctgtgaggggaccccgtttttaagatgcatggccaagctctctgcaaatggaaatgcttacactgggtgttggggatgtttgctacctcctgctatttttgtggttttggttctcccactatggtaggacccctggccagcattgtggcttgtcatgtcagccccattgactaccttctcatgctctgaggtactactgcctctgcagcacaaatttctatttctgtcaataaaaggagatgaaaatattc

SEQ ID NO: 329621 - DNA, 1406 bp, Homo sapiens
  misc_feature (42)..(42): n is a, c, g, or t
  misc_feature (48)..(48): n is a, c, g, or t
  misc_feature (53)..(53): n is a, c, g, or t
  misc_feature (56)..(56): n is a, c, g, or t
tatctattctgccttcacaaccaacaaaagcccctctgggtnaacatncctgnaanatctttcatcaattcctgaagattgccaagcccctctccagcctcactccactgattgctgcagctaaggaggcaacaaagaacaatcactaaaaccacactcaccccagcctcattgtgccaagccttctgtgagataaatgcacatttcagaaattccaactcctgatgccctcttctccttgccttgcttctcccatttcctgatctagcactcctcaagactttgatccttggaaaccgtgtgtccagcattgaagagaactgcaactgaatgactaatcagatgatggccatttctaaataaggaatttcctcccaattcatggatatgagggtggtttatgattaagggtttatataaataaatgtttctagtcttccgtgtgtcaaaatcctcacctccttcataaccatctcccacaattaattcttgactatataaatttatggtttgataatattatcaatttgtaatcaattgagatttctttagtgcttgcttttctgtgactcaactgcccagacacctcattgtacttgaaaactggaacagcttgggaatgccatggggtttgataatctgccagggacatgaagaggctcagcttcctggaccatgactttggctcagctgatcctgacatgggagaacaaccacatttttctttgtgtgtgcttctagcagctgttcgggaggaccttgacccaatagtgttcccatgctgtttcttgtgaaatgctctcggctatgtagcagcttttgattccctgcataccctaggctgctgcccctatcctgtcccttgtttataacattgagaggttttctagggcacatactgagtgagagcagtgttgagaagtcggggaaaatggtgactacttttagagcaaggctgggcatcagcacctgtccagctctacttgtgtgatgtttcaggaactcagcccctttttctgcctaggataaggagctgaaagattaacttggatcttctaatggtccaaatcttttggtcacaataaagagtctccaaattagagactgcatgttagttctggatggatttggtggcctgacatgataccctgccagctgtgaggggaccccgtttttaagatgcatggccaagctctctgcaaatggaaatgcttacactgggtgttggggatgtttgctacctcctgctatttttgtggttttggttctcccactatggtaggacccctggccagcattgtggcttgtcatgtcagccccattgactaccttctcatgctctgaggtactactgcctctgcagcacaaatttctatttctgtcaataaaaggagatgaaaatattc

SEQ ID NO: 329622 - DNA, 1352 bp, Homo sapiens
  misc_feature (1)..(1): n is a, c, g, or t
nttctggataccgtactgtagaatgtgaagctactctcacagcacttgcttgactgtttgcgattgctaaggaggcaacaaagaacaatcactaaaaccacactcaccccagcctcattgtgccaagccttctgtgagataaatgcacatttcagaaattccaactcctgatgccctcttctccttgccttgcttctcccatttcctgatctagcactcctcaagactttgatccttggaaaccgtgtgtccagcattgaagagaactgcaactgaatgactaatcagatgatggccatttctaaataaggaatttcctcccaattcatggatatgagggtggtttatgattaagggtttatataaataaatgtttctagtcttccgtgtgtcaaaatcctcacctccttcataaccatctcccacaattaattcttgactatataaatttatggtttgataatattatcaatttgtaatcaattgagatttctttagtgcttgcttttctgtgactcaactgcccagacacctcattgtacttgaaaactggaacagcttgggaatgccatggggtttgataatctgccagggacatgaagaggctcagcttcctggaccatgactttggctcagctgatcctgacatgggagaacaaccacatttttctttgtgtgtgcttctagcagctgttcgggaggaccttgacccaatagtgttcccatgctgtttcttgtgaaatgctctcggctatgtagcagcttttgattccctgcataccctaggctgctgcccctatcctgtcccttgtttataacattgagaggttttctagggcacatactgagtgagagcagtgttgagaagtcggggaaaatggtgactacttttagagcaaggctgggcatcagcacctgtccagctctacttgtgtgatgtttcaggaactcagcccctttttctgcctaggataaggagctgaaagattaacttggatcttctaatggtccaaatcttttggtcacaataaagagtctccaaattagagactgcatgttagttctggatggatttggtggcctgacatgataccctgccagctgtgaggggaccccgtttttaagatgcatggccaagctctctgcaaatggaaatgcttacactgggtgttggggatgtttgctacctcctgctatttttgtggttttggttctcccactatggtaggacccctggccagcattgtggcttgtcatgtcagccccattgactaccttctcatgctctgaggtactactgcctctgcagcacaaatttctatttctgtcaataaaaggagatgaaaatattc

SEQ ID NO: 329623 - DNA, 1872 bp, Homo sapiens
gccacgaaggccacagacgccttcccccttggactctcattcccttttccacggagccccgcgctttcgtgagccccctcgaggaacctggtctccgcatccagttaccacctcctgcctcagaggccatctgagcccttcgcacctcgcccctcagtccccccttgcccccccgcggagatcgcctcgctccctcccgcccccccatcatcccttccctcgcagttcccctgtcctgaggggagccccgccacggcagcgacagcgggcaggagggagaaagtgaaggttgggcgacacttggccctcactcccggctaggcggcacccaccgccgggaggaggaggaggagccgagaggagctgagcgagcgcggaagtagctgctgctggtggtgacaatgtcaaataacggcctagacattcaagacaaacccccagcccctccgatgagaaataccagcactatgattggagccggcagcaaagatgctggaaccctaaaccatggttctaaacctctgcctccaaacccagaggagaagaaaaagaaggaccgattttaccgatccattttacctggagataaaacaaataaaaagaaagagaaagagcggccagagatttctctcccttcagattttgaacacacaattcatgtcggttttgatgctgtcacaggggagtttacgggaatgccagagcagtgggcccgcttgcttcagacatcaaatatcactaagtcggagcagaagaaaaacccgcaggctgttctggatgtgttggagttttacaactcgaagaagacatccaacagccagaaatacatgagctttacagataagtcagctgaggattacaattcttctaatgccttgaatgtgaaggctgtgtctgagactcctgcagtgccaccagtttcagaagatgaggatgatgatgatgatgatgttatccccaacaccagtgattgctccacgcccagagcacacaaaatctgtatacacacggtctgtgattgaaccacttcctgtcactccaactcgggacgtggctacatctcccatttcacctactgaaaataacaccactccaccagatgctttgacccggaatactgagaagcagaagaagaagcctaaaatgtctgatgaggagatcttggagaaattacgaagcatagtgagtgttgggcgatcctaagaagaaatatacacggtttgagaagattggacaaggtgcttcaggcaccgtgtacacagcaatggatgtggccacaggacaggaggtggccattaagcagatgaatcttcagcagcagcccaagaaagagctgattattaatgagatcctggtcatgagggaaaacaagaacccaaacattgtgaattacttggacagttacctcgtgggagatgagctgtgggttgttatggaatacttggctggaggctccttgacagatgtggtgacagaaacttgcatggatgaaggccaaattgcagctgtgtgccgtgagtgtctgcaggctctggagttcttgcattcgaaccaggtcattcacagagacatcaagagtgacaatattctgttgggaatggatggctctgtcaagctaactgactttggattctgtgcacagataaccccagagcagagcaaacggagcaccatggtaggaaccccatactggatggcaccagaggttgtgacacgaaaggcctatgggcccaaggttgacatctggtccctgggcatcatggccatcgaaatgattgaaggggagcctccatacctcaatgaaaaccctctgagaaggctcttggtaccccttcatttggcccaccctaatattgggggaatccccccaag

SEQ ID NO: 329624 - DNA, 2127 bp, Homo sapiens
gccacgaaggccacagacgccttcccccttggactctcattcccttttccacggagccccgcgctttcgtgagccccctcgaggaacctggtctccgcatccagttaccacctcctgcctcagaggccatctgagcccttcgcacctcgcccctcagtccccccttgcccccccgcggagatcgcctcgctccctcccgcccccccatcatcccttccctcgcagttcccctgtcctgaggggagccccgccacggcagcgacagcgggcaggagggagaaagtgaaggttgggcgacacttggccctcactcccggctaggcggcacccaccgccgggaggaggaggaggagccgagaggagctgagcgagcgcggaagtagctgctgctggtggtgacaatgtcaaataacggcctagacattcaagacaaacccccagcccctccgatgagaaataccagcactatgattggagccggcagcaaagatgctggaaccctaaaccatggttctaaacctctgcctccaaacccagaggagaagaaaaagaaggaccgattttaccgatccattttacctggagataaaacaaataaaaagaaagagaaagagcggccagagatttctctcccttcagattttgaacacacaattcatgtcggttttgatgctgtcacaggggagtttacgggaatgccagagcagtgggcccgcttgcttcagacatcaaatatcactaagtcggagcagaagaaaaacccgcaggctgttctggatgtgttggagttttacaactcgaagaagacatccaacagccagaaatacatgagctttacagataagtcagctgaggattacaattcttctaatgccttgaatgtgaaggctgtgtctgagactcctgcagtgccaccagtttcagaagatgaggatgatgatgatgatgatgttatccccaacaccagtgattgctccacgcccagagcacacaaaatctgtatacacacggtctgtgattgaaccacttcctgtcactccaactcgggacgtggctacatctcccatttcacctactgaaaataacaccactccaccagatgctttgacccggaatactgagaagcagaagaagaagcctaaaatgtctgatgaggagatcttggagaaattacgaagcatagtgagtgttgggcgatcctaagaagaaatatacacggtttgagaagattggacaagggttagtaggggcattttctttccctggagaaatgactttaaagtgtgtgtgccggcatatatgattttgctttttttttgcctctcataaaccttgttcttctttctccactttacccctcacccatctggagttgttatgtgagactgacttgagatttggcagaattatgcttaatatgagagagatgccattagctgaccatgttgctaaaaatacccctgcagtgacagtgagagaacggttttttttcttagcacaaaaccaacttcccaaattacaactctgcttttccggatgaaccctgtttgtcctagtgctgagatccaccagcactaatataaaatggaagacccaaaactataaatccttctactactgtgataggacctgtttttctaggtagatgccagaatttatccttcttgcattcatccttctctgtatcttatatgctgccctcagtgtaatgaattcagcaagtcttaactgagttcctattgtgtgcaaggcactatgaattcagagacaatctctgcttccaaggacctcaagtcaacagaaaaagataggcaaacaattgtatagtcatatgttgcctaacaaaggggatatgttctgagaagtgcatccttaggcagttttgtcatgtgagcgtcatagagtgaacacaaaactaaatagtatagcctactacacacctaggctatatggtatagcctcttgctcctaggctacaagcctgtacagcatgttactgtactgaatactgtaggcattttacccatgtggttgttttcaacttgaacataggtaaatcgctaagataaaaagttttagtcggctaatgatgagtgtgatggatgcaaaaaaaggtttataggtttg

SEQ ID NO: 329625 - DNA, 1445 bp, Homo sapiens
gccacgaaggccacagacgccttcccccttggactctcattcccttttccacggagccccgcgctttcgtgagccccctcgaggaacctggtctccgcatccagttaccacctcctgcctcagaggccatctgagcccttcgcacctcgcccctcagtccccccttgcccccccgcggagatcgcctcgctccctcccgcccccccatcatcccttccctcgcagttcccctgtcctgaggggagccccgccacggcagcgacagcgggcaggagggagaaagtgaaggttgggcgacacttggccctcactcccggctaggcggcacccaccgccgggaggaggaggaggagccgagaggagctgagcgagcgcggaagtagctgctgctggtggtgacaatgtcaaataacggcctagacattcaagacaaacccccagcccctccgatgagaaataccagcactatgattggagccggcagcaaagatgctggaaccctaaaccatggttctaaacctctgcctccaaacccagaggagaagaaaaagaaggaccgattttaccgatccattttacctggagataaaacaaataaaaagaaagagaaagagcggccagagatttctctcccttcagattttgaacacacaattcatgtcggttttgatgctgtcacaggggagtttacgggaatgccagagcagtgggcccgcttgcttcagacatcaaatatcactaagtcggagcagaagaaaaacccgcaggctgttctggatgtgttggagttttacaactcgaagaagacatccaacagccagaaatacatgagctttacagataagtcagctgaggattacaattcttctaatgccttgaatgtgaaggctgtgtctgagactcctgcagtgccaccagtttcagaagatgaggatgatgatgatgatgatgttatccccaacaccagtgattgctccacgcccagagcacacaaaatctgtatacacacggtctgtgattgaaccacttcctgtcactccaactcgggacgtggctacatctcccatttcacctactgaaaataacaccactccaccagatgctttgacccggaatactgagaagcagaagaagaagcctaaaatgtctgatgaggagatcttggagaaattacgaagcatagtgagtgttgggcgataacatcgtgatgttatccccaacactacatacagcaaattttggtatttttaatagcgatggggtttcaccatgttggccaggatggtctcgaactcctgatctcaagtgatccgcccacctcagcctcccaaaatgtttggattacaggcatgagccaccacccctggcctggaccctctttttgacatgtgtgagcataggcagcaagcaaggccgtgcagagaaggggtgcttccagactgccc

SEQ ID NO: 329626 - DNA, 886 bp, Homo sapiens
gccacgaaggccacagacgccttcccccttggactctcattcccttttccacggagccccgcgctttcgtgagccccctcgaggaacctggtctccgcatccagttaccacctcctgcctcagaggccatctgagcccttcgcacctcgcccctcagtccccccttgcccccccgcggagatcgcctcgctccctcccgcccccccatcatcccttccctcgcagttcccctgtcctgaggggagccccgccacggcagcgacagcgggcaggagggagaaagtgaaggttgggcgacacttggccctcactcccggctaggcggcacccaccgccgggaggaggaggaggagccgagaggagctgagcgagcgcggaagtagctgctgctggtggtgacaatgtcaaataacggcctagacattcaagacaaacccccagcccctccgatgagaaataccagcactatgattggagccggcagcaaagatgctggaaccctaaaccatggttctaaacctctgcctccaaacccagaggagaagaaaaagaaggaccgattttaccgatccattttacctggagataaaacaaataaaaagaaagagaaagagcggccagagatttctctcccttcagattttgaacacacaattcatgtcggttttgatgctgtcacaggggagtttacgggaatgccagagcagtgggcccgcttgcttcagacatcaaatatcactaagtcggagcagaagaaaaacccgcaggctgttctggatgtgttggagttttacaactcgaagaagacatccaacagccagaaatacatgagctttacaggtatgagaactgcgtccagggcagtctcagcaagagatggttttaa

SEQ ID NO: 329627 - DNA, 1584 bp, Homo sapiens
tttaacttggggaagcataaaatattacaaatgaaggggattcttacctaatagaattgtcttcaactaatttcttttgttacagaatatttcttttagcttggggaatacaggatatttcttttagcttggggaagcataaaatattacagatgaaggggattcttatctaatagaattgtctttaactaatttcttttgatagttgtctagcctctattgaatatctttagtgctgagactctcacttcttttgtttacagtgagagtaaggaaggccattttacccagaatgggtgggcctgggcacagaggaggagtaatatagattttgacataagagaaaggatgagtttattggggtttgctctgtggatgttctaacctcacatctaggagaggttcccctatgctaacaaaggctggtcttgccaaaattttgcactaataatgcaggtatacacacggtctgtgattgaaccacttcctgtcactccaactcgggacgtggctacatctcccatttcacctactgaaaataacaccactccaccagatgctttgacccggaatactgagaagcagaagaagaagcctaaaatgtctgatgaggagatcttggagaaattacgaagcatagtgagtgttgggcgatcctaagaagaaatatacacggtttgagaagattggacaagggttagtaggggcattttctttccctggagaaatgactttaaagtgtgtgtgccggcatatatgattttgctttttttttgcctctcataaaccttgttcttctttctccactttacccctcacccatctggagttgttatgtgagactgacttgagatttggcagaattatgcttaatatgagagagatgccattagctgaccatgttgctaaaaatacccctgcagtgacagtgagagaacggttttttttcttagcacaaaaccaacttcccaaattacaactctgcttttccggatgaaccctgtttgtcctagtgctgagatccaccagcactaatataaaatggaagacccaaaactataaatccttctactactgtgataggacctgtttttctaggtagatgccagaatttatccttcttgcattcatccttctctgtatcttatatgctgccctcagtgtaatgaattcagcaagtcttaactgagttcctattgtgtgcaaggcactatgaattcagagacaatctctgcttccaaggacctcaagtcaacagaaaaagataggcaaacaattgtatagtcatatgttgcctaacaaaggggatatgttctgagaagtgcatccttaggcagttttgtcatgtgagcgtcatagagtgaacacaaaactaaatagtatagcctactacacacctaggctatatggtatagcctcttgctcctaggctacaagcctgtacagcatgttactgtactgaatactgtaggcattttacccatgtggttgttttcaacttgaacataggtaaatcgctaagataaaaagttttagtcggctaatgatgagtgtgatggatgcaaaaaaaggtttataggtttg

SEQ ID NO: 329628 - DNA, 412 bp, Homo sapiens
tcaatgaaaaccctctgagagtgagtgttaccagttctatttcaagttatttgggctgttgtctctagtcccaggaaataagaatccagggtgttctctgtggttttcaacctggagatcccttttctggatacaactagtcactgttgaacttaaagtataaatggccaaagaaaaggaatattagaagtcactcattcatttattcaacaattatttgagtccctgtcaagtgcaagaaactattctaatgaaaataaaataaattaatatgtagtaacagatggtaaatgctgtgagaaaaagcaaagtaagggagttaacagagtaatggaggaacaggtgtgctattttagagtagagagggaagttctctcttataagttattttattctgcagagttgggaagtc

SEQ ID NO: 329629 - DNA, 2331 bp, Homo sapiens
gccacgaaggccacagacgccttcccccttggactctcattcccttttccacggagccccgcgctttcgtgagccccctcgaggaacctggtctccgcatccagttaccacctcctgcctcagaggccatctgagcccttcgcacctcgcccctcagtccccccttgcccccccgcggagatcgcctcgctccctcccgcccccccatcatcccttccctcgcagttcccctgtcctgaggggagccccgccacggcagcgacagcgggcaggagggagaaagtgaaggttgggcgacacttggccctcactcccggctaggcggcacccaccgccgggaggaggaggaggagccgagaggagctgagcgagcgcggaagtagctgctgctggtggtgacaatgtcaaataacggcctagacattcaagacaaacccccagcccctccgatgagaaataccagcactatgattggagccggcagcaaagatgctggaaccctaaaccatggttctaaacctctgcctccaaacccagaggagaagaaaaagaaggaccgattttaccgatccattttacctggagataaaacaaataaaaagaaagagaaagagcggccagagatttctctcccttcagattttgaacacacaattcatgtcggttttgatgctgtcacaggggagtttacgggaatgccagagcagtgggcccgcttgcttcagacatcaaatatcactaagtcggagcagaagaaaaacccgcaggctgttctggatgtgttggagttttacaactcgaagaagacatccaacagccagaaatacatgagctttacagataagtcagctgaggattacaattcttctaatgccttgaatgtgaaggctgtgtctgagactcctgcagtgccaccagtttcagaagatgaggatgatgatgatgatgatgttatccccaacaccagtgattgctccacgcccagagcacacaaaatctgtatacacacggtctgtgattgaaccacttcctgtcactccaactcgggacgtggctacatctcccatttcacctactgaaaataacaccactccaccagatgctttgacccggaatactgagaagcagaagaagaagcctaaaatgtctgatgaggagatcttggagaaattacgaagcatagtgagtgttgggcgatcctaagaagaaatatacacggtttgagaagattggacaaggtgcttcaggcaccgtgtacacagcaatggatgtggccacaggacaggaggtggccattaagcagatgaatcttcagcagcagcccaagaaagagctgattattaatgagatcctggtcatgagggaaaacaagaacccaaacattgtgaattacttggacagttacctcgtgggagatgagctgtgggttgttatggaatacttggctggaggctccttgacagatgtggtgacagaaacttgcatggatgaaggccaaattgcagctgtgtgccgtgagtgtctgcaggctctggagttcttgcattcgaaccaggtcattcacagagacatcaagagtgacaatattctgttgggaatggatggctctgtcaagctaactgactttggattctgtgcacagataaccccagagcagagcaaacggagcaccatggtaggaaccccatactggatggcaccagaggttgtgacacgaaaggcctatgggcccaaggttgacatctggtccctgggcatcatggccatcgaaatgattgaaggggagcctccatacctcaatgaaaaccctctgagagccttgtacctcattgccaccaatgggaccccagaacttcagaacccagagaagctgtcagctatcttccgggactttctgaaccgctgtctcgagatggatgtggagaagagaggttcagctaaagagctgctacagcatcaattcctgaagattgccaagcccctctccagcctcactccactgattgctgcagctaaggaggcaacaaagaacaatcactaaaaccacactcaccccagcctcattgtgccaagccttctgtgagataaatgcacatttcagaaattccaactcctgatgccctcttctccttgccttgcttctcccatttcctgatctagcactcctcaagactttgatccttggaaaccgtgtgtccagcattgaagagaactgcaactgaatgactaatcagatgatggccatttctaaataaggaatttcctcccaattcatggatatgagggtggtttatgattaagggtttatataaataaatgtttctagtcttc

SEQ ID NO: 329630 - DNA, 432 bp, Homo sapiens
  misc_feature (37)..(37): n is a, c, g, or t
tatcgcccaacacacccagacgtatattaagcatgtnttaattctaacaaaataattttgttcttcctataactttattgccaaaaacatgtacaggaagaactaaaaaatataaaaaagacagacaatctatactatatgctggtgttggggataaatacgatgttatccccaacaccagtgattgctccacgcccagagcacacaaaatctgtatacacacggtctgtgattgaaccacttcctgtcactccaactcgggacgtggctacatctcccatttcacctactgaaaataacaccactccaccagatgctttgacccggaatactgagaagcagaagaagaagcctaaaatgtctgatgaggagatcttggagaaattacgaagcatagtgagtgttgggcgatacgtccggggtcccaagagc

SEQ ID NO: 329631 - DNA, 3347 bp, Homo sapiens
gccacgaaggccacagacgccttcccccttggactctcattcccttttccacggagccccgcgctttcgtgagccccctcgaggaacctggtctccgcatccagttaccacctcctgcctcagaggccatctgagcccttcgcacctcgcccctcagtccccccttgcccccccgcggagatcgcctcgctccctcccgcccccccatcatcccttccctcgcagttcccctgtcctgaggggagccccgccacggcagcgacagcgggcaggagggagaaagtgaaggttgggcgacacttggccctcactcccggctaggcggcacccaccgccgggaggaggaggaggagccgagaggagctgagcgagcgcggaagtagctgctgctggtggtgacaatgtcaaataacggcctagacattcaagacaaacccccagcccctccgatgagaaataccagcactatgattggagccggcagcaaagatgctggaaccctaaaccatggttctaaacctctgcctccaaacccagaggagaagaaaaagaaggaccgattttaccgatccattttacctggagataaaacaaataaaaagaaagagaaagagcggccagagatttctctcccttcagattttgaacacacaattcatgtcggttttgatgctgtcacaggggagtttacgggaatgccagagcagtgggcccgcttgcttcagacatcaaatatcactaagtcggagcagaagaaaaacccgcaggctgttctggatgtgttggagttttacaactcgaagaagacatccaacagccagaaatacatgagctttacagataagtcagctgaggattacaattcttctaatgccttgaatgtgaaggctgtgtctgagactcctgcagtgccaccagtttcagaagatgaggatgatgatgatgatgatgttatccccaacaccagtgattgctccacgcccagagcacacaaaatctgtatacacacggtctgtgattgaaccacttcctgtcactccaactcgggacgtggctacatctcccatttcacctactgaaaataacaccactccaccagatgctttgacccggaatactgagaagcagaagaagaagcctaaaatgtctgatgaggagatcttggagaaattacgaagcatagtgagtgttgggcgatcctaagaagaaatatacacggtttgagaagattggacaaggtgcttcaggcaccgtgtacacagcaatggatgtggccacaggacaggaggtggccattaagcagatgaatcttcagcagcagcccaagaaagagctgattattaatgagatcctggtcatgagggaaaacaagaacccaaacattgtgaattacttggacagttacctcgtgggagatgagctgtgggttgttatggaatacttggctggaggctccttgacagatgtggtgacagaaacttgcatggatgaaggccaaattgcagctgtgtgccgtgagtgtctgcaggctctggagttcttgcattcgaaccaggtcattcacagagacatcaagagtgacaatattctgttgggaatggatggctctgtcaagctaactgactttggattctgtgcacagataaccccagagcagagcaaacggagcaccatggtaggaaccccatactggatggcaccagaggttgtgacacgaaaggcctatgggcccaaggttgacatctggtccctgggcatcatggccatcgaaatgattgaaggggagcctccatacctcaatgaaaaccctctgagagccttgtacctcattgccaccaatgggaccccagaacttcagaacccagagaagctgtcagctatcttccgggactttctgaaccgctgtctcgagatggatgtggagaagagaggttcagctaaagagctgctacaggtgagaaaactgaggtttcaagtgtttagtaacttttccatgatagctgcatcaattcctgaagattgccaagcccctctccagcctcactccactgattgctgcagctaaggaggcaacaaagaacaatcactaaaaccacactcaccccagcctcattgtgccaagccttctgtgagataaatgcacatttcagaaattccaactcctgatgccctcttctccttgccttgcttctcccatttcctgatctagcactcctcaagactttgatccttggaaaccgtgtgtccagcattgaagagaactgcaactgaatgactaatcagatgatggccatttctaaataaggaatttcctcccaattcatggatatgagggtggtttatgattaagggtttatataaataaatgtttctagtcttccgtgtgtcaaaatcctcacctccttcataaccatctcccacaattaattcttgactatataaatttatggtttgataatattatcaatttgtaatcaattgagatttctttagtgcttgcttttctgtgactcaactgcccagacacctcattgtacttgaaaactggaacagcttgggaatgccatggggtttgataatctgccagggacatgaagaggctcagcttcctggaccatgactttggctcagctgatcctgacatgggagaacaaccacatttttctttgtgtgtgcttctagcagctgttcgggaggaccttgacccaatagtgttcccatgctgtttcttgtgaaatgctctcggctatgtagcagcttttgattccctgcataccctaggctgctgcccctatcctgtcccttgtttataacattgagaggttttctagggcacatactgagtgagagcagtgttgagaagtcggggaaaatggtgactacttttagagcaaggctgggcatcagcacctgtccagctctacttgtgtgatgtttcaggaactcagcccctttttctgcctaggataaggagctgaaagattaacttggatcttctaatggtccaaatcttttggtcacaataaagagtctccaaattagagactgcatgttagttctggatggatttggtggcctgacatgataccctgccagctgtgaggggaccccgtttttaagatgcatggccaagctctctgcaaatggaaatgcttacactgggtgttggggatgtttgctacctcctgctatttttgtggttttggttctcccactatggtaggacccctggccagcattgtggcttgtcatgtcagccccattgactaccttctcatgctctgaggtactactgcctctgcagcacaaatttctatttctgtcaataaaaggagatgaaaatattc

SEQ ID NO: 329632 - DNA, 3148 bp, Homo sapiens
gcgagagcgcgagcgtgctgcacctcgggagctggcggctgagctgccaggagcccagcccagctgaatcgagcggagccggtggagcaggggccttgtgggtacccggttgggcagggagaggtgcggctctgcgacggaaacaatcgccagagatgccggggctagccttccccaccagtagctgctgctggtggtgacaatgtcaaataacggcctagacattcaagacaaacccccagcccctccgatgagaaataccagcactatgattggagccggcagcaaagatgctggaaccctaaaccatggttctaaacctctgcctccaaacccagaggagaagaaaaagaaggaccgattttaccgatccattttacctggagataaaacaaataaaaagaaagagaaagagcggccagagatttctctcccttcagattttgaacacacaattcatgtcggttttgatgctgtcacaggggagtttacgggaatgccagagcagtgggcccgcttgcttcagacatcaaatatcactaagtcggagcagaagaaaaacccgcaggctgttctggatgtgttggagttttacaactcgaagaagacatccaacagccagaaatacatgagctttacagataagtcagctgaggattacaattcttctaatgccttgaatgtgaaggctgtgtctgagactcctgcagtgccaccagtttcagaagatgaggatgatgatgatgatgatgttatccccaacaccagtgattgctccacgcccagagcacacaaaatctgtatacacacggtctgtgattgaaccacttcctgtcactccaactcgggacgtggctacatctcccatttcacctactgaaaataacaccactccaccagatgctttgacccggaatactgagaagcagaagaagaagcctaaaatgtctgatgaggagatcttggagaaattacgaagcatagtgagtgttgggcgatcctaagaagaaatatacacggtttgagaagattggacaaggtgcttcaggcaccgtgtacacagcaatggatgtggccacaggacaggaggtggccattaagcagatgaatcttcagcagcagcccaagaaagagctgattattaatgagatcctggtcatgagggaaaacaagaacccaaacattgtgaattacttggacagttacctcgtgggagatgagctgtgggttgttatggaatacttggctggaggctccttgacagatgtggtgacagaaacttgcatggatgaaggccaaattgcagctgtgtgccgtgagtgtctgcaggctctggagttcttgcattcgaaccaggtcattcacagagacatcaagagtgacaatattctgttgggaatggatggctctgtcaagctaactgactttggattctgtgcacagataaccccagagcagagcaaacggagcaccatggtaggaaccccatactggatggcaccagaggttgtgacacgaaaggcctatgggcccaaggttgacatctggtccctgggcatcatggccatcgaaatgattgaaggggagcctccatacctcaatgaaaaccctctgagagccttgtacctcattgccaccaatgggaccccagaacttcagaacccagagaagctgtcagctatcttccgggactttctgaaccgctgtctcgagatggatgtggagaagagaggttcagctaaagagctgctacaggtgagaaaactgaggtttcaagtgtttagtaacttttccatgatagctgcatcaattcctgaagattgccaagcccctctccagcctcactccactgattgctgcagctaaggaggcaacaaagaacaatcactaaaaccacactcaccccagcctcattgtgccaagccttctgtgagataaatgcacatttcagaaattccaactcctgatgccctcttctccttgccttgcttctcccatttcctgatctagcactcctcaagactttgatccttggaaaccgtgtgtccagcattgaagagaactgcaactgaatgactaatcagatgatggccatttctaaataaggaatttcctcccaattcatggatatgagggtggtttatgattaagggtttatataaataaatgtttctagtcttccgtgtgtcaaaatcctcacctccttcataaccatctcccacaattaattcttgactatataaatttatggtttgataatattatcaatttgtaatcaattgagatttctttagtgcttgcttttctgtgactcaactgcccagacacctcattgtacttgaaaactggaacagcttgggaatgccatggggtttgataatctgccagggacatgaagaggctcagcttcctggaccatgactttggctcagctgatcctgacatgggagaacaaccacatttttctttgtgtgtgcttctagcagctgttcgggaggaccttgacccaatagtgttcccatgctgtttcttgtgaaatgctctcggctatgtagcagcttttgattccctgcataccctaggctgctgcccctatcctgtcccttgtttataacattgagaggttttctagggcacatactgagtgagagcagtgttgagaagtcggggaaaatggtgactacttttagagcaaggctgggcatcagcacctgtccagctctacttgtgtgatgtttcaggaactcagcccctttttctgcctaggataaggagctgaaagattaacttggatcttctaatggtccaaatcttttggtcacaataaagagtctccaaattagagactgcatgttagttctggatggatttggtggcctgacatgataccctgccagctgtgaggggaccccgtttttaagatgcatggccaagctctctgcaaatggaaatgcttacactgggtgttggggatgtttgctacctcctgctatttttgtggttttggttctcccactatggtaggacccctggccagcattgtggcttgtcatgtcagccccattgactaccttctcatgctctgaggtactactgcctctgcagcacaaatttctatttctgtcaataaaaggagatgaaaatattc

SEQ ID NO: 329633 - DNA, 3076 bp, Homo sapiens
gtagatctcagaggatccctggcatttaggtatctctgcgacggaattcaatcgccagagatgcggggctagccttccccaccagactgtcaaaccatcttttggagagtagctgctgctggtggtgacaatgtcaaataacggcctagacattcaagacaaacccccagcccctccgatgagaaataccagcactatgattggagccggcagcaaagatgctggaaccctaaaccatggttctaaacctctgcctccaaacccagaggagaagaaaaagaaggaccgattttaccgatccattttacctggagataaaacaaataaaaagaaagagaaagagcggccagagatttctctcccttcagattttgaacacacaattcatgtcggttttgatgctgtcacaggggagtttacgggaatgccagagcagtgggcccgcttgcttcagacatcaaatatcactaagtcggagcagaagaaaaacccgcaggctgttctggatgtgttggagttttacaactcgaagaagacatccaacagccagaaatacatgagctttacagataagtcagctgaggattacaattcttctaatgccttgaatgtgaaggctgtgtctgagactcctgcagtgccaccagtttcagaagatgaggatgatgatgatgatgatgttatccccaacaccagtgattgctccacgcccagagcacacaaaatctgtatacacacggtctgtgattgaaccacttcctgtcactccaactcgggacgtggctacatctcccatttcacctactgaaaataacaccactccaccagatgctttgacccggaatactgagaagcagaagaagaagcctaaaatgtctgatgaggagatcttggagaaattacgaagcatagtgagtgttgggcgatcctaagaagaaatatacacggtttgagaagattggacaaggtgcttcaggcaccgtgtacacagcaatggatgtggccacaggacaggaggtggccattaagcagatgaatcttcagcagcagcccaagaaagagctgattattaatgagatcctggtcatgagggaaaacaagaacccaaacattgtgaattacttggacagttacctcgtgggagatgagctgtgggttgttatggaatacttggctggaggctccttgacagatgtggtgacagaaacttgcatggatgaaggccaaattgcagctgtgtgccgtgagtgtctgcaggctctggagttcttgcattcgaaccaggtcattcacagagacatcaagagtgacaatattctgttgggaatggatggctctgtcaagctaactgactttggattctgtgcacagataaccccagagcagagcaaacggagcaccatggtaggaaccccatactggatggcaccagaggttgtgacacgaaaggcctatgggcccaaggttgacatctggtccctgggcatcatggccatcgaaatgattgaaggggagcctccatacctcaatgaaaaccctctgagagccttgtacctcattgccaccaatgggaccccagaacttcagaacccagagaagctgtcagctatcttccgggactttctgaaccgctgtctcgagatggatgtggagaagagaggttcagctaaagagctgctacaggtgagaaaactgaggtttcaagtgtttagtaacttttccatgatagctgcatcaattcctgaagattgccaagcccctctccagcctcactccactgattgctgcagctaaggaggcaacaaagaacaatcactaaaaccacactcaccccagcctcattgtgccaagccttctgtgagataaatgcacatttcagaaattccaactcctgatgccctcttctccttgccttgcttctcccatttcctgatctagcactcctcaagactttgatccttggaaaccgtgtgtccagcattgaagagaactgcaactgaatgactaatcagatgatggccatttctaaataaggaatttcctcccaattcatggatatgagggtggtttatgattaagggtttatataaataaatgtttctagtcttccgtgtgtcaaaatcctcacctccttcataaccatctcccacaattaattcttgactatataaatttatggtttgataatattatcaatttgtaatcaattgagatttctttagtgcttgcttttctgtgactcaactgcccagacacctcattgtacttgaaaactggaacagcttgggaatgccatggggtttgataatctgccagggacatgaagaggctcagcttcctggaccatgactttggctcagctgatcctgacatgggagaacaaccacatttttctttgtgtgtgcttctagcagctgttcgggaggaccttgacccaatagtgttcccatgctgtttcttgtgaaatgctctcggctatgtagcagcttttgattccctgcataccctaggctgctgcccctatcctgtcccttgtttataacattgagaggttttctagggcacatactgagtgagagcagtgttgagaagtcggggaaaatggtgactacttttagagcaaggctgggcatcagcacctgtccagctctacttgtgtgatgtttcaggaactcagcccctttttctgcctaggataaggagctgaaagattaacttggatcttctaatggtccaaatcttttggtcacaataaagagtctccaaattagagactgcatgttagttctggatggatttggtggcctgacatgataccctgccagctgtgaggggaccccgtttttaagatgcatggccaagctctctgcaaatggaaatgcttacactgggtgttggggatgtttgctacctcctgctatttttgtggttttggttctcccactatggtaggacccctggccagcattgtggcttgtcatgtcagccccattgactaccttctcatgctctgaggtactactgcctctgcagcacaaatttctatttctgtcaataaaaggagatgaaaatattc

SEQ ID NO: 329634 - DNA, 3250 bp, Homo sapiens
gccacgaaggccacagacgccttcccccttggactctcattcccttttccacggagccccgcgctttcgtgagccccctcgaggaacctggtctccgcatccagttaccacctcctgcctcagaggccatctgagcccttcgcacctcgcccctcagtccccccttgcccccccgcggagatcgcctcgctccctcccgcccccccatcatcccttccctcgcagttcccctgtcctgaggggagccccgccacggcagcgacagcgggcaggagggagaaagtgaaggttgggcgacacttggccctcactcccggctaggcggcacccaccgccgggaggaggaggaggagccgagaggagctgagcgagcgcggaagtagctgctgctggtggtgacaatgtcaaataccagcactatgattggagccggcagcaaagatgctggaaccctaaaccatggttctaaacctctgcctccaaacccagaggagaagaaaaagaaggaccgattttaccgatccattttacctggagataaaacaaataaaaagaaagagaaagagcggccagagatttctctcccttcagattttgaacacacaattcatgtcggttttgatgctgtcacaggggagtttacgggaatgccagagcagtgggcccgcttgcttcagacatcaaatatcactaagtcggagcagaagaaaaacccgcaggctgttctggatgtgttggagttttacaactcgaagaagacatccaacagccagaaatacatgagctttacagataagtcagctgaggattacaattcttctaatgccttgaatgtgaaggctgtgtctgagactcctgcagtgccaccagtttcagaagatgaggatgatgatgatgatgatgttatccccaacaccagtgattgctccacgcccagagcacacaaaatctgtatacacacggtctgtgattgaaccacttcctgtcactccaactcgggacgtggctacatctcccatttcacctactgaaaataacaccactccaccagatgctttgacccggaatactgagaagcagaagaagaagcctaaaatgtctgatgaggagatcttggagaaattacgaagcatagtgagtgttgggcgatcctaagaagaaatatacacggtttgagaagattggacaaggtgcttcaggcaccgtgtacacagcaatggatgtggccacaggacaggaggtggccattaagcagatgaatcttcagcagcagcccaagaaagagctgattattaatgagatcctggtcatgagggaaaacaagaacccaaacattgtgaattacttggacagttacctcgtgggagatgagctgtgggttgttatggaatacttggctggaggctccttgacagatgtggtgacagaaacttgcatggatgaaggccaaattgcagctgtgtgccgtgagtgtctgcaggctctggagttcttgcattcgaaccaggtcattcacagagacatcaagagtgacaatattctgttgggaatggatggctctgtcaagctaactgactttggattctgtgcacagataaccccagagcagagcaaacggagcaccatggtaggaaccccatactggatggcaccagaggttgtgacacgaaaggcctatgggcccaaggttgacatctggtccctgggcatcatggccatcgaaatgattgaaggggagcctccatacctcaatgaaaaccctctgagagccttgtacctcattgccaccaatgggaccccagaacttcagaacccagagaagctgtcagctatcttccgggactttctgaaccgctgtctcgagatggatgtggagaagagaggttcagctaaagagctgctacagcatcaattcctgaagattgccaagcccctctccagcctcactccactgattgctgcagctaaggaggcaacaaagaacaatcactaaaaccacactcaccccagcctcattgtgccaagccttctgtgagataaatgcacatttcagaaattccaactcctgatgccctcttctccttgccttgcttctcccatttcctgatctagcactcctcaagactttgatccttggaaaccgtgtgtccagcattgaagagaactgcaactgaatgactaatcagatgatggccatttctaaataaggaatttcctcccaattcatggatatgagggtggtttatgattaagggtttatataaataaatgtttctagtcttccgtgtgtcaaaatcctcacctccttcataaccatctcccacaattaattcttgactatataaatttatggtttgataatattatcaatttgtaatcaattgagatttctttagtgcttgcttttctgtgactcaactgcccagacacctcattgtacttgaaaactggaacagcttgggaatgccatggggtttgataatctgccagggacatgaagaggctcagcttcctggaccatgactttggctcagctgatcctgacatgggagaacaaccacatttttctttgtgtgtgcttctagcagctgttcgggaggaccttgacccaatagtgttcccatgctgtttcttgtgaaatgctctcggctatgtagcagcttttgattccctgcataccctaggctgctgcccctatcctgtcccttgtttataacattgagaggttttctagggcacatactgagtgagagcagtgttgagaagtcggggaaaatggtgactacttttagagcaaggctgggcatcagcacctgtccagctctacttgtgtgatgtttcaggaactcagcccctttttctgcctaggataaggagctgaaagattaacttggatcttctaatggtccaaatcttttggtcacaataaagagtctccaaattagagactgcatgttagttctggatggatttggtggcctgacatgataccctgccagctgtgaggggaccccgtttttaagatgcatggccaagctctctgcaaatggaaatgcttacactgggtgttggggatgtttgctacctcctgctatttttgtggttttggttctcccactatggtaggacccctggccagcattgtggcttgtcatgtcagccccattgactaccttctcatgctctgaggtactactgcctctgcagcacaaatttctatttctgtcaataaaaggagatgaaaatattc

SEQ ID NO: 329635 - DNA, 3772 bp, Homo sapiens
gccacgaaggccacagacgccttcccccttggactctcattcccttttccacggagccccgcgctttcgtgagccccctcgaggaacctggtctccgcatccagttaccacctcctgcctcagaggccatctgagcccttcgcacctcgcccctcagtccccccttgcccccccgcggagatcgcctcgctccctcccgcccccccatcatcccttccctcgcagttcccctgtcctgaggggagccccgccacggcagcgacagcgggcaggagggagaaagtgaaggttgggcgacacttggccctcactcccggctaggcggcacccaccgccgggaggaggaggaggagccgagaggagctgagcgagcgcggaagtagctgctgctggtggtgacaatgtcaaataacggcctagacattcaagacaaacccccagcccctccgatgagaaataccagcactatgattggagccggcagcaaagatgctggaaccctaaaccatggttctaaacctctgcctccaaacccagaggagaagaaaaagaaggaccgattttaccgatccattttacctggagataaaacaaataaaaagaaagagaaagagcggccagagatttctctcccttcagattttgaacacacaattcatgtcggttttgatgctgtcacaggggagtttacgggaatgccagagcagtgggcccgcttgcttcagacatcaaatatcactaagtcggagcagaagaaaaacccgcaggctgttctggatgtgttggagttttacaactcgaagaagacatccaacagccagaaatacatgagctttacagataagtcagctgaggattacaattcttctaatgccttgaatgtgaaggctgtgtctgagactcctgcagtgccaccagtttcagaagatgaggatgatgatgatgatgatgttatccccaacaccagtgattgctccacgcccagagcacacaaaatctgtatacacacggtctgtgattgaaccacttcctgtcactccaactcgggacgtggctacatctcccatttcacctactgaaaataacaccactccaccagatgctttgacccggaatactgagaagcagaagaagaagcctaaaatgtctgatgaggagatcttggagaaattacgaagcatagtgagtgttgggcgatcctaagaagaaatatacacggtttgagaagattggacaaggtgcttcaggcaccgtgtacacagcaatggatgtggccacaggacaggaggtggccattaagcagatgaatcttcagcagcagcccaagaaagagctgattattaatgagatcctggtcatgagggaaaacaagaacccaaacattgtgaattacttggacagttacctcgtgggagatgagctgtgggttgttatggaatacttggctggaggctccttgacagatgtggtgacagaaacttgcatggatgaaggccaaattgcagctgtgtgccgtgagtgtctgcaggctctggagttcttgcattcgaaccaggtcattcacagagacatcaagagtgacaatattctgttgggaatggatggctctgtcaagctaactgactttggattctgtgcacagataaccccagagcagagcaaacggagcaccatggtaggaaccccatactggatggcaccagaggttgtgacacgaaaggcctatgggcccaaggttgacatctggtccctgggcatcatggccatcgaaatgattgaaggggagcctccatacctcaatgaaaaccctctgagagccttgtacctcattgccaccaatgggaccccagaacttcagaacccagagaagctgtcagctatcttccgggactttctgaaccgctgtctcgagatggatgtggagaagagaggttcagctaaagagctgctacagcatcaattcctgaagattgccaagcccctctccagcctcactccactgattgctgcagctaaggaggcaacaaagaacaatcactaaaaccacactcaccccagcctcattgtgccaagccttctgtgagataaatgcacatttcagaaattccaactcctgatgccctcttctccttgccttgcttctcccatttcctgatctagcactcctcaagactttgatccttggaaaccgtgtgtccagcattgaagagaactgcaactgaatgactaatcagatgatggccatttctaaataaggaatttcctcccaattcatggatatgagggtggtttatgattaagggtttatataaataaatgtttctagtcttccgtgtgtcaaaatcctcacctccttcataaccatctcccacaattaattcttgactatataaatttatggtttgataatattatcaatttgtaatcaattgagatttctttagtgcttgcttttctgtgactcaactgcccagacacctcattgtacttgaaaactggaacagcttgggaatgccatggggtttgataatctgccagggacatgaagaggctcagcttcctggaccatgactttggctcagctgatcctgacatgggagaacaaccacatttttctttgtgtgtgcttctagcagctgttcgggaggaccttgacccaatagtgttcccatgctgtttcttgtgaaatgctctcggctatgtagcagcttttgattccctgcataccctaggctgctgcccctatcctgtcccttgtttataacattgagaggttttctagggcacatactgagtgagagcagtgttgagaagtcggggaaaatggtgactacttttagagcaaggctgggcatcagcacctgtccagctctacttgtgtgatgtttcaggaactcagcccctttttctgcctaggataaggagctgaaagattaacttggatcttctaatggtccaaatcttttggtcacaataaagagtctccaaattagagactgcatgttagttctggatggatttggtggcctgacatgataccctgccagctgtgaggggaccccgtttttaagatgcatggccaagctctctgcaaatggaaatgcttacactgggtgttggggatgtttgctacctcctgctatttttgtggttttggttctcccactatggtaggacccctggccagcattgtggcttgtcatgtcagccccattgactaccttctcatgctctgaggtactactgcctctgcagcacaaatttctatttctgtcaataaaaggagatgaaaatattctattggagtatgcctttcttttttctcttcgttttttctttccttttctaattttttatatgaaataatgagtagtttcttcctgaaccatttgagagtggtaagttgcagatagaatgcccctttaccactatatacctgaatgtgtattctttctttttaacacttttattttaaatataaattaagagaaatgggccaaaaccatttgtattgtttaaagaataattataaacacacttgtatccaccaaatcaagaaatggaacactgacagtaagaaccttctctatcttgtccttcctttctcattatagcccccacctaagaggtaaccaccatcttgacttttatttaaataactttcttgcttttctgtatactttcatcacattcaggtgtgttccaatacaagtagattttagttcggccagtttttgaactttaaataaacatatcataatagataaaaact

SEQ ID NO: 329636 - DNA, 2512 bp, Homo sapiens
  misc_feature (37)..(37): n is a, c, g, or t
tatcgcccaacacacccagacgtatattaagcatgtnttaattctaacaaaataattttgttcttcctataactttattgccaaaaacatgtacaggaagaactaaaaaatataaaaaagacagacaatctatactatatgctggtgttggggataaatacgatgttatccccaacaccagtgattgctccacgcccagagcacacaaaatctgtatacacacggtctgtgattgaaccacttcctgtcactccaactcgggacgtggctacatctcccatttcacctactgaaaataacaccactccaccagatgctttgacccggaatactgagaagcagaagaagaagcctaaaatgtctgatgaggagatcttggagaaattacgaagcatagtgagtgttgggcgatcctaagaagaaatatacacggtttgagaagattggacaaggtgcttcaggcaccgtgtacacagcaatggatgtggccacaggacaggaggtggccattaagcagatgaatcttcagcagcagcccaagaaagagctgattattaatgagatcctggtcatgagggaaaacaagaacccaaacattgtgaattacttggacagttacctcgtgggagatgagctgtgggttgttatggaatacttggctggaggctccttgacagatgtggtgacagaaacttgcatggatgaaggccaaattgcagctgtgtgccgtgagtgtctgcaggctctggagttcttgcattcgaaccaggtcattcacagagacatcaagagtgacaatattctgttgggaatggatggctctgtcaagctaactgactttggattctgtgcacagataaccccagagcagagcaaacggagcaccatggtaggaaccccatactggatggcaccagaggttgtgacacgaaaggcctatgggcccaaggttgacatctggtccctgggcatcatggccatcgaaatgattgaaggggagcctccatacctcaatgaaaaccctctgagagccttgtacctcattgccaccaatgggaccccagaacttcagaacccagagaagctgtcagctatcttccgggactttctgaaccgctgtctcgagatggatgtggagaagagaggttcagctaaagagctgctacagcatcaattcctgaagattgccaagcccctctccagcctcactccactgattgctgcagctaaggaggcaacaaagaacaatcactaaaaccacactcaccccagcctcattgtgccaagccttctgtgagataaatgcacatttcagaaattccaactcctgatgccctcttctccttgccttgcttctcccatttcctgatctagcactcctcaagactttgatccttggaaaccgtgtgtccagcattgaagagaactgcaactgaatgactaatcagatgatggccatttctaaataaggaatttcctcccaattcatggatatgagggtggtttatgattaagggtttatataaataaatgtttctagtcttccgtgtgtcaaaatcctcacctccttcataaccatctcccacaattaattcttgactatataaatttatggtttgataatattatcaatttgtaatcaattgagatttctttagtgcttgcttttctgtgactcaactgcccagacacctcattgtacttgaaaactggaacagcttgggaatgccatggggtttgataatctgccagggacatgaagaggctcagcttcctggaccatgactttggctcagctgatcctgacatgggagaacaaccacatttttctttgtgtgtgcttctagcagctgttcgggaggaccttgacccaatagtgttcccatgctgtttcttgtgaaatgctctcggctatgtagcagcttttgattccctgcataccctaggctgctgcccctatcctgtcccttgtttataacattgagaggttttctagggcacatactgagtgagagcagtgttgagaagtcggggaaaatggtgactacttttagagcaaggctgggcatcagcacctgtccagctctacttgtgtgatgtttcaggaactcagcccctttttctgcctaggataaggagctgaaagattaacttggatcttctaatggtccaaatcttttggtcacaataaagagtctccaaattagagactgcatgttagttctggatggatttggtggcctgacatgataccctgccagctgtgaggggaccccgtttttaagatgcatggccaagctctctgcaaatggaaatgcttacactgggtgttggggatgtttgctacctcctgctatttttgtggttttggttctcccactatggtaggacccctggccagcattgtggcttgtcatgtcagccccattgactaccttctcatgctctgaggtactactgcctctgcagcacaaatttctatttctgtcaataaaaggagatgaaaatattc

SEQ ID NO: 329637 - DNA, 2755 bp, Homo sapiens
tttaacttggggaagcataaaatattacaaatgaaggggattcttacctaatagaattgtcttcaactaatttcttttgttacagaatatttcttttagcttggggaatacaggatatttcttttagcttggggaagcataaaatattacagatgaaggggattcttatctaatagaattgtctttaactaatttcttttgatagttgtctagcctctattgaatatctttagtgctgagactctcacttcttttgtttacagtgagagtaaggaaggccattttacccagaatgggtgggcctgggcacagaggaggagtaatatagattttgacataagagaaaggatgagtttattggggtttgctctgtggatgttctaacctcacatctaggagaggttcccctatgctaacaaaggctggtcttgccaaaattttgcactaataatgcaggtatacacacggtctgtgattgaaccacttcctgtcactccaactcgggacgtggctacatctcccatttcacctactgaaaataacaccactccaccagatgctttgacccggaatactgagaagcagaagaagaagcctaaaatgtctgatgaggagatcttggagaaattacgaagcatagtgagtgttgggcgatcctaagaagaaatatacacggtttgagaagattggacaaggtgcttcaggcaccgtgtacacagcaatggatgtggccacaggacaggaggtggccattaagcagatgaatcttcagcagcagcccaagaaagagctgattattaatgagatcctggtcatgagggaaaacaagaacccaaacattgtgaattacttggacagttacctcgtgggagatgagctgtgggttgttatggaatacttggctggaggctccttgacagatgtggtgacagaaacttgcatggatgaaggccaaattgcagctgtgtgccgtgagtgtctgcaggctctggagttcttgcattcgaaccaggtcattcacagagacatcaagagtgacaatattctgttgggaatggatggctctgtcaagctaactgactttggattctgtgcacagataaccccagagcagagcaaacggagcaccatggtaggaaccccatactggatggcaccagaggttgtgacacgaaaggcctatgggcccaaggttgacatctggtccctgggcatcatggccatcgaaatgattgaaggggagcctccatacctcaatgaaaaccctctgagagccttgtacctcattgccaccaatgggaccccagaacttcagaacccagagaagctgtcagctatcttccgggactttctgaaccgctgtctcgagatggatgtggagaagagaggttcagctaaagagctgctacagcatcaattcctgaagattgccaagcccctctccagcctcactccactgattgctgcagctaaggaggcaacaaagaacaatcactaaaaccacactcaccccagcctcattgtgccaagccttctgtgagataaatgcacatttcagaaattccaactcctgatgccctcttctccttgccttgcttctcccatttcctgatctagcactcctcaagactttgatccttggaaaccgtgtgtccagcattgaagagaactgcaactgaatgactaatcagatgatggccatttctaaataaggaatttcctcccaattcatggatatgagggtggtttatgattaagggtttatataaataaatgtttctagtcttccgtgtgtcaaaatcctcacctccttcataaccatctcccacaattaattcttgactatataaatttatggtttgataatattatcaatttgtaatcaattgagatttctttagtgcttgcttttctgtgactcaactgcccagacacctcattgtacttgaaaactggaacagcttgggaatgccatggggtttgataatctgccagggacatgaagaggctcagcttcctggaccatgactttggctcagctgatcctgacatgggagaacaaccacatttttctttgtgtgtgcttctagcagctgttcgggaggaccttgacccaatagtgttcccatgctgtttcttgtgaaatgctctcggctatgtagcagcttttgattccctgcataccctaggctgctgcccctatcctgtcccttgtttataacattgagaggttttctagggcacatactgagtgagagcagtgttgagaagtcggggaaaatggtgactacttttagagcaaggctgggcatcagcacctgtccagctctacttgtgtgatgtttcaggaactcagcccctttttctgcctaggataaggagctgaaagattaacttggatcttctaatggtccaaatcttttggtcacaataaagagtctccaaattagagactgcatgttagttctggatggatttggtggcctgacatgataccctgccagctgtgaggggaccccgtttttaagatgcatggccaagctctctgcaaatggaaatgcttacactgggtgttggggatgtttgctacctcctgctatttttgtggttttggttctcccactatggtaggacccctggccagcattgtggcttgtcatgtcagccccattgactaccttctcatgctctgaggtactactgcctctgcagcacaaatttctatttctgtcaataaaaggagatgaaaatattc

SEQ ID NO: 329638 - DNA, 2988 bp, Homo sapiens
gccacgaaggccacagacgccttcccccttggactctcattcccttttccacggagccccgcgctttcgtgagccccctcgaggaacctggtctccgcatccagttaccacctcctgcctcagaggccatctgagcccttcgcacctcgcccctcagtccccccttgcccccccgcggagatcgcctcgctccctcccgcccccccatcatcccttccctcgcagttcccctgtcctgaggggagccccgccacggcagcgacagcgggcaggagggagaaagtgaaggttgggcgacacttggccctcactcccggctaggcggcacccaccgccgggaggaggaggaggagccgagaggagctgagcgagcgcggaagtagctgctgctggtggtgacaatgtcaaataacggcctagacattcaagacaaacccccagcccctccgatgagaaataccagcactatgattggagccggcagcaaagatgctggaaccctaaaccatggttctaaacctctgcctccaaacccagaggagaagaaaaagaaggaccgattttaccgatccattttacctggagataaaacaaataaaaagaaagagaaagagcggccagagatttctctcccttcagattttgaacacacaattcatgtcggttttgatgctgtcacaggggagtttacgggaatgccagagcagtgggcccgcttgcttcagacatcaaatatcactaagtcggagcagaagaaaaacccgcaggctgttctggatgtgttggagttttacaactcgaagaagacatccaacagccagaaatacatgagctttacagataagtcagctgaggattacaattcttctaatgccttgaatgtgaaggctgtgtctgagactcctgcagtgccaccagtttcagaagatgaggatgatgatgatgatgatgttatccccaacaccagtgattgctccacgcccagagcacacaaaatctgtatacacacggtctgtgattgaaccacttcctgtcactccaactcgggacgtggctacatctcccatttcacctactgaaaataacaccactccaccagatgctttgacccggaatactgagaagcagaagaagaagcctaaaatgtctgatgaggagatcttggagaaattacgaagcatagtgagtgttgggcgatcctaagaagaaatatacacggtttgagaagattggacaaggtgcttcaggcaccgtgtacacagcaatggatgtggccacaggacaggaggtggccattaagcagatgaatcttcagcagcagcccaagaaagagctgattattaatgagatcctggtcatgagggaaaacaagaacccaaacattgtgaattacttggacagttacctcgtgggagatgagctgtgggttgttatggaatacttggctggaggctccttgacagatgtggtgacagaaacttgcatggatgaaggccaaattgcagctgtgtgccgtgagtgtctgcaggctctggagttcttgcattcgaaccaggtcattcacagagacatcaagagtgacaatattctgttgggaatggatggctctgtcaagctaactgactttggattctgtgcacagataaccccagagcagagcaaacggagcaccatggtaggaaccccatactggatggcaccagaggttgtgacacgaaaggcctatgggcccaaggttgacatctggtccctgggcatcatggccatcgaaatgattgaaggggagcctccatacctcaatgaaaaccctctgagagccttgtacctcattgccaccaatgggaccccagaacttcagaacccagagaagctgtcagctatcttccgggactttctgaaccgctgtctcgagatggatgtggagaagagaggttcagctaaagagctgctacagcatcaattcctgaagattgccaagcccctctccagcctcactccactgattgctgcagctaaggaggcaacaaagaacaatcactaaaaccacactcaccccagcctcattgtgccaagccttctgtgagataaatgcacatttcagaaattccaactcctgatgccctcttctccttgccttgcttctcccatttcctgatctagcactcctcaagactttgatccttggaaaccgtgtgtccagcattgaagagaactgcaactgaatgactaatcagatgatggccatttctaaataaggaatttcctcccaattcatggatatgagggtggtttatgattaagggtttatataaataaatgtttctagtcttccgtgtgtcaaaatcctcacctccttcataaccatctcccacaattaattcttgactatataaatttatggtttgataatattatcaatttgtaatcaattgagatttctttagtgcttgcttttctgtgactcaactgcccagacacctcattgtacttgaaaactggaacagcttgggaatgccatggggtttgataatctgccagggacatgaagaggctcagcttcctggaccatgactttggctcagctgatcctgacatgggagaacaaccacatttttctttgtgtgtgcttctagcagctgttcgggaggaccttgacccaatagtgttcccatgctgtttcttgtgaaatgctctcggctatgtagcagcttttgattccctgcataccctaggctgctgcccctatcctgtcccttgtttataacattgagaggttttctagggcacatactgagtgagagcagtgttgagaagtcggggaaaatggtgactacttttagagcaaggctgggcatcagcacctgtccagctctacttgtgtgatgtttcaggaactcaccccattgactaccttctcatgctctgaggtactactgcctctgcagcacaaatttctatttctgtcaataaaaggagatgaaaatattc

SEQ ID NO: 329639 - DNA, 1439 bp, Homo sapiens
  misc_feature (1367)..(1367): n is a, c, g, or t
  misc_feature (1430)..(1430): n is a, c, g, or t
gccacgaaggccacagacgccttcccccttggactctcattcccttttccacggagccccgcgctttcgtgagccccctcgaggaacctggtctccgcatccagttaccacctcctgcctcagaggccatctgagcccttcgcacctcgcccctcagtccccccttgcccccccgcggagatcgcctcgctccctcccgcccccccatcatcccttccctcgcagttcccctgtcctgaggggagccccgccacggcagcgacagcgggcaggagggagaaagtgaaggttgggcgacacttggccctcactcccggctaggcggcacccaccgccgggaggaggaggaggagccgagaggagctgagcgagcgcggaagtagctgctgctggtggtgacaatgtcaaataacggcctagacattcaagacaaacccccagcccctccgatgagaaataccagcactatgattggagccggcagcaaagatgctggaaccctaaaccatggttctaaacctctgcctccaaacccagaggagaagaaaaagaaggaccgattttaccgatccattttacctggagataaaacaaataaaaagaaagagaaagagcggccagagatttctctcccttcagattttgaacacacaattcatgtcggttttgatgctgtcacaggggagtttacgggaatgccagagcagtgggcccgcttgcttcagacatcaaatatcactaagtcggagcagaagaaaaacccgcaggctgttctggatgtgttggagttttacaactcgaagaagacatccaacagccagaaatacatgagctttacagataagtcagctgaggattacaattcttctaatgccttgaatgtgaaggctgtgtctgagactcctgcagtgccaccagtttcagaagatgaggatgatgatgatgatgatgttatccccaacaccagtgattgctccacgcccagagcacacaaaatctgtatacacacggtctgtgattgaaccacttcctgtcactccaactcgggacgtggctacatctcccatttcacctactgaaaataacaccactccaccagatgctttgacccggaatactgagaagcagaagaagaagcctaaaatgtctgatgaggagatcttggagaaattacgaagcatagtggtgatgttatcgcccaacacacctgtaatcccaactactgtggagtctgaggtggcagaatcgcttgaacccaagaagcggatgtttcagtgagcagagatggtgccactgcacccagcctgtgtgacaaagcaagaccccatctcagtcaatcaatcaatctcagtggttgaactaccctngatatggttcagctctgtatccccagccaaatctcatgtcaaattgcaattcccagtgttggngataacata

SEQ ID NO: 329640 - DNA, 1218 bp, Homo sapiens
gccacgaaggccacagacgccttcccccttggactctcattcccttttccacggagccccgcgctttcgtgagccccctcgaggaacctggtctccgcatccagttaccacctcctgcctcagaggccatctgagcccttcgcacctcgcccctcagtccccccttgcccccccgcggagatcgcctcgctccctcccgcccccccatcatcccttccctcgcagttcccctgtcctgaggggagccccgccacggcagcgacagcgggcaggagggagaaagtgaaggttgggcgacacttggccctcactcccggctaggcggcacccaccgccgggaggaggaggaggagccgagaggagctgagcgagcgcggaagtagctgctgctggtggtgacaatgtcaaataacggcctagacattcaagacaaacccccagcccctccgatgagaaataccagcactatgattggagccggcagcaaagatgctggaaccctaaaccatggttctaaacctctgcctccaaacccagaggagaagaaaaagaaggaccgattttaccgatccattttacctggagataaaacaaataaaaagaaagagaaagagcggccagagatttctctcccttcagattttgaacacacaattcatgtcggttttgatgctgtcacaggggagtttacgggaatgccagagcagtgggcccgcttgcttcagacatcaaatatcactaagtcggagcagaagaaaaacccgcaggctgttctggatgtgttggagttttacaactcgaagaagacatccaacagccagaaatacatgagctttacagataagtcagctgaggattacaattcttctaatgccttgaatgtgaaggctgtgtctgagactcctgcagtgccaccagtttcagaagatgaggatgatgatgatgatgatgttatccccaacaccagtgattgctccacgcccagagcacacaaaatctgtatacacacggtctgtgattgaaccacttcctgtcactccaactcgggacgtggctacatctcccatttcacctactgaaaataacaccactccaccagatgctttgacccggaatactgagaagcagaagaagaagcctaaaatgtctgatgaggagatcttggagaaattacgaagcatagtgagtgttgggcgatacgtccggggtcccaagagc

SEQ ID NO: 329641 - DNA, 1362 bp, Homo sapiens
gcgagagcgcgagcgtgctgcacctcgggagctggcggctgagctgccaggagcccagcccagctgaatcgagcggagccggtggagcaggggccttgtgggtacccggttgggcagggagaggtgcggctctgcgacggaaacaatcgccagagatgccggggctagccttccccaccaggttggtggcgatacaaaaattgaaactggcctcagttgttgctctcaaatgcagatcaaggaatgtggacgctcatgtggtaagtattgtagaaggaagcacaaggggctgtgataatgcagaagagggcacttttgatttagcaagacagtggcagagctaggacctaaacttaagtcttctctgaaggtgatatctattctcttataccctgttatctcctgagtttgtgtatacatacagtgtacaaagagttttcctatatcctcttttctgcctacttttggggctagactctaggtactgctgacatgaaaaaaagaacaatcccatgtggcaggtcactgtgccatagccaaacaaacactcattaccttggaagggaaacagacttcgtccctgttaacttctggctcgaggccacttgggtgactatatgctgagctccctctctgagtcatttgatctcttccttcctttcctccctgttccatttacttaaattcaatttctggcgggttgcagagtccagagaccagatgcagctaggctaggcattttcgcttccactggcctctatagaatagggatttaacacctcatagggttggtgaggatcagatgaaataatgaatgcgtgaaaatgctttgtaaagtgctatatagatatcattgtggttgttcccgagtgcattttcaagccgtgaaaaattgctcagatgctatagcctgaaagcctagggttgccactgacaggcaagaataggcactcagtatagacaccaagatttactagaccctttctctgccctcgaaaaactcacagactaataggagaggattgaacctcaatcctccgtgagtaaaggaaaaggagtggggtagatagggctttaggactggtaatttagttccatggtcaaacaaaaaccacgaagtatgtgctttatttaaggtcgaacagatagtaggtggcaattataaaagatacttttagtgacttcttatgatgtaacacaaaaaggggaagggggacttaaaagtagattgacttcagttcaaatcctggttctaccacttactgttacctgatttttaatctttttaagcttcatgtataaaaatggaagatattcatacctactttgaagggttattataaagcttaaaaataatcatat

SEQ ID NO: 329642 - DNA, 148 bp, Homo sapiens
tggggcggggtggatcactccaaacttgtgtggtgtggtaactggagctcactgatgaaaccatgaacagttctggctgaaagaaccccacagtacactgaggtctgttggcatcgccgccagcaccgccccggtccctttgtgcgcg

SEQ ID NO: 329643 - DNA, 432 bp, Homo sapiens
gcaatctaggaggatgggacatcaagtgcaaaagctgagagaagagcgagcaaggcatgctggggtctgcatgcagccagagggctggaaccctgatggtaaggagtggagggaagagccagcaggcgcataatcaggaggggcccctgagtaccagggtcaggacttggagctcatctgcaaggtagtggggagttatagaaggagatagagctggagggttgggcgcagtagcttatgcctgtactcccagcactttgggaaggtgaggcaggagaatctctgaagcccagcagcagtccaagaccagcctgtgcaacataatgagaccctgtctactcgaaaatcaaaatcaaaatagccaggcacagtggtgcaagtccatagtcacagctgctctaaagcctgagatggagattgcggtgttcagga

SEQ ID NO: 329644 - DNA, 472 bp, Homo sapiens
caccgtttagcacgtggtatggagagatatgggcgatgttctcaggctgcttcgagcaggattaggggtggtgtgggaacctagagcgagcaaggcatgctggggtctgcatgcagccagagggctggaaccctgatggtaaggagtggagggaagagccagcaggcgcataatcaggaggggcccctgagtaccagggtcaggacttggagctcatctgcaaggtagtggggagttatagaaggagatagagctggagggttgggcgcagtagcttatgcctgtactcccagcactttgggaaggtgaggcaggagaatctctgaagcccagcagcagtccaagaccagcctgtgcaacataatgagaccctgtctactcgaaaatcaaaatcaaaatagccaggcacagtggtgcaagtccatagtcacagctgctctaaagcctgagatggagattgcggtgttcagga

SEQ ID NO: 329645 - DNA, 407 bp, Homo sapiens
caccacctgagtcctgcatgccacttctgtcctccaactaagagcggtggtgtagtttttaacagttcttacgtgtcctctgagggctatttcagaatcttctagactacagagagaaaacctgagatttccgttgttcacctaagggtctgtagagaatcttttttacatgaaggcccagattcttaacaaggtattcatgcctactaacgtacgagaacttcaggtttaggccactgatatcagccttccaatttccaccttaatagtgtgctaagtggagaatttcgagctcataaataaaagtatcgccaacccgactcaggtgaaagagcggatggaggtgtgtgagaatcaccagcactggcacacggtagtcaaagaggtaagagaactcggggggaaag

SEQ ID NO: 329646 - DNA, 3483 bp, Homo sapiens
caccacctgagtcctgcatgccacttctgtcctccaactaagagcggtggtgtagtttttaacagttcttacgtgtcctctgagggctatttcagaatcttctagactacagagagaaaacctgagatttccgttgttcacctaagggtctgtagagaatcttttttacatgaaggcccagattcttaacaaggtattcatgcctactaacgtacgagaacttcaggtttaggccactgatatcagccttccaatttccaccttaatagtgtgctaagtggagaatttcgagctcataaataaaagtatcgccaacccgactcaggtgaaagagcggatggaggtgtgtgagaatcaccagcactggcacacggtagtcaaagaggcatgtctgactcagggaatgaccttatatagctacggcatgctgctcccatgtggggtagaccagttccatggcactgaatatgtgtgctgccctcagacaaagattattggatctgtgtcaaaagaagaggaagaggaagatgaagaggaagaggaagaggaagatgaagaggaagactatgatgtttataaaagtgaatttcctactgaagcagatctggaagacttcacagaagcagctgtggatgaggatgatgaggatgaggaagaaggggaggaagtggtggaggaccgagattactactatgacaccttcaaaggagatgactacaatgaggagaatcctactgaacccggcagcgacggcaccatgtcagacaaggaaattactcatgatgtcaaagctgtctgctcccaggaggcgatgacggggccctgccgggccgtgatgcctcgttggtacttcgacctctccaagggaaagtgcgtgcgctttatatatggtggctgcggcggcaacaggaacaattttgagtctgaggattattgtatggctgtgtgtaaagcgatgattcctccaactcctctgccaaccaatgatgttgatgtgtatttcgagacctctgcagatgataatgagcatgctcgcttccagaaggctaaggagcagctggagattcggcaccgcaaccgaatggacagggtaaagaaggaatgggaagaggcagagcttcaagctaagaacctccccaaagcagagaggcagactctgattcagcacttccaagccatggttaaagctttagagaaggaagcagccagtgagaagcagcagctggtggagacccacctggcccgagtggaagctatgctgaatgaccgccgtcggatggctctggagaactacctggctgccttgcagtctgacccgccacggcctcatcgcattctccaggccttacggcgttatgtccgtgctgagaacaaagatcgcttacataccatccgtcattaccagcatgtgttggctgttgacccagaaaaggcggcccagatgaaatcccaggtgatgacacatctccacgtgattgaagaaaggaggaaccaaagcctctctctgctctacaaagtaccttatgtagcccaagaaattcaagaggaaattgatgagctccttcaggagcagcgtgcagatatggaccagttcactgcctcaatctcagagacccctgtggacgtccgggtgagctctgaggagagtgaggagatcccaccgttccaccccttccaccccttcccagccctacctgagaacgaaggatctggagtgggagagcaggatgggggactgatcggtgccgaagagaaagtgattaacagtaagaataaagtggatgaaaacatggtcattgacgagactctggatgttaaggaaatgattttcaatgccgagagagttggaggcctcgaggaagagcgggaatccgtgggcccactgcgggaggacttcagtctgagtagcagtgctctcattggcctgctggtcatcgcagtggccattgccacggtcatcgtcatcagcctggtgatgctgaggaagaggcagtatggcaccatcagccacgggatcgtggaggttgatccaatgctcaccccagaagagcgtcacctgaacaagatgcagaaccatggctatgagaaccccacctacaaatacctggagcagatgcagatttaggtggcagggagcgcggcagccctggcggagggatgcaggtgggccggaagatcccacgattccgatcgactgccaagcagcagccgctgccaggggctgcgtctgacatcctgacctcctggactgtaggactatataaagtactactgtagaactgcaatttccattcttttaaatgggtgaaaaatggtaatataacaatatatgatatataaaccttaaatgaaaaaaatgatctattgcagatatttgatgtagttttcttttttaaattaatcagaaaccccacttccattgtattgtctgacacatgctctcaatatataataaatgggaaatgtcgattttcaataatagacttatatgcaggctgtcgttccggttatgttgtgtaagtcaactcttcagcctcattcactgtcctggcttttatttaaagaaaaaaaaggcagtattccctttttaaatgagctttcaggaagttgctgagaaatggggtggaatagggaactgtaatggccactgaagcacgtgagagaccctcgcaaaatgatgtgaaaggaccagtttcttgaagtccagtgtttccacggctggatacctgtgtgtctccataaaagtcctgtcaccaaggacgttaaaggcattttattccagcgtcttctagagagcttagtgtatacagatgagggtgtccgctgctgctttccttcggaatccagtgcttccacagagattagcctgtagcttatatttgacattcttcactgtctgttgtttacctaccgtagctttttaccgttcacttccccttccaactatgtccagatgtgcaggctcctcctctctggactttctccaaaggcactgaccctcggcctctactttgtcccctcacctccaccccctcctgtcaccggccttgtgacattcactcagagaagaccacaccaaggaaggcggccgctggcccaggagagaacacggggaggtttgtttgtgtgaaaggaaagtagtccaggctgtccctgaaactgagtctgtggacactgtggaaagctttgaacaattgtgttttcgtcacaggagtctttgtaatgcttgtacagttgatgtcgatgctcactgcttctgctttttctttctttttattttaaatctgaaggttctggtaacctgtggtgtatttttattttcctgtgactgtttttgttttgtttttttcctttttcctcccctttgaccctattcatgtctctacccactatgcacagattaaacttcacctacaaactccttaatatgatctgtggagaatgtacacagtttaaacacatcaataaatactttaacttcca

SEQ ID NO: 329647 - DNA, 3315 bp, Homo sapiens
caccacctgagtcctgcatgccacttctgtcctccaactaagagcggtggtgtagtttttaacagttcttacgtgtcctctgagggctatttcagaatcttctagactacagagagaaaacctgagatttccgttgttcacctaagggtctgtagagaatcttttttacatgaaggcccagattcttaacaaggtattcatgcctactaacgtacgagaacttcaggtttaggccactgatatcagccttccaatttccaccttaatagtgtgctaagtggagaatttcgagctcataaataaaagtatcgccaacccgactcaggtgaaagagcggatggaggtgtgtgagaatcaccagcactggcacacggtagtcaaagaggcatgtctgactcagggaatgaccttatatagctacggcatgctgctcccatgtggggtagaccagttccatggcactgaatatgtgtgctgccctcagacaaagattattggatctgtgtcaaaagaagaggaagaggaagatgaagaggaagaggaagaggaagatgaagaggaagactatgatgtttataaaagtgaatttcctactgaagcagatctggaagacttcacagaagcagctgtggatgaggatgatgaggatgaggaagaaggggaggaagtggtggaggaccgagattactactatgacaccttcaaaggagatgactacaatgaggagaatcctactgaacccggcagcgacggcaccatgtcagacaaggaaattactcatgatgtcaaagttcctccaactcctctgccaaccaatgatgttgatgtgtatttcgagacctctgcagatgataatgagcatgctcgcttccagaaggctaaggagcagctggagattcggcaccgcaaccgaatggacagggtaaagaaggaatgggaagaggcagagcttcaagctaagaacctccccaaagcagagaggcagactctgattcagcacttccaagccatggttaaagctttagagaaggaagcagccagtgagaagcagcagctggtggagacccacctggcccgagtggaagctatgctgaatgaccgccgtcggatggctctggagaactacctggctgccttgcagtctgacccgccacggcctcatcgcattctccaggccttacggcgttatgtccgtgctgagaacaaagatcgcttacataccatccgtcattaccagcatgtgttggctgttgacccagaaaaggcggcccagatgaaatcccaggtgatgacacatctccacgtgattgaagaaaggaggaaccaaagcctctctctgctctacaaagtaccttatgtagcccaagaaattcaagaggaaattgatgagctccttcaggagcagcgtgcagatatggaccagttcactgcctcaatctcagagacccctgtggacgtccgggtgagctctgaggagagtgaggagatcccaccgttccaccccttccaccccttcccagccctacctgagaacgaaggatctggagtgggagagcaggatgggggactgatcggtgccgaagagaaagtgattaacagtaagaataaagtggatgaaaacatggtcattgacgagactctggatgttaaggaaatgattttcaatgccgagagagttggaggcctcgaggaagagcgggaatccgtgggcccactgcgggaggacttcagtctgagtagcagtgctctcattggcctgctggtcatcgcagtggccattgccacggtcatcgtcatcagcctggtgatgctgaggaagaggcagtatggcaccatcagccacgggatcgtggaggttgatccaatgctcaccccagaagagcgtcacctgaacaagatgcagaaccatggctatgagaaccccacctacaaatacctggagcagatgcagatttaggtggcagggagcgcggcagccctggcggagggatgcaggtgggccggaagatcccacgattccgatcgactgccaagcagcagccgctgccaggggctgcgtctgacatcctgacctcctggactgtaggactatataaagtactactgtagaactgcaatttccattcttttaaatgggtgaaaaatggtaatataacaatatatgatatataaaccttaaatgaaaaaaatgatctattgcagatatttgatgtagttttcttttttaaattaatcagaaaccccacttccattgtattgtctgacacatgctctcaatatataataaatgggaaatgtcgattttcaataatagacttatatgcaggctgtcgttccggttatgttgtgtaagtcaactcttcagcctcattcactgtcctggcttttatttaaagaaaaaaaaggcagtattccctttttaaatgagctttcaggaagttgctgagaaatggggtggaatagggaactgtaatggccactgaagcacgtgagagaccctcgcaaaatgatgtgaaaggaccagtttcttgaagtccagtgtttccacggctggatacctgtgtgtctccataaaagtcctgtcaccaaggacgttaaaggcattttattccagcgtcttctagagagcttagtgtatacagatgagggtgtccgctgctgctttccttcggaatccagtgcttccacagagattagcctgtagcttatatttgacattcttcactgtctgttgtttacctaccgtagctttttaccgttcacttccccttccaactatgtccagatgtgcaggctcctcctctctggactttctccaaaggcactgaccctcggcctctactttgtcccctcacctccaccccctcctgtcaccggccttgtgacattcactcagagaagaccacaccaaggaaggcggccgctggcccaggagagaacacggggaggtttgtttgtgtgaaaggaaagtagtccaggctgtccctgaaactgagtctgtggacactgtggaaagctttgaacaattgtgttttcgtcacaggagtctttgtaatgcttgtacagttgatgtcgatgctcactgcttctgctttttctttctttttattttaaatctgaaggttctggtaacctgtggtgtatttttattttcctgtgactgtttttgttttgtttttttcctttttcctcccctttgaccctattcatgtctctacccactatgcacagattaaacttcacctacaaactccttaatatgatctgtggagaatgtacacagtttaaacacatcaataaatactttaacttcca

SEQ ID NO: 329648 - DNA, 3629 bp, Homo sapiens
  misc_feature (591)..(591): n is a, c, g, or t
caccacctgagtcctgcatgccacttctgtcctccaactaagagcggtggtgtagtttttaacagttcttacgtgtcctctgagggctatttcagaatcttctagactacagagagaaaacctgagatttccgttgttcacctaagggtctgtagagaatcttttttacatgaaggcccagattcttaacaaggtattcatgcctactaacgtacgagaacttcaggtttaggccactgatatcagccttccaatttccaccttaatagtgtgctaagtggagaatttcgagctcataaataaaagtatcgccaacccgactcaggtgaaagagcggatggaggtgtgtgagaatcaccagcactggcacacggtagtcaaagaggcatgtctgactcagggaatgaccttatatagctacggcatgctgctcccatgtggggtagaccagttccatggcactgaatatgtgtgctgccctcagacaaagattattggatctgtgtcaaaagaagaggaagaggaagatgaagaggaagaggaagaggaagatgaagaggaagactatgatgtttataaaagtgaatttcntactgaagcagatctggaagacttcacagaagcagctgtggatgaggatgatgaggatgaggaagaaggggaggaagtggtggaggaccccgggaacaagtatgacacatccttacacatccgtaaggataaacgagtgaatttcctactgaagcagatctggaagacttcacagaagcagctgtggatgaggatgatgaggatgaggaagaaggggaggaagtggtggaggaccgagattactactatgacaccttcaaaggagatgactacaatgaggagaatcctactgaacccggcagcgacggcaccatgtcagacaaggaaattactcatgatgtcaaagctgtctgctcccaggaggcgatgacggggccctgccgggccgtgatgcctcgttggtacttcgacctctccaagggaaagtgcgtgcgctttatatatggtggctgcggcggcaacaggaacaattttgagtctgaggattattgtatggctgtgtgtaaagcgatgattcctccaactcctctgccaaccaatgatgttgatgtgtatttcgagacctctgcagatgataatgagcatgctcgcttccagaaggctaaggagcagctggagattcggcaccgcaaccgaatggacagggtaaagaaggaatgggaagaggcagagcttcaagctaagaacctccccaaagcagagaggcagactctgattcagcacttccaagccatggttaaagctttagagaaggaagcagccagtgagaagcagcagctggtggagacccacctggcccgagtggaagctatgctgaatgaccgccgtcggatggctctggagaactacctggctgccttgcagtctgacccgccacggcctcatcgcattctccaggccttacggcgttatgtccgtgctgagaacaaagatcgcttacataccatccgtcattaccagcatgtgttggctgttgacccagaaaaggcggcccagatgaaatcccaggtgatgacacatctccacgtgattgaagaaaggaggaaccaaagcctctctctgctctacaaagtaccttatgtagcccaagaaattcaagaggaaattgatgagctccttcaggagcagcgtgcagatatggaccagttcactgcctcaatctcagagacccctgtggacgtccgggtgagctctgaggagagtgaggagatcccaccgttccaccccttccaccccttcccagccctacctgagaacgaaggatctggagtgggagagcaggatgggggactgatcggtgccgaagagaaagtgattaacagtaagaataaagtggatgaaaacatggtcattgacgagactctggatgttaaggaaatgattttcaatgccgagagagttggaggcctcgaggaagagcgggaatccgtgggcccactgcgggaggacttcagtctgagtagcagtgctctcattggcctgctggtcatcgcagtggccattgccacggtcatcgtcatcagcctggtgatgctgaggaagaggcagtatggcaccatcagccacgggatcgtggaggttgatccaatgctcaccccagaagagcgtcacctgaacaagatgcagaaccatggctatgagaaccccacctacaaatacctggagcagatgcagatttaggtggcagggagcgcggcagccctggcggagggatgcaggtgggccggaagatcccacgattccgatcgactgccaagcagcagccgctgccaggggctgcgtctgacatcctgacctcctggactgtaggactatataaagtactactgtagaactgcaatttccattcttttaaatgggtgaaaaatggtaatataacaatatatgatatataaaccttaaatgaaaaaaatgatctattgcagatatttgatgtagttttcttttttaaattaatcagaaaccccacttccattgtattgtctgacacatgctctcaatatataataaatgggaaatgtcgattttcaataatagacttatatgcaggctgtcgttccggttatgttgtgtaagtcaactcttcagcctcattcactgtcctggcttttatttaaagaaaaaaaaggcagtattccctttttaaatgagctttcaggaagttgctgagaaatggggtggaatagggaactgtaatggccactgaagcacgtgagagaccctcgcaaaatgatgtgaaaggaccagtttcttgaagtccagtgtttccacggctggatacctgtgtgtctccataaaagtcctgtcaccaaggacgttaaaggcattttattccagcgtcttctagagagcttagtgtatacagatgagggtgtccgctgctgctttccttcggaatccagtgcttccacagagattagcctgtagcttatatttgacattcttcactgtctgttgtttacctaccgtagctttttaccgttcacttccccttccaactatgtccagatgtgcaggctcctcctctctggactttctccaaaggcactgaccctcggcctctactttgtcccctcacctccaccccctcctgtcaccggccttgtgacattcactcagagaagaccacaccaaggaaggcggccgctggcccaggagagaacacggggaggtttgtttgtgtgaaaggaaagtagtccaggctgtccctgaaactgagtctgtggacactgtggaaagctttgaacaattgtgttttcgtcacaggagtctttgtaatgcttgtacagttgatgtcgatgctcactgcttctgctttttctttctttttattttaaatctgaaggttctggtaacctgtggtgtatttttattttcctgtgactgtttttgttttgtttttttcctttttcctcccctttgaccctattcatgtctctacccactatgcacagattaaacttcacctacaaactccttaatatgatctgtggagaatgtacacagtttaaacacatcaataaatactttaacttcca

SEQ ID NO: 329649 - DNA, 3351 bp, Homo sapiens
caccacctgagtcctgcatgccacttctgtcctccaactaagagcggtggtgtagtttttaacagttcttacgtgtcctctgagggctatttcagaatcttctagactacagagagaaaacctgagatttccgttgttcacctaagggtctgtagagaatcttttttacatgaaggcccagattcttaacaaggtattcatgcctactaacgtacgagaacttcaggtttaggccactgatatcagccttccaatttccaccttaatagtgtgctaagtggagaatttcgagctcataaataaaagtatcgccaacccgactcaggtgaaagagcggatggaggtgtgtgagaatcaccagcactggcacacggtagtcaaagaggcatgtctgactcagggaatgaccttatatagctacggcatgctgctcccatgtggggtagaccagttccatggcactgaatatgtgtgctgccctcagacaaagattattggatctgtgtcaaaagaagaggaagaggaagatgaagaggaagaggaagaggaagatgaagaggaagactatgatgtttataaaagtgaatttcctactgaagcagatctggaagacttcacagaagcagctgtggatgaggatgatgaggatgaggaagaaggggaggaagtggtggaggaccgagattactactatgacaccttcaaaggagatgactacaatgaggagaatcctactgaacccggcagcgacggcaccatgtcagacaaggaaattactcatgatgtcaaagttcctccaactcctctgccaaccaatgatgttgatgtgtatttcgagacctctgcagatgataatgagcatgctcgcttccagaaggctaaggagcagctggagattcggcaccgcaaccgaatggacagggtaaagaaggaatgggaagaggcagagcttcaagctaagaacctccccaaagcagagaggcagactctgattcagcacttccaagccatggttaaagctttagagaaggaagcagccagtgagaagcagcagctggtggagacccacctggcccgagtggaagctatgctgaatgaccgccgtcggatggctctggagaactacctggctgccttgcagtctgacccgccacggcctcatcgcattctccaggccttacggcgttatgtccgtgctgagaacaaagatcgcttacataccatccgtcattaccagcatgtgttggctgttgacccagaaaaggcggcccagatgaaatcccaggtgatgacacatctccacgtgattgaagaaaggaggaaccaaagcctctctctgctctacaaagtaccttatgtagcccaagaaattcaagaggaaattgatgagctccttcaggagcagcgtgcagatatggaccagttcactgcctcaatctcagagacccctgtggacgtccgggtgagctctgaggagagtgaggagatcccaccgttccaccccttccaccccttcccagccctacctgagaacgaagacactcagccggagttgtaccacccaatgaaaaaaggatctggagtgggagagcaggatgggggactgatcggtgccgaagagaaagtgattaacagtaagaataaagtggatgaaaacatggtcattgacgagactctggatgttaaggaaatgattttcaatgccgagagagttggaggcctcgaggaagagcgggaatccgtgggcccactgcgggaggacttcagtctgagtagcagtgctctcattggcctgctggtcatcgcagtggccattgccacggtcatcgtcatcagcctggtgatgctgaggaagaggcagtatggcaccatcagccacgggatcgtggaggttgatccaatgctcaccccagaagagcgtcacctgaacaagatgcagaaccatggctatgagaaccccacctacaaatacctggagcagatgcagatttaggtggcagggagcgcggcagccctggcggagggatgcaggtgggccggaagatcccacgattccgatcgactgccaagcagcagccgctgccaggggctgcgtctgacatcctgacctcctggactgtaggactatataaagtactactgtagaactgcaatttccattcttttaaatgggtgaaaaatggtaatataacaatatatgatatataaaccttaaatgaaaaaaatgatctattgcagatatttgatgtagttttcttttttaaattaatcagaaaccccacttccattgtattgtctgacacatgctctcaatatataataaatgggaaatgtcgattttcaataatagacttatatgcaggctgtcgttccggttatgttgtgtaagtcaactcttcagcctcattcactgtcctggcttttatttaaagaaaaaaaaggcagtattccctttttaaatgagctttcaggaagttgctgagaaatggggtggaatagggaactgtaatggccactgaagcacgtgagagaccctcgcaaaatgatgtgaaaggaccagtttcttgaagtccagtgtttccacggctggatacctgtgtgtctccataaaagtcctgtcaccaaggacgttaaaggcattttattccagcgtcttctagagagcttagtgtatacagatgagggtgtccgctgctgctttccttcggaatccagtgcttccacagagattagcctgtagcttatatttgacattcttcactgtctgttgtttacctaccgtagctttttaccgttcacttccccttccaactatgtccagatgtgcaggctcctcctctctggactttctccaaaggcactgaccctcggcctctactttgtcccctcacctccaccccctcctgtcaccggccttgtgacattcactcagagaagaccacaccaaggaaggcggccgctggcccaggagagaacacggggaggtttgtttgtgtgaaaggaaagtagtccaggctgtccctgaaactgagtctgtggacactgtggaaagctttgaacaattgtgttttcgtcacaggagtctttgtaatgcttgtacagttgatgtcgatgctcactgcttctgctttttctttctttttattttaaatctgaaggttctggtaacctgtggtgtatttttattttcctgtgactgtttttgttttgtttttttcctttttcctcccctttgaccctattcatgtctctacccactatgcacagattaaacttcacctacaaactccttaatatgatctgtggagaatgtacacagtttaaacacatcaataaatactttaacttcca

SEQ ID NO: 329650 - DNA, 3399 bp, Homo sapiens
caccacctgagtcctgcatgccacttctgtcctccaactaagagcggtggtgtagtttttaacagttcttacgtgtcctctgagggctatttcagaatcttctagactacagagagaaaacctgagatttccgttgttcacctaagggtctgtagagaatcttttttacatgaaggcccagattcttaacaaggtattcatgcctactaacgtacgagaacttcaggtttaggccactgatatcagccttccaatttccaccttaatagtgtgctaagtggagaatttcgagctcataaataaaagtatcgccaacccgactcaggtgaaagagcggatggaggtgtgtgagaatcaccagcactggcacacggtagtcaaagaggcatgtctgactcagggaatgaccttatatagctacggcatgctgctcccatgtggggtagaccagttccatggcactgaatatgtgtgctgccctcagacaaagattattggatctgtgtcaaaagaagaggaagaggaagatgaagaggaagaggaagaggaagatgaagaggaagactatgatgtttataaaagtgaatttcctactgaagcagatctggaagacttcacagaagcagctgtggatgaggatgatgaggatgaggaagaaggggaggaagtggtggaggaccgagattactactatgacaccttcaaaggagatgactacaatgaggagaatcctactgaacccggcagcgacggcaccatgtcagacaaggaaattactcatgatgtcaaagttcctccaactcctctgccaaccaatgatgttgatgtgtatttcgagacctctgcagatgataatgagcatgctcgcttccagaaggctaaggagcagctggagattcggcaccgcaaccgaatggacagggtaaagaaggaatgggaagaggcagagcttcaagctaagaacctccccaaagcagagaggcagactctgattcagcacttccaagccatggttaaagctttagagaaggaagcagccagtgagaagcagcagctggtggagacccacctggcccgagtggaagctatgctgaatgaccgccgtcggatggctctggagaactacctggctgccttgcagtctgacccgccacggcctcatcgcattctccaggccttacggcgttatgtccgtgctgagaacaaagatcgcttacataccatccgtcattaccagcatgtgttggctgttgacccagaaaaggcggcccagatgaaatcccaggtgatgacacatctccacgtgattgaagaaaggaggaaccaaagcctctctctgctctacaaagtaccttatgtagcccaagaaattcaagaggaaattgatgagctccttcaggagcagcgtgcagatatggaccagttcactgcctcaatctcagagacccctgtggacgtccgggtgagctctgaggagagtgaggagatcccaccgttccaccccttccaccccttcccagccctacctgagaacgaagacactcagccggagttgtaccacccaatgaaaaaagcccatgtgatttcattacctgagttgtcggtgtcacgggatcccccaggatctggagtgggagagcaggatgggggactgatcggtgccgaagagaaagtgattaacagtaagaataaagtggatgaaaacatggtcattgacgagactctggatgttaaggaaatgattttcaatgccgagagagttggaggcctcgaggaagagcgggaatccgtgggcccactgcgggaggacttcagtctgagtagcagtgctctcattggcctgctggtcatcgcagtggccattgccacggtcatcgtcatcagcctggtgatgctgaggaagaggcagtatggcaccatcagccacgggatcgtggaggttgatccaatgctcaccccagaagagcgtcacctgaacaagatgcagaaccatggctatgagaaccccacctacaaatacctggagcagatgcagatttaggtggcagggagcgcggcagccctggcggagggatgcaggtgggccggaagatcccacgattccgatcgactgccaagcagcagccgctgccaggggctgcgtctgacatcctgacctcctggactgtaggactatataaagtactactgtagaactgcaatttccattcttttaaatgggtgaaaaatggtaatataacaatatatgatatataaaccttaaatgaaaaaaatgatctattgcagatatttgatgtagttttcttttttaaattaatcagaaaccccacttccattgtattgtctgacacatgctctcaatatataataaatgggaaatgtcgattttcaataatagacttatatgcaggctgtcgttccggttatgttgtgtaagtcaactcttcagcctcattcactgtcctggcttttatttaaagaaaaaaaaggcagtattccctttttaaatgagctttcaggaagttgctgagaaatggggtggaatagggaactgtaatggccactgaagcacgtgagagaccctcgcaaaatgatgtgaaaggaccagtttcttgaagtccagtgtttccacggctggatacctgtgtgtctccataaaagtcctgtcaccaaggacgttaaaggcattttattccagcgtcttctagagagcttagtgtatacagatgagggtgtccgctgctgctttccttcggaatccagtgcttccacagagattagcctgtagcttatatttgacattcttcactgtctgttgtttacctaccgtagctttttaccgttcacttccccttccaactatgtccagatgtgcaggctcctcctctctggactttctccaaaggcactgaccctcggcctctactttgtcccctcacctccaccccctcctgtcaccggccttgtgacattcactcagagaagaccacaccaaggaaggcggccgctggcccaggagagaacacggggaggtttgtttgtgtgaaaggaaagtagtccaggctgtccctgaaactgagtctgtggacactgtggaaagctttgaacaattgtgttttcgtcacaggagtctttgtaatgcttgtacagttgatgtcgatgctcactgcttctgctttttctttctttttattttaaatctgaaggttctggtaacctgtggtgtatttttattttcctgtgactgtttttgttttgtttttttcctttttcctcccctttgaccctattcatgtctctacccactatgcacagattaaacttcacctacaaactccttaatatgatctgtggagaatgtacacagtttaaacacatcaataaatactttaacttcca

SEQ ID NO: 329651 - DNA, 3289 bp, Homo sapiens
caccacctgagtcctgcatgccacttctgtcctccaactaagagcggtggtgtagtttttaacagttcttacgtgtcctctgagggctatttcagaatcttctagactacagagagaaaacctgagatttccgttgttcacctaagggtctgtagagaatcttttttacatgaaggcccagattcttaacaaggtattcatgcctactaacgtacgagaacttcaggtttaggccactgatatcagccttccaatttccaccttaatagtgtgctaagtggagaatttcgagctcataaataaaagtatcgccaacccgactcaggtgaaagagcggatggaggtgtgtgagaatcaccagcactggcacacggtagtcaaagaggcatgtctgactcagggaatgaccttatatagctacggcatgctgctcccatgtggggtagaccagttccatggcactgaatatgtgtgctgccctcagacaaagattattggatctgtgtcaaaagaagaggaagaggaagatgaagaggaagaggaagaggaagatgaagaggaagactatgatgtttataaaagtgaatttcctactgaagcagatctggaagacttcacagaagcagctgtggatgaggatgatgaggatgaggaagaaggggaggaagtggtggaggaccgagattactactatgacaccttcaaaggagatgactacaatgaggagaatcctactgaacccggcagcgacggcaccatgtcagacaaggaaattactcatgatgtcaaagttcctccaactcctctgccaaccaatgatgttgatgtgtatttcgagacctctgcagatgataatgagcatgctcgcttccagaaggctaaggagcagctggagattcggcaccgcaaccgaatggacagggtaaagaaggaatgggaagaggcagagcttcaagctaagaacctccccaaagcagagaggcagactctgattcagcacttccaagccatggttaaagctttagagaaggaagcagccagtgagaagcagcagctggtggagacccacctggcccgagtggaagctatgctgaatgaccgccgtcggatggctctggagaactacctggctgccttgcagtctgacccgccacggcctcatcgcattctccaggccttacggcgttatgtccgtgctgagaacaaagatcgcttacataccatccgtcattaccagcatgtgttggctgttgacccagaaaaggcggcccagatgaaatcccaggtgatgacacatctccacgtgattgaagaaaggaggaaccaaagcctctctctgctctacaaagtaccttatgtagcccaagaaattcaagaggaaattgatgagctccttcaggagcagcgtgcagatatggaccagttcactgcctcaatctcagagacccctgtggacgtccgggtgagctctgaggagagtgaggagatcccaccgttccaccccttccaccccttcccagccctacctgagaacgaaggatctggagtgggagagcaggatgggggactgatcggtgccgaagagaaagtgattaacagtcattgacgagactctggatgttaaggaaatgattttcaatgccgagagagttggaggcctcgaggaagagcgggaatccgtgggcccactgcgggaggacttcagtctgagtagcagtgctctcattggcctgctggtcatcgcagtggccattgccacggtcatcgtcatcagcctggtgatgctgaggaagaggcagtatggcaccatcagccacgggatcgtggaggttgatccaatgctcaccccagaagagcgtcacctgaacaagatgcagaaccatggctatgagaaccccacctacaaatacctggagcagatgcagatttaggtggcagggagcgcggcagccctggcggagggatgcaggtgggccggaagatcccacgattccgatcgactgccaagcagcagccgctgccaggggctgcgtctgacatcctgacctcctggactgtaggactatataaagtactactgtagaactgcaatttccattcttttaaatgggtgaaaaatggtaatataacaatatatgatatataaaccttaaatgaaaaaaatgatctattgcagatatttgatgtagttttcttttttaaattaatcagaaaccccacttccattgtattgtctgacacatgctctcaatatataataaatgggaaatgtcgattttcaataatagacttatatgcaggctgtcgttccggttatgttgtgtaagtcaactcttcagcctcattcactgtcctggcttttatttaaagaaaaaaaaggcagtattccctttttaaatgagctttcaggaagttgctgagaaatggggtggaatagggaactgtaatggccactgaagcacgtgagagaccctcgcaaaatgatgtgaaaggaccagtttcttgaagtccagtgtttccacggctggatacctgtgtgtctccataaaagtcctgtcaccaaggacgttaaaggcattttattccagcgtcttctagagagcttagtgtatacagatgagggtgtccgctgctgctttccttcggaatccagtgcttccacagagattagcctgtagcttatatttgacattcttcactgtctgttgtttacctaccgtagctttttaccgttcacttccccttccaactatgtccagatgtgcaggctcctcctctctggactttctccaaaggcactgaccctcggcctctactttgtcccctcacctccaccccctcctgtcaccggccttgtgacattcactcagagaagaccacaccaaggaaggcggccgctggcccaggagagaacacggggaggtttgtttgtgtgaaaggaaagtagtccaggctgtccctgaaactgagtctgtggacactgtggaaagctttgaacaattgtgttttcgtcacaggagtctttgtaatgcttgtacagttgatgtcgatgctcactgcttctgctttttctttctttttattttaaatctgaaggttctggtaacctgtggtgtatttttattttcctgtgactgtttttgttttgtttttttcctttttcctcccctttgaccctattcatgtctctacccactatgcacagattaaacttcacctacaaactccttaatatgatctgtggagaatgtacacagtttaaacacatcaataaatactttaacttcca

SEQ ID NO: 329652 - DNA, 3162 bp, Homo sapiens
caccacctgagtcctgcatgccacttctgtcctccaactaagagcggtggtgtagtttttaacagttcttacgtgtcctctgagggctatttcagaatcttctagactacagagagaaaacctgagatttccgttgttcacctaagggtctgtagagaatcttttttacatgaaggcccagattcttaacaaggtattcatgcctactaacgtacgagaacttcaggtttaggccactgatatcagccttccaatttccaccttaatagtgtgctaagtggagaatttcgagctcataaataaaagtatcgccaacccgactcaggtgaaagagcggatggaggtgtgtgagaatcaccagcactggcacacggtagtcaaagaggcatgtctgactcagggaatgaccttatatagctacggcatgctgctcccatgtggggtagaccagttccatggcactgaatatgtgtgctgccctcagacaaagattattggatctgtgtcaaaagaagaggaagaggaagatgaagaggaagaggaagaggaagatgaagaggaagactatgatgtttataaaagtgaatttcctactgaagcagatctggaagacttcacagaagcagctgtggatgaggatgatgaggatgaggaagaaggggaggaagtggtggaggaccgagattactactatgacaccttcaaaggagatgactacaatgaggagaatcctactgaacccggcagcgacggcaccatgtcagacaaggaaattactcatgatgtcaaagttcctccaactcctctgccaaccaatgatgttgatgtgtatttcgagacctctgcagatgataatgagcatgctcgcttccagaaggctaaggagcagctggagattcggcaccgcaaccgaatggacagggtaaagaaggaatgggaagaggcagagcttcaagctaagaacctccccaaagcagagaggcagactctgattcagcacttccaagccatggttaaagctttagagaaggaagcagccagtgagaagcagcagctggtggagacccacctggcccgagtggaagctatgctgaatgaccgccgtcggatggctctggagaactacctggctgccttgcagtctgacccgccacggcctcatcgcattctccaggccttacggcgttatgtccgtgctgagaacaaagatcgcttacataccatccgtcattaccagcatgtgttggctgttgacccagaaaaggcggcccagatgaaatcccaggtgatgacacatctccacgtgattgaagaaaggaggaaccaaagcctctctctgctctacaaagtaccttatgtagcccaagaaattcaagaggaaattggatctggagtgggagagcaggatgggggactgatcggtgccgaagagaaagtgattaacagtaagaataaagtggatgaaaacatggtcattgacgagactctggatgttaaggaaatgattttcaatgccgagagagttggaggcctcgaggaagagcgggaatccgtgggcccactgcgggaggacttcagtctgagtagcagtgctctcattggcctgctggtcatcgcagtggccattgccacggtcatcgtcatcagcctggtgatgctgaggaagaggcagtatggcaccatcagccacgggatcgtggaggttgatccaatgctcaccccagaagagcgtcacctgaacaagatgcagaaccatggctatgagaaccccacctacaaatacctggagcagatgcagatttaggtggcagggagcgcggcagccctggcggagggatgcaggtgggccggaagatcccacgattccgatcgactgccaagcagcagccgctgccaggggctgcgtctgacatcctgacctcctggactgtaggactatataaagtactactgtagaactgcaatttccattcttttaaatgggtgaaaaatggtaatataacaatatatgatatataaaccttaaatgaaaaaaatgatctattgcagatatttgatgtagttttcttttttaaattaatcagaaaccccacttccattgtattgtctgacacatgctctcaatatataataaatgggaaatgtcgattttcaataatagacttatatgcaggctgtcgttccggttatgttgtgtaagtcaactcttcagcctcattcactgtcctggcttttatttaaagaaaaaaaaggcagtattccctttttaaatgagctttcaggaagttgctgagaaatggggtggaatagggaactgtaatggccactgaagcacgtgagagaccctcgcaaaatgatgtgaaaggaccagtttcttgaagtccagtgtttccacggctggatacctgtgtgtctccataaaagtcctgtcaccaaggacgttaaaggcattttattccagcgtcttctagagagcttagtgtatacagatgagggtgtccgctgctgctttccttcggaatccagtgcttccacagagattagcctgtagcttatatttgacattcttcactgtctgttgtttacctaccgtagctttttaccgttcacttccccttccaactatgtccagatgtgcaggctcctcctctctggactttctccaaaggcactgaccctcggcctctactttgtcccctcacctccaccccctcctgtcaccggccttgtgacattcactcagagaagaccacaccaaggaaggcggccgctggcccaggagagaacacggggaggtttgtttgtgtgaaaggaaagtagtccaggctgtccctgaaactgagtctgtggacactgtggaaagctttgaacaattgtgttttcgtcacaggagtctttgtaatgcttgtacagttgatgtcgatgctcactgcttctgctttttctttctttttattttaaatctgaaggttctggtaacctgtggtgtatttttattttcctgtgactgtttttgttttgtttttttcctttttcctcccctttgaccctattcatgtctctacccactatgcacagattaaacttcacctacaaactccttaatatgatctgtggagaatgtacacagtttaaacacatcaataaatactttaacttcca

SEQ ID NO: 329653 - DNA, 3084 bp, Homo sapiens
caccacctgagtcctgcatgccacttctgtcctccaactaagagcggtggtgtagtttttaacagttcttacgtgtcctctgagggctatttcagaatcttctagactacagagagaaaacctgagatttccgttgttcacctaagggtctgtagagaatcttttttacatgaaggcccagattcttaacaaggtattcatgcctactaacgtacgagaacttcaggtttaggccactgatatcagccttccaatttccaccttaatagtgtgctaagtggagaatttcgagctcataaataaaagtatcgccaacccgactcaggtgaaagagcggatggaggtgtgtgagaatcaccagcactggcacacggtagtcaaagaggcatgtctgactcagggaatgaccttatatagctacggcatgctgctcccatgtggggtagaccagttccatggcactgaatatgtgtgctgccctcagacaaagattattggatctgtgtcaaaagaagaggaagaggaagatgaagaggaagaggaagaggaagatgaagaggaagactatgatgtttataaaagtgaatttcctactgaagcagatctggaagacttcacagaagcagctgtggatgaggatgatgaggatgaggaagaaggggaggaagtggtggaggaccgagattactactatgacaccttcaaaggagatgactacaatgaggagaatcctactgaacccggcagcgacggcaccatgtcagacaaggaaattactcatgatgtcaaagttcctccaactcctctgccaaccaatgatgttgatgtgtatttcgagacctctgcagatgataatgagcatgctcgcttccagaaggctaaggagcagctggagattcggcaccgcaaccgaatggacagggtaaagaaggaatgggaagaggcagagcttcaagctaagaacctccccaaagcagagaggcagactctgattcagcacttccaagccatggttaaagctttagagaaggaagcagccagtgagaagcagcagctggtggagacccacctggcccgagtggaagctatgctgaatgaccgccgtcggatggctctggagaactacctggctgccttgcagtctgacccgccacggcctcatcgcattctccaggccttacggcgttatgtccgtgctgagaacaaagatcgcttacataccatccgtcattaccagcatgtgttggctgttgacccagaaaaggcggcccagatgaaatcccaggtgatgacacatctccacgtgattgaagaaaggaggaaccaaagcctctctctgctctacaaagtaccttatgtagcccaagaaattcaagaggaaattgatgagctccttcaggagcagcgtgcagatatggaccagttcactgcctcaatctcagagacccctgtggacgtccgggtgagctctgaggagagtgaggagatcccaccgttccaccccttccaccccttcccagccctacctgagaacgaaggatctggagtgggagagcaggatgggggactgatcggtgccgaagagaaagtgattaacagtaagaataaagtggatgaaaacatggttgatccaatgctcaccccagaagagcgtcacctgaacaagatgcagaaccatggctatgagaaccccacctacaaatacctggagcagatgcagatttaggtggcagggagcgcggcagccctggcggagggatgcaggtgggccggaagatcccacgattccgatcgactgccaagcagcagccgctgccaggggctgcgtctgacatcctgacctcctggactgtaggactatataaagtactactgtagaactgcaatttccattcttttaaatgggtgaaaaatggtaatataacaatatatgatatataaaccttaaatgaaaaaaatgatctattgcagatatttgatgtagttttcttttttaaattaatcagaaaccccacttccattgtattgtctgacacatgctctcaatatataataaatgggaaatgtcgattttcaataatagacttatatgcaggctgtcgttccggttatgttgtgtaagtcaactcttcagcctcattcactgtcctggcttttatttaaagaaaaaaaaggcagtattccctttttaaatgagctttcaggaagttgctgagaaatggggtggaatagggaactgtaatggccactgaagcacgtgagagaccctcgcaaaatgatgtgaaaggaccagtttcttgaagtccagtgtttccacggctggatacctgtgtgtctccataaaagtcctgtcaccaaggacgttaaaggcattttattccagcgtcttctagagagcttagtgtatacagatgagggtgtccgctgctgctttccttcggaatccagtgcttccacagagattagcctgtagcttatatttgacattcttcactgtctgttgtttacctaccgtagctttttaccgttcacttccccttccaactatgtccagatgtgcaggctcctcctctctggactttctccaaaggcactgaccctcggcctctactttgtcccctcacctccaccccctcctgtcaccggccttgtgacattcactcagagaagaccacaccaaggaaggcggccgctggcccaggagagaacacggggaggtttgtttgtgtgaaaggaaagtagtccaggctgtccctgaaactgagtctgtggacactgtggaaagctttgaacaattgtgttttcgtcacaggagtctttgtaatgcttgtacagttgatgtcgatgctcactgcttctgctttttctttctttttattttaaatctgaaggttctggtaacctgtggtgtatttttattttcctgtgactgtttttgttttgtttttttcctttttcctcccctttgaccctattcatgtctctacccactatgcacagattaaacttcacctacaaactccttaatatgatctgtggagaatgtacacagtttaaacacatcaataaatactttaacttcca

SEQ ID NO: 329654 - DNA, 3060 bp, Homo sapiens
caccacctgagtcctgcatgccacttctgtcctccaactaagagcggtggtgtagtttttaacagttcttacgtgtcctctgagggctatttcagaatcttctagactacagagagaaaacctgagatttccgttgttcacctaagggtctgtagagaatcttttttacatgaaggcccagattcttaacaaggtattcatgcctactaacgtacgagaacttcaggtttaggccactgatatcagccttccaatttccaccttaatagtgtgctaagtggagaatttcgagctcataaataaaagtatcgccaacccgactcaggtgaaagagcggatggaggtgtgtgagaatcaccagcactggcacacggtagtcaaagaggcatgtctgactcagggaatgaccttatatagctacggcatgctgctcccatgtggggtagaccagttccatggcactgaatatgtgtgctgccctcagacaaagattattggatctgtgtcaaaagaagaggaagaggaagatgaagaggaagaggaagaggaagatgaagaggaagactatgatgtttataaaagtgaatttcctactgaagcagatctggaagacttcacagaagcagctgtggatgaggatgatgaggatgaggaagaaggggaggaagtggtggaggaccgagattactactatgacaccttcaaaggagatgactacaatgaggagaatcctactgaacccggcagcgacggcaccatgtcagacaaggaaattactcatgatgtcaaagctgtctgctcccaggaggcgatgacggggccctgccgggccgtgatgcctcgttggtacttcgacctctccaagggaaagtgcgtgcgctttatatatggtggctgcggcggcaacaggaacaattttgagtctgaggattattgtatggctgtgtgtaaagcgatgattcctccaactcctctgccaaccaatgatgttgatgtgtatttcgagacctctgcagatgataatgagcatgctcgcttccagaaggctaaggagcagctggagattcggcaccgcaaccgaatggacagggtaaagaaggaatgggaagaggcagagcttcaagctaagaacctccccaaagcagagaggcagactctgattcagcacttccaagccatggttaaagctttagagaaggaagcagccagtgagaagcagcagctggtggagacccacctggcccgagtggaagctatgctgaatgaccgccgtcggatggctctggagaactacctggctgccttgcagtctgacccgccacggcctcatcgcattctccaggccttacggcgttatgtccgtgctgagaacaaagatcgcttacataccatccgtcattaccagcatgtgttggctgttgacccagaaaaggcggcccagatgaaatcccaggtgatgacacatctccacgtgattgaagaaaggaggaaccaaagcctctctctgctctacaaagtaccttatgtagcccaagaaattcaagaggaaattgatgagctccttcaggagcagcgtgcagatatggaccagttcactgcctcaatctcagagacccctgtggacgtccgggtgagctctgaggagagtgaggagatcccaccgttccaccccttccaccccttcccagccctacctgagaacgaaggatctggagtgggagagcaggatgggggactgatcggtgccgaagagaaagtgattaacagtaagaataaagtggatgaaaacatggtcattgacgagactctggatgttaaggaaatgattttcaatgccgagagagttggaggcctcgaggaagagcgggaatccgtgggcccactgcgggaggacttcagtctgagtagcagtgctctcattggcctgctggtcatcgcagtggccattgccacggtcatcgtcatcagcctggtgatgctgaggaagaggcagtatggcaccatcagccacgggatcgtggaggttgatccaatgctcaccccagaagagcgtcacctgaacaagatgcagaaccatggctatgagaaccccacctacaaatacctggagcagatgcagatttaggtggcagggagcgcggcagccctggcggagggatgcaggtgggccggaagatcccacgattccgatcgactgccaagcagcagccgctgccaggggctgcgtctgacatcctgacctcctggactgtaggactatataaagtactactgtagaactgcaatttccattcttttaaatgggtgaaaaatggtaatataacaatatatgatatataaaccttaaatgaaaaaaatgatctattgcagatatttgatgtagttttcttttttaaattaatcagaaaccccacttccattgtattgtctgacacatgctctcaatatataataaatgggaaatgtcgattttcaataatagacttatatgcaggctgtcgttccggttatgttgtgtaagtcaactcttcagcctcattcactgtcctggcttttatttaaagaaaaaaaaggcagtattccctttttaaatgagctttcaggaagttgctgagaaatggggtggaatagggaactgtaatggccactgaagcacgtgagagaccctcgcaaaatgatgtgaaaggaccagtttcttgaagtccagtgtttccacggctggatacctgtgtgtctccataaaagtcctgtcaccaaggacgttaaaggcattttattccagcgtcttctagagagcttagtgtatacagatgagggtgtccgctgctgctttccttcggaatccagtgcttccacagagattagcctgtagcttatatttgacattcttcactgtctgttgtttacctaccgtagctttttaccgttcacttccccttccaactatgtccagatgttacactgtaggagttggattcttgtgccaggggttgaggctgcagtgagccacagtcacgccactgcattctatcctgggcaacagatggagaccttgtctca

SEQ ID NO: 329655 - DNA, 3059 bp, Homo sapiens
  misc_feature (2956)..(2956): n is a, c, g, or t
caccacctgagtcctgcatgccacttctgtcctccaactaagagcggtggtgtagtttttaacagttcttacgtgtcctctgagggctatttcagaatcttctagactacagagagaaaacctgagatttccgttgttcacctaagggtctgtagagaatcttttttacatgaaggcccagattcttaacaaggtattcatgcctactaacgtacgagaacttcaggtttaggccactgatatcagccttccaatttccaccttaatagtgtgctaagtggagaatttcgagctcataaataaaagtatcgccaacccgactcaggtgaaagagcggatggaggtgtgtgagaatcaccagcactggcacacggtagtcaaagaggcatgtctgactcagggaatgaccttatatagctacggcatgctgctcccatgtggggtagaccagttccatggcactgaatatgtgtgctgccctcagacaaagattattggatctgtgtcaaaagaagaggaagaggaagatgaagaggaagaggaagaggaagatgaagaggaagactatgatgtttataaaagtgaatttcctactgaagcagatctggaagacttcacagaagcagctgtggatgaggatgatgaggatgaggaagaaggggaggaagtggtggaggaccgagattactactatgacaccttcaaaggagatgactacaatgaggagaatcctactgaacccggcagcgacggcaccatgtcagacaaggaaattactcatgatgtcaaagctgtctgctcccaggaggcgatgacggggccctgccgggccgtgatgcctcgttggtacttcgacctctccaagggaaagtgcgtgcgctttatatatggtggctgcggcggcaacaggaacaattttgagtctgaggattattgtatggctgtgtgtaaagcgatgattcctccaactcctctgccaaccaatgatgttgatgtgtatttcgagacctctgcagatgataatgagcatgctcgcttccagaaggctaaggagcagctggagattcggcaccgcaaccgaatggacagggtaaagaaggaatgggaagaggcagagcttcaagctaagaacctccccaaagcagagaggcagactctgattcagcacttccaagccatggttaaagctttagagaaggaagcagccagtgagaagcagcagctggtggagacccacctggcccgagtggaagctatgctgaatgaccgccgtcggatggctctggagaactacctggctgccttgcagtctgacccgccacggcctcatcgcattctccaggccttacggcgttatgtccgtgctgagaacaaagatcgcttacataccatccgtcattaccagcatgtgttggctgttgacccagaaaaggcggcccagatgaaatcccaggtgatgacacatctccacgtgattgaagaaaggaggaaccaaagcctctctctgctctacaaagtaccttatgtagcccaagaaattcaagaggaaattgatgagctccttcaggagcagcgtgcagatatggaccagttcactgcctcaatctcagagacccctgtggacgtccgggtgagctctgaggagagtgaggagatcccaccgttccaccccttccaccccttcccagccctacctgagaacgaaggatctggagtgggagagcaggatgggggactgatcggtgccgaagagaaagtgattaacagtaagaataaagtggatgaaaacatggtcattgacgagactctggatgttaaggaaatgattttcaatgccgagagagttggaggcctcgaggaagagcgggaatccgtgggcccactgcgggaggacttcagtctgagtagcagtgctctcattggcctgctggtcatcgcagtggccattgccacggtcatcgtcatcagcctggtgatgctgaggaagaggcagtatggcaccatcagccacgggatcgtggaggttgatccaatgctcaccccagaagagcgtcacctgaacaagatgcagaaccatggctatgagaaccccacctacaaatacctggagcagatgcagatttaggtggcagggagcgcggcagccctggcggagggatgcaggtgggccggaagatcccacgattccgatcgactgccaagcagcagccgctgccaggggctgcgtctgacatcctgacctcctggactgtaggactatataaagtactactgtagaactgcaatttccattcttttaaatgggtgaaaaatggtaatataacaatatatgatatataaaccttaaatgaaaaaaatgatctattgcagatatttgatgtagttttcttttttaaattaatcagaaaccccacttccattgtattgtctgacacatgctctcaatatataataaatgggaaatgtcgattttcaataatagacttatatgcaggctgtcgttccggttatgttgtgtaagtcaactcttcagcctcattcactgtcctggcttttatttaaagaaaaaaaaggcagtattccctttttaaatgagctttcaggaagttgctgagaaatggggtggaatagggaactgtaatggccactgaagcacgtgagagaccctcgcaaaatgatgtgaaaggaccagtttcttgaagtccagtgtttccacggctggatacctgtgtgtctccataaaagtcctgtcaccaaggacgttaaaggcattttattccagcgtcttctagagagcttagtgtatacagatgagggtgtccgctgctgctttccttcggaatccagtgcttccacagagattagcctgtagcttatatttgacattcttcactgtctgttgtttacctaccgtagctttttaccgttcacttcgcagtactagttttctgtatgntcataacaaaaaggttccattgactcatggttctacaggctgtaaaaaaaaaagcacagtagcttggggaattgtaagtaaggcatcatcggattttcgagcg

SEQ ID NO: 329656 - DNA, 2993 bp, Homo sapiens
caccacctgagtcctgcatgccacttctgtcctccaactaagagcggtggtgtagtttttaacagttcttacgtgtcctctgagggctatttcagaatcttctagactacagagagaaaacctgagatttccgttgttcacctaagggtctgtagagaatcttttttacatgaaggcccagattcttaacaaggtattcatgcctactaacgtacgagaacttcaggtttaggccactgatatcagccttccaatttccaccttaatagtgtgctaagtggagaatttcgagctcataaataaaagtatcgccaacccgactcaggtgaaagagcggatggaggtgtgtgagaatcaccagcactggcacacggtagtcaaagaggcatgtctgactcagggaatgaccttatatagctacggcatgctgctcccatgtggggtagaccagttccatggcactgaatatgtgtgctgccctcagacaaagattattggatctgtgtcaaaagaagaggaagaggaagatgaagaggaagaggaagaggaagatgaagaggaagactatgatgtttataaaagtgaatttcctactgaagcagatctggaagacttcacagaagcagctgtggatgaggatgatgaggatgaggaagaaggggaggaagtggtggaggaccgagattactactatgacaccttcaaaggagatgactacaatgaggagaatcctactgaacccggcagcgacggcaccatgtcagacaaggaaattactcatgatgtcaaagctgtctgctcccaggaggcgatgacggggccctgccgggccgtgatgcctcgttggtacttcgacctctccaagggaaagtgcgtgcgctttatatatggtggctgcggcggcaacaggaacaattttgagtctgaggattattgtatggctgtgtgtaaagcgatgattcctccaactcctctgccaaccaatgatgttgatgtgtatttcgagacctctgcagatgataatgagcatgctcgcttccagaaggctaaggagcagctggagattcggcaccgcaaccgaatggacagggtaaagaaggaatgggaagaggcagagcttcaagctaagaacctccccaaagcagagaggcagactctgattcagcacttccaagccatggttaaagctttagagaaggaagcagccagtgagaagcagcagctggtggagacccacctggcccgagtggaagctatgctgaatgaccgccgtcggatggctctggagaactacctggctgccttgcagtctgacccgccacggcctcatcgcattctccaggccttacggcgttatgtccgtgctgagaacaaagatcgcttacataccatccgtcattaccagcatgtgttggctgttgacccagaaaaggcggcccagatgaaatcccaggtgatgacacatctccacgtgattgaagaaaggaggaaccaaagcctctctctgctctacaaagtaccttatgtagcccaagaaattcaagaggaaattgatgagctccttcaggagcagcgtgcagatatggaccagttcactgcctcaatctcagagacccctgtggacgtccgggtgagctctgaggagagtgaggagatcccaccgttccaccccttccaccccttcccagccctacctgagaacgaaggatctggagtgggagagcaggatgggggactgatcggtgccgaagagaaagtgattaacagtaagaataaagtggatgaaaacatggtcattgacgagactctggatgttaaggaaatgattttcaatgccgagagagttggaggcctcgaggaagagcgggaatccgtgggcccactgcgggaggacttcagtctgagtagcagtgctctcattggcctgctggtcatcgcagtggccattgccacggtcatcgtcatcagcctggtgatgctgaggaagaggcagtatggcaccatcagccacgggatcgtggaggttgatccaatgctcaccccagaagagcgtcacctgaacaagatgcagaaccatggctatgagaaccccacctacaaatacctggagcagatgcagatttaggtggcagggagcgcggcagccctggcggagggatgcaggtgggccggaagatcccacgattccgatcgactgccaagcagcagccgctgccaggggctgcgtctgacatcctgacctcctggactgtaggactatataaagtactactgtagaactgcaatttccattcttttaaatgggtgaaaaatggtaatataacaatatatgatatataaaccttaaatgaaaaaaatgatctattgcagatatttgatgtacttatatttgacattcttcactgtctgttgtttacctaccgtagctttttaccgttcacttccccttccaactatgtccagatgtgcaggctcctcctctctggactttctccaaaggcactgaccctcggcctctactttgtcccctcacctccaccccctcctgtcaccggccttgtgacattcactcagagaagaccacaccaaggaaggcggccgctggcccaggagagaacacggggaggtttgtttgtgtgaaaggaaagtagtccaggctgtccctgaaactgagtctgtggacactgtggaaagctttgaacaattgtgttttcgtcacaggagtctttgtaatgcttgtacagttgatgtcgatgctcactgcttctgctttttctttctttttattttaaatctgaaggttctggtaacctgtggtgtatttttattttcctgtgactgtttttgttttgtttttttcctttttcctcccctttgaccctattcatgtctctacccactatgcacagattaaacttcacctacaaactccttaatatgatctgtggagaatgtacacagtttaaacacatcaataaatactttaacttcca

SEQ ID NO: 329657 - DNA, 2620 bp, Homo sapiens
caccacctgagtcctgcatgccacttctgtcctccaactaagagcggtggtgtagtttttaacagttcttacgtgtcctctgagggctatttcagaatcttctagactacagagagaaaacctgagatttccgttgttcacctaagggtctgtagagaatcttttttacatgaaggcccagattcttaacaaggtattcatgcctactaacgtacgagaacttcaggtttaggccactgatatcagccttccaatttccaccttaatagtgtgctaagtggagaatttcgagctcataaataaaagtatcgccaacccgactcaggtgaaagagcggatggaggtgtgtgagaatcaccagcactggcacacggtagtcaaagaggcatgtctgactcagggaatgaccttatatagctacggcatgctgctcccatgtggggtagaccagttccatggcactgaatatgtgtgctgccctcagacaaagattattggatctgtgtcaaaagaagaggaagaggaagatgaagaggaagaggaagaggaagatgaagaggaagactatgatgtttataaaagtgaatttcctactgaagcagatctggaagacttcacagaagcagctgtggatgaggatgatgaggatgaggaagaaggggaggaagtggtggaggaccgagattactactatgacaccttcaaaggagatgactacaatgaggagaatcctactgaacccggcagcgacggcaccatgtcagacaaggaaattactcatgatgtcaaagctgtctgctcccaggaggcgatgacggggccctgccgggccgtgatgcctcgttggtacttcgacctctccaagggaaagtgcgtgcgctttatatatggtggctgcggcggcaacaggaacaattttgagtctgaggattattgtatggctgtgtgtaaagcgatgattcctccaactcctctgccaaccaatgatgttgatgtgtatttcgagacctctgcagatgataatgagcatgctcgcttccagaaggctaaggagcagctggagattcggcaccgcaaccgaatggacagggtaaagaaggaatgggaagaggcagagcttcaagctaagaacctccccaaagcagagaggcagactctgattcagcacttccaagccatggttaaagctttagagaaggaagcagccagtgagaagcagcagctggtggagacccacctggcccgagtggaagctatgctgaatgaccgccgtcggatggctctggagaactacctggctgccttgcagtctgacccgccacggcctcatcgcattctccaggccttacggcgttatgtccgtgctgagaacaaagatcgcttacataccatccgtcattaccagcatgtgttggctgttgacccagaaaaggcggcccagatgaaatcccaggtgatgacacatctccacgtgattgaagaaaggaggaaccaaagcctctctctgctctacaaagtaccttatgtagcccaagaaattcaagaggaaattgatgagctccttcaggagcagcgtgcagatatggaccagttcactgcctcaatctcagagacccctgtggacgtccgggtgagctctgaggagagtgaggagatcccaccgttccaccccttccaccccttcccagccctacctgagaacgaaggatctggagtgggagagcaggatgggggactgatcggtgccgaagagaaagtgattaacagtaagaataaagtggatgaaaacatggtcattgacgagactctggatgttaaggaaatgattttcaatgccgagagagttggaggcctcgaggaagagcgggaatccgtgggcccactgcgggaggacttcagtctgagtagcagtgctctcattggcctgctggtcatcgcagtggccattgccacggtcatcgtcatcagcctggtgatgctgaggaagaggcagtatggcaccatcagccacgggatcgtggaggttgatccaatgctcaccccagaagagcgtcacctgaacaagatgcagaaccatggctatgagaaccccacctacaaatacctggagcagatgcagatttaggtggcagggagcgcggcagccctggcggagggatgcaggtgggccggaagatcccacgattccgatcgactgccaagcagcagccgctgccaggggctgcgtctgacatcctgacctcctggactgtaggactatataaagtactactgtagaactgcaatttccattcttttaaatgggtgaaaaatggtaatataacaatatatgatatataaaccttaaatgaaaaaaatgatctattgcagatatttgatgtagttttcttttttaaattaatcagaaaccccacttccattgtattgtctgacacatgctctcaatatataataaatgggaaatgtcgattttcaataatagacttatatgcaggctgtcgttccggttatgttgtgtaagtcaactcttcagcctcattcactgtcctggcttttatttaaagagaggatatggaactgtatgggcactgagcacgtgagagacctcgctgatgtggcc

SEQ ID NO: 329658 - DNA, 2187 bp, Homo sapiens
caccacctgagtcctgcatgccacttctgtcctccaactaagagcggtggtgtagtttttaacagttcttacgtgtcctctgagggctatttcagaatcttctagactacagagagaaaacctgagatttccgttgttcacctaagggtctgtagagaatcttttttacatgaaggcccagattcttaacaaggtattcatgcctactaacgtacgagaacttcaggtttaggccactgatatcagccttccaatttccaccttaatagtgtgctaagtggagaatttcgagctcataaataaaagtatcgccaacccgactcaggtgaaagagcggatggaggtgtgtgagaatcaccagcactggcacacggtagtcaaagaggcatgtctgactcagggaatgaccttatatagctacggcatgctgctcccatgtggggtagaccagttccatggcactgaatatgtgtgctgccctcagacaaagattattggatctgtgtcaaaagaagaggaagaggaagatgaagaggaagaggaagaggaagatgaagaggaagactatgatgtttataaaagtgaatttcctactgaagcagatctggaagacttcacagaagcagctgtggatgaggatgatgaggatgaggaagaaggggaggaagtggtggaggaccgagattactactatgacaccttcaaaggagatgactacaatgaggagaatcctactgaacccggcagcgacggcaccatgtcagacaaggaaattactcatgatgtcaaagttcctccaactcctctgccaaccaatgatgttgatgtgtatttcgagacctctgcagatgataatgagcatgctcgcttccagaaggctaaggagcagctggagattcggcaccgcaaccgaatggacagggtaaagaaggaatgggaagaggcagagcttcaagctaagaacctccccaaagcagagaggcagactctgattcagcacttccaagccatggttaaagctttagagaaggaagcagccagtgagaagcagcagctggtggagacccacctggcccgagtggaagctatgctgaatgaccgccgtcggatggctctggagaactacctggctgccttgcagtctgacccgccacggcctcatcgcattctccaggccttacggcgttatgtccgtgctgagaacaaagatcgcttacataccatccgtcattaccagcatgtgttggctgttgacccagaaaaggcggcccagatgaaatcccaggtgatgacacatctccacgtgattgaagaaaggaggaaccaaagcctctctctgctctacaaagtaccttatgtagcccaagaaattcaagaggaaattgatgagctccttcaggagcagcgtgcagatatggaccagttcactgcctcaatctcagagacccctgtggacgtccgggtgagctctgaggagagtgaggagatcccaccgttccaccccttccaccccttcccagccctacctgagaacgaagacactcagccggagttgtaccacccaatgaaaaaaggatctggagtgggagagcaggatgggggactgatcggtgccgaagagaaagtgattaacagtaagaataaagtggatgaaaacatgtgcaggctcctcctctctggactttctccaaaggcactgaccctcggcctctactttgtcccctcacctccaccccctcctgtcaccggccttgtgacattcactcagagaagaccacaccaaggaaggcggccgctggcccaggagagaacacggggaggtttgtttgtgtgaaaggaaagtagtccaggctgtccctgaaactgagtctgtggacactgtggaaagctttgaacaattgtgttttcgtcacaggagtctttgtaatgcttgtacagttgatgtcgatgctcactgcttctgctttttctttctttttattttaaatctgaaggttctggtaacctgtggtgtatttttattttcctgtgactgtttttgttttgtttttttcctttttcctcccctttgaccctattcatgtctctacccactatgcacagattaaacttcacctacaaactccttaatatgatctgtggagaatgtacacagtttaaacacatcaataaatactttaacttcca

SEQ ID NO: 329659 - DNA, 2074 bp, Homo sapiens
caccacctgagtcctgcatgccacttctgtcctccaactaagagcggtggtgtagtttttaacagttcttacgtgtcctctgagggctatttcagaatcttctagactacagagagaaaacctgagatttccgttgttcacctaagggtctgtagagaatcttttttacatgaaggcccagattcttaacaaggtattcatgcctactaacgtacgagaacttcaggtttaggccactgatatcagccttccaatttccaccttaatagtgtgctaagtggagaatttcgagctcataaataaaagtatcgccaacccgactcaggtgaaagagcggatggaggtgtgtgagaatcaccagcactggcacacggtagtcaaagaggcatgtctgactcagggaatgaccttatatagctacggcatgctgctcccatgtggggtagaccagttccatggcactgaatatgtgtgctgccctcagacaaagattattggatctgtgtcaaaagaagaggaagaggaagatgaagaggaagaggaagaggaagatgaagaggaagactatgatgtttataaaagtgaatttcctactgaagcagatctggaagacttcacagaagcagctgtggatgaggatgatgaggatgaggaagaaggggaggaagtggtggaggaccgagattactactatgacaccttcaaaggagatgactacaatgaggagaatcctactgaacccggcagcgacggcaccatgtcagacaaggaaattactcatgatgtcaaagctgtctgctcccaggaggcgatgacggggccctgccgggccgtgatgcctcgttggtacttcgacctctccaagggaaagtgcgtgcgctttatatatggtggctgcggcggcaacaggaacaattttgagtctgaggattattgtatggctgtgtgtaaagcgatgattcctccaactcctctgccaaccaatgatgttgatgtgtatttcgagacctctgcagatgataatgagcatgctcgcttccagaaggctaaggagcagctggagattcggcaccgcaaccgaatggacagggtaaagaaggaatgggaagaggcagagcttcaagctaagaacctccccaaagcagagaggcagactctgattcagcacttccaagccatggttaaagctttagagaaggaagcagccagtgagaagcagcagctggtggagacccacctggcccgagtggaagctatgctgaatgaccgccgtcggatggctctggagaactacctggctgccttgcagtctgacccgccacggcctcatcgcattctccaggccttacggcgttatgtccgtgctgagaacaaagatcgcttacataccatccgtcattaccagcatgtgttggctgttgacccagaaaaggcggcccagatgaaatcccaggtgatgacacatctccacgtgattgaagaaaggaggaaccaaagcctctctctgctctacaaagtaccttatgtagcccaagaaattcaagaggaaattgatgagctccttcaggagcagcgtgcagatatggaccctcggcctctactttgtcccctcacctccaccccctcctgtcaccggccttgtgacattcactcagagaagaccacaccaaggaaggcggccgctggcccaggagagaacacggggaggtttgtttgtgtgaaaggaaagtagtccaggctgtccctgaaactgagtctgtggacactgtggaaagctttgaacaattgtgttttcgtcacaggagtctttgtaatgcttgtacagttgatgtcgatgctcactgcttctgctttttctttctttttattttaaatctgaaggttctggtaacctgtggtgtatttttattttcctgtgactgtttttgttttgtttttttcctttttcctcccctttgaccctattcatgtctctacccactatgcacagattaaacttcacctacaaactccttaatatgatctgtggagaatgtacacagtttaaacacatcaataaatactttaacttcca

SEQ ID NO: 329660 - DNA, 1905 bp, Homo sapiens
caccacctgagtcctgcatgccacttctgtcctccaactaagagcggtggtgtagtttttaacagttcttacgtgtcctctgagggctatttcagaatcttctagactacagagagaaaacctgagatttccgttgttcacctaagggtctgtagagaatcttttttacatgaaggcccagattcttaacaaggtattcatgcctactaacgtacgagaacttcaggtttaggccactgatatcagccttccaatttccaccttaatagtgtgctaagtggagaatttcgagctcataaataaaagtatcgccaacccgactcaggtgaaagagcggatggaggtgtgtgagaatcaccagcactggcacacggtagtcaaagaggcatgtctgactcagggaatgaccttatatagctacggcatgctgctcccatgtggggtagaccagttccatggcactgaatatgtgtgctgccctcagacaaagattattggatctgtgtcaaaagaagaggaagaggaagatgaagaggaagaggaagaggaagatgaagaggaagactatgatgtttataaaagtgaatttcctactgaagcagatctggaagacttcacagaagcagctgtggatgaggatgatgaggatgaggaagaaggggaggaagtggtggaggaccgagattactactatgacaccttcaaaggagatgactacaatgaggagaatcctactgaacccggcagcgacggcaccatgtcagacaaggaaattactcatgatgtcaaagctgtctgctcccaggaggcgatgacggggccctgccgggccgtgatgcctcgttggtacttcgacctctccaagggaaagtgcgtgcgctttatatatggtggctgcggcggcaacaggaacaattttgagtctgaggattattgtatggctgtgtgtaaagcgatgattcctccaactcctctgccaaccaatgatgttgatgtgtatttcgagacctctgcagatgataatgagcatgctcgcttccagaaggctaaggagcagctggagattcggcaccgcaaccgaatggacagggtaaagaaggaatgggaagaggcagagcttcaagctaagaacctccccaaagcagagaggcagactctgattcagcacttccaagccatggttaaagctttagagaaggaagcagccagtgagaagcagcagctggtggagacccacctggcccgagtggaagctatgctgaatgaccgccgtcggatggctctggagaactacctggctgccttgcagtctgacccgccacggcctcatcgcattctccaggccttacggcgttatgtccgtgctgagaacaaagatcgcttacataccatccgtcattaccagcatgtgttggctgttgacccagaaaaggcggcccagatgaaatcccagcctcctgtcaccggccttgtgacattcactcagagaagaccacaccaaggaaggcggccgctggcccaggagagaacacggggaggtttgtttgtgtgaaaggaaagtagtccaggctgtccctgaaactgagtctgtggacactgtggaaagctttgaacaattgtgttttcgtcacaggagtctttgtaatgcttgtacagttgatgtcgatgctcactgcttctgctttttctttctttttattttaaatctgaaggttctggtaacctgtggtgtatttttattttcctgtgactgtttttgttttgtttttttcctttttcctcccctttgaccctattcatgtctctacccactatgcacagattaaacttcacctacaaactccttaatatgatctgtggagaatgtacacagtttaaacacatcaataaatactttaacttcca

SEQ ID NO: 329661 - DNA, 2338 bp, Homo sapiens
caccacctgagtcctgcatgccacttctgtcctccaactaagagcggtggtgtagtttttaacagttcttacgtgtcctctgagggctatttcagaatcttctagactacagagagaaaacctgagatttccgttgttcacctaagggtctgtagagaatcttttttacatgaaggcccagattcttaacaaggtattcatgcctactaacgtacgagaacttcaggtttaggccactgatatcagccttccaatttccaccttaatagtgtgctaagtggagaatttcgagctcataaataaaagtatcgccaacccgactcaggtgaaagagcggatggaggtgtgtgagaatcaccagcactggcacacggtagtcaaagaggcatgtctgactcagggaatgaccttatatagctacggcatgctgctcccatgtggggtagaccagttccatggcactgaatatgtgtgctgccctcagacaaagattattggatctgtgtcaaaagaagaggaagaggaagatgaagaggaagaggaagaggaagatgaagaggaagactatgatgtttataaaagtgaatttcctactgaagcagatctggaagacttcacagaagcagctgtggatgaggatgatgaggatgaggaagaaggggaggaagtggtggaggaccgagattactactatgacaccttcaaaggagatgactacaatgaggagaatcctactgaacccggcagcgacggcaccatgtcagacaaggaaattactcatgatgtcaaagctgtctgctcccaggaggcgatgacggggccctgccgggccgtgatgcctcgttggtacttcgacctctccaagggaaagtgcgtgcgctttatatatggtggctgcggcggcaacaggaacaattttgagtctgaggattattgtatggctgtgtgtaaagcgatgattcctccaactcctctgccaaccaatgatgttgatgtgtatttcgagacctctgcagatgataatgagcatgctcgcttccagaaggctaaggagcagctggagattcggcaccgcaaccgaatggacagggtaaagaaggaatgggaagaggcagagcttcaagctaagaacctccccaaagcagagaggcagactctgattcagcacttccaagccatggttaaagctttagagaaggaagcagccagtgagaagcagcagctggtggagacccacctggcccgagtggaagctatgctgaatgaccgccgtcggatggctctggagaactacctggctgccttgcagtctgacccgccacggcctcatcgcattctccaggccttacggcgttatgtccgtgctgagaacaaagatcgcttacataccatccgtcattaccagcatgtgttggctgttgacccagaaaaggcggcccagatgaaatcccaggtgatgacacatctccacgtgattgaagaaaggaggaaccaaagcctctctctgctctacaaagtaccttatgtagcccaagaaattcaagaggaaattgatgagctccttcaggagcagcgtgcagatatggaccagttcactgcctcaatctcagagacccctgtggacgtccgggtgagctctgaggagagtgaggagatcccaccgttccaccccttccaccccttcccagccctacctgagaacgaaggatctggagtgggagagcaggatgggggactgatcggtgccgaagagaaagtgattaacagtaagaataaagtggatgaaaacatggtcattgacgagactctggatgttaaggaaatgattttcaatgccgagagagttggaggcctcgaggaagagcgggaatccgtgggcccactgcgggaggacttcagtctgagtagcagtgctctcattggcctgctggtcatcgcagtggccattgccacggtcatcgtcatcagcctggtgatgctgaggaagaggcagtatggcaccatcagccacgggatcgtggaggttgatccaatgctcaccccagaagagcgtcacctgaacaagatgcagaaccatggctatgagaaccccacctacaaatacctggagcagatgcagatttaggtggcagggagcgcggcagccctggcggagggatgcaggtgggccggaagatcccacgattccgatcgactgccaagcagcagccgctgccaggggctgcgtctgacatcctgacctcctggactgtaggactatataaagtactactgtagaactgcaatttccattcttttaaatgggtgaaaaatggtaatataacaatatatgatatat

SEQ ID NO: 329662 - DNA, 1998 bp, Homo sapiens
caccacctgagtcctgcatgccacttctgtcctccaactaagagcggtggtgtagtttttaacagttcttacgtgtcctctgagggctatttcagaatcttctagactacagagagaaaacctgagatttccgttgttcacctaagggtctgtagagaatcttttttacatgaaggcccagattcttaacaaggtattcatgcctactaacgtacgagaacttcaggtttaggccactgatatcagccttccaatttccaccttaatagtgtgctaagtggagaatttcgagctcataaataaaagtatcgccaacccgactcaggtgaaagagcggatggaggtgtgtgagaatcaccagcactggcacacggtagtcaaagaggcatgtctgactcagggaatgaccttatatagctacggcatgctgctcccatgtggggtagaccagttccatggcactgaatatgtgtgctgccctcagacaaagattattggatctgtgtcaaaagaagaggaagaggaagatgaagaggaagaggaagaggaagatgaagaggaagactatgatgtttataaaagtgaatttcctactgaagcagatctggaagacttcacagaagcagctgtggatgaggatgatgaggatgaggaagaaggggaggaagtggtggaggaccgagattactactatgacaccttcaaaggagatgactacaatgaggagaatcctactgaacccggcagcgacggcaccatgtcagacaaggaaattactcatgatgtcaaagttcctccaactcctctgccaaccaatgatgttgatgtgtatttcgagacctctgcagatgataatgagcatgctcgcttccagaaggctaaggagcagctggagattcggcaccgcaaccgaatggacagggtaaagaaggaatgggaagaggcagagcttcaagctaagaacctccccaaagcagagaggcagactctgattcagcacttccaagccatggttaaagctttagagaaggaagcagccagtgagaagcagcagctggtggagacccacctggcccgagtggaagctatgctgaatgaccgccgtcggatggctctggagaactacctggctgccttgcagtctgacccgccacggcctcatcgcattctccaggccttacggcgttatgtccgtgctgagaacaaagatcgcttacataccatccgtcattaccagcatgtgttggctgttgacccagaaaaggcggcccagatgaaatcccaggtgatgacacatctccacgtgattgaagaaaggaggaaccaaagcctctctctgctctacaaagtaccttatgtagcccaagaaattcaagaggaaattgatgagctccttcaggagcagcgtgcagatatggaccagttcactgcctcaatctcagagacccctgtggacgtccgggtgagctctgaggagagtgaggagatcccaccgttccaccccttccaccccttcccagccctacctgagaacgaagacactcagccggagttgtaccacccaatgaaaaaaggatctggagtgggagagcaggatgggggactgatcggtgccgaagagaaagtgattaacagtaagaataaagtggatgaaaacatggtcattgacgagactctggatgttaaggaaatgattttcaatgccgagagagttggaggcctcgaggaagagcgggaatccgtgggcccactgcgggaggacttcagtctgagtagcagtgctctcattggcctgctggtcatcgcagtggccattgccacggtcatcgtcatcagcctggtgatgctgaggaagaggcagtatggcaccatcagccacgggatcgtggagtgattcaatgcttacccccggaggggggtaacttgaccaggtggagaaccatggctatgagaaacccaacttacaattatctgcatctgttccaaggtgctcgagcc

SEQ ID NO: 329663 - DNA, 1962 bp, Homo sapiens
caccacctgagtcctgcatgccacttctgtcctccaactaagagcggtggtgtagtttttaacagttcttacgtgtcctctgagggctatttcagaatcttctagactacagagagaaaacctgagatttccgttgttcacctaagggtctgtagagaatcttttttacatgaaggcccagattcttaacaaggtattcatgcctactaacgtacgagaacttcaggtttaggccactgatatcagccttccaatttccaccttaatagtgtgctaagtggagaatttcgagctcataaataaaagtatcgccaacccgactcaggtgaaagagcggatggaggtgtgtgagaatcaccagcactggcacacggtagtcaaagaggcatgtctgactcagggaatgaccttatatagctacggcatgctgctcccatgtggggtagaccagttccatggcactgaatatgtgtgctgccctcagacaaagattattggatctgtgtcaaaagaagaggaagaggaagatgaagaggaagaggaagaggaagatgaagaggaagactatgatgtttataaaagtgaatttcctactgaagcagatctggaagacttcacagaagcagctgtggatgaggatgatgaggatgaggaagaaggggaggaagtggtggaggaccgagattactactatgacaccttcaaaggagatgactacaatgaggagaatcctactgaacccggcagcgacggcaccatgtcagacaaggaaattactcatgatgtcaaagttcctccaactcctctgccaaccaatgatgttgatgtgtatttcgagacctctgcagatgataatgagcatgctcgcttccagaaggctaaggagcagctggagattcggcaccgcaaccgaatggacagggtaaagaaggaatgggaagaggcagagcttcaagctaagaacctccccaaagcagagaggcagactctgattcagcacttccaagccatggttaaagctttagagaaggaagcagccagtgagaagcagcagctggtggagacccacctggcccgagtggaagctatgctgaatgaccgccgtcggatggctctggagaactacctggctgccttgcagtctgacccgccacggcctcatcgcattctccaggccttacggcgttatgtccgtgctgagaacaaagatcgcttacataccatccgtcattaccagcatgtgttggctgttgacccagaaaaggcggcccagatgaaatcccaggtgatgacacatctccacgtgattgaagaaaggaggaaccaaagcctctctctgctctacaaagtaccttatgtagcccaagaaattcaagaggaaattgatgagctccttcaggagcagcgtgcagatatggaccagttcactgcctcaatctcagagacccctgtggacgtccgggtgagctctgaggagagtgaggagatcccaccgttccaccccttccaccccttcccagccctacctgagaacgaaggatctggagtgggagagcaggatgggggactgatcggtgccgaagagaaagtgattaacagtaagaataaagtggatgaaaacatggtgagcctgttctttcttctgcccaacacgctttacttttgagactcattagagcgagtgacctgatgtcagatgcttccaggtgcacgtctctgtgttcgttttccgcacagtagaaggttggagggctccaacggctcccacagactggctgtggtgtttagcatctgggtatgaaaaggattaaaaagcccttttcagcagtagctcatctcttgctatagagtaggaaaatatatttacaactaaagatatgaataacctgttagagccattttcaagtgagtagagagttaataacttggattagtgttggggatacatcacgggtcctctag

SEQ ID NO: 329664 - DNA, 1720 bp, Homo sapiens
caccacctgagtcctgcatgccacttctgtcctccaactaagagcggtggtgtagtttttaacagttcttacgtgtcctctgagggctatttcagaatcttctagactacagagagaaaacctgagatttccgttgttcacctaagggtctgtagagaatcttttttacatgaaggcccagattcttaacaaggtattcatgcctactaacgtacgagaacttcaggtttaggccactgatatcagccttccaatttccaccttaatagtgtgctaagtggagaatttcgagctcataaataaaagtatcgccaacccgactcaggtgaaagagcggatggaggtgtgtgagaatcaccagcactggcacacggtagtcaaagaggcatgtctgactcagggaatgaccttatatagctacggcatgctgctcccatgtggggtagaccagttccatggcactgaatatgtgtgctgccctcagacaaagattattggatctgtgtcaaaagaagaggaagaggaagatgaagaggaagaggaagaggaagatgaagaggaagactatgatgtttataaaagtgaatttcctactgaagcagatctggaagacttcacagaagcagctgtggatgaggatgatgaggatgaggaagaaggggaggaagtggtggaggaccgagattactactatgacaccttcaaaggagatgactacaatgaggagaatcctactgaacccggcagcgacggcaccatgtcagacaaggaaattactcatgatgtcaaagttcctccaactcctctgccaaccaatgatgttgatgtgtatttcgagacctctgcagatgataatgagcatgctcgcttccagaaggctaaggagcagctggagattcggcaccgcaaccgaatggacagggtaaagaaggaatgggaagaggcagagcttcaagctaagaacctccccaaagcagagaggcagactctgattcagcacttccaagccatggttaaagctttagagaaggaagcagccagtgagaagcagcagctggtggagacccacctggcccgagtggaagctatgctgaatgaccgccgtcggatggctctggagaactacctggctgccttgcagtctgacccgccacggcctcatcgcattctccaggccttacggcgttatgtccgtgctgagaacaaagatcgcttacataccatccgtcattaccagcatgtgttggctgttgacccagaaaaggcggcccagatgaaatcccaggtgatgacacatctccacgtgattgaagaaaggaggaaccaaagcctctctctgctctacaaagtaccttatgtagcccaagaaattcaagaggaaattgatgagctccttcaggagcagcgtgcagatatggaccagttcactgcctcaatctcagagacccctgtggacgtccgggtgagctctgaggagagtgaggagatcccaccgttccaccccttccaccccttcccagccctacctgagaacgaagacactcagccagagagagctctgcacgtcaccaagtaaccaggccccagcctccaggcccccaactccgcccagcctctccccgctctggatcctgcactctaacactcgactctgctgctcatgggaagaacagaattgctcctgcatgcaactaattcaataaaactgtcttgtgagctg

SEQ ID NO: 329665 - DNA, 1576 bp, Homo sapiens
caccacctgagtcctgcatgccacttctgtcctccaactaagagcggtggtgtagtttttaacagttcttacgtgtcctctgagggctatttcagaatcttctagactacagagagaaaacctgagatttccgttgttcacctaagggtctgtagagaatcttttttacatgaaggcccagattcttaacaaggtattcatgcctactaacgtacgagaacttcaggtttaggccactgatatcagccttccaatttccaccttaatagtgtgctaagtggagaatttcgagctcataaataaaagtatcgccaacccgactcaggtgaaagagcggatggaggtgtgtgagaatcaccagcactggcacacggtagtcaaagaggcatgtctgactcagggaatgaccttatatagctacggcatgctgctcccatgtggggtagaccagttccatggcactgaatatgtgtgctgccctcagacaaagattattggatctgtgtcaaaagaagaggaagaggaagatgaagaggaagaggaagaggaagatgaagaggaagactatgatgtttataaaagtgaatttcctactgaagcagatctggaagacttcacagaagcagctgtggatgaggatgatgaggatgaggaagaaggggaggaagtggtggaggaccgagattactactatgacaccttcaaaggagatgactacaatgaggagaatcctactgaacccggcagcgacggcaccatgtcagacaaggaaattactcatgatgtcaaagttcctccaactcctctgccaaccaatgatgttgatgtgtatttcgagacctctgcagatgataatgagcatgctcgcttccagaaggctaaggagcagctggagattcggcaccgcaaccgaatggacagggtaaagaaggaatgggaagaggcagagcttcaagctaagaacctccccaaagcagagaggcagactctgattcagcacttccaagccatggttaaagctttagagaaggaagcagccagtgagaagcagcagctggtggagacccacctggcccgagtggaagctatgctgaatgaccgccgtcggatggctctggagaactacctggctgccttgcagtctgacccgccacggcctcatcgcattctccaggccttacggcgttatgtccgtgctgagaacaaagatcgcttacataccatccgtcattaccagcatgtgttggctgttgacccagaaaaggcggcccagatgaaatcccaggtgatgacacatctccacgtgattgaagaaaggaggaaccaaagcctctctctgctctacaaagtaccttatgtagcccaagaaattcaagaggaaattgatgagctccttcaggagcagcgtgcagatatggaccagttcactgcctcaatctcagagacccctgtggacgtccgggtgagctctgaggagagtgaggagatcccaccgttccaccccttccaccccttcccagccctacctgagaacgaagatctggagtgtagagcagagaagagacaggtcgtggta

SEQ ID NO: 329666 - DNA, 1336 bp, Homo sapiens
caccacctgagtcctgcatgccacttctgtcctccaactaagagcggtggtgtagtttttaacagttcttacgtgtcctctgagggctatttcagaatcttctagactacagagagaaaacctgagatttccgttgttcacctaagggtctgtagagaatcttttttacatgaaggcccagattcttaacaaggtattcatgcctactaacgtacgagaacttcaggtttaggccactgatatcagccttccaatttccaccttaatagtgtgctaagtggagaatttcgagctcataaataaaagtatcgccaacccgactcaggtgaaagagcggatggaggtgtgtgagaatcaccagcactggcacacggtagtcaaagaggcatgtctgactcagggaatgaccttatatagctacggcatgctgctcccatgtggggtagaccagttccatggcactgaatatgtgtgctgccctcagacaaagattattggatctgtgtcaaaagaagaggaagaggaagatgaagaggaagaggaagaggaagatgaagaggaagactatgatgtttataaaagtgaatttcctactgaagcagatctggaagacttcacagaagcagctgtggatgaggatgatgaggatgaggaagaaggggaggaagtggtggaggaccgagattactactatgacaccttcaaaggagatgactacaatgaggagaatcctactgaacccggcagcgacggcaccatgtcagacaaggaaattactcatgatgtcaaagttcctccaactcctctgccaaccaatgatgttgatgtgtatttcgagacctctgcagatgataatgagcatgctcgcttccagaaggctaaggagcagctggagattcggcaccgcaaccgaatggacagggtaaagaaggaatgggaagaggcagagcttcaagctaagaacctccccaaagcagagaggcagactctgattcagcacttccaagccatggttaaagctttagagaaggaagcagccagtgagaagcagcagctggtggagacccacctggcccgagtggaacacattttcaaaaagttaatacataatattgtacatgtttatggggtacatgtgatattttgttacatgcatagaatatgtaatgatcaagtcagggtatttagggtatccatcacctcgagtatttatcatatctatatgttgggaacatttcaagtcctttcttctagctattttgaaatatgtaatacattgttgttaactatagtcacccttctctgctataaaacattagaacttatttctttcgta

SEQ ID NO: 329667 - DNA, 817 bp, Homo sapiens
caccacctgagtcctgcatgccacttctgtcctccaactaagagcggtggtgtagtttttaacagttcttacgtgtcctctgagggctatttcagaatcttctagactacagagagaaaacctgagatttccgttgttcacctaagggtctgtagagaatcttttttacatgaaggcccagattcttaacaaggtattcatgcctactaacgtacgagaacttcaggtttaggccactgatatcagccttccaatttccaccttaatagtgtgctaagtggagaatttcgagctcataaataaaagtatcgccaacccgactcaggtgaaagagcggatggaggtgtgtgagaatcaccagcactggcacacggtagtcaaagaggcatgtctgactcagggaatgaccttatatagctacggcatgctgctcccatgtggggtagaccagttccatggcactgaatatgtgtgctgccctcagacaaagattattggatctgtgtcaaaagaagaggaagaggaagatgaagaggaagaggaagaggaagatgaagaggaagactatgatgtttataaaagtgaatttcctactgaagcagatctggaagacttcacagaagcagctgtggatgaggatgatgaggatgaggaagaaggggaggaagtggtggaggaccgagattactactatgacaccttcaaaggagatgactacaatgaggagaatcctactgaacccggcagcgacgttcctcatcccagtgacgtctcatcccagtgacgttcctcatcccagtgacgtccaaatcccggc

SEQ ID NO: 329668 - DNA, 3642 bp, Homo sapiens
caccacctgagtcctgcatgccacttctgtcctccaactaagagcggtggtgtagtttttaacagttcttacgtgtcctctgagggctatttcagaatcttctagactacagagagaaaacctgagatttccgttgttcacctaagggtctgtagagaatcttttttacatgaaggcccagattcttaacaaggtattcatgcctactaacgtacgagaacttcaggtttaggccactgatatcagccttccaatttccaccttaatagtgtgctaagtggagaatttcgagctcataaataaaagtatcgccaacccgactcaggtgaaagagcggatggaggtgtgtgagaatcaccagcactggcacacggtagtcaaagaggcatgtctgactcagggaatgaccttatatagctacggcatgctgctcccatgtggggtagaccagttccatggcactgaatatgtgtgctgccctcagacaaagattattggatctgtgtcaaaagaagaggaagaggaagatgaagaggaagaggaagaggaagatgaagaggaagactatgatgtttataaaagtgaatttcctactgaagcagatctggaagacttcacagaagcagctgtggatgaggatgatgaggatgaggaagaaggggaggaagtggtggaggaccgagattactactatgacaccttcaaaggagatgactacaatgaggagaatcctactgaacccggcagcgacggcaccatgtcagacaaggaaattactcatgatgtcaaagctgtctgctcccaggaggcgatgacggggccctgccgggccgtgatgcctcgttggtacttcgacctctccaagggaaagtgcgtgcgctttatatatggtggctgcggcggcaacaggaacaattttgagtctgaggattattgtatggctgtgtgtaaagcgatgaggaccgagggtgtcttcagaaaaaagcatttcggcccgctgtcctctccactctggtcccagggaggctggaagcagcctgtgtttgctgttccctttttccagtccagcaatgtgaaccaaaggctccgtctccagcgctcaggcctttatagcacagttcctccaactcctctgccaaccaatgatgttgatgtgtatttcgagacctctgcagatgataatgagcatgctcgcttccagaaggctaaggagcagctggagattcggcaccgcaaccgaatggacagggtaaagaaggaatgggaagaggcagagcttcaagctaagaacctccccaaagcagagaggcagactctgattcagcacttccaagccatggttaaagctttagagaaggaagcagccagtgagaagcagcagctggtggagacccacctggcccgagtggaagctatgctgaatgaccgccgtcggatggctctggagaactacctggctgccttgcagtctgacccgccacggcctcatcgcattctccaggccttacggcgttatgtccgtgctgagaacaaagatcgcttacataccatccgtcattaccagcatgtgttggctgttgacccagaaaaggcggcccagatgaaatcccaggtgatgacacatctccacgtgattgaagaaaggaggaaccaaagcctctctctgctctacaaagtaccttatgtagcccaagaaattcaagaggaaattgatgagctccttcaggagcagcgtgcagatatggaccagttcactgcctcaatctcagagacccctgtggacgtccgggtgagctctgaggagagtgaggagatcccaccgttccaccccttccaccccttcccagccctacctgagaacgaaggatctggagtgggagagcaggatgggggactgatcggtgccgaagagaaagtgattaacagtaagaataaagtggatgaaaacatggtcattgacgagactctggatgttaaggaaatgattttcaatgccgagagagttggaggcctcgaggaagagcgggaatccgtgggcccactgcgggaggacttcagtctgagtagcagtgctctcattggcctgctggtcatcgcagtggccattgccacggtcatcgtcatcagcctggtgatgctgaggaagaggcagtatggcaccatcagccacgggatcgtggaggttgatccaatgctcaccccagaagagcgtcacctgaacaagatgcagaaccatggctatgagaaccccacctacaaatacctggagcagatgcagatttaggtggcagggagcgcggcagccctggcggagggatgcaggtgggccggaagatcccacgattccgatcgactgccaagcagcagccgctgccaggggctgcgtctgacatcctgacctcctggactgtaggactatataaagtactactgtagaactgcaatttccattcttttaaatgggtgaaaaatggtaatataacaatatatgatatataaaccttaaatgaaaaaaatgatctattgcagatatttgatgtagttttcttttttaaattaatcagaaaccccacttccattgtattgtctgacacatgctctcaatatataataaatgggaaatgtcgattttcaataatagacttatatgcaggctgtcgttccggttatgttgtgtaagtcaactcttcagcctcattcactgtcctggcttttatttaaagaaaaaaaaggcagtattccctttttaaatgagctttcaggaagttgctgagaaatggggtggaatagggaactgtaatggccactgaagcacgtgagagaccctcgcaaaatgatgtgaaaggaccagtttcttgaagtccagtgtttccacggctggatacctgtgtgtctccataaaagtcctgtcaccaaggacgttaaaggcattttattccagcgtcttctagagagcttagtgtatacagatgagggtgtccgctgctgctttccttcggaatccagtgcttccacagagattagcctgtagcttatatttgacattcttcactgtctgttgtttacctaccgtagctttttaccgttcacttccccttccaactatgtccagatgtgcaggctcctcctctctggactttctccaaaggcactgaccctcggcctctactttgtcccctcacctccaccccctcctgtcaccggccttgtgacattcactcagagaagaccacaccaaggaaggcggccgctggcccaggagagaacacggggaggtttgtttgtgtgaaaggaaagtagtccaggctgtccctgaaactgagtctgtggacactgtggaaagctttgaacaattgtgttttcgtcacaggagtctttgtaatgcttgtacagttgatgtcgatgctcactgcttctgctttttctttctttttattttaaatctgaaggttctggtaacctgtggtgtatttttattttcctgtgactgtttttgttttgtttttttcctttttcctcccctttgaccctattcatgtctctacccactatgcacagattaaacttcacctacaaactccttaatatgatctgtggagaatgtacacagtttaaacacatcaataaatactttaacttcca

SEQ ID NO: 329669 - DNA, 3512 bp, Homo sapiens
  misc_feature (3496)..(3496): n is a, c, g, or t
  misc_feature (3501)..(3501): n is a, c, g, or t
  misc_feature (3508)..(3508): n is a, c, g, or t
caccacctgagtcctgcatgccacttctgtcctccaactaagagcggtggtgtagtttttaacagttcttacgtgtcctctgagggctatttcagaatcttctagactacagagagaaaacctgagatttccgttgttcacctaagggtctgtagagaatcttttttacatgaaggcccagattcttaacaaggtattcatgcctactaacgtacgagaacttcaggtttaggccactgatatcagccttccaatttccaccttaatagtgtgctaagtggagaatttcgagctcataaataaaagtatcgccaacccgactcaggtgaaagagcggatggaggtgtgtgagaatcaccagcactggcacacggtagtcaaagaggcatgtctgactcagggaatgaccttatatagctacggcatgctgctcccatgtggggtagaccagttccatggcactgaatatgtgtgctgccctcagacaaagattattggatctgtgtcaaaagaagaggaagaggaagatgaagaggaagaggaagaggaagatgaagaggaagactatgatgtttataaaagtgaatttcctactgaagcagatctggaagacttcacagaagcagctgtggatgaggatgatgaggatgaggaagaaggggaggaagtggtggaggaccgagattactactatgacaccttcaaaggagatgactacaatgaggagaatcctactgaacccggcagcgacggcaccatgtcagacaaggaaattactcatgatgtcaaagctgtctgctcccaggaggcgatgacggggccctgccgggccgtgatgcctcgttggtacttcgacctctccaagggaaagtgcgtgcgctttatatatggtggctgcggcggcaacaggaacaattttgagtctgaggattattgtatggctgtgtgtaaagcgatgattcctccaactcctctgccaaccaatgatgttgatgtgtatttcgagacctctgcagatgataatgagcatgctcgcttccagaaggctaaggagcagctggagattcggcaccgcaaccgaatggacagggtaaagaaggaatgggaagaggcagagcttcaagctaagaacctccccaaagcagagaggcagactctgattcagcacttccaagccatggttaaagctttagagaaggaagcagccagtgagaagcagcagctggtggagacccacctggcccgagtggaagctatgctgaatgaccgccgtcggatggctctggagaactacctggctgccttgcagtctgacccgccacggcctcatcgcattctccaggccttacggcgttatgtccgtgctgagaacaaagatcgcttacataccatccgtcattaccagcatgtgttggctgttgacccagaaaaggcggcccagatgaaatcccaggtgatgacacatctccacgtgattgaagaaaggaggaaccaaagcctctctctgctctacaaagtaccttatgtagcccaagaaattcaagaggaaattgatgagctccttcaggagcagcgtgcagatatggaccagttcactgcctcaatctcagagacccctgtggacgtccgggtgagctctgaggagagtgaggagatcccaccgttccaccccttccaccccttcccagccctacctgagaacgaaggatctggagtgggagagcaggatgggggactgatcggtgccgaagagaaagtgattaacagtaagaataaagtggatgaaaacatggtcattgacgagactctggatgttaaggaaatgattttcaatgccgagagagttggaggcctcgaggaagagcgggaatccgtgggcccactgcgggaggacttcagtctgagtagcagtgctctcattggcctgctggtcatcgcagtggccattgccacggtcatcgtcatcagcctggtgatgctgaggaagaggcagtatggcaccatcagccacgggatcgtggaggttgatccaatgctcaccccagaagagcgtcacctgaacaagatgcagaaccatggctatgagaaccccacctacaaatacctggagcagatgcagatttaggtggcagggagcgcggcagccctggcggagggatgcaggtgggccggaagatcccacgattccgatcgactgccaagcagcagccgctgccaggggctgcgtctgacatcctgacctcctggactgtaggactatataaagtactactgtagaactgcaatttccattcttttaaatgggtgaaaaatggtaatataacaatatatgatatataaaccttaaatgaaaaaaatgatctattgcagatatttgatgtagttttcttttttaaattaatcagaaaccccacttccattgtattgtctgacacatgctctcaatatataataaatgggaaatgtcgattttcaataatagacttatatgcaggctgtcgttccggttatgttgtgtaagtcaactcttcagcctcattcactgtcctggcttttatttaaagaaaaaaaaggcagtattccctttttaaatgagctttcaggaagttgctgagaaatggggtggaatagggaactgtaatggccactgaagcacgtgagagaccctcgcaaaatgatgtgaaaggaccagtttcttgaagtccagtgtttccacggctggatacctgtgtgtctccataaaagtcctgtcaccaaggacgttaaaggcattttattccagcgtcttctagagagcttagtgtatacagatgagggtgtccgctgctgctttccttcggaatccagtgcttccacagagattagcctgtagcttatatttgacattcttcactgtctgttgtttacctaccgtagctttttaccgttcacttccccttccaactatgtccagatgtgcaggctcctcctctctggactttctccaaaggcactgaccctcggcctctactttgtcccctcacctccaccccctcctgtcaccggccttgtgacattcactcagagaagaccacaccaaggaaggcggccgctggcccaggagagaacacggggaggtttgtttgtgtgaaaggaaagtagtccaggctgtccctgaaactgagtctgtggacactgtggaaagctttgaacaattgtgttttcgtcacaggagtctttgtaatgcttgtacagttgatgtcgatgctcactgcttctgctttttctttctttttattttaaatctgaaggttctggtaacctgtggtgtatttttattttcctgtgactgtttttgttttgtttttttcctttttcctcccctttgaccctattcatgtctctacccactatgcacagattaaacttcacctacaaactccttaatatgatctgtggagaatgtacacagtttaaacacatcaataaatactttaacttccaaaaaaaaaaaccncgggngtgtttntttt

SEQ ID NO: 329670 - DNA, 4126 bp, Homo sapiens
caccacctgagtcctgcatgccacttctgtcctccaactaagagcggtggtgtagtttttaacagttcttacgtgtcctctgagggctatttcagaatcttctagactacagagagaaaacctgagatttccgttgttcacctaagggtctgtagagaatcttttttacatgaaggcccagattcttaacaaggtattcatgcctactaacgtacgagaacttcaggtttaggccactgatatcagccttccaatttccaccttaatagtgtgctaagtggagaatttcgagctcataaataaaagtatcgccaacccgactcaggtgaaagagcggatggaggtgtgtgagaatcaccagcactggcacacggtagtcaaagaggcatgtctgactcagggaatgaccttatatagctacggcatgctgctcccatgtggggtagaccagttccatggcactgaatatgtgtgctgccctcagacaaagattattggatctgtgtcaaaagaagaggaagaggaagatgaagaggaagaggaagaggaagatgaagaggaagactatgatgtttataaaagtgaatttcctactgaagcagatctggaagacttcacagaagcagctgtggatgaggatgatgaggatgaggaagaaggggaggaagtggtggaggaccgagattactactatgacaccttcaaaggagatgactacaatgaggagaatcctactgaacccggcagcgacggcaccatgtcagacaaggaaattactcatgatgtcaaagctgtctgctcccaggaggcgatgacggggccctgccgggccgtgatgcctcgttggtacttcgacctctccaagggaaagtgcgtgcgctttatatatggtggctgcggcggcaacaggaacaattttgagtctgaggattattgtatggctgtgtgtaaagcgatgattcctccaactcctctgccaaccaatgatgttgatgtgtatttcgagacctctgcagatgataatgagcatgctcgcttccagaaggctaaggagcagctggagattcggcaccgcaaccgaatggacagggtaaagaaggaatgggaagaggcagagcttcaagctaagaacctccccaaagcagagaggcagactctgattcagcacttccaagccatggttaaagctttagagaaggaagcagccagtgagaagcagcagctggtggagacccacctggcccgagtggaagctatgctgaatgaccgccgtcggatggctctggagaactacctggctgccttgcagtctgacccgccacggcctcatcgcattctccaggccttacggcgttatgtccgtgctgagaacaaagatcgcttacataccatccgtcattaccagcatgtgttggctgttgacccagaaaaggcggcccagatgaaatcccaggtgatgacacatctccacgtgattgaagaaaggaggaaccaaagcctctctctgctctacaaagtaccttatgtagcccaagaaattcaagaggaaattgatgagctccttcaggagcagcgtgcagatatggaccagttcactgcctcaatctcagagacccctgtggacgtccgggtgagctctgaggagagtgaggagatcccaccgttccaccccttccaccccttcccagccctacctgagaacgaaggatctggagtgggagagcaggatgggggactgatcggtgccgaagagaaagtgattaacagtaagaataaagtggatgaaaacatggtcattgacgagactctggatgttaaggaaatgattttcaatgccgagagagttggaggcctcgaggaagagcgggaatccgtgggcccactgcgggaggacttcagtctgagtagcagtgctctcattggcctgctggtcatcgcagtggccattgccacggtcatcgtcatcagcctggtgatgctgaggaagaggcagtatggcaccatcagccacgggatcgtggaggttgatccaatgctcaccccagaagagcgtcacctgaacaagatgcagaaccatggctatgagaaccccacctacaaatacctggagcagatgcagatttaggtggcagggagcgcggcagccctggcggagggatgcaggtgggccggaagatcccacgattccgatcgactgccaagcagcagccgctgccaggggctgcgtctgacatcctgacctcctggactgtaggactatataaagtactactgtagaactgcaatttccattcttttaaatgggtgaaaaatggtaatataacaatatatgatatataaaccttaaatgaaaaaaatgatctattgcagatatttgatgtagttttcttttttaaattaatcagaaaccccacttccattgtattgtctgacacatgctctcaatatataataaatgggaaatgtcgattttcaataatagacttatatgcaggctgtcgttccggttatgttgtgtaagtcaactcttcagcctcattcactgtcctggcttttatttaaagaaaaaaaaggcagtattccctttttaaatgagctttcaggaagttgctgagaaatggggtggaatagggaactgtaatggccactgaagcacgtgagagaccctcgcaaaatgatgtgaaaggaccagtttcttgaagtccagtgtttccacggctggatacctgtgtgtctccataaaagtcctgtcaccaaggacgttaaaggcattttattccagcgtcttctagagagcttagtgtatacagatgagggtgtccgctgctgctttccttcggaatccagtgcttccacagagattagcctgtagcttatatttgacattcttcactgtctgttgtttacctaccgtagctttttaccgttcacttccccttccaactatgtccagatgtgcaggctcctcctctctggactttctccaaaggcactgaccctcggcctctactttgtcccctcacctccaccccctcctgtcaccggccttgtgacattcactcagagaagaccacaccaaggaaggcggccgctggcccaggagagaacacggggaggtttgtttgtgtgaaaggaaagtagtccaggctgtccctgaaactgagtctgtggacactgtggaaagctttgaacaattgtgttttcgtcacaggagtctttgtaatgcttgtacagttgatgtcgatgctcactgcttctgctttttctttctttttattttaaatctgaaggttctggtaacctgtggtgtatttttattttcctgtgactgtttttgttttgtttttttcctttttcctcccctttgaccctattcatgtctctacccactatgcacagattaaacttcacctacaaactccttaatatgatctgtggagaatgtacacagtttaaacacatcaataaatactttaacttccaaaaaaaaaaaaaaaaaacaaaaaaaaaaaaaaaaaaaacacgaaacacaaaaaacaacaaaaaaacacacaacaaacaaacacaaacacacaacagacagaaaaaaaaataaagggagcggccccaatacacacaccgagggggcacaccccaaggaagcaacaaatataggatagaaagggagaacaaacaggaggaaaataaacaggcacggcgagcgcaaaaaaaaaacagggagagaaaaaaataaagcgaacatatgagacgaacacacacccacggggggcgacgcacaggcgcgaacacacaaccagaagaaacacatccagagcaaaaaaaaagacgagaagagtgatggcacaacaacgtgagtggggagaaaacacgacgcagggtatataaaaattatcgcggaggacataagagtgaagacaacggacgccgaccgagaggagaggggcgggaggaggcaggatggcgagagaggggagacatggggaagggcgggaagcgtgaaaagagaacaaccacggaagaccgaaggcggagggagccggacgaggggagaaccagaagacagaagagtaagaagcaacgagacgacaccggatggacataacggacaagcacgcacagatctagc

SEQ ID NO: 329671 - DNA, 3778 bp, Homo sapiens
  misc_feature (3498)..(3498): n is a, c, g, or t
  misc_feature (3754)..(3754): n is a, c, g, or t
  misc_feature (3756)..(3756): n is a, c, g, or t
caccacctgagtcctgcatgccacttctgtcctccaactaagagcggtggtgtagtttttaacagttcttacgtgtcctctgagggctatttcagaatcttctagactacagagagaaaacctgagatttccgttgttcacctaagggtctgtagagaatcttttttacatgaaggcccagattcttaacaaggtattcatgcctactaacgtacgagaacttcaggtttaggccactgatatcagccttccaatttccaccttaatagtgtgctaagtggagaatttcgagctcataaataaaagtatcgccaacccgactcaggtgaaagagcggatggaggtgtgtgagaatcaccagcactggcacacggtagtcaaagaggcatgtctgactcagggaatgaccttatatagctacggcatgctgctcccatgtggggtagaccagttccatggcactgaatatgtgtgctgccctcagacaaagattattggatctgtgtcaaaagaagaggaagaggaagatgaagaggaagaggaagaggaagatgaagaggaagactatgatgtttataaaagtgaatttcctactgaagcagatctggaagacttcacagaagcagctgtggatgaggatgatgaggatgaggaagaaggggaggaagtggtggaggaccgagattactactatgacaccttcaaaggagatgactacaatgaggagaatcctactgaacccggcagcgacggcaccatgtcagacaaggaaattactcatgatgtcaaagctgtctgctcccaggaggcgatgacggggccctgccgggccgtgatgcctcgttggtacttcgacctctccaagggaaagtgcgtgcgctttatatatggtggctgcggcggcaacaggaacaattttgagtctgaggattattgtatggctgtgtgtaaagcgatgattcctccaactcctctgccaaccaatgatgttgatgtgtatttcgagacctctgcagatgataatgagcatgctcgcttccagaaggctaaggagcagctggagattcggcaccgcaaccgaatggacagggtaaagaaggaatgggaagaggcagagcttcaagctaagaacctccccaaagcagagaggcagactctgattcagcacttccaagccatggttaaagctttagagaaggaagcagccagtgagaagcagcagctggtggagacccacctggcccgagtggaagctatgctgaatgaccgccgtcggatggctctggagaactacctggctgccttgcagtctgacccgccacggcctcatcgcattctccaggccttacggcgttatgtccgtgctgagaacaaagatcgcttacataccatccgtcattaccagcatgtgttggctgttgacccagaaaaggcggcccagatgaaatcccaggtgatgacacatctccacgtgattgaagaaaggaggaaccaaagcctctctctgctctacaaagtaccttatgtagcccaagaaattcaagaggaaattgatgagctccttcaggagcagcgtgcagatatggaccagttcactgcctcaatctcagagacccctgtggacgtccgggtgagctctgaggagagtgaggagatcccaccgttccaccccttccaccccttcccagccctacctgagaacgaaggatctggagtgggagagcaggatgggggactgatcggtgccgaagagaaagtgattaacagtaagaataaagtggatgaaaacatggtcattgacgagactctggatgttaaggaaatgattttcaatgccgagagagttggaggcctcgaggaagagcgggaatccgtgggcccactgcgggaggacttcagtctgagtagcagtgctctcattggcctgctggtcatcgcagtggccattgccacggtcatcgtcatcagcctggtgatgctgaggaagaggcagtatggcaccatcagccacgggatcgtggaggttgatccaatgctcaccccagaagagcgtcacctgaacaagatgcagaaccatggctatgagaaccccacctacaaatacctggagcagatgcagatttaggtggcagggagcgcggcagccctggcggagggatgcaggtgggccggaagatcccacgattccgatcgactgccaagcagcagccgctgccaggggctgcgtctgacatcctgacctcctggactgtaggactatataaagtactactgtagaactgcaatttccattcttttaaatgggtgaaaaatggtaatataacaatatatgatatataaaccttaaatgaaaaaaatgatctattgcagatatttgatgtagttttcttttttaaattaatcagaaaccccacttccattgtattgtctgacacatgctctcaatatataataaatgggaaatgtcgattttcaataatagacttatatgcaggctgtcgttccggttatgttgtgtaagtcaactcttcagcctcattcactgtcctggcttttatttaaagaaaaaaaaggcagtattccctttttaaatgagctttcaggaagttgctgagaaatggggtggaatagggaactgtaatggccactgaagcacgtgagagaccctcgcaaaatgatgtgaaaggaccagtttcttgaagtccagtgtttccacggctggatacctgtgtgtctccataaaagtcctgtcaccaaggacgttaaaggcattttattccagcgtcttctagagagcttagtgtatacagatgagggtgtccgctgctgctttccttcggaatccagtgcttccacagagattagcctgtagcttatatttgacattcttcactgtctgttgtttacctaccgtagctttttaccgttcacttccccttccaactatgtccagatgtgcaggctcctcctctctggactttctccaaaggcactgaccctcggcctctactttgtcccctcacctccaccccctcctgtcaccggccttgtgacattcactcagagaagaccacaccaaggaaggcggccgctggcccaggagagaacacggggaggtttgtttgtgtgaaaggaaagtagtccaggctgtccctgaaactgagtctgtggacactgtggaaagctttgaacaattgtgttttcgtcacaggagtctttgtaatgcttgtacagttgatgtcgatgctcactgcttctgctttttctttctttttattttaaatctgaaggttctggtaacctgtggtgtatttttattttcctgtgactgtttttgttttgtttttttcctttttcctcccctttgaccctattcatgtctctacccactatgcacagattaaacttcacctacaaactccttaatatgatctgtggagaatgtacacagtttaaacacatcaataaatactttaacttccaaaaaaaaaaaaaaanaaatggagatgttgcccaaaaaaatggatctgttgcagtggtgcaatctgggctcactgaaaccaccacccaggttcaagcaattatcccgccccagcctcccgagtaggtgggattacaggagcgtgccaccatgcccggctactttttgtatttttagtagagacagggttccatcatgttggccaggctagtctcaaacccctgaccccaggtgatcagcccgctcggcctcccagagtgctgggattacagngngaccactgtggccaacctaatg

SEQ ID NO: 329672 - DNA, 3047 bp, Homo sapiens
caccacctgagtcctgcatgccacttctgtcctccaactaagagcggtggtgtagtttttaacagttcttacgtgtcctctgagggctatttcagaatcttctagactacagagagaaaacctgagatttccgttgttcacctaagggtctgtagagaatcttttttacatgaaggcccagattcttaacaaggtattcatgcctactaacgtacgagaacttcaggtttaggccactgatatcagccttccaatttccaccttaatagtgtgctaagtggagaatttcgagctcataaataaaagtatcgccaacccgactcaggtgaaagagcggatggaggtgtgtgagaatcaccagcactggcacacggtagtcaaagaggcatgtctgactcagggaatgaccttatatagctacggcatgctgctcccatgtggggtagaccagttccatggcactgaatatgtgtgctgccctcagacaaagattattggatctgtgtcaaaagaagaggaagaggaagatgaagaggaagaggaagaggaagatgaagaggaagactatgatgtttataaaagtgaatttcctactgaagcagatctggaagacttcacagaagcagctgtggatgaggatgatgaggatgaggaagaaggggaggaagtggtggaggaccgagattactactatgacaccttcaaaggagatgactacaatgaggagaatcctactgaacccggcagcgacggcaccatgtcagacaaggaaattactcatgatgtcaaagttcctccaactcctctgccaaccaatgatgttgatgtgtatttcgagacctctgcagatgataatgagcatgctcgcttccagaaggctaaggagcagctggagattcggcaccgcaaccgaatggacagggtaaagaaggaatgggaagaggcagagcttcaagctaagaacctccccaaagcagagaggcagactctgattcagcacttccaagccatggttaaagctttagagaaggaagcagccagtgagaagcagcagctggtggagacccacctggcccgagtggaagctatgctgaatgaccgccgtcggatggctctggagaactacctggctgccttgcagtctgacccgccacggcctcatcgcattctccaggccttacggcgttatgtccgtgctgagaacaaagatcgcttacataccatccgtcattaccagcatgtgttggctgttgacccagaaaaggcggcccagatgaaatcccaggtgatgacacatctccacgtgattgaagaaaggaggaaccaaagcctctctctgctctacaaagtaccttatgtagcccaagaaattcaagaggaaattgatgagctccttcaggagcagcgtgcagatatggaccagttcactgcctcaatctcagagacccctgtggacgtccgggtgagctctgaggagagtgaggagatcccaccgttccaccccttccaccccttcccagccctacctgagaacgaaggatctggagtgggagagcaggatgggggactgatcggtgccgaagagaaagtgattaacagtaagaataaagtggatgaaaacatggtcattgacgagactctggatgttaaggaaatgattttcaatacctggagcagatgcagatttaggtggcagggagcgcggcagccctggcggagggatgcaggtgggccggaagatcccacgattccgatcgactgccaagcagcagccgctgccaggggctgcgtctgacatcctgacctcctggactgtaggactatataaagtactactgtagaactgcaatttccattcttttaaatgggtgaaaaatggtaatataacaatatatgatatataaaccttaaatgaaaaaaatgatctattgcagatatttgatgtagttttcttttttaaattaatcagaaaccccacttccattgtattgtctgacacatgctctcaatatataataaatgggaaatgtcgattttcaataatagacttatatgcaggctgtcgttccggttatgttgtgtaagtcaactcttcagcctcattcactgtcctggcttttatttaaagaaaaaaaaggcagtattccctttttaaatgagctttcaggaagttgctgagaaatggggtggaatagggaactgtaatggccactgaagcacgtgagagaccctcgcaaaatgatgtgaaaggaccagtttcttgaagtccagtgtttccacggctggatacctgtgtgtctccataaaagtcctgtcaccaaggacgttaaaggcattttattccagcgtcttctagagagcttagtgtatacagatgagggtgtccgctgctgctttccttcggaatccagtgcttccacagagattagcctgtagcttatatttgacattcttcactgtctgttgtttacctaccgtagctttttaccgttcacttccccttccaactatgtccagatgtgcaggctcctcctctctggactttctccaaaggcactgaccctcggcctctactttgtcccctcacctccaccccctcctgtcaccggccttgtgacattcactcagagaagaccacaccaaggaaggcggccgctggcccaggagagaacacggggaggtttgtttgtgtgaaaggaaagtagtccaggctgtccctgaaactgagtctgtggacactgtggaaagctttgaacaattgtgttttcgtcacaggagtctttgtaatgcttgtacagttgatgtcgatgctcactgcttctgctttttctttctttttattttaaatctgaaggttctggtaacctgtggtgtatttttattttcctgtgactgtttttgttttgtttttttcctttttcctcccctttgaccctattcatgtctctacccactatgcacagattaaacttcacctacaaactccttaatatgatctgtggagaatgtacacagtttaaacacatcaataaatactttaacttcca

SEQ ID NO: 329673 - DNA, 3429 bp, Homo sapiens
caccacctgagtcctgcatgccacttctgtcctccaactaagagcggtggtgtagtttttaacagttcttacgtgtcctctgagggctatttcagaatcttctagactacagagagaaaacctgagatttccgttgttcacctaagggtctgtagagaatcttttttacatgaaggcccagattcttaacaaggtattcatgcctactaacgtacgagaacttcaggtttaggccactgatatcagccttccaatttccaccttaatagtgtgctaagtggagaatttcgagctcataaataaaagtatcgccaacccgactcaggtgaaagagcggatggaggtgtgtgagaatcaccagcactggcacacggtagtcaaagaggcatgtctgactcagggaatgaccttatatagctacggcatgctgctcccatgtggggtagaccagttccatggcactgaatatgtgtgctgccctcagacaaagattattggatctgtgtcaaaagaagaggaagaggaagatgaagaggaagaggaagaggaagatgaagaggaagactatgatgtttataaaagtgaatttcctactgaagcagatctggaagacttcacagaagcagctgtggatgaggatgatgaggatgaggaagaaggggaggaagtggtggaggaccgagattactactatgacaccttcaaaggagatgactacaatgaggagaatcctactgaacccggcagcgacggcaccatgtcagacaaggaaattactcatgatgtcaaagctgtctgctcccaggaggcgatgacggggccctgccgggccgtgatgcctcgttggtacttcgacctctccaagggaaagtgcgtgcgctttatatatggtggctgcggcggcaacaggaacaattttgagtctgaggattattgtatggctgtgtgtaaagcgatgattcctccaactcctctgccaaccaatgatgttgatgtgtatttcgagacctctgcagatgataatgagcatgctcgcttccagaaggctaaggagcagctggagattcggcaccgcaaccgaatggacagggtaaagaaggaatgggaagaggcagagcttcaagctaagaacctccccaaagcagagaggcagactctgattcagcacttccaagccatggttaaagctttagagaaggaagcagccagtgagaagcagcagctggtggagacccacctggcccgagtggaagctatgctgaatgaccgccgtcggatggctctggagaactacctggctgccttgcagtctgacccgccacggcctcatcgcattctccaggccttacggcgttatgtccgtgctgagaacaaagatcgcttacataccatccgtcattaccagcatgtgttggctgttgacccagaaaaggcggcccagatgaaatcccaggtgatgacacatctccacgtgattgaagaaaggaggaaccaaagcctctctctgctctacaaagtaccttatgtagcccaagaaattcaagaggaaattgatgagctccttcaggagcagcgtgcagatatggaccagttcactgcctcaatctcagagacccctgtggacgtccgggtgagctctgaggagagtgaggagatcccaccgttccaccccttccaccccttcccagccctacctgagaacgaaggatctggagtgggagagcaggatgggggactgatcggtgccgaagagaaagtgattaacagtaagaataaagtggatgaaaacatggtcattgacgagactctggatgttaaggaaatgattttcaatgccgagagagttggaggcctcgaggaagagcgggaatccgtgggcccactgcgggaggacttcagtctgagtagcagtgctctcattggcctgctggtcatcgcagtggccattgccacggtcatcgtcatcagcctggtgatgctgaggaagaggcagtatggcaccatcagccacgggatcgtggaggttgatccaatgctcaccccagaagagcgtcacctgaacaagatgcagaaccatggctatgagaaccccacctacaaatacctggagcagatgcagatttaggtggcagggagcgcggcagccctggcggagggatgcaggtgggccggaagatcccacgattccgatcgactgccaagcagcagccgctgccaggggctgcgtctgacatcctgacctcctggactgtaggactatataaagtactactgtagaactgcaatttccattcttttaaatgggtgaaaaatggtaatataacaatatatgatatataaaccttaaatgaaaaaaatgatctattgcagatatttgatgtagttttcttttttaaattaatcagaaaccccacttccattgtattgtctgacacatgctctcaatatataataaatgggaaatgtcgattttcaataatagacttatatgcaggctgtcgttccggttatgttgtgtaagtcaactcttcagcctcattcactgtcctggcttttatttaaagaaaaaaaaggcagtattccctttttaaatgagctttcaggaagttgctgagaaatggggtggaatagggaactgtaatggccactgaagcacgtgagagaccctcgcaaaatgatgtgaaaggaccagtttcttgaagtccagtgtttccacggctggatacctgtgtgtctccatagcttagtgtatacagatgagggtgtccgctgctgctttccttcggaatccagtgcttccacagagattagcctgtagcttatatttgacattcttcactgtctgttgtttacctaccgtagctttttaccgttcacttccccttccaactatgtccagatgtgcaggctcctcctctctggactttctccaaaggcactgaccctcggcctctactttgtcccctcacctccaccccctcctgtcaccggccttgtgacattcactcagagaagaccacaccaaggaaggcggccgctggcccaggagagaacacggggaggtttgtttgtgtgaaaggaaagtagtccaggctgtccctgaaactgagtctgtggacactgtggaaagctttgaacaattgtgttttcgtcacaggagtctttgtaatgcttgtacagttgatgtcgatgctcactgcttctgctttttctttctttttattttaaatctgaaggttctggtaacctgtggtgtatttttattttcctgtgactgtttttgttttgtttttttcctttttcctcccctttgaccctattcatgtctctacccactatgcacagattaaacttcacctacaaactccttaatatgatctgtggagaatgtacacagtttaaacacatcaataaatactttaacttcca

SEQ ID NO: 329674 - DNA, 2690 bp, Homo sapiens
caccacctgagtcctgcatgccacttctgtcctccaactaagagcggtggtgtagtttttaacagttcttacgtgtcctctgagggctatttcagaatcttctagactacagagagaaaacctgagatttccgttgttcacctaagggtctgtagagaatcttttttacatgaaggcccagattcttaacaaggtattcatgcctactaacgtacgagaacttcaggtttaggccactgatatcagccttccaatttccaccttaatagtgtgctaagtggagaatttcgagctcataaataaaagtatcgccaacccgactcaggtgaaagagcggatggaggtgtgtgagaatcaccagcactggcacacggtagtcaaagaggcatgtctgactcagggaatgaccttatatagctacggcatgctgctcccatgtggggtagaccagttccatggcactgaatatgtgtgctgccctcagacaaagattattggatctgtgtcaaaagaagaggaagaggaagatgaagaggaagaggaagaggaagatgaagaggaagactatgatgtttataaaagtgaatttcctactgaagcagatctggaagacttcacagaagcagctgtggatgaggatgatgaggatgaggaagaaggggaggaagtggtggaggaccgagattactactatgacaccttcaaaggagatgactacaatgaggagaatcctactgaacccggcagcgacggcaccatgtcagacaaggaaattactcatgatgtcaaagctgtctgctcccaggaggcgatgacggggccctgccgggccgtgatgcctcgttggtacttcgacctctccaagggaaagtgcgtgcgctttatatatggtggctgcggcggcaacaggaacaattttgagtctgaggattattgtatggctgtgtgtaaagcgatgattcctccaactcctctgccaaccaatgatgttgatgtgtatttcgagacctctgcagatgataatgagcatgctcgcttccagaaggctaaggagcagctggagattcggcaccgcaaccgaatggacagggtaaagaaggaatgggaagaggcagagcttcaagctaagaacctccccaaagcagagaggcagactctgattcagcacttccaagccatggttaaagctttagagaaggaagcagccagtgagaagcagcagctggtggagacccacctggcccgagtggaagctatgctgaatgaccgccgtcggatggctctggagaactacctggctgccttgcagtctgacccgccacggcctcatcgcattctccaggccttacggcgttatgtccgtgctgagaacaaagatcgcttacataccatccgtcattaccagcatgtgttggctgttgacccagaaaaggcggcccagatgaaatcccaggtgatgacacatctccacgtgattgaagaaaggaggaaccaaagcctctctctgctctacaaagtaccttatgtagcccaagaaattcaagaggaaattgatgagctccttcaggagcagcgtgcagatatggaccagttcactgcctcaatctcagagacccctgtggacgtccgggtgagctctgaggagagtgaggagatcccaccgttccaccccttccaccccttcccagccctacctgagaacgaaggatctggagtgggagagcaggatgggggactgatcggtgccgaagagaaagtgattaacagtaagaataaagtggatgaaaacatggtcattgacgagactctggatgttaaggaaatgattttcaatgccgagagagttggaggcctcgaggaagagcgggaatccgtgggcccactgcgggaggacttcagtctgagtagcagtgctctcattggcctgctggtcatcgcagtggccattgccacggtcatcgtcatcagcctggtgatgctgaggaagaggcagtatggcaccatcagccacgggatcgtggaggttgatccaatgctcaccccagaagagcgtcacctgaacaagatgcagaaccatggctatgagaaccccacctacaaatacctggagcagatgcagatttaggtggcagggagcgcggcagccctggcggagggatgcagtgcaggctcctcctctctggactttctccaaaggcactgaccctcggcctctactttgtcccctcacctccaccccctcctgtcaccggccttgtgacattcactcagagaagaccacaccaaggaaggcggccgctggcccaggagagaacacggggaggtttgtttgtgtgaaaggaaagtagtccaggctgtccctgaaactgagtctgtggacactgtggaaagctttgaacaattgtgttttcgtcacaggagtctttgtaatgcttgtacagttgatgtcgatgctcactgcttctgctttttctttctttttattttaaatctgaaggttctggtaacctgtggtgtatttttattttcctgtgactgtttttgttttgtttttttcctttttcctcccctttgaccctattcatgtctctacccactatgcacagattaaacttcacctacaaactccttaatatgatctgtggagaatgtacacagtttaaacacatcaataaatactttaacttcca

SEQ ID NO: 329675 - DNA, 2151 bp, Homo sapiens
caccacctgagtcctgcatgccacttctgtcctccaactaagagcggtggtgtagtttttaacagttcttacgtgtcctctgagggctatttcagaatcttctagactacagagagaaaacctgagatttccgttgttcacctaagggtctgtagagaatcttttttacatgaaggcccagattcttaacaaggtattcatgcctactaacgtacgagaacttcaggtttaggccactgatatcagccttccaatttccaccttaatagtgtgctaagtggagaatttcgagctcataaataaaagtatcgccaacccgactcaggtgaaagagcggatggaggtgtgtgagaatcaccagcactggcacacggtagtcaaagaggcatgtctgactcagggaatgaccttatatagctacggcatgctgctcccatgtggggtagaccagttccatggcactgaatatgtgtgctgccctcagacaaagattattggatctgtgtcaaaagaagaggaagaggaagatgaagaggaagaggaagaggaagatgaagaggaagactatgatgtttataaaagtgaatttcctactgaagcagatctggaagacttcacagaagcagctgtggatgaggatgatgaggatgaggaagaaggggaggaagtggtggaggaccgagattactactatgacaccttcaaaggagatgactacaatgaggagaatcctactgaacccggcagcgacggcaccatgtcagacaaggaaattactcatgatgtcaaagttcctccaactcctctgccaaccaatgatgttgatgtgtatttcgagacctctgcagatgataatgagcatgctcgcttccagaaggctaaggagcagctggagattcggcaccgcaaccgaatggacagggtaaagaaggaatgggaagaggcagagcttcaagctaagaacctccccaaagcagagaggcagactctgattcagcacttccaagccatggttaaagctttagagaaggaagcagccagtgagaagcagcagctggtggagacccacctggcccgagtggaagctatgctgaatgaccgccgtcggatggctctggagaactacctggctgccttgcagtctgacccgccacggcctcatcgcattctccaggccttacggcgttatgtccgtgctgagaacaaagatcgcttacataccatccgtcattaccagcatgtgttggctgttgacccagaaaaggcggcccagatgaaatcccaggtgatgacacatctccacgtgattgaagaaaggaggaaccaaagcctctctctgctctacaaagtaccttatgtagcccaagaaattcaagaggaaattgatgagctccttcaggagcagcgtgcagatatggaccagttcactgcctcaatctcagagacccctgtggacgtccgggtgagctctgaggagagtgaggagatcccaccgttccaccccttccaccccttcccagccctacctgagaacgaaggatctggagtgggagagcaggatgggggactgatcggtgccgaagagaaagtgattaacagtaagaataaagtggatgaaaacatgtgcaggctcctcctctctggactttctccaaaggcactgaccctcggcctctactttgtcccctcacctccaccccctcctgtcaccggccttgtgacattcactcagagaagaccacaccaaggaaggcggccgctggcccaggagagaacacggggaggtttgtttgtgtgaaaggaaagtagtccaggctgtccctgaaactgagtctgtggacactgtggaaagctttgaacaattgtgttttcgtcacaggagtctttgtaatgcttgtacagttgatgtcgatgctcactgcttctgctttttctttctttttattttaaatctgaaggttctggtaacctgtggtgtatttttattttcctgtgactgtttttgttttgtttttttcctttttcctcccctttgaccctattcatgtctctacccactatgcacagattaaacttcacctacaaactccttaatatgatctgtggagaatgtacacagtttaaacacatcaataaatactttaacttcca

SEQ ID NO: 329676 - DNA, 1812 bp, Homo sapiens
caccacctgagtcctgcatgccacttctgtcctccaactaagagcggtggtgtagtttttaacagttcttacgtgtcctctgagggctatttcagaatcttctagactacagagagaaaacctgagatttccgttgttcacctaagggtctgtagagaatcttttttacatgaaggcccagattcttaacaaggtattcatgcctactaacgtacgagaacttcaggtttaggccactgatatcagccttccaatttccaccttaatagtgtgctaagtggagaatttcgagctcataaataaaagtatcgccaacccgactcaggtgaaagagcggatggaggtgtgtgagaatcaccagcactggcacacggtagtcaaagaggcatgtctgactcagggaatgaccttatatagctacggcatgctgctcccatgtggggtagaccagttccatggcactgaatatgtgtgctgccctcagacaaagattattggatctgtgtcaaaagaagaggaagaggaagatgaagaggaagaggaagaggaagatgaagaggaagactatgatgtttataaaagtgaatttcctactgaagcagatctggaagacttcacagaagcagctgtggatgaggatgatgaggatgaggaagaaggggaggaagtggtggaggaccgagattactactatgacaccttcaaaggagatgactacaatgaggagaatcctactgaacccggcagcgacggcaccatgtcagacaaggaaattactcatgatgtcaaagttcctccaactcctctgccaaccaatgatgttgatgtgtatttcgagacctctgcagatgataatgagcatgctcgcttccagaaggctaaggagcagctggagattcggcaccgcaaccgaatggacagggtaaagaaggaatgggaagaggcagagcttcaagctaagaacctccccaaagcagagaggcagactctgattcagcacttccaagccatggttaaagctttagagaaggaagcagccagtgagaagcagcagctggtggagacccacctggcccgagtggaagctatgctgaatgaccgccgtcggatggctctggagaactacctggctgccttgcagtctgacccgccacggcctcatcgcattctccaggccttacggcgttatgtccgtgctgagaacaaagatcgcttacataccatccgtcattaccagcatgtgttggctgttgacccagaaaaggcggcccagatgaaatcccagtgcaggctcctcctctctggactttctccaaaggcactgaccctcggcctctactttgtcccctcacctccaccccctcctgtcaccggccttgtgacattcactcagagaagaccacaccaaggaaggcggccgctggcccaggagagaacacggggaggtttgtttgtgtgaaaggaaagtagtccaggctgtccctgaaactgagtctgtggacactgtggaaagctttgaacaattgtgttttcgtcacaggagtctttgtaatgcttgtacagttgatgtcgatgctcactgcttctgctttttctttctttttattttaaatctgaaggttctggtaacctgtggtgtatttttattttcctgtgactgtttttgttttgtttttttcctttttcctcccctttgaccctattcatgtctctacccactatgcacagattaaacttcacctacaaactccttaatatgatctgtggagaatgtacacagtttaaacacatcaataaatactttaacttcca

SEQ ID NO: 329677 - DNA, 1962 bp, Homo sapiens
caccacctgagtcctgcatgccacttctgtcctccaactaagagcggtggtgtagtttttaacagttcttacgtgtcctctgagggctatttcagaatcttctagactacagagagaaaacctgagatttccgttgttcacctaagggtctgtagagaatcttttttacatgaaggcccagattcttaacaaggtattcatgcctactaacgtacgagaacttcaggtttaggccactgatatcagccttccaatttccaccttaatagtgtgctaagtggagaatttcgagctcataaataaaagtatcgccaacccgactcaggtgaaagagcggatggaggtgtgtgagaatcaccagcactggcacacggtagtcaaagaggcatgtctgactcagggaatgaccttatatagctacggcatgctgctcccatgtggggtagaccagttccatggcactgaatatgtgtgctgccctcagacaaagattattggatctgtgtcaaaagaagaggaagaggaagatgaagaggaagaggaagaggaagatgaagaggaagactatgatgtttataaaagtgaatttcctactgaagcagatctggaagacttcacagaagcagctgtggatgaggatgatgaggatgaggaagaaggggaggaagtggtggaggaccgagattactactatgacaccttcaaaggagatgactacaatgaggagaatcctactgaacccggcagcgacggcaccatgtcagacaaggaaattactcatgatgtcaaagttcctccaactcctctgccaaccaatgatgttgatgtgtatttcgagacctctgcagatgataatgagcatgctcgcttccagaaggctaaggagcagctggagattcggcaccgcaaccgaatggacagggtaaagaaggaatgggaagaggcagagcttcaagctaagaacctccccaaagcagagaggcagactctgattcagcacttccaagccatggttaaagctttagagaaggaagcagccagtgagaagcagcagctggtggagacccacctggcccgagtggaagctatgctgaatgaccgccgtcggatggctctggagaactacctggctgccttgcagtctgacccgccacggcctcatcgcattctccaggccttacggcgttatgtccgtgctgagaacaaagatcgcttacataccatccgtcattaccagcatgtgttggctgttgacccagaaaaggcggcccagatgaaatcccaggtgatgacacatctccacgtgattgaagaaaggaggaaccaaagcctctctctgctctacaaagtaccttatgtagcccaagaaattcaagaggaaattgatgagctccttcaggagcagcgtgcagatatggaccagttcactgcctcaatctcagagacccctgtggacgtccgggtgagctctgaggagagtgaggagatcccaccgttccaccccttccaccccttcccagccctacctgagaacgaaggatctggagtgggagagcaggatgggggactgatcggtgccgaagagaaagtgattaacagtaagaataaagtggatgaaaacatggtcattgacgagactctggatgttaaggaaatgattttcaatgccgagagagttggaggcctcgaggaagagcgggaatccgtgggcccactgcgggaggacttcagtctgagtagcagtgctctcattggcctgctggtcatcgcagtggccattgccacggtcatcgtcatcagcctggtgatgctgaggaagaggcagtatggcaccatcagccacgggatcgtggagtgattcaatgcttacccccggaggggggtaacttgaccaggtggagaaccatggctatgagaaacccaacttacaattatctgcatctgttccaaggtgctcgagcc

SEQ ID NO: 329678 - DNA, 2004 bp, Homo sapiens
  misc_feature (1932)..(1932): n is a, c, g, or t
  misc_feature (1970)..(1970): n is a, c, g, or t
caccacctgagtcctgcatgccacttctgtcctccaactaagagcggtggtgtagtttttaacagttcttacgtgtcctctgagggctatttcagaatcttctagactacagagagaaaacctgagatttccgttgttcacctaagggtctgtagagaatcttttttacatgaaggcccagattcttaacaaggtattcatgcctactaacgtacgagaacttcaggtttaggccactgatatcagccttccaatttccaccttaatagtgtgctaagtggagaatttcgagctcataaataaaagtatcgccaacccgactcaggtgaaagagcggatggaggtgtgtgagaatcaccagcactggcacacggtagtcaaagaggcatgtctgactcagggaatgaccttatatagctacggcatgctgctcccatgtggggtagaccagttccatggcactgaatatgtgtgctgccctcagacaaagattattggatctgtgtcaaaagaagaggaagaggaagatgaagaggaagaggaagaggaagatgaagaggaagactatgatgtttataaaagtgaatttcctactgaagcagatctggaagacttcacagaagcagctgtggatgaggatgatgaggatgaggaagaaggggaggaagtggtggaggaccgagattactactatgacaccttcaaaggagatgactacaatgaggagaatcctactgaacccggcagcgacggcaccatgtcagacaaggaaattactcatgatgtcaaagttcctccaactcctctgccaaccaatgatgttgatgtgtatttcgagacctctgcagatgataatgagcatgctcgcttccagaaggctaaggagcagctggagattcggcaccgcaaccgaatggacagggtaaagaaggaatgggaagaggcagagcttcaagctaagaacctccccaaagcagagaggcagactctgattcagcacttccaagccatggttaaagctttagagaaggaagcagccagtgagaagcagcagctggtggagacccacctggcccgagtggaagctatgctgaatgaccgccgtcggatggctctggagaactacctggctgccttgcagtctgacccgccacggcctcatcgcattctccaggccttacggcgttatgtccgtgctgagaacaaagatcgcttacataccatccgtcattaccagcatgtgttggctgttgacccagaaaaggcggcccagatgaaatcccaggtgatgacacatctccacgtgattgaagaaaggaggaaccaaagcctctctctgctctacaaagtaccttatgtagcccaagaaattcaagaggaaattgatgagctccttcaggagcagcgtgcagatatggaccagttcactgcctcaatctcagagacccctgtggacgtccgggtgagctctgaggagagtgaggagatcccaccgttccaccccttccaccccttcccagccctacctgagaacgaagacactcagccggagttgtaccacccaatgaaaaaaggatctggagtgggagagcaggatgggggactgatcggtgccgaagagaaagtgattaacagtaagaataaagtggatgaaaacatggtcattgacgagactctggatgttaaggaaatgattttcaatgccgagagagttggaggcctcgaggaagagcgggaatccgtgggcccactgcgggaggacttcagtctgagtagcagtgctctcattggcctgctggtcatcgcagtggccattgccacggtcatcgtcatcagcctggtgatgctgaggaagaggcagtatggcaccatcagccacgggatcgtggaggttggatccaattgttcaccccaggaagaggggtcaacctnaacaaagatggaaggacccattggggtttttgaagaancccccacccacaaaattaccttggagggaaagtt

SEQ ID NO: 329679 - DNA, 1866 bp, Homo sapiens
caccacctgagtcctgcatgccacttctgtcctccaactaagagcggtggtgtagtttttaacagttcttacgtgtcctctgagggctatttcagaatcttctagactacagagagaaaacctgagatttccgttgttcacctaagggtctgtagagaatcttttttacatgaaggcccagattcttaacaaggtattcatgcctactaacgtacgagaacttcaggtttaggccactgatatcagccttccaatttccaccttaatagtgtgctaagtggagaatttcgagctcataaataaaagtatcgccaacccgactcaggtgaaagagcggatggaggtgtgtgagaatcaccagcactggcacacggtagtcaaagaggcatgtctgactcagggaatgaccttatatagctacggcatgctgctcccatgtggggtagaccagttccatggcactgaatatgtgtgctgccctcagacaaagattattggatctgtgtcaaaagaagaggaagaggaagatgaagaggaagaggaagaggaagatgaagaggaagactatgatgtttataaaagtgaatttcctactgaagcagatctggaagacttcacagaagcagctgtggatgaggatgatgaggatgaggaagaaggggaggaagtggtggaggaccgagattactactatgacaccttcaaaggagatgactacaatgaggagaatcctactgaacccggcagcgacggcaccatgtcagacaaggaaattactcatgatgtcaaagttcctccaactcctctgccaaccaatgatgttgatgtgtatttcgagacctctgcagatgataatgagcatgctcgcttccagaaggctaaggagcagctggagattcggcaccgcaaccgaatggacagggtaaagaaggaatgggaagaggcagagcttcaagctaagaacctccccaaagcagagaggcagactctgattcagcacttccaagccatggttaaagctttagagaaggaagcagccagtgagaagcagcagctggtggagacccacctggcccgagtggaagctatgctgaatgaccgccgtcggatggctctggagaactacctggctgccttgcagtctgacccgccacggcctcatcgcattctccaggccttacggcgttatgtccgtgctgagaacaaagatcgcttacataccatccgtcattaccagcatgtgttggctgttgacccagaaaaggcggcccagatgaaatcccaggtgatgacacatctccacgtgattgaagaaaggaggaaccaaagcctctctctgctctacaaagtaccttatgtagcccaagaaattcaagaggaaattgatgagctccttcaggagcagcgtgcagatatggaccagttcactgcctcaatctcagagacccctgtggacgtccgggtgagctctgaggagagtgaggagatcccaccgttccaccccttccaccccttcccagccctacctgagaacgaagacactcagccggagttgtaccacccaatgaaaaaaggatctggagtgggagagcaggatgggggactgatcggtgccgaagagaaagtgattaacagtaagaataaagtggatgaaaacatgcattgacgagactctgccaaccaatgatgttgatgtgtatttcgagacctctgcagacgataatgagcatgctcgcttccagaaggctaaggagcagctggagattcggcaccgcaaccgaatggacagggtaaagaaggaatgggaagaggcagagcttcaagctaagaacctccccaaagcagatgaggtggcagatgaggggg

SEQ ID NO: 329680 - DNA, 1599 bp, Homo sapiens
caccacctgagtcctgcatgccacttctgtcctccaactaagagcggtggtgtagtttttaacagttcttacgtgtcctctgagggctatttcagaatcttctagactacagagagaaaacctgagatttccgttgttcacctaagggtctgtagagaatcttttttacatgaaggcccagattcttaacaaggtattcatgcctactaacgtacgagaacttcaggtttaggccactgatatcagccttccaatttccaccttaatagtgtgctaagtggagaatttcgagctcataaataaaagtatcgccaacccgactcaggtgaaagagcggatggaggtgtgtgagaatcaccagcactggcacacggtagtcaaagaggcatgtctgactcagggaatgaccttatatagctacggcatgctgctcccatgtggggtagaccagttccatggcactgaatatgtgtgctgccctcagacaaagattattggatctgtgtcaaaagaagaggaagaggaagatgaagaggaagaggaagaggaagatgaagaggaagactatgatgtttataaaagtgaatttcctactgaagcagatctggaagacttcacagaagcagctgtggatgaggatgatgaggatgaggaagaaggggaggaagtggtggaggaccgagattactactatgacaccttcaaaggagatgactacaatgaggagaatcctactgaacccggcagcgacggcaccatgtcagacaaggaaattactcatgatgtcaaagttcctccaactcctctgccaaccaatgatgttgatgtgtatttcgagacctctgcagatgataatgagcatgctcgcttccagaaggctaaggagcagctggagattcggcaccgcaaccgaatggacagggtaaagaaggaatgggaagaggcagagcttcaagctaagaacctccccaaagcagagaggcagactctgattcagcacttccaagccatggttaaagctttagagaaggaagcagccagtgagaagcagcagctggtggagacccacctggcccgagtggaagctatgctgaatgaccgccgtcggatggctctggagaactacctggctgccttgcagtctgacccgccacggcctcatcgcattctccaggccttacggcgttatgtccgtgctgagaacaaagatcgcttacataccatccgtcattaccagcatgtgttggctgttgacccagaaaaggcggcccagatgaaatcccaggtgatgacacatctccacgtgattgaagaaaggaggaaccaaagcctctctctgctctacaaagtaccttatgtagcccaagaaattcaagaggaaattgcctgctttctgtcccctgccctgtcttcatcagatgagctccttcaggagcagcgtgcagatatggaccagttcactgcctcaatctcagagacccctgtggacgtccgggtgagctctgaggagagtgaggagatcccaccgttccaccccttccaccccttcccagccctacctgagaacgaaggtgtgtatgggcgacggtgccacttctg

SEQ ID NO: 329681 - DNA, 948 bp, Homo sapiens
caccacctgagtcctgcatgccacttctgtcctccaactaagagcggtggtgtagtttttaacagttcttacgtgtcctctgagggctatttcagaatcttctagactacagagagaaaacctgagatttccgttgttcacctaagggtctgtagagaatcttttttacatgaaggcccagattcttaacaaggtattcatgcctactaacgtacgagaacttcaggtttaggccactgatatcagccttccaatttccaccttaatagtgtgctaagtggagaatttcgagctcataaataaaagtatcgccaacccgactcaggtgaaagagcggatggaggtgtgtgagaatcaccagcactggcacacggtagtcaaagaggcatgtctgactcagggaatgaccttatatagctacggcatgctgctcccatgtggggtagaccagttccatggcactgaatatgtgtgctgccctcagacaaagattattggatctgtgtcaaaagaagaggaagaggaagatgaagaggaagaggaagaggaagatgaagaggaagactatgatgtttataaaagtgaatttcctactgaagcagatctggaagacttcacagaagcagctgtggatgaggatgatgaggatgaggaagaaggggaggaagtggtggaggaccgagattactactatgacaccttcaaaggagatgactacaatgaggagaatcctactgaacccggcagcgacggcaccatgtcagacaaggaaattactcatgatgtcaaagctgtctgctcccaggaggcgatgacggggccctgccgggccgtgatgcctcgttggtacttcgacctctccaagggaaagtgcgtgcgctttatatatggtggctgcagtcgctggatgacaagtgttacacaagagacagctatgagccatatacg

SEQ ID NO: 329682 - DNA, 510 bp, Homo sapiens
ctcgttgaggccaaaaagacagatttttttttttgtaattttaaaacattgtttatttaatagtacataattattacaaaaagcagaaatgtaaatattattgtaatcaccaactacaaacttgcaggcaatctagaggtcatttgcaaaatatttgtcagttctagggtatagactgaaattagtagtcttaagggatttcttgtagatggtcttcagaaggtcttgaggtgactgtattcatactctggcaatcctcataataatgtcctagttaataaaattgctgcaatccattgtcctttaagaaaagaaagtaggctggacatggtggctcacacctgtaatcccagtgctttgagagaccgaggcaggaggattgcttgaggccaggagttcaagaccagtttgggcagtataatgagaccccatcttgtagcggggttaataagagagccaggcagctcaacctcccctcccctccccaccgcccgctcccgcctcccccct

SEQ ID NO: 329683 - DNA, 512 bp, Homo sapiens
ctcgttgaggccaaaaagacagatttttttttttgtaattttaaaacattgtttatttaatagtacataattattacaaaaagcagaaatgtaaatattattgtaatcaccaactacaaacttgcaggcaatctagaggtcatttgcaaaatatttgtcagttctagggtatagactgaaattagtagtcttaagggatttcttgtagatggtcttcagaaggtcttgaggtgactgtattcatactctggcaatcctcataataatgtcctagttaataaaattgctgcaatccattgtcctttaagaaaagaaagtaggctggacatggtggctcacacctgtaatcccagtgctttgagagaccgaggcaggaggattgcttgaggccaggagttcaagaccagtttgggcagtataatgagaccccatctgtgtagcggtggaaataagagagtcgtgcagctaacccttccccccccctcccgtacacagccgctccaacctccgcc

SEQ ID NO: 329684 - DNA, 355 bp, Homo sapiens
gagccccctgggagtcctggtggcctgagaggcagggaagagtcagtgagtggaggaagagcatgaatgaattttcccgagggcaggagaggcagttgtgtgtccctggggttgtcttgcatgggatcaccaatgcctgcatgaagacaggaagatgggattagaagacttggcctccctcaaatcggagcagctgctccagctcaccatagaagtgggcaagaaggagagaacacgaaggaggaaagagacatgggttctcattagacaagtgggtcagattcttcctcttttttgttctgcaccaatgtctttccttgcggtcttcattaacctgtgactctgatgaccctgc

SEQ ID NO: 329685 - DNA, 136 bp, Homo sapiens
atcaacctccataaactatgacctcctcaccacccagccctgggcatcacaacccccaactcactcctcttccatgacaatcgcaaagtcactggcatgtgttccttccatccctgtcccatgatccctgtgcccc

SEQ ID NO: 329686 - DNA, 3416 bp, Homo sapiens
cgttgcggcagcgggatcgtaaagctgttgatatcgattcgggcggtgcgggccggggggggacgcaggcgagcgtgcgggttccaaccctcgacccgtgccctgagcgtgcagacttcgcaagcgctcggacgtcgtcgcgccatggcggagaccaagattatctaccacatggacgaggaggagacgccgtacctggtcaagctgcccgtggcccccgagcgcgtcacgctggccgacttcaagaacgtgctcagcaaccggcccgtgcacgcctacaaattcttctttaagtccatggaccaggacttcggggtggtgaaggaggagatctttgatgacaatgccaagcttccctgcttcaacggccgcgtggtctcctggctggtcctggctgagggtgctcactcggatgcggggtcccagggcacggacagccacacagacctgcccccgcctcttgagcggacaggcggcatcggggactcccggcccccctccttccacccgaatgtggccagcagccgtgacgggatggacaacgagacaggcacggagtccatggtcagtcaccggcgggagcgtgcccgacgccggaaccgcgaggaggccgcccggaccaatgggcacccaaggggagaccgacggcgggatgtggggctgcccccagacagcgcgtccaccgccctcagcagcgagcttgagtccagcagctttgtggactcggacgaggatggcagcacgagcaggctcagcagctccacggagcagagcacctcatccagactcatccggaagcacaaacgccggcggaggaagcagcgccttcggcaggcggaccgggcctcctccttcagcagcataaccgactccaccatgtccctcaacatcgtcactgtcacgctcaacatggaaagacatcactttctgggcatcagcatcgtggggcagagcaacgaccgtggagacggcggcatctacattggctccatcatgaagggcggggctgtggccgctgacggccgcatcgagcccggcgacatgttgctgcaggtgaatgacgtgaactttgagaacatgagcaatgacgatgccgtgcgggtgctgcgggagatcgtttcccagacggggcccatcagcctcactgtggccaagtgctgggacccaacgccccgaagctacttcaccgtcccacgggctgacccggtgcggcccatcgaccccgccgcctggctgtcccacacggcggcactgacaggagccctgccccgctacgagctggaagaggcgccgctgacggtgaagagtgacatgagcgccgtcgtccgggtcatgcagctgccagactcgggactggagatccgcgaccgcatgtggctcaagatcaccatcgccaatgccgtcatcggggcggacgtggtggactggctgtacacacacgtggagggcttcaaggagcggcgggaggcccggaagtacgccagcagcttgctgaagcacggcttcctgcggcacacggtcaacaagatcaccttctccgagcagtgctactacgtcttcggggatctctgcagcaatctcgccaccctgaacctcaacagtggctccagtgggacttcggatcaggacacgctggccccgctgccccacccggctgccccctggcctctgggtcagggctacccctaccagtacccgggacccccaccctgcttcccgcctgcctaccaggacccgggctttagctatggcagcggcagcaccgggagtcagcagagtgaagggagcaaaagcagtgggtccacccggagcagccgccgggccccgggccgtgagaaggagcgtcgggcggcgggagctgggggcagtggcagtgaatcggatcacacggcaccgagtggggtggggagcagctggcgagagcgtccggccggccagctcagccgtggcagcagcccacgcagtcaggcctcggctaccgccccggggctccccccgccccaccccacgaccaaggcctatacagtggtgggggggccacccgggggaccccctgtccgggagctggctgccgtccccccggaattgacaggcagccgccagtccttccagaaggctatggggaacccctgcgagttcttcgtggacatcatgtgactcgtggcgcatgccccagccctgcctgaggtggggagctggcggtcctgccgcatgcagagctcgcgtgggcttgccttcgtgggggccaggacgggaggcagggtggggggcaggctggaccaccaccatctgccctggcagcctggctgctccagctcctgacagcacctgtgtctgagcagccgtgttgggggcgctccctctctgcccctcagcgagagcctcggacctcccaaccccttgtgtctggtggggatccctcctgggatgaggaagaccccctcgggctctcggctgacccccacctcctgcacagctgtgcccaggcccccagggtggtccacgcggggcaaccccctgcggtgcacaggccccctgtctggagtagggatctaatttatttatttattgcctggccggtgactcgggggaggaggcgaccctgtcatctgtcccacctgctgctgccccttggagcagcctgcaccttctctcctcccatccggcaacagtctgaaagtacgtggaggacgggaccggaagacgagagagggctggacatcctgcccaccgtgtcccagccagggcagggagggaccatggcccgcagggtcaaggggccccgatgtgcacagctgccacagggagggaggtcttggggagatgggcagtcaggtggcccgtccttggtgagtgcacacactgcgcgcacacatcgcggccttcctggcttctctggcccccacgtgtctgtgctgtagatactgtatcaaagtcccagcgtttagatggttaacatagagctgcttctgtgtaaatgctgcttattttaaacactaaaaagcgtttaattttatgggaaaaaaaaaaaaaaaaaaaaaaaaaaaaaaaaaaaaaaaaaaaaaaaaaaaaaaaaaaagaggggggggcgcacaagaagaagacacaaccccacgagagggccccaacaagacaaacaagcacaaacccaacatgcaggagaacacaggagggccccccacacgagacacgaaccaagataacaaacaaaacagagcagacagggcccagcaactacccaacgcaagagagagaaaggacacaacaccgggagccaagacgagcgagaccacagaggagaagaaccagacccacaacaaccgagagagggagaaaaacaagaggcacacaccaacacccaccacacacaaaaaaagagacacaagaagaaaaaaaaaaccgacacaaagcagcac

SEQ ID NO: 329687 - DNA, 3375 bp, Homo sapiens
cgttgcggcagcgggatcgtaaagctgttgatatcgattcgggcggtgcgggccggggggggacgcaggcgagcgtgcgggttccaaccctcgacccgtgccctgagcgtgcagacttcgcaagcgctcggacgtcgtcgcgccatggcggagaccaagattatctaccacatggacgaggaggagacgccgtacctggtcaagctgcccgtggcccccgagcgcgtcacgctggccgacttcaagaacgtgctcagcaaccggcccgtgcacgcctacaaattcttctttaagtccatggaccaggacttcggggtggtgaaggaggagatctttgatgacaatgccaagcttccctgcttcaacggccgcgtggtctcctggctggtcctggctgagggtgctcactcggatgcggggtcccagggcacggacagccacacagacctgcccccgcctcttgagcggacaggcggcatcggggactcccggcccccctccttccacccgaatgtggccagcagccgtgacgggatggacaacgagacaggcacggagtccatggtcagtcaccggcgggagcgtgcccgacgccggaaccgcgaggaggccgcccggaccaatgggcacccaaggggagaccgacggcgggatgtggggctgcccccagacagcgcgtccaccgccctcagcagcgagcttgagtccagcagctttgtggactcggacgaggatggcagcacgagcaggctcagcagctccacggagcagagcacctcatccagactcatccggaagcacaaacgccggcggaggaagcagcgccttcggcaggcggaccgggcctcctccttcagcagcataaccgactccaccatgtccctcaacatcgtcactgtcacgctcaacatggaaagacatcactttctgggcatcagcatcgtggggcagagcaacgaccgtggagacggcggcatctacattggctccatcatgaagggcggggctgtggccgctgacggccgcatcgagcccggcgacatgttgctgcaggtgaatgacgtgaactttgagaacatgagcaatgacgatgccgtgcgggtgctgcgggagatcgtttcccagacggggcccatcagcctcactgtggccaagtgctgggacccaacgccccgaagctacttcaccgtcccacgggctgacccggtgcggcccatcgaccccgccgcctggctgtcccacacggcggcactgacaggagccctgccccgctacgagctggaagaggcgccgctgacggtgaagagtgacatgagcgccgtcgtccgggtcatgcagctgccagactcgggactggagatccgcgaccgcatgtggctcaagatcaccatcgccaatgccgtcatcggggcggacgtggtggactggctgtacacacacgtggagggcttcaaggagcggcgggaggcccggaagtacgccagcagcttgctgaagcacggcttcctgcggcacacggtcaacaagatcaccttctccgagcagtgctactacgtcttcggggatctctgcagcaatctcgccaccctgaacctcaacagtggctccagtgggacttcggatcaggacacgctggccccgctgccccacccggctgccccctggcctctgggtcagggctacccctaccagtacccgggacccccaccctgcttcccgcctgcctaccaggacccgggctttagctatggcagcggcagcaccgggagtcagcagagtgaagggagcaaaagcagtgggtccacccggagcagccgccgggccccgggccgtgagaaggagcgtcgggcggcgggagctgggggcagtggcagtgaatcggatcacacggcaccgagtggggtggggagcagctggcgagagcgtccggccggccagctcagccgtggcagcagcccacgcagtcaggcctcggctaccgccccggggctccccccgccccaccccacgaccaaggcctatacagtggtgggggggccacccgggggaccccctgtccgggagctggctgccgtccccccggaattgacaggcagccgccagtccttccagaaggctatggggaacccctgcgagttcttcgtggacatcatgtgactcgtggcgcatgccccagccctgcctgaggtggggagctggcggtcctgccgcatgcagagctcgcgtgggcttgccttcgtgggggccaggacgggaggcagggtggggggcaggctggaccaccaccatctgccctggcagcctggctgctccagctcctgacagcacctgtgtctgagcagccgtgttgggggcgctccctctctgcccctcagcgagagcctcggacctcccaaccccttgtgtctggtggggatccctcctgggatgaggaagaccccctcgggctctcggctgacccccacctcctgcacagctgtgcccaggcccccagggtggtccacgcggggcaaccccctgcggtgcacaggccccctgtctggagtagggatctaatttatttatttattgcctggccggtgactcgggggaggaggcgaccctgtcatctgtcccacctgctgctgccccttggagcagcctgcaccttctctcctcccatccggcaacagtctgaaagtacgtggaggacgggaccggaagacgagagagggctggacatcctgcccaccgtgtcccagccagggcagggagggaccatggcccgcagggtcaaggggccccgatgtgcacagctgccacagggagggaggtcttggggagatgggcagtcaggtggcccgtccttggtgagtgcacacactgcgcgcacacatcgcggccttcctggcttctctggcccccacgtgtctgtgctgtagatactgtatcaaagtcccagcgtttagatggttaacatagagctgcttctgtgtaaatgctgcttattttaaacactaaaaagcgtttaattttatgggacagatgtggggcctgggccccttctctccggctgggctgccttggaatgaggcacagggagctggtccagcctcccctaggccctgctgggagctgaccctgggactctgaccggaaaccctgtgtgggcctggcggcgtgctggcgtcaaatcctggtgggcagttttctgtccatggtgctggctccggggtcctgggggtcggggctggccgtggggctggaccccgcccccaccccacctgggctctgtccctggtactggtgacagtcatgatgctgtctacccactgggcaaagggcagagtaggaagctgggtgccacccctacctcggcgggctctgccctgggca

SEQ ID NO: 329688 - DNA, 3099 bp, Homo sapiens
cgttgcggcagcgggatcgtaaagctgttgatatcgattcgggcggtgcgggccggggggggacgcaggcgagcgtgcgggttccaaccctcgacccgtgccctgagcgtgcagacttcgcaagcgctcggacgtcgtcgcgccatggcggagaccaagattatctaccacatggacgaggaggagacgccgtacctggtcaagctgcccgtggcccccgagcgcgtcacgctggccgacttcaagaacgtgctcagcaaccggcccgtgcacgcctacaaattcttctttaagtccatggaccaggacttcggggtggtgaaggaggagatctttgatgacaatgccaagcttccctgcttcaacggccgcgtggtctcctggctggtcctggctgagggtgctcactcggatgcggggtcccagggcacggacagccacacagacctgcccccgcctcttgagcggacaggcggcatcggggactcccggcccccctccttccacccgaatgtggccagcagccgtgacgggatggacaacgagacaggcacggagtccatggtcagtcaccggcgggagcgtgcccgacgccggaaccgcgaggaggccgcccggaccaatgggcacccaaggggagaccgacggcgggatgtggggctgcccccagacagcgcgtccaccgccctcagcagcgagcttgagtccagcagctttgtggactcggacgaggatggcagcacgagcaggctcagcagctccacggagcagagcacctcatccagactcatccggaagcacaaacgccggcggaggaagcagcgccttcggcaggcggaccgggcctcctccttcagcagcataaccgactccaccatgtccctcaacatcgtcactgtcacgctcaacatggaaagacatcactttctgggcatcagcatcgtggggcagagcaacgaccgtggagacggcggcatctacattggctccatcatgaagggcggggctgtggccgctgacggccgcatcgagcccggcgacatgttgctgcaggtgaatgacgtgaactttgagaacatgagcaatgacgatgccgtgcgggtgctgcgggagatcgtttcccagacggggcccatcagcctcactgtggccaagtgctgggacccaacgccccgaagctacttcaccgtcccacgggctgacccggtgcggcccatcgaccccgccgcctggctgtcccacacggcggcactgacaggagccctgccccgctacgacggtacgagtccctgctccagcgccgtcacgcgcaccagctcctcctcactaaccagctccgtgcctggtgctccacagctggaagaggcgccgctgacggtgaagagtgacatgagcgccgtcgtccgggtcatgcagctgccagactcgggactggagatccgcgaccgcatgtggctcaagatcaccatcgccaatgccgtcatcggggcggacgtggtggactggctgtacacacacgtggagggcttcaaggagcggcgggaggcccggaagtacgccagcagcttgctgaagcacggcttcctgcggcacacggtcaacaagatcaccttctccgagcagtgctactacgtcttcggggatctctgcagcaatctcgccaccctgaacctcaacagtggctccagtgggacttcggatcaggacacgctggccccgctgccccacccggctgccccctggcctctgggtcagggctacccctaccagtacccgggacccccaccctgcttcccgcctgcctaccaggacccgggctttagctatggcagcggcagcaccgggagtcagcagagtgaagggagcaaaagcagtgggtccacccggagcagccgccgggccccgggccgtgagaaggagcgtcgggcggcgggagctgggggcagtggcagtgaatcggatcacacggcaccgagtggggtggggagcagctggcgagagcgtccggccggccagctcagccgtggcagcagcccacgcagtcaggcctcggctaccgccccggggctccccccgccccaccccacgaccaaggcctatacagtggtgggggggccacccgggggaccccctgtccgggagctggctgccgtccccccggaattgacaggcagccgccagtccttccagaaggctatggggaacccctgcgagttcttcgtggacatcatgtgactcgtggcgcatgccccagccctgcctgaggtggggagctggcggtcctgccgcatgcagagctcgcgtgggcttgccttcgtgggggccaggacgggaggcagggtggggggcaggctggaccaccaccatctgccctggcagcctggctgctccagctcctgacagcacctgtgtctgagcagccgtgttgggggcgctccctctctgcccctcagcgagagcctcggacctcccaaccccttgtgtctggtggggatccctcctgggatgaggaagaccccctcgggctctcggctgacccccacctcctgcacagctgtgcccaggcccccagggtggtccacgcggggcaaccccctgcggtgcacaggccccctgtctggagtagggatctaatttatttatttattgcctggccggtgactcgggggaggaggcgaccctgtcatctgtcccacctgctgctgccccttggagcagcctgcaccttctctcctcccatccggcaacagtctgaaagtacgtggaggacgggaccggaagacgagagagggctggacatcctgcccaccgtgtcccagccagggcagggagggaccatggcccgcagggtcaaggggccccgatgtgcacagctgccacagggagggaggtcttggggagatgggcagtcaggtggcccgtccttggtgagtgcacacactgcgcgcacacatcgcggccttcctggcttctctggcccccacgtgtctgtgctgtagatactgtatcaaagtcccagcgtttagatggttaacatagagctgcttctgtgtaaatgctgcttattttaaacactaaaaagcgtttaattttatggga

SEQ ID NO: 329689 - DNA, 2996 bp, Homo sapiens
cgttgcggcagcgggatcgtaaagctgttgatatcgattcgggcggtgcgggccggggggggacgcaggcgagcgtgcgggttccaaccctcgacccgtgccctgagcgtgcagacttcgcaagcgctcggacgtcgtcgcgccatggcggagaccaagattatctaccacatggacgaggaggagacgccgtacctggtcaagctgcccgtggcccccgagcgcgtcacgctggccgacttcaagaacgtgctcagcaaccggcccgtgcacgcctacaaattcttctttaagtccatggaccaggacttcggggtggtgaaggaggagatctttgatgacaatgccaagcttccctgcttcaacggccgcgtggtctcctggctggtcctggctgagggtgctcactcggatgcggggtcccagggcacggacagccacacagacctgcccccgcctcttgagcggacaggcggcatcggggactcccggcccccctccttccacccgaatgtggccagcagccgtgacgggatggacaacgagacaggcacggagtccatggtcagtcaccggcgggagcgtgcccgacgccggaaccgcgaggaggccgcccggaccaatgggcacccaaggggagaccgacggcgggatgtggggctgcccccagacagcgcgtccaccgccctcagcagcgagcttgagtccagcagctttgtggactcggacgaggatggcagcacgagcaggctcagcagctccacggagcagagcacctcatccagactcatccggaagcacaaacgccggcggaggaagcagcgccttcggcaggcggaccgggcctcctccttcagcagcataaccgactccaccatgtccctcaacatcgtcactgtcacgctcaacatggaaagacatcactttctgggcatcagcatcgtggggcagagcaacgaccgtggagacggcggcatctacattggctccatcatgaagggcggggctgtggccgctgacggccgcatcgagcccggcgacatgttgctgcaggtgaatgacgtgaactttgagaacatgagcaatgacgatgccgtgcgggtgctgcgggagatcgtttcccagacggggcccatcagcctcactgtggccaagtgctgggacccaacgccccgaagctacttcaccgtcccacgggctgacccggtgcggcccatcgaccccgccgcctggctgtcccacacggcggcactgacaggagccctgccccgctacgagctggaagaggcgccgctgacggtgaagagtgacatgagcgccgtcgtccgggtcatgcagctgccagactcgggactggagatccgcgaccgcatgtggctcaagatcaccatcgccaatgccgtcatcggggcggacgtggtggactggctgtacacacacgtggagggcttcaaggagcggcgggaggcccggaagtacgccagcagcttgctgaagcacggcttcctgcggcacacggtcaacaagatcaccttctccgagcagtgctactacgtcttcggggatctctgcagcatggctccagtgggacttcggatcaggacacgctggccccgctgccccacccggctgccccctggcctctgggtcagggctacccctaccagtacccgggacccccaccctgcttcccgcctgcctaccaggacccgggctttagctatggcagcggcagcaccgggagtcagcagagtgaagggagcaaaagcagtgggtccacccggagcagccgccgggccccgggccgtgagaaggagcgtcgggcggcgggagctgggggcagtggcagtgaatcggatcacacggcaccgagtggggtggggagcagctggcgagagcgtccggccggccagctcagccgtggcagcagcccacgcagtcaggcctcggctaccgccccggggctccccccgccccaccccacgaccaaggcctatacagtggtgggggggccacccgggggaccccctgtccgggagctggctgccgtccccccggaattgacaggcagccgccagtccttccagaaggctatggggaacccctgcgagttcttcgtggacatcatgtgactcgtggcgcatgccccagccctgcctgaggtggggagctggcggtcctgccgcatgcagagctcgcgtgggcttgccttcgtgggggccaggacgggaggcagggtggggggcaggctggaccaccaccatctgccctggcagcctggctgctccagctcctgacagcacctgtgtctgagcagccgtgttgggggcgctccctctctgcccctcagcgagagcctcggacctcccaaccccttgtgtctggtggggatccctcctgggatgaggaagaccccctcgggctctcggctgacccccacctcctgcacagctgtgcccaggcccccagggtggtccacgcggggcaaccccctgcggtgcacaggccccctgtctggagtagggatctaatttatttatttattgcctggccggtgactcgggggaggaggcgaccctgtcatctgtcccacctgctgctgccccttggagcagcctgcaccttctctcctcccatccggcaacagtctgaaagtacgtggaggacgggaccggaagacgagagagggctggacatcctgcccaccgtgtcccagccagggcagggagggaccatggcccgcagggtcaaggggccccgatgtgcacagctgccacagggagggaggtcttggggagatgggcagtcaggtggcccgtccttggtgagtgcacacactgcgcgcacacatcgcggccttcctggcttctctggcccccacgtgtctgtgctgtagatactgtatcaaagtcccagcgtttagatggttaacatagagctgcttctgtgtaaatgctgcttattttaaacactaaaaagcgtttaattttatggga

SEQ ID NO: 329690 - DNA, 1844 bp, Homo sapiens
cgttgcggcagcgggatcgtaaagctgttgatatcgattcgggcggtgcgggccggggggggacgcaggcgagcgtgcgggttccaaccctcgacccgtgccctgagcgtgcagacttcgcaagcgctcggacgtcgtcgcgccatggcggagaccaagattatctaccacatggacgaggaggagacgccgtacctggtcaagctgcccgtggcccccgagcgcgtcacgctggccgacttcaagaacgtgctcagcaaccggcccgtgcacgcctacaaattcttctttaagtccatggaccaggacttcggggtggtgaaggaggagatctttgatgacaatgccaagcttccctgcttcaacggccgcgtggtctcctggctggtcctggctgagggtgctcactcggatgcggggtcccagggcacggacagccacacagacctgcccccgcctcttgagcggacaggcggcatcggggactcccggcccccctccttccacccgaatgtggccagcagccgtgacgggatggacaacgagacaggcacggagtccatggtcagtcaccggcgggagcgtgcccgacgccggaaccgcgaggaggccgcccggaccaatgggcacccaaggggagaccgacggcgggatgtggggctgcccccagacagcgcgtccaccgccctcagcagcgagcttgagtccagcagctttgtggactcggacgaggatggcagcacgagcaggctcagcagctccacggagcagagcacctcatccagactcatccggaagcacaaacgccggcggaggaagcagcgccttcggcaggcggaccgggcctcctccttcagcagcataaccgactccaccatgtccctcaacatcgtcactgtcacgctcaacatggaaagacatcactttctgggcatcagcatcgtggggcagagcaacgaccgtggagacggcggcatctacattggctccatcatgaagggcggggctgtggccgctgacggccgcatcgagcccggcgacatgttgctgcaggtgaatgacgtgaactttgagaacatgagcaatgacgatgccgtgcgggtgctgcgggagatcgtttcccagacggggcccatcagcctcactgtggccaagtgctgggacccaacgccccgaagctacttcaccgtcccacgggctgacccggtgcggcccatcgaccccgccgcctggctgtcccacacggcggcactgacaggagccctgccccgctacgacggtacgagtccctgctccagcgccgtcacgcgcaccagctcctcctcactaaccagctccgtgcctggtgctccacagctggaagaggcgccgctgacggtgaagagtgacatgagcgccgtcgtccgggtcatgcagctgccagactcgggactggagatccgcgaccgcatgtggctcaagatcaccatcgccaatgccgtcatcggggcggacgtggtggactggctgtacacacacgtggagggcttcaaggagcggcgggaggcccggaagtacgccagcagcttgctgaagcacggcttcctgcggcacacgcaaggggccccgatgtgcacagctgccacagggagggaggtcttggggagatgggcagtcaggtggcccgtccttggtgagtgcacacactgcgcgcacacatcgcggccttcctggcttctctggcccccacgtgtctgtgctgtagatactgtatcaaagtcccagcgtttagatggttaacatagagctgcttctgtgtaaatgctgcttattttaaacactaaaaagcgtttaattttatggga

SEQ ID NO: 329691 - DNA, 1414 bp, Homo sapiens
cgttgcggcagcgggatcgtaaagctgttgatatcgattcgggcggtgcgggccggggggggacgcaggcgagcgtgcgggttccaaccctcgacccgtgccctgagcgtgcagacttcgcaagcgctcggacgtcgtcgcgccatggcggagaccaagattatctaccacatggacgaggaggagacgccgtacctggtcaagctgcccgtggcccccgagcgcgtcacgctggccgacttcaagaacgtgctcagcaaccggcccgtgcacgcctacaaattcttctttaagtccatggaccaggacttcggggtggtgaaggaggagatctttgatgacaatgccaagcttccctgcttcaacggccgcgtggtctcctggctggtcctggctgagggtgctcactcggatgcggggtcccagggcacggacagccacacagacctgcccccgcctcttgagcggacaggcggcatcggggactcccggcccccctccttccacccgaatgtggccagcagccgtgacgggatggacaacgagacaggcacggagtccatggtcagtcaccggcgggagcgtgcccgacgccggaaccgcgaggaggccgcccggaccaatgggcacccaaggggagaccgacggcgggatgtggggctgcccccagacagcgcgtccaccgccctcagcagcgagcttgagtccagcagctttgtggactcggacgaggatggcagcacgagcaggctcagcagctccacggagcagagcacctcatccagactcatccggaagcacaaacgccggcggaggaagcagcgccttcggcaggcggaccgggcctcctccttcagcagcataaccgactccaccatgtccctcaacatcgtcactgtcacgctcaacatggaaagacatcactttctgggcatcagcatcgtggggcagagcaacgaccgtggagacggcggcatctacattggctccatcatgaagggcggggctgtggccgctgacggccgcatcgagcccggcgacatgttgctgcaggtgaatgacgtgaactttgagaacatgagcaatgacgatgccgtgcgggtgctgcgggagatcgtttcccagacggggcccatcagcctcactgtggccaagtgctgggacccaacgccccgaagctacttcaccgtcccacgggctgacacggtgcgttggcccaacacggtgcgttggcccaacacggtgcgttggcccaacacggtgcgttgggttgggccaacgcaccgtgttagccaggatggtctctatctcctgacctcatgatccacccgcctcggcctcctaaagtgctgggattacaggcgtgagccacggcgccccgcctgcttttctcctttctggctacattgtgaat

SEQ ID NO: 329692 - DNA, 3021 bp, Homo sapiens
cgttgcggcagcgggatcgtaaagctgttgatatcgattcgggcggtgcgggccggggggggacgcaggcgagcgtgcgggttccaaccctcgacccgtgccctgagcgtgcagacttcgcaagcgctcggacgtcgtcgcgccatggcggagaccaagattatctaccacatggacgaggaggagacgccgtacctggtcaagctgcccgtggcccccgagcgcgtcacgctggccgacttcaagaacgtgctcagcaaccggcccgtgcacgcctacaaattcttctttaagtccatggaccaggacttcggggtggtgaaggaggagatctttgatgacaatgccaagcttccctgcttcaacggccgcgtggtctcctggctggtcctggctgagggtgctcactcggatgcggggtcccagggcacggacagccacacagacctgcccccgcctcttgagcggacaggcggcatcggggactcccggcccccctccttccacccgaatgtggccagcagccgtgacgggatggacaacgagacaggcacggagtccatggtcagtcaccggcgggagcgtgcccgacgccggaaccgcgaggaggccgcccggaccaatgggcacccaaggggagaccgacggcgggatgtggggctgcccccagacagcgcgtccaccgccctcagcagcgagcttgagtccagcagctttgtggactcggacgaggatggcagcacgagcaggctcagcagctccacggagcagagcacctcatccagactcatccggaagcacaaacgccggcggaggaagcagcgccttcggcaggcggaccgggcctcctccttcagcagcataaccgactccaccatgtccctcaacatcgtcactgtcacgctcaacatggaaagacatcactttctgggcatcagcatcgtggggcagagcaacgaccgtggagacggcggcatctacattggctccatcatgaagggcggggctgtggccgctgacggccgcatcgagcccggcgacatgttgctgcaggtgaatgacgtgaactttgagaacatgagcaatgacgatgccgtgcgggtgctgcgggagatcgtttcccagacggggcccatcagcctcactgtggccaagtgctgggacccaacgccccgaagctacttcaccgtcccacgggctgacccggtgcggcccatcgaccccgccgcctggctgtcccacacggcggcactgacaggagccctgccccgctacgagctggaagaggcgccgctgacggtgaagagtgacatgagcgccgtcgtccgggtcatgcagctgccagactcgggactggagatccgcgaccgcatgtggctcaagatcaccatcgccaatgccgtcatcggggcggacgtggtggactggctgtacacacacgtggagggcttcaaggagcggcgggaggcccggaagtacgccagcagcttgctgaagcacggcttcctgcggcacacggtcaacaagatcaccttctccgagcagtgctactacgtcttcggggatctctgcagcaatctcgccaccctgaacctcaacagtggctccagtgggacttcggatcaggacacgctggccccgctgccccacccggctgccccctggcctctgggtcagggctacccctaccagtacccgggacccccaccctgcttcccgcctgcctaccaggacccgggctttagctatggcagcggcagcaccgggagtcagcagagtgaagggagcaaaagcagtgggtccacccggagcagccgccgggccccgggccgtgagaaggagcgtcgggcggcgggagctgggggcagtggcagtgaatcggatcacacggcaccgagtggggtggggagcagctggcgagagcgtccggccggccagctcagccgtggcagcagcccacgcagtcaggcctcggctaccgccccggggctccccccgccccaccccacgaccaaggcctatacagtggtgggggggccacccgggggaccccctgtccgggagctggctgccgtccccccggaattgacaggcagccgccagtccttccagaaggctatggggaacccctgcgagttcttcgtggacatcatgtgactcgtggcgcatgccccagccctgcctgaggtggggagctggcggtcctgccgcatgcagagctcgcgtgggcttgccttcgtgggggccaggacgggaggcagggtggggggcaggctggaccaccaccatctgccctggcagcctggctgctccagctcctgacagcacctgtgtctgagcagccgtgttgggggcgctccctctctgcccctcagcgagagcctcggacctcccaaccccttgtgtctggtggggatccctcctgggatgaggaagaccccctcgggctctcggctgacccccacctcctgcacagctgtgcccaggcccccagggtggtccacgcggggcaaccccctgcggtgcacaggccccctgtctggagtagggatctaatttatttatttattgcctggccggtgactcgggggaggaggcgaccctgtcatctgtcccacctgctgctgccccttggagcagcctgcaccttctctcctcccatccggcaacagtctgaaagtacgtggaggacgggaccggaagacgagagagggctggacatcctgcccaccgtgtcccagccagggcagggagggaccatggcccgcagggtcaaggggccccgatgtgcacagctgccacagggagggaggtcttggggagatgggcagtcaggtggcccgtccttggtgagtgcacacactgcgcgcacacatcgcggccttcctggcttctctggcccccacgtgtctgtgctgtagatactgtatcaaagtcccagcgtttagatggttaacatagagctgcttctgtgtaaatgctgcttattttaaacactaaaaagcgtttaattttatggga

SEQ ID NO: 329693 - DNA, 3268 bp, Homo sapiens
cgttgcggcagcgggatcgtaaagctgttgatatcgattcgggcggtgcgggccggggggggacgcaggcgagcgtgcgggttccaaccctcgacccgtgccctgagcgtgcagacttcgcaagcgctcggacgtcgtcgcgccatggcggagaccaagattatctaccacatggacgaggaggagacgccgtacctggtcaagctgcccgtggcccccgagcgcgtcacgctggccgacttcaagaacgtgctcagcaaccggcccgtgcacgcctacaaattcttctttaagtccatggaccaggacttcggggtggtgaaggaggagatctttgatgacaatgccaagcttccctgcttcaacggccgcgtggtctcctggctggtcctggctgagggtgctcactcggatgcggggtcccagggcacggacagccacacagacctgcccccgcctcttgagcggacaggcggcatcggggactcccggcccccctccttccacccgaatgtggccagcagccgtgacgggatggacaacgagacaggcacggagtccatggtcagtcaccggcgggagcgtgcccgacgccggaaccgcgaggagggtacagtggtcatgtctgcccagctgtggacccccagcctccctgggacccccatgagccatgttcctactacagcagttcctgtcccccagccagtggcggtgcttgggtggaggcacaggcccagcgagcctacagttgagctgccagctcccagacccacaggcatgcagcactgcccaggcagccccaaacccatgacctctgggagaccctgcagtcagttcccaacctgctgcccccacagccgcccggaccaatgggcacccaaggggagaccgacggcgggatgtggggctgcccccagacagcgcgtccaccgccctcagcagcgagcttgagtccagcagctttgtggactcggacgaggatggcagcacgagcaggctcagcagctccacggagcagagcacctcatccagactcatccggaagcacaaacgccggcggaggaagcagcgccttcggcaggcggaccgggcctcctccttcagcagcataaccgactccaccatgtccctcaacatcgtcactgtcacgctcaacatggaaagacatcactttctgggcatcagcatcgtggggcagagcaacgaccgtggagacggcggcatctacattggctccatcatgaagggcggggctgtggccgctgacggccgcatcgagcccggcgacatgttgctgcaggtgaatgacgtgaactttgagaacatgagcaatgacgatgccgtgcgggtgctgcgggagatcgtttcccagacggggcccatcagcctcactgtggccaagtgctgggacccaacgccccgaagctacttcaccgtcccacgggctgacccggtgcggcccatcgaccccgccgcctggctgtcccacacggcggcactgacaggagccctgccccgctacgagctggaagaggcgccgctgacggtgaagagtgacatgagcgccgtcgtccgggtcatgcagctgccagactcgggactggagatccgcgaccgcatgtggctcaagatcaccatcgccaatgccgtcatcggggcggacgtggtggactggctgtacacacacgtggagggcttcaaggagcggcgggaggcccggaagtacgccagcagcttgctgaagcacggcttcctgcggcacacggtcaacaagatcaccttctccgagcagtgctactacgtcttcggggatctctgcagcaatctcgccaccctgaacctcaacagtggctccagtgggacttcggatcaggacacgctggccccgctgccccacccggctgccccctggcctctgggtcagggctacccctaccagtacccgggacccccaccctgcttcccgcctgcctaccaggacccgggctttagctatggcagcggcagcaccgggagtcagcagagtgaagggagcaaaagcagtgggtccacccggagcagccgccgggccccgggccgtgagaaggagcgtcgggcggcgggagctgggggcagtggcagtgaatcggatcacacggcaccgagtggggtggggagcagctggcgagagcgtccggccggccagctcagccgtggcagcagcccacgcagtcaggcctcggctaccgccccggggctccccccgccccaccccacgaccaaggcctatacagtggtgggggggccacccgggggaccccctgtccgggagctggctgccgtccccccggaattgacaggcagccgccagtccttccagaaggctatggggaacccctgcgagttcttcgtggacatcatgtgactcgtggcgcatgccccagccctgcctgaggtggggagctggcggtcctgccgcatgcagagctcgcgtgggcttgccttcgtgggggccaggacgggaggcagggtggggggcaggctggaccaccaccatctgccctggcagcctggctgctccagctcctgacagcacctgtgtctgagcagccgtgttgggggcgctccctctctgcccctcagcgagagcctcggacctcccaaccccttgtgtctggtggggatccctcctgggatgaggaagaccccctcgggctctcggctgacccccacctcctgcacagctgtgcccaggcccccagggtggtccacgcggggcaaccccctgcggtgcacaggccccctgtctggagtagggatctaatttatttatttattgcctggccggtgactcgggggaggaggcgaccctgtcatctgtcccacctgctgctgccccttggagcagcctgcaccttctctcctcccatccggcaacagtctgaaagtacgtggaggacgggaccggaagacgagagagggctggacatcctgcccaccgtgtcccagccagggcagggagggaccatggcccgcagggtcaaggggccccgatgtgcacagctgccacagggagggaggtcttggggagatgggcagtcaggtggcccgtccttggtgagtgcacacactgcgcgcacacatcgcggccttcctggcttctctggcccccacgtgtctgtgctgtagatactgtatcaaagtcccagcgtttagatggttaacatagagctgcttctgtgtaaatgctgcttattttaaacactaaaaagcgtttaattttatggga

SEQ ID NO: 329694 - DNA, 2158 bp, Homo sapiens
gttgggggcaggggcaggggcttggccgcggctcatggctcttcctgcagaaagacatcactttctgggcatcagcatcgtggggcagagcaacgaccgtggagacggcggcatctacattggctccatcatgaagggcggggctgtggccgctgacggccgcatcgagcccggcgacatgttgctgcaggtgaatgacgtgaactttgagaacatgagcaatgacgatgccgtgcgggtgctgcgggagatcgtttcccagacggggcccatcagcctcactgtggccaagtgctgggacccaacgccccgaagctacttcaccgtcccacgggctgacccggtgcggcccatcgaccccgccgcctggctgtcccacacggcggcactgacaggagccctgccccgctacgagctggaagaggcgccgctgacggtgaagagtgacatgagcgccgtcgtccgggtcatgcagctgccagactcgggactggagatccgcgaccgcatgtggctcaagatcaccatcgccaatgccgtcatcggggcggacgtggtggactggctgtacacacacgtggagggcttcaaggagcggcgggaggcccggaagtacgccagcagcttgctgaagcacggcttcctgcggcacacggtcaacaagatcaccttctccgagcagtgctactacgtcttcggggatctctgcagcaatctcgccaccctgaacctcaacagtggctccagtgggacttcggatcaggacacgctggccccgctgccccacccggctgccccctggcctctgggtcagggctacccctaccagtacccgggacccccaccctgcttcccgcctgcctaccaggacccgggctttagctatggcagcggcagcaccgggagtcagcagagtgaagggagcaaaagcagtgggtccacccggagcagccgccgggccccgggccgtgagaaggagcgtcgggcggcgggagctgggggcagtggcagtgaatcggatcacacggcaccgagtggggtggggagcagctggcgagagcgtccggccggccagctcagccgtggcagcagcccacgcagtcaggcctcggctaccgccccggggctccccccgccccaccccacgaccaaggcctatacagtggtgggggggccacccgggggaccccctgtccgggagctggctgccgtccccccggaattgacaggcagccgccagtccttccagaaggctatggggaacccctgcgagttcttcgtggacatcatgtgactcgtggcgcatgccccagccctgcctgaggtggggagctggcggtcctgccgcatgcagagctcgcgtgggcttgccttcgtgggggccaggacgggaggcagggtggggggcaggctggaccaccaccatctgccctggcagcctggctgctccagctcctgacagcacctgtgtctgagcagccgtgttgggggcgctccctctctgcccctcagcgagagcctcggacctcccaaccccttgtgtctggtggggatccctcctgggatgaggaagaccccctcgggctctcggctgacccccacctcctgcacagctgtgcccaggcccccagggtggtccacgcggggcaaccccctgcggtgcacaggccccctgtctggagtagggatctaatttatttatttattgcctggccggtgactcgggggaggaggcgaccctgtcatctgtcccacctgctgctgccccttggagcagcctgcaccttctctcctcccatccggcaacagtctgaaagtacgtggaggacgggaccggaagacgagagagggctggacatcctgcccaccgtgtcccagccagggcagggagggaccatggcccgcagggtcaaggggccccgatgtgcacagctgccacagggagggaggtcttggggagatgggcagtcaggtggcccgtccttggtgagtgcacacactgcgcgcacacatcgcggccttcctggcttctctggcccccacgtgtctgtgctgtagatactgtatcaaagtcccagcgtttagatggttaacatagagctgcttctgtgtaaatgctgcttattttaaacactaaaaagcgtttaattttatggga

SEQ ID NO: 329695 - DNA, 1406 bp, Homo sapiens
cgttgcggcagcgggatcgtaaagctgttgatatcgattcgggcggtgcgggccggggggggacgcaggcgagcgtgcgggttccaaccctcgacccgtgccctgagcgtgcagacttcgcaagcgctcggacgtcgtcgcgccatggcggagaccaagattatctaccacatggacgaggaggagacgccgtacctggtcaagctgcccgtggcccccgagcgcgtcacgctggccgacttcaagaacgtgctcagcaaccggcccgtgcacgcctacaaattcttctttaagtccatggaccaggacttcggggtggtgaaggaggagatctttgatgacaatgccaagcttccctgcttcaacggccgcgtggtctcctggctggtcctggctgagggtgctcactcggatgcggggtcccagggcacggacagccacacagacctgcccccgcctcttgagcggacaggcggcatcggggactcccggcccccctccttccacccgaatgtggccagcagccgtgacgggatggacaacgagacaggcacggagtccatggtcagtcaccggcgggagcgtgcccgacgccggaaccgcgaggaggccgcccggaccaatgggcacccaaggggagaccgacggcgggatgtggggctgcccccagacagcgcgtccaccgccctcagcagcgagcttgagtccagcagctttgtggactcggacgaggatggcagcacgagcaggctcagcagctccacggagcagagcacctcatccagactcatccggaagcacaaacgccggcggaggaagcagcgccttcggcaggcggaccgggcctcctccttcagcagcataaccgactccaccatgtccctcaacatcgtcactgtcacgctcaacatggaaagacatcactttctgggcatcagcatcgtggggcagagcaacgaccgtggagacggcggcatctacattggctccatcatgaagggcggggctgtggccgctgacggccgcatcgagcccggcgacatgttgctgcaggtgaatgacgtgaactttgagaacatgagcaatgacgatgccgtgcgggtgctgcgggagatcgtttcccagacggggcccatcagcctcactgtggccaagtgctgggacccaacgccccgaagctacttcaccgtcccacgggctgacccggtgcggcccatcgaccccgccgcctggctgtcccacacggcggcactgacaggagccctgccccgctacggcacctgtaatcctagctactcaggaggctgaggcaggggaatcgcctgaccccagaaggtggaagttgcagtgagccgagatcgcgccactgcactccagcctgggcaacagagcgagactctgtctca

SEQ ID NO: 329696 - DNA, 995 bp, Homo sapiens
gccccgggccgggccctgagcgcgcgggctccgcgccgccgccgcgccatggcggagaccaagattatctaccacatggacgaggaggagacgccgtacctggtcaagctgcccgtggcccccgagcgcgtcacgctggccgacttcaagaacgtgctcagcaaccggcccgtgcacgcctacaaattcttctttaagtccatggaccaggacttcggggtggtgaaggaggagatctttgatgacaatgccaagcttccctgcttcaacggccgcgtggtctcctggctggtcctggctgagggtgctcactcggatgcggggtcccagggcacggacagccacacagacctgcccccgcctcttgagcggacaggcggcatcggggactcccggcccccctccttccacccgaatgtggccagcagccgtgacgggatggacaacgagacaggcacggagtccatggtcagtcaccggcgggagcgtgcccgacgccggaaccgcgaggaggccgcccggaccaatgggcacccaaggggagaccgacggcgggatgtggggctgcccccagacagcgcgtccaccgccctcagcagcgagcttgagtccagcagctttgtggactcggacgaggatggcagcacgagcaggctcagcagctccacggagcagagcacctcatccagactcatccggaagcacaaacgccggcggaggaagcagcgccttcggcaggcggaccggcaaggggccccgatgtgcacagctgccacagggagggaggtcttggggagatgggcagtcaggtggcccgtccttggtgagtgcacacactgcgcgcacacatcgcggccttcctggcttctctggcccccacgtgtctgtgctgtagatactgtatcaaagtcccagcgtttagatggttaacatagagctgcttctgtgtaaatgctgcttattttaaacactaaaaagcgtttaattttatggga

SEQ ID NO: 329697 - DNA, 514 bp, Homo sapiens
cggtgtctgggtagtcgtgcgtggttttctgcgctggtgtcttggtttggtgctgtgtgttctgcctgaatgcgtatctgatgagctggtgtgggtggttggtcgcagaggcgtagtgctacggtcgttctatggtctagtctggtgggttggtgtggatgggcgagatgccgcgttgctggtggaccgatgtagctgcggggttgcgtgcgcccccgtcgagtgttgtttttgtgtgccccatggtccgcgtcgctgttcgccgggccgtaggtagcgttgtcaggcaccgacttcgcgctttggtttcaacgaagctcgactggttcgcccgtccggcattcccgcgaatcgtcgacccacgcgtccgctttgaaagctgaatataaggagaaaactggccaggaatataaacctggaaaccctcctgctgaaataggacagaatatttcagcaggagggtttccaggtttatattcctggccagttttctccttatattcagctttcaaag

SEQ ID NO: 329698 - DNA, 4887 bp, Homo sapiens
agtagctgcggcgcaggggcggagcgaaggctgcggcggcgtcgggtacgcgcacacgttgcatcttcttcctttcgcggggtcctccgtagttctggcacgagccaggcgtactgacaggtggaccagcggactggtggagatggcgacgctctctctgaccgtgaattcaggagaccctccgctaggagctttgctggcagtagaacacgtgaaagacgatgtcagcatttccgttgaagaagggaaagagaatattcttcatgtttctgaaaatgtgatattcacagatgtgaattctatacttcgctacttggctagagttgcaactacagctgggttatatggctctaatctgatggaacatactgagattgatcactggttggagttcagtgctacaaaattatcttcatgtgattcctttacttctacaattaatgaactcaatcattgcctgtctctgagaacatacttagttggaaactccttgagtttagcagatttatgtgtttgggccaccctaaaaggaaatgctgcctggcaagaacagttgaaacagaagaaagctccagttcatgtaaaacgttggtttggctttcttgaagcccagcaggccttccagtcagtaggtaccaagtgggatgtttcaacaaccaaagctcgagtggcacctgagaaaaagcaagatgttgggaaatttgttgagcttccaggtgcggagatgggaaaggttaccgtcagatttcctccagaggccagtggttacttacacattgggcatgcaaaagctgctcttctgaaccagcactaccaggttaactttaaagggaaactgatcatgagatttgatgacacaaatcctgaaaaagaaaaggaagattttgagaaggttatcttggaagatgttgcaatgttgcatatcaaaccagatcaatttacttatacttcggatcattttgaaactataatgaagtatgcagagaagctaattcaagaagggaaggcttatgtggatgatactcctgctgaacagatgaaagcagaacgtgagcagaggatagaatctaaacatagaaaaaaccctattgagaagaatctacaaatgtgggaagaaatgaaaaaagggagccagtttggtcagtcctgttgtttgcgagcaaaaattgacatgagtagtaacaatggatgcatgagagatccaaccctttatcgctgcaaaattcaaccacatccaagaactggaaataaatacaatgtttatccaacatatgattttgcctgccccatagttgacagcatcgaaggtgttacacatgccctgagaacaacagaataccatgacagagatgagcagttttactggattattgaagctttaggcataagaaaaccatatatttgggaatatagtcggctaaatctcaacaacacagtgctatccaaaagaaaactcacatggtttgtcaatgaaggactagtagatggatgggatgacccaagatttcctacggttcgtggtgtactgagaagagggatgacagttgaaggactgaaacagtttattgctgctcagggctcctcacgttcagtcgtgaacatggagtgggacaaaatctgggcgtttaacaaaaaggttattgacccagtggctccacgatatgttgcattactgaagaaagaagtgatcccagtgaatgtacctgaagctcaggaggagatgaaagaagtagccaaacacccaaagaatcctgaggttggcttgaagcctgtgtggtatagtcccaaagttttcattgaaggtgctgatgcagagactttttcggagggtgagatggttacatttataaattggggcaacctcaacattacaaaaatacacaaaaatgcagatggaaaaatcatatctcttgatgcaaagttgaatttggaaaacaaagactacaagaaaaccactaaggtcacttggcttgcagagactacacatgctcttcctattccagtaatctgtgtcacttatgagcacttgatcacaaagccagtgctaggaaaagacgaggactttaagcagtatgtcaacaagaacagtaagcatgaagagctaatgctaggggatccctgccttaaggatttgaaaaaaggagatattatacaactccagagaagaggattcttcatatgtgatcaaccttatgaacctgttagcccatatagttgcaaggaagccccgtgtgttttgatatacattcctgatgggcacacaaaggaaatgccaacatcagggtcaaaggaaaagaccaaagtagaagccacaaaaaatgagacctctgctccttttaaggaaagaccaacaccttctctgaataataattgtactacatctgaggattccttggtcctttacaatagagtggctgttcaaggagatgtggttcgtgaattaaaagccaagaaagcaccaaaggaagatgtagatgcagctgtaaaacagcttttgtctttgaaagctgaatataaggagaaaactggccaggaatataaacctggaaaccctcctgctgaaataggacagaatatttcttctaattcctcagcaagtattctggaaagtaaatctctgtatgatgaagttgctgcacaaggggaggtggttcgtaagctaaaagctgaaaaatcccctaaggctaaaataaatgaagctgtagaatgcttactgtccctgaaggctcagtataaagaaaaaactgggaaggagtacatacctggtcagcccccattatctcaaagttcggattcaagcccaaccagaaattctgaacctgctggtttagaaacaccagaagcgaaagtactttttgacaaagtagcttctcaaggggaagtagttcggaaacttaaaactgaaaaagcccctaaggatcaagtagatatagctgttcaagaactccttcagctaaaggcacagtacaagtctttgataggagtagagtataagcctgtgtcggccactggagctgaggacaaagataagaagaagaaagaaaaagaaaataaatctgaaaagcagaataagcctcagaaacaaaatgatggccaaaggaaagacccttctaaaaaccaaggaggtgggctctcatcaagtggagcaggagaagggcaggggcctaagaaacagaccaggttgggtcttgaggcaaaaaaagaagaaaatcttgctgattggtattctcaggtcatcacaaagtcagaaatgattgaataccatgacataagtggctgttatattcttcgtccctgggcctatgccatttgggaagccatcaaggacttttttgatgctgagatcaagaaacttggtgttgaaaactgctacttccccatgtttgtgtctcaaagtgcattagagaaagagaagactcatgttgctgactttgccccagaggttgcttgggttacaagatctggcaaaaccgagctggcagaaccaattgccattcgtcctactagtgaaacagtaatgtatcctgcatatgcaaaatgggtacaatcacacagagacctgcccatcaagctcaatcagtggtgcaatgtggtgcgttgggaattcaagcatcctcagcctttcctacgtactcgtgaatttctttggcaggaagggcacagtgcttttgctaccatggaagaggcagcggaagaggtcttgcagatacttgacttatatgctcaggtatatgaagaactcctggcaattcctgttgttaaaggaagaaagacggaaaaggaaaaatttgcaggaggagactatacaactacaatagaagcatttatatctgctagtggaagagctatccagggaggaacatcacatcatttagggcagaatttttccaaaatgtttgaaatcgtttttgaagatccaaagataccaggagagaagcaatttgcctatcaaaactcctggggcctgacaactcgaactattggtgttatgaccatggttcatggggacaacatgggtttagtattaccaccccgtgtagcatgtgttcaggtggtgattattccttgtggcattaccaatgcactttctgaagaagacaaagaagcgctgattgcaaaatgcaatgattatcgaaggcgattactcagtgttaacatccgcgttagagctgatttacgagataattattctccaggttggaaattcaatcactgggagctcaagggagttcccattagacttgaagttgggccacgtgatatgaagagctgtcagtttgtagccgtcagacgagatactggagaaaagctgacagttgctgaaaatgaggcagagactaaacttcaagctattttggaagacatccaggtcacccttttcacaagggcttctgaagaccttaagactcatatggttgtggctaatacaatggaagactttcagaagatactagattctggaaagattgttcagattccattctgtggggaaattgactgtgaggactggatcaaaaagaccactgccagggatcaagatcttgaacctggtgctccatccatgggagctaaaagcctttgcatccccttcaaaccactctgtgaactgcagcctggagccaaatgtgtctgtggcaagaaccctgccaagtactacaccttatttggtcgcagctactgagggatgaacgaaagccccctcttcaactcctctcactttttaaagcattgatattagtatcttctcagatacagaccgttttatgattttttaaaaagtaaaagttctaaaatgaagtcacacaggacaattattcttatgcctaagttaacagtggataaaagacttttctgtaaacaactccagtaataaatatcatgaactaa

SEQ ID NO: 329699 - DNA, 5126 bp, Homo sapiens
gccgtcgtctgtctcacaaccccaacttccttcttgcctttggagctgatcttattcctgataaagaagtccccatcccatttatgttagcacctctcctacttcagctattattttactccagacacttgtctctgacttgaaaaaagccattattgctcagtgggtgtgtgactgggaggttagggagtagtgggatgatgtggagttgtggtttttcttggaggtcacttccttcttctacaactagtttggaacaagtaagaatatgctttttccaacttggaaagacagttttttcaaaaacaactttcttgaggtataattgacatacagaaaatcacacttatttaaaaatgtatattttgataaattttgacatatatatgtgtgtgtatatatacatacacacacacacacagctgtggaactatggttacaatcaagataataaatatatccaccacccccaaaagttcctcatgctgctttgtaatcatccaccctcaccaggtcccaagaaaccagcatgcccagctttgcatatttttcgtcttccagttgggttgtatctacggttatggaacccatggacacagagagctaactgttttagaaaacagttcagtgtatatccagatatttaacatttcatttgctttagaagcacaactttaagccatctcaattactttaattagtcacaactggaactttgcttttgaagctgcagatttattgaatagtttaaaattatctttgctcataggaaatgctgcctggcaagaacagttgaaacagaagaaagctccagttcatgtaaaacgttggtttggctttcttgaagcccagcaggccttccagtcagtaggtaccaagtgggatgtttcaacaaccaaagctcgagtggcacctgagaaaaagcaagatgttgggaaatttgttgagcttccaggtgcggagatgggaaaggttaccgtcagatttcctccagaggccagtggttacttacacattgggcatgcaaaagctgctcttctgaaccagcactaccaggttaactttaaagggaaactgatcatgagatttgatgacacaaatcctgaaaaagaaaaggaagattttgagaaggttatcttggaagatgttgcaatgttgcatatcaaaccagatcaatttacttatacttcggatcattttgaaactataatgaagtatgcagagaagctaattcaagaagggaaggcttatgtggatgatactcctgctgaacagatgaaagcagaacgtgagcagaggatagaatctaaacatagaaaaaaccctattgagaagaatctacaaatgtgggaagaaatgaaaaaagggagccagtttggtcagtcctgttgtttgcgagcaaaaattgacatgagtagtaacaatggatgcatgagagatccaaccctttatcgctgcaaaattcaaccacatccaagaactggaaataaatacaatgtttatccaacatatgattttgcctgccccatagttgacagcatcgaaggtgttacacatgccctgagaacaacagaataccatgacagagatgagcagttttactggattattgaagctttaggcataagaaaaccatatatttgggaatatagtcggctaaatctcaacaacacagtgctatccaaaagaaaactcacatggtttgtcaatgaaggactagtagatggatgggatgacccaagatttcctacggttcgtggtgtactgagaagagggatgacagttgaaggactgaaacagtttattgctgctcagggctcctcacgttcagtcgtgaacatggagtgggacaaaatctgggcgtttaacaaaaaggttattgacccagtggctccacgatatgttgcattactgaagaaagaagtgatcccagtgaatgtacctgaagctcaggaggagatgaaagaagtagccaaacacccaaagaatcctgaggttggcttgaagcctgtgtggtatagtcccaaagttttcattgaaggtgctgatgcagagactttttcggagggtgagatggttacatttataaattggggcaacctcaacattacaaaaatacacaaaaatgcagatggaaaaatcatatctcttgatgcaaagttgaatttggaaaacaaagactacaagaaaaccactaaggtcacttggcttgcagagactacacatgctcttcctattccagtaatctgtgtcacttatgagcacttgatcacaaagccagtgctaggaaaagacgaggactttaagcagtatgtcaacaagaacagtaagcatgaagagctaatgctaggggatccctgccttaaggatttgaaaaaaggagatattatacaactccagagaagaggattcttcatatgtgatcaaccttatgaacctgttagcccatatagttgcaaggaagccccgtgtgttttgatatacattcctgatgggcacacaaaggaaatgccaacatcagggtcaaaggaaaagaccaaagtagaagccacaaaaaatgagacctctgctccttttaaggaaagaccaacaccttctctgaataataattgtactacatctgaggattccttggtcctttacaatagagtggctgttcaaggagatgtggttcgtgaattaaaagccaagaaagcaccaaaggaagatgtagatgcagctgtaaaacagcttttgtctttgaaagctgaatataaggagaaaactggccaggaatataaacctggaaaccctcctgctgaaataggacagaatatttcttctaattcctcagcaagtattctggaaagtaaatctctgtatgatgaagttgctgcacaaggggaggtggttcgtaagctaaaagctgaaaaatcccctaaggctaaaataaatgaagctgtagaatgcttactgtccctgaaggctcagtataaagaaaaaactgggaaggagtacatacctggtcagcccccattatctcaaagttcggattcaagcccaaccagaaattctgaacctgctggtttagaaacaccagaagcgaaagtactttttgacaaagtagcttctcaaggggaagtagttcggaaacttaaaactgaaaaagcccctaaggatcaagtagatatagctgttcaagaactccttcagctaaaggcacagtacaagtctttgataggagtagagtataagcctgtgtcggccactggagctgaggacaaagataagaagaagaaagaaaaagaaaataaatctgaaaagcagaataagcctcagaaacaaaatgatggccaaaggaaagacccttctaaaaaccaaggaggtgggctctcatcaagtggagcaggagaagggcaggggcctaagaaacagaccaggttgggtcttgaggcaaaaaaagaagaaaatcttgctgattggtattctcaggtcatcacaaagtcagaaatgattgaataccatgacataagtggctgttatattcttcgtccctgggcctatgccatttgggaagccatcaaggacttttttgatgctgagatcaagaaacttggtgttgaaaactgctacttccccatgtttgtgtctcaaagtgcattagagaaagagaagactcatgttgctgactttgccccagaggttgcttgggttacaagatctggcaaaaccgagctggcagaaccaattgccattcgtcctactagtgaaacagtaatgtatcctgcatatgcaaaatgggtacaatcacacagagacctgcccatcaagctcaatcagtggtgcaatgtggtgcgttgggaattcaagcatcctcagcctttcctacgtactcgtgaatttctttggcaggaagggcacagtgcttttgctaccatggaagaggcagcggaagaggtcttgcagatacttgacttatatgctcaggtatatgaagaactcctggcaattcctgttgttaaaggaagaaagacggaaaaggaaaaatttgcaggaggagactatacaactacaatagaagcatttatatctgctagtggaagagctatccagggaggaacatcacatcatttagggcagaatttttccaaaatgtttgaaatcgtttttgaagatccaaagataccaggagagaagcaatttgcctatcaaaactcctggggcctgacaactcgaactattggtgttatgaccatggttcatggggacaacatgggtttagtattaccaccccgtgtagcatgtgttcaggtggtgattattccttgtggcattaccaatgcactttctgaagaagacaaagaagcgctgattgcaaaatgcaatgattatcgaaggcgattactcagtgttaacatccgcgttagagctgatttacgagataattattctccaggttggaaattcaatcactgggagctcaagggagttcccattagacttgaagttgggccacgtgatatgaagagctgtcagtttgtagccgtcagacgagatactggagaaaagctgacagttgctgaaaatgaggcagagactaaacttcaagctattttggaagacatccaggtcacccttttcacaagggcttctgaagaccttaagactcatatggttgtggctaatacaatggaagactttcagaagatactagattctggaaagattgttcagattccattctgtggggaaattgactgtgaggactggatcaaaaagaccactgccagggatcaagatcttgaacctggtgctccatccatgggagctaaaagcctttgcatccccttcaaaccactctgtgaactgcagcctggagccaaatgtgtctgtggcaagaaccctgccaagtactacaccttatttggtcgcagctactgagggatgaacgaaagccccctcttcaactcctctcactttttaaagcattgatattagtatcttctcagatacagaccgttttatgattttttaaaaagtaaaagttctaaaatgaagtcacacaggacaattattcttatgcctaagttaacagtggataaaagacttttctgtaaacaactccagtaataaatatcatgaactaa

SEQ ID NO: 329700 - DNA, 4993 bp, Homo sapiens
agtagctgcggcgcaggggcggagcgaaggctgcggcggcgtcgggtacgcgcacacgttgcatcttcttcctttcgcggggtcctccgtagttctggcacgagccaggcgtactgacaggtggaccagcggactggtggagatggcgacgctctctctgaccgtgaattcaggagaccctccgctaggagctttgctggcagtagaacacgtgaaagacgatgtcagcatttccgttgaagaagggaaagagaatattcttcatgtttctgaaaatgtgatattcacagatgtgaattctatacttcgctacttggctagagttgcaactacagctgggttatatggctctaatctgatggaacatactgagattgatcactggttggagttcagtgctacaaaattatcttcatgtgattcctttacttctacaattaatgaactcaatcattgcctgtctctgagaacatacttagttggaaactccttgagtttagcagatttatgtgtttgggccaccctaaaaggaaatgctgcctggcaagaacagttgaaacagaagaaagctccagttcatgtaaaacgttggtttggctttcttgaagcccagcaggccttccagtcagtaggtaccaagtgggatgtttcaacaaccaaagctcgagtggcacctgagaaaaagcaagatgttgggaaatttgttgagcttccaggtgcggagatgggaaaggttaccgtcagatttcctccagaggccagtggttacttacacattgggcatgcaaaagctgctcttctgaaccagcactaccaggttaactttaaagggaaactgatcatgagatttgatgacacaaatcctgaaaaagaaaaggaagattttgagaaggttatcttggaagatgttgcaatgttgcatatcaaaccagatcaatttacttatacttcggatcattttgaaactataatgaagtatgcagagaagctaattcaagaagggaaggcttatgtggatgatactcctgctgaacagatgaaagcagaacgtgagcagaggatagaatctaaacatagaaaaaaccctattgagaagaatctacaaatgtgggaagaaatgaaaaaagggagccagtttggtcagtcctgttgtttgcgagcaaaaattgacatgagtagtaacaatggatgcatgagagatccaaccctttatcgctgcaaaattcaaccacatccaagaactggaaataaatacaatgtttatccaacatatgattttgcctgccccatagttgacagcatcgaaggtgttacacatgccctgagaacaacagaataccatgacagagatgagcagttttactggattattgaagctttaggcataagaaaaccatatatttgggaatatagtcggctaaatctcaacaacacagtgctatccaaaagaaaactcacatggtttgtcaatgaaggactagtagatggatgggatgacccaagatttcctacggttcgtggtgtactgagaagagggatgacagttgaaggactgaaacagtttattgctgctcagggctcctcacgttcagtcgtgaacatggagtgggacaaaatctgggcgtttaacaaaaaggttattgacccagtggctccacgatatgttgcattactgaagaaagaagtgatcccagtgaatgtacctgaagctcaggaggagatgaaagaagtagccaaacacccaaagaatcctgaggttggcttgaagcctgtgtggtatagtcccaaagttttcattgaaggtgctgatgcagagactttttcggagggtgagatggttacatttataaattggggcaacctcaacattacaaaaatacacaaaaatgcagatggaaaaatcatatctcttgatgcaaagttgaatttggaaaacaaagactacaagaaaaccactaaggtcacttggcttgcagagactacacatgctcttcctattccagtaatctgtgtcacttatgagcacttgatcacaaagccagtgctaggaaaagacgaggactttaagcagtatgtcaacaagaacagtaagcatgaagagctaatgctaggggatccctgccttaaggatttgaaaaaaggagatattatacaactccagagaagaggattcttcatatgtgatcaaccttatgaacctgttagcccatatagttgcaaggaagccccgtgtgttttgatatacattcctgatgggcacacaaaggaaatgccaacatcagggtcaaaggaaaagaccaaagtagaagccacaaaaaatgagacctctgctccttttaaggaaagaccaacaccttctctgaataataattgtactacatctgaggattccttggtcctttacaatagagtggctgttcaaggagatgtggttcgtgaattaaaagccaagaaagcaccaaaggaagatgtagatgcagctgtaaaacagcttttgtctttgaaagctgaatataaggagaaaactggccaggaatataaacctggaaaccctcctgctgaaataggacagaatatttcttctaattcctcagcaagtattctggaaagtaaatctctgtatgatgaagttgctgcacaaggggaggtggttcgtaagctaaaagctgaaaaatcccctaaggctaaaataaatgaagctgtagaatgcttactgtccctgaaggctcagtataaagaaaaaactgggaaggagtacatacctggtcagcccccattatctcaaagttcggattcaagcccaaccagaaattctgaacctgctggtttagaaacaccagaagcgaaagtactttttgacaaagtagcttctcaaggggaagtagttcggaaacttaaaactgaaaaagcccctaaggatcaagtagatatagctgttcaagaactccttcagctaaaggcacagtacaagtctttgataggagtagagtataagcctgtgtcggccactggagctgaggacaaagataagaagaagaaagaaaaagaaaataaatctgaaaagcagaataagcctcagaaacaaaatgatggccaaaggaaagacccttctaaaaaccaaggaggtgggctctcatcaagtggagcaggagaagggcaggggcctaagaaacagaccaggttgggtcttgaggcaaaaaaagaagaaaatcttgctgattggtattctcaggtcatcacaaagtcagaaatgattgaataccatgacataagtggctgttatattcttcgtccctgggcctatgccatttgggaagccatcaaggacttttttgatgctgagatcaagaaacttggtgttgaaaactgctacttccccatgtttgtgtctcaaagtgcattagagaaagagaagactcatgttgctgactttgccccagaggttgcttgggttacaagatctggcaaaaccgagctggcagaaccaattgccattcgtcctactagtgaaacagtaatgtatcctgcatatgcaaaatgggtacaatcacacagagacctgcccatcaagctcaatcagtggtgcaatgtggtgcgttgggaattcaagcatcctcagcctttcctacgtactcgtgaatttctttggcaggaagggcacagtgcttttgctaccatggaagaggcagcggaagaggtcttgcagatacttgacttatatgctcaggtatatgaagaactcctggcaattcctgttgttaaaggaagaaagacggaaaaggaaaaatttgcaggaggagactatacaactacaatagaagcatttatatctgctagtggaagagctatccagggaggaacatcacatcatttagggcagaatttttccaaaatgtttgaaatcgtttttgaagatccaaagataccaggagagaagcaatttgcctatcaaaactcctggggcctgacaactcgaactattggtgttatgaccatggttcatggggacaacatgggtttagtattaccaccccgtgtagcatgtgttcaggtggtgattattccttgtggcattaccaatgcactttctgaagaagacaaagaagcgctgattgcaaaatgcaatgattatcgaaggcgattactcagtgttaacatccgcgttagagctgatttacgagataattattctccaggttggaaattcaatcactgggagctcaagggagttcccattagacttgaagttgggccacgtgatatgaagagctgtcagtttgtagccgtcagacgagatactggagaaaagctgacagttgctgaaaatgaggcagagactaaacttcaagctattttggaagacatccaggtcacccttttcacaagggcttctgaagaccttaagactcatatggttgtggctaatacaatggaagactttcagaagatactagattctggaaagattgttcagattccattctgtggggaaattgactgtgaggactggatcaaaaagaccactgccagggatcaagatcttgaacctggtgctccatccatgggagctaaaagcctttgcatccccttcaaaccactctgtgaactgcagcctggagccaaatgtgtctgtggcaagaaccctgccaagtactacaccttatttggtcgcagctactgagggatgaacgaaagccccctcttcaactcctctcactttttaaagcattgatattagtatcttctcagatacagaccgttttatgattttttaaaaagtaaaagttctaaaatgaagtcacacaggacaattattcttatgcctaagttaacagtggataaaagacttttctgtaaacaactccagtaataaatatcatgaactaagaaaaaaatcataaaaacttgaggttggggcccgttaccccaattcgccctaatgggagtcgaattacaattcactggcccggcgtttacaacgatcggacttgga

SEQ ID NO: 329701 - DNA, 3126 bp, Homo sapiens
taggctagtcgaggctggtgtgaatcggccgaggattgaaggtgctgatgcagagactttttcggagggtgagatggttacatttataaattggggcaacctcaacattacaaaaatacacaaaaatgcagatggaaaaatcatatctcttgatgcaaagttgaatttggaaaacaaagactacaagaaaaccactaaggtcacttggcttgcagagactacacatgctcttcctattccagtaatctgtgtcacttatgagcacttgatcacaaagccagtgctaggaaaagacgaggactttaagcagtatgtcaacaagaacagtaagcatgaagagctaatgctaggggatccctgccttaaggatttgaaaaaaggagatattatacaactccagagaagaggattcttcatatgtgatcaaccttatgaacctgttagcccatatagttgcaaggaagccccgtgtgttttgatatacattcctgatgggcacacaaaggaaatgccaacatcagggtcaaaggaaaagaccaaagtagaagccacaaaaaatgagacctctgctccttttaaggaaagaccaacaccttctctgaataataattgtactacatctgaggattccttggtcctttacaatagagtggctgttcaaggagatgtggttcgtgaattaaaagccaagaaagcaccaaaggaagatgtagatgcagctgtaaaacagcttttgtctttgaaagctgaatataaggagaaaactggccaggaatataaacctggaaaccctcctgctgaaataggacagaatatttcttctaattcctcagcaagtattctggaaagtaaatctctgtatgatgaagttgctgcacaaggggaggtggttcgtaagctaaaagctgaaaaatcccctaaggctaaaataaatgaagctgtagaatgcttactgtccctgaaggctcagtataaagaaaaaactgggaaggagtacatacctggtcagcccccattatctcaaagttcggattcaagcccaaccagaaattctgaacctgctggtttagaaacaccagaagcgaaagtactttttgacaaagtagcttctcaaggggaagtagttcggaaacttaaaactgaaaaagcccctaaggatcaagtagatatagctgttcaagaactccttcagctaaaggcacagtacaagtctttgataggagtagagtataagcctgtgtcggccactggagctgaggacaaagataagaagaagaaagaaaaagaaaataaatctgaaaagcagaataagcctcagaaacaaaatgatggccaaaggaaagacccttctaaaaaccaaggaggtgggctctcatcaagtggagcaggagaagggcaggggcctaagaaacagaccaggttgggtcttgaggcaaaaaaagaagaaaatcttgctgattggtattctcaggtcatcacaaagtcagaaatgattgaataccatgacataagtggctgttatattcttcgtccctgggcctatgccatttgggaagccatcaaggacttttttgatgctgagatcaagaaacttggtgttgaaaactgctacttccccatgtttgtgtctcaaagtgcattagagaaagagaagactcatgttgctgactttgccccagaggttgcttgggttacaagatctggcaaaaccgagctggcagaaccaattgccattcgtcctactagtgaaacagtaatgtatcctgcatatgcaaaatgggtacaatcacacagagacctgcccatcaagctcaatcagtggtgcaatgtggtgcgttgggaattcaagcatcctcagcctttcctacgtactcgtgaatttctttggcaggaagggcacagtgcttttgctaccatggaagaggcagcggaagaggtcttgcagatacttgacttatatgctcaggtatatgaagaactcctggcaattcctgttgttaaaggaagaaagacggaaaaggaaaaatttgcaggaggagactatacaactacaatagaagcatttatatctgctagtggaagagctatccagggaggaacatcacatcatttagggcagaatttttccaaaatgtttgaaatcgtttttgaagatccaaagataccaggagagaagcaatttgcctatcaaaactcctggggcctgacaactcgaactattggtgttatgaccatggttcatggggacaacatgggtttagtattaccaccccgtgtagcatgtgttcaggtggtgattattccttgtggcattaccaatgcactttctgaagaagacaaagaagcgctgattgcaaaatgcaatgattatcgaaggcgattactcagtgttaacatccgcgttagagctgatttacgagataattattctccaggttggaaattcaatcactgggagctcaagggagttcccattagacttgaagttgggccacgtgatatgaagagctgtcagtttgtagccgtcagacgagatactggagaaaagctgacagttgctgaaaatgaggcagagactaaacttcaagctattttggaagacatccaggtcacccttttcacaagggcttctgaagaccttaagactcatatggttgtggctaatacaatggaagactttcagaagatactagattctggaaagattgttcagattccattctgtggggaaattgactgtgaggactggatcaaaaagaccactgccagggatcaagatcttgaacctggtgctccatccatgggagctaaaagcctttgcatccccttcaaaccactctgtgaactgcagcctggagccaaatgtgtctgtggcaagaaccctgccaagtactacaccttatttggtcgcagctactgagggatgaacgaaagccccctcttcaactcctctcactttttaaagcattgatattagtatcttctcagatacagaccgttttatgattttttaaaaagtaaaagttctaaaatgaagtcacacaggacaattattcttatgcctaagttaacagtggataaaagacttttctgtaaacaactccagtaataaatatcatgaactaa

SEQ ID NO: 329702 - DNA, 5409 bp, Homo sapiens
agtagctgcggcgcaggggcggagcgaaggctgcggcggcgtcgggtacgcgcacacgttgcatcttcttcctttcgcggggtcctccgtagttctggcacgagccaggcgtactgacaggtggaccagcggactggtggagatggcgacgctctctctgaccgtgaattcaggagaccctccgctaggagctttgctggcagtagaacacgtgaaagacgatgtcagcatttccgttgaagaagggaaagagaatattcttcatgtttctgaaaatgtgatattcacagatgtgaattctatacttcgctacttggctagagttgcaactacagctgggttatatggctctaatctgatggaacatactgagattgatcactggttggagttcagtgctacaaaattatcttcatgtgattcctttacttctacaattaatgaactcaatcattgcctgtctctgagaacatacttagttggaaactccttgagtttagcagatttatgtgtttgggccaccctaaaaggaaatgctgcctggcaagaacagttgaaacagaagaaagctccagttcatgtaaaacgttggtttggctttcttgaagcccagcaggccttccagtcagtaggtaccaagtgggatgtttcaacaaccaaagctcgagtggcacctgagaaaaagcaagatgttgggaaatttgttgagcttccaggtgcggagatgggaaaggttaccgtcagatttcctccagaggccagtggttacttacacattgggcatgcaaaagctgctcttctgaaccagcactaccaggttaactttaaagggaaactgatcatgagatttgatgacacaaatcctgaaaaagaaaaggaagattttgagaaggttatcttggaagatgttgcaatgttgcatatcaaaccagatcaatttacttatacttcggatcattttgaaactataatgaagtatgcagagaagctaattcaagaagggaaggcttatgtggatgatactcctgctgaacagatgaaagcagaacgtgagcagaggatagaatctaaacatagaaaaaaccctattgagaagaatctacaaatgtgggaagaaatgaaaaaagggagccagtttggtcagtcctgttgtttgcgagcaaaaattgacatgagtagtaacaatggatgcatgagagatccaaccctttatcgctgcaaaattcaaccacatccaagaactggaaataaatacaatgtttatccaacatatgattttgcctgccccatagttgacagcatcgaaggtgttacacatgccctgagaacaacagaataccatgacagagatgagcagttttactggattattgaagctttaggcataagaaaaccatatatttgggaatatagtcggctaaatctcaacaacacagtgctatccaaaagaaaactcacatggtttgtcaatgaaggactagtagatggatgggatgacccaagatttcctacggttcgtggtgtactgagaagagggatgacagttgaaggactgaaacagtttattgctgctcagggctcctcacgttcagtcgtgaacatggagtgggacaaaatctgggcgtttaacaaaaaggttattgacccagtggctccacgatatgttgcattactgaagaaagaagtgatcccagtgaatgtacctgaagctcaggaggagatgaaagaagtagccaaacacccaaagaatcctgaggttggcttgaagcctgtgtggtatagtcccaaagttttcattgaaggtgctgatgcagagactttttcggagggtgagatggttacatttataaattggggcaacctcaacattacaaaaatacacaaaaatgcagatggaaaaatcatatctcttgatgcaaagttgaatttggaaaacaaagactacaagaaaaccactaaggtcacttggcttgcagagactacacatgctcttcctattccagtaatctgtgtcacttatgagcacttgatcacaaagccagtgctaggaaaagacgaggactttaagcagtatgtcaacaagaacagtaagcatgaagagctaatgctaggggatccctgccttaaggatttgaaaaaaggagatattatacaactccagagaagaggattcttcatatgtgatcaaccttatgaacctgttagcccatatagttgcaaggaagccccgtgtgttttgatatacattcctgatgggcacacaaaggaaatgccaacatcagggtcaaaggaaaagaccaaagtagaagccacaaaaaatgagacctctgctccttttaaggaaagaccaacaccttctctgaataataattgtactacatctgaggattccttggtcctttacaatagagtggctgttcaaggagatgtggttcgtgaattaaaagccaagaaagcaccaaaggaagatgtagatgcagctgtaaaacagcttttgtctttgaaagctgaatataaggagaaaactggccaggaatataaacctggaaaccctcctgctgaaataggacagaatatttcttctaattcctcagcaagtattctggaaagtaaatctctgtatgatgaagttgctgcacaaggggaggtggttcgtaagctaaaagctgaaaaatcccctaaggctaaaataaatgaagctgtagaatgcttactgtccctgaaggctcagtataaagaaaaaactgggaaggagtacatacctggtcagcccccattatctcaaagttcggattcaagcccaaccagaaattctgaacctgctggtttagaaacaccagaagcgaaagtactttttgacaaagtagcttctcaaggggaagtagttcggaaacttaaaactgaaaaagcccctaaggatcaagtagatatagctgttcaagaactccttcagctaaaggcacagtacaagtctttgataggagtagagtataagcctgtgtcggccactggagctgaggacaaagataagaagaagaaagaaaaagaaaataaatctgaaaagcagaataagcctcagaaacaaaatgatggccaaaggaaagacccttctaaaaaccaaggaggtgggctctcatcaagtggagcaggagaagggcaggggcctaagaaacagaccaggttgggtcttgaggcaaaaaaagaagaaaatcttgctgattggtattctcaggtcatcacaaagtcagaaatgattgaataccatgacataagtggctgttatattcttcgtccctgggcctatgccatttgggaagccatcaaggacttttttgatgctgagatcaagaaacttggtgttgaaaactgctacttccccatgtttgtgtctcaaagtgcattagagaaagagaagactcatgttgctgactttgccccagaggttgcttgggttacaagatctggcaaaaccgagctggcagaaccaattgccattcgtcctactagtgaaacagtaatgtatcctgcatatgcaaaatgggtacaatcacacagagacctgcccatcaagctcaatcagtggtgcaatgtggtgcgttgggaattcaagcatcctcagcctttcctacgtactcgtgaatttctttggcaggaagggcacagtgcttttgctaccatggaagaggcagcggaagaggtcttgcagatacttgacttatatgctcaggtatatgaagaactcctggcaattcctgttgttaaaggaagaaagacggaaaaggaaaaatttgcaggaggagactatacaactacaatagaagcatttatatctgctagtggaagagctatccagggaggaacatcacatcatttagggcagaatttttccaaaatgtttgaaatcgtttttgaagatccaaagataccaggagagaagcaatttgcctatcaaaactcctggggcctgacaactcgaactattggtgttatgaccatggttcatggggacaacatgggtttagtattaccaccccgtgtagcatgtgttcaggtggtgattattccttgtggcattaccaatgcactttctgaagaagacaaagaagcgctgattgcaaaatgcaatgattatcgaaggcgattactcagtgttaacatccgcgttagagctgatttacgagataattattctccaggttggaaattcaatcactgggagctcaagggagttcccattagacttgaagttgggccacgtgatatgaagagctgtcagtttgtagccgtcagacgagatactggagaaaagctgacagttgctgaaaatgaggcagagactaaacttcaagctattttggaagacatccaggtcacccttttcacaagggcttctgaagaccttaagactcatatggttgtggctaatacaatggaagactttcagaagatactagattctggaaagattgttcagattccattctgtggggaaattgactgtgaggactggatcaaaaagaccactgccaggtaaacctaattaactggcaaaacttttgaaaaattgcaatggaaaggaatagcaatttgcagcataaatgagtggaattcttatttgttattaatttcagggatcaagatcttgaacctggtgctccatccatgggagctaaaagcctttgcatccccttcaaaccactctgtgaactgcagcctggagccaaatgtgtctgtggcaagaaccctgccaagtactacaccttatttggtcgcagctactgagggatgaacgaaagccccctcttcaactcctctcactttttaaagcattgatattagtatcttctcagatacagaccgttttatgattttttaaaaagtaaaagttctaaaatgaagtcacacaggacaattattcttatgcctaagttaacagtggataaaagacttttctgtaaacaactccagtaataaatatcatgaactaaaaaaaaaaaaaaaaaaaaaaaaaaaaaaaaaaaaaaaaaaaaaaaaaaaaaaaaaaaaaataaaaaaaagaaacatccaacaaaatgaaagaaccaaaccataaaaatggataaaatataaacagatgcataacaacaatcaagtagtgactatcgacaaaacaccaatgataagaccagtttgacatacgggattggcgggcgtcgctacgtcactgtcactggcaagacgaagcccttacggaccatgttggaacgcctttcatatttcatgtatcgctatcctagtgcgggtccatcctcacacatactctgatgaacaccactaacccgcagtggtggagtagcagacaatttcaatgcggcacatggatccgcgcctctctcactccacaacatcttgtttggtcattcccacgtt

SEQ ID NO: 329703 - DNA, 4277 bp, Homo sapiens
agtagctgcggcgcaggggcggagcgaaggctgcggcggcgtcgggtacgcgcacacgttgcatcttcttcctttcgcggggtcctccgtagttctggcacgagccaggcgtactgacaggtggaccagcggactggtggagatggcgacgctctctctgaccgtgaattcaggagaccctccgctaggagctttgctggcagtagaacacgtgaaagacgatgtcagcatttccgttgaagaagggaaagagaatattcttcatgtttctgaaaatgtgatattcacagatgtgaattctatacttcgctacttggctagagttgcaactacagctgggttatatggctctaatctgatggaacatactgagattgatcactggttggagttcagtgctacaaaattatcttcatgtgattcctttacttctacaattaatgaactcaatcattgcctgtctctgagaacatacttagttggaaactccttgagtttagcagatttatgtgtttgggccaccctaaaaggaaatgctgcctggcaagaacagttgaaacagaagaaagctccagttcatgtaaaacgttggtttggctttcttgaagcccagcaggccttccagtcagtaggtaccaagtgggatgtttcaacaaccaaagctcgagtggcacctgagaaaaagcaagatgttgggaaatttgttgagcttccaggtgcggagatgggaaaggttaccgtcagatttcctccagaggccagtggttacttacacattgggcatgcaaaagctgctcttctgaaccagcactaccaggttaactttaaagggaaactgatcatgagatttgatgacacaaatcctgaaaaagaaaaggaagattttgagaaggttatcttggaagatgttgcaatgttgcatatcaaaccagatcaatttacttatacttcggatcattttgaaactataatgaagtatgcagagaagctaattcaagaagggaaggcttatgtggatgatactcctgctgaacagatgaaagcagaacgtgagcagaggatagaatctaaacatagaaaaaaccctattgagaagaatctacaaatgtgggaagaaatgaaaaaagggagccagtttggtcagtcctgttgtttgcgagcaaaaattgacatgagtagtaacaatggatgcatgagagatccaaccctttatcgctgcaaaattcaaccacatccaagaactggaaataaatacaatgtttatccaacatatgattttgcctgccccatagttgacagcatcgaaggtgttacacatgccctgagaacaacagaataccatgacagagatgagcagttttactggattattgaagctttaggcataagaaaaccatatatttgggaatatagtcggctaaatctcaacaacacagtgctatccaaaagaaaactcacatggtttgtcaatgaaggactagtagatggatgggatgacccaagatttcctacggttcgtggtgtactgagaagagggatgacagttgaaggactgaaacagtttattgctgctcagggctcctcacgttcagtcgtgaacatggagtgggacaaaatctgggcgtttaacaaaaaggttattgacccagtggctccacgatatgttgcattactgaagaaagaagtgatcccagtgaatgtacctgaagctcaggaggagatgaaagaagtagccaaacacccaaagaatcctgaggttggcttgaagcctgtgtggtatagtcccaaagttttcattgaaggtgctgatgcagagactttttcggagggtgagatggttacatttataaattggggcaacctcaacattacaaaaatacacaaaaatgcagatggaaaaatcatatctcttgatgcaaagttgaatttggaaaacaaagactacaagaaaaccactaaggtcacttggcttgcagagactacacatgctcttcctattccagtaatctgtgtcacttatgagcacttgatcacaaagccagtgctaggaaaagacgaggactttaagcagtatgtcaacaagaacagtaagcatgaagagctaatgctaggggatccctgccttaaggatttgaaaaaaggagatattatacaactccagagaagaggattcttcatatgtgatcaaccttatgaacctgttagcccatatagttgcaaggaagccccgtgtgttttgatatacattcctgatgggcacacaaaggaaatgccaacatcagggtcaaaggaaaagaccaaagtagaagccacaaaaaatgagacctctgctccttttaaggaaagaccaacaccttctctgaataataattgtactacatctgaggattccttggtcctttacaatagagtggctgttcaaggagatgtggttcgtgaattaaaagccaagaaagcaccaaaggaagatgtagatgcagctgtaaaacagcttttgtctttgaaagctgaatataaggagaaaactggccaggaatataaacctggaaaccctcctgctgaaataggacagaatatttcttctaattcctcagcaagtattctggaaagtaaatctctgtatgatgaagttgctgcacaaggggaggtggttcgtaagctaaaagctgaaaaatcccctaaggctaaaataaatgaagctgtagaatgcttactgtccctgaaggctcagtataaagaaaaaactgggaaggagtacatacctggtcagcccccattatctcaaagttcggattcaagcccaaccagaaattctgaacctgctggtttagaaacaccagaagcgaaagtactttttgacaaagtagcttctcaaggggaagtagttcggaaacttaaaactgaaaaagcccctaaggatcaagtagatatagctgttcaagaactccttcagctaaaggcacagtacaagtctttgataggagtagagtataagcctgtgtcggccactggagctgaggacaaagataagaagaagaaagaaaaagaaaataaatctgaaaagcagaataagcctcagaaacaaaatgatggccaaaggaaagacccttctaaaaaccaaggaggtgggctctcatcaagtggagcaggagaagggcaggggcctaagaaacagaccaggttgggtcttgaggcaaaaaaagaagaaaatcttgctgattggtattctcaggtcatcacaaagtcagaaatgattgaataccatgacataagtggctgttatattcttcgtccctgggcctatgccatttgggaagccatcaaggacttttttgatgctgagatcaagaaacttggtgttgaaaactgctacttccccatgtttgtgtctcaaagtgcattagagaaagagaagactcatgttgctgactttgccccagaggttgcttgggttacaagatctggcaaaaccgagctggcagaaccaattgccattcgtcctactagtgaaacagtaatgtatcctgcatatgcaaaatgggtacaatcacacagagacctgcccatcaagctcaatcagtggtgcaatgtggtgcgttgggaattcaagcatcctcagcctttcctacgtactcgtgaatttctttggcaggaagggcacagtgcttttgctaccatggaagaggcagcggaagaggtcttgcagatacttgacttatatgctcaggtatatgaagaactcctggcaattcctgttgttaaaggaagaaagacggaaaaggaaaaatttgcaggaggagactatacaactacaatagaagcatttatatctgctagtggaagagctatccagggaggaacatcacatcatttagggcagaatttttccaaaatgtttgaaatcgtttttgaagatccaaagataccaggagagaagcaatttgcctatcaaaactcctggggcctgacaactcgaactattggtgttatgaccatggttcatggggacaacatgggtttagtattaccaccccgtgtagcatgtgttcaggtggtgattattccttgtggcattaccaatgcactttctgaagaagacaaagaagcgctgattgcaaaatgcaatgattatcgaaggcgattactcagtgttaacatccgcgttagagctgatttacgagataattattctccaggttggaaattcaatcactgggagctcaagggagtcccattgattgaatttccaacctggagagcctacataatggagggac

SEQ ID NO: 329704 - DNA, 1643 bp, Homo sapiens
gggctggtacggtcggaagttttgggatgtggctgttatattcttcgtccctgggcctatgccatttgggaagccatcaaggacttttttgatgctgagatcaagaaacttggtgttgaaaactgctacttccccatgtttgtgtctcaaagtgcattagagaaagagaagactcatgttgctgactttgccccagaggttgcttgggttacaagatctggcaaaaccgagctggcagaaccaattgccattcgtcctactagtgaaacagtaatgtatcctgcatatgcaaaatgggtacaatcacacagagacctgcccatcaagctcaatcagtggtgcaatgtggtgcgttgggaattcaagcatcctcagcctttcctacgtactcgtgaatttctttggcaggaagggcacagtgcttttgctaccatggaagaggcagcggaagaggtcttgcagatacttgacttatatgctcaggtatatgaagaactcctggcaattcctgttgttaaaggaagaaagacggaaaaggaaaaatttgcaggaggagactatacaactacaatagaagcatttatatctgctagtggaagagctatccagggaggaacatcacatcatttagggcagaatttttccaaaatgtttgaaatcgtttttgaagatccaaagataccaggagagaagcaatttgcctatcaaaactcctggggcctgacaactcgaactattggtgttatgaccatggttcatggggacaacatgggtttagtattaccaccccgtgtagcatgtgttcaggtggtgattattccttgtggcattaccaatgcactttctgaagaagacaaagaagcgctgattgcaaaatgcaatgattatcgaaggcgattactcagtgttaacatccgcgttagagctgatttacgagataattattctccaggttggaaattcaatcactgggagctcaagggagttcccattagacttgaagttgggccacgtgatatgaagagctgtcagtttgtagccgtcagacgagatactggagaaaagctgacagttgctgaaaatgaggcagagactaaacttcaagctattttggaagacatccaggtcacccttttcacaagggcttctgaagaccttaagactcatatggttgtggctaatacaatggaagactttcagaagatactagattctggaaagattgttcagattccattctgtggggaaattgactgtgaggactggatcaaaaagaccactgccagggatcaagatcttgaacctggtgctccatccatgggagctaaaagcctttgcatccccttcaaaccactctgtgaactgcagcctggagccaaatgtgtctgtggcaagaaccctgccaagtactacaccttatttggtcgcagctactgagggatgaacgaaagccccctcttcaactcctctcactttttaaagcattgatattagtatcttctcagatacagaccgttttatgattttttaaaaagtaaaagttctaaaatgaagtcacacaggacaattattcttatgcctaagttaacagtggataaaagacttttctgtaaacaactccagtaataaatatcatgaactaa

SEQ ID NO: 329705 - DNA, 3647 bp, Homo sapiens
  misc_feature (3630)..(3630): n is a, c, g, or t
agtagctgcggcgcaggggcggagcgaaggctgcggcggcgtcgggtacgcgcacacgttgcatcttcttcctttcgcggggtcctccgtagttctggcacgagccaggcgtactgacaggtggaccagcggactggtggagatggcgacgctctctctgaccgtgaattcaggagaccctccgctaggagctttgctggcagtagaacacgtgaaagacgatgtcagcatttccgttgaagaagggaaagagaatattcttcatgtttctgaaaatgtgatattcacagatgtgaattctatacttcgctacttggctagagttgcaactacagctgggttatatggctctaatctgatggaacatactgagattgatcactggttggagttcagtgctacaaaattatcttcatgtgattcctttacttctacaattaatgaactcaatcattgcctgtctctgagaacatacttagttggaaactccttgagtttagcagatttatgtgtttgggccaccctaaaaggaaatgctgcctggcaagaacagttgaaacagaagaaagctccagttcatgtaaaacgttggtttggctttcttgaagcccagcaggccttccagtcagtaggtaccaagtgggatgtttcaacaaccaaagctcgagtggcacctgagaaaaagcaagatgttgggaaatttgttgagcttccaggtgcggagatgggaaaggttaccgtcagatttcctccagaggccagtggttacttacacattgggcatgcaaaagctgctcttctgaaccagcactaccaggttaactttaaagggaaactgatcatgagatttgatgacacaaatcctgaaaaagaaaaggaagattttgagaaggttatcttggaagatgttgcaatgttgcatatcaaaccagatcaatttacttatacttcggatcattttgaaactataatgaagtatgcagagaagctaattcaagaagggaaggcttatgtggatgatactcctgctgaacagatgaaagcagaacgtgagcagaggatagaatctaaacatagaaaaaaccctattgagaagaatctacaaatgtgggaagaaatgaaaaaagggagccagtttggtcagtcctgttgtttgcgagcaaaaattgacatgagtagtaacaatggatgcatgagagatccaaccctttatcgctgcaaaattcaaccacatccaagaactggaaataaatacaatgtttatccaacatatgattttgcctgccccatagttgacagcatcgaaggtgttacacatgccctgagaacaacagaataccatgacagagatgagcagttttactggattattgaagctttaggcataagaaaaccatatatttgggaatatagtcggctaaatctcaacaacacagtgctatccaaaagaaaactcacatggtttgtcaatgaaggactagtagatggatgggatgacccaagatttcctacggttcgtggtgtactgagaagagggatgacagttgaaggactgaaacagtttattgctgctcagggctcctcacgttcagtcgtgaacatggagtgggacaaaatctgggcgtttaacaaaaaggttattgacccagtggctccacgatatgttgcattactgaagaaagaagtgatcccagtgaatgtacctgaagctcaggaggagatgaaagaagtagccaaacacccaaagaatcctgaggttggcttgaagcctgtgtggtatagtcccaaagttttcattgaaggtgctgatgcagagactttttcggagggtgagatggttacatttataaattggggcaacctcaacattacaaaaatacacaaaaatgcagatggaaaaatcatatctcttgatgcaaagttgaatttggaaaacaaagactacaagaaaaccactaaggtcacttggcttgcagagactacacatgctcttcctattccagtaatctgtgtcacttatgagcacttgatcacaaagccagtgctaggaaaagacgaggactttaagcagtatgtcaacaagaacagtaagcatgaagagctaatgctaggggatccctgccttaaggatttgaaaaaaggagatattatacaactccagagaagaggattcttcatatgtgatcaaccttatgaacctgttagcccatatagttgcaaggaagccccgtgtgttttgatatacattcctgatgggcacacaaaggaaatgccaacatcagggtcaaaggaaaagaccaaagtagaagccacaaaaaatgagacctctgctccttttaaggaaagaccaacaccttctctgaataataattgtactacatctgaggattccttggtcctttacaatagagtggctgttcaaggagatgtggttcgtgaattaaaagccaagaaagcaccaaaggaagatgtagatgcagctgtaaaacagcttttgtctttgaaagctgaatataaggagaaaactggccaggaatataaacctggaaaccctcctgctgaaataggacagaatatttcttctaattcctcagcaagtattctggaaagtaaatctctgtatgatgaagttgctgcacaaggggaggtggttcgtaagctaaaagctgaaaaatcccctaaggctaaaataaatgaagctgtagaatgcttactgtccctgaaggctcagtataaagaaaaaactgggaaggagtacatacctggtcagcccccattatctcaaagttcggattcaagcccaaccagaaattctgaacctgctggtttagaaacaccagaagcgaaagtactttttgacaaagtagcttctcaaggggaagtagttcggaaacttaaaactgaaaaagcccctaaggatcaagtagatatagctgttcaagaactccttcagctaaaggcacagtacaagtctttgataggagtagagtataagcctgtgtcggccactggagctgaggacaaagataagaagaagaaagaaaaagaaaataaatctgaaaagcagaataagcctcagaaacaaaatgatggccaaaggaaagacccttctaaaaaccaaggaggtgggctctcatcaagtggagcaggagaagggcaggggcctaagaaacagaccaggttgggtcttgaggcaaaaaaagaagaaaatcttgctgattggtattctcaggtcatcacaaagtcagaaatgattgaataccatgacataagtggctgttatattcttcgtccctgggcctatgccatttgggaagccatcaaggacttttttgatgctgagatcaagaaacttggtgttgaaaactgctacttccccatgtttgtgtctcaaagttcggattcaagcccaaccagaaattctgaacctgctggtttagaaacaccagaagcgaaagtactttttgacaaagtagcttctcaaggggaagtagttcggaaacttaaaactgaaaaagcccctaaggatcaagtagatatagctgttcaagaactccttcagctaaaggcacagtacaagtctttgataggagtagagtataagcctgtgtcggccactggagctgaggncaaagataaaaaaaaga

SEQ ID NO: 329706 - DNA, 1287 bp, Homo sapiens
agtagctgcggcgcaggggcggagcgaaggctgcggcggcgtcgggtacgcgcacacgttgcatcttcttcctttcgcggggtcctccgtagttctggcacgagccaggcgtactgacaggtggaccagcggactggtggagatggcgacgctctctctgaccgtgaattcaggagaccctccgctaggagctttgctggcagtagaacacgtgaaagacgatgtcagcatttccgttgaagaagggaaagagaatattcttcatgtttctgaaaatgtgatattcacagatgtgaattctatacttcgctacttggctagagttgcaactacagctgggttatatggctctaatctgatggaacatactgagattgatcactggttggagttcagtgctacaaaattatcttcatgtgattcctttacttctacaattaatgaactcaatcattgcctgtctctgagaacatacttagttggaaactccttgagtttagcagatttatgtgtttgggccaccctaaaaggaaatgctgcctggcaagaacagttgaaacagaagaaagctccagttcatgtaaaacgttggtttggctttcttgaagcccagcaggccttccagtcagtaggtaccaagtgggatgtttcaacaaccaaagctcgagtggcacctgagaaaaagcaagatgttgggaaatttgttgagcttccaggtgcggagatgggaaaggttaccgtcagatttcctccagaggccagtggttacttacacattgggcatgcaaaagctgctcttctgaaccagcactaccaggttaactttaaagggaaactgatcatgagatttgatgacacaaatcctgaaaaagaaaaggaagattttgagaaggttatcttggaagatgttgcaatgttgcatatcaaaccagatcaatttacttatacttcggatcattttgaaactataatgaagtatgcagagaagctaattcaagaagggaaggcttatgtggatgatactcctgctgaacagatgaaagcagaacgtgagcagaggatagaatctaaacatagaaaaaaccctattgagaagaatctacaaatgtgggaagaaatgaaaaaagggagccagtttggtcagtcctgttgtttgcgagcaaaaattgacatgagtagtaacaatggatgcatgagagatccaaccctttatcgctgcaaaattcaaccacatccaagaactggaaataaatacaatggtttaccccaccataatggatttttgcc

SEQ ID NO: 329707 - DNA, 1157 bp, Homo sapiens
cagagtaagactgtgtctcaaaaaaaaaatttttttttaatgcttgtctagtctgacatccacaatttattaaaagaaaacccagagctagagattttcaaacacatggcaaatttcaaaattaaaataaaatcctaagtatcttgattcggcctttgttttatgtagtctaagaatgaaaaattgaaaggtttttttttttttccttacacaaaatgattttaggactttaaaaatgatccacttacctatataacatgttaggaacattgtggcataaagtgaaatttgcgtgattgttaattgttgctgttaacaacacattaaaaatcagtttgctatttttgatgttccttttctcctcctgataactatttagataggtagagcaggtgtagtccaggtttgaaatgagggagatataactggagttcaacttcttttcagccactgtgttttagccagtttatgggagatttgagggtactgcaaagatgtctttgttgtgtcttgatgtgctgtgagcgtgggttttggatagtggaaaaacattctttcctatcttttataactgagcaaagttcctaataggtttgcaaaggtatcatagcctgaaaaaaggttgggagacctatcctttttgcttgccagtttaatatagaactcaaatgttccttctgcagaatagaattgaaggagttataaatactgattacttttccttttcttaattagattgttcagattccattctgtggggaaattgactgtgaggactggatcaaaaagaccactgccagggatcaagatcttgaacctggtgctccatccatgggagctaaaagcctttgcatccccttcaaaccactctgtgaactgcagcctggagccaaatgtgtctgtggcaagaaccctgccaagtactacaccttatttggtcgcagctactgagggatgaacgaaagccccctcttcaactcctctcactttttaaagcattgatattagtatcttctcagatacagaccgttttatgattttttaaaaagtaaaagttctaaaatgaagtcacacaggacaattattcttatgcctaagttaacagtggataaaagacttttctgtaaacaactccagtaataaatatcatgaactaa

SEQ ID NO: 329708 - DNA, 1258 bp, Homo sapiens
cagagtaagactgtgtctcaaaaaaaaaatttttttttaatgcttgtctagtctgacatccacaatttattaaaagaaaacccagagctagagattttcaaacacatggcaaatttcaaaattaaaataaaatcctaagtatcttgattcggcctttgttttatgtagtctaagaatgaaaaattgaaaggtttttttttttttccttacacaaaatgattttaggactttaaaaatgatccacttacctatataacatgttaggaacattgtggcataaagtgaaatttgcgtgattgttaattgttgctgttaacaacacattaaaaatcagtttgctatttttgatgttccttttctcctcctgataactatttagataggtagagcaggtgtagtccaggtttgaaatgagggagatataactggagttcaacttcttttcagccactgtgttttagccagtttatgggagatttgagggtactgcaaagatgtctttgttgtgtcttgatgtgctgtgagcgtgggttttggatagtggaaaaacattctttcctatcttttataactgagcaaagttcctaataggtttgcaaaggtatcatagcctgaaaaaaggttgggagacctatcctttttgcttgccagtttaatatagaactcaaatgttccttctgcagaatagaattgaaggagttataaatactgattacttttccttttcttaattagattgttcagattccattctgtggggaaattgactgtgaggactggatcaaaaagaccactgccaggtaaacctaattaactggcaaaacttttgaaaaattgcaatggaaaggaatagcaatttgcagcataaatgagtggaattcttatttgttattaatttcagggatcaagatcttgaacctggtgctccatccatgggagctaaaagcctttgcatccccttcaaaccactctgtgaactgcagcctggagccaaatgtgtctgtggcaagaaccctgccaagtactacaccttatttggtcgcagctactgagggatgaacgaaagccccctcttcaactcctctcactttttaaagcattgatattagtatcttctcagatacagaccgttttatgattttttaaaaagtaaaagttctaaaatgaagtcacacaggacaattattcttatgcctaagttaacagtggataaaagacttttctgtaaacaactccagtaataaatatcatgaactaa

SEQ ID NO: 329709 - DNA, 236 bp, Homo sapiens
atagccggaccggaaggtagctgttactgagggatgaacgaaagccccctcttcaactcctctcactttttaaagcattgatattagtatcttctcagatacagaccgttttatgattttttaaaaagtaaaagttctaaaatgaagtcacacaggacaattattcttatgcctaagttaacagtggataaaagacttttctgtaaacaactccagtaataaatatcatgaactaa

SEQ ID NO: 329710 - DNA, 207 bp, Homo sapiens
tatatggctctaatctgatggaacatactgaggtaagcaatgaacattttgttgtgtgtgttttgtcttatgcttctgtttttttatgggaacctcatcatttattgttggcttatgaactattctacttaagtatattaacagagtgttaattatatagaccaaggtacagaatgctcatcttgtttttttgtcacaaaaaaattc

SEQ ID NO: 329711 - DNA, 380 bp, Homo sapiens
ataccttgtcccctctgtgagattttacatttgaagttgtttcttataattgttttatatatggtatagtcttttttttttttcctgtcagggtcagattttctatcacagtactttttgttagaaaataaaatatgacttgggtaccaattagaaggacttttgtttagttctcatctcctcaaaaaggttaagtttaagtatttagttaaaacatgttaatgagtttctttgtgaaatgtttttgttttagttacttacacattgggcatgcaaaagctgctcttctgaaccagcactaccaggttaactttaaagggaaactgatcatgagatttgatgacacaaatcctgaaaaagaaaaggaagattttgagaag

SEQ ID NO: 329712 - DNA, 619 bp, Homo sapiens
atgggagctaaaagcctttgcatccccttcaaaccactctgtgaactgcagcctggagccaaatgtgtctgtggcaagaaccctgccaagtactacaccttatttggtcgcagctactgagggatgaacgaaagccccctcttcaactcctctcactttttaaagcattgatattagtatcttctcagatacagaccgttttatgattttttaaaaagtaaaagttctaaaatgaagtcacacaggacaattattcttatgcctaagttaacagtggataaaagacttttctgtaaacaactccagtaataaatatcatgaactaaatatggtttttgtattcatttgtttctgaaaaatgtgcattatgtactatgaggaaatttctacaaagagatgaagacaattgaaagccagatatctgttattgatctaagcactcccaacatgtctcagaccctgaaccgccagttataccctacactgataggtctcgaagcactttctttccatagctcctaatacagaatctgaaattgtcctaaatctttctgtttaaaaaacaaagcaaacccacaaatggaaaaagcaacaataataaagatttcccttgaacttc

SEQ ID NO: 329713 - DNA, 455 bp, Homo sapiens
gattcggcacgagggcgcgaagaggtcttgcagatacttgacttatatgctcaggtatatgaagaactcctggcaattcctgttgttaaaggaagaaagacggaaaaggaaaaatttgcaggaggagactatacaactacaatagaagcatttatatctgctagtggaagagctatccagggaggaacatcacatcatttagggcagagattgcagtgagccaagatcaagccattgtactccagcctggacaacaagagcgaaactctgtctaaaaaaaaaaaaaaaaacacacacacacacaacacaatgttttcacgcctgtaaacctagcacattgggaagccaaggtgggaggattgcttgaggccaggggttcaaggctgcagtgagctatgattgcacactgtactctagcctgggagacagagtgagacactgtctctaaaaaaaaa

SEQ ID NO: 329714 - DNA, 5003 bp, Homo sapiens
agtagctgcggcgcaggggcggagcgaaggctgcggcggcgtcgggtacgcgcacacgttgcatcttcttcctttcgcggggtcctccgtagttctggcacgagccaggcgtactgacaggtggaccagcggactggtggagatggcgacgctctctctgaccgtgaattcaggagaccctccgctagtttcgctgtgtcattcaggcaggaacgcagtggtgcaatcagggctcactgcggccatgacttcccaggctcaagcagtcctgccacctcagccccctgggtagctgggaccacaggagctttgctggcagtagaacacgtgaaagacgatgtcagcatttccgttgaagaagggaaagagaatattcttcatgtttctgaaaatgtgatattcacagatgtgaattctatacttcgctacttggctagagttgcaactacagctgggttatatggctctaatctgatggaacatactgagattgatcactggttggagttcagtgctacaaaattatcttcatgtgattcctttacttctacaattaatgaactcaatcattgcctgtctctgagaacatacttagttggaaactccttgagtttagcagatttatgtgtttgggccaccctaaaaggaaatgctgcctggcaagaacagttgaaacagaagaaagctccagttcatgtaaaacgttggtttggctttcttgaagcccagcaggccttccagtcagtaggtaccaagtgggatgtttcaacaaccaaagctcgagtggcacctgagaaaaagcaagatgttgggaaatttgttgagcttccaggtgcggagatgggaaaggttaccgtcagatttcctccagaggccagtggttacttacacattgggcatgcaaaagctgctcttctgaaccagcactaccaggttaactttaaagggaaactgatcatgagatttgatgacacaaatcctgaaaaagaaaaggaagattttgagaaggttatcttggaagatgttgcaatgttgcatatcaaaccagatcaatttacttatacttcggatcattttgaaactataatgaagtatgcagagaagctaattcaagaagggaaggcttatgtggatgatactcctgctgaacagatgaaagcagaacgtgagcagaggatagaatctaaacatagaaaaaaccctattgagaagaatctacaaatgtgggaagaaatgaaaaaagggagccagtttggtcagtcctgttgtttgcgagcaaaaattgacatgagtagtaacaatggatgcatgagagatccaaccctttatcgctgcaaaattcaaccacatccaagaactggaaataaatacaatgtttatccaacatatgattttgcctgccccatagttgacagcatcgaaggtgttacacatgccctgagaacaacagaataccatgacagagatgagcagttttactggattattgaagctttaggcataagaaaaccatatatttgggaatatagtcggctaaatctcaacaacacagtgctatccaaaagaaaactcacatggtttgtcaatgaaggactagtagatggatgggatgacccaagatttcctacggttcgtggtgtactgagaagagggatgacagttgaaggactgaaacagtttattgctgctcagggctcctcacgttcagtcgtgaacatggagtgggacaaaatctgggcgtttaacaaaaaggttattgacccagtggctccacgatatgttgcattactgaagaaagaagtgatcccagtgaatgtacctgaagctcaggaggagatgaaagaagtagccaaacacccaaagaatcctgaggttggcttgaagcctgtgtggtatagtcccaaagttttcattgaaggtgctgatgcagagactttttcggagggtgagatggttacatttataaattggggcaacctcaacattacaaaaatacacaaaaatgcagatggaaaaatcatatctcttgatgcaaagttgaatttggaaaacaaagactacaagaaaaccactaaggtcacttggcttgcagagactacacatgctcttcctattccagtaatctgtgtcacttatgagcacttgatcacaaagccagtgctaggaaaagacgaggactttaagcagtatgtcaacaagaacagtaagcatgaagagctaatgctaggggatccctgccttaaggatttgaaaaaaggagatattatacaactccagagaagaggattcttcatatgtgatcaaccttatgaacctgttagcccatatagttgcaaggaagccccgtgtgttttgatatacattcctgatgggcacacaaaggaaatgccaacatcagggtcaaaggaaaagaccaaagtagaagccacaaaaaatgagacctctgctccttttaaggaaagaccaacaccttctctgaataataattgtactacatctgaggattccttggtcctttacaatagagtggctgttcaaggagatgtggttcgtgaattaaaagccaagaaagcaccaaaggaagatgtagatgcagctgtaaaacagcttttgtctttgaaagctgaatataaggagaaaactggccaggaatataaacctggaaaccctcctgctgaaataggacagaatatttcttctaattcctcagcaagtattctggaaagtaaatctctgtatgatgaagttgctgcacaaggggaggtggttcgtaagctaaaagctgaaaaatcccctaaggctaaaataaatgaagctgtagaatgcttactgtccctgaaggctcagtataaagaaaaaactgggaaggagtacatacctggtcagcccccattatctcaaagttcggattcaagcccaaccagaaattctgaacctgctggtttagaaacaccagaagcgaaagtactttttgacaaagtagcttctcaaggggaagtagttcggaaacttaaaactgaaaaagcccctaaggatcaagtagatatagctgttcaagaactccttcagctaaaggcacagtacaagtctttgataggagtagagtataagcctgtgtcggccactggagctgaggacaaagataagaagaagaaagaaaaagaaaataaatctgaaaagcagaataagcctcagaaacaaaatgatggccaaaggaaagacccttctaaaaaccaaggaggtgggctctcatcaagtggagcaggagaagggcaggggcctaagaaacagaccaggttgggtcttgaggcaaaaaaagaagaaaatcttgctgattggtattctcaggtcatcacaaagtcagaaatgattgaataccatgacataagtggctgttatattcttcgtccctgggcctatgccatttgggaagccatcaaggacttttttgatgctgagatcaagaaacttggtgttgaaaactgctacttccccatgtttgtgtctcaaagtgcattagagaaagagaagactcatgttgctgactttgccccagaggttgcttgggttacaagatctggcaaaaccgagctggcagaaccaattgccattcgtcctactagtgaaacagtaatgtatcctgcatatgcaaaatgggtacaatcacacagagacctgcccatcaagctcaatcagtggtgcaatgtggtgcgttgggaattcaagcatcctcagcctttcctacgtactcgtgaatttctttggcaggaagggcacagtgcttttgctaccatggaagaggcagcggaagaggtcttgcagatacttgacttatatgctcaggtatatgaagaactcctggcaattcctgttgttaaaggaagaaagacggaaaaggaaaaatttgcaggaggagactatacaactacaatagaagcatttatatctgctagtggaagagctatccagggaggaacatcacatcatttagggcagaatttttccaaaatgtttgaaatcgtttttgaagatccaaagataccaggagagaagcaatttgcctatcaaaactcctggggcctgacaactcgaactattggtgttatgaccatggttcatggggacaacatgggtttagtattaccaccccgtgtagcatgtgttcaggtggtgattattccttgtggcattaccaatgcactttctgaagaagacaaagaagcgctgattgcaaaatgcaatgattatcgaaggcgattactcagtgttaacatccgcgttagagctgatttacgagataattattctccaggttggaaattcaatcactgggagctcaagggagttcccattagacttgaagttgggccacgtgatatgaagagctgtcagtttgtagccgtcagacgagatactggagaaaagctgacagttgctgaaaatgaggcagagactaaacttcaagctattttggaagacatccaggtcacccttttcacaagggcttctgaagaccttaagactcatatggttgtggctaatacaatggaagactttcagaagatactagattctggaaagattgttcagattccattctgtggggaaattgactgtgaggactggatcaaaaagaccactgccagggatcaagatcttgaacctggtgctccatccatgggagctaaaagcctttgcatccccttcaaaccactctgtgaactgcagcctggagccaaatgtgtctgtggcaagaaccctgccaagtactacaccttatttggtcgcagctactgagggatgaacgaaagccccctcttcaactcctctcactttttaaagcattgatattagtatcttctcagatacagaccgttttatgattttttaaaaagtaaaagttctaaaatgaagtcacacaggacaattattcttatgcctaagttaacagtggataaaagacttttctgtaaacaactccagtaataaatatcatgaactaa

SEQ ID NO: 329715 - DNA, 5070 bp, Homo sapiens
agtagctgcggcgcaggggcggagcgaaggctgcggcggcgtcgggtacgcgcacacgttgcatcttcttcctttcgcggggtcctccgtagttctggcacgagccaggcgtactgacaggtggaccagcggactggtggagatggcgacgctctctctgaccgtgaattcaggagaccctccgctaggagctttgctggcagtagaacacgtgaaagacgatgtcagcatttccgttgaagaagggaaagagaatattcttcatgtttctgaaaatgtgatattcacagatgtgaattctatacttcgctacttggctagagttgcaactacagctgggttatatggctctaatctgatggaacatactgagattgatcactggttggagttcagtgctacaaaattatcttcatgtgattcctttacttctacaattaatgaactcaatcattgcctgtctctgagaacatacttagttggaaactccttgagtttagcagatttatgtgtttgggccaccctaaaaggaaatgctgcctggcaagaacagttgaaacagaagaaagctccagttcatgtaaaacgttggtttggctttcttgaagcccagcaggccttccagtcagtaggtaccaagtgggatgtttcaacaaccaaagctcgagtggcacctgagaaaaagcaagatgttgggaaatttgttgagcttccaggtgcggagatgggaaaggttaccgtcagatttcctccagaggccagtggttacttacacattgggcatgcaaaagctgctcttctgaaccagcactaccaggttaactttaaagggaaactgatcatgagatttgatgacacaaatcctgaaaaagaaaaggaagattttgagaaggttatcttggaagatgttgcaatgttgcatatcaaaccagatcaatttacttatacttcggatcattttgaaactataatgaagtatgcagagaagctaattcaagaagggaaggcttatgtggatgatactcctgctgaacagatgaaagcagaacgtgagcagaggatagaatctaaacatagaaaaaaccctattgagaagaatctacaaatgtgggaagaaatgaaaaaagggagccagtttggtcagtcctgttgtttgcgagcaaaaattgacatgagtagtaacaatggatgcatgagagatccaaccctttatcgctgcaaaattcaaccacatccaagaactggaaataaatacaatgtttatccaacatatgattttgcctgccccatagttgacagcatcgaaggtgttacacatgccctgagaacaacagaataccatgacagagatgagcagttttactggattattgaagctttaggcataagaaaaccatatatttgggaatatagtcggctaaatctcaacaacacagtgctatccaaaagaaaactcacatggtttgtcaatgaaggactagtagatggatgggatgacccaagatttcctacggttcgtggtgtactgagaagagggatgacagttgaaggactgaaacagtttattgctgctcagggctcctcacgttcagtcgtgaacatggagtgggacaaaatctgggcgtttaacaaaaaggttattgacccagtggctccacgatatgttgcattactgaagaaagaagtgatcccagtgaatgtacctgaagctcaggaggagatgaaagaagtagccaaacacccaaagaatcctgaggttggcttgaagcctgtgtggtatagtcccaaagttttcattgaaggtgctgatgcagagactttttcggagggtgagatggttacatttataaattggggcaacctcaacattacaaaaatacacaaaaatgcagatggaaaaatcatatctcttgatgcaaagttgaatttggaaaacaaagactacaagaaaaccactaaggtcacttggcttgcagagactacacatgctcttcctattccagtaatctgtgtcacttatgagcacttgatcacaaagccagtgctaggaaaagacgaggactttaagcagtatgtcaacaagaacagtaagcatgaagagctaatgctaggggatccctgccttaaggatttgaaaaaaggagatattatacaactccagagaagaggattcttcatatgtgatcaaccttatgaacctgttagcccatatagttgcaaggaagccccgtgtgttttgatatacattcctgatgggcacacaaaggaaatgccaacatcagggtcaaaggaaaagaccaaagtagaagccacaaaaaatgagacctctgctccttttaaggaaagaccaacaccttctctgaataataattgtactacatctgaggattccttggtcctttacaatagagtggctgttcaaggagatgtggttcgtgaattaaaagccaagaaagcaccaaaggaagatgtagatgcagctgtaaaacagcttttgtctttgaaagctgaatataaggagaaaactggccaggaatataaacctggaaaccctcctgctgaaataggacagaatatttcttctaattcctcagcaagtattctggaaagtaaatctctgtatgatgaagttgctgcacaaggggaggtggttcgtaagctaaaagctgaaaaatcccctaaggctaaaataaatgaagctgtagaatgcttactgtccctgaaggctcagtataaagaaaaaactgggaaggagtacatacctggtcagcccccattatctcaaagttcggattcaagcccaaccagaaattctgaacctgctggtttagaaacaccagaagcgaaagtactttttgacaaagtagcttctcaaggggaagtagttcggaaacttaaaactgaaaaagcccctaaggatcaagtagatatagctgttcaagaactccttcagctaaaggcacagtacaagtctttgataggagtagagtataagcctgtgtcggccactggagctgaggacaaagataagaagaagaaagaaaaagaaaataaatctgaaaagcagaataagcctcagaaacaaaatgatggccaaaggaaagacccttctaaaaaccaaggaggtgggctctcatcaagtggagcaggagaagggcaggggcctaagaaacagaccaggttgggtcttgaggcaaaaaaagaagaaaatcttgctgattggtattctcaggtcatcacaaagtcagaaatgattgaataccatgacataagtggctgttatattcttcgtccctgggcctatgccatttgggaagccatcaaggacttttttgatgctgagatcaagaaacttggtgttgaaaactgctacttccccatgtttgtgtctcaaagtgcattagagaaagagaagactcatgttgctgactttgccccagaggttgcttgggttacaagatctggcaaaaccgagctggcagaaccaattgccattcgtcctactagtgaaacagtaatgtatcctgcatatgcaaaatgggtacaatcacacagagacctgcccatcaagctcaatcagtggtgcaatgtggtgcgttgggaattcaagcatcctcagcctttcctacgtactcgtgaatttctttggcaggaagggcacagtgcttttgctaccatggaagaggcagcggaagaggtcttgcagatacttgacttatatgctcaggtatatgaagaactcctggcaattcctgttgttaaaggaagaaagacggaaaaggaaaaatttgcaggaggagactatacaactacaatagaagcatttatatctgctagtggaagagctatccagggaggaacatcacatcatttagggcagaatttttccaaaatgtttgaaatcgtttttgaagatccaaagataccaggagagaagcaatttgcctatcaaaactcctggggcctgacaactcgaactattggtgttatgaccatggttcatggggacaacatgggtttagtattaccaccccgtgtagcatgtgttcaggtggtgattattccttgtggcattaccaatgcactttctgaagaagacaaagaagcgctgattgcaaaatgcaatgattatcgaaggcgattactcagtgttaacatccgcgttagagctgatttacgagataattattctccaggttggaaattcaatcactgggagctcaagggagttcccattagacttgaagttgggccacgtgatatgaagagctgtcagtttgtagccgtcagacgagatactggagaaaagctgacagttgctgaaaatgaggcagagactaaacttcaagctattttggaagacatccaggtcacccttttcacaagggcttctgaagaccttaagactcatatggttgtggctaatacaatggaagactttcagaagatactagattctggaaagattgttcagattccattctgtggggaaattgactgtgaggactggatcaaaaagaccactgccagggatcaagatcttgaacctggtgctccatccatgggagctaaaagcctttgcatccccttcaaaccactctgtgaactgcagcctggagccaaatgtgtctgtggcaagaaccctgccaagtactacaccttatttggtcgcagctactgagggatgaacgaaagccccctcttcaactcctctcactttttaaagcattgatattagtatcttctcagatacagaccgttttatgattttttaaaaagtaaaagttctaaaatgaagtcacacaggacaattattcttatgcctaagttaacagtggataaaagacttttctgtaaacaactccagtaataaatatcatgaactaaaaaaaaaaaaaaaaaaaaaaaaaaaaaaaggggggggcgaaaaagtttccttgaggggggccaggttagggtaaaccagttttttggtaaagaggggcctaatgaggagtggatataaagaaaggacggcggggttaaaaagttgggcgggaaagtgacggatttgggaaagaccattcgggg

SEQ ID NO: 329716 - DNA, 3073 bp, Homo sapiens
cggccgcgcgacatttttttttgtgtatttttgtaatgttgaggttgccccaatttataaaaatacacaaaaatgcagatggaaaaatcatatctcttgatgcaaagttgaatttggaaaacaaagactacaagaaaaccactaaggtcacttggcttgcagagactacacatgctcttcctattccagtaatctgtgtcacttatgagcacttgatcacaaagccagtgctaggaaaagacgaggactttaagcagtatgtcaacaagaacagtaagcatgaagagctaatgctaggggatccctgccttaaggatttgaaaaaaggagatattatacaactccagagaagaggattcttcatatgtgatcaaccttatgaacctgttagcccatatagttgcaaggaagccccgtgtgttttgatatacattcctgatgggcacacaaaggaaatgccaacatcagggtcaaaggaaaagaccaaagtagaagccacaaaaaatgagacctctgctccttttaaggaaagaccaacaccttctctgaataataattgtactacatctgaggattccttggtcctttacaatagagtggctgttcaaggagatgtggttcgtgaattaaaagccaagaaagcaccaaaggaagatgtagatgcagctgtaaaacagcttttgtctttgaaagctgaatataaggagaaaactggccaggaatataaacctggaaaccctcctgctgaaataggacagaatatttcttctaattcctcagcaagtattctggaaagtaaatctctgtatgatgaagttgctgcacaaggggaggtggttcgtaagctaaaagctgaaaaatcccctaaggctaaaataaatgaagctgtagaatgcttactgtccctgaaggctcagtataaagaaaaaactgggaaggagtacatacctggtcagcccccattatctcaaagttcggattcaagcccaaccagaaattctgaacctgctggtttagaaacaccagaagcgaaagtactttttgacaaagtagcttctcaaggggaagtagttcggaaacttaaaactgaaaaagcccctaaggatcaagtagatatagctgttcaagaactccttcagctaaaggcacagtacaagtctttgataggagtagagtataagcctgtgtcggccactggagctgaggacaaagataagaagaagaaagaaaaagaaaataaatctgaaaagcagaataagcctcagaaacaaaatgatggccaaaggaaagacccttctaaaaaccaaggaggtgggctctcatcaagtggagcaggagaagggcaggggcctaagaaacagaccaggttgggtcttgaggcaaaaaaagaagaaaatcttgctgattggtattctcaggtcatcacaaagtcagaaatgattgaataccatgacataagtggctgttatattcttcgtccctgggcctatgccatttgggaagccatcaaggacttttttgatgctgagatcaagaaacttggtgttgaaaactgctacttccccatgtttgtgtctcaaagtgcattagagaaagagaagactcatgttgctgactttgccccagaggttgcttgggttacaagatctggcaaaaccgagctggcagaaccaattgccattcgtcctactagtgaaacagtaatgtatcctgcatatgcaaaatgggtacaatcacacagagacctgcccatcaagctcaatcagtggtgcaatgtggtgcgttgggaattcaagcatcctcagcctttcctacgtactcgtgaatttctttggcaggaagggcacagtgcttttgctaccatggaagaggcagcggaagaggtcttgcagatacttgacttatatgctcaggtatatgaagaactcctggcaattcctgttgttaaaggaagaaagacggaaaaggaaaaatttgcaggaggagactatacaactacaatagaagcatttatatctgctagtggaagagctatccagggaggaacatcacatcatttagggcagaatttttccaaaatgtttgaaatcgtttttgaagatccaaagataccaggagagaagcaatttgcctatcaaaactcctggggcctgacaactcgaactattggtgttatgaccatggttcatggggacaacatgggtttagtattaccaccccgtgtagcatgtgttcaggtggtgattattccttgtggcattaccaatgcactttctgaagaagacaaagaagcgctgattgcaaaatgcaatgattatcgaaggcgattactcagtgttaacatccgcgttagagctgatttacgagataattattctccaggttggaaattcaatcactgggagctcaagggagttcccattagacttgaagttgggccacgtgatatgaagagctgtcagtttgtagccgtcagacgagatactggagaaaagctgacagttgctgaaaatgaggcagagactaaacttcaagctattttggaagacatccaggtcacccttttcacaagggcttctgaagaccttaagactcatatggttgtggctaatacaatggaagactttcagaagatactagattctggaaagattgttcagattccattctgtggggaaattgactgtgaggactggatcaaaaagaccactgccagggatcaagatcttgaacctggtgctccatccatgggagctaaaagcctttgcatccccttcaaaccactctgtgaactgcagcctggagccaaatgtgtctgtggcaagaaccctgccaagtactacaccttatttggtcgcagctactgagggatgaacgaaagccccctcttcaactcctctcactttttaaagcattgatattagtatcttctcagatacagaccgttttatgattttttaaaaagtaaaagttctaaaatgaagtcacacaggacaattattcttatgcctaagttaacagtggataaaagacttttctgtaaacaactccagtaataaatatcatgaactaa

SEQ ID NO: 329717 - DNA, 2028 bp, Homo sapiens
gctcgcgacccttcctctcctcccacctcgggaacttaaaactgaaaaagcccctaaggatcaagtagatatagctgttcaagaactccttcagctaaaggcacagtacaagtctttgataggagtagagtataagcctgtgtcggccactggagctgaggacaaagataagaagaagaaagaaaaagaaaataaatctgaaaagcagaataagcctcagaaacaaaatgatggccaaaggaaagacccttctaaaaaccaaggaggtgggctctcatcaagtggagcaggagaagggcaggggcctaagaaacagaccaggttgggtcttgaggcaaaaaaagaagaaaatcttgctgattggtattctcaggtcatcacaaagtcagaaatgattgaataccatgacataagtggctgttatattcttcgtccctgggcctatgccatttgggaagccatcaaggacttttttgatgctgagatcaagaaacttggtgttgaaaactgctacttccccatgtttgtgtctcaaagtgcattagagaaagagaagactcatgttgctgactttgccccagaggttgcttgggttacaagatctggcaaaaccgagctggcagaaccaattgccattcgtcctactagtgaaacagtaatgtatcctgcatatgcaaaatgggtacaatcacacagagacctgcccatcaagctcaatcagtggtgcaatgtggtgcgttgggaattcaagcatcctcagcctttcctacgtactcgtgaatttctttggcaggaagggcacagtgcttttgctaccatggaagaggcagcggaagaggtcttgcagatacttgacttatatgctcaggtatatgaagaactcctggcaattcctgttgttaaaggaagaaagacggaaaaggaaaaatttgcaggaggagactatacaactacaatagaagcatttatatctgctagtggaagagctatccagggaggaacatcacatcatttagggcagaatttttccaaaatgtttgaaatcgtttttgaagatccaaagataccaggagagaagcaatttgcctatcaaaactcctggggcctgacaactcgaactattggtgttatgaccatggttcatggggacaacatgggtttagtattaccaccccgtgtagcatgtgttcaggtggtgattattccttgtggcattaccaatgcactttctgaagaagacaaagaagcgctgattgcaaaatgcaatgattatcgaaggcgattactcagtgttaacatccgcgttagagctgatttacgagataattattctccaggttggaaattcaatcactgggagctcaagggagttcccattagacttgaagttgggccacgtgatatgaagagctgtcagtttgtagccgtcagacgagatactggagaaaagctgacagttgctgaaaatgaggcagagactaaacttcaagctattttggaagacatccaggtcacccttttcacaagggcttctgaagaccttaagactcatatggttgtggctaatacaatggaagactttcagaagatactagattctggaaagattgttcagattccattctgtggggaaattgactgtgaggactggatcaaaaagaccactgccagggatcaagatcttgaacctggtgctccatccatgggagctaaaagcctttgcatccccttcaaaccactctgtgaactgcagcctggagccaaatgtgtctgtggcaagaaccctgccaagtactacaccttatttggtcgcagctactgagggatgaacgaaagccccctcttcaactcctctcactttttaaagcattgatattagtatcttctcagatacagaccgttttatgattttttaaaaagtaaaagttctaaaatgaagtcacacaggacaattattcttatgcctaagttaacagtggataaaagacttttctgtaaacaactccagtaataaatatcatgaactaa

SEQ ID NO: 329718 - DNA, 1698 bp, Homo sapiens
ggcacgaggaaaactgctacttccccatgtttcttgatctcaggtcatcacaaagtcagaaatgattgaataccatgacataagtggctgttatattcttcgtccctgggcctatgccatttgggaagccatcaaggacttttttgatgctgagatcaagaaacttggtgttgaaaactgctacttccccatgtttgtgtctcaaagtgcattagagaaagagaagactcatgttgctgactttgccccagaggttgcttgggttacaagatctggcaaaaccgagctggcagaaccaattgccattcgtcctactagtgaaacagtaatgtatcctgcatatgcaaaatgggtacaatcacacagagacctgcccatcaagctcaatcagtggtgcaatgtggtgcgttgggaattcaagcatcctcagcctttcctacgtactcgtgaatttctttggcaggaagggcacagtgcttttgctaccatggaagaggcagcggaagaggtcttgcagatacttgacttatatgctcaggtatatgaagaactcctggcaattcctgttgttaaaggaagaaagacggaaaaggaaaaatttgcaggaggagactatacaactacaatagaagcatttatatctgctagtggaagagctatccagggaggaacatcacatcatttagggcagaatttttccaaaatgtttgaaatcgtttttgaagatccaaagataccaggagagaagcaatttgcctatcaaaactcctggggcctgacaactcgaactattggtgttatgaccatggttcatggggacaacatgggtttagtattaccaccccgtgtagcatgtgttcaggtggtgattattccttgtggcattaccaatgcactttctgaagaagacaaagaagcgctgattgcaaaatgcaatgattatcgaaggcgattactcagtgttaacatccgcgttagagctgatttacgagataattattctccaggttggaaattcaatcactgggagctcaagggagttcccattagacttgaagttgggccacgtgatatgaagagctgtcagtttgtagccgtcagacgagatactggagaaaagctgacagttgctgaaaatgaggcagagactaaacttcaagctattttggaagacatccaggtcacccttttcacaagggcttctgaagaccttaagactcatatggttgtggctaatacaatggaagactttcagaagatactagattctggaaagattgttcagattccattctgtggggaaattgactgtgaggactggatcaaaaagaccactgccagggatcaagatcttgaacctggtgctccatccatgggagctaaaagcctttgcatccccttcaaaccactctgtgaactgcagcctggagccaaatgtgtctgtggcaagaaccctgccaagtactacaccttatttggtcgcagctactgagggatgaacgaaagccccctcttcaactcctctcactttttaaagcattgatattagtatcttctcagatacagaccgttttatgattttttaaaaagtaaaagttctaaaatgaagtcacacaggacaattattcttatgcctaagttaacagtggataaaagacttttctgtaaacaactccagtaataaatatcatgaactaa

SEQ ID NO: 329719 - DNA, 3020 bp, Homo sapiens
  misc_feature (2951)..(2951): n is a, c, g, or t
  misc_feature (2954)..(2954): n is a, c, g, or t
agtagctgcggcgcaggggcggagcgaaggctgcggcggcgtcgggtacgcgcacacgttgcatcttcttcctttcgcggggtcctccgtagttctggcacgagccaggcgtactgacaggtggaccagcggactggtggagatggcgacgctctctctgaccgtgaattcaggagaccctccgctaggagctttgctggcagtagaacacgtgaaagacgatgtcagcatttccgttgaagaagggaaagagaatattcttcatgtttctgaaaatgtgatattcacagatgtgaattctatacttcgctacttggctagagttgcaactacagctgggttatatggctctaatctgatggaacatactgagattgatcactggttggagttcagtgctacaaaattatcttcatgtgattcctttacttctacaattaatgaactcaatcattgcctgtctctgagaacatacttagttggaaactccttgagtttagcagatttatgtgtttgggccaccctaaaaggaaatgctgcctggcaagaacagttgaaacagaagaaagctccagttcatgtaaaacgttggtttggctttcttgaagcccagcaggccttccagtcagtaggtaccaagtgggatgtttcaacaaccaaagctcgagtggcacctgagaaaaagcaagatgttgggaaatttgttgagcttccaggtgcggagatgggaaaggttaccgtcagatttcctccagaggccagtggttacttacacattgggcatgcaaaagctgctcttctgaaccagcactaccaggttaactttaaagggaaactgatcatgagatttgatgacacaaatcctgaaaaagaaaaggaagattttgagaaggttatcttggaagatgttgcaatgttgcatatcaaaccagatcaatttacttatacttcggatcattttgaaactataatgaagtatgcagagaagctaattcaagaagggaaggcttatgtggatgatactcctgctgaacagatgaaagcagaacgtgagcagaggatagaatctaaacatagaaaaaaccctattgagaagaatctacaaatgtgggaagaaatgaaaaaagggagccagtttggtcagtcctgttgtttgcgagcaaaaattgacatgagtagtaacaatggatgcatgagagatccaaccctttatcgctgcaaaattcaaccacatccaagaactggaaataaatacaatgtttatccaacatatgattttgcctgccccatagttgacagcatcgaaggtgttacacatgccctgagaacaacagaataccatgacagagatgagcagttttactggattattgaagctttaggcataagaaaaccatatatttgggaatatagtcggctaaatctcaacaacacagtgctatccaaaagaaaactcacatggtttgtcaatgaaggactagtagatggatgggatgacccaagatttcctacggttcgtggtgtactgagaagagggatgacagttgaaggactgaaacagtttattgctgctcagggctcctcacgttcagtcgtgaacatggagtgggacaaaatctgggcgtttaacaaaaaggttattgacccagtggctccacgatatgttgcattactgaagaaagaagtgatcccagtgaatgtacctgaagctcaggaggagatgaaagaagtagccaaacacccaaagaatcctgaggttggcttgaagcctgtgtggtatagtcccaaagttttcattgaaggtgctgatgcagagactttttcggagggtgagatggttacatttataaattggggcaacctcaacattacaaaaatacacaaaaatgcagatggaaaaatcatatctcttgatgcaaagttgaatttggaaaacaaagactacaagaaaaccactaaggtcacttggcttgcagagactacacatgctcttcctattccagtaatctgtgtcacttatgagcacttgatcacaaagccagtgctaggaaaagacgaggactttaagcagtatgtcaacaagaacagtaagcatgaagagctaatgctaggggatccctgccttaaggatttgaaaaaaggagatattatacaactccagagaagaggattcttcatatgtgatcaaccttatgaacctgttagcccatatagttgcaaggaagccccgtgtgttttgatatacattcctgatgggcacacaaaggaaatgccaacatcagggtcaaaggaaaagaccaaagtagaagccacaaaaaatgagacctctgctccttttaaggaaagaccaacaccttctctgaataataattgtactacatctgaggattccttggtcctttacaatagagtggctgttcaaggagatgtggttcgtgaattaaaagccaagaaagcaccaaaggaagatgtagatgcagctgtaaaacagcttttgtctttgaaagctgaatataaggagaaaactggccaggaatataaacctggaaaccctcctgctgaaataggacagaatatttcttctaattcctcagcaagtattctggaaagtaaatctctgtatgatgaagttgctgcacaaggggaggtggttcgtaagctaaaagctgaaaaatcccctaaggctaaaataaatgaagctgtagaatgcttactgtccctgaaggctcagtataaagaaaaaactgggaaggagtacatacctggtcagcccccattatctcaaagttcggattcaagcccaaccagaaattctgaacctgctggtttagaaacaccagaagcgaaagtactttttgacaaagtagcttctcaaggggaagtagttcggaaacttaaaactgaaaaagcccctaaggatcaagtagatatagctgttcaagaactccttntcncttggtgatcatgtcttttccatgtgtacctgtaatatttttccatcatatctcaaagtaaagtca

SEQ ID NO: 329720 - DNA, 3797 bp, Homo sapiens
cgcccagtccgcgcgtcagtcggtccctagcgcggctgcggggcggagagctgcggctggcccagcgcgcccacctgaggaggcggcggggtccgcaggcgtcgcgggacgaggagatcggagccgggagactcgcgcagcgccatggcccccattggcctcaaagctgttgtcggagagaagattatgcatgatgtgataaagaaggtcaagaagaagggggaatggaaggtgctggtggtggatcagttaagcatgaggatgctgtcctcctgctgcaagatgacagacatcatgaccgagggcataacgattgtggaagatatcaataagcgcagagagccgctccccagcctggaggctgtgtatctcatcactccatccgagaagtccgtccactctctcatcagtgactttaaggacccgccgactgctaaataccgggctgcacacgtcttcttcactgactcttgtccagatgccctgtttaatgaactggtaaaatcccgagcagccaaagtcatcaaaactctgacggaaatcaatattgcatttctcccgtatgaatcccaggtctattccttggactctgctgactctttccaaagcttctacagtccccacaaggctcagatgaagaatcctatactggagcgcctggcagagcagatcgcgaccctttgtgccaccctgaaggagtacccggctgtgcggtatcggggggaatacaaggacaatgccctgctggctcagctaatccaggacaagctcgatgcctataaagctgatgatccaacaatgggggagggcccagacaaggcacgctcccagctcctgatcctggatcgaggctttgaccccagctcccctgtgctccatgaattgacttttcaggctatgagttatgatctgctgcctatcgaaaatgatgtatacaagtatgagaccagcggcatcggggaggcacgggtgaaggaggtgctcctggacgaggacgacgacctgtggatagcactgcgccacaagcacatcgcagaggtgtcccaggaagtcacccggtctctgaaagatttttcttctagcaagagaatgaatactggagagaagaccaccatgcgggacctgtcccagatgctgaagaagatgcctcagtaccagaaagagctcagcaagtactccacccacctgcaccttgctgaggactgtatgaagcattaccaaggcaccgtagacaaactctgccgagtggagcaggacctggccatgggcacagatgctgagggagagaagatcaaggaccctatgcgagccatcgtccccattctgctggatgccaatgtcagcacttatgacaaaatccgcatcatccttctctacatctttttgaagaatggcatcacggaggaaaacctgaacaaactgatccagcacgcccagatacccccggaggatagtgagatcatcaccaacatggctcacctcggcgtgcccatcgtcaccgattccacgctgcgtcgccggagcaagccggagcggaaggaacgcatcagcgagcagacctaccagctctcacggtggactccgattatcaaggacatcatggaggacactattgaggacaaacttgacaccaaacactacccttatatctctacccgttcctctgcctccttcagcaccaccgccgtcagcgcccgctatgggcactggcataagaacaaggccccaggcgagtaccgcagtggcccccgcctcatcattttcatccttgggggtgtgagcctgaatgagatgcgctgcgcctacgaggtgacccaggccaacggaaagtgggaggtgctgataggatccacacacatcctcaccccacagaaactgctggacacactgaagaaactgaataaaacagatgaagaaataagcagttaaaaaaataagtcgcccctccaaaacacgcccccatcccacagcgctccgcagcttcccaccaccgcccgcctcagttcctttgcgtctgttgcctccccagccctgcacgccctggctggcactgttgccgctgcattctcgtgttcagtgatgccctcttcttgtttgaaacaaaagaaaataatgcattgtgttttttaaaaagagtatcttatacatgtatcctaaaaagagaagctcatgtgcaattggtgcacagcaggagaaatttctggactgttaggatgaatggacgccttctccccgttatttaagatttgtgaccttgtacataaccctgggtgacgtgcacattgcttgggtatggaacggtagaaatttgggtgtttttaaaaccttgtttggggttgttcctgtccttgttgagaatcatagagatgtctgtgttcttggagtatttcacactgaggactaatctgctatcttcattccagtccctacccctcagtgcctgctctcatccaaataacctgggaggtgacaatcaggatatctcaggaggtccaaggtggaacagacctctttgcctttcccagcgtctcatacccccggtagtgcagctgtgggtggaggctggggtgtctgcacgaagtcaggccagcgtcctcctccacagcctgtcactgccccctccccagcctgtgtccacagtgctgtgatcccgagggaagtcctccagtctaagtcacagtgccctgacaggtgagaagcaaactcccgctggaagcctccatctctttggaaaaacagttagtctggagcctgtggcccaggcccttctgtccccaggcatcatcccaacagctcattttccctagtccgccttcgttcaagggtcaggaatggaccagaacagatgggttctggaggcccctgaacagagggctatggctgtggagaaggttcttggcccgttggactcacacagaccctgtaccctctcggcaagcatcttcagtcagattatcctcagtttcagatacttcataataccttgtgttgtgtggggtcatacatcatcgtgtttgtaagagaagatggtcattttattctctgtataaaacttagctctaaagcagaaactaaagcagcaaatgcaggaaggctgtctcgccatcctcaagactcagcagctctcattctccagtggtgagcacaccatttgtgctgctgctgttgtcgtgaaatataataacagtggaagtcacaaaaatgtcccctgcccagccccctcgccgcccttgacctcctgcaggccatgtgtgtattacttgtctagtgatgtcctctcaaagtgctgtacgcgagctcggcgccacctccgcctccctttcagagcctgctccccgccctctctgctcgctgcattgtggtgttctcttctcaaggctttgaaatctccccttgcactgagattagtcgtcagatctctccccgtctccctcccaacttatacgacctgatttccttaggacggaaccgcaggcacctgcgccgggcgtcttactcccgctgcttgttctgtcccctccctcggaccaaacagtgctcatgcttcaggaccttgtttgtcgaagatgttggtttccctttctctgttatttatataaaaataatttatcaaaaggatattttaaaaaagctagtctgtcttgaaacttgtttaccttaaaattatcagaatctcagtgtttgaaagtactgaagcacaaacatatatcatctctgtaccattctgtactaaagcacttgagtctaataaataaagaaatcagcaccccttcccggtgtccagggggaaaaaaaaa

SEQ ID NO: 329721 - DNA, 1092 bp, Homo sapiens
cgcccagtccgcgcgtcagtcggtccctagcgcggctgcggggcggagagctgcggctggcccagcgcgcccacctgaggaggcggcggggtccgcaggcgtcgcgggacgaggagatcggagccgggagactcgcgcagcgccatggcccccattggcctcaaagctgttgtcggagagaagattatgcatgatgtgataaagaaggtcaagaagaagggggaatggaaggtgctggtggtggatcagttaagcatgaggatgctgtcctcctgctgcaagatgacagacatcatgaccgagggcataacgattgtggaagatatcaataagcgcagagagccgctccccagcctggaggctgtgtatctcatcactccatccgagaagtccgtccactctctcatcagtgactttaaggacccgccgactgctaaataccgggctgcacacgtcttcttcactgactcttgtccagatgccctgtttaatgaactggtaaaatcccgagcagccaaagtcatcaaaactctgacggaaatcaatattgcatttctcccgtatgaatcccaggtctattccttggactctgctgactctttccaaagcttctacagtccccacaaggctcagatgaagaatcctatactggagcgcctggcagagcagatcgcgaccctttgtgccaccctgaaggagtacccggctgtgcggtatcgggggtaaggcagtgcaccagtctgctggagtggcctcccgtgtgtcccccaagtgaggagctggcctggactcctcctccggccttaaggttcctctgacagttgtctcaagaagatcaggatttgagcatctcttacttcaaattattcttccagtggttttgttatcttctcaatgttatagtgaaatataataatacatgcagaaaaaagcataaatcaactattgaataacgaaaatgtgaacctctatgtaactgcaactcaggctgcctaccgtttttaatttctttctaatctttaaaaacaaatactatctttactaaagatgtttcagagtaagataaaatacaaagagagtaattctccaaag

SEQ ID NO: 329722 - DNA, 741 bp, Homo sapiens
cgcccagtccgcgcgtcagtcggtccctagcgcggctgcggggcggagagctgcggctggcccagcgcgcccacctgaggaggcggcggggtccgcaggcgtcgcgggacgaggagatcggagccgggagactcgcgcagcgccatggcccccattggcctcaaagctgttgtcggagagagtaagtggagccgggatccttccagcaggcggggactgcggctcccgaggagccccgcgcggcccctgccggcagcgcccaggcctccgagcgggctgccggccctgcgccccgggcctgaggctcctggtccgtggggtcccgttattcaggcgccgcccgcgcgagaggaaggctttgcacctgaatactgcacgataacatcaacctgcagtgctacagcaacgcggcaggacagcaacagcgcacaagaggcacaagacaccaggcggaaggcgaacgccacagtgccgaagcgcgccggcgcaaagagtgcgtggcagtgataccaaggccataagcagcaccccagtggaccggttaagcgacgcacagacagctgtgacctcaccgatcggttatgggccttgccaccgcgtgtgtctatccgggggactatagtcctgggaacgacagagcacacgcacggagtgactaacgaggcccgaacgaggctgtctgcgaaccagtccagatgagcacacgctcagtgcccgcactccgtaagtgagcggggatga

SEQ ID NO: 329723 - DNA, 417 bp, Homo sapiens
gactcttaacataaaatgctcaaagcaggaagttaaacatgccagacacatcatcagcaccatgtggagccaagcatttgctaaagccgcagcttaaatttgggtgtttttaaaaccttgtttggggttgttcctgtccttgttgagaatcatagagatgtctgtgttcttggagtatttcacactgaggactaatctgctatcttcattccagtccctacccctcagtgcctgctctcatccaaataacctgggaggtgacaatcaggatatctcaggaggtccaaggtggatcgtgaacaacctatattttcgccattttacaatggagagttgtgacaagtacaggttatcaagtttgcacttaactatgccaaaaaaagtttgaagcgctctattctcagacatgctgtatta

SEQ ID NO: 329724 - DNA, 3733 bp, Homo sapiens
cgcccagtccgcgcgtcagtcggtccctagcgcggctgcggggcggagagctgcggctggcccagcgcgcccacctgaggaggcggcggggtccgcaggcgtcgcgggacgaggagatcggagccgggagactcgcgcagcgccatggcccccattggcctcaaagctgttgtcggagagaagattatgcatgatgtgataaagaaggtcaagaagaagggggaatggaaggtgctggtggtggatcagttaagcatgaggatgctgtcctcctgctgcaagatgacagacatcatgaccgagggcataacgattgtggaagatatcaataagcgcagagagccgctccccagcctggaggctgtgtatctcatcactccatccgagaagtccgtccactctctcatcagtgactttaaggacccgccgactgctaaataccgggctgcacacgtcttcttcactgactcttgtccagatgccctgtttaatgaactggtaaaatcccgagcagccaaagtcatcaaaactctgacggaaatcaatattgcatttctcccgtatgaatcccaggtctattccttggactctgctgactctttccaaagcttctacagtccccacaaggctcagatgaagaatcctatactggagcgcctggcagagcagatcgcgaccctttgtgccaccctgaaggagtacccggctgtgcggtatcggggggaatacaaggacaatgccctgctggctcagctaatccaggacaagctcgatgcctataaagctgatgatccaacaatgggggagggcccagacaaggcacgctcccagctcctgatcctggatcgaggctttgaccccagctcccctgtgctccatgaattgacttttcaggctatgagttatgatctgctgcctatcgaaaatgatgtatacaagtatgagaccagcggcatcggggaggcacgggtgaaggaggtgctcctggacgaggacgacgacctgtggatagcactgcgccacaagcacatcgcagaggtgtcccaggaagtcacccggtctctgaaagatttttcttctagcaagagaatgaatactggagagaagaccaccatgcgggacctgtcccagatgctgaagaagatgcctcagtaccagaaagagctcagcaagtactccacccacctgcaccttgctgaggactgtatgaagcattaccaaggcaccgtagacaaactctgccgagtggagcaggacctggccatgggcacagatgctgagggagagaagatcaaggaccctatgcgagccatcgtccccattctgctggatgccaatgtcagcacttatgacaaaatccgcatcatccttctctacatctttttgaagaatggcatcacggaggaaaacctgaacaaactgatccagcacgcccagatacccccggaggatagtgagatcatcaccaacatggctcacctcggcgtgcccatcgtcaccgattccacgctgcgtcgccggagcaagccggagcggaaggaacgcatcagcgagcagacctaccagctctcacggtggactccgattatcaaggacatcatggaggacactattgaggacaaacttgacaccaaacactacccttatatctctacccgttcctctgcctccttcagcaccaccgccgtcagcgcccgctatgggcactggcataagaacaaggccccaggcgagtaccgcagtggcccccgcctcatcattttcatccttgggggtgtgagcctgaatgagatgcgctgcgcctacgaggtgacccaggccaacggaaagtgggaggtgctgataggatccacacacatcctcaccccacagaaactgctggacacactgaagaaactgaataaaacagatgaagaaataagcagttaaaaaaataagtcgcccctccaaaacacgcccccatcccacagcgctccgcagcttcccaccaccgcccgcctcagttcctttgcgtctgttgcctccccagccctgcacgccctggctggcactgttgccgctgcattctcgtgttcagtgatgccctcttcttgtttgaaacaaaagaaaataatgcattgtgttttttaaaaagagtatcttatacatgtatcctaaaaagagaagctcatgtgcaattggtgcacagcaggagaaatttctggactgttaggatgaatggacgccttctccccgttatttaagatttgtgaccttgtacataaccctgggtgacgtgcacattgcttgggtatggaacggtagaaatttgggtgtttttaaaaccttgtttggggttgttcctgtccttgttgagaatcatagagatgtctgtgttcttggagtatttcacactgaggactaatctgctatcttcattccagtccctacccctcagtgcctgctctcatccaaataacctgggaggtgacaatcaggatatctcaggaggtccaaggtggaacagacctctttgcctttcccagcgtctcatacccccggtagtgcagctgtgggtggaggctggggtgtctgcacgaagtcaggccagcgtcctcctccacagcctgtcactgccccctccccagcctgtgtccacagtgctgtgatcccgagggaagtcctccagtctaagtcacagtgccctgacaggtgagaagcaaactcccgctggaagcctccatctctttggaaaaacagttagtctggagcctgtggcccaggcccttctgtccccaggcatcatcccaacagctcattttccctagtccgccttcgttcaagggtcaggaatggaccagaacagatgggttctggaggcccctgaacagagggctatggctgtggagaaggttcttggcccgttggactcacacagaccctgtaccctctcggcaagcatcttcagtcagattatcctcagtttcagatacttcataataccttgtgttgtgtggggtcatacatcatcgtgtttgtaagagaagatggtcattttattctctgtataaaacttagctctaaagcagaaactaaagcagcaaatgcaggaaggctgtctcgccatcctcaagactcagcagctctcattctccagtggtgagcacaccatttgtgctgctgctgttgtcgtgaaatataataacagtggaagtcacaaaaatgtcccctgcccagccccctcgccgcccttgacctcctgcaggccatgtgtgtattacttgtctagtgatgtccctctctgctcgctgcattgtggtgttctcttctcaaggctttgaaatctccccttgcactgagattagtcgtcagatctctccccgtctccctcccaacttatacgacctgatttccttaggacggaaccgcaggcacctgcgccgggcgtcttactcccgctgcttgttctgtcccctccctcggaccaaacagtgctcatgcttcaggaccttgtttgtcgaagatgttggtttccctttctctgttatttatataaaaataatttatcaaaaggatattttaaaaaagctagtctgtcttgaaacttgtttaccttaaaattatcagaatctcagtgtttgaaagtactgaagcacaaacatatatcatctctgtaccattctgtactaaagcacttgagtctaataaataaagaaatcagcaccccttcccggtgtccagggggaaaaaaaaa

SEQ ID NO: 329725 - DNA, 2021 bp, Homo sapiens
cgcccagtccgcgcgtcagtcggtccctagcgcggctgcggggcggagagctgcggctggcccagcgcgcccacctgaggaggcggcggggtccgcaggcgtcgcgggacgaggagatcggagccgggagactcgcgcagcgccatggcccccattggcctcaaagctgttgtcggagagaagattatgcatgatgtgataaagaaggtcaagaagaagggggaatggaaggtgctggtggtggatcagttaagcatgaggatgctgtcctcctgctgcaagatgacagacatcatgaccgagggcataacgattgtggaagatatcaataagcgcagagagccgctccccagcctggaggctgtgtatctcatcactccatccgagaagtccgtccactctctcatcagtgactttaaggacccgccgactgctaaataccgggctgcacacgtcttcttcactgactcttgtccagatgccctgtttaatgaactggtaaaatcccgagcagccaaagtcatcaaaactctgacggaaatcaatattgcatttctcccgtatgaatcccaggtctattccttggactctgctgactctttccaaagcttctacagtccccacaaggctcagatgaagaatcctatactggagcgcctggcagagcagatcgcgaccctttgtgccaccctgaaggagtacccggctgtgcggtatcggggggaatacaaggacaatgccctgctggctcagctaatccaggacaagctcgatgcctataaagctgatgatccaacaatgggggagggcccagacaaggcacgctcccagctcctgatcctggatcgaggctttgaccccagctcccctgtgctccatgaattgacttttcaggctatgagttatgatctgctgcctatcgaaaatgatgtatacaagtatgagaccagcggcatcggggaggcacgggtgaaggaggtgctcctggacgaggacgacgacctgtggatagcactgcgccacaagcacatcgcagaggtgtcccaggaagtcacccggtctctgaaagatttttcttctagcaagagaatgaatactggagagaagaccaccatgcgggacctgtcccagatgctgaagaagatgcctcagtaccagaaagagctcagcaagtactccacccacctgcaccttgctgaggactgtatgaagcattaccaaggcaccgtagacaaactctgccgagtggagcaggacctggccatgggcacagatgctgagggagagaagatcaaggaccctatgcgagccatcgtccccattctgctggatgccaatgtcagcacttatgacaaaatccgcatcatccttctctacatctttttgaagaatggcatcacggaggaaaacctgaacaaactgatccagcacgcccagatacccccggaggatagtgagatcatcaccaacatggctcacctcggcgtgcccatcgtcaccgattccacgctgcgtcgccggagcaagccggagcggaaggaacgcatcagcgagcagacctaccagctctcacggtggactccgattatcaaggacatcatggaggacactattgaggacaaacttgacaccaaacactacccttatatctctacccgttcctctgcctccttcagcaccaccgccgtcagcgcccgctatgggcactggcataagaacaaggccccaggcgagtaccgcagtggcccccgcctcatcattttcatccttgggggtgtgagcctgaatgagatgcgctgcgcctacgaggtgacccaggccaacggaaagtgggaggtgctgataggttctactcacattcttactcccaccaaatttctcatggacctgagacaccccgacttcagggagtcctctagggtatcttttgaggatcaggctccaacaatggagtgagagccaaagaaacaaagtaaaagcagcttattacagaaaagaaactcttccactctgaagggctt

SEQ ID NO: 329726 - DNA, 1059 bp, Homo sapiens
gttgggatgatgcctggggacagaagggcctgggccacaggctccagactaactgctcattttccctagtccgccttcgttcaagggtcaggaatggaccagaacagatgggttctggaggcccctgaacagagggctatggctgtggagaaggttcttggcccgttggactcacacagaccctgtaccctctcggcaagcatcttcagtcagattatcctcagtttcagatacttcataataccttgtgttgtgtggggtcatacatcatcgtgtttgtaagagaagatggtcattttattctctgtataaaacttagctctaaagcagaaactaaagcagcaaatgcaggaaggctgtctcgccatcctcaagactcagcagctctcattctccagtggtgagcacaccatttgtgctgctgctgttgtcgtgaaatataataacagtggaagtcacaaaaatgtcccctgcccagccccctcgccgcccttgacctcctgcaggccatgtgtgtattacttgtctagtgatgtcctctcaaagtgctgtacgcgagctcggcgccacctccgcctccctttcagagcctgctccccgccctctctgctcgctgcattgtggtgttctcttctcaaggctttgaaatctccccttgcactgagattagtcgtcagatctctccccgtctccctcccaacttatacgacctgatttccttaggacggaaccgcaggcacctgcgccgggcgtcttactcccgctgcttgttctgtcccctccctcggaccaaacagtgctcatgcttcaggaccttgtttgtcgaagatgttggtttccctttctctgttatttatataaaaataatttatcaaaaggatattttaaaaaagctagtctgtcttgaaacttgtttaccttaaaattatcagaatctcagtgtttgaaagtactgaagcacaaacatatatcatctctgtaccattctgtactaaagcacttgagtctaataaataaagaaatcagcaccccttcccggtgtccagggggaaaaaaaaa

SEQ ID NO: 329727 - DNA, 1099 bp, Homo sapiens
cgcccagtccgcgcgtcagtcggtccctagcgcggctgcggggcggagagctgcggctggcccagcgcgcccacctgaggaggcggcggggtccgcaggcgtcgcgggacgaggagatcggagccgggagactcgcgcagcgccatggcccccattggcctcaaagctgttgtcggagagaagattatgcatgatgtgataaagaaggtcaagaagaagggggaatggaaggtgctggtggtggatcagttaagcatgaggatgctgtcctcctgctgcaagatgacagacatcatgaccgagggcataacgattgtggaagatatcaataagcgcagagagccgctccccagcctggaggctgtgtatctcatcactccatccgagaagtccgtccactctctcatcagtgactttaaggacccgccgactgctaaataccgggctgcacacgtcttcttcactgactcttgtccagatgccctgtttaatgaactggtaaaatcccgagcagccaaagtcatcaaaactctgacggaaatcaatattgcatttctcccgtatgaatcccaggtctattccttggactctgctgactctttccaaagcttctacagtccccacaaggctcagatgaagaatcctatactggagcgcctggcagagcagatcgcgaccctttgtgccaccctgaaggagtacccggctgtgcggtatcggggggaatacaaggacaatgccctgctggctcagctaatccaggacaagctcgatgcctataaagctgatgatccaacaatgggggagggcccagacaaggcacgctcccagctcctgatcctggatcgaggctttgaccccagctcccctgtgctccatgaattgacttttcaggctatgagttatgatctgctgcctatcgaaaatgatgtatacaagtatgagaccagcggcatcggggaggcacgggtgaaggaggtgctcctggacgaggacgacgacctgtggatagcactgcgccacaagcacatcgcagaggtgtcccagaaagtcagacagtctctgtataatttttcgtatcactatagagtgtagttcg

SEQ ID NO: 329728 - DNA, 166 bp, Homo sapiens
gtaagagccccctgcccccttctccagcgaggcgcctctacccagctgctattgatgatgcgttcactctgggcacctcgcgggggctcatcactgtgtgaattcgttttcttggcagagtcaccaacatgctaacccgtaatgataaatcccttctgttctctga

SEQ ID NO: 329729 - DNA, 370 bp, Homo sapiens
tagagatgaggtttcaccatgttggccaggctggtcttgaactcctgacatcaagtgatgtgcccacctcagcctcccaaagtgctgggattacaggcatgagccaccatgcccagcccagatttcagattctaacatcttgggcatgttgagaccatggaattcactcccaaggaacgtggtaaccttaaggaatgagtgaatgattccccccggtcccccactgtagatatttatctgcaacagtctgaaggtagcctgtctatattgcttctggttttatggtcacccatcatgttttcttattcactgtgggttgttttgttgtctagttgtggaagatatcaataagcgcagagagccgctcccc

SEQ ID NO: 329730 - DNA, 3923 bp, Homo sapiens
cgcccagtccgcgcgtcagtcggtccctagcgcggctgcggggcggagagctgcggctggcccagcgcgcccacctgaggaggcggcggggtccgcaggcgtcgcgggacgaggagatcggagccgggagactcgcgcagcgccatggcccccattggcctcaaagctgttgtcggagagaagattatgcatgatgtgataaagaaggtcaagaagaagggggaatggaaggtgctggtggtggatcagttaagcatgaggatgctgtcctcctgctgcaagatgacagacatcatgaccgagggcataacgattgtggaagatatcaataagcgcagagagccgctccccagcctggaggctgtgtatctcatcactccatccgagaagtccgtccactctctcatcagtgactttaaggacccgccgactgctaaataccgggctgcacacgtcttcttcactgactcttgtccagatgccctgtttaatgaactggtaaaatcccgagcagccaaagtcatcaaaactctgacggaaatcaatattgcatttctcccgtatgaatcccaggtctattccttggactctgctgactctttccaaagcttctacagtccccacaaggctcagatgaagaatcctatactggagcgcctggcagagcagatcgcgaccctttgtgccaccctgaaggagtacccggctgtgcggtatcggggggaatacaaggacaatgccctgctggctcagctaatccaggacaagctcgatgcctataaagctgatgatccaacaatgggggagggcccagacaaggcacgctcccagctcctgatcctggatcgaggctttgaccccagctcccctgtgctccatgaattgacttttcaggctatgagttatgatctgctgcctatcgaaaatgatgtatacaagtatgagaccagcggcatcggggaggcacgggtgaaggaggtgctcctggacgaggacgacgacctgtggatagcactgcgccacaagcacatcgcagaggtgtcccaggaagtcacccggtctctgaaagatttttcttctagcaagagaatgaatactggagagaagaccaccatgcgggacctgtcccagatgctgaagaagatgcctcagtaccagaaagagctcagcaagtactccacccacctgcaccttgctgaggactgtatgaagcattaccaaggcaccgtagacaaactctgccgagtggagcaggacctggccatgggcacagatgctgagggagagaagatcaaggaccctatgcgagccatcgtccccattctgctggatgccaatgtcagcacttatgacaaaatccgcatcatccttctctacatctttttgaagaatggcatcacggaggaaaacctgaacaaactgatccagcacgcccagatacccccggaggatagtgagatcatcaccaacatggctcacctcggcgtgcccatcgtcaccgattccacgctgcgtcgccggagcaagccggagcggaaggaacgcatcagcgagcagacctaccagctctcacggtggactccgattatcaaggacatcatggaggacactattgaggacaaacttgacaccaaacactacccttatatctctacccgttcctctgcctccttcagcaccaccgccgtcagcgcccgctatgggcactggcataagaacaaggccccaggcgagtaccgcagtggcccccgcctcatcattttcatccttgggggtgtgagcctgaatgagatgcgctgcgcctacgaggtgacccaggccaacggaaagtgggaggtgctgataggttctactcacattcttactcccaccaaatttctcatggacctgagacaccccgacttcagggagtcctctagggtatcttttgaggatcaggctccaacaatggagtgagagccaaagaaacaaagatccacacacatcctcaccccacagaaactgctggacacactgaagaaactgaataaaacagatgaagaaataagcagttaaaaaaataagtcgcccctccaaaacacgcccccatcccacagcgctccgcagcttcccaccaccgcccgcctcagttcctttgcgtctgttgcctccccagccctgcacgccctggctggcactgttgccgctgcattctcgtgttcagtgatgccctcttcttgtttgaaacaaaagaaaataatgcattgtgttttttaaaaagagtatcttatacatgtatcctaaaaagagaagctcatgtgcaattggtgcacagcaggagaaatttctggactgttaggatgaatggacgccttctccccgttatttaagatttgtgaccttgtacataaccctgggtgacgtgcacattgcttgggtatggaacggtagaaatttgggtgtttttaaaaccttgtttggggttgttcctgtccttgttgagaatcatagagatgtctgtgttcttggagtatttcacactgaggactaatctgctatcttcattccagtccctacccctcagtgcctgctctcatccaaataacctgggaggtgacaatcaggatatctcaggaggtccaaggtggaacagacctctttgcctttcccagcgtctcatacccccggtagtgcagctgtgggtggaggctggggtgtctgcacgaagtcaggccagcgtcctcctccacagcctgtcactgccccctccccagcctgtgtccacagtgctgtgatcccgagggaagtcctccagtctaagtcacagtgccctgacaggtgagaagcaaactcccgctggaagcctccatctctttggaaaaacagttagtctggagcctgtggcccaggcccttctgtccccaggcatcatcccaacagctcattttccctagtccgccttcgttcaagggtcaggaatggaccagaacagatgggttctggaggcccctgaacagagggctatggctgtggagaaggttcttggcccgttggactcacacagaccctgtaccctctcggcaagcatcttcagtcagattatcctcagtttcagatacttcataataccttgtgttgtgtggggtcatacatcatcgtgtttgtaagagaagatggtcattttattctctgtataaaacttagctctaaagcagaaactaaagcagcaaatgcaggaaggctgtctcgccatcctcaagactcagcagctctcattctccagtggtgagcacaccatttgtgctgctgctgttgtcgtgaaatataataacagtggaagtcacaaaaatgtcccctgcccagccccctcgccgcccttgacctcctgcaggccatgtgtgtattacttgtctagtgatgtcctctcaaagtgctgtacgcgagctcggcgccacctccgcctccctttcagagcctgctccccgccctctctgctcgctgcattgtggtgttctcttctcaaggctttgaaatctccccttgcactgagattagtcgtcagatctctccccgtctccctcccaacttatacgacctgatttccttaggacggaaccgcaggcacctgcgccgggcgtcttactcccgctgcttgttctgtcccctccctcggaccaaacagtgctcatgcttcaggaccttgtttgtcgaagatgttggtttccctttctctgttatttatataaaaataatttatcaaaaggatattttaaaaaagctagtctgtcttgaaacttgtttaccttaaaattatcagaatctcagtgtttgaaagtactgaagcacaaacatatatcatctctgtaccattctgtactaaagcacttgagtctaataaataaagaaatcagcaccccttcccggtgtccagggggaaaaaaaaa

SEQ ID NO: 329731 - DNA, 463 bp, Homo sapiens
  misc_feature (11)..(11): n is a, c, g, or t
  misc_feature (14)..(14): n is a, c, g, or t
  misc_feature (17)..(17): n is a, c, g, or t
  misc_feature (21)..(21): n is a, c, g, or t
  misc_feature (420)..(420): n is a, c, g, or t
gagccactcgnagnggngtcnaggaagtcacccggtctctgaaagatttttcttctagcaagagaatgaatactggagagaagaccaccatgcgggacctgtcccagatgctgaagaagatgcctcagtaccagaaagagctcagcaagtactccacccacctgcaccttgctgaggactgtatgaagcattaccaaggcaccgtagacaaactctgccgagtggagcaggacctggccatgggcacagatgctgagggagagaagatcaaggaccctatgcgagccatcgtccccattctgctggatgccaatgtcagcacttatgacaaaatccgcatcatccttctctacatctttttgaagaatggcatcacggagggaaacctgaacaatccctttcctccgacagtcccacgtntgcttccaggaatcaaagagcatgccagtggcagctatctgtg

SEQ ID NO: 329732 - DNA, 3625 bp, Homo sapiens
cgcccagtccgcgcgtcagtcggtccctagcgcggctgcggggcggagagctgcggctggcccagcgcgcccacctgaggaggcggcggggtccgcaggcgtcgcgggacgaggagatcggagccgggagactcgcgcagcgccatggcccccattggcctcaaagctgttgtcggagagaagattatgcatgatgtgataaagaaggtcaagaagaagggggaatggaaggtgctggtggtggatcagttaagcatgaggatgctgtcctcctgctgcaagatgacagacatcatgaccgagggcataacgattgtggaagatatcaataagcgcagagagccgctccccagcctggaggctgtgtatctcatcactccatccgagaagtccgtccactctctcatcagtgactttaaggacccgccgactgctaaataccgggctgcacacgtcttcttcactgactcttgtccagatgccctgtttaatgaactggtaaaatcccgagcagccaaagtcatcaaaactctgacggaaatcaatattgcatttctcccgtatgaatcccaggtctattccttggactctgctgactctttccaaagcttctacagtccccacaaggctcagatgaagaatcctatactggagcgcctggcagagcagatcgcgaccctttgtgccaccctgaaggagtacccggctgtgcggtatcggggggaatacaaggacaatgccctgctggctcagctaatccaggacaagctcgatgcctataaagctgatgatccaacaatgggggagggcccagacaaggcacgctcccagctcctgatcctggatcgaggctttgaccccagctcccctgtgctccatgaattgacttttcaggctatgagttatgatctgctgcctatcgaaaatgatgtatacaagtatgagaccagcggcatcggggaggcacgggtgaaggaggtgctcctggacgaggacgacgacctgtggatagcactgcgccacaagcacatcgcagaggtgtcccaggaagtcacccggtctctgaaagatttttcttctagcaagagaatgaatactggagagaagaccaccatgcgggacctgtcccagatgctgaagaagatgcctcagtaccagaaagagctcagcaagtactccacccacctgcaccttgctgaggactgtatgaagcattaccaaggcaccgtagacaaactctgccgagtggagcaggacctggccatgggcacagatgctgagggagagaagatcaaggaccctatgcgagccatcgtccccattctgctggatgccaatgtcagcacttatgacaaaatccgcatcatccttctctacatctttttgaagaatggcatcacggaggaaaacctgaacaaactgatccagcacgcccagatacccccggaggatagtgagatcatcaccaacatggctcacctcggcgtgcccatcgtcaccgattccacgctgcgtcgccggagcaagccggagcggaaggaacgcatcagcgagcagacctaccagctctcacggtggactccgattatcaaggacatcatggaggacactattgaggacaaacttgacaccaaacactacccttatatctctacccgttcctctgcctccttcagcaccaccgccgtcagcgcccgctatgggcactggcataagaacaaggccccaggcgagtaccgcagtggcccccgcctcatcattttcatccttgggggtgtgagcctgaatgagatgcgctgcgcctacgaggtgacccaggccaacggaaagtgggaggtgctgataggatccacacacatcctcaccccacagaaactgctggacacactgaagaaactgaataaaacagatgaagaaataagcagttaaaaaaataagtcgcccctccaaaacacgcccccatcccacagcgctccgcagcttcccaccaccgcccgcctcagttcctttgcgtctgttgcctccccagccctgcacgccctggctggcactgttgccgctgcattctcgtgttcagtgatgccctcttcttgtttgaaacaaaagaaaataatgcattgtgttttttaaaaagagtatcttatacatgtatcctaaaaagagaagctcatgtgcaattggtgcacagcaggagaaatttctggactgttaggatgaatggacgccttctccccgttatttaagatttgtgaccttgtacataaccctgggtgacgtgcacattgcttgggtatggaacggtagaaatttgggtgtttttaaaaccttgtttggggttgttcctgtccttgttgagaatcatagagatgtctgtgttcttggagtatttcacactgaggactaatctgctatcttcattccagtccctacccctcagtgcctgctctcatccaaataacctgggaggtgacaatcaggatatctcaggaggtccaaggtggaacagacctctttgcctttcccagcgtctcatacccccggtagtgcagctgtgggtggaggctggggtgtctgcacgaagtcaggccagcgtcctcctccacagcctgtcactgccccctccccagcctgtgtccacagtgctgtgatcccgagggaagtcctccagtctaagtcacagtgccctgacaggtgagaagcaaactcccgctggaagcctccatctctttggaaaaacagttagtctggagcctgtggcccaggcccttctgtccccaggcatcatcccaacagctcattttccctagtccgccttcgttcaagggtcaggaatggaccagaacagatgggttctggaggcccctgaacagagggctatggctgtggagaaggttcttggcccgttggactcacacagaccctgtaccctctcggcaagcatcttcagtcagattatcctcagtttcagatacttcataataccttgtgttgtgtggggtcatacatcatcgtgtttgtaagagaagatggtcattttattctctgtataaaacttagctctaaagcagaaactaaagcagcaaatgcaggaaggctgtctcgccatcctcaagactcagcagctctcattctccagtggtgagcacaccatttgtgctgctgctgttgtcgtgaaatataataacagtggaagtcacaaaaatgtcccctgcccagccccctcgccgcccttgacctcctgcaggccatgtgtgtattacttgtctagtgatgtcctctcaaagtgctgtacgcgagctcggcgccacctccgcctccctttcagagcctgctccccgccctctctgctcgctgcattgtggtgttctcttctcaaggctttgaaatctccccttgcactgagattagtcgtcagatctctccccgtctccctcccaacttatacgacctgatttccttaggacggaaccgcaggcacctgcgccgggcgtcttactcccgctgcttgttctgtcccctccctcggaccaaacagtgctcatgcttcaggaccttgtttgtcgaagatgttggtttccctttctctgttatttatataaaaataatttatcaaaaggatatttta

SEQ ID NO: 329733 - DNA, 3642 bp, Homo sapiens
cgcccagtccgcgcgtcagtcggtccctagcgcggctgcggggcggagagctgcggctggcccagcgcgcccacctgaggaggcggcggggtccgcaggcgtcgcgggacgaggagatcggagccgggagactcgcgcagcgccatggcccccattggcctcaaagctgttgtcggagagaagattatgcatgatgtgataaagaaggtcaagaagaagggggaatggaaggtgctggtggtggatcagttaagcatgaggatgctgtcctcctgctgcaagatgacagacatcatgaccgagggcataacgattgtggaagatatcaataagcgcagagagccgctccccagcctggaggctgtgtatctcatcactccatccgagaagtccgtccactctctcatcagtgactttaaggacccgccgactgctaaataccgggctgcacacgtcttcttcactgactcttgtccagatgccctgtttaatgaactggtaaaatcccgagcagccaaagtcatcaaaactctgacggaaatcaatattgcatttctcccgtatgaatcccaggtctattccttggactctgctgactctttccaaagcttctacagtccccacaaggctcagatgaagaatcctatactggagcgcctggcagagcagatcgcgaccctttgtgccaccctgaaggagtacccggctgtgcggtatcggggggaatacaaggacaatgccctgctggctcagctaatccaggacaagctcgatgcctataaagctgatgatccaacaatgggggagggcccagacaaggcacgctcccagctcctgatcctggatcgaggctttgaccccagctcccctgtgctccatgaattgacttttcaggctatgagttatgatctgctgcctatcgaaaatgatgtatacaagtatgagaccagcggcatcggggaggcacgggtgaaggaggtgctcctggacgaggacgacgacctgtggatagcactgcgccacaagcacatcgcagaggtgtcccaggaagtcacccggtctctgaaagatttttcttctagcaagagaatgaatactggagagaagaccaccatgcgggacctgtcccagatgctgaagaagatgcctcagtaccagaaagagctcagcaagtactccacccacctgcaccttgctgaggactgtatgaagcattaccaaggcaccgtagacaaactctgccgagtggagcaggacctggccatgggcacagatgctgagggagagaagatcaaggaccctatgcgagccatcgtccccattctgctggatgccaatgtcagcacttatgacaaaatccgcatcatccttctctacatctttttgaagaatggcatcacggaggaaaacctgaacaaactgatccagcacgcccagatacccccggaggatagtgagatcatcaccaacatggctcacctcggcgtgcccatcgtcaccgattccacgctgcgtcgccggagcaagccggagcggaaggaacgcatcagcgagcagacctaccagctctcacggtggactccgattatcaaggacatcatggaggacactattgaggacaaacttgacaccaaacactacccttatatctctacccgttcctctgcctccttcagcaccaccgccgtcaggatccacacacatcctcaccccacagaaactgctggacacactgaagaaactgaataaaacagatgaagaaataagcagttaaaaaaataagtcgcccctccaaaacacgcccccatcccacagcgctccgcagcttcccaccaccgcccgcctcagttcctttgcgtctgttgcctccccagccctgcacgccctggctggcactgttgccgctgcattctcgtgttcagtgatgccctcttcttgtttgaaacaaaagaaaataatgcattgtgttttttaaaaagagtatcttatacatgtatcctaaaaagagaagctcatgtgcaattggtgcacagcaggagaaatttctggactgttaggatgaatggacgccttctccccgttatttaagatttgtgaccttgtacataaccctgggtgacgtgcacattgcttgggtatggaacggtagaaatttgggtgtttttaaaaccttgtttggggttgttcctgtccttgttgagaatcatagagatgtctgtgttcttggagtatttcacactgaggactaatctgctatcttcattccagtccctacccctcagtgcctgctctcatccaaataacctgggaggtgacaatcaggatatctcaggaggtccaaggtggaacagacctctttgcctttcccagcgtctcatacccccggtagtgcagctgtgggtggaggctggggtgtctgcacgaagtcaggccagcgtcctcctccacagcctgtcactgccccctccccagcctgtgtccacagtgctgtgatcccgagggaagtcctccagtctaagtcacagtgccctgacaggtgagaagcaaactcccgctggaagcctccatctctttggaaaaacagttagtctggagcctgtggcccaggcccttctgtccccaggcatcatcccaacagctcattttccctagtccgccttcgttcaagggtcaggaatggaccagaacagatgggttctggaggcccctgaacagagggctatggctgtggagaaggttcttggcccgttggactcacacagaccctgtaccctctcggcaagcatcttcagtcagattatcctcagtttcagatacttcataataccttgtgttgtgtggggtcatacatcatcgtgtttgtaagagaagatggtcattttattctctgtataaaacttagctctaaagcagaaactaaagcagcaaatgcaggaaggctgtctcgccatcctcaagactcagcagctctcattctccagtggtgagcacaccatttgtgctgctgctgttgtcgtgaaatataataacagtggaagtcacaaaaatgtcccctgcccagccccctcgccgcccttgacctcctgcaggccatgtgtgtattacttgtctagtgatgtcctctcaaagtgctgtacgcgagctcggcgccacctccgcctccctttcagagcctgctccccgccctctctgctcgctgcattgtggtgttctcttctcaaggctttgaaatctccccttgcactgagattagtcgtcagatctctccccgtctccctcccaacttatacgacctgatttccttaggacggaaccgcaggcacctgcgccgggcgtcttactcccgctgcttgttctgtcccctccctcggaccaaacagtgctcatgcttcaggaccttgtttgtcgaagatgttggtttccctttctctgttatttatataaaaataatttatcaaaaggatattttaaaaaagctagtctgtcttgaaacttgtttaccttaaaattatcagaatctcagtgtttgaaagtactgaagcacaaacatatatcatctctgtaccattctgtactaaagcacttgagtctaataaataaagaaatcagcaccccttcccggtgtccagggggaaaaaaaaa

SEQ ID NO: 329734 - DNA, 616 bp, Homo sapiens
cgcccagtccgcgcgtcagtcggtccctagcgcggctgcggggcggagagctgcggctggcccagcgcgcccacctgaggaggcggcggggtccgcaggcgtcgcgggacgaggagatcggcgccacctccgcctccctttcagagcctgctccccgccctctctgctcgctgcattgtggtgttctcttctcaaggctttgaaatctccccttgcactgagattagtcgtcagatctctccccgtctccctcccaacttatacgacctgatttccttaggacggaaccgcaggcacctgcgccgggcgtcttactcccgctgcttgttctgtcccctccctcggaccaaacagtgctcatgcttcaggaccttgtttgtcgaagatgttggtttccctttctctgttatttatataaaaataatttatcaaaaggatattttaaaaaagctagtctgtcttgaaacttgtttaccttaaaattatcagaatctcagtgtttgaaagtactgaagcacaaacatatatcatctctgtaccattctgtactaaagcacttgagtctaataaataaagaaatcagcaccccttcccggtgtccagggggaaaaaaaaa

SEQ ID NO: 329735 - DNA, 7537 bp, Homo sapiens
agccgagtgcgccgtgcggtctccggacgctcgctgctcagcccgatccccgccaactgtgcaggcggctgacccgcagcggcagcggcagcagcgaggactcgagcgctggctgcagcgacaccatggatctctcctttatggccgcgcagctgcccatgatggggggagctttcatggactcgcccaacgaggacttcagcaccgagtactccctgtttaactcctctgccaatgtccacgcggctgccaatggccagggccagccggaagatcctcctcggtcctccaacgacgccgtcttgctatggattgccatcatagctacgctggggaacatcgtggtggtgggcgtggtgtatgccttcaccttctgaggacggcacaccctgcaccaccatggggtgaggcttggcacgtagctctgacttgctgtcggcctttggcttctcctgtgttctagaaccaggagttttgaccaggggcggcggccgtccttctggaatttctccccagcagccctgatttcaaatatcccatgttgtggtcaagctgagtcagaagacatggaagtatgggcctcctgcccctagaggcatgacggggcaaggccttcagagggcagattggggatccttgaaactacattccaggaacatgggaccagatgagacagctagttaagtttaaaacatagacatgatttgatgatcgcttgctggtggtaaataatcactcgtgtgtcttgtttttatgcaaacttatcgaacctagggcgtggggtgctggggcaagagcagccctcagaacttcagtgttcctgacccaattctggtttcacattcagtcccttggccatctagtagggccattggatgttcctagtttgactttgaaatggcacctttgccaccagacacctggtcccttccaagacccaagtgcattgggagacccagggatggggggttactggtaataggtggggtttctgggggtgttgttggtggtttttatctcctggtcggactttctcttctttttaagaagaggagaggatgtctttaagagctagatgtgccaggcagtggactcttcaggccacccacgtgagaatgctgtttcttctctgaggaatcgtggaattttaaagatgaacaagattcacatccactgaattattcaacggatgggtcagaaaggggggtgatttgcctgtggtcaccaggcaggtttgtggaggagtcggaacagaaagatgtgtcctcactctcagctcactgagctctctgccccaactaagcacttccctgaggaggttgctgagaagctgccctcaggagaatgtccaggcatcttgaaggtgggtgcgagattggcaggctgctcagatacccgtcctttacattcagtgtggataccgtgcattctcctgaagctgtgaaagtgcttctgcccaagccacttccttaaattctgaaatatcagcatctggggtcctggcaagcaaggaagcttccaagtaaaaaccagagagaagggcacacttttctttcttcattaggaaatcttattgcacaggaaccacccccacccccaccccccacaccttcccaaggcagcatcccagtgcagatagagtgggaaaggtcccagaagggggctcactcacctctaggcccagagaggctttctcctcactttatacactgcaaaaacagaagaattgtgtcaataacaccctctgtagtggagaaacttaaaaagctggttaggaagctctcgtgtatatttagagacaattacaagaaagctggacttgccgctgtggtctcaggagaaatgagtgttcttgatgacaggcaaagggacatcttagttgtccagaagcggcactcttccctggaagccgccatgttaataggattactagcctggctccagacagtgcctgctcatggctgccagttcttaccgatcacatctgtcactgccaccgtatatcatctgccagtgcatcagcttaaggggaggtcacgagtgcaaaagaacctgacccttgacaatgagggagaagggacatggaccacctgtctggaattcctggaatcactggcagggtggaggctgggctggggagttagccgcggtgtgcgtgaatggctctgtctccagcaagtctctctccatcaaaccccaggtctgccccataagcaagatctttaacagatggatgtctccatgagaaaacccaaggcgagaagcccagagccatggcggggttgcttgacgtcctcatggagtcactctgccccacatgctcaaatcttccctctggccccacatccctaggagggcctgacccctgtaaagatacaggaggcagctccctggcctccaaatggcccatggagatggcagtcgggagacagggttctgtgtttgctgcggtgaagggaggagaaggcaggaggaaaaaggatggcttctagccctgaagaggactccagcatcccaggcaccgggtgcttctggctgcagttttccctatggaggcccctcagcctccagccctaacataaatgtcggttaaattcagttttcaagcctctctcccttttcagtgtcagagcagtagatggtccagggcattggaggcctcgaccactctgcattgcagattacagtgacttcctcggggttgccccatcttggtctcctgtggtttcttcatcagctttttttttaccagcatctctcaaataacaatgaagatagatatgcccattagtgtctgattaaggagcaaaggctggatttctggccacagcgagctgcactctccctcctgcctcagccggggtccgtcttagcagtttggaaaggggaaaaagatgccggtcctcactgcttaagttttgtgtccaggtgccactagacttgcatgcacactaactccttacaatcaccacacagcatcatcgccccagtgcacagatgaggaaccagaggctcagaggagtgaagttgccttcctgaggtcacacagcatgaaagtgatgagctaggatttgaatctgggaagttgggctctagagccagactgtactgccttctgccacactgtactgccttctgtgactgggtggcacctccagggcacatttacacaaggccctgaatctgcagaggctgtttctcaagatgcccgtcatggtgtggcctgggccagctctggcttccacaggtccctgactgtcctcagagtggaacatgctcaacctcccgcccactgctctctctctgcccagatttcaggggtgccggtccccaaggcctgcccccttctttaagactgaactcaagtctccttggaaggccccggtgaagctcccagagactggttttcttgggatgcaggcagaaggggaccctccctggccaacacccaggagcccagcagaagcacccacacgtagaaagaggctcactacagccagaagtgcagagtcagagtcctgggaccatcttgttctgcaaggtgaccccaggctccccaggacaggggagagggatcgtcctcattcagactctagctggggcctctgtactggcttctccctgggtggggttgcctgttacatagctgtgcctcagagaaagggtcctgcattttctggaatgttctctgtgcttacccctctgtgtgcccctccattgctcctctacaagcaattaggtgattcaaaagagcaacttaggctgggtgcagtgactcacacccgtaatcccggcactttgggaggccgaggcgggcagggacaggagttcaagaccagcctggccaacatggtgaaaccctgtctctacaaaaaatacaaaaattaaccagacattgtggcatgtgcctgtaatcccagctactcaggaggctgacacaggagaattgcttgaaccaggaggcggaggctgcagtgagctgagattgtgccactgcactccagcctgggcaacagaacgagactctgtctcaaaaaaaaaaaaaaagaaaagagaaaaaaaaaaagagcaacttactgctttgtgaggttgtgagtggccaccactgaaggtctttgagaagaggccagacgctgctgtagccaggcctgtcttaagaggacttgtgcttccagggacccaggcaggatgatggcgcagctcttcctactccaagccaacgctgtccttcccctttcccatgaaatcaaggtcaagaggcaaataagactccctgctccactctaccccccagagagaaatgattctcgctcctttcagatcccccaggatctgagggagaaaggatgggaggaggggcagcagcatttcgctggaaaggcagcagatgcttttccagccccggttcagctggaaggcttggaggccggccagaccactctggcgtctcctgaagtgggtccctggagaccgaagaggctcagtggagtctgtctgttgtcagcactgctgcctgatccctgcaagacaaatggcactttccttcttcagaagcatcatctgccttcattattagcagtaatattattcccagttattattcttaccggtgccagttttgcacatctttttgttgctctatttgtgtctcatttacttctcaaattgcccctgggggcaggaatgaggatgcagagagatgcacgttaattactgtcgcatttttctgtggagaaaactgaggccagggctgaacgctcacagctaaggagctgtgattcagacccagttctgtcagctctagaggcaccctgcatcatgcccaccagggtgatccccctgggatggaccatctcgggatatgaggcctcggaggctggggttgagatttggtcctgaagagcttatagccagattgccacattcaagtgtaagtccaggaaaggggcaggcggcagtgcacagggatttatcagttccagaacctcacagtgataagaggctttagagagcatctaatcgagacctttaatttttcggggagagcagctgaggccgtgtggaaaattagtggagagctgacaagtgtctgggctcctggcccaggggtccgtggtccagcacgttgtgcgttcagtgggaagcaaagggcttgcccgggattacctgccccagccccgaggtgggttgtgctccctgcagctgccatcggcccgctttgcttcgtcctggcagatgcccagtgattgtccccgagcaagtgccagggttgggctgagctgctatgacagggaggcccagggagttctgctcagggagccaaagggaacagccagatcctgaatgttctatgttcacctgccccagccccacccaccctggcccactccacaggcccctgaccatggtcactcacggagagggatggaggagaaggtggttgaactgagtactgagaacccagaggacagagcccacagcttccaagcaggaaaagggacctctctgaaaaatctggataaccagaattatcacagcaccttctcattcccagcgcgtccttctgagctcagaccttgagcatttactgggtttctttttgaggaagagggaaagtgacaaaggacaaaacaatgcaaatcttcatgactgaagacgatcaaagactccctggagcgagaaaacagttactgccagaagcagaatggaagagccaaaaagtacacaaaatggacgccataaattctgaaataaaagtgtatgatgtgttctgagtcactgtagaagtcatgcatttattatcaagatagaaaagagcagagaatgacgtggacattggtcctcggagaggctgcataggtggtgcggtccccgggggattctggatgctggtcttttgaccgtggcggcagcctcgcgcctgcccggatggctccatccagacatttggcaaggctgtcatctgctcttgggtcctttttcaagctgatttcctgcctccccaagaggaggtttgagccccattctgccttggaaataaatcctgacagatgtgcacagcatatttgcagggaatttgcaggcctcgattattgggggaatcagagcccattccacaccgagccccatccacgtggctgagcaacacccctgtgtcccctgtatctgtctcactggctgtctttctgccagtttcttaaagaaccacaccattactgcgtttgccgttcgaagcgttgtcccaacaatgcagatggttctgacaagggctctatatgctggcagaagggagcttccaaccttttaacttgaggaaaatgaatctctgagaggcttgagagtgttgccaggtggagcttttcaggagacaggggtcttgagcccaggacacctaactatcgagttttcactaggagacttagtggtggctttcatgaggccagtcgttctcaaggaagggctgggggccatcagcaatgtctggagacatttttgattctcacagcttggtggggactgctattggtatctcatgggtggaggccagggatgccaccgaacatcctacaatgcacagggcagccccccacaaataagaattatccagccccaaaatgccaatagtgccgaggtcaggggaccctgtgctggccatcctatctctgattctgaaactatgcatgctttccacttttccccatttgtgagtcattgagtaaattaaagctcttctgagcagcagcagtgatcatggtcactgccctgcgttcaaataatgcgagctgaggacagtgatctgcaactcccagcatgtcatgtggtctcttagaaatccatgtgactgtttccaccatcttgggcatttgtggggacccccagactggagggagaaagccctacaaagtggatgggagtgtggggctgaacttttccctacccttaactttgtgtctctgggacctccagggacctggcccctcaccaatgcatatgaagagtatgcttggggaagagcttaggaatggggtgggcatgggagtgctgggtagcagcctttgagcaaatctgcatcttctcttatttctgacctttttccatgtgcccagtcctatttctgccagttgaaggcatactaatattctttatactatttaatcttttgcagaaaccttactattataacttgctactctccagataccaattcttcatgccgagagcatcggaaatgtttttgtgtcttactgatgttttcatgatcaacttgtaaatgtaagcagttgacttcataaaaggtattttaactattcttggagtcctttgctacccaagcacctggtttcaccatgcgatcactgacttctctacagtgaagactctttcttaataaaggatttcgctgtgctcttttgattaaaaatatctaaccttaaaagacgtaaaaatgtatctgtgaaatctcactttgttagcgttgctgctgttgtcattttctattatgataactgaaaagagaaaagaagaaaacatgaaaaaa

SEQ ID NO: 329736 - DNA, 7440 bp, Homo sapiens
agccgagtgcgccgtgcggtctccggacgctcgctgctcagcccgatccccgccaactgtgcaggcggctgacccgcagcggcagcggcagcagcgaggactcgagcgctggctgcagcgacaccatggatctctcctttatggccgcgcagctgcccatgatggggggagctttcatggactcgcccaacgaggacttcagcaccgagtactccctgtttaactcctctgccaatgtccacgcggctgccaatggccagggccagccggaagatcctcctcggtcctccaacgacgccgtcttgctatggattgccatcatagctacgctggggaacatcgtggtggtgggcgtggtgtatgccttcaccttctgaggacggcacaccctgcaccaccatggggtgaggcttggcacgtagctctgacttgctgtcggcctttggcttctcctgtgttctagaaccaggagttttgaccaggggcggcggccgtccttctggaatttctccccagcagccctgatttcaaatatcccatgttgtggtcaagctgagtcagaagacatggaagtatgggcctcctgcccctagaggcatgacggggcaaggccttcagagggcagattggggatccttgaaactacattccaggaacatgggaccagatgagacagctagttaagtttaaaacatagacatgatttgatgatcgcttgctggtggtaaataatcactcgtgtgtcttgtttttatgcaaacttatcgaacctagggcgtggggtgctggggcaagagcagccctcagaacttcagtgttcctgacccaattctggtttcacattcagtcccttggccatctagtagggccattggatgttcctagtttgactttgaaatggcacctttgccaccagacacctggtcccttccaagacccaagtgcattgggagacccagggatggggggttactggtaataggtggggtttctgggggtgttgttggtggtttttatctcctggtcggactttctcttctttttaagaagaggagaggatgtctttaagagctagatgtgccaggcagtggactcttcaggccacccacgtgagaatgctgtttcttctctgaggaatcgtggaattttaaagatgaacaagattcacatccactgaattattcaacggatgggtcagaaaggggggtgatttgcctgtggtcaccaggcaggtttgtggaggagtcggaacagaaagatgtgtcctcactctcagctcactgagctctctgccccaactaagcacttccctgaggaggttgctgagaagctgccctcaggagaatgtccaggcatcttgaaggtgggtgcgagattggcaggctgctcagatacccgtcctttacattcagtgtggataccgtgcattctcctgaagctgtgaaagtgcttctgcccaagccacttccttaaattctgaaatatcagcatctggggtcctggcaagcaaggaagcttccaagtaaaaaccagagagaagggcacacttttctttcttcattaggaaatcttattgcacaggaaccacccccacccccaccccccacaccttcccaaggcagcatcccagtgcagatagagtgggaaaggtcccagaagggggctcactcacctctaggcccagagaggctttctcctcactttatacactgcaaaaacagaagaattgtgtcaataacaccctctgtagtggagaaacttaaaaagctggttaggaagctctcgtgtatatttagagacaattacaagaaagctggacttgccgctgtggtctcaggagaaatgagtgttcttgatgacaggcaaagggacatcttagttgtccagaagcggcactcttccctggaagccgccatgttaataggattactagcctggctccagacagtgcctgctcatggctgccagttcttaccgatcacatctgtcactgccaccgtatatcatctgccagtgcatcagcttaaggggaggtcacgagtgcaaaagaacctgacccttgacaatgagggagaagggacatggaccacctgtctggaattcctggaatcactggcagggtggaggctgggctggggagttagccgcggtgtgcgtgaatggctctgtctccagcaagtctctctccatcaaaccccaggtctgccccataagcaagatctttaacagatggatgtctccatgagaaaacccaaggcgagaagcccagagccatggcggggttgcttgacgtcctcatggagtcactctgccccacatgctcaaatcttccctctggccccacatccctaggagggcctgacccctgtaaagatacaggaggcagctccctggcctccaaatggcccatggagatggcagtcgggagacagggttctgtgtttgctgcggtgaagggaggagaaggcaggaggaaaaaggatggcttctagccctgaagaggactccagcatcccaggcaccgggtgcttctggctgcagttttccctatggaggcccctcagcctccagccctaacataaatgtcggttaaattcagttttcaagcctctctcccttttcagtgtcagagcagtagatggtccagggcattggaggcctcgaccactctgcattgcagattacagtgacttcctcggggttgccccatcttggtctcctgtggtttcttcatcagctttttttttaccagcatctctcaaataacaatgaagatagatatgcccattagtgtctgattaaggagcaaaggctggatttctggccacagcgagctgcactctccctcctgcctcagccggggtccgtcttagcagtttggaaaggggaaaaagatgccggtcctcactgcttaagttttgtgtccaggtgccactagacttgcatgcacactaactccttacaatcaccacacagcatcatcgccccagtgcacagatgaggaaccagaggctcagaggagtgaagttgccttcctgaggtcacacagcatgaaagtgatgagctaggatttgaatctgggaagttgggctctagagccagactgtactgccttctgccacactgtactgccttctgtgactgggtggcacctccagggcacatttacacaaggccctgaatctgcagaggctgtttctcaagatgcccgtcatggtgtggcctgggccagctctggcttccacaggtccctgactgtcctcagagtggaacatgctcaacctcccgcccactgctctctctctgcccagatttcaggggtgccggtccccaaggcctgcccccttctttaagactgaactcaagtctccttggaaggccccggtgaagctcccagagactggttttcttgggatgcaggcagaaggggaccctccctggccaacacccaggagcccagcagaagcacccacacgtagaaagaggctcactacagccagaagtgcagagtcagagtcctgggaccatcttgttctgcaaggtgaccccaggctccccaggacaggggagagggatcgtcctcattcagactctagctggggcctctgtactggcttctccctgggtggggttgcctgttacatagctgtgcctcagagaaagggtcctgcattttctggaatgttctctgtgcttacccctctgtgtgcccctccattgctcctctacaagcaattaggtgattcaaaagagcaacttaggctgggtgcagtgactcacacccgtaatcccggcactttgggaggccgaggcgggcagggacaggagttcaagaccagcctggccaacatggtgaaaccctgtctctacaaaaaatacaaaaattaaccagacattgtggcatgtgcctgtaatcccagctactcaggaggctgacacaggagaattgcttgaaccaggaggcggaggctgcagtgagctgagattgtgccactgcactccagcctgggcaacagaacgagactctgtctcaaaaaaaaaaaaaaagaaaagagaaaaaaaaaaagagcaacttactgctttgtgaggttgtgagtggccaccactgaaggtctttgagaagaggccagacgctgctgtagccaggcctgtcttaagaggacttgtgcttccagggacccaggcaggatgatggcgcagctcttcctactccaagccaacgctgtccttcccctttcccatgaaatcaaggtcaagaggcaaataagactccctgctccactctaccccccagagagaaatgattctcgctcctttcagatcccccaggatctgagggagaaaggatgggaggaggggcagcagcatttcgctggaaaggcagcagatgcttttccagccccggttcagctggaaggcttggaggccggccagaccactctggcgtctcctgaagtgggtccctggagaccgaagaggctcagtggagtctgtctgttgtcagcactgctgcctgatccctgcaagacaaatggcactttccttcttcagaagcatcatctgccttcattattagcagtaatattattcccagttattattcttaccggtgccagttttgcacatctttttgttgctctatttgtgtctcatttacttctcaaattgcccctgggggcaggaatgaggatgcagagagatgcacgttaattactgtcgcatttttctgtggagaaaactgaggccagggctgaacgctcacagctaaggagctgtgattcagacccagttctgtcagctctagaggcaccctgcatcatgcccaccagggtgatccccctgggatggaccatctcgggatatgaggcctcggaggctggggttgagatttggtcctgaagagcttatagccagattgccacattcaagtgtaagtccaggaaaggggcaggcggcagtgcacagggatttatcagttccagaacctcacagtgataagaggctttagagagcatctaatcgagacctttaatttttcggggagagcagctgaggccgtgtggaaaattagtggagagctgacaagtgtctgggctcctggcccaggggtccgtggtccagcacgttgtgcgttcagtgggaagcaaagggcttgcccgggattacctgccccagccccgaggtgggttgtgctccctgcagctgccatcggcccgctttgcttcgtcctggcagatgcccagtgattgtccccgagcaagtgccagggttgggctgagctgctatgacagggaggcccagggagttctgctcagggagccaaagggaacagccagatcctgaatgttctatgttcacctgccccagccccacccaccctggcccactccacaggcccctgaccatggtcactcacggagagggatggaggagaaggtggttgaactgagtactgagaacccagaggacagagcccacagcttccaagcaggaaaagggacctctctgaaaaatctggataaccagaattatcacagcaccttctcattcccagcgcgtccttctgagctcagaccttgagcatttactgggtttctttttgaggaagagggaaagtgacaaaggacaaaacaatgcaaatcttcatgactgaagacgatcaaagactccctggagcgagaaaacagttactgccagaagcagaatggaagagccaaaaagtacacaaaatggacgccataaattctgaaataaaagtgtatgatgtgttctgagtcactgtagaagtcatgcatttattatcaagatagaaaagagcagagaatgacgtggacattggtcctcggagaggctgcataggtggtgcggtccccgggggattctggatgctggtcttttgaccgtggcggcagcctcgcgcctgcccggatggctccatccagacatttggcaaggctgtcatctgctcttgggtcctttttcaagctgatttcctgcctccccaagaggaggtttgagccccattctgccttggaaataaatcctgacagatgtgcacagcatatttgcagggaatttgcaggcctcgattattgggggaatcagagcccattccacaccgagccccatccacgtggctgagcaacacccctgtgtcccctgtatctgtctcactggctgtctttctgccagtttcttaaagaaccacaccattactgcgtttgccgttcgaagcgttgtcccaacaatgcagatggttctgacaagggctctatatgctggcagaagggagcttccaaccttttaacttgaggaaaatgaatctctgagaggcttgagagtgttgccaggtggagcttttcaggagacaggggtcttgagcccaggacacctaactatcgagttttcactaggagacttagtggtggctttcatgaggccagtcgttctcaaggaagggctgggggccatcagcaatgtctggagacatttttgattctcacagcttggtggggactgctattggtatctcatgggtggaggccagggatgccaccgaacatcctacaatgcacagggcagccccccacaaataagaattatccagccccaaaatgccaatagtgccgaggtcaggggaccctgtgctggccatcctatctctgattctgaaactatgcatgctttccacttttccccatttgtgagtcattgagtaaattaaagctcttctgagcagcagcagtgatcatggtcactgccctgcgttcaaataatgcgagctgaggacagtgatctgcaactcccagcatgtcatgtggtctcttagaaatccatgtgactgtttccaccatcttgggcatttgtggggacccccagactggagggagaaagccctacaaagtggatgggagtgtggggctgaacttttccctacccttaactttgtgtctctgggacctccagggacctggcccctcaccaatgcatatgaagagtatgcttggggaagagcttaggaatggggtgggcatgggagtgctgggtagcagcctttgagcaaatctgcatcttctcttatttctgacctttttccatgtgcccagtcctatttctgccagttgaaggcatactaatattctttatactatttaatcttttgcagaaaccttactattataacttgctactctccagataccaattcttcatgccgagagcatcggaaatgtttttgtgtcttactgatgttttcatgatcaacttgtaaatgtaagcagttgacttcataaaaggtattttaactattcttggagtcctttgctacccaagcacctggtttcaccatgcgatcactgacttctctacagtgaagactctttcttaataaaggatttcgctgtgctcttttgattaaaaatatctaaccttaaaagacgt

SEQ ID NO: 329737 - DNA, 776 bp, Homo sapiens
agccgagtgcgccgtgcggtctccggacgctcgctgctcagcccgatccccgccaactgtgcaggcggctgacccgcagcggcagcggcagcagcgaggactcgagcgctggctgcagcgacaccatggatctctcctttatggccgcgcagctgcccatgatggggggagctttcatggactcgcccaacgaggacttcagcaccgagtactccctgtttaactcctctgccaatgtccacgcggctgccaatggccagggccagccggaagatcctcctcggtcctccaacgacgccgtcttgctatggattgccatcatagctacgctggggaacatcgtggtggtgggcgtggtgtatgccttcaccttctgaggacggcacaccctgcaccaccatgggaaaccttactattataacttgctactctccagataccaattcttcatgccgagagcatcggaaatgtttttgtgtcttactgatgttttcatgatcaacttgtaaatgtaagcagttgacttcataaaaggtattttaactattcttggagtcctttgctacccaagcacctggtttcaccatgcgatcactgacttctctacagtgaagactctttcttaataaaggatttcgctgtgctcttttgattaaaaatatctaaccttaaaagacgtaaaaatgtatctgtgaaatctcactttgttagcgttgctgctgttgtcattttctattatgataactgaaaagagaaaagaagaaaacatgaaaaaa

SEQ ID NO: 329738 - DNA, 679 bp, Homo sapiens
agccgagtgcgccgtgcggtctccggacgctcgctgctcagcccgatccccgccaactgtgcaggcggctgacccgcagcggcagcggcagcagcgaggactcgagcgctggctgcagcgacaccatggatctctcctttatggccgcgcagctgcccatgatggggggagctttcatggactcgcccaacgaggacttcagcaccgagtactccctgtttaactcctctgccaatgtccacgcggctgccaatggccagggccagccggaagatcctcctcggtcctccaacgacgccgtcttgctatggattgccatcatagctacgctggggaacatcgtggtggtgggcgtggtgtatgccttcaccttctgaggacggcacaccctgcaccaccatgggaaaccttactattataacttgctactctccagataccaattcttcatgccgagagcatcggaaatgtttttgtgtcttactgatgttttcatgatcaacttgtaaatgtaagcagttgacttcataaaaggtattttaactattcttggagtcctttgctacccaagcacctggtttcaccatgcgatcactgacttctctacagtgaagactctttcttaataaaggatttcgctgtgctcttttgattaaaaatatctaaccttaaaagacgt

SEQ ID NO: 329739 - DNA, 5778 bp, Homo sapiens
agccgagtgcgccgtgcggtctccggacgctcgctgctcagcccgatccccgccaactgtgcaggcggctgacccgcagcggcagcggcagcagcgaggactcgagcgctggctgcagcgacaccatggatctctcctttatggccgcgcagctgcccatgatggggggagctttcatggactcgcccaacgaggacttcagcaccgagtactccctgtttaactcctctgccaatgtccacgcggctgccaatggccagggccagccggaagatcctcctcggtcctccaacgacgccgtcttgctatggattgccatcatagctacgctggggaacatcgtggtggtgggcgtggtgtatgccttcaccttctgaggacggcacaccctgcaccaccatggggtgaggcttggcacgtagctctgacttgctgtcggcctttggcttctcctgtgttctagaaccaggagttttgaccaggggcggcggccgtccttctggaatttctccccagcagccctgatttcaaatatcccatgttgtggtcaagctgagtcagaagacatggaagtatgggcctcctgcccctagaggcatgacggggcaaggccttcagagggcagattggggatccttgaaactacattccaggaacatgggaccagatgagacagctagttaagtttaaaacatagacatgatttgatgatcgcttgctggtggtaaataatcactcgtgtgtcttgtttttatgcaaacttatcgaacctagggcgtggggtgctggggcaagagcagccctcagaacttcagtgttcctgacccaattctggtttcacattcagtcccttggccatctagtagggccattggatgttcctagtttgactttgaaatggcacctttgccaccagacacctggtcccttccaagacccaagtgcattgggagacccagggatggggggttactggtaataggtggggtttctgggggtgttgttggtggtttttatctcctggtcggactttctcttctttttaagaagaggagaggatgtctttaagagctagatgtgccaggcagtggactcttcaggccacccacgtgagaatgctgtttcttctctgaggaatcgtggaattttaaagatgaacaagattcacatccactgaattattcaacggatgggtcagaaaggggggtgatttgcctgtggtcaccaggcaggtttgtggaggagtcggaacagaaagatgtgtcctcactctcagctcactgagctctctgccccaactaagcacttccctgaggaggttgctgagaagctgccctcaggagaatgtccaggcatcttgaaggtgggtgcgagattggcaggctgctcagatacccgtcctttacattcagtgtggataccgtgcattctcctgaagctgtgaaagtgcttctgcccaagccacttccttaaattctgaaatatcagcatctggggtcctggcaagcaaggaagcttccaagtaaaaaccagagagaagggcacacttttctttcttcattaggaaatcttattgcacaggaaccacccccacccccaccccccacaccttcccaaggcagcatcccagtgcagatagagtgggaaaggtcccagaagggggctcactcacctctaggcccagagaggctttctcctcactttatacactgcaaaaacagaagaattgtgtcaataacaccctctgtagtggagaaacttaaaaagctggttaggaagctctcgtgtatatttagagacaattacaagaaagctggacttgccgctgtggtctcaggagaaatgagtgttcttgatgacaggcaaagggacatcttagttgtccagaagcggcactcttccctggaagccgccatgttaataggattactagcctggctccagacagtgcctgctcatggctgccagttcttaccgatcacatctgtcactgccaccgtatatcatctgccagtgcatcagcttaaggggaggtcacgagtgcaaaagaacctgacccttgacaatgagggagaagggacatggaccacctgtctggaattcctggaatcactggcagggtggaggctgggctggggagttagccgcggtgtgcgtgaatggctctgtctccagcaagtctctctccatcaaaccccaggtctgccccataagcaagatctttaacagatggatgtctccatgagaaaacccaaggcgagaagcccagagccatggcggggttgcttgacgtcctcatggagtcactctgccccacatgctcaaatcttccctctggccccacatccctaggagggcctgacccctgtaaagatacaggaggcagctccctggcctccaaatggcccatggagatggcagtcgggagacagggttctgtgtttgctgcggtgaagggaggagaaggcaggaggaaaaaggatggcttctagccctgaagaggactccagcatcccaggcaccgggtgcttctggctgcagttttccctatggaggcccctcagcctccagccctaacataaatgtcggttaaattcagttttcaagcctctctcccttttcagtgtcagagcagtagatggtccagggcattggaggcctcgaccactctgcattgcagattacagtgacttcctcggggttgccccatcttggtctcctgtggtttcttcatcagctttttttttaccagcatctctcaaataacaatgaagatagatatgcccattagtgtctgattaaggagcaaaggctggatttctggccacagcgagctgcactctccctcctgcctcagccggggtccgtcttagcagtttggaaaggggaaaaagatgccggtcctcactgcttaagttttgtgtccaggtgccactagacttgcatgcacactaactccttacaatcaccacacagcatcatcgccccagtgcacagatgaggaaccagaggctcagaggagtgaagttgccttcctgaggtcacacagcatgaaagtgatgagctaggatttgaatctgggaagttgggctctagagccagactgtactgccttctgccacactgtactgccttctgtgactgggtggcacctccagggcacatttacacaaggccctgaatctgcagaggctgtttctcaagatgcccgtcatggtgtggcctgggccagctctggcttccacaggtccctgactgtcctcagagtggaacatgctcaacctcccgcccactgctctctctctgcccagatttcaggggtgccggtccccaaggcctgcccccttctttaagactgaactcaagtctccttggaaggccccggtgaagctcccagagactggttttcttgggatgcaggcagaaggggaccctccctggccaacacccaggagcccagcagaagcacccacacgtagaaagaggctcactacagccagaagtgcagagtcagagtcctgggaccatcttgttctgcaaggtgaccccaggctccccaggacaggggagagggatcgtcctcattcagactctagctggggcctctgtactggcttctccctgggtggggttgcctgttacatagctgtgcctcagagaaagggtcctgcattttctggaatgttctctgtgcttacccctctgtgtgcccctccattgctcctctacaagcaattaggtgattcaaaagagcaacttaggctgggtgcagtgactcacacccgtaatcccggcactttgggaggccgaggcgggcagggacaggagttcaagaccagcctggccaacatggtgaaaccctgtctctacaaaaaatacaaaaattaaccagacattgtggcatgtgcctgtaatcccagctactcaggaggctgacacaggagaattgcttgaaccaggaggcggaggctgcagtgagctgagattgtgccactgcactccagcctgggcaacagaacgagactctgtctcaaaaaaaaaaaaaaagaaaagagaaaaaaaaaaagagcaacttactgctttgtgaggttgtgagtggccaccactgaaggtctttgagaagaggccagacgctgctgtagccaggcctgtcttaagaggacttgtgcttccagggacccaggcaggatgatggcgcagctcttcctactccaagccaacgctgtccttcccctttcccatgaaatcaaggtcaagaggcaaataagactccctgctccactctaccccccagagagaaatgattctcgctcctttcagatcccccaggatctgagggagaaaggatgggaggaggggcagcagcatttcgctggaaaggcagcagatgcttttccagccccggttcagctggaaggcttggaggccggccagaccactctggcgtctcctgaagtgggtccctggagaccgaagaggctcagtggagtctgtctgttgtcagcactgctgcctgatccctgcaagacaaatggcactttccttcttcagaagcatcatctgccttcattattagcagtaatattattcccagttattattcttaccggtgccagttttgcacatctttttgttgctctatttgtgtctcatttacttctcaaattgcccctgggggcaggaatgaggatgcagagagatgcacgttaattactgtcgcatttttctgtggagaaaactgaggccagggctgaacgctcacagctaaggagctgtgattcagacccagttctgtcagctctagaggcaccctgcatcatgcccaccagggtgatccccctgggatggaccatctcgggatatgaggcctcggaggctggggttgagatttggtcctgaagagcttatagccagattgccacattcaagtgtaagtccaggaaaggggcaggcggcagtgcacagggatttatcagttccagaacctcacagtgataagaggctttagagagcatctaatcgagacctttaatttttcggggagagcagctgaggccgtgtggaaaattagtggagagctgacaagtgtctgggctcctggcccaggggtccgtggtccagcacgttgtgcgttcagtgggaagcaaagggcttgcccgggattacctgccccagccccgaggtgggttgtgctccctgcagctgccatcggcccgctttgcttcgtcctggcagatgcccagtgattgtccccgagcaagtgccagggttgggctgagctgctatgacagggaggcccagggagttctgctcagggagccaaagggaacagccagatcctgaatgttctatgttcacctgccccagccccacccaccctggcccactccacaggcccctgaccatggtcactcacggagagggatggaggagaaggtggttgaactgagtactgagaacccagaggacagagcccacagcttccaagcaggaaaagggacctctctgaaaaatctggataaccagaattatcacagcaccttctcattcccagcgcgtccttctgagctcagaccttgagcatttactgggtttctttttgaggaagagggaaagtgacaaaggacaaaacaatgcaaatcttcatgactgaagacgatcaaagactccctggagcgagaaaacagttactgccagaagcagaatggaagagccaaaaagtacacaaaatggacgccataaattctgaaataaaagtgtatgatgtgttctgagtca

SEQ ID NO: 329740 - DNA, 8286 bp, Homo sapiens
caaggcggccggcggcgaccatggcagcgggccggcggcggccgtagtggcccaggcctgggcttcagcctcccggggccccagagggcggggcggtccgggccgcggcggtggcggcgccacttccctgctcccgcccgaggactcctgcgggcactcgctgaggaccagcggaccggcggcgcgaatctgactgaggggcggggacgccgtctgttccccgccgctcccggcagggccgggccgggccgggctgggccgggctgggccgggcgggcccctgggagcagcccccaggcgggggaccgccttggagacccgaagccggagctagaggcaggcggtgggcccgggtggagtcccggccggagctggtggttcgggggcggtgctaggccccgaggctgcgggacctgagcgcgaggagcctgagtgcgggtccagcggtggcggcatgagccggcccccgccgacggggaaaatgcccggcgcccccgagaccgcgccgggggacggggcaggcgcgagccgccagaggaagctggaggcgctgatccgagaccctcgctcccccatcaacgtggagagcttgctggatggcttaaattccttggtccttgatttagattttcctgctttgaggaaaaacaagaacatagataatttcttaaatagatatgagaaaattgtgaaaaaaatcagaggtctacagatgaaggcagaagactatgatgttgtaaaagttattggaagaggtgcttttggtgaagtgcagttggttcgtcacaaggcatcgcagaaggtttatgctatgaagcttcttagtaagtttgaaatgataaaaagatcagattctgcctttttttgggaagaaagagatattatggcctttgccaatagcccctgggtggttcagcttttttatgcctttcaagatgataggtatctgtacatggtaatggagtacatgcctggtggagaccttgtaaaccttatgagtaattatgatgtgcctgaaaaatgggccaaattttacactgctgaagttgttcttgctctggatgcaatacactccatgggtttaatacacagagatgtgaagcctgacaacatgctcttggataaacatggacatctaaaattagcagattttggcacgtgtatgaagatggatgaaacaggcatggtacattgtgatacagcagttggaacaccggattatatatcacctgaggttctgaaatcacaagggggtgatggtttctatgggcgagaatgtgattggtggtctgtaggtgttttcctttatgagatgctagtgggggatactccattttatgcggattcacttgtaggaacatatagcaaaattatggatcataagaattcactgtgtttccctgaagatgcagaaatttccaaacatgcaaagaatctcatctgtgctttcttaacagatagggaggtacgacttgggagaaatggggtggaagaaatcagacagcatcctttctttaagaatgatcagtggcattgggataacataagagaaacggcagctcctgtagtacctgaactcagcagtgacatagacagcagcaatttcgatgacattgaagatgacaaaggagatgtagaaaccttcccaattcctaaagcttttgttggaaatcagctgcctttcatcggatttacctactatagagaaaatttattattaagtgactctccatcttgtagagaaaatgattccatacaatcaaggaaaaatgaagaaagtcaagagattcagaaaaaactgtatacattagaagaacatcttagcaatgagatgcaagccaaagaggaactggaacagaagtgcaaatctgttaatactcgcctagaaaaaacagcaaaggagctagaagaggagattaccttacggaaaagtgtggaatcagcattaagacagttagaaagagaaaaggcgcttcttcagcacaaaaatgcagaatatcagaggaaagctgatcatgaagcagacaaaaaacgaaatttggaaaatgatgttaacagcttaaaagatcaacttgaagatttgaaaaaaagaaatcaaaactctcaaatatccactgagaaagtgaatcaactccagagacaactggatgaaaccaatgctttactgcgaacagagtctgatactgcagcccggttaaggaaaacccaggcagaaagttcaaaacagattcagcagctggaatctaacaatagagatctacaagataaaaactgcctgctggagactgccaagttaaaacttgaaaaggaatttatcaatcttcagtcagctctagaatctgaaaggagggatcgaacccatggatcagagataattaatgatttacaaggtagaatatgtggcctagaagaagatttaaagaacggcaaaatcttactagcgaaagtagaactggagaagagacaacttcaggagagatttactgatttggaaaaggaaaaaagcaacatggaaatagatatgacataccaactaaaagttatacagcagagcctagaacaagaagaagctgaacataaggccacaaaggcacgactagcagataaaaataagatctatgagtccatcgaagaagccaaatcagaagccatgaaagaaatggagaagaagctcttggaggaaagaactttaaaacagaaagtggagaacctattgctagaagctgagaaaagatgttctctattagactgtgacctcaaacagtcacagcagaaaataaatgagctccttaaacagaaagatgtgctaaatgaggatgttagaaacctgacattaaaaatagagcaagaaactcagaagcgctgccttacacaaaatgacctgaagatgcaaacacaacaggttaacacactaaaaatgtcagaaaagcagttaaagcaagaaaataaccatctcatggaaatgaaaatgaacttggaaaaacaaaatgctgaacttcgaaaagaacgtcaggatgcagatgggcaaatgaaagagctccaggatcagctcgaagcagaacagtatttctcaaccctttataaaacacaagttagggagcttaaagaagaatgtgaagaaaagaccaaacttggtaaagaattgcagcagaagaaacaggaattacaggatgaacgggactctttggctgcccaactggagatcaccttgaccaaagcagattctgagcaactggctcgttcaattgctgaagaacaatattctgatttggaaaaagagaagatcatgaaagagctggagatcaaagagatgatggctagacacaaacaggaacttacggaaaaagatgctacaattgcttctcttgaggaaactaataggacactaactagtgatgttgccaatcttgcaaatgagaaagaagaattaaataacaaattgaaagatgttcaagagcaactgtcaagattgaaagatgaagaaataagcgcagcagctattaaagcacagtttgagaagcagctattaacagaaagaacactcaaaactcaagctgtgaataagttggctgagatcatgaatcgaaaagaacctgtcaagcgtggtaatgacacagatgtgcggagaaaagagaaggagaatagaaagctacatatggagcttaaatctgaacgtgagaaattgacccagcagatgatcaagtatcagaaagaactgaatgaaatgcaggcacaaatagctgaagagagccagattcgaattgaactgcagatgacattggacagtaaagacagtgacattgagcagctgcggtcacaactccaagccttgcatattggtctggatagttccagtataggcagtggaccaggggatgctgaggcagatgatgggtttccagaatcaagattagaaggatggctttcattgcctgtacgaaacaacactaagaaatttggatgggttaaaaagtatgtgattgtaagcagtaagaagattcttttctatgacagtgaacaagataaagaacaatccaatccttacatggttttagatatagacaagttatttcatgtccgaccagttacacagacagatgtgtatagagcagatgctaaagaaattccaaggatattccagattctgtatgccaatgaaggagaaagtaagaaggaacaagaatttccagtggagccagttggagaaaaatctaattatatttgccacaagggacatgagtttattcctactctttatcatttcccaaccaactgtgaggcttgtatgaagcccctgtggcacatgtttaagcctcctcctgctttggagtgccgccgttgccatattaagtgtcataaagatcatatggacaaaaaggaggagattatagcaccttgcaaagtatattatgatatttcaacggcaaagaatctgttattactagcaaattctacagaagagcagcagaagtgggttagtcggttggtgaaaaagatacctaaaaagcccccagctccagacccttttgcccgatcatctcctagaacttcaatgaagatacagcaaaaccagtctattagacggccaagtcgacagcttgccccaaacaaacctagctaactgccttctatgaaagcagtcattattcaaggtgatcgtattcttccagtgaaaacaagactgaaatatgatggcccaaaatttattaaaaagctatattttcctgagagactgatacatacactcatacatatatgtgttccccttttccctgtaatataaattacaaatctgggctcctttgaagcaacaggttgaaccaacaatgattggttgatagactaaggatatatgcaactcttccagacttttccataaagctctctcggcagtcgctcacactacagtgcacacaaggattgagaagagttaaaggctaaagaaaacatcttttctagcttcaacagagaggtttcaccagcacatttaccagaagaatctgggaatggattccactacagtgatattgactgcatctttaagaagtgaccattatactgtgtatatatatataaacacacacacatatatatatatatatagtactctaatactgcaagaaggttttttaaacttcccactttattttttatacacattaatcagatatcattacttgctgcagttgcaactatgcacttgtataaagccataatgttggagtttatatcactcattcctgtgtacctgatggaagttgcatgttcatgtttaagcagttactgtaacaagaagtttaaagttaattatatcagtttcctaatgcttcatgataggcaactttacccattttgaatgccttaatttaatttttttcaaagtctcagccctgtctgtattaaaaaacaaaaaaagcgtttaccagctcttaggatgtaaactagctttgtggaagataaatcgtgcactatttttacacataaatagttatatcaatgtcagcctattttgattaacaaatgtttttaaagtattattggttatagaaacaataatggatggtgttggaactaatatatccttgatgtctgtctattattcattcaactctttttacagacctcagtattagtctgtgactacaaaatattttatttgctttaaatttgctggctaccctagatgtgtttttattcctggtaaagacatttgtgattacattttcacacttaagattcaaaatttttcccaaatataaagaaaactaagacagactgtagatgcattttaaatatttaaatatgatcctcagacatgcagctgtgtgtggcagtattttagtaccgggttaagaaaactggcaactgggaagaagtggcctcaaaggcacttaatttgatttttattttttaaatgctgtcaaagttacagtttacgcaggacattcttgccgtattctcatgatcccagataagtgtgtgttttatactgcaacaatatgcagcaatggtaagcgtaaagtttttttttgtttttgtttttgtttttttttatattatgaagtcttttaacagtctctctttatataaatacacagagtttggtatgatatttaaatacatcatctggccaggcatggtggcttacgcctgtaatcctagcactttgggaggccaagacgggcggatcacctgaggtgaggagttcaagaccagcctgcccaacatagtgaaactccgtctctaccaatatacaaaaattagccgggcatgatggtggtggcctgtaatcccagctacttgggaggctgagacaggagaatcgcttgaacccaggagacggtggttgcagtgagcgaagatcgagccactgcactccagcctgggcagctgaacaagactccgtctcaaaaaaaaaaaaaaaaaaaagtcatctaatatttcgatgaaggaaatagacatttttcattgattccctctgatgtcagttagagatatttaaaaagttagatccccataatagatactattgtggaaactgaagagtagctactggcctactgatagactgaaactggttttgttattcttaacgttctccagtctgcactctgctgtgctgtctgtgctcagactagacgtgcatgccgtttcctttgcaggtgtgttctgcagctctggttttgggggatagctcttttttaagtaagattaaaaaatgaaaaatatataaatttatatagaataaatatttccattcattagagttgttaaaaggagactgaattaatattttatataaagattttgttacattatgggaggttctatcctattctgaattggagagtatatatatatatatatatatatatatttttaataaactttattaaggtgaaataatttcaagtttacatatgagtaactgaaatatttgagtaaaaaaggcaaaagtttaaatttggaatgctgtatatattagagaatatggggaatcatggtgtgaccaactgtacaaggaagattcatatgaaggtcttaggggaaaaagataattctgaagggtgaaaaaaaaatctctcccatggagattcttcacattatatggtttgacataagggtttataaggttgtttgtccaactaatgaaaatgcgcttaataaaaaattctgaccttgggtaagaattcgctttttaccgcattgccgctttcatgtacatacatgagtgcatgcacctatcaatgtgttttcttcccaacacttattaaatataaaacaacctgattttgtgctcgtttctcgtttttcttgaggccctgaagcttccaagataaatataagactaaaatttgcttgttccttcacacctgatttctcctagaaccataaatacctcctatggggaactaagaaatcatgaatactgggattttcttattggattttttacttttgttttgtggggataacgagacagaagtgaaaggaaaactggtgccggtattactgttgaaattaatgtacagtgaatgtttttaaagtattaattttaaaaaaccatgttctctagaaacaagttttaaaaatctatatgaaagttttaaaatgttccagctaactaatggataagcataccagtaaagccaaagtaaaggttagtgcctttaaaactaacctgtgttagagttacatgaatctggctctaaagtatctattttgcatccatttatatatagatcttaaacagaaatactctaggttgccacaccacagttttaagaagttatgctgctgctgttactctcttctaggattctggtggtaaagtagagaaactcggacactatattaaccttactgaaacatgctttaaatcgtgtctaaaatctgatttgagcaagtcactgccgagcttctgagtctgcattgacactgctactgactcacctctccttccctggaataaggcttcagcttccctatgctgtgaagacaccatttgtaagcactttgaacataagcactgtgtgacagcgctggatatcatgcttgggggggggcctctccctgactcccatccccataataatgagttttgtttggaattgtaataagtaatgaactgcatggtttagaaaattataaatatttgatcagctgtcctctctgaaaaaaattgcacccctttttcttttttaaaattttgttgcatcttcgtagtaatgtaattgtattttatgcctgcttttttataaaaaaataaaataaaataaatggaga

SEQ ID NO: 329741 - DNA, 8660 bp, Homo sapiens
caaggcggccggcggcgaccatggcagcgggccggcggcggccgtagtggcccaggcctgggcttcagcctcccggggccccagagggcggggcggtccgggccgcggcggtggcggcgccacttccctgctcccgcccgaggactcctgcgggcactcgctgaggaccagcggaccggcggcgcgaatctgactgaggggcggggacgccgtctgttccccgccgctcccggcagggccgggccgggccgggctgggccgggctgggccgggcgggcccctgggagcagcccccaggcgggggaccgccttggagacccgaagccggagctagaggcaggcggtgggcccgggtggagtcccggccggagctggtggttcgggggcggtgctaggccccgaggctgcgggacctgagcgcgaggagcctgagtgcgggtccagcggtggcggcatgagccggcccccgccgacggggaaaatgcccggcgcccccgagaccgcgccgggggacggggcaggcgcgagccgccagaggaagctggaggcgctgatccgagaccctcgctcccccatcaacgtggagagcttgctggatggcttaaattccttggtccttgatttagattttcctgctttgaggaaaaacaagaacatagataatttcttaaatagatatgagaaaattgtgaaaaaaatcagaggtctacagatgaaggcagaagactatgatgttgtaaaagttattggaagaggtgcttttggtgaagtgcagttggttcgtcacaaggcatcgcagaaggtttatgctatgaagcttcttagtaagtttgaaatgataaaaagatcagattctgcctttttttgggaagaaagagatattatggcctttgccaatagcccctgggtggttcagcttttttatgcctttcaagatgataggtatctgtacatggtaatggagtacatgcctggtggagaccttgtaaaccttatgagtaattatgatgtgcctgaaaaatgggccaaattttacactgctgaagttgttcttgctctggatgcaatacactccatgggtttaatacacagagatgtgaagcctgacaacatgctcttggataaacatggacatctaaaattagcagattttggcacgtgtatgaagatggatgaaacaggcatggtacattgtgatacagcagttggaacaccggattatatatcacctgaggttctgaaatcacaagggggtgatggtttctatgggcgagaatgtgattggtggtctgtaggtgttttcctttatgagatgctagtgggggatactccattttatgcggattcacttgtaggaacatatagcaaaattatggatcataagaattcactgtgtttccctgaagatgcagaaatttccaaacatgcaaagaatctcatctgtgctttcttaacagatagggaggtacgacttgggagaaatggggtggaagaaatcagacagcatcctttctttaagaatgatcagtggcattgggataacataagagaaacggcagctcctgtagtacctgaactcagcagtgacatagacagcagcaatttcgatgacattgaagatgacaaaggagatgtagaaaccttcccaattcctaaagcttttgttggaaatcagctgcctttcatcggatttacctactatagagaaaatttattattaagtgactctccatcttgtagagaaaatgattccatacaatcaaggaaaaatgaagaaagtcaagagattcagaaaaaactgtatacattagaagaacatcttagcaatgagatgcaagccaaagaggaactggaacagaagtgcaaatctgttaatactcgcctagaaaaaacagcaaaggagctagaagaggagattaccttacggaaaagtgtggaatcagcattaagacagttagaaagagaaaaggcgcttcttcagcacaaaaatgcagaatatcagaggaaagctgatcatgaagcagacaaaaaacgaaatttggaaaatgatgttaacagcttaaaagatcaacttgaagatttgaaaaaaagaaatcaaaactctcaaatatccactgagaaagtgaatcaactccagagacaactggatgaaaccaatgctttactgcgaacagagtctgatactgcagcccggttaaggaaaacccaggcagaaagttcaaaacagattcagcagctggaatctaacaatagagatctacaagataaaaactgcctgctggagactgccaagttaaaacttgaaaaggaatttatcaatcttcagtcagctctagaatctgaaaggagggatcgaacccatggatcagagataattaatgatttacaaggtagaatatgtggcctagaagaagatttaaagaacggcaaaatcttactagcgaaagtagaactggagaagagacaacttcaggagagatttactgatttggaaaaggaaaaaagcaacatggaaatagatatgacataccaactaaaagttatacagcagagcctagaacaagaagaagctgaacataaggccacaaaggcacgactagcagataaaaataagatctatgagtccatcgaagaagccaaatcagaagccatgaaagaaatggagaagaagctcttggaggaaagaactttaaaacagaaagtggagaacctattgctagaagctgagaaaagatgttctctattagactgtgacctcaaacagtcacagcagaaaataaatgagctccttaaacagaaagatgtgctaaatgaggatgttagaaacctgacattaaaaatagagcaagaaactcagaagcgctgccttacacaaaatgacctgaagatgcaaacacaacaggttaacacactaaaaatgtcagaaaagcagttaaagcaagaaaataaccatctcatggaaatgaaaatgaacttggaaaaacaaaatgctgaacttcgaaaagaacgtcaggatgcagatgggcaaatgaaagagctccaggatcagctcgaagcagaacagtatttctcaaccctttataaaacacaagttagggagcttaaagaagaatgtgaagaaaagaccaaacttggtaaagaattgcagcagaagaaacaggaattacaggatgaacgggactctttggctgcccaactggagatcaccttgaccaaagcagattctgagcaactggctcgttcaattgctgaagaacaatattctgatttggaaaaagagaagatcatgaaagagctggagatcaaagagatgatggctagacacaaacaggaacttacggaaaaagatgctacaattgcttctcttgaggaaactaataggacactaactagtgatgttgccaatcttgcaaatgagaaagaagaattaaataacaaattgaaagatgttcaagagcaactgtcaagattgaaagatgaagaaataagcgcagcagctattaaagcacagtttgagaagcagctattaacagaaagaacactcaaaactcaagctgtgaataagttggctgagatcatgaatcgaaaagaacctgtcaagcgtggtaatgacacagatgtgcggagaaaagagaaggagaatagaaagctacatatggagcttaaatctgaacgtgagaaattgacccagcagatgatcaagtatcagaaagaactgaatgaaatgcaggcacaaatagctgaagagagccagattcgaattgaactgcagatgacattggacagtaaagacagtgacattgagcagctgcggtcacaactccaagccttgcatattggtctggatagttccagtataggcagtggaccaggggatgctgaggcagatgatgggtttccagaatcaagattagaaggatggctttcattgcctgtacgaaacaacactaagaaatttggatgggttaaaaagtatgtgattgtaagcagtaagaagattcttttctatgacagtgaacaagataaagaacaatccaatccttacatggttttagatatagacaagttatttcatgtccgaccagttacacagacagatgtgtatagagcagatgctaaagaaattccaaggatattccagattctgtatgccaatgaaggagaaagtaagaaggaacaagaatttccagtggagccagttggagaaaaatctaattatatttgccacaagggacatgagtttattcctactctttatcatttcccaaccaactgtgaggcttgtatgaagcccctgtggcacatgtttaagcctcctcctgctttggagtgccgccgttgccatattaagtgtcataaagatcatatggacaaaaaggaggagattatagcaccttgcaaagtatattatgatatttcaacggcaaagaatctgttattactagcaaattctacagaagagcagcagaagtgggttagtcggttggtgaaaaagatacctaaaaagcccccagctccagacccttttgcccgatcatctcctagaacttcaatgaagatacagcaaaaccagtctattagacggccaagtcgacagcttgccccaaacaaacctagctaactgccttctatgaaagcagtcattattcaaggtgatcgtattcttccagtgaaaacaagactgaaatatgatggcccaaaatttattaaaaagctatattttcctgagagactgatacatacactcatacatatatgtgttccccttttccctgtaatataaattacaaatctgggctcctttgaagcaacaggttgaaccaacaatgattggttgatagactaaggatatatgcaactcttccagacttttccataaagctctctcggcagtcgctcacactacagtgcacacaaggattgagaagagttaaaggctaaagaaaacatcttttctagcttcaacagagaggtttcaccagcacatttaccagaagaatctgggaatggattccactacagtgatattgactgcatctttaagaagtgaccattatactgtgtatatatatataaacacacacacatatatatatatatatagtactctaatactgcaagaaggttttttaaacttcccactttattttttatacacattaatcagatatcattacttgctgcagttgcaactatgcacttgtataaagccataatgttggagtttatatcactcattcctgtgtacctgatggaagttgcatgttcatgtttaagcagttactgtaacaagaagtttaaagttaattatatcagtttcctaatgcttcatgataggcaactttacccattttgaatgccttaatttaatttttttcaaagtctcagccctgtctgtattaaaaaacaaaaaaagcgtttaccagctcttaggatgtaaactagctttgtggaagataaatcgtgcactatttttacacataaatagttatatcaatgtcagcctattttgattaacaaatgtttttaaagtattattggttatagaaacaataatggatggtgttggaactaatatatccttgatgtctgtctattattcattcaactctttttacagacctcagtattagtctgtgactacaaaatattttatttgctttaaatttgctggctaccctagatgtgtttttattcctggtaaagacatttgtgattacattttcacacttaagattcaaaatttttcccaaatataaagaaaactaagacagactgtagatgcattttaaatatttaaatatgatcctcagacatgcagctgtgtgtggcagtattttagtaccgggttaagaaaactggcaactgggaagaagtggcctcaaaggcacttaatttgatttttattttttaaatgctgtcaaagttacagtttacgcaggacattcttgccgtattctcatgatcccagataagtgtgtgttttatactgcaacaatatgcagcaatggtaagcgtaaagtttttttttgtttttgtttttgtttttttttatattatgaagtcttttaacagtctctctttatataaatacacagagtttggtatgatatttaaatacatcatctggccaggcatggtggcttacgcctgtaatcctagcactttgggaggccaagacgggcggatcacctgaggtgaggagttcaagaccagcctgcccaacatagtgaaactccgtctctaccaatatacaaaaattagccgggcatgatggtggtggcctgtaatcccagctacttgggaggctgagacaggagaatcgcttgaacccaggagacggtggttgcagtgagcgaagatcgagccactgcactccagcctgggcagctgaacaagactccgtctcaaaaaaaaaaaaaaaaaaaagtcatctaatatttcgatgaaggaaatagacatttttcattgattccctctgatgtcagttagagatatttaaaaagttagatccccataatagatactattgtggaaactgaagagtagctactggcctactgatagactgaaactggttttgttattcttaacgttctccagtctgcactctgctgtgctgtctgtgctcagactagacgtgcatgccgtttcctttgcaggtgtgttctgcagctctggttttgggggatagctcttttttaagtaagattaaaaaatgaaaaatatataaatttatatagaataaatatttccattcattagagttgttaaaaggagactgaattaatattttatataaagattttgttacattatgggaggttctatcctattctgaattggagagtatatatatatatatatatatatatatttttaataaactttattaaggtgaaataatttcaagtttacatatgagtaactgaaatatttgagtaaaaaaggcaaaagtttaaatttggaatgctgtatatattagagaatatggggaatcatggtgtgaccaactgtacaaggaagattcatatgaaggtcttaggggaaaaagataattctgaagggtgaaaaaaaaatctctcccatggagattcttcacattatatggtttgacataagggtttataaggttgtttgtccaactaatgaaaatgcgcttaataaaaaattctgaccttgggtaagaattcgctttttaccgcattgccgctttcatgtacatacatgagtgcatgcacctatcaatgtgttttcttcccaacacttattaaatataaaacaacctgattttgtgctcgtttctcgtttttcttgaggccctgaagcttccaagataaatataagactaaaatttgcttgttccttcacacctgatttctcctagaaccataaatacctcctatggggaactaagaaatcatgaatactgggattttcttattggattttttacttttgttttgtggggataacgagacagaagtgaaaggaaaactggtgccggtattactgttgaaattaatgtacagtgaatgtttttaaagtattaattttaaaaaaccatgttctctagaaacaagttttaaaaatctatatgaaagttttaaaatgttccagctaactaatggataagcataccagtaaagccaaagtaaaggttagtgcctttaaaactaacctgtgttagagttacatgaatctggctctaaagtatctattttgcatccatttatatatagatcttaaacagaaatactctaggttgccacaccacagttttaagaagttatgctgctgctgttactctcttctaggattctggtggtaaagtagagaaactcggacactatattaaccttactgaaacatgctttaaatcgtgtctaaaatctgatttgagcaagtcactgccgagcttctgagtctgcattgacactgctactgactcacctctccttccctggaataaggcttcagcttccctatgctgtgaagacaccatttgtaagcactttgaacataagcactgtgtgacagcgctggatatcatgcttgggggggggcctctccctgactcccatccccataataatgagttttgtttggaattgtaataagtaatgaactgcatggtttagaaaattataaatatttgatcagctgtcctctctgaaaaaaattgcacccctttttcttttttaaaattttgttgcatcttcgtagtaatgtaattgtattttatgcctgcttttttataaaaaaataaaataaaataaatggagaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggaaaaaaaaaaaaaaaaaaaaaaattgggcccaaattggggcctatttggccaatttccccttatggggggcgtattaacaatcattggcgcgcggttaaaaacgtcgagatgtggaaaaccctggcgttacccaacttaaagccctttgaagacatatccctttttccacattgggcaaatccaaaaagccccccccgatcgcctttcccaacaatgccacccttaatggccaagggaaattgcacgcctaaaatcttgtaaaaatcgcgtttttgtgccc

SEQ ID NO: 329742 - DNA, 8232 bp, Homo sapiens
caaggcggccggcggcgaccatggcagcgggccggcggcggccgtagtggcccaggcctgggcttcagcctcccggggccccagagggcggggcggtccgggccgcggcggtggcggcgccacttccctgctcccgcccgaggactcctgcgggcactcgctgaggaccagcggaccggcggcgcgaatctgactgaggggcggggacgccgtctgttccccgccgctcccggcagggccgggccgggccgggctgggccgggctgggccgggcgggcccctgggagcagcccccaggcgggggaccgccttggagacccgaagccggagctagaggcaggcggtgggcccgggtggagtcccggccggagctggtggttcgggggcggtgctaggccccgaggctgcgggacctgagcgcgaggagcctgagtgcgggtccagcggtggcggcatgagccggcccccgccgacggggaaaatgcccggcgcccccgagaccgcgccgggggacggggcaggcgcgagccgccagaggaagctggaggcgctgatccgagaccctcgctcccccatcaacgtggagagcttgctggatggcttaaattccttggtccttgatttagattttcctgctttgaggaaaaacaagaacatagataatttcttaaatagatatgagaaaattgtgaaaaaaatcagaggtctacagatgaaggcagaagactatgatgttgtaaaagttattggaagaggtgcttttggtgaagtgcagttggttcgtcacaaggcatcgcagaaggtttatgctatgaagcttcttagtaagtttgaaatgataaaaagatcagattctgcctttttttgggaagaaagagatattatggcctttgccaatagcccctgggtggttcagcttttttatgcctttcaagatgataggtatctgtacatggtaatggagtacatgcctggtggagaccttgtaaaccttatgagtaattatgatgtgcctgaaaaatgggccaaattttacactgctgaagttgttcttgctctggatgcaatacactccatgggtttaatacacagagatgtgaagcctgacaacatgctcttggataaacatggacatctaaaattagcagattttggcacgtgtatgaagatggatgaaacaggcatggtacattgtgatacagcagttggaacaccggattatatatcacctgaggttctgaaatcacaagggggtgatggtttctatgggcgagaatgtgattggtggtctgtaggtgttttcctttatgagatgctagtgggggatactccattttatgcggattcacttgtaggaacatatagcaaaattatggatcataagaattcactgtgtttccctgaagatgcagaaatttccaaacatgcaaagaatctcatctgtgctttcttaacagatagggaggtacgacttgggagaaatggggtggaagaaatcagacagcatcctttctttaagaatgatcagtggcattgggataacataagagaaacggcagctcctgtagtacctgaactcagcagtgacatagacagcagcaatttcgatgacattgaagatgacaaaggagatgtagaaaccttcccaattcctaaagcttttgttggaaatcagctgcctttcatcggatttacctactatagagaaaatttattattaagtgactctccatcttgtagagaaaatgattccatacaatcaaggaaaaatgaagaaagtcaagagattcagaaaaaactgtatacattagaagaacatcttagcaatgagatgcaagccaaagaggaactggaacagaagtgcaaatctgttaatactcgcctagaaaaaacagcaaaggagctagaagaggagattaccttacggaaaagtgtggaatcagcattaagacagttagaaagagaaaaggcgcttcttcagcacaaaaatgcagaatatcagaggaaagctgatcatgaagcagacaaaaaacgaaatttggaaaatgatgttaacagcttaaaagatcaacttgaagatttgaaaaaaagaaatcaaaactctcaaatatccactgagaaagtgaatcaactccagagacaactggatgaaaccaatgctttactgcgaacagagtctgatactgcagcccggttaaggaaaacccaggcagaaagttcaaaacagattcagcagctggaatctaacaatagagatctacaagataaaaactgcctgctggagactgccaagttaaaacttgaaaaggaatttatcaatcttcagtcagctctagaatctgaaaggagggatcgaacccatggatcagagataattaatgatttacaaggtagaatatgtggcctagaagaagatttaaagaacggcaaaatcttactagcgaaagtagaactggagaagagacaacttcaggagagatttactgatttggaaaaggaaaaaagcaacatggaaatagatatgacataccaactaaaagttatacagcagagcctagaacaagaagaagctgaacataaggccacaaaggcacgactagcagataaaaataagatctatgagtccatcgaagaagccaaatcagaagccatgaaagaaatggagaagaagctcttggaggaaagaactttaaaacagaaagtggagaacctattgctagaagctgagaaaagatgttctctattagactgtgacctcaaacagtcacagcagaaaataaatgagctccttaaacagaaagatgtgctaaatgaggatgttagaaacctgacattaaaaatagagcaagaaactcagaagcgctgccttacacaaaatgacctgaagatgcaaacacaacaggttaacacactaaaaatgtcagaaaagcagttaaagcaagaaaataaccatctcatggaaatgaaaatgaacttggaaaaacaaaatgctgaacttcgaaaagaacgtcaggatgcagatgggcaaatgaaagagctccaggatcagctcgaagcagaacagtatttctcaaccctttataaaacacaagttagggagcttaaagaagaatgtgaagaaaagaccaaacttggtaaagaattgcagcagaagaaacaggaattacaggatgaacgggactctttggctgcccaactggagatcaccttgaccaaagcagattctgagcaactggctcgttcaattgctgaagaacaatattctgatttggaaaaagagaagatcatgaaagagctggagatcaaagagatgatggctagacacaaacaggaacttacggaaaaagatgctacaattgcttctcttgaggaaactaataggacactaactagtgatgttgccaatcttgcaaatgagaaagaagaattaaataacaaattgaaagatgttcaagagcaactgtcaagattgaaagatgaagaaataagcgcagcagctattaaagcacagtttgagaagcagctattaacagaaagaacactcaaaactcaagctgtgaataagttggctgagatcatgaatcgaaaagaacctgtcaagcgtggtaatgacacagatgtgcggagaaaagagaaggagaatagaaagctacatatggagcttaaatctgaacgtgagaaattgacccagcagatgatcaagtatcagaaagaactgaatgaaatgcaggcacaaatagctgaagagagccagattcgaattgaactgcagatgacattggacagtaaagacagtgacattgagcagctgcggtcacaactccaagccttgcatattggtctggatagttccagtataggcagtggaccaggggatgctgaggcagatgatgggtttccagaatcaagattagaaggatggctttcattgcctgtacgaaacaacactaagaaatttggatgggttaaaaagtatgtgattgtaagcagtaagaagattcttttctatgacagtgaacaagataaagaacaatccaatccttacatggttttagatatagacaagttatttcatgtccgaccagttacacagacagatgtgtatagagcagatgctaaagaaattccaaggatattccagattctgtatgccaatgaaggagaaagtaagaaggaacaagaatttccagtggagccagttggagaaaaatctaattatatttgccacaagggacatgagtttattcctactctttatcatttcccaaccaactgtgaggcttgtatgaagcccctgtggcacatgtttaagcctcctcctgctttggagtgccgccgttgccatattaagtgtcataaagatcatatggacaaaaaggaggagattatagcaccttgcaaagtatattatgatatttcaacggcaaagaatctgttattactagcaaattctacagaagagcagcagaagtgggttagtcggttggtgaaaaagatacctaaaaagcccccagctccagacccttttgcccgatcatctcctagaacttcaatgaagatacagcaaaaccagtctattagacggccaagtcgacagcttgccccaaacaaacctagctaactgccttctatgaaagcagtcattattcaaggtgatcgtattcttccagtgaaaacaagactgaaatatgatggcccaaaatttattaaaaagctatattttcctgagagactgatacatacactcatacatatatgtgttccccttttccctgtaatataaattacaaatctgggctcctttgaagcaacaggttgaaccaacaatgattggttgatagactaaggatatatgcaactcttccagacttttccataaagctctctcggcagtcgctcacactacagtgcacacaaggattgagaagagttaaaggctaaagaatctgggaatggattccactacagtgatattgactgcatctttaagaagtgaccattatactgtgtatatatatataaacacacacacatatatatatatatatagtactctaatactgcaagaaggttttttaaacttcccactttattttttatacacattaatcagatatcattacttgctgcagttgcaactatgcacttgtataaagccataatgttggagtttatatcactcattcctgtgtacctgatggaagttgcatgttcatgtttaagcagttactgtaacaagaagtttaaagttaattatatcagtttcctaatgcttcatgataggcaactttacccattttgaatgccttaatttaatttttttcaaagtctcagccctgtctgtattaaaaaacaaaaaaagcgtttaccagctcttaggatgtaaactagctttgtggaagataaatcgtgcactatttttacacataaatagttatatcaatgtcagcctattttgattaacaaatgtttttaaagtattattggttatagaaacaataatggatggtgttggaactaatatatccttgatgtctgtctattattcattcaactctttttacagacctcagtattagtctgtgactacaaaatattttatttgctttaaatttgctggctaccctagatgtgtttttattcctggtaaagacatttgtgattacattttcacacttaagattcaaaatttttcccaaatataaagaaaactaagacagactgtagatgcattttaaatatttaaatatgatcctcagacatgcagctgtgtgtggcagtattttagtaccgggttaagaaaactggcaactgggaagaagtggcctcaaaggcacttaatttgatttttattttttaaatgctgtcaaagttacagtttacgcaggacattcttgccgtattctcatgatcccagataagtgtgtgttttatactgcaacaatatgcagcaatggtaagcgtaaagtttttttttgtttttgtttttgtttttttttatattatgaagtcttttaacagtctctctttatataaatacacagagtttggtatgatatttaaatacatcatctggccaggcatggtggcttacgcctgtaatcctagcactttgggaggccaagacgggcggatcacctgaggtgaggagttcaagaccagcctgcccaacatagtgaaactccgtctctaccaatatacaaaaattagccgggcatgatggtggtggcctgtaatcccagctacttgggaggctgagacaggagaatcgcttgaacccaggagacggtggttgcagtgagcgaagatcgagccactgcactccagcctgggcagctgaacaagactccgtctcaaaaaaaaaaaaaaaaaaaagtcatctaatatttcgatgaaggaaatagacatttttcattgattccctctgatgtcagttagagatatttaaaaagttagatccccataatagatactattgtggaaactgaagagtagctactggcctactgatagactgaaactggttttgttattcttaacgttctccagtctgcactctgctgtgctgtctgtgctcagactagacgtgcatgccgtttcctttgcaggtgtgttctgcagctctggttttgggggatagctcttttttaagtaagattaaaaaatgaaaaatatataaatttatatagaataaatatttccattcattagagttgttaaaaggagactgaattaatattttatataaagattttgttacattatgggaggttctatcctattctgaattggagagtatatatatatatatatatatatatatttttaataaactttattaaggtgaaataatttcaagtttacatatgagtaactgaaatatttgagtaaaaaaggcaaaagtttaaatttggaatgctgtatatattagagaatatggggaatcatggtgtgaccaactgtacaaggaagattcatatgaaggtcttaggggaaaaagataattctgaagggtgaaaaaaaaatctctcccatggagattcttcacattatatggtttgacataagggtttataaggttgtttgtccaactaatgaaaatgcgcttaataaaaaattctgaccttgggtaagaattcgctttttaccgcattgccgctttcatgtacatacatgagtgcatgcacctatcaatgtgttttcttcccaacacttattaaatataaaacaacctgattttgtgctcgtttctcgtttttcttgaggccctgaagcttccaagataaatataagactaaaatttgcttgttccttcacacctgatttctcctagaaccataaatacctcctatggggaactaagaaatcatgaatactgggattttcttattggattttttacttttgttttgtggggataacgagacagaagtgaaaggaaaactggtgccggtattactgttgaaattaatgtacagtgaatgtttttaaagtattaattttaaaaaaccatgttctctagaaacaagttttaaaaatctatatgaaagttttaaaatgttccagctaactaatggataagcataccagtaaagccaaagtaaaggttagtgcctttaaaactaacctgtgttagagttacatgaatctggctctaaagtatctattttgcatccatttatatatagatcttaaacagaaatactctaggttgccacaccacagttttaagaagttatgctgctgctgttactctcttctaggattctggtggtaaagtagagaaactcggacactatattaaccttactgaaacatgctttaaatcgtgtctaaaatctgatttgagcaagtcactgccgagcttctgagtctgcattgacactgctactgactcacctctccttccctggaataaggcttcagcttccctatgctgtgaagacaccatttgtaagcactttgaacataagcactgtgtgacagcgctggatatcatgcttgggggggggcctctccctgactcccatccccataataatgagttttgtttggaattgtaataagtaatgaactgcatggtttagaaaattataaatatttgatcagctgtcctctctgaaaaaaattgcacccctttttcttttttaaaattttgttgcatcttcgtagtaatgtaattgtattttatgcctgcttttttataaaaaaataaaataaaataaatggaga

SEQ ID NO: 329743 - DNA, 2475 bp, Homo sapiens
caaggcggccggcggcgaccatggcagcgggccggcggcggccgtagtggcccaggcctgggcttcagcctcccggggccccagagggcggggcggtccgggccgcggcggtggcggcgccacttccctgctcccgcccgaggactcctgcgggcactcgctgaggaccagcggaccggcggcgcgaatctgactgaggggcggggacgccgtctgttccccgccgctcccggcagggccgggccgggccgggctgggccgggctgggccgggcgggcccctgggagcagcccccaggcgggggaccgccttggagacccgaagccggagctagaggcaggcggtgggcccgggtggagtcccggccggagctggtggttcgggggcggtgctaggccccgaggctgcgggacctgagcgcgaggagcctgagtgcgggtccagcggtggcggcatgagccggcccccgccgacggggaaaatgcccggcgcccccgagaccgcgccgggggacggggcaggcgcgagccgccagaggaagctggaggcgctgatccgagaccctcgctcccccatcaacgtggagagcttgctggatggcttaaattccttggtccttgatttagattttcctgctttgaggaaaaacaagaacatagataatttcttaaatagatatgagaaaattgtgaaaaaaatcagaggtctacagatgaaggcagaagactatgatgttgtaaaagttattggaagaggtgcttttggtgaagtgcagttggttcgtcacaaggcatcgcagaaggtttatgctatgaagcttcttagtaagtttgaaatgataaaaagatcagattctgcctttttttgggaagaaagagatattatggcctttgccaatagcccctgggtggttcagcttttttatgcctttcaagatgataggtatctgtacatggtaatggagtacatgcctggtggagaccttgtaaaccttatgagtaattatgatgtgcctgaaaaatgggccaaattttacactgctgaagttgttcttgctctggatgcaatacactccatgggtttaatacacagagatgtgaagcctgacaacatgctcttggataaacatggacatctaaaattagcagattttggcacgtgtatgaagatggatgaaacaggcatggtacattgtgatacagcagttggaacaccggattatatatcacctgaggttctgaaatcacaagggggtgatggtttctatgggcgagaatgtgattggtggtctgtaggtgttttcctttatgagatgctagtgggggatactccattttatgcggattcacttgtaggaacatatagcaaaattatggatcataagaattcactgtgtttccctgaagatgcagaaatttccaaacatgcaaagaatctcatctgtgctttcttaacagatagggaggtacgacttgggagaaatggggtggaagaaatcagacagcatcctttctttaagaatgatcagtggcattgggataacataagagaaacggcagctcctgtagtacctgaactcagcagtgacatagacagcagcaatttcgatgacattgaagatgacaaaggagatgtagaaaccttcccaattcctaaagcttttgttggaaatcagctgcctttcatcggatttacctactatagagaaaatttattattaagtgactctccatcttgtagagaaaatgattccatacaatcaaggaaaaatgaagaaagtcaaggaaagtcaagaggtatgttgatgttgtcagatatattgaaaaactgagaaaagctcatcactctcgcaaagtttaaatatagtcatatcctacctagcatttggagtactacatctacccaagagagaagttcccaacctttcttctaccaagtatctcttttattattgttctgtggatctgtttaaaatatatattatgtaattttgtttttatttatcaaggacatataactggcagcaaaaatttctgattagcatataataactggtgtgctcaaattattgtaatgcagtagtagccaaaagcaattaaacttgactagttcattagcctgtatatttttattaagggaaaacagagttttgcttaagatagatgcagtatttaaaaccatggagaacctgatcactagaaggaataatggaaagtacattgccatgggagtctaatagacctgcattgatttttgccactgcgacttattagctatgccatcttggcctgattatttaccttttttgaatttcattttctgtatcaagtagatacaatgctaccatctttgtaggatttttgttaatattaacaagacaacatttgtaaagtgcctgatattttaccaaaggcaccacaggagctcaaaaagttaaatcctttaaaaagtaaataatgttccaaaaatggatta

SEQ ID NO: 329744 - DNA, 263 bp, Homo sapiens
gaacacacaaacacgttattttagccatcagaatgatgtaattacaagtcatgtggcctcaggaaaagtacatacggtatataacgagggaatgagagttttaaaaaaaaccatggtgctcagtattatgaaaatgatttgaccttatgggttctgtggaagaacctcagagactcccagggcttcccccagaccatactttgagagctgctcgtttaaaatatgtgtaagttatttaaacctttgattcattgtcctcacag

SEQ ID NO: 329745 - DNA, 296 bp, Homo sapiens
ctgatagaaagcaagagatgggggagtttttccttttatcaatataagtcacattaaggaggtacaaatactgtaccattatagaggacattatgtttagtggaaagacaaaataagcttatcattgttttctttaagcctctcatctttaaatatgaccaaaatacgtaattacagtttcttgttttttgacagattcagaaaaaactgtatacattagaagaacatcttagcaatgagatgcaagccaaagaggaactggaacagaagtgcaagtatgttttgtagataattaa

SEQ ID NO: 329746 - DNA, 171 bp, Homo sapiens
tacttttttgataataactttaagcattatttcagattaccttacggaaaagtgtggaatcagcattaagacagttagaaagagaaaaggcgcttcttcagcacaaaaatgcagaatatcagaggaaagctgatcatgaagcagacaaaaaacgaaatttggaaaatgatg

SEQ ID NO: 329747 - DNA, 428 bp, Homo sapiens
tttttttgggaagaaagagatattatggcctttgccaatagcccctgggtggttcaggtaagcatactaacttttataagtttatttcctttttttatgagtgctttattattcatgagttgatttttgtgtgccaagtcttatgcttcatttacatggtaacagtgcagttatttttaggagatttgattcaaaacatttgtttaatgttccaaaacagtatgtccacatagatatgacatgtaatacttacttaaattgttgtatggaagcaagtattacttgcagctttttcttcttgataaagaattggcttgaataccagtatgccattgtttcatacccacttattcttgtgatttacatagtaggaacatagtaaattcattgaatcatctggaaggatatatacatattaatattccaac

SEQ ID NO: 329748 - DNA, 4719 bp, Homo sapiens
caaggcggccggcggcgaccatggcagcgggccggcggcggccgtagtggcccaggcctgggcttcagcctcccggggccccagagggcggggcggtccgggccgcggcggtggcggcgccacttccctgctcccgcccgaggactcctgcgggcactcgctgaggaccagcggaccggcggcgcgaatctgactgaggggcggggacgccgtctgttccccgccgctcccggcagggccgggccgggccgggctgggccgggctgggccgggcgggcccctgggagcagcccccaggcgggggaccgccttggagacccgaagccggagctagaggcaggcggtgggcccgggtggagtcccggccggagctggtggttcgggggcggtgctaggccccgaggctgcgggacctgagcgcgaggagcctgagtgcgggtccagcggtggcggcatgagccggcccccgccgacggggaaaatgcccggcgcccccgagaccgcgccgggggacggggcaggcgcgagccgccagaggaagctggaggcgctgatccgagaccctcgctcccccatcaacgtggagagcttgctggatggcttaaattccttggtccttgatttagattttcctgctttgaggaaaaacaagaacatagataatttcttaaatagatatgagaaaattgtgaaaaaaatcagaggtctacagatgaaggcagaagactatgatgttgtaaaagttattggaagaggtgcttttggtgaagtgcagttggttcgtcacaaggcatcgcagaaggtttatgctatgaagcttcttagtaagtttgaaatgataaaaagatcagattctgcctttttttgggaagaaagagatattatggcctttgccaatagcccctgggtggttcagcttttttatgcctttcaagatgataggtatctgtacatggtaatggagtacatgcctggtggagaccttgtaaaccttatgagtaattatgatgtgcctgaaaaatgggccaaattttacactgctgaagttgttcttgctctggatgcaatacactccatgggtttaatacacagagatgtgaagcctgacaacatgctcttggataaacatggacatctaaaattagcagattttggcacgtgtatgaagatggatgaaacaggcatggtacattgtgatacagcagttggaacaccggattatatatcacctgaggttctgaaatcacaagggggtgatggtttctatgggcgagaatgtgattggtggtctgtaggtgttttcctttatgagatgctagtgggggatactccattttatgcggattcacttgtaggaacatatagcaaaattatggatcataagaattcactgtgtttccctgaagatgcagaaatttccaaacatgcaaagaatctcatctgtgctttcttaacagatagggaggtacgacttgggagaaatggggtggaagaaatcagacagcatcctttctttaagaatgatcagtggcattgggataacataagagaaacggcagctcctgtagtacctgaactcagcagtgacatagacagcagcaatttcgatgacattgaagatgacaaaggagatgtagaaaccttcccaattcctaaagcttttgttggaaatcagctgcctttcatcggatttacctactatagagaaaatttattattaagtgactctccatcttgtagagaaaatgattccatacaatcaaggaaaaatgaagaaagtcaagagattcagaaaaaactgtatacattagaagaacatcttagcaatgagatgcaagccaaagaggaactggaacagaagtgcaaatctgttaatactcgcctagaaaaaacagcaaaggagctagaagaggagattaccttacggaaaagtgtggaatcagcattaagacagttagaaagagaaaaggcgcttcttcagcacaaaaatgcagaatatcagaggaaagctgatcatgaagcagacaaaaaacgaaatttggaaaatgatgttaacagcttaaaagatcaacttgaagatttgaaaaaaagaaatcaaaactctcaaatatccactgagaaagtgaatcaactccagagacaactggatgaaaccaatgctttactgcgaacagagtctgatactgcagcccggttaaggaaaacccaggcagaaagttcaaaacagattcagcagctggaatctaacaatagagatctacaagataaaaactgcctgctggagactgccaagttaaaacttgaaaaggaatttatcaatcttcagtcagctctagaatctgaaaggagggatcgaacccatggatcagagataattaatgatttacaaggtagaatatgtggcctagaagaagatttaaagaacggcaaaatcttactagcgaaagtagaactggagaagagacaacttcaggagagatttactgatttggaaaaggaaaaaagcaacatggaaatagatatgacataccaactaaaagttatacagcagagcctagaacaagaagaagctgaacataaggccacaaaggcacgactagcagataaaaataagatctatgagtccatcgaagaagccaaatcagaagccatgaaagaaatggagaagaagctcttggaggaaagaactttaaaacagaaagtggagaacctattgctagaagctgagaaaagatgttctctattagactgtgacctcaaacagtcacagcagaaaataaatgagctccttaaacagaaagatgtgctaaatgaggatgttagaaacctgacattaaaaatagagcaagaaactcagaagcgctgccttacacaaaatgacctgaagatgcaaacacaacaggttaacacactaaaaatgtcagaaaagcagttaaagcaagaaaataaccatctcatggaaatgaaaatgaacttggaaaaacaaaatgctgaacttcgaaaagaacgtcaggatgcagatgggcaaatgaaagagctccaggatcagctcgaagcagaacagtatttctcaaccctttataaaacacaagttagggagcttaaagaagaatgtgaagaaaagaccaaacttggtaaagaattgcagcagaagaaacaggaattacaggatgaacgggactctttggctgcccaactggagatcaccttgaccaaagcagattctgagcaactggctcgttcaattgctgaagaacaatattctgatttggaaaaagagaagatcatgaaagagctggagatcaaagagatgatggctagacacaaacaggaacttacggaaaaagatgctacaattgcttctcttgaggaaactaataggacactaactagtgatgttgccaatcttgcaaatgagaaagaagaattaaataacaaattgaaagatgttcaagagcaactgtcaagattgaaagatgaagaaataagcgcagcagctattaaagcacagtttgagaagcagctattaacagaaagaacactcaaaactcaagctgtgaataagttggctgagatcatgaatcgaaaagaacctgtcaagcgtggtaatgacacagatgtgcggagaaaagagaaggagaatagaaagctacatatggagcttaaatctgaacgtgagaaattgacccagcagatgatcaagtatcagaaagaactgaatgaaatgcaggcacaaatagctgaagagagccagattcgaattgaactgcagatgacattggacagtaaagacagtgacattgagcagctgcggtcacaactccaagccttgcatattggtctggatagttccagtataggcagtggaccaggggatgctgaggcagatgatgggtttccagaatcaagattagaaggatggctttcattgcctgtacgaaacaacactaagaaatttggatgggttaaaaagtatgtgattgtaagcagtaagaagattcttttctatgacagtgaacaagataaagaacaatccaatccttacatggttttagatatagacaagttatttcatgtccgaccagttacacagacagatgtgtatagagcagatgctaaagaaattccaaggatattccagattctgtatgccaatgaaggagaaagtaagaaggaacaagaatttccagtggagccagttggagaaaaatctaattatatttgccacaagggacatgagtttattcctactctttatcatttcccaaccaactgtgaggcttgtatgaagcccctgtggcacatgtttaagcctcctcctgctttggagtgccgccgttgccatattaagtgtcataaagatcatatggacaaaaaggaggagattatagcaccttgcaaagtatattatgatatttcaacggcaaagaatctgttattactagcaaattctacagaagagcagcagaagtgggttagtcggttggtgaaaaagatacctaaaaagcccccagctccagacccttttgcccgatcatctcctagaacttcaatgaagatacagcaaaaccagtctattagacggccaagtcgacagcttgccccaaacaaacctagctaactgccttctatgaaagcagtcattattcaaggtgatcgtattcttccagtgaaaacaagactgaaatatgatggccccatggtacccggatcctcgaa

SEQ ID NO: 329749 - DNA, 8227 bp, Homo sapiens
caaggcggccggcggcgaccatggcagcgggccggcggcggccgtagtggcccaggcctgggcttcagcctcccggggccccagagggcggggcggtccgggccgcggcggtggcggcgccacttccctgctcccgcccgaggactcctgcgggcactcgctgaggaccagcggaccggcggcgcgaatctgactgaggggcggggacgccgtctgttccccgccgctcccggcagggccgggccgggccgggctgggccgggctgggccgggcgggcccctgggagcagcccccaggcgggggaccgccttggagacccgaagccggagctagaggcaggcggtgggcccgggtggagtcccggccggagctggtggttcgggggcggtgctaggccccgaggctgcgggacctgagcgcgaggagcctgagtgcgggtccagcggtggcggcatgagccggcccccgccgacggggaaaatgcccggcgcccccgagaccgcgccgggggacggggcaggcgcgagccgccagaggaagctggaggcgctgatccgagaccctcgctcccccatcaacgtggagagcttgctggatggcttaaattccttggtccttgatttagattttcctgctttgaggaaaaacaagaacatagataatttcttaaatagatatgagaaaattgtgaaaaaaatcagaggtctacagatgaaggcagaagactatgatgttgtaaaagttattggaagaggtgcttttggtgaagtgcagttggttcgtcacaaggcatcgcagaaggtttatgctatgaagcttcttagtaagtttgaaatgataaaaagatcagattctgcctttttttgggaagaaagagatattatggcctttgccaatagcccctgggtggttcagcttttttatgcctttcaagatgataggtatctgtacatggtaatggagtacatgcctggtggagaccttgtaaaccttatgagtaattatgatgtgcctgaaaaatgggccaaattttacactgctgaagttgttcttgctctggatgcaatacactccatgggtttaatacacagagatgtgaagcctgacaacatgctcttggataaacatggacatctaaaattagcagattttggcacgtgtatgaagatggatgaaacaggcatggtacattgtgatacagcagttggaacaccggattatatatcacctgaggttctgaaatcacaagggggtgatggtttctatgggcgagaatgtgattggtggtctgtaggtgttttcctttatgagatgctagtgggggatactccattttatgcggattcacttgtaggaacatatagcaaaattatggatcataagaattcactgtgtttccctgaagatgcagaaatttccaaacatgcaaagaatctcatctgtgctttcttaacagatagggaggtacgacttgggagaaatggggtggaagaaatcagacagcatcctttctttaagaatgatcagtggcattgggataacataagagaaacggcagctcctgtagtacctgaactcagcagtgacatagacagcagcaatttcgatgacattgaagatgacaaaggagatgtagaaaccttcccaattcctaaagcttttgttggaaatcagctgcctttcatcggatttacctactatagagaaaatttattattaagtgactctccatcttgtagagaaaatgattccatacaatcaaggaaaaatgaagaaagtcaagagattcagaaaaaactgtatacattagaagaacatcttagcaatgagatgcaagccaaagaggaactggaacagaagtgcaaatctgttaatactcgcctagaaaaaacagcaaaggagctagaagaggagattaccttacggaaaagtgtggaatcagcattaagacagttagaaagagaaaaggcgcttcttcagcacaaaaatgcagaatatcagaggaaagctgatcatgaagcagacaaaaaacgaaatttggaaaatgatgttaacagcttaaaagatcaacttgaagatttgaaaaaaagaaatcaaaactctcaaatatccactgagaaagtgaatcaactccagagacaactggatgaaaccaatgctttactgcgaacagagtctgatactgcagcccggttaaggaaaacccaggcagaaagttcaaaacagattcagcagctggaatctaacaatagagatctacaagataaaaactgcctgctggagactgccaagttaaaacttgaaaaggaatttatcaatcttcagtcagctctagaatctgaaaggagggatcgaacccatggatcagagataattaatgatttacaaggtagaatatgtggcctagaagaagatttaaagaacggcaaaatcttactagcgaaagtagaactggagaagagacaacttcaggagagatttactgatttggaaaaggaaaaaagcaacatggaaatagatatgacataccaactaaaagttatacagcagagcctagaacaagaagaagctgaacataaggccacaaaggcacgactagcagataaaaataagatctatgagtccatcgaagaagccaaatcagaagccatgaaagaaatggagaagaagctcttggaggaaagaactttaaaacagaaagtggagaacctattgctagaagctgagaaaagatgttctctattagactgtgacctcaaacagtcacagcagaaaataaatgagctccttaaacagaaagatgtgctaaatgaggatgttagaaacctgacattaaaaatagagcaagaaactcagaagcgctgccttacacaaaatgacctgaagatgcaaacacaacaggttaacacactaaaaatgtcagaaaagcagttaaagcaagaaaataaccatctcatggaaatgaaaatgaacttggaaaaacaaaatgctgaacttcgaaaagaacgtcaggatgcagatgggcaaatgaaagagctccaggatcagctcgaagcagaacagtatttctcaaccctttataaaacacaagttagggagcttaaagaagaatgtgaagaaaagaccaaacttggtaaagaattgcagcagaagaaacaggaattacaggatgaacgggactctttggctgcccaactggagatcaccttgaccaaagcagattctgagcaactggctcgttcaattgctgaagaacaatattctgatttggaaaaagagaagatcatgaaagagctggagatcaaagagatgatggctagacacaaacaggaacttacggaaaaagatgctacaattgcttctcttgaggaaactaataggacactaactagtgatgttgccaatcttgcaaatgagaaagaagaattaaataacaaattgaaagatgttcaagagcaactgtcaagattgaaagatgaagaaataagcgcagcagctattaaagcacagtttgagaagcagctattaacagaaagaacactcaaaactcaagctgtgaataagttggctgagatcatgaatcgaaaagaacctgtcaagcgtggtaatgacacagatgtgcggagaaaagagaaggagaatagaaagctacatatggagcttaaatctgaacgtgagaaattgacccagcagatgatcaagtatcagaaagaactgaatgaaatgcaggcacaaatagctgaagagagccagattcgaattgaactgcagatgacattggacagtaaagacagtgacattgagcagctgcggtcacaactccaagccttgcatattggtctggatagttccagtataggcagtggaccaggggatgctgaggcagatgatgggtttccagaatcaagattagaaggatggctttcattgcctgtacgaaacaacactaagaaatttggatgggttaaaaagtatgtgattgtaagcagtaagaagattcttttctatgacagtgaacaagataaagaacaatccaatccttacatggttttagatatagacaagttatttcatgtccgaccagttacacagacagatgtgtatagagcagatgctaaagaaattccaaggatattccagattctgtatgccaatgaaggagaaagtaagaaggaacaagaatttccagtggagccagttggagaaaaatctaattatatttgccacaagggacatgagtttattcctactctttatcatttcccaaccaactgtgaggcttgtatgaagcccctgtggcacatgtttaagcctcctcctgctttggagtgccgccgttgccatattaagtgtcataaagatcatatggacaaaaaggaggagattatagcaccttgcaaagtatattatgatatttcaacggcaaagaatctgttattactagcaaattctacagaagagcagcagaagtgggttagtcggttggtgaaaaagatacctaaaaagcccccagctccagacccttttgcccgatcatctcctagaacttcaatgaagatacagcaaaaccagtctattagacggccaagtcgacagcttgccccaaacaaacctagctaactgccttctatgaaagcagtcattattcaaggtgatcgtattcttccagtgaaaacaagactgaaatatgatggcccaaaatttattaaaaagctatattttcctgagagactgatacatacactcatacatatatgtgttccccttttccctgtaatataaattacaaatctgggctcctttgaagcaacaggttgaaccaacaatgattggttgatagactaaggatatatgcaactcttccagacttttccataaagctctctcggcagtcgctcacactacagtgcacacaaggattgagaagagttaaaggctaaagaaaacatcttttctagcttcaacagagaggtttcaccagcacatttaccagaagaatctgggaatggattccactacagtgatattgactgcatctttaagaagtgaccattatactgtgtatatatatataaacacacacacatatatatatatatatagtactctaatactgcaagaaggttttttaaacttcccactttattttttatacacattaatcagatatcattacttgctgcagttgcaactatgcacttgtataaagccataatgttggagtttatatcactcattcctgtgtacctgatggaagttgcatgttcatgtttaagcagttactgtaacaagaagtttaaagttaattatatcagtttcctaatgcttcatgataggcaactttacccattttgaatgccttaatttaatttttttcaaagtctcagccctgtctgtattaaaaaacaaaaaaagcgtttaccagctcttaggatgtaaactagctttgtggaagataaatcgtgcactatttttacacataaatagttatatcaatgtcagcctattttgattaacaaatgtttttaaagtattattggttatagaaacaataatggatggtgttggaactaatatatccttgatgtctgtctattattcattcaactctttttacagacctcagtattagtctgtgactacaaaatattttatttgctttaaatttgctggctaccctagatgtgtttttattcctggtaaagacatttgtgattacattttcacacttaagattcaaaatttttcccaaatataaagaaaactaagacagactgtagatgcattttaaatatttaaatatgatcctcagacatgcagctgtgtgtggcagtattttagtaccgggttaagaaaactggcaactgggaagaagtggcctcaaaggcacttaatttgatttttattttttaaatgctgtcaaagttacagtttacgcaggacattcttgccgtattctcatgatcccagataagtgtgtgttttatactgcaacaatatgcagcaatggtaagcgtaaagtttttttttgtttttgtttttgtttttttttatattatgaagtcttttaacagtctctctttatataaatacacagagtttggtatgatatttaaatacatcatctggccaggcatggtggcttacgcctgtaatcctagcactttgggaggccaagacgggcggatcacctgaggtgaggagttcaagaccagcctgcccaacatagtgaaactccgtctctaccaatatacaaaaattagccgggcatgatggtggtggcctgtaatcccagctacttgggaggctgagacaggagaatcgcttgaacccaggagacggtggttgcagtgagcgaagatcgagccactgcactccagcctgggcagctgaacaagactccgtctcaaaaaaaaaaaaaaaaaaaagtcatctaatatttcgatgaaggaaatagacatttttcattgattccctctgatgtcagttagagatatttaaaaagttagatccccataatagatactattgtggaaactgaagagtagctactggcctactgatagactgaaactggttttgttattcttaacgttctccagtctgcactctgctgtgctgtctgtgctcagactagacgtgcatgccgtttcctttgcaggtgtgttctgcagctctggttttgggggatagctcttttttaagtaagattaaaaaatgaaaaatatataaatttatatagaataaatatttccattcattagagttgttaaaaggagactgaattaatattttatataaagattttgttacattatgggaggttctatcctattctgaattggagagtatatatatatatatatatatatatatttttaataaactttattaaggtgaaataatttcaagtttacatatgagtaactgaaatatttgagtaaaaaaggcaaaagtttaaatttggaatgctgtatatattagagaatatggggaatcatggtgtgaccaactgtacaaggaagattcatatgaaggtcttaggggaaaaagataattctgaagggtgaaagttgtttgtccaactaatgaaaatgcgcttaataaaaaattctgaccttgggtaagaattcgctttttaccgcattgccgctttcatgtacatacatgagtgcatgcacctatcaatgtgttttcttcccaacacttattaaatataaaacaacctgattttgtgctcgtttctcgtttttcttgaggccctgaagcttccaagataaatataagactaaaatttgcttgttccttcacacctgatttctcctagaaccataaatacctcctatggggaactaagaaatcatgaatactgggattttcttattggattttttacttttgttttgtggggataacgagacagaagtgaaaggaaaactggtgccggtattactgttgaaattaatgtacagtgaatgtttttaaagtattaattttaaaaaaccatgttctctagaaacaagttttaaaaatctatatgaaagttttaaaatgttccagctaactaatggataagcataccagtaaagccaaagtaaaggttagtgcctttaaaactaacctgtgttagagttacatgaatctggctctaaagtatctattttgcatccatttatatatagatcttaaacagaaatactctaggttgccacaccacagttttaagaagttatgctgctgctgttactctcttctaggattctggtggtaaagtagagaaactcggacactatattaaccttactgaaacatgctttaaatcgtgtctaaaatctgatttgagcaagtcactgccgagcttctgagtctgcattgacactgctactgactcacctctccttccctggaataaggcttcagcttccctatgctgtgaagacaccatttgtaagcactttgaacataagcactgtgtgacagcgctggatatcatgcttgggggggggcctctccctgactcccatccccataataatgagttttgtttggaattgtaataagtaatgaactgcatggtttagaaaattataaatatttgatcagctgtcctctctgaaaaaaattgcacccctttttcttttttaaaattttgttgcatcttcgtagtaatgtaattgtattttatgcctgcttttttataaaaaaataaaataaaataaatggaga

SEQ ID NO: 329750 - DNA, 8338 bp, Homo sapiens
caaggcggccggcggcgaccatggcagcgggccggcggcggccgtagtggcccaggcctgggcttcagcctcccggggccccagagggcggggcggtccgggccgcggcggtggcggcgccacttccctgctcccgcccgaggactcctgcgggcactcgctgaggaccagcggaccggcggcgcgaatctgactgaggggcggggacgccgtctgttccccgccgctcccggcagggccgggccgggccgggctgggccgggctgggccgggcgggcccctgggagcagcccccaggcgggggaccgccttggagacccgaagccggagctagaggcaggcggtgggcccgggtggagtcccggccggagctggtggttcgggggcggtgctaggccccgaggctgcgggacctgagcgcgaggagcctgagtgcgggtccagcggtggcggcatgagccggcccccgccgacggggaaaatgcccggcgcccccgagaccgcgccgggggacggggcaggcgcgagccgccagaggaagctggaggcgctgatccgagaccctcgctcccccatcaacgtggagagcttgctggatggcttaaattccttggtccttgatttagattttcctgctttgaggaaaaacaagaacatagataatttcttaaatagatatgagaaaattgtgaaaaaaatcagaggtctacagatgaaggcagaagactatgatgttgtaaaagttattggaagaggtgcttttggtgaagtgcagttggttcgtcacaaggcatcgcagaaggtttatgctatgaagcttcttagtaagtttgaaatgataaaaagatcagattctgcctttttttgggaagaaagagatattatggcctttgccaatagcccctgggtggttcagcttttttatgcctttcaagatgataggtatctgtacatggtaatggagtacatgcctggtggagaccttgtaaaccttatgagtaattatgatgtgcctgaaaaatgggccaaattttacactgctgaagttgttcttgctctggatgcaatacactccatgggtttaatacacagagatgtgaagcctgacaacatgctcttggataaacatggacatctaaaattagcagattttggcacgtgtatgaagatggatgaaacaggcatggtacattgtgatacagcagttggaacaccggattatatatcacctgaggttctgaaatcacaagggggtgatggtttctatgggcgagaatgtgattggtggtctgtaggtgttttcctttatgagatgctagtgggggatactccattttatgcggattcacttgtaggaacatatagcaaaattatggatcataagaattcactgtgtttccctgaagatgcagaaatttccaaacatgcaaagaatctcatctgtgctttcttaacagatagggaggtacgacttgggagaaatggggtggaagaaatcagacagcatcctttctttaagaatgatcagtggcattgggataacataagagaaacggcagctcctgtagtacctgaactcagcagtgacatagacagcagcaatttcgatgacattgaagatgacaaaggagatgtagaaaccttcccaattcctaaagcttttgttggaaatcagctgcctttcatcggatttacctactatagagaaaatttattattaagtgactctccatcttgtagagaaaatgattccatacaatcaaggaaaaatgaagaaagtcaagagattcagaaaaaactgtatacattagaagaacatcttagcaatgagatgcaagccaaagaggaactggaacagaagtgcaaatctgttaatactcgcctagaaaaaacagcaaaggagctagaagaggagattaccttacggaaaagtgtggaatcagcattaagacagttagaaagagaaaaggcgcttcttcagcacaaaaatgcagaatatcagaggaaagctgatcatgaagcagacaaaaaacgaaatttggaaaatgatgttaacagcttaaaagatcaacttgaagatttgaaaaaaagaaatcaaaactctcaaatatccactgagaaagtgaatcaactccagagacaactggatgaaaccaatgctttactgcgaacagagtctgatactgcagcccggttaaggaaaacccaggcagaaagttcaaaacagattcagcagctggaatctaacaatagagatctacaagataaaaactgcctgctggagactgccaagttaaaacttgaaaaggaatttatcaatcttcagtcagctctagaatctgaaaggagggatcgaacccatggatcagagataattaatgatttacaaggtagaatatgtggcctagaagaagatttaaagaacggcaaaatcttactagcgaaagtagaactggagaagagacaacttcaggagagatttactgatttggaaaaggaaaaaagcaacatggaaatagatatgacataccaactaaaagttatacagcagagcctagaacaagaagaagctgaacataaggccacaaaggcacgactagcagataaaaataagatctatgagtccatcgaagaagccaaatcagaagccatgaaagaaatggagaagaagctcttggaggaaagaactttaaaacagaaagtggagaacctattgctagaagctgagaaaagatgttctctattagactgtgacctcaaacagtcacagcagaaaataaatgagctccttaaacagaaagatgtgctaaatgaggatgttagaaacctgacattaaaaatagagcaagaaactcagaagcgctgccttacacaaaatgacctgaagatgcaaacacaacaggttaacacactaaaaatgtcagaaaagcagttaaagcaagaaaataaccatctcatggaaatgaaaatgaacttggaaaaacaaaatgctgaacttcgaaaagaacgtcaggatgcagatgggcaaatgaaagagctccaggatcagctcgaagcagaacagtatttctcaaccctttataaaacacaagttagggagcttaaagaagaatgtgaagaaaagaccaaacttggtaaagaattgcagcagaagaaacaggaattacaggatgaacgggactctttggctgcccaactggagatcaccttgaccaaagcagattctgagcaactggctcgttcaattgctgaagaacaatattctgatttggaaaaagagaagatcatgaaagagctggagatcaaagagatgatggctagacacaaacaggaacttacggaaaaagatgctacaattgcttctcttgaggaaactaataggacactaactagtgatgttgccaatcttgcaaatgagaaagaagaattaaataacaaattgaaagatgttcaagagcaactgtcaagattgaaagatgaagaaataagcgcagcagctattaaagcacagtttgagaagcagctattaacagaaagaacactcaaaactcaagctgtgaataagttggctgagatcatgaatcgaaaagaacctgtcaagcgtggtaatgacacagatgtgcggagaaaagagaaggagaatagaaagctacatatggagcttaaatctgaacgtgagaaattgacccagcagatgatcaagtatcagaaagaactgaatgaaatgcaggcacaaatagctgaagagagccagattcgaattgaactgcagatgacattggacagtaaagacagtgacattgagcagctgcggtcacaactccaagccttgcatattggtctggatagttccagtataggcagtggaccaggggatgctgaggcagatgatgggtttccagaatcaagattagaaggatggctttcattgcctgtacgaaacaacactaagaaatttggatgggttaaaaagtatgtgattgtaagcagtaagaagattcttttctatgacagtgaacaagataaagaacaatccaatccttacatggttttagatatagacaagttatttcatgtccgaccagttacacagacagatgtgtatagagcagatgctaaagaaattccaaggatattccagattctgtatgccaatgaaggagaaagtaagaaggaacaagaatttccagtggagccagttggagaaaaatctaattatatttgccacaagggacatgagtttattcctactctttatcatttcccaaccaactgtgaggcttgtatgaagcccctgtggcacatgtttaagcctcctcctgctttggagtgccgccgttgccatattaagtgtcataaagatcatatggacaaaaaggaggagattatagcaccttgcaaagtatattatgatatttcaacggcaaagaatctgttattactagcaaattctacagaagagcagcagaagtgggttagtcggttggtgaaaaagatacctaaaaagcccccagctccagacccttttgcccgatcatctcctagaacttcaatgaagatacagcaaaaccagtctattagacggccaagtcgacagcttgccccaaacaaacctagctaactgccttctatgaaagcagtcattattcaaggtgatcgtattcttccagtgaaaacaagactgaaatatgatggcccaaaatttattaaaaagctatattttcctgagagactgatacatacactcatacatatatgtgttccccttttccctgtaatataaattacaaatctgggctcctttgaagcaacaggttgaaccaacaatgattggttgatagactaaggatatatgcaactcttccagacttttccataaagctctctcggcagtcgctcacactacagtgcacacaaggattgagaagagttaaaggctaaagaaaacatcttttctagcttcaacagagaggtttcaccagcacatttaccagaagaatctgggaatggattccactacagtgatattgactgcatctttaagaagtgaccattatactgtgtatatatatataaacacacacacatatatatatatatatagtactctaatactgcaagaaggttttttaaacttcccactttattttttatacacattaatcagatatcattacttgctgcagttgcaactatgcacttgtataaagccataatgttggagtttatatcactcattcctgtgtacctgatggaagttgcatgttcatgtttaagcagttactgtaacaagaagtttaaagttaattatatcagtttcctaatgcttcatgataggcaactttacccattttgaatgccttaatttaatttttttcaaagtctcagccctgtctgtattaaaaaacaaaaaaagcgtttaccagctcttaggatgtaaactagctttgtggaagataaatcgtgcactatttttacacataaatagttatatcaatgtcagcctattttgattaacaaatgtttttaaagtattattggttatagaaacaataatggatggtgttggaactaatatatccttgatgtctgtctattattcattcaactctttttacagacctcagtattagtctgtgactacaaaatattttatttgctttaaatttgctggctaccctagatgtgtttttattcctggtaaagacatttgtgattacattttcacacttaagattcaaaatttttcccaaatataaagaaaactaagacagactgtagatgcattttaaatatttaaatatgatcctcagacatgcagctgtgtgtggcagtattttagtaccgggttaagaaaactggcaactgggaagaagtggcctcaaaggcacttaatttgatttttattttttaaatgctgtcaaagttacagtttacgcaggacattcttgccgtattctcatgatcccagataagtgtgtgttttatactgcaacaatatgcagcaatggtaagcgtaaagtttttttttgtttttgtttttgtttttttttatattatgaagtcttttaacagtctctctttatataaatacacagagtttggtatgatatttaaatacatcatctggccaggcatggtggcttacgcctgtaatcctagcactttgggaggccaagacgggcggatcacctgaggtgaggagttcaagaccagcctgcccaacatagtgaaactccgtctctaccaatatacaaaaattagccgggcatgatggtggtggcctgtaatcccagctacttgggaggctgagacaggagaatcgcttgaacccaggagacggtggttgcagtgagcgaagatcgagccactgcactccagcctgggcagctgaacaagactccgtctcaaaaaaaaaaaaaaaaaaaagtcatctaatatttcgatgaaggaaatagacatttttcattgattccctctgatgtcagttagagatatttaaaaagttagatccccataatagatactattgtggaaactgaagagtagctactggcctactgatagactgaaactggttttgttattcttaacgttctccagtctgcactctgctgtgctgtctgtgctcagactagacgtgcatgccgtttcctttgcaggtgtgttctgcagctctggttttgggggatagctcttttttaagtaagattaaaaaatgaaaaatatataaatttatatagaataaatatttccattcattagagttgttaaaaggagactgaattaatattttatataaagattttgttacattatgggaggttctatcctattctgaattggagagtatatatatatatatatatatatatatttttaataaactttattaaggtgaaataatttcaagtttacatatgagtaactgaaatatttgagtaaaaaaggcaaaagtttaaatttggaatgctgtatatattagagaatatggggaatcatggtgtgaccaactgtacaaggaagattcatatgaaggtcttaggggaaaaagataattctgaagggtgaaaaaaaaatctctcccatggagattcttcacattatatggtttgacataagggtttataaggttgtttgtccaactaatgaaaatgcgcttaataaaaaattctgaccttgggtaagaattcgctttttaccgcattgccgctttcatgtacatacatgagtgcatgcacctatcaatgtgttttcttcccaacacttattaaatataaaacaacctgattttgtgctcgtttctcgtttttcttgaggccctgaagcttccaagataaatataagactaaaatttgcttgttccttcacacctgatttctcctagaaccataaatacctcctatggggaactaagaaatcatgaatactgggattttcttattggattttttacttttgttttgtggggataacgagacagaagtgaaaggaaaactggtgccggtattactgttgaaattaatgtacagtgaatgtttttaaagtattaattttaaaaaaccatgttctctagaaacaagttttaaaaatctatatgaaagttttaaaatgttccagctaactaatggataagcataccagtaaagccaaagtaaaggttagtgcctttaaaactaacctgtgttagagttacatgaatctggctctaaagtatctattttgcatccatttatatatagatcttaaacagaaatactctaggttgccacaccacagttttaagaagttatgctgctgctgttactctcttctaggattctggtggtaaagtagagaaactcggacactatattaaccttactgaaacatgctttaaatcgtgtctaaaatctgatttgagcaagtcactgccgagcttctgagtctgcattgacactgctactgactcacctctccttccctggaataaggcttcagcttccctatgctgtgaagacaccatttgtaagcactttgaacataagcactgtgtgacagcgctggatatcatgcttgggggggggcctctccctgactcccatccccataataatgagttttgtttggaattgtaataagtaatgaactgcatggtttagaaaattataaatatttgatcagctgtcctctctgaaaaaaattgcacccctttttcttttttaaaattttgttgcatcttcgtagtaatgtaattgtattttatgcctgcttttttataaaaaaataaaataaaataaatggagaggcggccgaaaccccacgatatataacaccaacccgggggaaaacaaaaaca

SEQ ID NO: 329751 - DNA, 4569 bp, Homo sapiens
ttttgcattgcataactttttactactgatcctgtactattactgtatcctagatgatgtatagtgataaattctaaaggatatattttatttgttttataaatttcatattaaaattttattaagttctttgttatctaaggagaattgttatctttagcctcacatgttgtgcttatttgtagaatcaagattagaaggatggctttcattgcctgtacgaaacaacactaagaaatttggatgggttaaaaagtatgtgattgtaagcagtaagaagattcttttctatgacagtgaacaagataaagaacaatccaatccttacatggttttagatatagacaagttatttcatgtccgaccagttacacagacagatgtgtatagagcagatgctaaagaaattccaaggatattccagattctgtatgccaatgaaggagaaagtaagaaggaacaagaatttccagtggagccagttggagaaaaatctaattatatttgccacaagggacatgagtttattcctactctttatcatttcccaaccaactgtgaggcttgtatgaagcccctgtggcacatgtttaagcctcctcctgctttggagtgccgccgttgccatattaagtgtcataaagatcatatggacaaaaaggaggagattatagcaccttgcaaagtatattatgatatttcaacggcaaagaatctgttattactagcaaattctacagaagagcagcagaagtgggttagtcggttggtgaaaaagatacctaaaaagcccccagctccagacccttttgcccgatcatctcctagaacttcaatgaagatacagcaaaaccagtctattagacggccaagtcgacagcttgccccaaacaaacctagctaactgccttctatgaaagcagtcattattcaaggtgatcgtattcttccagtgaaaacaagactgaaatatgatggcccaaaatttattaaaaagctatattttcctgagagactgatacatacactcatacatatatgtgttccccttttccctgtaatataaattacaaatctgggctcctttgaagcaacaggttgaaccaacaatgattggttgatagactaaggatatatgcaactcttccagacttttccataaagctctctcggcagtcgctcacactacagtgcacacaaggattgagaagagttaaaggctaaagaaaacatcttttctagcttcaacagagaggtttcaccagcacatttaccagaagaatctgggaatggattccactacagtgatattgactgcatctttaagaagtgaccattatactgtgtatatatatataaacacacacacatatatatatatatatagtactctaatactgcaagaaggttttttaaacttcccactttattttttatacacattaatcagatatcattacttgctgcagttgcaactatgcacttgtataaagccataatgttggagtttatatcactcattcctgtgtacctgatggaagttgcatgttcatgtttaagcagttactgtaacaagaagtttaaagttaattatatcagtttcctaatgcttcatgataggcaactttacccattttgaatgccttaatttaatttttttcaaagtctcagccctgtctgtattaaaaaacaaaaaaagcgtttaccagctcttaggatgtaaactagctttgtggaagataaatcgtgcactatttttacacataaatagttatatcaatgtcagcctattttgattaacaaatgtttttaaagtattattggttatagaaacaataatggatggtgttggaactaatatatccttgatgtctgtctattattcattcaactctttttacagacctcagtattagtctgtgactacaaaatattttatttgctttaaatttgctggctaccctagatgtgtttttattcctggtaaagacatttgtgattacattttcacacttaagattcaaaatttttcccaaatataaagaaaactaagacagactgtagatgcattttaaatatttaaatatgatcctcagacatgcagctgtgtgtggcagtattttagtaccgggttaagaaaactggcaactgggaagaagtggcctcaaaggcacttaatttgatttttattttttaaatgctgtcaaagttacagtttacgcaggacattcttgccgtattctcatgatcccagataagtgtgtgttttatactgcaacaatatgcagcaatggtaagcgtaaagtttttttttgtttttgtttttgtttttttttatattatgaagtcttttaacagtctctctttatataaatacacagagtttggtatgatatttaaatacatcatctggccaggcatggtggcttacgcctgtaatcctagcactttgggaggccaagacgggcggatcacctgaggtgaggagttcaagaccagcctgcccaacatagtgaaactccgtctctaccaatatacaaaaattagccgggcatgatggtggtggcctgtaatcccagctacttgggaggctgagacaggagaatcgcttgaacccaggagacggtggttgcagtgagcgaagatcgagccactgcactccagcctgggcagctgaacaagactccgtctcaaaaaaaaaaaaaaaaaaaagtcatctaatatttcgatgaaggaaatagacatttttcattgattccctctgatgtcagttagagatatttaaaaagttagatccccataatagatactattgtggaaactgaagagtagctactggcctactgatagactgaaactggttttgttattcttaacgttctccagtctgcactctgctgtgctgtctgtgctcagactagacgtgcatgccgtttcctttgcaggtgtgttctgcagctctggttttgggggatagctcttttttaagtaagattaaaaaatgaaaaatatataaatttatatagaataaatatttccattcattagagttgttaaaaggagactgaattaatattttatataaagattttgttacattatgggaggttctatcctattctgaattggagagtatatatatatatatatatatatatatttttaataaactttattaaggtgaaataatttcaagtttacatatgagtaactgaaatatttgagtaaaaaaggcaaaagtttaaatttggaatgctgtatatattagagaatatggggaatcatggtgtgaccaactgtacaaggaagattcatatgaaggtcttaggggaaaaagataattctgaagggtgaaaaaaaaatctctcccatggagattcttcacattatatggtttgacataagggtttataaggttgtttgtccaactaatgaaaatgcgcttaataaaaaattctgaccttgggtaagaattcgctttttaccgcattgccgctttcatgtacatacatgagtgcatgcacctatcaatgtgttttcttcccaacacttattaaatataaaacaacctgattttgtgctcgtttctcgtttttcttgaggccctgaagcttccaagataaatataagactaaaatttgcttgttccttcacacctgatttctcctagaaccataaatacctcctatggggaactaagaaatcatgaatactgggattttcttattggattttttacttttgttttgtggggataacgagacagaagtgaaaggaaaactggtgccggtattactgttgaaattaatgtacagtgaatgtttttaaagtattaattttaaaaaaccatgttctctagaaacaagttttaaaaatctatatgaaagttttaaaatgttccagctaactaatggataagcataccagtaaagccaaagtaaaggttagtgcctttaaaactaacctgtgttagagttacatgaatctggctctaaagtatctattttgcatccatttatatatagatcttaaacagaaatactctaggttgccacaccacagttttaagaagttatgctgctgctgttactctcttctaggattctggtggtaaagtagagaaactcggacactatattaaccttactgaaacatgctttaaatcgtgtctaaaatctgatttgagcaagtcactgccgagcttctgagtctgcattgacactgctactgactcacctctccttccctggaataaggcttcagcttccctatgctgtgaagacaccatttgtaagcactttgaacataagcactgtgtgacagcgctggatatcatgcttgggggggggcctctccctgactcccatccccataataatgagttttgtttggaattgtaataagtaatgaactgcatggtttagaaaattataaatatttgatcagctgtcctctctgaaaaaaattgcacccctttttcttttttaaaattttgttgcatcttcgtagtaatgtaattgtattttatgcctgcttttttataaaaaaataaaataaaataaatggaga

SEQ ID NO: 329752 - DNA, 704 bp, Homo sapiens
cccccacccgcccctctctctgcagtcaagccaagccagaccccgcagccgaaggacaagtgaagcagccccctgagcctcacaaggacctcctggctggtgaggagggggccgcgccaggctcccaggcctccacagagtcttcagcgcatcccccaacagcagcccctgccagtccctcgggtccaggcaaggccctgggggtctccttaaatgccacctcgggcaagtcccagtcccagtcctcggccacccccagctctggatcccagggccagctgccctctggctctggctgtggctcccgcctgtccggcagggcccagggccagcgtcgggcacagggcagctcccactggtctcggcaacacacccagccgcctggtacttcctccagcccctcccagtcagccctcccgtcctcggggcccctgcagccacccaacgtcacctccagcccggtctcacccatggtccagtctcccagcagcagcaacatccccacgcagccccccagcaagtcctctggcaagccggaggacgcagcccccaagaccagcggacagcgccagaaggaatcgtcgaaacagcctgccagcagcgcctcagtgcccgagctggtcccctgccattccgggacctctctggagtacacttcggagtccaccaccgagatcacctgcagctggccacaccacaggccc

SEQ ID NO: 329753 - DNA, 1531 bp, Homo sapiens
ctcccggcggggtctgggcagcggcggccgtggcggagggctatgcggcgggggagacggggcaggcccctcctcctttgtccgccctgccctcccattggtcctagcggggggccgggggcggacaccggcgcggggccggagcatcgcggctcaggctgcgggaaagcggtgcgcgtgcagcggggtgggtgccctggtccgcgggcgagctcgagcagccaaccccgggcgcgtcggggccatggacggcctgaggcagcgcgtggagcacttcctggagcaaaggaacctggtcaccgaagtgctgggggcgctggaggccaagaccggggtggagaagcggtatctggctgcaggagccgtcactctgctaagcctgtatctgctgttcggctacggagcgtctctgctgtgcaatctcatcggatttgtgtaccccgcatatgcctcaatcaaagctatcgagagcccaagcaaggacgacgacactgtgtggctcacctactgggtggtgtacgccctgtttgggctggccgagttcttcagcgatctactcctgtcctggttccctttctactacgtgggcaagtgcgccttcctgttgttctgcatggctcccaggccctggaacggggctctcatgctgtatcagcgcgtcgtgcgtccgctgttcctaaggcaccacggggccgtagacagaatcatgaacgacctcagcgggcgagccctggacgcggcggccggaataaccaggaacgtcaagccaagccagaccccgcagccgaaggacaagtgaagcagccccctgagcctcacaaggacctcctggctggtgaggagggggccgcgccaggctcccaggcctccacagagtcttcagcgcatcccccaacagcagcccctgccagtccctcgggtccaggcaaggccctgggggtctccttaaatgccacctcgggcaagtcccagtcccagtcctcggccacccccagctctggatcccagggccagctgccctctggctctggctgtggctcccgcctgtccggcagggcccagggccagcgtcgggcacagggcagctcccactggtctcggcaacacacccagccgcctggtacttcctccagcccctcccagtcagccctcccgtcctcggggcccctgcagccacccaacgtcacctccagcccggtctcacccatggtccagtctcccagcagcagcaacatccccacgcagccccccagcaagtcctctggcaagccggaggacgcagcccccaagaccagcggacagcgccagaaggaatcgtcgaaacagcctgccagcagcgcctcagtgcccgagctggtcccctgccattccgggacctctctggagtacacttcggagtccaccaccgagatcacctgcagctggccacaccacaggcccccgtgcctgcagcactactggtgcctgaaacacctggcctgctaggaggctccaataaagctaacccggacaaagacctgtgtgccacgtg

SEQ ID NO: 329754 - DNA, 146 bp, Homo sapiens
gggagatgcaggtgggagctatggagaaaagagctccagaaatctgcaaaagggtgcccttgagtctttgctgaggactaaatccttagaatggaattcagaggacacatcctatgaaaagggggacacatccttagaatgaaatt

SEQ ID NO: 329755 - DNA, 1656 bp, Homo sapiens
ttttagtaaacagaatattatcaaacaatttattttggctttattgaaaaaagagtatttggtctaaatgtgccaccataggtgttaaattctcctatctgcaattgtctttatcctatattgtgttcatttcttttcttaataatttactttgttgtgtgtttctacactttcatccctgttttttatcttgtatatcatcaggaaattgtgatttaatcattaacattggtttttttgtgtgtgtggtaaaaatcaacactaggctcatggtacatatttttattctgtacatttgcttgtaactatcaatttgtaactctgtttatctactacatgtgtatatatacttagagcattttctctaacacattttaatgttagtattttttaaaaggtctgaccagtctagcaaattgtcagtccaacgtcattactttaaattaagaagcagtcttcttctggtaaaccttgttggtatttgtaaaataattttgaaggtcttaatttcttcctttgtaaaaggaaaaggttttttttaaagtttttaggttggcatggaggcagaagttggtgattacttgatttacaacagattttttccagatcatacaaaaggccatacagtaagtatagaagtaggtatggggagggcttactaatatcaaataggcaaggccttagtgagtgggcaggataccacctgagagtggccagatctggggaggttactctgctctgggtgctctcattcatgaatcgacaaggatacattagattattttgaaacatttttttaagaagcagaattctttaataattccttcctagacattgaatatacttataaaattaaagacttggggaaggagacactgagagacttgccagtttggttcctcatgaacaaaagaggacagtttgataactaccagaatagaatatccctagttttaaaatagtgagaatctctgaagttcatcaacatcttaagatgcacttacttgaaagtttgagattctgtttatcatttgaaaacacattttgctttaattctttctttgacatgttgttttttcatatcaagaaatatatgaacaaaataataaccttttgaccctgaccttgctgggtgaattagctctgaaacactctctacaaccagtaatgcatttgtcccacatttcattctgatagaaaatgaacaccatagcaccaaacaaaaatccgaggcgttagataatgtctggattaaataatttaagactctctaggattttggttgtcattttttatttataacagactttaagtcactttctgttgcctcataggtcacattttagacaggtttgtgtctgttccttgcatctgaattcctgattgtaaagacacctatgaggtctcttagtttttgtcattcattttcttggtttatcacccctcccttctttttgttgtttttccctgactgttaagcagtttcatctttgcttttgttaaatatttgacagcagttagtttgtgttaagctcttgaaacttgtgattgtactttctgtgtagatatacatgtaattattttttatttttcaatcatagattcaagcttccttcttttttaccacaaatcattaaagttatttgtgtttccata

SEQ ID NO: 329756 - DNA, 2393 bp, Homo sapiens
  misc_feature (2356)..(2356): n is a, c, g, or t
ttttagtaaacagaatattatcaaacaatttattttggctttattgaaaaaagagtatttggtctaaatgtgccaccataggtgttaaattctcctatctgcaattgtctttatcctatattgtgttcatttcttttcttaataatttactttgttgtgtgtttctacactttcatccctgttttttatcttgtatatcatcaggaaattgtgatttaatcattaacattggtttttttgtgtgtgtggtaaaaatcaacactaggctcatggtacatatttttattctgtacatttgcttgtaactatcaatttgtaactctgtttatctactacatgtgtatatatacttagagcattttctctaacacattttaatgttagtattttttaaaaggtctgaccagtctagcaaattgtcagtccaacgtcattactttaaattaagaagcagtcttcttctggtaaaccttgttggtatttgtaaaataattttgaaggtcttaatttcttcctttgtaaaaggaaaaggttttttttaaagtttttaggttggcatggaggcagaagttggtgattacttgatttacaacagattttttccagatcatacaaaaggccatacagtaagtatagaagtaggtatggggagggcttactaatatcaaataggcaaggccttagtgagtgggcaggataccacctgagagtggccagatctggggaggttactctgctctgggtgctctcattcatgaatcgacaaggatacattagattattttgaaacatttttttaagaagcagaattctttaataattccttcctagacattgaatatacttataaaattaaagacttggggaaggagacactgagagacttgccagtttggttcctcatgaacaaaagaggacagtttgataactaccagaatagaatatccctagttttaaaatagtgagaatctctgaagttcatcaacatcttaagatgcacttacttgaaagtttgagattctgtttatcatttgaaaacacattttgctttaattctttctttgacatgttgttttttcatatcaagaaatatatgaacaaaataataaccttttgaccctgaccttgctgggtgaattagctctgaaacactctctacaaccagtaatgcatttgtcccacatttcattctgatagaaaatgaacaccatagcaccaaacaaaaatccgaggcgttagataatgtctggattaaataatttaagactctctaggattttggttgtcattttttatttataacagactttaagtcactttctgttgcctcataggtcacattttagacaggtttgtgtctgttccttgcatctgaattcctgattgtaaagacacctatgaggtctcttagtttttgtcattcattttcttggtttatcacccctcccttctttttgttgtttttccctgactgttaagcagtttcatctttgcttttgttaaatatttgacagcagttagtttgtgttaagctcttgaaacttgtgattgtactttctgtgtagatatacatgtaattattttttatttttcaatcatagattcaagcttccttcttttttaccacaaatcattaaagttatttgtgtttccataaaaaaaaaaaaaaaaaaaaaaaaaaaaaaaaaaaaaaaaaaaaaaaaaaaaaaaaaaaaaaaaaaaaaaaaaaaaaaagaagagagagaaagaaaacaaaataaatatataattataatatgaaggagggggcgcgacgcatgatatagatgatgtcgcgtggttgtggttgtggtgggggggtggtccccgtcattgtggttgttgttattattgtgtgcgtcgcgacgagcgtgcttcttatttatatatatctaagtgaggagcatcggggcggaagtagattgtgttcatagtagaaggagacggagatctttgtgtagagaagaagagaagctcaagattagtaatgtgaatagagcgatagtaagagaaagaaagtagagtgggaggaaataataaagttattagaaataagagcagaaatatatataacatacgacagatcaccacagacggcgagatacatacaaccttagcgacaatcatgacacaagcgagacgagagcgaggacagagagagagagaggagcaataacaacaaacaacaacgaggagagcgagagaatagagtagcagagaggagagagaacagagcaaaaagagagagtaggtgaggcgcgccggcaactgagggagacaacaggacagaaaaagaaagagaaaaccaaaaataactacacaacaacccaaccggganaggacataacgagaaaccaaaaaaaaagaaagcaagg

SEQ ID NO: 329757 - DNA, 892 bp, Homo sapiens
ggacgcgtgggtgacccacgcgtccgatttttttaagaagcagaattctttaataattccttcctagacattgaatatacttataaaattaaagacttggggaaggagacactgagagacttgccagtttggttcctcatgaacaaaagaggacagtttgataactaccagaatagaatatccctagttttaaaatagtgagaatctctgaagttcatcaacatcttaagatgcacttacttgaaagtttgagattctgtttatcatttgaaaacacattttgctttaattctttctttgacatgttgttttttcatatcaagaaatatatgaacaaaataataaccttttgaccctgaccttgctgggtgaattagctctgaaacactctctacaaccagtaatgcatttgtcccacatttcattctgatagaaaatgaacaccatagcaccaaacaaaaatccgaggcgttagataatgtctggattaaataatttaagactctctaggattttggttgtcattttttatttataacagactttaagtcactttctgttgcctcataggtcacattttagacaggtttgtgtctgttccttgcatctgaattcctgattgtaaagacacctatgaggtctcttagtttttgtcattcattttcttggtttatcacccctcccttctttttgttgtttttccctgactgttaagcagtttcatctttgcttttgttaaatatttgacagcagttagtttgtgttaagctcttgaaacttgtgattgtactttctgtgtagatatacatgtaattattttttatttttcaatcatagattcaagcttccttcttttttaccacaaatcattaaagttatttgtgtttccata

SEQ ID NO: 329758 - DNA, 337 bp, Homo sapiens
cgcagaggcaccaaagggtctttgtcaacattccttttttctttttcttgtttttggttatcccaaggctctgtcatctgtctctgtccgcattctatctggagagcatggttggctggagcagctcccgctctaaaacactcactctggcttccttctccttcctccagccctgcccaacttgggctcctctgactgccccatctttgctgggttccatgaggctttgccctgtgacaacctctcctcggggtccttgttgccctgcctcagtcgtgctgctgtgcccattctcctggcccggccagggctggcaagaccagctgcctcctctgag

SEQ ID NO: 329759 - DNA, 632 bp, Homo sapiens
tgtagaaaatttaggcagtcctcaacctctctaggtatgctgaattaaaaaaaaaaaagaatgacatttttaattcccatggcaaatggagttctcctctttcttctgttcctcttcttcaccttgcaatgactgtcattttgtaaaactttctctctgtctctgtctctcttactcacacatacactcacaatgttccttaatatcttctaatcctgaatttcctttctcaatttgtttagttagatcttcactagaaataagtattagaaattgggaaaagtttatactggttgtattagggttctccaaataaacagaactattaggagatggatagatagatagatacattgattgatagatgacagatagatgaatggatggataggtggataataggctggtagatgatagatggatgatagacagattagatagatagatagatagataatagattagatgatagacagaaagaataagagatttattatgaagaattggcttacgtgattatgggaggctgcaaagtcccagtatctgtgagctgcagatccatgatatagttcactttgagtccaaaggccagagaatcacgggagctgatggtacaaaccacagttcaagaa

SEQ ID NO: 329760 - DNA, 652 bp, Homo sapiens
tgtagaaaatttaggcagtcctcaacctctctaggtatgctgaattaaaaaaaaaaaagaatgacatttttaattcccatggcaaatggagttctcctctttcttctgttcctcttcttcaccttgcaatgactgtcattttgtaaaactttctctctgtctctgtctctcttactcacacatacactcacaatgttccttaatatcttctaatcctgaatttcctttctcaatttgtttagttagatcttcactagaaataagtattagaaattgggaaaagtttatactggttgtattagggttctccaaataaacagaactattaggagatggatagatagatagatacattgattgatagatgacagatagatgaatggatggataggtggataataggctggtagatgatagatggatgatagacagattagatagatagatagatagatagatagatagatagatagataatagattagatgatagacagaaagaataagagatttattatgaagaattggcttacgtgattatgggaggctgcaaagtcccagtatctgtgagctgcagatccatgatatagttcactttgagtccaaaggccagagaatcacgggagctgatggtacaaaccacagttcaagaa

SEQ ID NO: 329761 - DNA, 2334 bp, Homo sapiens
gcggccgcgccacctgcggcggcggcggcggcctcgggcgggtgggggcagcgctcccgctccgcccccggcccccgctgcccgcgtcccctgccaggcccctcctcccggcggcgcggcagagccaggccccagcgctcggccggccgcgagcccgccggccggggacgagcgtcgcagctcatgctgatcgctgtcctcctcctccccctcaggcggcgctggcggcggccctgggacccgcggaagccggcatgctggagaagctggagttcgaggacgaagcagtagaagactcagaaagtggtgtttacatgcgattcatgaggtcacacaagtgttatgacatcgttccaaccagttcaaagcttgttgtctttgatactacattacaagttaaaaaggccttctttgctttggtagccaacggtgtccgagcagcgccactgtgggagagtaaaaaacaaagttttgtaggaatgctaacaattacagatttcataaatatactacatagatactataaatcacctatggtacagatttatgaattagaggaacataaaattgaaacatggagggagctttatttacaagaaacatttaagcctttagtgaatatatctccagatgcaagcctcttcgatgctgtatactccttgatcaaaaataaaatccacagattgcccgttattgaccctatcagtgggaatgcactttatatacttacccacaaaagaatcctcaagttcctccagctttttatgtctgatatgccaaagcctgccttcatgaagcagaacctggatgagcttggaataggaacgtaccacaacattgccttcatacatccagacactcccatcatcaaagccttgaacatatttgtggaaagacgaatatcagctctgcctgttgtggatgagtcaggaaaagttgtagatatttattccaaatttgatgtaattaatcttgctgctgagaaaacatacaataacctagatatcacggtgacccaggcccttcagcaccgttcacagtattttgaaggtgttgtgaagtgcaataagctggaaatactggagaccatcgtggacagaatagtaagagctgaggtccatcggctggtggtggtaaatgaagcagatagtattgtgggtattatttccctgtcggacattctgcaagccctgatcctcacaccagcaggtgccaaacaaaaggagacagaaacggagtgaccgccgtgaatgtagacgccctaggaggagaacttgaacaaagtctctgggtcacgttttgcctcatgaacactggctgcaagtggttaagaatgtatatcagggtttaacgataggtatttcttccagtgatgttgaaattaagcttaaaaaagaaagattttatgtgcttgaagattcaggcttgcattaaaagactgttttcagacctttgtctgaaggattttaaatgctgtatgtcattaaagtgcactgtgtcctgaagttttcattatttttcatttcaaagaattcactggtatggaacaggtgatgtggcataaggtgagtgcacggtatgttcagatcacagtgccttatgtccgaatacagcaatatgtcaccgccgcagccggggcgcacgcgtgtgaaacaacaccgagcttgaatgtggaagtctttgaaccttttaccaaatcagtttgttttctttagatttgtcaaaaagttgtaatttgaatataaataattactttaaaattgtaatgacacttttacacgtaagtgttttgttctgggctaccgtgtcaacgaggctgctttacaacagctttatttatttttactttcatgcaatttttttacacatcttttggtggagtaaacttcaccacatccatgaataaactctcagttattttgaaatggcaaatttctcattatttaagtttggatctggaaaggacatgacttctgaaatagccgctgctgggttttaaaagctgaggtctctcaaagtgtggaggagacgttgccgtcaggcgggagccaagtgccgggaagatgtctattttttttcttgtgtattgaaatgtaaaatcatgatgtttgttatgactgctgatgcgattgtttttgtaaattttattgtggcatatacagtattgtcatacagttgaagagaaacaatgtttcctaatgtaagtgctctgaaaatgttgacactgtatatatatatatgaggatagtttgtttttttttgttttgggttttttttttttcagattgaaaaattaaaataaatcctactatctaccattttgttaaaaaaaaa

SEQ ID NO: 329762 - DNA, 2893 bp, Homo sapiens
gcggctccagtccgaaggcagcggccgggggagggaaggaggggaccgaacccccgaggagtttcgcagaatcaacttctggttagagttatgggaagcgcggttatggacaccaagaagaaaaaagatgtttccagccccggcgggagcggcggcaagaaaaatgccagccagaagaggcgttcgctgcgcgtgcacattccggacctgagctccttcgccatgccgctcctggacggagacctggagggttccggaaagcattcctctcgaaaggtggacagccccttcggcccgggcagcccctccaaagggttcttctccagaggcccccagccccggccctccagccccatgtctgcacctgtgaggcccaagaccagccccggctctcccaaaaccgtgttcccgttctcctaccaggagtccccgccacgctcccctcgacgcatgagcttcagtgggatcttccgctcctcctccaaagagtcttcccccaactccaaccctgctacctcgcccgggggcatcaggtttttctcccgctccagaaaaacctccggcctctcctcctctccgtcaacacccacccaagtgaccaagcagcacacgtttcccctggaatcctataagcacgagcctgaacggttagagaatcgcatctatgcctcgtcttcccccccggacacagggcagaggttctgcccgtcttccttccagagcccgaccaggcctccactggcatcaccgacacactatgctccctccaaagccgcggcgctggcggcggccctgggacccgcggaagccggcatgctggagaagctggagttcgaggacgaagcagtagaagactcagaaagtggtgtttacatgcgattcatgaggtcacacaagtgttatgacatcgttccaaccagttcaaagcttgttgtctttgatactacattacaagttaaaaaggccttctttgctttggtagccaacggtgtccgagcagcgccactgtgggagagtaaaaaacaaagttttgtaggaatgctaacaattacagatttcataaatatactacatagatactataaatcacctatggtacagatttatgaattagaggaacataaaattgaaacatggagggagctttatttacaagaaacatttaagcctttagtgaatatatctccagatgcaagcctcttcgatgctgtatactccttgatcaaaaataaaatccacagattgcccgttattgaccctatcagtgggaatgcactttatatacttacccacaaaagaatcctcaagttcctccagctttttatgtctgatatgccaaagcctgccttcatgaagcagaacctggatgagcttggaataggaacgtaccacaacattgccttcatacatccagacactcccatcatcaaagccttgaacatatttgtggaaagacgaatatcagctctgcctgttgtggatgagtcaggaaaagttgtagatatttattccaaatttgatgtaattaatcttgctgctgagaaaacatacaataacctagatatcacggtgacccaggcccttcagcaccgttcacagtattttgaaggtgttgtgaagtgcaataagctggaaatactggagaccatcgtggacagaatagtaagagctgaggtccatcggctggtggtggtaaatgaagcagatagtattgtgggtattatttccctgtcggacattctgcaagccctgatcctcacaccagcaggtgccaaacaaaaggagacagaaacggagtgaccgccgtgaatgtagacgccctaggaggagaacttgaacaaagtctctgggtcacgttttgcctcatgaacactggctgcaagtggttaagaatgtatatcagggtttaacgataggtatttcttccagtgatgttgaaattaagcttaaaaaagaaagattttatgtgcttgaagattcaggcttgcattaaaagactgttttcagacctttgtctgaaggattttaaatgctgtatgtcattaaagtgcactgtgtcctgaagttttcattatttttcatttcaaagaattcactggtatggaacaggtgatgtggcataaggtgagtgcacggtatgttcagatcacagtgccttatgtccgaatacagcaatatgtcaccgccgcagccggggcgcacgcgtgtgaaacaacaccgagcttgaatgtggaagtctttgaaccttttaccaaatcagtttgttttctttagatttgtcaaaaagttgtaatttgaatataaataattactttaaaattgtaatgacacttttacacgtaagtgttttgttctgggctaccgtgtcaacgaggctgctttacaacagctttatttatttttactttcatgcaatttttttacacatcttttggtggagtaaacttcaccacatccatgaataaactctcagttattttgaaatggcaaatttctcattatttaagtttggatctggaaaggacatgacttctgaaatagccgctgctgggttttaaaagctgaggtctctcaaagtgtggaggagacgttgccgtcaggcgggagccaagtgccgggaagatgtctattttttttcttgtgtattgaaatgtaaaatcatgatgtttgttatgactgctgatgcgattgtttttgtaaattttattgtggcatatacagtattgtcatacagttgaagagaaacaatgtttcctaatgtaagtgctctgaaaatgttgacactgtatatatatatatgaggatagtttgtttttttttgttttgggttttttttttttcagattgaaaaattaaaataaatcctactatctaccattttgttaaaaaaaaa

SEQ ID NO: 329763 - DNA, 2717 bp, Homo sapiens
ttcaggacttcctctttcaggcccggcttgcaagagcgctagggccaagctcctttcagccctaatcggtactggagctaatcgcattcgcggcgcccgtgcactctgcagggatgggccgtggggccagggacctcagtcccctctcggcctgtcctgcccttccaggaggctagcggctgctggccgcgcagcctgccaacctgagttggccatagtagagtctcagatacccagctcctgagcggccagggccagattcagggtgtgtacgtttttggcagcggctccccaaccgagaagacactcggctgcgaagagaggacgcgaattaagagttccatgctggaaaaaaaaaaatggatagcgacaaagtgcatctacaatacgtgtagcccacggaacgatttttgttaagggggccgaggatgggcagttacatctaaaatttggaaagggaagaggaaagcgagaaaggatcccctagctggcgccccggggcgttctgcagcctccagcccctctccccctccccgcgccgcggagcccacacctgcgcaggtggagcctgccgagcgcggccgccggtgctgggaaggcggcgctggcggcggccctgggacccgcggaagccggcatgctggagaagctggagttcgaggacgaagcagtagaagactcagaaagtggtgtttacatgcgattcatgaggtcacacaagtgttatgacatcgttccaaccagttcaaagcttgttgtctttgatactacattacaagttaaaaaggccttctttgctttggtagccaacggtgtccgagcagcgccactgtgggagagtaaaaaacaaagttttgtaggaatgctaacaattacagatttcataaatatactacatagatactataaatcacctatggtacagatttatgaattagaggaacataaaattgaaacatggagggagctttatttacaagaaacatttaagcctttagtgaatatatctccagatgcaagcctcttcgatgctgtatactccttgatcaaaaataaaatccacagattgcccgttattgaccctatcagtgggaatgcactttatatacttacccacaaaagaatcctcaagttcctccagctttttatgtctgatatgccaaagcctgccttcatgaagcagaacctggatgagcttggaataggaacgtaccacaacattgccttcatacatccagacactcccatcatcaaagccttgaacatatttgtggaaagacgaatatcagctctgcctgttgtggatgagtcaggaaaagttgtagatatttattccaaatttgatgtaattaatcttgctgctgagaaaacatacaataacctagatatcacggtgacccaggcccttcagcaccgttcacagtattttgaaggtgttgtgaagtgcaataagctggaaatactggagaccatcgtggacagaatagtaagagctgaggtccatcggctggtggtggtaaatgaagcagatagtattgtgggtattatttccctgtcggacattctgcaagccctgatcctcacaccagcaggtgccaaacaaaaggagacagaaacggagtgaccgccgtgaatgtagacgccctaggaggagaacttgaacaaagtctctgggtcacgttttgcctcatgaacactggctgcaagtggttaagaatgtatatcagggtttaacgataggtatttcttccagtgatgttgaaattaagcttaaaaaagaaagattttatgtgcttgaagattcaggcttgcattaaaagactgttttcagacctttgtctgaaggattttaaatgctgtatgtcattaaagtgcactgtgtcctgaagttttcattatttttcatttcaaagaattcactggtatggaacaggtgatgtggcataaggtgagtgcacggtatgttcagatcacagtgccttatgtccgaatacagcaatatgtcaccgccgcagccggggcgcacgcgtgtgaaacaacaccgagcttgaatgtggaagtctttgaaccttttaccaaatcagtttgttttctttagatttgtcaaaaagttgtaatttgaatataaataattactttaaaattgtaatgacacttttacacgtaagtgttttgttctgggctaccgtgtcaacgaggctgctttacaacagctttatttatttttactttcatgcaatttttttacacatcttttggtggagtaaacttcaccacatccatgaataaactctcagttattttgaaatggcaaatttctcattatttaagtttggatctggaaaggacatgacttctgaaatagccgctgctgggttttaaaagctgaggtctctcaaagtgtggaggagacgttgccgtcaggcgggagccaagtgccgggaagatgtctattttttttcttgtgtattgaaatgtaaaatcatgatgtttgttatgactgctgatgcgattgtttttgtaaattttattgtggcatatacagtattgtcatacagttgaagagaaacaatgtttcctaatgtaagtgctctgaaaatgttgacactgtatatatatatatgaggatagtttgtttttttttgttttgggttttttttttttcagattgaaaaattaaaataaatcctactatctaccattttgttaaaaaaaaa

SEQ ID NO: 329764 - DNA, 2115 bp, Homo sapiens
gcggccgcgccacctgcggcggcggcggcggcctcgggcgggtgggggcagcgctcccgctccgcccccggcccccgctgcccgcgtcccctgccaggcccctcctcccggcggcgcggcagagccaggccccagcgctcggccggccgcgagcccgccggccggggacgagcgtcgcagctcatgctgatcgctgtcctcctcctccccctcaggcggcgctggcggcggccctgggacccgcggaagccggcatgctggagaagctggagttcgaggacgaagcagtagaagactcagaaagtggtgtttacatgcgattcatgaggtcacacaagtgttatgacatcgttccaaccagttcaaagcttgttgtctttgatactacattacaagttaaaaaggccttctttgctttggtagccaacggtgtccgagcagcgccactgtgggagagtaaaaaacaaagttttgtaggaatgctaacaattacagatttcataaatatactacatagatactataaatcacctatggtacagatttatgaattagaggaacataaaattgaaacatggagggagctttatttacaagaaacatttaagcctttagtgaatatatctccagatgcaagcctcttcgatgctgtatactccttgatcaaaaataaaatccacagattgcccgttattgaccctatcagtgggaatgcactttatatacttacccacaaaagaatcctcaagttcctccagctttttatgtctgatatgccaaagcctgccttcatgaagcagaacctggatgagcttggaataggagcgatctctaaaagtttgttgaattgaattgaatggaaaagtcctggtatcataggtgaatccaataaactggtccatcggctggtggtggtaaatgaagcagatagtattgtgggtattatttccctgtcggacattctgcaagccctgatcctcacaccagcaggtgccaaacaaaaggagacagaaacggagtgaccgccgtgaatgtagacgccctaggaggagaacttgaacaaagtctctgggtcacgttttgcctcatgaacactggctgcaagtggttaagaatgtatatcagggtttaacgataggtatttcttccagtgatgttgaaattaagcttaaaaaagaaagattttatgtgcttgaagattcaggcttgcattaaaagactgttttcagacctttgtctgaaggattttaaatgctgtatgtcattaaagtgcactgtgtcctgaagttttcattatttttcatttcaaagaattcactggtatggaacaggtgatgtggcataaggtgagtgcacggtatgttcagatcacagtgccttatgtccgaatacagcaatatgtcaccgccgcagccggggcgcacgcgtgtgaaacaacaccgagcttgaatgtggaagtctttgaaccttttaccaaatcagtttgttttctttagatttgtcaaaaagttgtaatttgaatataaataattactttaaaattgtaatgacacttttacacgtaagtgttttgttctgggctaccgtgtcaacgaggctgctttacaacagctttatttatttttactttcatgcaatttttttacacatcttttggtggagtaaacttcaccacatccatgaataaactctcagttattttgaaatggcaaatttctcattatttaagtttggatctggaaaggacatgacttctgaaatagccgctgctgggttttaaaagctgaggtctctcaaagtgtggaggagacgttgccgtcaggcgggagccaagtgccgggaagatgtctattttttttcttgtgtattgaaatgtaaaatcatgatgtttgttatgactgctgatgcgattgtttttgtaaattttattgtggcatatacagtattgtcatacagttgaagagaaacaatgtttcctaatgtaagtgctctgaaaatgttgacactgtatatatatatatgaggatagtttgtttttttttgttttgggttttttttttttcagattgaaaaattaaaataaatcctactatctaccattttgttaaaaaaaaa

SEQ ID NO: 329765 - DNA, 2588 bp, Homo sapiens
  misc_feature (2074)..(2074): n is a, c, g, or t
  misc_feature (2077)..(2078): n is a, c, g, or t
  misc_feature (2081)..(2082): n is a, c, g, or t
  misc_feature (2089)..(2089): n is a, c, g, or t
  misc_feature (2106)..(2106): n is a, c, g, or t
  misc_feature (2111)..(2113): n is a, c, g, or t
  misc_feature (2116)..(2118): n is a, c, g, or t
  misc_feature (2121)..(2121): n is a, c, g, or t
  misc_feature (2135)..(2136): n is a, c, g, or t
  misc_feature (2143)..(2144): n is a, c, g, or t
  misc_feature (2146)..(2146): n is a, c, g, or t
  misc_feature (2151)..(2152): n is a, c, g, or t
  misc_feature (2157)..(2157): n is a, c, g, or t
  misc_feature (2163)..(2163): n is a, c, g, or t
  misc_feature (2167)..(2167): n is a, c, g, or t
  misc_feature (2169)..(2169): n is a, c, g, or t
  misc_feature (2470)..(2470): n is a, c, g, or t
  misc_feature (2475)..(2476): n is a, c, g, or t
  misc_feature (2484)..(2486): n is a, c, g, or t
  misc_feature (2491)..(2491): n is a, c, g, or t
  misc_feature (2499)..(2499): n is a, c, g, or t
  misc_feature (2516)..(2516): n is a, c, g, or t
  misc_feature (2523)..(2523): n is a, c, g, or t
  misc_feature (2540)..(2541): n is a, c, g, or t
  misc_feature (2549)..(2550): n is a, c, g, or t
  misc_feature (2559)..(2560): n is a, c, g, or t
  misc_feature (2563)..(2563): n is a, c, g, or t
  misc_feature (2570)..(2571): n is a, c, g, or t
gcggccgcgccacctgcggcggcggcggcggcctcgggcgggtgggggcagcgctcccgctccgcccccggcccccgctgcccgcgtcccctgccaggcccctcctcccggcggcgcggcagagccaggccccagcgctcggccggccgcgagcccgccggccggggacgagcgtcgcagctcatgctgatcgctgtcctcctcctccccctcaggcggcgctggcggcggccctgggacccgcggaagccggcatgctggagaagctggagttcgaggacgaagcagtagaagactcagaaagtggtgtttacatgcgattcatgaggtcacacaagtgttatgacatcgttccaaccagttcaaagcttgttgtctttgatactacattacaagttaaaaaggccttctttgctttggtagccaacggtgtccgagcagcgccactgtgggagagtaaaaaacaaagttttgtaggaatgctaacaattacagatttcataaatatactacatagatactataaatcacctatggtacagatttatgaattagaggaacataaaattgaaacatggaggggtaagcactattggatgtttaaaatcttttagtatcgggaaagctatgtttagtatgaaaagtatgttttcattttgcagatccttttctctctgctccataaaatgttatataaaacattctctttatttctgttaattttgatagtatgctactgtactaaagctgaacaatataagtattgtcccttctgtttatagacatgtataggacaccttcagcaggcaaggccttatcctagggccaggaatgtgaagatgaatgagctaaccaagccccacctcgctgcccacaatggggccaccgctcactactaagtctaagccctcagagatttgccttggtattaagaaatgcatcagaggcatgcctaacttgaaccaaagcaagcatctgttcttatttaaacctagtaattgtttctttacaaattgtggagaaacttaggacaaatgaacctcaaactagatggtttggagcaaatagcatggaagtaatttgaagaccatattctcttcattgtcacattgacattcaccctgtaaaatcatgatactcttttctgccatagaaccatttcttaaattcgcatttcatgattgtaaggtggtggtctcactgacacttgtcatggtgggttggtggagaggaccgggggtgggaatcacggcagacccagtctgtctgcaacagcggagcctttggagggtgctcaaggaaacactggtagaaatggagggaccaactgaaggaaaattttgaattcaaaattgaagagtttggttctgtgtttcccataatatgcttgataggagaagcaacctttgtaactggctgtgaaatcagaatacatcttggagttctcttacacccccaggggccctttcaaatccatacgatttagaagtttcactgagtgatgggtttggtttattacggctttgtcaaaccaagctaaacaaatttggcatgggatctgtacagtctgttgtgcagtgattgtgtaacaccagcttcttgtccagttctactgtacaagtactgatagaccaaggtttaagtatgtttacgttttgacattacatgatattttgtagtaataataatgccaaaatattcttaaacgccttctgtatagaaactttggtaaagcaaggccaggtgcggtggctcacacctgtaatcccagcactttgggaggccaaagcaggtggatcacttgagatcaggagttcaagaccagcctgaccaacatggtgaaaccctctctctactaaaaatacaaaattagagccaggcgcagtagctcacgcctataatcccagcactttgggaagccgaggcgggtggatcacctgaggtcaggagttcgagaccagcctagccaacatggtgaaaccctgtctctactaaaaatacaaaaaagtagccaggcgtggtggtgcgcacctgtactcccagctactcgggaggctgaggcaggagactcgcntgnnccnnggaggcngaggttgcagtgagccnagatnnngcnnntgnactccagcctgggnnacagagnnanactcnntctcnaaaaanaaananaaccatactcttaggaagttttaccaaagattttgtaaatatcctgtatttatttcccatgaagtgtattatttcttcaatattaccaatgcaagtgaacacgggctttccttatagtggtcatatctctgcttttgaactagcaaaatcagcatgagtgtgatttttgaatagatagatttctgtgaaatgcagcaaatcccatataagaaatcttagcagtagaatatgaaatcaaaattgcaaaaaagcagttatgtctaaatatgcagcccaaagtttttcttaatatctgtagatnaggcnnggcacagnnnctcangcctgtantcccagcactttgggangctgagnaggtggatcacttgagnncaggagtnngagaccagnnggncaacatnntgaaaccccatctctac

SEQ ID NO: 329766 - DNA, 364 bp, Homo sapiens
atcacttgaggtcaggagttcgagacgagcttagccaacatggtgaaaccctgtttctaccaaaaatacaaaaattagccgggcatggtggcacatgcctgtcatcccagctactcgggaggctgaggtgagagaatcaattgagcccaggaagcagaggttgctgtgagccaagatggtgccactgcactccagcctgggcaacagagtgaaaccttgtctcaaaaaaaaaaggtatttttcttcctggactttgaaagtatgttttgtttctcctctttttcttcaggttaaaaaggccttctttgctttggtagccaacggtgtccgagcagcgccactgtgggagagtaaaaaacaaagt

SEQ ID NO: 329767 - DNA, 545 bp, Homo sapiens
aataaaatccacagattgcccgttattgaccctatcagtgggaatgcactttatatacttacccacaaaagaatcctcaagttcctccagctttttgtaagtagtttttagcgtttctaaagacataattgcatttacttattaaataatgtacttcaagtaaattggctcctgttaccctcagtagaagaaattgttagttttgaggtctccctttctaaacttcagtttctcaacttactactctctgaattgtacattcttaaagttgattccaatttaaaagaatcaccttttagtgcaagtatcaaaacaattttaacaacaaaactcggcattctctctttaaattaaaacatttgtcaccagcatatgaggggaaataaggcaatctgcaagtctaattgaggactgttgtacaagataaactgaactaatatctagagcaaaaattgctttatgttgcttttactggtgtcatggttttagaaacatgttccaaaaaatgctttcctcaagattatcttataaactgcagcagtgat

SEQ ID NO: 329768 - DNA, 509 bp, Homo sapiens
ccttgttccccagggagcttgttgagaaggtccgttgctgcagcatttctagccctgtggcactcaccaccctttacagatgtcagcccaccttgccagagatttcatccatgcatggtagagagcattagagggtaaaaattggggggcagtctttggcaggatatactgtcaaagtttaacaatgttgcttcgtaaggaaggtagaccttgtaacatggttatctttaattgtgattgatatgttgacaaaataacagtagcaatggcatgtcgtaagccagaaagaacgtctgatgtatgcaggtactaaattcagataagcattaaagtttttagaaatcaggctctcttaagctcactaattttggtcattgaagtgaactgaaatgaaaggatataatttattctcttgcttcattacagaatcttgctgctgagaaaacatacaataacctagatatcacggtgacccaggcccttcagcaccgttcacagtattttgaagg

SEQ ID NO: 329769 - DNA, 1964 bp, Homo sapiens
acgcatcgagctcggcaccctacaagttaaaaaggccttctttgctttggtagccaacggtgtccgagcagcgccactgtgggagagtaaaaaacaaagttttgtaggaatgctaacaattacagatttcataaatatactacatagatactataaatcacctatggtacagatttatgaattagaggaacataaaattgaaacatggagggagctttatttacaagaaacatttaagcctttagtgaatatatctccagatgcaagcctcttcgatgctgtatactccttgatcaaaaataaaatccacagattgcccgttattgaccctatcagtgggaatgcactttatatacttacccacaaaagaatcctcaagttcctccagctttttatgtctgatatgccaaagcctgccttcatgaagcagaacctggatgagcttggaataggaacgtaccacaacattgccttcatacatccagacactcccatcatcaaagccttgaacatatttgtggaaagacgaatatcagctctgcctgttgtggatgagtcaggaaaagttgtagatatttattccaaatttgatgtaattaatcttgctgctgagaaaacatacaataacctagatatcacggtgacccaggcccttcagcaccgttcacagtattttgaaggtgttgtgaagtgcaataagctggaaatactggagaccatcgtggacagaatagtaagagctgaggtccatcggctggtggtggtaaatgaagcagatagtattgtgggtattatttccctgtcggacattctgcaagccctgatcctcacaccagcaggtgccaaacaaaaggagacagaaacggagtgaccgccgtgaatgtagacgccctaggaggagaacttgaacaaagtctctgggtcacgttttgcctcatgaacactggctgcaagtggttaagaatgtatatcagggtttaacgataggtatttcttccagtgatgttgaaattaagcttaaaaaagaaagattttatgtgcttgaagattcaggcttgcattaaaagactgttttcagacctttgtctgaaggattttaaatgctgtatgtcattaaagtgcactgtgtcctgaagttttcattatttttcatttcaaagaattcactggtatggaacaggtgatgtggcataaggtgagtgcacggtatgttcagatcacagtgccttatgtccgaatacagcaatatgtcaccgccgcagccggggcgcacgcgtgtgaaacaacaccgagcttgaatgtggaagtctttgaaccttttaccaaatcagtttgttttctttagatttgtcaaaaagttgtaatttgaatataaataattactttaaaattgtaatgacacttttacacgtaagtgttttgttctgggctaccgtgtcaacgaggctgctttacaacagctttatttatttttactttcatgcaatttttttacacatcttttggtggagtaaacttcaccacatccatgaataaactctcagttattttgaaatggcaaatttctcattatttaagtttggatctggaaaggacatgacttctgaaatagccgctgctgggttttaaaagctgaggtctctcaaagtgtggaggagacgttgccgtcaggcgggagccaagtgccgggaagatgtctattttttttcttgtgtattgaaatgtaaaatcatgatgtttgttatgactgctgatgcgattgtttttgtaaattttattgtggcatatacagtattgtcatacagttgaagagaaacaatgtttcctaatgtaagtgctctgaaaatgttgacactgtatatatatatatgaggatagtttgtttttttttgttttgggttttttttttttcagattgaaaaattaaaataaatcctactatctaccattttgttaaaaaaaaa

SEQ ID NO: 329770 - DNA, 1841 bp, Homo sapiens
gcggccgcgccacctgcggcggcggcggcggcctcgggcgggtgggggcagcgctcccgctccgcccccggcccccgctgcccgcgtcccctgccaggcccctcctcccggcggcgcggcagagccaggccccagcgctcggccggccgcgagcccgccggccggggacgagcgtcgcagctcatgctgatcgctgtcctcctcctccccctcaggcggcgctggcggcggccctgggacccgcggaagccggcatgctggagaagctggagttcgaggacgaagcagtagaagactcagaaagtggtgtttacatgcgattcatgaggtcacacaagtgttatgacatcgttccaaccagttcaaagcttgttgtctttgatactacattacaagttaaaaaggccttctttgctttggtagccaacggtgtccgagcagcgccactgtgggagagtaaaaaacaaagttttgtaggaatgctaacaattacagatttcataaatatactacatagatactataaatcacctatggtacagatttatgaattagaggaacataaaattgaaacatggagggagctttatttacaagaaacatttaagcctttagtgaatatatctccagatgcaagcctcttcgatgctgtatactccttgatcaaaaataaaatccacagattgcccgttattgaccctatcagtgggaatgcactttatatacttacccacaaaagaatcctcaagttcctccagctttttatgtctgatatgccaaagcctgccttcatgaagcagaacctggatgagcttggaataggaacgtaccacaacattgccttcatacatccagacactcccatcatcaaagccttgaacatatttgtggaaagacgaatatcagctctgcctgttgtggatgagtcaggaaaagttgtagatatttattccaaatttgatgtaattaatcttgctgctgagaaaacatacaataacctagatatcacggtgacccaggcccttcagcaccgttcacagtattttgaaggtgttgtgaagtgcaataagctggaaatactggagaccatcgtggacagaatagtaagagctgaggtccatcggctggtggtggtaaatgaagcagatagtattgtgggtattatttccctgtcggacattctgcaagccctgatcctcacaccagcaggtgccaaacaaaaggagacagaaacggagtgaccgccgtgaatgtagacgccctaggaggagaacttgaacaaagtctctgggtcacgttttgcctcatgaacactggctgcaagtggttaagaatgtatatcagggtttaacgataggtatttcttccagtgatgttgaaattaagcttaaaaaagaaagattttatgtgcttgaagattcaggcttgcattaaaagactgttttcagacctttgtctgaaggattttaaatgctgtatgtcattaaagtgcactgtgtcctgaagttttcattatttttcatttcaaagaattcactggtatggaacaggtgatgtggcataaggtgagtgcacggtatgttcagatcacagtgccttatgtccgaatacagcaatatgtcaccgccgcagccggggcgcacgcgtgtgaaacaacaccgagcttgaatgtggaagtctttgaaccttttaccaaatcagtttgttttctttagatttgtcaaaaagttgtaatttgaatataaataattactttaaaattgtaatgacacttttacacgtaagtgttttgttctgggctgccttgggcggctgccattgggcacggctgccattggtgt

SEQ ID NO: 329771 - DNA, 544 bp, Homo sapiens
cctcagacatcatctaaaaggactggacctacatctgcagttaactgcacaatggaagaaacggcctctcctgggcagcctcatggatggggtgaagagacaaagcttgggagtgtagcatgttgagcacatctgctcagaggtaacatttaagcatttaggttgtctccaagcataaaaatggaaatactgatcctgtgacaacacagcctgaattttctgctttgcagatgccagatttatttttaaatggtgtgaatcaaatctgtgctgagaggccaacttcaaaatataaaagaaaaattggcaatgggaggattgtgctggtttggctgaaatgaagtgctctacggcatttcattctagtggagcgtctgactgtgaaaatccttccaattgtaattttctttggcttgtcaaaagaggattatgaactaaagtcagtgttgcaggaaatgtcacctgtcctttgaaagaaaataataaatcaaaatggcttttgttcatcatgtttaaaatgaaaaaaaaaaaaaagttgatccac

SEQ ID NO: 329772 - DNA, 2162 bp, Homo sapiens
cctgcggcaaagaaccgggctgtgtccaaagtgttctctggaagttgtagttcctgtattggtgaggcaaggaggaggcggagtgactcggcggccattagctgtgtgtagttgcccgggactaggagcttaagtgaagaggtacgccttgttcggtggaaatcagccgtagccatgagtttctgccggggctagccctagagtacggagcaggcggacttttcggttccccgccccgccaggtggcggggcctactaggcctccgggcatccccggtctcaagtaggcctcatctgccggcaagggcgcccgaaacgcgggaggcgccatgtcgctggttgcttacgccagcagcgatgagagcgagccggatgaggctgagcccgagccggaggaagaggaggcggtggctcctacatctgggcccgctttagggggcttgttcgcttctctccctgcgcccaagggtccggccttgctgcctccgccccctcagatgctggcgccagcctttcccccgccgctgttgcttcccccacccaccggagaccccaggcttcagcctcctccccccttgcccttcggcctgggaggcttccccccacctccaggcgtgagcccggctgaagcggcgggagttggggagggactgggattggggttgccctcgccccgaggccctggcctcaatctgccccctccaattggcggtgccggtcccccgctggggcttcccaagccaaagaagaggaaagagcccgtgaagatcgcggcgccggagttgcataagggagattcagattctgaggaagatgaacccacaaagaagaaaactatccttcagggatccagtgaggggactggtttgtctgccttgcttccccaacctaaaaacctgactgtgaaagagactaacaggttgctcctgccccatgccttctcccgcaaaccctcggatggctcccctgatactaagccctccagactggcttctaagaccaagacttcctctcttgcccctgttgtgggcaccacaaccaccactccgtcgccctctgctatcaaggctgctgccaagagtgctgccctgcaggtgacaaagcagatcacgcaggaagaagacgacagtgatgaggaagtagcccccgaaaactttttctccctccctgaaaaggctgagccacctggagttgagccatacccttaccccatccccactgtccctgaagagctgcctccaggcacggaaccagagccggctttccaggacgatgcagccaatgccccccttgaattcaagatggcagcaggttcaagtggggccccttggatgcctaagcctggggacgactacagctacaatcagttttccacatatggcgatgccaatgccgctggtgcttattatcaggattattacagtggtggctactatcctgcacaggacccggccctggtccccccccaggaaattgccccagatgcctccttcatcgatgacgaagcatttaagcggctgcagggcaagaggaaccgagggagagaagaaatcaactttgtggagatcaaaggtgatgaccagctcagtggggcccagcaatggatgactaagtcattgacagaagagaaaaccatgaagtcattcagcaaaaagaaaggtgagcagccaacaggccagcagcggcggaaacaccagatcacatatcttattcatcaggccaaggagcgggagctggaactgaagaacacctggtcagagaacaagctcagccgccgtcagacccaagccaaatatggattctagggctctggaactgattgctcccaggatctcctgccagcccagctggcctggcccccagcttcacctctgggaccccagctgctctaagcccaggatctctttccccaaggacccagccctcgcctctgcgagaatgaacatatttgatagatttttcttaacaagttagaaaattcagctcctttctgtcctggagctagcaaagacttgtgtgatgcctccgaaggggctctgagttctggggtgggagttttgctctctgtcaggtgtgataaaatgttgaaccctccccaccaccacttttttttttttaaaccagggatgtctgttgaaataaaacattcagtctgacaaaca

SEQ ID NO: 329773 - DNA, 669 bp, Homo sapiens
cctgcggcaaagaaccgggctgtgtccaaagtgttctctggaagttgtagttcctgtattggtgaggcaaggaggaggcggagtgactcggcggccattagctgtgtgtagttgcccgggactaggagcttaagtgaagaggtacgccttgttcggtggaaatcagccgtagccatgagtttctgccggggctagccctagagtacggagcaggcggacttttcggttccccgccccgccaggtggcggggcctactaggcctccgggcatccccggtctcaagtaggcctcatctgccggcaagggcgcccgaaacgcgggaggcgccatgtcgctggttgcttacgccagcagcgatgagagcgagccggatgaggctgagcccgagccggaggaagaggaggcggtggctcctacatctgggcccgctttagggggcttgttcgcttctctccctgcgcccaagggtccggccttgctgcctccgccccctcagatgctggcgccagcctttcccccggcgtttgtgctcccatcaggctacatctatatcattactggaaccgagttttcatttgcacattcaccttacatgtttaagggcctaaccaatcctgggaagttttactgtgtcctttaccttttattggttaaggctttttactttg

SEQ ID NO: 329774 - DNA, 2335 bp, Homo sapiens
cctgcggcaaagaaccgggctgtgtccaaagtgttctctggaagttgtagttcctgtattggtgaggcaaggaggaggcggagtgactcggcggccattagctgtgtgtagttgcccgggactaggagcttaagtgaagaggtacgccttgttcggtggaaatcagccgtagccatgagtttctgccggggctagccctagagtacggagcaggcggacttttcggttccccgccccgccaggtggcggggcctactaggcctccgggcatccccggtctcaagtaggcctcatctgccggcaagggcgcccgaaacgcgggaggcgccatgtcgctggttgcttacgccagcagcgatgagagcgagccggatgaggctgagcccgagccggaggaagaggaggcggtggctcctacatctgggcccgctttagggggcttgttcgcttctctccctgcgcccaagggtccggccttgctgcctccgccccctcagatgctggcgccagcctttcccccgccgctgttgcttcccccacccaccggagaccccaggcttcagcctcctccccccttgcccttcggcctgggaggcttccccccacctccaggcgtgagcccggctgaagcggcgggagttggggagggactgggattggggttgccctcgccccgaggccctggcctcaatctgccccctccaattggcggtgccggtcccccgctggggcttcccaagccaaagaagaggaaagagcccgtgaagatcgcggcgccggagttgcataagggagattcagattctgaggaagatgaacccacaaagaagaaaactatccttcagggatccagtgaggggactggtttgtctgccttgcttccccaacctaaaaacctgactgtgaaagagactaacaggttgctcctgccccatgccttctcccgcaaaccctcggatggctcccctgatactaagccctccagactggcttctaagaccaagacttcctctcttgcccctgttgtgggcaccacaaccaccactccgtcgccctctgctatcaaggctgctgccaagagtgctgccctgcaggtgacaaagcagatcacgcaggaagaagacgacagtgatgaggaagtagcccccgaaaactttttctccctccctgaaaaggctgagccacctggagttgagccatacccttaccccatccccactgtccctgaagagctgcctccaggcacggaaccagagccggctttccaggacgatgcagccaatgccccccttgaattcaagatggcagcaggttcaagtggggccccttggatgcctaagcctggggacgactacagctacaatcagttttccacatatggcgatgccaatgccgctggtgcttattatcaggattattacagtggtggctactatcctgcacaggacccggccctggtccccccccaggaaattgccccagatgcctccttcatcgatgacgaagcatttaagcggctgcagggcaagaggaaccgagggagagaagaaatcaactttgtggagatcaaaggtgatgaccagctcagtggggcccagcaatggatgactaagtcattgacagaagagaaaaccatgaagtcattcagcaaaaagaaaggtgagcagccaacaggccagcagcggcggaaacaccagatcacatatcttattcatcaggccaaggagcgggagctggaactgaagaacacctggtcagagaacaagctcagccgccgtcagacccaagccaaatatggattctagggctctggaactgattgctcccaggatctcctgccagcccagctggcctggcccccagcttcacctctgggaccccagctgctctaagcccaggatctctttccccaaggacccagccctcgcctctgcgagaatgaacatatttgatagatttttcttaacaagttagaaaattcagctcctttctgtcctggagctagcaaagacttgtgtgatgcctccgaaggggctctgagttctggggtgggagttttgctctctgtcaggtgtgataaaatgttgaaccctccccaccaccacttttttttttttaaaccagggatgtctgttgaaataaaacattcagtctgacaaacaaaaaagatacaagacaaagcaaccgagagaacaacaaacaaagcgggcggggcgacaaaaaagttccaccgggggggggcccaatttacggcggcacccagtttttcttggcaaaaagggggggcccaaaagaggggctattaaaacaagagcaggggcggtgttacacaccg

SEQ ID NO: 329775 - DNA, 2426 bp, Homo sapiens
cctgcggcaaagaaccgggctgtgtccaaagtgttctctggaagttgtagttcctgtattggtgaggcaaggaggaggcggagtgactcggcggccattagctgtgtgtagttgcccgggactaggagcttaagtgaagaggtacgccttgttcggtggaaatcagccgtagccatgagtttctgccggggctagccctagagtacggagcaggcggacttttcggttccccgccccgccaggtggcggggcctactaggcctccgggcatccccggtctcaagtaggcctcatctgccggcaagggcgcccgaaacgcgggaggcgccatgtcgctggttgcttacgccagcagcgatgagagcgagccggatgaggctgagcccgagccggaggaagaggaggcggtggctcctacatctgggcccgctttagggggcttgttcgcttctctccctgcgcccaagggtccggccttgctgcctccgccccctcagatgctggcgccagcctttcccccgccgctgttgcttcccccacccaccggagaccccaggcttcagcctcctccccccttgcccttcggcctgggaggcttccccccacctccaggcgtgagcccggctgaagcggcgggagttggggagggactgggattggggttgccctcgccccgaggccctggcctcaatctgccccctccaattggcggtgccggtcccccgctggggcttcccaagccaaagaagaggaaagagcccgtgaagatcgcggcgccggagttgcataagggagattcagattctgaggaagatgaacccacaaagaagaaaactatccttcagggatccagtgaggggactggtttgtctgccttgcttccccaacctaaaaacctgactgtgaaagagactaacaggttgctcctgccccatgccttctcccgcaaaccctcggatggctcccctgatactaagccctccagactggcttctaagaccaagacttcctctcttgcccctgttgtgggcaccacaaccaccactccgtcgccctctgctatcaaggctgctgccaagagtgctgccctgcaggtgacaaagcagatcacgcaggaagaagacgacagtgatgaggaagtagcccccgaaaactttttctccctccctgaaaaggctgagccacctggagttgagccatacccttaccccatccccactgtccctgaagagctgcctccaggcacggaaccagagccggctttccaggacgatgcagccaatgccccccttgaattcaagatggcagcaggttcaagtggggccccttggatgcctaagcctggggacgactacagctacaatcagttttccacatatggcgatgccaatgccgctggtgcttattatcaggattattacagtggtggctactatcctgcacaggacccggccctggtccccccccaggaaattgccccagatgcctccttcatcgatgacgaagcatttaagcggctgcagggcaagaggaaccgagggagagaagaaatcaactttgtggagatcaaaggtgatgaccagctcagtggggcccagcaatggatgactaagtcattgacagaagagaaaaccatgaagtcattcagcaaaaagaaaggtgagcagccaacaggccagcagcggcggaaacaccagatcacatatcttattcatcaggccaaggagcgggagctggaactgaagaacacctggtcagagaacaagctcagccgccgtcagacccaagccaaatatggattctagggctctggaactgattgctcccaggatctcctgccagcccagctggcctggcccccagcttcacctctgggaccccagctgctctaagcccaggatctctttccccaaggacccagccctcgcctctgcgagaatgaacatatttgatagatttttcttaacaagttagaaaattcagctcctttctgtcctggagctagcaaagacttgtgtgatgcctccgaaggggctctgagttctggggtgggagttttgctctctgtcaggtgtgataaaatgttgaaccctccccaccaccacttttttttttttaaaccagggatgtctgttgaaataaaacattcagtctgacaaacaaaaaacaaaaaaaaaaacaaacaaaaaaacaacaaaaaaaaaaaaacacaaaaaaaaaaaaacaaaaaacacacctcaaaaaaagagaaaaaaaacaacacgcaaaagcaaacgggggagggcgcctaccacggcgaccccacgagtgacagaaacacgaaacggagacagcgaagaacacaaagcaacgaagagaagaagccacaagaaacggacaaatgacacacaagcaaagagaagaagaaaaaaacaggagcgagaaag

SEQ ID NO: 329776 - DNA, 2258 bp, Homo sapiens
cctgcggcaaagaaccgggctgtgtccaaagtgttctctggaagttgtagttcctgtattggtgaggcaaggaggaggcggagtgactcggcggccattagctgtgtgtagttgcccgggactaggagcttaagtgaagaggtacgccttgttcggtggaaatcagccgtagccatgagtttctgccggggctagccctagagtacggagcaggcggacttttcggttccccgccccgccaggtggcggggcctactaggcctccgggcatccccggtctcaagtaggcctcatctgccggcaagggcgcccgaaacgcgggaggcgccatgtcgctggttgcttacgccagcagcgatgagagcgagccggatgaggctgagcccgagccggaggaagaggaggcggtggctcctacatctgggcccgctttagggggcttgttcgcttctctccctgcgcccaagggtccggccttgctgcctccgccccctcagatgctggcgccagcctttcccccgccgctgttgcttcccccacccaccggagaccccaggcttcagcctcctccccccttgcccttcggcctgggaggcttccccccacctccaggcgtgagcccggctgaagcggcgggagttggggagggactgggattggggttgccctcgccccgaggccctggcctcaatctgccccctccaattggcggtgccggtcccccgctggggcttcccaagccaaagaagaggaaagagcccgtgaagatcgcggcgccggagttgcataagggagattcagattctgaggaagatgaacccacaaagaagaaaactatccttcagggatccagtgaggggactggtttgtctgccttgcttccccaacctaaaaacctgactgtgaaagagactaacaggttgctcctgccccatgccttctcccgcaaaccctcggatggctcccctgatactaagccctccagactggcttctaagaccaagacttcctctcttgcccctgttgtgggcaccacaaccaccactccgtcgccctctgctatcaaggctgctgccaagagtgctgccctgcaggtgacaaagcagatcacgcaggaagaagacgacagtgatgaggaagtagcccccgaaaactttttctccctccctgaaaaggctgagccacctggagttgagccatacccttaccccatccccactgtccctgaagagctgcctccaggcacggaaccagagccggctttccaggacgatgcagccaatgccccccttgaattcaagatggcagcaggttcaagtggggccccttggatgcctaagcctggggacgactacagctacaatcagttttccacatatggcgatgccaatgccgctggtgcttattatcagggtctgcagcaacatctgggccactcgcctctaaggggaatcatgagattcctgaactcaaaatctggtaaacgaacctgctttgttcccagctttgattattacagtggtggctactatcctgcacaggacccggccctggtccccccccaggaaattgccccagatgcctccttcatcgatgacgaagcatttaagcggctgcagggcaagaggaaccgagggagagaagaaatcaactttgtggagatcaaaggtgatgaccagctcagtggggcccagcaatggatgactaagtcattgacagaagagaaaaccatgaagtcattcagcaaaaagaaaggtgagcagccaacaggccagcagcggcggaaacaccagatcacatatcttattcatcaggccaaggagcgggagctggaactgaagaacacctggtcagagaacaagctcagccgccgtcagacccaagccaaatatggattctagggctctggaactgattgctcccaggatctcctgccagcccagctggcctggcccccagcttcacctctgggaccccagctgctctaagcccaggatctctttccccaaggacccagccctcgcctctgcgagaatgaacatatttgatagatttttcttaacaagttagaaaattcagctcctttctgtcctggagctagcaaagacttgtgtgatgcctccgaaggggctctgagttctggggtgggagttttgctctctgtcaggtgtgataaaatgttgaaccctccccaccaccacttttttttttttaaaccagggatgtctgttgaaataaaacattcagtctgacaaaca

SEQ ID NO: 329777 - DNA, 1878 bp, Homo sapiens
cctgcggcaaagaaccgggctgtgtccaaagtgttctctggaagttgtagttcctgtattggtgaggcaaggaggaggcggagtgactcggcggccattagctgtgtgtagttgcccgggactaggagcttaagtgaagaggtacgccttgttcggtggaaatcagccgtagccatgagtttctgccggggctagccctagagtacggagcaggcggacttttcggttccccgccccgccaggtggcggggcctactaggcctccgggcatccccggtctcaagtaggcctcatctgccggcaagggcgcccgaaacgcgggaggcgccatgtcgctggttgcttacgccagcagcgatgagagcgagccggatgaggctgagcccgagccggaggaagaggaggcggtggctcctacatctgggcccgctttagggggcttgttcgcttctctccctgcgcccaagggtccggccttgctgcctccgccccctcagatgctggcgccagcctttcccccgccgctgttgcttcccccacccaccggagaccccaggcttcagcctcctccccccttgcccttcggcctgggaggcttccccccacctccaggcgtgagcccggctgaagcggcgggagttggggagggactgggattggggttgccctcgccccgaggccctggcctcaatctgccccctccaattggcggtgccggtcccccgctggggcttcccaagccaaagaagaggaaagagcccgtgaagatcgcggcgccggagttgcataagggagattcagattctgaggaagatgaacccacaaagaagaaaactatccttcagggatccagtgaggggactggtttgtctgccttgcttccccaacctaaaaacctgactgtgaaagagactaacaggttgctcctgccccatgccttctcccgcaaaccctcggatggctcccctgatactaagccctccagactggcttctaagaccaagacttcctctcttgcccctgttgtgggcaccacaaccaccactccgtcgccctctgctatcaaggctgctgccaagagtgctgccctgcaggtgacaaagcagatcacgcaggaagaagacgacagtgatgaggaagtagcccccgaaaactttttctccctccctgaaaaggctgagccacctggagttgagccatacccttaccccatccccactgtccctgaagagctgcctccaggcacggaaccgagggagagaagaaatcaactttgtggagatcaaaggtgatgaccagctcagtggggcccagcaatggatgactaagtcattgacagaagagaaaaccatgaagtcattcagcaaaaagaaaggtgagcagccaacaggccagcagcggcggaaacaccagatcacatatcttattcatcaggccaaggagcgggagctggaactgaagaacacctggtcagagaacaagctcagccgccgtcagacccaagccaaatatggattctagggctctggaactgattgctcccaggatctcctgccagcccagctggcctggcccccagcttcacctctgggaccccagctgctctaagcccaggatctctttccccaaggacccagccctcgcctctgcgagaatgaacatatttgatagatttttcttaacaagttagaaaattcagctcctttctgtcctggagctagcaaagacttgtgtgatgcctccgaaggggctctgagttctggggtgggagttttgctctctgtcaggtgtgataaaatgttgaaccctccccaccaccacttttttttttttaaaccagggatgtctgttgaaataaaacattcagtctgacaaaca

SEQ ID NO: 329778 - DNA, 1963 bp, Homo sapiens
cctgcggcaaagaaccgggctgtgtccaaagtgttctctggaagttgtagttcctgtattggtgaggcaaggaggaggcggagtgactcggcggccattagctgtgtgtagttgcccgggactaggagcttaagtgaagaggtacgccttgttcggtggaaatcagccgtagccatgagtttctgccggggctagccctagagtacggagcaggcggacttttcggttccccgccccgccaggtggcggggcctactaggcctccgggcatccccggtctcaagtaggcctcatctgccggcaagggcgcccgaaacgcgggaggcgccatgtcgctggttgcttacgccagcagcgatgagagcgagccggatgaggctgagcccgagccggaggaagaggaggcggtggctcctacatctgggcccgctttagggggcttgttcgcttctctccctgcgcccaagggtccggccttgctgcctccgccccctcagatgctggcgccagcctttcccccgccgctgttgcttcccccacccaccggagaccccaggcttcagcctcctccccccttgcccttcggcctgggaggcttccccccacctccaggcgtgagcccggctgaagcggcgggagttggggagggactgggattggggttgccctcgccccgaggccctggcctcaatctgccccctccaattggcggtgccggtcccccgctggggcttcccaagccaaagaagaggaaagagcccgtgaagatcgcggcgccggagttgcataagggagattcagattctgaggaagatgaacccacaaagaagaaaactatccttcagggatccagtgaggggactggtttgtctgccttgcttccccaacctaaaaacctgactgtgaaagagactaacaggttgctcctgccccatgccttctcccgcaaaccctcggatggctcccctgatactaagccctccagactggcttctaagaccaagacttcctctcttgcccctgttgtgggcaccacaaccaccactccgtcgccctctgctatcaaggctgctgccaagagtgctgccctgcaggtgacaaagcagatcacgcaggaagaagacgacagtgatgaggaagtagcccccgaaaactttttctccctccctgaaaaggctgagccacctggagttgagccatacccttaccccatccccactgtccctgaagagctgcctccaggcacggaaccagagccggctttccaggacgatgcagccaatgccccccttgaattcaagatggcagcaggttcaagtggggccccttggatgcctaagcctggggacgactacagctacaatcagttttccacatatggcgatgccaatgccgctggtgcttattatcaggattattacagtggtggctactatcctgcacaggacccggccctggtccccccccaggaaattgccccagatgcctccttcatcgatgacgaagcatttaagcggctgcagggcaagaggaaccgagggagagaagaaatcaactttgtggagatcaaaggtgatgaccagctcagtggggcccagcaatggatgactaagtcattgacagaagagaaaaccatgaagtcattcagcaaaaagaaaggtgagcagccaacaggccagcagcggcggaaacaccagatcacatatcttattcatcaggccaaggagcgggagctggaactgaagaacacctggtcagagaacaagctcagccgccgtcagacccaagccaaatatggattctagggctctggaactgattgctcccaggatctcctgccagcccagctggcctggcccccgttcctctgggtccgtcgggttctgccgggtctctttccaaggggccgcctgtccttgcgggatgtgttttggtggttgtgttcgtggatctccctcgtgcg

SEQ ID NO: 329779 - DNA, 1487 bp, Homo sapiens
ggacttcctaataccacaagggaatctgccacctcaatcctaaatttgagttggcagcatatggaggaatatttctgtggagctgagggctgatgggttctgacggataatttccaagccagtcagattctgaggaagatgaacccacaaagaagaaaactatccttcagggatccagtgaggggactggtttgtctgccttgcttccccaacctaaaaacctgactgtgaaagagactaacaggttgctcctgccccatgccttctcccgcaaaccctcggatggctcccctgatactaagccctccagactggcttctaagaccaagacttcctctcttgcccctgttgtgggcaccacaaccaccactccgtcgccctctgctatcaaggctgctgccaagagtgctgccctgcaggtgacaaagcagatcacgcaggaagaagacgacagtgatgaggaagtagcccccgaaaactttttctccctccctgaaaaggctgagccacctggagttgagccatacccttaccccatccccactgtccctgaagagctgcctccaggcacggaaccagagccggctttccaggacgatgcagccaatgccccccttgaattcaagatggcagcaggttcaagtggggccccttggatgcctaagcctggggacgactacagctacaatcagttttccacatatggcgatgccaatgccgctggtgcttattatcaggattattacagtggtggctactatcctgcacaggacccggccctggtccccccccaggaaattgccccagatgcctccttcatcgatgacgaagcatttaagcggctgcagggcaagaggaaccgagggagagaagaaatcaactttgtggagatcaaaggtgatgaccagctcagtggggcccagcaatggatgactaagtcattgacagaagagaaaaccatgaagtcattcagcaaaaagaaaggtgagcagccaacaggccagcagcggcggaaacaccagatcacatatcttattcatcaggccaaggagcgggagctggaactgaagaacacctggtcagagaacaagctcagccgccgtcagacccaagccaaatatggattctagggctctggaactgattgctcccaggatctcctgccagcccagctggcctggcccccagcttcacctctgggaccccagctgctctaagcccaggatctctttccccaaggacccagccctcgcctctgcgagaatgaacatatttgatagatttttcttaacaagttagaaaattcagctcctttctgtcctggagctagcaaagacttgtgtgatgcctccgaaggggctctgagttctggggtgggagttttgctctctgtcaggtgtgataaaatgttgaaccctccccaccaccacttttttttttttaaaccagggatgtctgttgaaataaaacattcagtctgacaaaca

SEQ ID NO: 329780 - DNA, 1884 bp, Homo sapiens
cctgcggcaaagaaccgggctgtgtccaaagtgttctctggaagttgtagttcctgtattggtgaggcaaggaggaggcggagtgactcggcggccattagctgtgtgtagttgcccgggactaggagcttaagtgaagaggtacgccttgttcggtggaaatcagccgtagccatgagtttctgccggggctagccctagagtacggagcaggcggacttttcggttccccgccccgccaggtggcggggcctactaggcctccgggcatccccggtctcaagtaggcctcatctgccggcaagggcgcccgaaacgcgggaggcgccatgtcgctggttgcttacgccagcagcgatgagagcgagccggatgaggctgagcccgagccggaggaagaggaggcggtggctcctacatctgggcccgctttagggggcttgttcgcttctctccctgcgcccaagggtccggccttgctgcctccgccccctcagatgctggcgccagcctttcccccgccgctgttgcttcccccacccaccggagaccccaggcttcagcctcctccccccttgcccttcggcctgggaggcttccccccacctccaggcgtgagcccggctgaagcggcgggagttggggagggactgggattggggttgccctcgccccgaggccctggcctcaatctgccccctccaattggcggtgccggtcccccgctggggcttcccaagccaaagaagaggaaagagcccgtgaagatcgcggcgccggagttgcataagggagattcagattctgaggaagatgaacccacaaagaagaaaactatccttcagggatccagtgaggggactggtttgtctgccttgcttccccaacctaaaaacctgactgtgaaagagactaacaggttgctcctgccccatgccttctcccgcaaaccctcggatggctcccctgatactaagccctccagactggcttctaagaccaagacttcctctcttgcccctgttgtgggcaccacaaccaccactccgtcgccctctgctatcaaggctgctgccaagagtgctgccctgcaggtgacaaagcagatcacgcaggaagaagacgacagtgatgaggaagtagcccccgaaaactttttctccctccctgaaaaggctgagccacctggagttgagccatacccttaccccatccccactgtccctgaagagctgcctccaggcacggaaccagagccggctttccaggacgatgcagccaatgccccccttgaattcaagatggcagcaggttcaagtggggccccttggatgcctaagcctggggacgactacagctacaatcagttttccacatatggcgatgccaatgccgctggtgcttattatcaggattattacagtggtggctactatcctgcacaggacccggccctggtccccccccaggaaattgccccagatgcctccttcatcgatgacgaagcatttaagcggctgcagggcaagaggaaccgagggagagaagaaatcaactttgtggagatcaaaggtgatgaccagagcttcacctctgggaccccagctgctctaagcccaggatctctttccccaaggacccagccctcgcctctgcgagaatgaacatatttgatagatttttcttaacaagttagaaaattcagctcctttctgtcctggagctagcaaagacttgtgtgatgcctccgaaggggctctgagttctggggtgggagttttgctctctgtcaggtgtgataaaatgttgaaccctccccaccaccacttttttttttttaaaccagggatgtctgttgaaataaaacattcagtctgacaaaca

SEQ ID NO: 329781 - DNA, 1378 bp, Homo sapiens
cctgcggcaaagaaccgggctgtgtccaaagtgttctctggaagttgtagttcctgtattggtgaggcaaggaggaggcggagtgactcggcggccattagctgtgtgtagttgcccgggactaggagcttaagtgaagaggtacgccttgttcggtggaaatcagccgtagccatgagtttctgccggggctagccctagagtacggagcaggcggacttttcggttccccgccccgccaggtggcggggcctactaggcctccgggcatccccggtctcaagtaggcctcatctgccggcaagggcgcccgaaacgcgggaggcgccatgtcgctggttgcttacgccagcagcgatgagagcgagccggatgaggctgagcccgagccggaggaagaggaggcggtggctcctacatctgggcccgctttagggggcttgttcgcttctctccctgcgcccaagggtccggccttgctgcctccgccccctcagatgctggcgccagcctttcccccgccgctgttgcttcccccacccaccggagaccccaggcttcagcctcctccccccttgcccttcggcctgggaggcttccccccacctccaggcgtgagcccggctgaagcggcgggagttggggagggactgggattggggttgccctcgccccgaggccctggcctcaatctgccccctccaattggcggtgccggtcccccgctggggcttcccaagccaaagaagaggaaagagcccgtgaagatcgcggcgccggagttgcataagggagattcagattctgaggaagatgaacccacaaagaagaaaactatccttcagggatccagtgaggggactggtttgtctgccttgcttccccaacctaaaaacctgactgtgaaagagactaacaggttgctcctgccccatgccttctcccgcaaaccctcggatggctcccctgatactaagccctccagactggcttctaagaccaagacttcctctcttgcccctgttgtgggcaccacaaccaccactccgtcgccctctgctatcaaggctgctgccaagagtgctgccctgcaggtgacaaagcagatcacgcaggaagaagacgacagtgatgaggaagtagcccccgaaaactttttctccctccctgaaaaggctgagccacctggagttgagccatacccttaccccatccccactgtccctgaagagctgcctccaggcacggaaccagagccggctttccaggacgatgcagccaatgccccccttgaattcaagatgaagttgcgccgaatgaaccgcttcactgtggctgagctcaagcagctggtggctcggcctgatgtcgtgaagat

SEQ ID NO: 329782 - DNA, 964 bp, Homo sapiens
  misc_feature (420)..(420): n is a, c, g, or t
  misc_feature (440)..(440): n is a, c, g, or t
  misc_feature (458)..(458): n is a, c, g, or t
  misc_feature (508)..(508): n is a, c, g, or t
  misc_feature (522)..(522): n is a, c, g, or t
  misc_feature (525)..(525): n is a, c, g, or t
  misc_feature (529)..(529): n is a, c, g, or t
  misc_feature (544)..(544): n is a, c, g, or t
  misc_feature (566)..(566): n is a, c, g, or t
  misc_feature (568)..(568): n is a, c, g, or t
  misc_feature (570)..(571): n is a, c, g, or t
  misc_feature (576)..(576): n is a, c, g, or t
  misc_feature (592)..(598): n is a, c, g, or t
  misc_feature (601)..(601): n is a, c, g, or t
  misc_feature (603)..(603): n is a, c, g, or t
  misc_feature (607)..(607): n is a, c, g, or t
  misc_feature (615)..(616): n is a, c, g, or t
  misc_feature (619)..(620): n is a, c, g, or t
  misc_feature (624)..(624): n is a, c, g, or t
  misc_feature (636)..(639): n is a, c, g, or t
  misc_feature (659)..(659): n is a, c, g, or t
  misc_feature (662)..(663): n is a, c, g, or t
  misc_feature (666)..(666): n is a, c, g, or t
  misc_feature (672)..(672): n is a, c, g, or t
  misc_feature (677)..(677): n is a, c, g, or t
  misc_feature (682)..(682): n is a, c, g, or t
  misc_feature (700)..(700): n is a, c, g, or t
  misc_feature (703)..(703): n is a, c, g, or t
  misc_feature (709)..(709): n is a, c, g, or t
  misc_feature (713)..(713): n is a, c, g, or t
  misc_feature (720)..(720): n is a, c, g, or t
  misc_feature (731)..(731): n is a, c, g, or t
  misc_feature (735)..(735): n is a, c, g, or t
  misc_feature (777)..(777): n is a, c, g, or t
  misc_feature (783)..(783): n is a, c, g, or t
  misc_feature (800)..(800): n is a, c, g, or t
  misc_feature (807)..(807): n is a, c, g, or t
  misc_feature (819)..(819): n is a, c, g, or t
  misc_feature (870)..(870): n is a, c, g, or t
  misc_feature (884)..(884): n is a, c, g, or t
  misc_feature (921)..(921): n is a, c, g, or t
cctgcggcaaagaaccgggctgtgtccaaagtgttctctggaagttgtagttcctgtattggtgaggcaaggaggaggcggagtgactcggcggccattagctgtgtgtagttgcccgggactaggagcttaagtgaagaggtacgccttgttcggtggaaatcagccgtagccatgagtttctgccggggctagccctagagtacggagcaggcggacttttcggttccccgccccgccaggtggcggggcctactaggcctccgggcatccccggtctcaagtaggcctcatctgccggcaagggcgcccgaaacgcgggaggcgccatgtcgctggttgcttacgccagcagcgatgagagcgagccggatgaggctgagccccgcagcccgcgcaggcaagcaggcagcgcgtgtnggctctcttaccatcctggngccccgcctttttagggnggccttgctttcgcctttcttcttccctcgccgcccccaaaggggttccnggccctttgtcttnccntccnccccccccctccagnaatgcctgggcgcccagcctgngngnnccccncccgcctgctttgcgnnnnnnnccnancccnaacgggtnnaanncccnagggctttttannnnttctctttttcccccctttnccnnctnttcggnctctnggggnaggccttttccccccccnacncttccnaggngcgctgnagccccgcgcnctgnaaagcgcgccgggggcagtttggggcgcaggggcactggggnatttgnggggtttgcccccttcnccccccncagggccccctnggcccttcaaattcttgccccccctcccaaatttgggccgggtggccgggnttcccccccgcctnggggggcttttccccaaagccccaaaagcaaagcagngcaaaagcagcccccgttgcaaagcattcgccgggccgccccg

SEQ ID NO: 329783 - DNA, 360 bp, Homo sapiens
actaagtcattgacagaagagaaaaccatgaagtcattcagcaaagtaagtgggaaacgtctattgagtggtcagcttgggaagctgcaaagcaaaatcttgtcttactccccgtcttgaccccacaccccattgttattgtcacagcacctttagcaaacacattttgcccatggtactggagtatgcactaaacctcacagatacagctcctgccctctagaactttgcaggactttaacagctctgcagctggatggggggtctggttgctgagatcgagtagttggtgaggcctcccagcctgtggttgtggcttcttctcaggctgcacagaatccacagctgctctactcttgc

SEQ ID NO: 329784 - DNA, 550 bp, Homo sapiens
ctatgtaaattaaagcactttaaatacactaggggactctgaaatttaaatgtatcttattgtgaataccattataaaaaaaatccatactctaattgctctggatttttatatattattttatgtagtgaatattaaacctattttcatttagctcatcataaaacaaatgttcttagaagggcatttcttggagtttaagacgaagtggaagaattaggaaaaagtataggcaaggaggaaacagtttattggccctgtggctgcctgacttcaccaagcagaggccttgcccttgccttcaccctcctcttcctctagggtctgcagcaacatctgggccactcgcctctaaggggaatcatgagattcctgaactcaaaatctggtaaacgaacctgctttgttcccagctttgtaagtttcattgtatcctaatagtggttattttaaatcagagatctataacctccccacccggtttagactgtttccctgtatccacaggaccaaactagaatgaggagcaggaatggcatgacgtatacct

SEQ ID NO: 329785 - DNA, 666 bp, Homo sapiens
cctgcggcaaagaaccgggctgtgtccaaagtgttctctggaagttgtagttcctgtattggtgaggcaaggaggaggcggagtgactcggcggccattagctgtgtgtagttgcccgggactaggagcttaagtgaagaggtacgccttgttcggtggaaatcagccgtagccatgagtttctgccggggctagccctagagtacggagcaggcggacttttcggttccccgccccgccaggtggcggggcctactaggcctccgggcatccccggtctcaagtaggcctcatctgccggcaagggcgcccgaaacgcgggaggcgccatgtcgctggttgcttacgccagcagcgatgagagcgagccggatgaggctgagcccgagccggaggaagaggaggcggtggctcctacatctgggcccgctttagggggcttgttcgcttctctccctgcgcccaagggtccggccttgctgcctccgccccctcagatgctggcgccagcctttcccccgccgctgttgcttcccccacccaccggagaccccaggcttcagcctcctccccccttgcccttatgggagggggggcttacctcttattgtagtaatgaactcggccttaatctatgggacataggtgaatgtattggacctgtgt

SEQ ID NO: 329786 - DNA, 1053 bp, Homo sapiens
cctgcggcaaagaaccgggctgtgtccaaagtgttctctggaagttgtagttcctgtattggtgaggcaaggaggaggcggagtgactcggcggccattagctgtgtgtagttgcccgggactaggagcttaagtgaagaggtacgccttgttcggtggaaatcagccgtagccatgagtttctgccggggctagccctagagtacggagcaggcggacttttcggttccccgccccgccaggtggcggggcctactaggcctccgggcatccccggtctcaagtaggcctcatctgccggcaagggcgcccgaaacgcgggaggcgccatgtcgctggttgcttacgccagcagcgatgagagcgagccggatgaggctgagcccgagccggaggaagaggaggcggtggctcctacatctgggcccgctttagggggcttgttcgcttctctccctgcgcccaagggtccggccttgctgcctccgccccctcagatgctggcgccagcctttcccccgcttagcgcggcgactcgccgaacgcctcgcgctcgatgcaccacctcatgctatataataagagccgggtcacgaggaccgcctgcttgccctccgaacaccaccccacacgcaccccacccacaccaccacgacacgaaaagcaccagccaccccccaccacacaacaatgcgaaacccatcacgcgccggcgggcgcgccgccaccccctcacaccaccccacggcggagagccagccctgccgccacccaccagcggccgtccccccaccgccgcgcctgccggccacgcgcaccccaccacccccacccctccgccagcagccaccgagccacccgacaccacaaccccccggctagcgaggccgcacccacaccaccccaccgacgacgcagagcgcgcgagaagacagacatcccggccgagccctgcacccgcactggcccgccgcgagccaccgcccccgccgcccgccgacgccacccccacccccgcccacccccaccccaacgccgccccagcgacgcccc

SEQ ID NO: 329787 - DNA, 2792 bp, Homo sapiens
cctgcggcaaagaaccgggctgtgtccaaagtgttctctggaagttgtagttcctgtattggtgaggcaaggaggaggcggagtgactcggcggccattagctgtgtgtagttgcccgggactaggagcttaagtgaagaggtacgccttgttcggtggaaatcagccgtagccatgagtttctgccggggctagccctagagtacggagcaggcggacttttcggttccccgccccgccaggtggcggggcctactaggcctccgggcatccccggtctcaagtaggcctcatctgccggcaagggcgcccgaaacgcgggaggcgccatgtcgctggttgcttacgccagcagcgatgagagcgagccggatgaggctgagcccgagccggaggaagaggaggcggtggctcctacatctgggcccgctttagggggcttgttcgcttctctccctgcgcccaagggtccggccttgctgcctccgccccctcagatgctggcgccagcctttcccccgccgctgttgcttcccccacccaccggagaccccaggcttcagcctcctccccccttgcccttcggcctgggaggcttccccccacctccaggcgtgagcccggctgaagcggcgggagttggggagggactgggattggggttgccctcgccccgaggccctggcctcaatctgccccctccaattggcggtgccggtcccccgctggggcttcccaagccaaagaagaggaaagagcccgtgaagatcgcggcgccggagttgcataagggagattcagattctgaggaagatgaacccacaaagaagaaaactatccttcagggatccagtgaggggactggtttgtctgccttgcttccccaacctaaaaacctgactgtgaaagagactaacaggttgctcctgccccatgccttctcccgcaaaccctcggatggctcccctgatactaagccctccagactggcttctaagaccaagacttcctctcttgcccctgttgtgggcaccacaaccaccactccgtcgccctctgctatcaaggctgctgccaagagtgctgccctgcaggtgacaaagcagatcacgcaggaagaagacgacagtgatgaggaagtagcccccgaaaactttttctccctccctgaaaaggctgagccacctggagttgagccatacccttaccccatccccactgtccctgaagagctgcctccaggcacggaaccagagccggctttccaggacgatgcagccaatgccccccttgaattcaagatggcagcaggttcaagtggggccccttggatgcctaagcctggggacgactacagctacaatcagttttccacatatggcgatgccaatgccgctggtgcttattatcagggtctgcagcaacatctgggccactcgcctctaaggggaatcatgagattcctgaactcaaaatctggtaaacgaacctgctttgttcccagctttgtaagtttcattgtatcctaatagtggttattttaaatcagagatctataacctccccacccggtttagactgtttccctgtatccacaggaccaaactagaatgaggagcaggaatggcatgacgtataccttctcgtccctgctcgcatcgtagctcattggggtcttatgagcaggaggagcagggctgagggcatggtagaggtaagaggtgagagtctctcttaggaagtagctgagggagcaaggtatagattgaagcaggagagactgtctttgtttcttgttaccctttcctaaaaaatatccatctgtctggatagtgtagatgagaaaagctgtagggactgttcttgagttgtaggtcggtccttgggatctatgcctttaactggtctgtttgaggaagctgtagtatagctatctcaccattgcctctttgatgacaattttctgtttctggacagaccttaccttcccctctccaactgtgccctcagttggtgtgtttttctttcctgtttggctgcaggattattacagtggtggctactatcctgcacaggacccggccctggtccccccccaggaaattgccccagatgcctccttcatcgatgacgaagcatttaagcggctgcagggcaagaggaaccgagggagagaagaaatcaactttgtggagatcaaaggtgatgaccagctcagtggggcccagcaatggatgactaagtcattgacagaagagaaaaccatgaagtcattcagcaaaaagaaaggtgagcagccaacaggccagcagcggcggaaacaccagatcacatatcttattcatcaggccaaggagcgggagctggaactgaagaacacctggtcagagaacaagctcagccgccgtcagacccaagccaaatatggattctagggctctggaactgattgctcccaggatctcctgccagcccagctggcctggcccccagcttcacctctgggaccccagctgctctaagcccaggatctctttccccaaggacccagccctcgcctctgcgagaatgaacatatttgatagatttttcttaacaagttagaaaattcagctcctttctgtcctggagctagcaaagacttgtgtgatgcctccgaaggggctctgagttctggggtgggagttttgctctctgtcaggtgtgataaaatgttgaaccctccccaccaccacttttttttttttaaaccagggatgtctgttgaaataaaacattcagtctgacaaaca

SEQ ID NO: 329788 - DNA, 1506 bp, Homo sapiens
cctgcggcaaagaaccgggctgtgtccaaagtgttctctggaagttgtagttcctgtattggtgaggcaaggaggaggcggagtgactcggcggccattagctgtgtgtagttgcccgggactaggagcttaagtgaagagtcagattctgaggaagatgaacccacaaagaagaaaactatccttcagggatccagtgaggggactggtttgtctgccttgcttccccaacctaaaaacctgactgtgaaagagactaacaggttgctcctgccccatgccttctcccgcaaaccctcggatggctcccctgatactaagccctccagactggcttctaagaccaagacttcctctcttgcccctgttgtgggcaccacaaccaccactccgtcgccctctgctatcaaggctgctgccaagagtgctgccctgcaggtgacaaagcagatcacgcaggaagaagacgacagtgatgaggaagtagcccccgaaaactttttctccctccctgaaaaggctgagccacctggagttgagccatacccttaccccatccccactgtccctgaagagctgcctccaggcacggaaccagagccggctttccaggacgatgcagccaatgccccccttgaattcaagatggcagcaggttcaagtggggccccttggatgcctaagcctggggacgactacagctacaatcagttttccacatatggcgatgccaatgccgctggtgcttattatcaggattattacagtggtggctactatcctgcacaggacccggccctggtccccccccaggaaattgccccagatgcctccttcatcgatgacgaagcatttaagcggctgcagggcaagaggaaccgagggagagaagaaatcaactttgtggagatcaaaggtgatgaccagctcagtggggcccagcaatggatgactaagtcattgacagaagagaaaaccatgaagtcattcagcaaaaagaaaggtgagcagccaacaggccagcagcggcggaaacaccagatcacatatcttattcatcaggccaaggagcgggagctggaactgaagaacacctggtcagagaacaagctcagccgccgtcagacccaagccaaatatggattctagggctctggaactgattgctcccaggatctcctgccagcccagctggcctggcccccagcttcacctctgggaccccagctgctctaagcccaggatctctttccccaaggacccagccctcgcctctgcgagaatgaacatatttgatagatttttcttaacaagttagaaaattcagctcctttctgtcctggagctagcaaagacttgtgtgatgcctccgaaggggctctgagttctggggtgggagttttgctctctgtcaggtgtgataaaatgttgaaccctccccaccaccacttttttttttttaaaccagggatgtctgttgaaataaaacattcagtctgacaaaca

SEQ ID NO: 329789 - DNA, 1936 bp, Homo sapiens
cctgcggcaaagaaccgggctgtgtccaaagtgttctctggaagttgtagttcctgtattggtgaggcaaggaggaggcggagtgactcggcggccattagctgtgtgtagttgcccgggactaggagcttaagtgaagaggtacgccttgttcggtggaaatcagccgtagccatgagtttctgccggggctagccctagagtacggagcaggcggacttttcggttccccgccccgccaggtggcggggcctactaggcctccgggcatccccggtctcaagtaggcctcatctgccggcaagggcgcccgaaacgcgggaggcgccatgtcgctggttgcttacgccagcagcgatgagagcgagccggatgaggctgagcccgagccggaggaagaggaggcggtggctcctacatctgggcccgctttagggggcttgttcgcttctctccctgcgcccaagggtccggccttgctgcctccgccccctcagatgctggcgccagcctttcccccgccgctgttgcttcccccacccaccggagaccccaggcttcagcctcctccccccttgcccttcggcctgggaggcttccccccacctccaggcgtgagcccggctgaagcggcgggagttggggagggactgggattggggttgccctcgccccgaggccctggcctcaatctgccccctccaattggcggtgccggtcccccgctggggcttcccaagccaaagaagaggaaagagcccgtgaagatcgcggcgccggagttgcataagggagattcagattctgaggaagatgaacccacaaagaagaaaactatccttcagggatccagtgaggggactggtttgtctgccttgcttccccaacctaaaaacctgactgtgaaagagactaacaggttgctcctgccccatgccttctcccgcaaaccctcggatggctcccctgatactaagccctccagactggcttctaagaccaagacttcctctcttgcccctgttgtgggcaccacaaccaccactccgtcgccctctgctatcaaggctgctgccaagagtgctgccctgcaggtgacaaagcagatcacgcaggaagaagacgacagtgatgaggaagtagcccccgaaaactttttctccctccctgaaaaggctgagccacctggagttgagccatacccttaccccatccccactgtccctgaagagctgcctccaggcacggaaccagagccggctttccaggacgatgcagccaatgccccccttgaattcaagatggcagcaggttcaagtggggccccttggatgcctaagcctggggacgactacagctacaatcagttttccacatatggcgatgccaatgccgctggtgcttattatcaggattattacagtggtggctactatcctgcacaggacccggccctggtccccccccaggaaattgccccagatgcctccttcatcgatgacgaagcatttaagcggctgcagggcaagaggaaccgagggagagaagaaatcaactttgtggagatcaaaggtgatgaccagctcagtggggcccagcaatggatgactaagtcattgacagaagagaaaaccatgaagtcattcagcaaaaagaaaggtgagcagccaacaggccagcagcggcggaaacaccagatcacatatcttattcatcagatatttgatagatttttcttaacaagttagaaaattcagctcctttctgtcctggagctagcaaagacttgtgtgatgcctccgaaggggctctgagttctggggtgggagttttgctctctgtcaggtgtgataaaatgttgaaccctccccaccaccacttttttttttttaaaccagggatgtctgttgaaataaaacattcagtctgacaaaca

SEQ ID NO: 329790 - DNA, 1857 bp, Homo sapiens
cctgcggcaaagaaccgggctgtgtccaaagtgttctctggaagttgtagttcctgtattggtgaggcaaggaggaggcggagtgactcggcggccattagctgtgtgtagttgcccgggactaggagcttaagtgaagaggtacgccttgttcggtggaaatcagccgtagccatgagtttctgccggggctagccctagagtacggagcaggcggacttttcggttccccgccccgccaggtggcggggcctactaggcctccgggcatccccggtctcaagtaggcctcatctgccggcaagggcgcccgaaacgcgggaggcgccatgtcgctggttgcttacgccagcagcgatgagagcgagccggatgaggctgagcccgagccggaggaagaggaggcggtggctcctacatctgggcccgctttagggggcttgttcgcttctctccctgcgcccaagggtccggccttgctgcctccgccccctcagatgctggcgccagcctttcccccgccgctgttgcttcccccacccaccggagaccccaggcttcagcctcctccccccttgcccttcggcctgggaggcttccccccacctccaggcgtgagcccggctgaagcggcgggagttggggagggactgggattggggttgccctcgccccgaggccctggcctcaatctgccccctccaattggcggtgccggtcccccgctggggcttcccaagccaaagaagaggaaagagcccgtgaagatcgcggcgccggagttgcataagggagattcagattctgaggaagatgaacccacaaagaagaaaactatccttcagggatccagtgaggggactggtttgtctgccttgcttccccaacctaaaaacctgactgtgaaagagactaacaggttgctcctgccccatgccttctcccgcaaaccctcggatggctcccctgatactaagccctccagactggcttctaagaccaagacttcctctcttgcccctgttgtgggcaccacaaccaccactccgtcgccctctgctatcaaggctgctgccaagagtgctgccctgcaggtgacaaagcagatcacgcaggaagaagacgacagtgatgaggaagtagcccccgaaaactttttctccctccctgaaaaggctgagccacctggagttgagccatacccttaccccatccccactgtccctgaagagctgcctccaggcacggaaccagagccggctttccaggacgatgcagccaatgccccccttgaattcaagatggcagcaggttcaagtggggccccttggatgcctaagcctggggacgactacagctacaatcagttttccacatatggcgatgccaatgccgctggtgcttattatcaggattattacagtggtggctactatcctgcacaggacccggccctggtccccccccaggaaattgccccagatgcctccttcatcgatgacgaagcatttaagcggctgcagggcaagaggaaccgagggagagaagaaatcaactttgtggagatcaaaggtgatgaccagctaagcccaggatctctttccccaaggacccagccctcgcctctgcgagaatgaacatatttgatagatttttcttaacaagttagaaaattcagctcctttctgtcctggagctagcaaagacttgtgtgatgcctccgaaggggctctgagttctggggtgggagttttgctctctgtcaggtgtgataaaatgttgaaccctccccaccaccacttttttttttttaaaccagggatgtctgttgaaataaaacattcagtctgacaaaca

SEQ ID NO: 329791 - DNA, 1243 bp, Homo sapiens
cctgcggcaaagaaccgggctgtgtccaaagtgttctctggaagttgtagttcctgtattggtgaggcaaggaggaggcggagtgactcggcggccattagctgtgtgtagttgcccgggactaggagcttaagtgaagaggtacgccttgttcggtggaaatcagccgtagccatgagtttctgccggggctagccctagagtacggagcaggcggacttttcggttccccgccccgccaggtggcggggcctactaggcctccgggcatccccggtctcaagtaggcctcatctgccggcaagggcgcccgaaacgcgggaggcgccatgtcgctggttgcttacgccagcagcgatgagagcgagccggatgaggctgagcccgagccggaggaagaggaggcggtggctcctacatctgggcccgctttagggggcttgttcgcttctctccctgcgcccaagggtccggccttgctgcctccgccccctcagatgctggcgccagcctttcccccgccgctgttgcttcccccacccaccggagaccccaggcttcagcctcctccccccttgcccttcggcctgggaggcttccccccacctccaggcgtgagcccggctgaagcggcgggagttggggagggactgggattggggttgccctcgccccgaggccctggcctcaatctgccccctccaattggcggtgccggtcccccgctggggcttcccaagccaaagaagaggaaagagcccgtgaagatcgcggcgccggagttgcataagggagattcagattctgaggaagatgaacccacaaagaagaaaactatccttcagggatccagtgaggggactggtttgtctgccttgcttccccaacctaaaaacctgactgtgaaagagactaacaggttgctcctgccccatgccttctcccgcaaaccctcggatggctcccctgctaagcccaggatctctttccccaaggacccagccctcgcctctgcgagaatgaacatatttgatagatttttcttaacaagttagaaaattcagctcctttctgtcctggagctagcaaagacttgtgtgatgcctccgaaggggctctgagttctggggtgggagttttgctctctgtcaggtgtgataaaatgttgaaccctccccaccaccacttttttttttttaaaccagggatgtctgttgaaataaaacattcagtctgacaaaca

SEQ ID NO: 329792 - DNA, 863 bp, Homo sapiens
tctccacaaagttgatttcttctctcccttggatgcctaagcctggggacgactacagctacaatcagttttccacatatggcgatgccaatgccgctggtgcttattatcaggattattacagtggtggctactatcctgcacaggacccggccctggtccccccccaggaaattgccccagatgcctccttcatcgatgacgaagcatttaagcggctgcagggcaagaggaaccgagggagagaagaaatcaactttgtggagatcaaaggtgatgaccagctcagtggggcccagcaatggatgactaagtcattgacagaagagaaaaccatgaagtcattcagcaaaaagaaaggtgagcagccaacaggccagcagcggcggaaacaccagatcacatatcttattcatcaggccaaggagcgggagctggaactgaagaacacctggtcagagaacaagctcagccgccgtcagacccaagccaaatatggattctagggctctggaactgattgctcccaggatctcctgccagcccagctggcctggcccccagcttcacctctgggaccccagctgctctaagcccaggatctctttccccaaggacccagccctcgcctctgcgagaatgaacatatttgatagatttttcttaacaagttagaaaattcagctcctttctgtcctggagctagcaaagacttgtgtgatgcctccgaaggggctctgagttctggggtgggagttttgctctctgtcaggtgtgataaaatgttgaaccctccccaccaccacttttttttttttaaaccagggatgtctgttgaaataaaacattcagtctgacaaaca

SEQ ID NO: 329793 - DNA, 359 bp, Homo sapiens
acaataggtacacatggggagcaatagatattggagactccaaaagatgggaggatgggaggagggtgaggggtgaaaatttcctattgagtacaatgttcactatttgaatcatggctacacacaaagcccagacctcagcactccacaatatatgcatatagcactccacaatatttgcccctggtccagttgtgaagtctcatacagagtatcaatcagtcaatgttctcccttggttttgaatgtatttcttttacttcaagagtaagttgtcaagcgtggtggctcacacctgtaatcccagcactttgggaggccgaggcgggcagatcacttgaggtcaggagatcaagacc

SEQ ID NO: 329794 - DNA, 464 bp, Homo sapiens
taaggaaagggccactgtgctgagtgttgggggacctgtttcctgtctttagctgtagggtttatgtgagtctccctacagtaaaagacagggttggatgatggtttcttaaggcagatcctccctggacagtctgtggctccttagctgctgtgagcccagaccagagcctccagtacaattgggagcctccagggggacatctctgagctgttggttcaggtacctaagattccaagatgggtgtactttgcctctcattcgcacatcagaggctgtggcatggaaccccattatagcataaggtgtgccacccccctgtggtgactggccacttaataaacattccagaactcactcctccagatggctgttgtcaccaccaaaagcagtcaccagagaggctggaagtctgttccaaacccttcctgggaatttccctcagagtctgaatcatattctct

SEQ ID NO: 329795 - DNA, 669 bp, Homo sapiens
ccagtttcaagtatatccaaaactgagtgttttggataaccctggctataaatgaaactaccattcttagaaaattactggaaggaaatcatcacaggacagtttgagaatgtcagaatatcagggggtggcagatggccttcagagaagcaattatttcctgatcattctcaacttaatcaccctggaaagccatagaaaaaccaagtaatatgggatattgaatgttgatgtattatttgagtctaatatcttaatagctacttatcagcaactcaagaaaatatgagtgatataccatgcagaaatcaagcaggtgaacagcttgtgagtaggttgtacttggaaaatgcttggtacttccaaaagcaaaataatgtcctggtgagaatattaatatatgtggttttagtggaattggtattgtcattagcagactgatgacgtagggagaaagacaaggtaagacactgaggaaaaatatagttcatttatacagaaaaagccaaattttaagtgaaagcatcatgggagaaagattatatatggaaatgcaggagagctaaaagtggtctggtgaaccacatattagctgagcatgagtcattcatggattgatattttaaaaagctagagacacttgaatttgagaaactaggacaaggatat

SEQ ID NO: 329796 - DNA, 1338 bp, Homo sapiens
caacaagagcgaaactccgtctcaggaaaaaaaaaaaaaagcagaactccttactggcctcaaaacatactgtgacatttccgtaacctacaggtctagaaatcctgtgccaaatatggttaacttgtttgctgagaaggatgtggaagaactggaaccctcatacacagctgatgggaaaacagtctggaactttcttaaaacattctggtaaatgggggcccggcaagctagaaagtgtggctataatcccttgcttttttccttttttaaactttttctctctcagtcctgacctaaagatgaccctagtcaggctggacacggtggctcacgcctgtcatcccagcactttgggaggccaagacgggtggatcacctgaagtcaggagttcaagaccagcctgaccaacatggagaaaccctgtctctactaaaaacacaaaattagctgggcgtggtggtgcatgcctataattccagctactcgggaggctgaggcaggagaatcgcttgaacctgggaggtggaggttgcagtgagccgagatcgcgccattgcactccagcctggacagcaagagcaaaactccgtctcaaaaaacaaaaacaaaaacaaacaaaaaaattcccctgagagaaaacctgtctttccagccagaggagcaggaaaaaatgaccctatggtctgaagaatgtggaaataatccatctttttttctctctctgctttctgcctgaggggcgttccttttggcaaaatgagcaggcagtgtaggcaggtaatcatcagagagaaagcccatctttctaagccagaggatgaggaaaaggggccccctgggtgccagggagtctggggggaaatcctgaagagcaaagacctgaaaagaggattctctaattctgtacatgagctgaattccgtgctcagcccagagctgcacatacaagagacagagcccaggcaacacagccacactctgaactgacactcggaccaccaccaccaaacagaaggcaacgcaggacctgcagactaaggctaacgaggctgattgcctgacaaaacagaaaaaaaagaaacattcttcagggaattttagcagaacacagagtctcccaacataaaacagacagtcctcactgcacagcagttcagaactgtaaaaatgaccttccaacctgaaactgccatgtgctgttcataatcattaatgggtaaaattgtgatttttttcctgtcttttgaaaattgtcaaaacattgataatcttgtactgttagaaatgtataaggaaacaataaagtaaatatttttgtacactgtaatttaaaa

SEQ ID NO: 329797 - DNA, 486 bp, Homo sapiens
attcagttagcaaacccagggtaccgtatcaacagcatggggactggcataggcttcccagtgctgaagtcccgaagttctttctgctttgggacaagatacagacagaagaacaagatgagctggccactcctggagaccagatgaagtggccacagatatcaagaggggaggcactggggggaaagaagccaagtgggactgactctagacattagctaattgaggcagatcttttgtgatagatgaaaaccctttggtacctctccccagattttgatagctgctaagtctccaagtaatgtaccttgggatagatttcgacttcagctttttttttatttttattttttgaggcggagtctttactctgtcgcccaggctggagtgcagtggtgtgatctcagctcactgcaacttctgcctcccaggttcaagcgatttgcctgcctcagcctcctgagtagctgggattacaggcgtgca

SEQ ID NO: 329798 - DNA, 118 bp, Homo sapiens
tttatacatatcctatgagagagcttctgttgtagttgatacattatgctcactttcacaagtaagcaggactgtttcaaatccaataaatgctttttaagtatgactctgcaggttg

SEQ ID NO: 329799 - DNA, 476 bp, Homo sapiens
gtatacatctataaaaatgtttatatgaagggattttttaaaactgggcttacattaaatgaaaacacaggagcaacagtgtggtgtatgggaaaggacactgcaatcagccagacctagatcaaaccttttgggtgagtgcataagttattttacctgtctaagaatctcagctttctcatcaaaaaaggagagaacagccattatctccaaattcctcaataatttggaagctatttccagtatagtgcctgggatgtagaaggtgcttaataaatggtaatagtgttaatagatttttaaaatagaaaacaattacaggcatcaatgtatacgtgtgaaagcttaagacaggatggacatctggttcttcattactgtaaaatattaactgcttaataagactaatgtcttcagctgtttttctttgataaaataaaagtatttaaaaaaagctattgcatatgggggagccc

SEQ ID NO: 329800 - DNA, 183 bp, Homo sapiens
ggcctgctaggtctgaaggggtaaggtggggagggctgctggagcccagaaggctgctggaaggggagcaagaccagctgcggctgaacaggatgcagccacacccatcccacagcccagtggggagggagccgtgggaagagaaacccaacctcagttttccccaggcctccggcgccctgt

SEQ ID NO: 329801 - DNA, 684 bp, Homo sapiens
tggagagggcacgtgtagcctctgcaagaaggagcaccagggcaaggaaagcttgggcagctcggggcagcctgggaggggaggccacccacatgttcaagcccacagcacctccaggtctgtctgggcattgggaatctagaagatttgccaagaatgctgcttccagacctttctgttctactggttgctctcctgcactggtgtcctcaacacacttctgaacacacctcgctaacagatcagaatcctatagcccacagaaccatcagagccagaccttgagggcctgagctggtgtttctggagaccaggctcctggggacagatgtcaagagtacattccaccaaagcctgtgatgagaacactcaactcccactgaaccatgagctcagttaagcctgctcacagcatccctccttctccagtggcacacctcttacagcccgaacccaaatcatcctcctctcctcctccaggcctgaggctgatggtcctggtatctatcaaggaactggttttctttcgtaataaaaatgggcaaaggtgagcaagagaagcctggggggactgcttggcaggcctccgccctgacgaggaagttcatctccacagggatgcgagtcaggaactccagcatgagccaggaccattcccctcatcaatggacacttcttgaacta

SEQ ID NO: 329802 - DNA, 521 bp, Homo sapiens
ccatgaaggacattactgagcacccactaagcgtgagatgaagctgccacgaggcactgtgcacccaggcgctgcgcccagcaggcctgcagaaaaagcacaaggccaggtacccttaagacgacagcaaagtgcaggcgcactgccagctgtgggctgggacagatgtcaagagtacattccaccaaagcctgtgatgagaacactcaactcccactgaaccatgagctcagttaagcctgctcacagcatccctccttctccagtggcacacctcttacagcccgaacccaaatcatcctcctctcctcctccaggcctgaggctgatggtcctggtatctatcaaggaactggttttctttcgtaataaaaatgggcaaaggtgagcaagagaagcctggggggactgcttggcaggcctccgccctgacgaggaagttcatctccacagggatgcgagtcaggaactccagcatgagccaggaccattcccctcatcaatggacacttcttgaacta

SEQ ID NO: 329803 - DNA, 411 bp, Homo sapiens
tggagagggcacgtgtagcctctgcaagaaggagcaccagggcaaggaaagcttgggcagctcggggcagcctgggaggggaggccacccacatgttcaagcccacagcacctccaggtctgtctgggcattgggaatctagaagatttgccaagaatgctgcttccagacctttctgttctactggttgctctcctgcactggtgtcctcaacacacttctgaacacacctcgctaacagatcagaatcctatagcccacagaaccatcagagccagaccttgagggcctgagctggtgtttctggagaccaggctcctggggacagatgtcaagagtacattccaccaaagccacctcggtccatgccccgccaccacggaagccacctctgtctccaccacagcgcga

SEQ ID NO: 329804 - DNA, 321 bp, Homo sapiens
tatggcaggataagagagaagaatgagacttgtggaggtgactctattaatttaaataaggttgtttggtgtgttttgagaaaccctagtcctgagagatctatgagaaatggattctggggacaaattagtttgagaaacgttaccctattaagttctgccataaagaaacttatgtaattgtggattaaagccagttaaacaagttattagacaagaaaacccccgatcatcactaggattttgtgagctaaagttccaaagagcacattgcaggagaagctggaccagagtatgaggatccagtggccaggtaggaca

SEQ ID NO: 329805 - DNA, 684 bp, Homo sapiens
gcagtagagctcgctgcagatccgggctctgaccatgatttggcgccgcgcggcgctggcggggacgcggctggtttggagcaggagcggctcggcaggctggcttgacagggcggcgggagctgcgggagctgcggcagctgcggcctctgggatggagagcaatacatcatcatctttggagaatttagcgacggcgcctgtgaaccagatccaagaaacaatttctgataattgtgtggtgattttctcaaaaacatcctgttcttactgtacaatggcaaaaaagcttttccatgacatgaatgttaactataaagtggtggaactggacctgcttgaatatggaaaccagttccaagatgctctttacaaaatgactggtgaaagaactgttccaagaatatttgtcaatggtacttttattggaggtgcaactgacactcataggcttcacaaagaaggaaaattgctcccactagttcatcagtgttatttaaaaaaaagtaagaggaaagaatttcagtgatgtttatactaataagtttgctagtacagtgtcagttatttaaagtggtaatgcccgataatgtcttttaaatgtttgaggatgttttaaatacatgcattgtcttcacgaagaagatgtaaaaataatgaacaataaattgcggtggaaacctc

SEQ ID NO: 329806 - DNA, 1037 bp, Homo sapiens
gcagtagagctcgctgcagatccgggctctgaccatgatttggcgccgcgcggcgctggcggggacgcggctggtttggagcaggagcggctcggcaggctggcttgacagggcggcgggagctgcgggagctgcggcagctgcggcctctgggatggagagcaatacatcatcatctttggagaatttagcgacggcgcctgtgaaccagatccaagaaacaatttctgataattgtgtggtgattttctcaaaaacatcctgttcttactgtacaatggcaaaaaagcttttccatgacatgaatgttaactataaagtggtggaactggacctgcttgaatatggaaaccagttccaagatgctctttacaaaatgactggtgaaagaactgttccaagaatatttgtcaatggtacttttattggaggtgcaactgacactcataggcttcacaaagaaggaaaattgctcccactagttcatcagtgttatttaaaaaaaagtaagaggaaagaatttcagtgatgtttatactaataagtttgctagtacagtgtcagttatttaaagtggtaatgcccgataatgtcttttaaatgtttgaggatgttttaaatacatgcattgtcttcacgaagaagatgtaaaaataatgaacaataaattgcggtggaaacctcaaaaaaaaacaaaattaacaacccccctctccacagcaacccgcaccaccccactccgaacacaccaccctgggcctctttggcttaaggggggaaccttcgcgcccgctctcttttagggggggtaaatcaagaaccctgcttcactaactacttcactctgagcctcgcgtggcgggcaggggttcaaccaccttaaagggggatatccggttttccactacatcaggggaaaccccagaagaaaattgtggcacaaaggcccacaaagggccgaaaacctaaaaagggcgccgtcgggcgggttatcataaggcctcccccctgtgcagatcaaaaaattgcactttaag

SEQ ID NO: 329807 - DNA, 727 bp, Homo sapiens
  misc_feature (685)..(685): n is a, c, g, or t
  misc_feature (720)..(720): n is a, c, g, or t
  misc_feature (727)..(727): n is a, c, g, or t
gcagtagagctcgctgcagatccgggctctgaccatgatttggcgccgcgcggcgctggcggggacgcggctggtttggagcaggagcggctcggcaggctggcttgacagggcggcgggagctgcgggagctgcggcagctgcggcctctgggatggagagcaatacatcatcatctttggagaatttagcgacggcgcctgtgaaccagatccaagaaacaatttctgataattgtgtggtgattttctcaaaaacatcctgttcttactgtacaatggcaaaaaagcttttccatgacatgaatgttaactataaagtggtggaactggacctgcttgaatatggaaaccagttccaagatgctctttacaaaatgactggtgaaagaactgttccaagaatatttgtcaatggtacttttattggaggtgcaactgacactcataggcttcacaaagaaggaaaattgctcccactagttcatcagtgttatttaaaaaaaagtaagaggaaagaatttcagtgatgtttatactaataagtttgctagtacagtgtcagttatttaaagtggtaatgcccgataatgtcttttaaatgtttgaggatgttttaaatacatgcattgtcttcacgaagaagatgtaaaaataatgaacaataaattgcggtggaaacctcncgatggcctcgttggcctcagcggtggagctctcngccggan

SEQ ID NO: 329808 - DNA, 701 bp, Homo sapiens
  misc_feature (660)..(660): n is a, c, g, or t
  misc_feature (668)..(668): n is a, c, g, or t
  misc_feature (672)..(672): n is a, c, g, or t
  misc_feature (674)..(674): n is a, c, g, or t
gcagtagagctcgctgcagatccgggctctgaccatgatttggcgccgcgcggcgctggcggggacgcggctggtttggagcaggagcggctcggcaggctggcttgacagggcggcgggagctgcgggagctgcggcagctgcggcctctgggatggagagcaatacatcatcatctttggagaatttagcgacggcgcctgtgaaccagatccaagaaacaatttctgataattgtgtggtgattttctcaaaaacatcctgttcttactgtacaatggcaaaaaagcttttccatgacatgaatgttaactataaagtggtggaactggacctgcttgaatatggaaaccagttccaagatgctctttacaaaatgactggtgaaagaactgttccaagaatatttgtcaatggtacttttattggaggtgcaactgacactcataggcttcacaaagaaggaaaattgctcccactagttcatcagtgttatttaaaaaaaagtaagaggaaagaatttcagtgatgtttatactaataagtttgctagtacagtgtcagttatttaaagtggtaatgcccgataatgtcttttaaatgtttgaggatgttttaaatacatgcattgtcttcacgaagaagagttttatctcccgncaagatcncatncngagtcacacaaagaaacctcttttcct

SEQ ID NO: 329809 - DNA, 1129 bp, Homo sapiens
aaggctattattaccaccactgagtggcttaaataatcctgtcaacagcaatcgcccatttccaaagccatggtgaaacatctctgtgctaatttcttttgttttgtttcctaattttttttttttggcaggtggtgggaaataatctttgtcttctttggagtaaaccttcaacaccggattttttcttttaattatggatgtaaaccccaatatccccataatttacattgggtctcgaccaattgcctaattataagaggatatatttaggctcttatttcatccacacaaaaacttgtgtaacaggtagttggaaacatctgaggcaccactttgattctgttttggatggtcatgttttttctcctccgtttccccagcatgtctgccaccatcctcatgcactgcttccaagtgcctgggagcctttatgagcgtccctaaacctaaaagaatccagaggcggggctcggatgaaccctcgagataagcaagtgagccgcttctcccctctaaaggatgtttacacgtgggtggcactcgctggaatccagcgctcgggcagccctgggaggacgcgctcagctgcgaggaggatggagagcaatacatcatcatctttggagaatttagcgacggcgcctgtgaaccagatccaagaaacaatttctgataattgtgtggtgattttctcaaaaacatcctgttcttactgtacaatggcaaaaaagcttttccatgacatgaatgttaactataaagtggtggaactggacctgcttgaatatggaaaccagttccaagatgctctttacaaaatgactggtgaaagaactgttccaagaatatttgtcaatggtacttttattggaggtgcaactgacactcataggcttcacaaagaaggaaaattgctcccactagttcatcagtgttatttaaaaaaaagtaagaggaaagaatttcagtgatgtttatactaataagtttgctagtacagtgtcagttatttaaagtggtaatgcccgataatgtcttttaaatgtttgaggatgttttaaatacatgcattgtcttcacgaagaagatgtaaaaataatgaacaataaattgcggtggaaacctc

SEQ ID NO: 329810 - DNA, 535 bp, Homo sapiens
  misc_feature (1)..(1): n is a, c, g, or t
  misc_feature (28)..(28): n is a, c, g, or t
  misc_feature (39)..(39): n is a, c, g, or t
ntcttttgttcatcgcaaacatccttanctgtaggactngagcgacggcgcctgtgaaccagatccaagaaacaatttctgataattgtgtggtgattttctcaaaaacatcctgttcttactgtacaatggcaaaaaagcttttccatgacatgaatgttaactataaagtggtggaactggacctgcttgaatatggaaaccagttccaagatgctctttacaaaatgactggtgaaagaactgttccaagaatatttgtcaatggtacttttattggaggtgcaactgacactcataggcttcacaaagaaggaaaattgctcccactagttcatcagtgttatttaaaaaaaagtaagaggaaagaatttcagtgatgtttatactaataagtttgctagtacagtgtcagttatttaaagtggtaatgcccgataatgtcttttaaatgtttgaggatgttttaaatacatgcattgtcttcacgaagaagatgtaaaaataatgaacaataaattgcggtggaaacctc

SEQ ID NO: 329811 - DNA, 587 bp, Homo sapiens
  misc_feature (49)..(49): n is a, c, g, or t
  misc_feature (55)..(55): n is a, c, g, or t
acagacaaactgattattataatcatcataaataaaaaatattctcagnaggcanagatggagagcaatacatcatcatctttggagaatttagcgacggcgcctgtgaaccagatccaagaaacaatttctgataattgtgtggtgattttctcaaaaacatcctgttcttactgtacaatggcaaaaaagcttttccatgacatgaatgttaactataaagtggtggaactggacctgcttgaatatggaaaccagttccaagatgctctttacaaaatgactggtgaaagaactgttccaagaatatttgtcaatggtacttttattggaggtgcaactgacactcataggcttcacaaagaaggaaaattgctcccactagttcatcagtgttatttaaaaaaaagtaagaggaaagaatttcagtgatgtttatactaataagtttgctagtacagtgtcagttatttaaagtggtaatgcccgataatgtcttttaaatgtttgaggatgttttaaatacatgcattgtcttcacgaagaagatgtaaaaataatgaacaataaattgcggtggaaacctc

SEQ ID NO: 329812 - DNA, 392 bp, Homo sapiens
cactctattcaggtcaacagaaacacttttaaaatggcattttcaatgcattatctcttaacatttacaaaccagcttatactttccttaattcagttcattacataataatataaatgaagcaaaaattataaaatgtagtagcaatcactgaggctgctatgaaaggtagttttataggttgcaaagtttatggtttgcaaagtaaaataaagccaaaaacggtaagtaataactaaactctataaaacagtctctctctagatgtgatttttcctttgacactgcacaaccaaatggtttcatttggcaaatactgatactggagttgactattacatagttggttctttagtttttgttttgctcatatacattttcaagttgtatga

SEQ ID NO: 329813 - DNA, 166 bp, Homo sapiens
tctacttgccaaattaacttggttagttttccttttatattcatcagaaccgaagacattttcattctgttctgaaaccataattaagtcagtaagtcttcagtgtttcagtcatacattgatttcaaaaatgaaagctcgggccgggtgcggtggctcacacctg

SEQ ID NO: 329814 - DNA, 207 bp, Homo sapiens
ttccctttatgttttagtggaaagacaaatgctttttaatataaatcaaataactatgataattgctaaatactagccaatggtctcttctgtctcaaacattattcaatacaacaagaaggaaataaaaacgttggattagatattgaggctgaagtccctgctgtaagggacatgctggaaggctggtattctagatacttacct

SEQ ID NO: 329815 - DNA, 245 bp, Homo sapiens
atgataatggaaattttttggtagagtgacatgattagatttttgcctcagaaggaagtctgtagttctgtggaggtcacatatgttggagtaagagaccagggacagtgaaacctgtcttgaggagcaaagataagtggtctgaatttctgtcgtgacagcaggataggaagaaaacagaatgatttccagctgatgaatcaggaggcccaggaggtttagtgaggggtggagatgagaacgta

SEQ ID NO: 329816 - DNA, 518 bp, Homo sapiens
gcggccgcccagagcggcggcgggggcggcggggcgcggggcgcgggggcccagctgagccggccgtcggagtgagaccctgcggcagagacgacggaggcggaagcaacccgatcccggaggcggcggcggcggggggagccggagccgcctgggatgttcagtcatgaaacgagtgcgtaccgagcagattcagatggcagtgtcctgctacctcaaacgccggcagtacgtggactcagatggtcccctgaagcaaggactgcggctgtcacagactgctgaagagatggcggccaatctaacagtgcaatcagaatctggttgtgccaacatagtgtctgcagccccttgccaggcagaaccccagcaatatgaagtacagtttggacgactgcggaattttctcactggtctctgaagagcagttaaccaaatcaaatgaatagttatttcctgatcaccaagataaagtgttgtctgtagatgagagattctgtgagctcacctattgccgt

SEQ ID NO: 329817 - DNA, 441 bp, Homo sapiens
gcggccgcccagagcggcggcgggggcggcggggcgcggggcgcgggggcccagctgagccggccgtcggagtgagaccctgcggcagagacgacggaggcggaagcaacccgatcccggaggcggcggcggcggggggagccggagccgcctgggatgttcagtcatgaaacgagtgcgtaccgagcagattcagatggcagtgtcctgctacctcaaacgccggcagtacgtggactcagatggtcccctgaagcaaggactgcggctgtcacagactgctgaagagatggcggccaatctaacaggtaatggtgggggctcgtctggtggggtgagcctggagcaggagaactcacgtcaatatccatgtggaattacttctcctcttctcaagacagtgccagagagagcagactgaccaaaaacctcagtgagcta

SEQ ID NO: 329818 - DNA, 2931 bp, Homo sapiens
aatccgagctcgatacccgtctgtaggaggcaagcaatagatgtgatttatctcagcctgggttaataatcgtctctctgtttcccgccctgacttgtgtatcttctcctctttagtgcaatcagaatctggttgtgccaacatagtgtctgcagccccttgccaggcagaaccccagcaatatgaagtacagtttggacgactgcggaattttctcactgattctgattcccagcatagccacgaagtgatgcctctcctctatcctctctttgtctacctccatctcaacctggtccaaaacagtccgaagagcacagtggaaagtttttacagccgcttccatggaatgtttctgcagaatgctagccagaaggatgtcattgagcagctacagaccactcaaaccatccaggacatcctatctaacttcaagcttcgagcattcctagataacaagtacgtggtccgtctccaagaagacagctacaactaccttatccgctacctccaaagtgacaacaatactgccctgtgcaaagtcctcaccttacatattcatcttgacgtgcagcctgccaagagaacagactatcagctgtatgccagtggcagctcctcccgcagtgagaacaacggtttggagccccctgacatgcccagccctattctgcagaacgaggctgccctagaggtcttacaggagagcattaagcgcgtcaaggatgggcctccctccctcactaccatctgcttctatgccttctataacacagagcagctgttgaacactgcagaaatctcccccgatagcaagctgcttgctgctgggtttgacaactcctgtataaaactttggagtttacgatccaagaagttaaaatcagagccccaccaagtagacgtgtcccgcatccatttggcttgtgatattctggaggaggaggatgatgaggatgataatgcaggcacggagatgaagatactgcggggccactgcggaccagtgtacagcacgaggttcctcgcggacagctcagggttgctctcttgttctgaagacatgtccatcagatactgggatctggggagtttcaccaacactgtgttgtaccaaggacatgcctatcctgtgtgggatctggacatcagtccatatagcctgtacttcgccagcgggtcccacgaccgcaccgccaggctgtggtcatttgatcggacgtacccgctgaggatatatgcaggacacctgcgcagatgtggactgtgtcaaattccaccctaattcaaactacttggccacgggctcaaccgacaagaccgtccggctgtggagcgctcagcaggggaactcggtgaggcttttcacaggccaccgtggccccgtgctttctctcgccttttctcccaacggtaagtacttggcgtctgctggcgaggaccagcggttgaagctgtgggacttggcctctgggaccctttataaagagttgagaggccacacagacaatatcaccagcctcaccttcagtccagacagcggcttgattgcctctgcctccatggacaactcggtgcgcgtctgggacatcaggaacacttactgcagtgcacctgccgacggctcctccagcgagctcgtgggcgtgtacaccgggcagatgagcaacgtcctgagcgtgcagttcatggcctgtaaccttcttctggtgactggaattacacaagaaaatcaggaacattaattttttaactttgttggaacggactggggtaacagtggaaagcctccagttgcaatccttcaatgagctgagattgaatcattgactgtgaaagagccccctcctcccctctctcctgggccctcattccgggcaggtcccccttcactcagccccccagtgtcgaaggccaaggttggggaggggaacaggagagaggcaatgatgagtgatcaagaattagagtgccctggaggtcactcacaagtcctcatggagactctgccgtgacctcgcgcatgcgagcaccttcctgtctctcattttcaccatctgactggggctaggtttggttagagggcggctgtagagcaccctcaggagaagtggcgccgcaggggtcacgcatggtccagccctcaggtgggagggaagtccttgttggcagagggatgtggggcgggaatgaggaaaggggagggcatgatcctggcaaatagtctttccttttccgtaattacagagaaccaggattttttttaattattgttattataattataattattattattattgacatgaggaaacctagcactggcagagggcaccttctctgcttttaatctttcaggtttgactcctggcactggttttgatacttggaattttgaggttcagggaattcagagaatttggtagcacagtgtattgggagaaagggaaatttcgggtgacagattgatcaccctggctgacatgtttctggaagtgggtgggtgggtttgattgagaacactttgggctcctgcagtgatggtgggaaagaaaaattctttccaaagctgcacttctcttaataattctctcccctcaaaagaaagattatgataaagaataatttggagtaataagtaacaagatagaattagaaaaatgttgaatttctgaatgaccattcagaggtgtggctttttccacgtctttttctcctgcaatgaactgctcccacgtcctgcactgcaataccagtctaatgaacactttgtgaaacaaatcgtaagtatgtacgcacgcatatcaaactatgctctgaggataaagcaagttctaatttgtggaaaaaggattaaatatttctgttttctgaaaagagttattttgtattttgttttctattaaaatgtatttagtttcaaaaaaaaaa

SEQ ID NO: 329819 - DNA, 795 bp, Homo sapiens
gcggccgcccagagcggcggcgggggcggcggggcgcggggcgcgggggcccagctgagccggccgtcggagtgagaccctgcggcagagacgacggaggcggaagcaacccgatcccggaggcggcggcggcggggggagccggagccgcctgggatgttcagtcatgaaacgagtgcgtaccgagcagattcagatggcagtgtcctgctacctcaaacgccggcagtacgtggactcagatggtcccctgaagcaaggactgcggctgtcacagactgctgaagagatggcggccaatctaacagtgcaatcagaatctggttgtgccaacatagtgtctgcagccccttgccaggcagaaccccagcaatatgaagtacagtttggacgactgcggaattttctcactgattctgattcccagcatagccacgaagtgatgcctctcctctatcctctctttgtctacctccatctcaacctggtccaaaacagtccgaagagcacagtggaaagtttttacagccgcttccatggaatgtttctgcagaatgctagccagaaggatgtcattgagcagctacagaccactcaaaccatccaggacatcctatctaacttcaagcttcgagcattcctagataacaagtacgtggtccgtctccaagaagacagctacaactaccttatccgctacctccaaagtgacaacaatactgccctgtcgggctagtcggggccccgactagcccgacagcccccctagccccccctgtcgggctagtcgggggg

SEQ ID NO: 329820 - DNA, 373 bp, Homo sapiens
caggcccctgatgtctctgtatcctgtcgttgcctcccttgaaggtcatgaaacgagtgcgtaccgagcagattcagatggcagtgtcctgctacctcaaacgccggcagtacgtggactcagatggtcccctgaagcaaggactgcggctgtcacagactgctgaagagatggcggccaatctaacaggtaatggtgggggctcgtctggtggggtgagcctggagcaggagaactcacgtcaatatccatgtggaattacttctcctcttctcaagacagtgccagagagagcagactgaccaaaaacctcagtgagctacgttaagtgaatgatgttggcctcagagaccctgtctgtcatttagagcgg

SEQ ID NO: 329821 - DNA, 3123 bp, Homo sapiens
gcggccgcccagagcggcggcgggggcggcggggcgcggggcgcgggggcccagctgagccggccgtcggagtgagaccctgcggcagagacgacggaggcggaagcaacccgatcccggaggcggcggcggcggggggagccggagccgcctgggatgttcagtcatgaaacgagtgcgtaccgagcagattcagatggcagtgtcctgctacctcaaacgccggcagtacgtggactcagatggtcccctgaagcaaggactgcggctgtcacagactgctgaagagatggcggccaatctaacagtgcaatcagaatctggttgtgccaacatagtgtctgcagccccttgccaggcagaaccccagcaatatgaagtacagtttggacgactgcggaattttctcactgattctgattcccagcatagccacgaagtgatgcctctcctctatcctctctttgtctacctccatctcaacctggtccaaaacagtccgaagagcacagtggaaagtttttacagccgcttccatggaatgtttctgcagaatgctagccagaaggatgtcattgagcagctacagaccactcaaaccatccaggacatcctatctaacttcaagcttcgagcattcctagataacaagtacgtggtccgtctccaagaagacagctacaactaccttatccgctacctccaaagtgacaacaatactgccctgtgcaaagtcctcaccttacatattcatcttgacgtgcagcctgccaagagaacagactatcagctgtatgccagtggcagctcctcccgcagtgagaacaacggtttggagccccctgacatgcccagccctattctgcagaacgaggctgccctagaggtcttacaggagagcattaagcgcgtcaaggatgggcctccctccctcactaccatctgcttctatgccttctataacacagagcagctgttgaacactgcagaaatctcccccgatagcaagctgcttgctgctgggtttgacaactcctgtataaaactttggagtttacgatccaagaagttaaaatcagagccccaccaagtagacgtgtcccgcatccatttggcttgtgatattctggaggaggaggatgatgaggatgataatgcaggcacggagatgaagatactgcggggccactgcggaccagtgtacagcacgaggttcctcgcggacagctcagggttgctctcttgttctgaagacatgtccatcagatactgggatctggggagtttcaccaacactgtgttgtaccaaggacatgcctatcctgtgtgggatctggacatcagtccatatagcctgtacttcgccagcgggtcccacgaccgcaccgccaggctgtggtcatttgatcggacgtacccgctgaggatatatgcaggacacctgcgcagatgtggactgtgtcaaattccaccctaattcaaactacttggccacgggctcaaccgacaagaccgtccggctgtggagcgctcagcaggggaactcggtgaggcttttcacaggccaccgtggccccgtgctttctctcgccttttctcccaacggtaagtacttggcgtctgctggcgaggaccagcggttgaagctgtgggacttggcctctgggaccctttataaagagttgagaggccacacagacaatatcaccagcctcaccttcagtccagacagcggcttgattgcctctgcctccatggacaactcggtgcgcgtctgggacatcaggaacacttactgcagtgcacctgccgacggctcctccagcgagctcgtgggcgtgtacaccgggcagatgagcaacgtcctgagcgtgcagttcatggcctgtaaccttcttctggtgactggaattacacaagaaaatcaggaacattaattttttaactttgttggaacggactggggtaacagtggaaagcctccagttgcaatccttcaatgagctgagattgaatcattgactgtgaaagagccccctcctcccctctctcctgggccctcattccgggcaggtcccccttcactcagccccccagtgtcgaaggccaaggttggggaggggaacaggagagaggcaatgatgagtgatcaagaattagagtgccctggaggtcactcacaagtcctcatggagactctgccgtgacctcgcgcatgcgagcaccttcctgtctctcattttcaccatctgactggggctaggtttggttagagggcggctgtagagcaccctcaggagaagtggcgccgcaggggtcacgcatggtccagccctcaggtgggagggaagtccttgttggcagagggatgtggggcgggaatgaggaaaggggagggcatgatcctggcaaatagtctttccttttccgtaattacagagaaccaggattttttttaattattgttattataattataattattattattattgacatgaggaaacctagcactggcagagggcaccttctctgcttttaatctttcaggtttgactcctggcactggttttgatacttggaattttgaggttcagggaattcagagaatttggtagcacagtgtattgggagaaagggaaatttcgggtgacagattgatcaccctggctgacatgtttctggaagtgggtgggtgggtttgattgagaacactttgggctcctgcagtgatggtgggaaagaaaaattctttccaaagctgcacttctcttaataattctctcccctcaaaagaaagattatgataaagaataatttggagtaataagtaacaagatagaattagaaaaatgttgaatttctgaatgaccattcagaggtgtggctttttccacgtctttttctcctgcaatgaactgctcccacgtcctgcactgcaataccagtctaatgaacactttgtgaaacaaatcgtaagtatgtacgcacgcatatcaaactatgctctgaggataaagcaagttctaatttgtggaaaaaggattaaatatttctgttttctgaaaagagttattttgtattttgttttctattaaaatgtatttagtttcaaaaaaaaaa

SEQ ID NO: 329822 - DNA, 1326 bp, Homo sapiens
gcggccgcccagagcggcggcgggggcggcggggcgcggggcgcgggggcccagctgagccggccgtcggagtgagaccctgcggcagagacgacggaggcggaagcaacccgatcccggaggcggcggcggcggggggagccggagccgcctgggatgttcagtcatgaaacgagtgcgtaccgagcagattcagatggcagtgtcctgctacctcaaacgccggcagtacgtggactcagatggtcccctgaagcaaggactgcggctgtcacagactgctgaagagatggcggccaatctaacagtgcaatcagaatctggttgtgccaacatagtgtctgcagccccttgccaggcagaaccccagcaatatgaagtacagtttggacgactgcggaattttctcactgattctgattcccagcatagccacgaagtgatgcctctcctctatcctctctttgtctacctccatctcaacctggtccaaaacagtccgaagagcacagtggaaagtttttacagccgcttccatggaatgtttctgcagaatgctagccagaaggatgtcattgagcagctacagaccactcaaaccatccaggacatcctatctaacttcaagcttcgagcattcctagataacaagtacgtggtccgtctccaagaagacagctacaactaccttatccgctacctccaaagtgacaacaatactgccctgtgcaaagtcctcaccttacatattcatcttgactcctggcactggttttgatacttggaattttgaggttcagggaattcagagaatttggtagcacagtgtattgggagaaagggaaatttcgggtgacagattgatcaccctggctgacatgtttctggaagtgggtgggtgggtttgattgagaacactttgggctcctgcagtgatggtgggaaagaaaaattctttccaaagctgcacttctcttaataattctctcccctcaaaagaaagattatgataaagaataatttggagtaataagtaacaagatagaattagaaaaatgttgaatttctgaatgaccattcagaggtgtggctttttccacgtctttttctcctgcaatgaactgctcccacgtcctgcactgcaataccagtctaatgaacactttgtgaaacaaatcgtaagtatgtacgcacgcatatcaaactatgctctgaggataaagcaagttctaatttgtggaaaaaggattaaatatttctgttttctgaaaagagttattttgtattttgttttctattaaaatgtatttagtttcaaaaaaaaaa

SEQ ID NO: 329823 - DNA, 393 bp, Homo sapiens
caggtataatgttgcccaaaaatgtcagtcttctcccagcctcttgccccaccaggcctttattccatcagcctggtcctgacatttattaagtacttatgtcactcagcactctggactgtgcctcatgctagatgagaatgtcttcaaataaaataacgtagttgtggaagaatcacctgagcccaggaggtcgaggctgcagtgagctgtgattgtgccactgcactccagcctaggtggtgggagcctgtcttgaggccaccctggccaacacagtgaaaccccctatctactaaaaatacaaaaattagcagggtgtggtggcgggcacctgtaatcccagcaactcgggaggctgaggcaggagaatcacttgaacccgggaggcag

SEQ ID NO: 329824 - DNA, 298 bp, Homo sapiens
tcatctcccagggtcatttcaatgacaaatgcacaagaaggaaaagaccccaaaagcactgaaacccccactctaccactcccactggcaactagagaaaaggggtccaaaggcagtcttgaggggtggggcaacctccctctagctagacagcatgcagggagcttggagcccagcagaccccaaagctgagcgaggcaggcacccactcagtgagaggactcgtgattacagtctgttccagggaagatcaatatagcaggaaaagtcaagacagataccagggcatgggtcgacg

SEQ ID NO: 329825 - DNA, 903 bp, Homo sapiens
tcttaaaggaaggaacaaaatcaaaggctgagatttcttaacttcatcacctttaatgaggctcaccattacattttctgaatgtgcttgtgttaattattagtaatggtaacagagtacagacagtatactaattacaatattaagcagggctggctggttaattctctcttgagaatttgaactaggacatatcaacagccttgggatctgaagctataataacatgagatagagaggttcccaaaacccattagagtcatgtagaagccgtgtgatcttaagcaagttatttaatttctctgtacctcactttcttcagctaaaaaaagtaaggatgatagtttccatgtcaagactttttgatttaatgagttaatatctgtggagtctttaaaacattgcttgatgtactggtaagtgctatttatgttaaataagctaataaacaatcaaataaatgcctgaaatcatcaggaattagggaacaatgtatgaacagaagaggccagccaacagagagagaagaatggagcagatgtgcagaaactgtgcaagagtgcccccgctggtcctaagggactaggccaagatgcaatttctagagctaactcttgggactgggggatgaggaatgggaggcagtgctggcaccttcattcaccttcattcactagaactgtcactgagtgtaaataaaggtcatttgtttgtgtgactgtttttgtaagagagtgtgtcagaatggaagttggtggctgattgagacttagagggggtgattgggaatgatggatgctaaggctcagtacccaacattgcccttacttagctatgtcaatcaatgacctctcgtattcttaccagaaataaccccacttttaaaaaagtgctttttaaaga

SEQ ID NO: 329826 - DNA, 471 bp, Homo sapiens
gcattgttgatacagcatttcttaggaatgccactgttgtctacagaattttcttccaagctactgacactcattctgtaagttctatgggtatgcacaggcaatgaggatacatcacaaccgccatctgctcagcaatgattgtaggatacattccaattttggagattcattgtagaatcaaaacttagtattgtactcttaaaggaaggaacaaaatcaaaggctgagatttcttaacttcatcacctttaatgaggctcaccattacattttctgaatgtgcttgtgttaattattagtaatggtaacagagtacagacagtatactaattacaatattaagcagggctggctggttaattctctcttgagaatttgaactaggacatatcaacagccttgggatctgaagctataataacatgagatagagaggttcccaaaacccattagagtcatgtagaagcc

SEQ ID NO: 329827 - DNA, 737 bp, Homo sapiens
tcccttcagggagcagaggcaggggcctggacttgggagcctagagggtgggggcttggagccacttgaggttagaaccttggctccccctcttgtgacaggatataaggacaaaggaaaccagatttgtgcaaacagaggaggcgtttgtggggtcaccaggctaggactggccatgcaagggccttatgtcatctgggctctctgaggcctcccctctggagcataaccatcagacagccagagatgtccccacgcccccaccatgttttctgtgccagggaggaggagcacacaggcagagaggcagatgagtactgactgacagtcagctgcaccggttgttaaaatgtttccaccctacagccctgagctccccaggcgctttcactcaccttacccaggacctcccaacctcccagcaactaaacactccagcaacgaaagggttaatactgcccatcaggagcctccctgtttctcctccaagcttaccagtatgcatctccatggcgaacaggttgttaaatattttgaatattgcccctgctcccaaacaggactcagacaccaacacacaaaagctggagtaagcaggagagggaggtccaactgacagaaagtaacggcctggattttagctttgtaggtttattagtttgtgcaggagtggtcaggtctagggggactgattcacattaaccaagatcaccagatgctgatgtacaaactgaaag

SEQ ID NO: 329828 - DNA, 2122 bp, Homo sapiens
agaattcagcggccgctgaattctagcaaaggcaccatgcctctgcgggatgaaaccctccgagaggtgtgggcctctgacagtgggcatgaagaagaaagcctgagcccggaggccccgcggcgccccaaacagcgacccgccccggcacagaggctaaggaagaagaggacggaggcccccgaatccccctgccccacgggatccaagccccggaagcccggagaggaggaggaggaagaggaggacgaggaggacgaggaagaggaggcagaggaaaagaaagagaaaatccttctgcctcccaagaagcccctgagagagaagagctccgcagacctgaaggagaggagggccaaggcccagggcccaaggggagacctgggaagccctgaccccccaccgaaacctctgcgtgttaggaataaggaagctccagcaggggaggggaccaagatgagaaagaccaagaagaaagggtctggggaggccgacaaggacccctcagggagcccagccagtgcgaggaagagcccagcagccatgtttctggttggggaaggcagtcctgacaagaaagccctgaagaagaaaggcactcccaaaggcgcgaggaaggaggaagaagaggaggaggaggcagctacggtgataaagaacagcaatcaaaagggcaaagccaaaggaaaaggcaaaaagaaagcgaaggaggagagggccccgtctccccccgtggaggtggacgaaccccgggagtttgtgctccggcctgccccccagggccgcacggtgcgctgccggctgacccgggacaaaaagggcatggatcgaggcatgtatccctcctacttcctgcacctggacacggagaagaaggtgttcctcttggctggcaggaaacgaaaacggagcaagacagccaattacctcatctccatcgaccctaccaatctgtcccgaggaggggagaatttcatcgggaagctgaggtccaacctcctggggaaccgcttcacggtctttgacaacgggcagaacccacagcgtgggtacagcactaatgtggcaagccttcggcaggagctggcagctgtgatctatgaaaccaacgtgctgggcttccgtggcccccggcgcatgaccgtcatcattcctggcatgagtgcggagaacgagagggtccccatccggccccgaaatgctagtgacggcctgctggtgcgctggcagaacaagacgctggagagcctcatagaactgcacaacaagccacctgtctggaacgatgacagtggctcctacaccctcaacttccaaggccgggtcacccaggcctcagtcaagaacttccagattgtccacgctgatgaccccgactatatcgtgctgcagttcggccgcgtggcggaggacgccttcaccctagactaccggtacccgctgtgcgccctgcaggccttcgccatcgccctctccagtttcgacgggaagctggcctgcgagtgaccccagcagcccctcagcgcccccagagcccgtcagcgtgggggaaaggattcagtggaggctggcagggtccctccagcaaagctcccgcggaaaactgctcctgtgtcggggctgacctctcactgcctctcggtgacctccgtcctctccccagcctggcacaggccgaggcaggaggagcccggacggcgggtaggacggagatgaagaacatctggagttggagccgcacatctggtctcggagctcgcctgcgccgctgtgcccccctcctccccgcgccccagtcacttcctgtccgggagcagtagtcattgttgttttaacctcccctctccccgggaccgcgctagggctccgaggagctggggcgggctaggaggagggggtaggtgatgggggacgagggccaggcacccacatccccaataaagccgcgtccttggccaagcggagcggtggttcctcagcgcgtgcggagaacgaggcggcaggaggcgtccgaggcgcgagctggaagtctcaacccccgtcccactcctgcccaggccccgggcgctcccgcgtcccctccccgcgcccgtcgcgggtcctaccgaaactcggcggccgc

SEQ ID NO: 329829 - DNA, 2281 bp, Homo sapiens
agaattcagcggccgctgaattctagcaaaggcaccatgcctctgcgggatgaaaccctccgagaggtgtgggcctctgacagtgggcatgaagaagaaagcctgagcccggaggccccgcggcgccccaaacagcgacccgccccggcacagaggctaaggaagaagaggacggaggcccccgaatccccctgccccacgggatccaagccccggaagcccggagctgggcggacggggaggccgcgggaggagccttccccagacccagcccaggcccgggcgccgcagacggtctacgccaggttcctcagggaccccgaggccaagaagcgcgacccccgggaaacctttctggtagcccgtgccccagacgcggaggacgaggaggaggaggaagaggaggacgaggaggacgaggaagaggaggcagaggaaaagaaagagaaaatccttctgcctcccaagaagcccctgagagagaagagctccgcagacctgaaggagaggagggccaaggcccagggcccaaggggagacctgggaagccctgaccccccaccgaaacctctgcgtgttaggaataaggaagctccagcaggggaggggaccaagatgagaaagaccaagaagaaagggtctggggaggccgacaaggacccctcagggagcccagccagtgcgaggaagagcccagcagccatgtttctggttggggaaggcagtcctgacaagaaagccctgaagaagaaaggcactcccaaaggcgcgaggaaggaggaagaagaggaggaggaggcagctacggtgataaagaacagcaatcaaaagggcaaagccaaaggaaaaggcaaaaagaaagcgaaggaggagagggccccgtctccccccgtggaggtggacgaaccccgggagtttgtgctccggcctgccccccagggccgcacggtgcgctgccggctgacccgggacaaaaagggcatggatcgaggcatgtatccctcctacttcctgcacctggacacggagaagaaggtgttcctcttggctggcaggaaacgaaaacggagcaagacagccaattacctcatctccatcgaccctaccaatctgtcccgaggaggggagaatttcatcgggaagctgaggtccaacctcctggggaaccgcttcacggtctttgacaacgggcagaacccacagcgtgggtacagcactaatgtggcaagccttcggcaggagctggcagctgtgatctatgaaaccaacgtgctgggcttccgtggcccccggcgcatgaccgtcatcattcctggcatgagtgcggagaacgagagggtccccatccggccccgaaatgctagtgacggcctgctggtgcgctggcagaacaagacgctggagagcctcatagaactgcacaacaagccacctgtctggaacgatgacagtggctcctacaccctcaacttccaaggccgggtcacccaggcctcagtcaagaacttccagattgtccacgctgatgaccccgactatatcgtgctgcagttcggccgcgtggcggaggacgccttcaccctagactaccggtacccgctgtgcgccctgcaggccttcgccatcgccctctccagtttcgacgggaagctggcctgcgagtgaccccagcagcccctcagcgcccccagagcccgtcagcgtgggggaaaggattcagtggaggctggcagggtccctccagcaaagctcccgcggaaaactgctcctgtgtcggggctgacctctcactgcctctcggtgacctccgtcctctccccagcctggcacaggccgaggcaggaggagcccggacggcgggtaggacggagatgaagaacatctggagttggagccgcacatctggtctcggagctcgcctgcgccgctgtgcccccctcctccccgcgccccagtcacttcctgtccgggagcagtagtcattgttgttttaacctcccctctccccgggaccgcgctagggctccgaggagctggggcgggctaggaggagggggtaggtgatgggggacgagggccaggcacccacatccccaataaagccgcgtccttggccaagcggagcggtggttcctcagcgcgtgcggagaacgaggcggcaggaggcgtccgaggcgcgagctggaagtctcaacccccgtcccactcctgcccaggccccgggcgctcccgcgtcccctccccgcgcccgtcgcgggtcctaccgaaactcggcggccgc

SEQ ID NO: 329830 - DNA, 2285 bp, Homo sapiens
ctagacctgcagagaaaggggtgcgataggcaaaggcaccatgcctctgcgggatgaaaccctccgagaggtgtgggcctctgacagtgggcatgaagaagaaagcctgagcccggaggccccgcggcgccccaaacagcgacccgccccggcacagaggctaaggaagaagaggacggaggcccccgaatccccctgccccacgggatccaagccccggaagcccggagctgggcggacggggaggccgcgggaggagccttccccagacccagcccaggcccgggcgccgcagacggtctacgccaggttcctcagggaccccgaggccaagaagcgcgacccccgggaaacctttctggtagcccgtgccccagacgcggaggacgaggaggaggaggaagaggaggacgaggaggacgaggaagaggaggcagaggaaaagaaagagaaaatccttctgcctcccaagaagcccctgagagagaagagctccgcagacctgaaggagaggagggccaaggcccagggcccaaggggagacctgggaagccctgaccccccaccgaaacctctgcgtgttaggaataaggaagctccagcaggggaggggaccaagatgagaaagaccaagaagaaagggtctggggaggccgacaaggacccctcagggagcccagccagtgcgaggaagagcccagcagccatgtttctggttggggaaggcagtcctgacaagaaagccctgaagaagaaaggcactcccaaaggcgcgaggaaggaggaagaagaggaggaggaggcagctacggtgataaagaacagcaatcaaaagggcaaagccaaaggaaaaggcaaaaagaaagcgaaggaggagagggccccgtctccccccgtggaggtggacgaaccccgggagtttgtgctccggcctgccccccagggccgcacggtgcgctgccggctgacccgggacaaaaagggcatggatcgaggcatgtatccctcctacttcctgcacctggacacggagaagaaggtgttcctcttggctggcaggaaacgaaaacggagcaagacagccaattacctcatctccatcgaccctaccaatctgtcccgaggaggggagaatttcatcgggaagctgaggtccaacctcctggggaaccgcttcacggtctttgacaacgggcagaacccacagcgtgggtacagcactaatgtggcaagccttcggcaggagctggcagctgtgatctatgaaaccaacgtgctgggcttccgtggcccccggcgcatgaccgtcatcattcctggcatgagtgcggagaacgagagggtccccatccggccccgaaatgctagtgacggcctgctggtgcgctggcagaacaagacgctggagagcctcatagaactgcacaacaagccacctgtctggaacgatgacagtggctcctacaccctcaacttccaaggccgggtcacccaggcctcagtcaagaacttccagattgtccacgctgatgaccccgactatatcgtgctgcagttcggccgcgtggcggaggacgccttcaccctagactaccggtacccgctgtgcgccctgcaggccttcgccatcgccctctccagtttcgacgggaagctggcctgcgagtgaccccagcagcccctcagcgcccccagagcccgtcagcgtgggggaaaggattcagtggaggctggcagggtccctccagcaaagctcccgcggaaaactgctcctgtgtcggggctgacctctcactgcctctcggtgacctccgtcctctccccagcctggcacaggccgaggcaggaggagcccggacggcgggtaggacggagatgaagaacatctggagttggagccgcacatctggtctcggagctcgcctgcgccgctgtgcccccctcctccccgcgccccagtcacttcctgtccgggagcagtagtcattgttgttttaacctcccctctccccgggaccgcgctagggctccgaggagctggggcgggctaggaggagggggtaggtgatgggggacgagggccaggcacccacatccccaataaagccgcgtccttggccaagcggagcggtggttcctcagcgcgtgcggagaacgaggcggcaggaggcgtccgaggcgcgagctggaagtctcaacccccgtcccactcctgcccaggccccgggcgctcccgcgtcccctccccgcgcccgtcgcgggtcctaccgaaactcggcggccgc

SEQ ID NO: 329831 - DNA, 502 bp, Homo sapiens
actctcttgtggttgtggggagcatccaagtgagacatgggtgttggaagcactttgcaaaccagggtgaggagttcacagccttgtttccccctccacgctcaggcactcccaaaggcgcgaggaaggaggaagaagaggaggaggaggcagctacggtgataaagaacagcaatcaaaagggcaaagccaaaggaaaaggcaaaaaggttggggcccagaggggcagggggctgaggtcccttcagggagcagaggcaggggcctggacttgggagcctagagggtgggggcttggagccacttgaggttagaaccttggctccccctcttgtgacaggatataaggacaaaggaaaccagatttgtgcaaacagaggaggcgtttgtggggtcaccaggctaggactggccatgcaagggccttatgtcatctgggctctctgaggcctcccctctggagcataaccatcagacagccagagatgtccccacgccccca

SEQ ID NO: 329832 - DNA, 217 bp, Homo sapiens
aggatcctgtcctagggtgcttcccatatcctgctctcctccttcctcaacacactccaaacatatgtgctacatttccaggatgaccccaaacactttcctgccacagcacctttgcgtttgtgagactctcttccaagtacaccattctcctctagtcaggactggtttcttgtcagctccaatattccccctcctacccccacaaaaggccttt

SEQ ID NO: 329833 - DNA, 200 bp, Homo sapiens
cacaaatgttcaacagcaaaagaatgggtaaaagagttgaggtatattcacataccatgttaccacgtagcaacaaataaatgaacgagagctacacacagcaaaatgaatcttaggatttcgttgacataaagttaaaaatattcataaataatctgtggtgttagaagacagcttgggtggaagcaggtggggtagtg

SEQ ID NO: 329834 - DNA, 450 bp, Homo sapiens
tctggaggtgacctgtggagggcccttgtagaactgggcatggcatttttgaagggggtgttcatggatgtttgccgctgaccagtggctggcagctatgagctggagatcaggagccggcagtgggcagaacatggagaggcatcagctgtggccctgacggtatctaaatagctgtcacaacccaaggcaatgtcagtgctccactgaattctaagctggagcctagtgggtgagcctctggcctctaggatcgctcccaggccctattccatatccttcctatagtctgtctccatgcagtgggtgttccccactaccaggagctcacacatggactcctgccctccttgaagtctagagcattgcttcaagaccaccagcatcaggaccacctggagcgcttgttaaaaggggcaatgcctggcgccaccgctatttaaccagaat

SEQ ID NO: 329835 - DNA, 218 bp, Homo sapiens
tgtgaggaatgtttggagggaatggggtttggttttggatatgctaagctctttatcacactctcaagtggaaagctttcccattctccacatagctctcttttctaaaatgtctgcttagaattcctttacccccatcctggctaacacagtgaaactccgtctctactaaaaatacaaaaattagccgggcgtgggggtgggggcgcctgtagtcc

SEQ ID NO: 329836 - DNA, 344 bp, Homo sapiens
acctcagcctccagagttcaagcaattcttctgtgtcagcctcccaagtagctgggattacaggtgcacaccaccacgcccagccaatttatgtatttttagtagagactgggttttaccatattggccaggctggtctcgaactcctgaccttgtgatctgcccgcctcaggctcccaaagtgctgggattactgatgcgagccaccgcgtccagctgcctcacttgttgttttaggacttaggctccacctcaccagtgtagtcccagcaggtagataggagttaatagttgactatctcagctcaccaccctccaaacctttttttttttttttttttttt

SEQ ID NO: 329837 - DNA, 2757 bp, Homo sapiens
  misc_feature (2)..(2): n is a, c, g, or t
  misc_feature (66)..(66): n is a, c, g, or t
  misc_feature (77)..(78): n is a, c, g, or t
angctgataatgccagtaaactagctgcaatgctaaatacctgttcctttcagaaaccagaacaantacaacaacannaatcagtttttgagatatgcccatctcctgcagaaaataacatccagggaaccacaaagctagcgtctggtgaagaattctgttcaggttccagcagcaatttgcaagctcctggtggcagctctgaacggtatttaaaacaaaatgaaatgaatggtgcttacttcaagcaaagctcagtgttcactaaggattccttttctgccactaccacaccaccaccaccatcacaattgcttctttctccccctcctcctcttccacaggttcctcagcttccttcagaaggaaaaagcactctgaatggtggagttttagaagaacaccaccactaccccaaccaaagtaacacaacacttttaagggaagtgaaaatagagggtaaacctgaggcaccaccttcccagagtcctaatccatctacacatgtatgcagcccttctccgatgctttctgaaaggcctcagaataattgtgtgaacaggaatgacatacagactgcagggacaatgactgttccattgtgttctgagaaaacaagaccaatgtcagaacacctcaagcataacccaccaatttttggtagcagtggagagctacaggacaactgccagcagttgatgagaaacaaagagcaagagattctgaagggtcgagacaaggagcaaacacgagatcttgtgcccccaacacagcactatctgaaaccaggatggattgaattgaaggcccctcgttttcaccaagcggaatcccatctaaaacgtaatgaggcatcactgccatcaattcttcagtatcaacccaatctctccaatcaaatgacctccaaacaatacactggaaattccaacatgcctggggggctcccaaggcaagcttacacccagaaaacaacacagctggagcacaagtcacaaatgtaccaagttgaaatgaatcaagggcagtcccaaggtacagtggaccaacatctccagttccaaaaaccctcacaccaggtgcacttctccaaaacagaccatttaccaaaagctcatgtgcagtcactgtgtggcactagatttcattttcaacaaagagcagattcccaaactgaaaaacttatgtccccagtgttgaaacagcacttgaatcaacaggcttcagagactgagccattttcaaactcacaccttttgcaacataagcctcataaacaggcagcacaaacacaaccatcccagagttcacatctccctcaaaaccagcaacagcagcaaaaattacaaataaagaataaagaggaaatactccagacttttcctcacccccaaagcaacaatgatcagcaaagagaaggatcattctttggccagactaaagtggaagaatgttttcatggtgaaaatcagtattcaaaatcaagcgagttcgagactcataatgtccaaatgggactggaggaagtacagaatataaatcgtagaaattccccttatagtcagaccatgaaatcaagtgcatgcaaaatacaggtttcttgttcaaacaatacacacctagtttcagagaataaagaacagactacacatcctgaactttttgcaggaaacaagacccaaaacttgcatcacatgcaatattttccaaataatgtgatcccaaagcaagatcttcttcacaggtgctttcaagaacaggagcagaagtcacaacaagcttcagttctacagggatataaaaatagaaaccaagatatgtctggtcaacaagctgcgcaacttgctcagcaaaggtacttgatacataaccatgcaaatgtttttcctgtgcctgaccagggaggaagtcacactcagacccctccccagaaggacactcaaaagcatgctgctctaaggtggcatctcttacagaagcaagaacagcagcaaacacagcaaccccaaactgagtcttgccatagtcagatgcacaggccaattaaggtggaacctggatgcaagccacatgcctgtatgcacacagcaccaccagaaaacaaaacatggaaaaaggtaactaagcaagagaatccacctgcaagctgtgataatgtgcagcaaaagagcatcattgagaccatggagcagcatctgaagcagtttcacgccaagtcgttatttgaccataaggctcttactctcaaatcacagaagcaagtaaaagttgaaatgtcagggccagtcacagttttgactagacaaaccactgctgcagaacttgatagccacaccccagctttagagcagcaaacaacttcttcagaaaagacaccaaccaaaagaacagctgcttctgttctcaataattttatagagtcaccttccaaattactagatactcctataaaaaatttattggatacacctgtcaagactcaatatgatttcccatcttgcagatgtgtaggtaagtgccagaaatgtactgagacacatggcgtttatccagaattagcaaatttatcttcagatatgggattttccttctttttttaaatcttgagtctggcagcaatttgtaaaggctcataaaaatctgaagcttacattttttgtcaagttaccgatgcttgtgtcttgtgaaagagaacttcacttacatgcagtttttccaaaagaattaaataatcgtgcatgtttatttttccctctc

SEQ ID NO: 329838 - DNA, 284 bp, Homo sapiens
tcacatgttcgacaaaggtcttgcatctaacatatacaaagaactcccaaaactcaaatctttgtaaaaccacaaacagcctagtttctaagaacaggcaaaatacttggacacctacttacttccccaaagaggatgtgttaaaggaaaacatccacatgaaaatatgctcaacatcattactcattaggaaaatgcaaattaagaccatgatgaaatattctgcatccttgtgaacagccacagtaaagaatcatgacagtatgacatgctgcccagggtgc

SEQ ID NO: 329839 - DNA, 376 bp, Homo sapiens
gtactggggagctgccaaggcaaccaagacttgagagtccaagatctcagtgagaagggaactgcagaaaggtgagcaaataccctataagatgctgaggcagagcttttgtccatcttcagatggactagagagatgtaagtaaatagacagacatgtaaataaataaacaaatggagttcacaaagcagaactcctgggcttaagagatcttcccacctcagcctcccaagtagctgggactacaggcatgtgctaccacacccatctaatttttgtgtttttttgtagcaatgaggtcgcccaggctggtctcaaactcctagcctcaagcaatcctcctgcctcagcctcccaagtagctgggattacaggc

SEQ ID NO: 329840 - DNA, 493 bp, Homo sapiens
ttgtactcctgcctgtgggtagcacaagagcgaaactccgtctcaagaaaacaaaacaaaataaaaaataaagactacatctaaccaggtaaggtcacaaacaaggaaactcttccactatcagttctcaccagagtattctgtaactgtaaaagattaggccttcagcagctcaaaactcagcatctgctgcctaaggctctgccacctcaaagactcttccttgtaagactgcaggccaattgcccaccaactggcccagaccaagatgccttttgtcttccttgctccctctaaactggttccataacgtttgctcctatatctttttcctcttgatgctaagcattattttgttccttgtgttgtaatgcccaaccttgttttcactaatcctgtttttagactctcccttttgctctcttaatcacctagcctcgtttccacatgaatagactctcgcttagctgagaaagccagacgagctccacct

SEQ ID NO: 329841 - DNA, 505 bp, Homo sapiens
agttgcatgatacaatcgagctcggtacctgtgtgtagcagtatagcgaaaatcgtcagaaaacaaaacaaaataaaaaataaagactacatctaaccaggtaaggtcacaaacaaggaaactcttccactatcagttctcaccagagtattctgtaactgtaaaagattaggccttcagcagctcaaaactcagcatctgctgcctaaggctctgccacctcaaagactcttccttgtaagactgcaggccaattgcccaccaactggcccagaccaagatgccttttgtcttccttgctccctctaaactggttccataacgtttgctcctatatctttttcctcttgatgctaagcattattttgttccttgtgttgtaatgcccaaccttgttttcactaatcctgtttttagactctcccttttgctctcttaatcacctagcctcgtttccacatgaatagactctcgcttagctgagaaagccagacgagctccacct

SEQ ID NO: 329842 - DNA, 424 bp, Homo sapiens
tgttgggtcccagaggatacctgacgcacacactatctcttccatcagtgccttagcctgatccctggttgcaaaaactgtaaaagattaggccttcagcagctcaaaactcagcatctgctgcctaaggctctgccacctcaaagactcttccttgtaagactgcaggccaattgcccaccaactggcccagaccaagatgccttttgtcttccttgctccctctaaactggttccataacgtttgctcctatatctttttcctcttgatgctaagcattattttgttccttgtgttgtaatgcccaaccttgttttcactaatcctgtttttagactctcccttttgctctcttaatcacctagcctcgtttccacatgaatagactctcgcttagctgagaaagccagacgagctccacct

SEQ ID NO: 329843 - DNA, 413 bp, Homo sapiens
actttctataaagcccagaaagattagatcagagaagtgccaccaacttggactctactgacttccaaccagccacagtctcaggtccccgattctgctctatcaactttccttcaccctgcagtacttcctccaccggagtgaaggatctcagctattttccatccatctcttgctaaagtggaaatatctgagccccaccttcctctccaatgaaaggacaagatgataaagcacaaagaatcagcaccctctccccttgccttgactcatcgcctcaaactctccgcaagcactggccttccacctaagcacagaacatccactggaagtcagtctggaaaaacaataaagtgtttgaaggctttaaaagcgtttaaagtgctggttgtcacgggggagttcccagcaat

SEQ ID NO: 329844 - DNA, 163 bp, Homo sapiens
ggtcctatgctagttttgaagttctgctattgctgtctttaaattcttgatttttgtttgtttgtttgtttttaatagagacagagactggagtcaggctggagtgcagtagtgtgatcatagctcactgtagccttgaacgaacttttgggctcaagcagtt

SEQ ID NO: 329845 - DNA, 651 bp, Homo sapiens
cccggtggcgcccgttttaaagaagtgtatctctgggttgcggaaatttggcacgagcggctccaagccaacctggggcctatcaaccaagaccaggttttacttcacttcctggaagtaccatgacccctcctccaagtgggcctaatccttatgcgcgtaaccgtcctccctttggtcagggctatacccaacctggacctggttatcgataaggaggctcctctacaccaattaatgtagctgctagctattggcctcccaaaagactccagtactattttaatttgtattgaagaagttcagaaatttaaaagcagagcattttttatgatatcattgttggtgttaattgaaagtataatttgctggaacacaaagaccaaaatgaaagttttttcctccctgcttaaaaatgtagcagcttcttagttactttggaacactactcttacatgtataaagtgattgacttgactttctagcttcccttgtccggaggatattaaaatgctagggtgaggtttagccatcttacttggctttttactattaacatgatgtactaaagtagagccctttgagaatacaagatattatgtataaaatgtaacactgatgataggttaataaagatgattgaatccatta

SEQ ID NO: 329846 - DNA, 1013 bp, Homo sapiens
  misc_feature (594)..(594): n is a, c, g, or t
  misc_feature (694)..(694): n is a, c, g, or t
ggatactaaactgacttttttttgactatccaggccacccagtgctcctgcagaagatcgttcaggaacacccgacagcattgcttcctcctcctcagcagctcacccaccaggcgttcagccacagcagccaccatatacaggagctcagactcaagcaggtcagattgacggtcagatgtccccatcatttccacgcccaggcacgggtatggtgcacagcttctcgcctgctccaccctcacatgcctcagaagtataggttttcactcattcaccctgctctcaacccgcacaccgagaccggcgaaacactacagaggtaatcgggcgctccggccagcacctcatttttacaagatactgacatccttgcctttcctggtatagtttcatcaatttggctccgcaagtcccttcgccgacatgcccgcaacgtctatctcgtttactcatatctccctccttacaaatcatcctttatagtatatattagttattgacggtacttagcatgccatctcagtaaacgaactcaccagccgcgaatcgcaacgaaaccacttagtagtcatcatctcgaatggctccaancggttgtccgcactttttcccttctcatcccggcacgctacgtatttgatgcatcagctggtctgtccttcacgccgcagtattacatacccctcacctntgccgtgtgtcatctctccattctggtcaactcgatctcgcggcacgctaacttcaccctctcagcgatcactgtaaagaccaaactcccccaccgatcactaacgtcccaccccatctatctccttcactcccttgctactcccgattccaggccaaactaaaccttagcgccccgatgtctctctttcccaccgctcctgtcgcttatggtcgcccaccttcttattctcactactccggctcgccatccgggcgccacctgtacttcattttttatcccccgctgtaactactgcccgggcacgctcgcgcaagtg

SEQ ID NO: 329847 - DNA, 150 bp, Homo sapiens
gcggccgcctactactactactgctcgaattcaagcttctaacgatgtacggggacatgatgtactaaagtagagccctttgagaatacaagatattatgtataaaatgtaacactgatgataggttaataaagatgattgaatccatta

SEQ ID NO: 329848 - DNA, 2094 bp, Homo sapiens
gtgcatcggggcagctcacgcttcctaaatcccgtcatccagtgagaaagcagggactcttcggcctaggcagccgggacccagccagccctgcgcctcgcgccgtcgcgcatgcgtcctgggtatgtccacgcgcaataaggaggggcgaaaggacatttttttttttcttgctcccgcctctgttcttcccccacctgccacgtacagagcccaagttctcgctaggcttgttgggtcagcgcgattggccggggcccgcgcgagcctgcgagcgaggtgcggcggtcgcgaagggcaaccgagcgggccgtgaccaccgcctccccgcgacgccccagtccagtggcctcgcgtccgcccattcagcggagacctgcggagaggcggcggccgcggcctccgcaagccgtctttctctagagttgtatatatagaacatcctggagtccaccatgaacggacagttggatctaagtgggaagctaatcatcaaagctcaacttggggaggatattcggcgaattcctattcataatgaagatattacttatgatgaattagtgctaatgatgcaacgagttttcagaggaaaacttctgagtaatgatgaagtaacaataaagtataaagatgaagatggagatcttataacaatttttgatagttctgacctttcctttgcaattcagtgcagtaggatactgaaactgacattatttgttaatggccagccaagaccccttgaatcaagtcaggtgaaatatctccgtcgagaactgatagaacttcgaaataaagtgaatcgtttattggatagcttggaaccacctggagaaccaggaccttccaccaatattcctgaaaatgatactgtggatggtagggaagaaaagtctgcttctgattcttctggaaaacagtctactcaggttatggcagcaagtatgtctgcttttgatcctttaaaaaaccaagatgaaatcaataaaaatgttatgtcagcgtttggcttaacagatgatcaggtttcagggccacccagtgctcctgcagaagatcgttcaggaacacccgacagcattgcttcctcctcctcagcagctcacccaccaggcgttcagccacagcagccaccatatacaggagctcagactcaagcaggtcagattgaaggtcagatgtaccaacagtaccagcaacaggccggctatggtgcacagcagccgcaggctccacctcagcagcctcaacagtatggtattcagtattcagcaagctatagtcagcagactggacctcaacaacctcagcagttccagggatatggccagcaaccaacttcccaggcaccagctcctgccttttctggtcagcctcaacaactgcctgctcagccgccacagcagtaccaggcgagcaattatcctgcacaaacttacactgcccaaacttctcagcctactaattatactgtggctcctgcctctcaacctggaatggctccaagccaacctggggcctatcaaccaagaccaggttttacttcacttcctggaagtaccatgacccctcctccaagtgggcctaatccttatgcgcgtaaccgtcctccctttggtcagggctatacccaacctggacctggttatcgataaggaggctcctctacaccaattaatgtagctgctagctattggcctcccaaaagactccagtactattttaatttgtattgaagaagttcagaaatttaaaagcagagcattttttatgatatcattgttggtgttaattgaaagtataatttgctggaacacaaagaccaaaatgaaagttttttcctccctgcttaaaaatgtagcagcttcttagttactttggaacactactcttacatgtataaagtgattgacttgactttctagcttcccttgtccggaggatattaaaatgctagggtgaggtttagccatcttacttggctttttactattaacatgatgtactaaagtagagccctttgagaatacaagatattatgtataaaatgtaacactgatgataggttaataaagatgattgaatccatta

SEQ ID NO: 329849 - DNA, 1804 bp, Homo sapiens
gtgcatcggggcagctcacgcttcctaaatcccgtcatccagtgagaaagcagggactcttcggcctaggcagccgggacccagccagccctgcgcctcgcgccgtcgcgcatgcgtcctggtctttctctagagttgtatatatagaacatcctggagtccaccatgaacggacagttggatctaagtgggaagctaatcatcaaagctcaacttggggaggatattcggcgaattcctattcataatgaagatattacttatgatgaattagtgctaatgatgcaacgagttttcagaggaaaacttctgagtaatgatgaagtaacaataaagtataaagatgaagatggagatcttataacaatttttgatagttctgacctttcctttgcaattcagtgcagtaggatactgaaactgacattatttgttaatggccagccaagaccccttgaatcaagtcaggtgaaatatctccgtcgagaactgatagaacttcgaaataaagtgaatcgtttattggatagcttggaaccacctggagaaccaggaccttccaccaatattcctgaaaatgatactgtggatggtagggaagaaaagtctgcttctgattcttctggaaaacagtctactcaggttatggcagcaagtatgtctgcttttgatcctttaaaaaaccaagatgaaatcaataaaaatgttatgtcagcgtttggcttaacagatgatcaggtttcagggccacccagtgctcctgcagaagatcgttcaggaacacccgacagcattgcttcctcctcctcagcagctcacccaccaggcgttcagccacagcagccaccatatacaggagctcagactcaagcaggtcagattgaaggtcagatgtaccaacagtaccagcaacaggccggctatggtgcacagcagccgcaggctccacctcagcagcctcaacagtatggtattcagtattcagcaagctatagtcagcagactggacctcaacaacctcagcagttccagggatatggccagcaaccaacttcccaggcaccagctcctgccttttctggtcagcctcaacaactgcctgctcagccgccacagcagtaccaggcgagcaattatcctgcacaaacttacactgcccaaacttctcagcctactaattatactgtggctcctgcctctcaacctggaatggctccaagccaacctggggcctatcaaccaagaccaggttttacttcacttcctggaagtaccatgacccctcctccaagtgggcctaatccttatgcgcgtaaccgtcctccctttggtcagggctatacccaacctggacctggttatcgataaggaggctcctctacaccaattaatgtagctgctagctattggcctcccaaaagactccagtactattttaatttgtattgaagaagttcagaaatttaaaagcagagcattttttatgatatcattgttggtgttaattgaaagtataatttgctggaacacaaagaccaaaatgaaagttttttcctccctgcttaaaaatgtagcagcttcttagttactttggaacactactcttacatgtataaagtgattgacttgactttctagcttcccttgtccggaggatattaaaatgctagggtgaggtttagccatcttacttggctttttactattaacatgatgtactaaagtagagccctttgagaatacaagatattatgtataaaatgtaacactgatgataggttaataaagatgattgaatccatta

SEQ ID NO: 329850 - DNA, 2192 bp, Homo sapiens
gtgcatcggggcagctcacgcttcctaaatcccgtcatccagtgagaaagcagggactcttcggcctaggcagccgggacccagccagccctgcgcctcgcgccgtcgcgcatgcgtcctgggtatgtccacgcgcaataaggaggggcgaaaggacatttttttttttcttgctcccgcctctgttcttcccccacctgccacgtacagagcccaagttctcgctaggcttgttgggtcagcgcgattggccggggcccgcgcgagcctgcgagcgaggtgcggcggtcgcgaagggcaaccgagcgggccgtgaccaccgcctccccgcgacgccccagtccagtggcctcgcgtccgcccattcagcggagacctgcggagaggcggcggccgcggcctccgcaagccgatgactgcaagagcaaacgacagctttaggaaagaagcactggttcctggccacaagatgtttacagtcaataggaaacacaaaaagtgaatttgcagtctttctctagagttgtatatatagaacatcctggagtccaccatgaacggacagttggatctaagtgggaagctaatcatcaaagctcaacttggggaggatattcggcgaattcctattcataatgaagatattacttatgatgaattagtgctaatgatgcaacgagttttcagaggaaaacttctgagtaatgatgaagtaacaataaagtataaagatgaagatggagatcttataacaatttttgatagttctgacctttcctttgcaattcagtgcagtaggatactgaaactgacattatttgttaatggccagccaagaccccttgaatcaagtcaggtgaaatatctccgtcgagaactgatagaacttcgaaataaagtgaatcgtttattggatagcttggaaccacctggagaaccaggaccttccaccaatattcctgaaaatgatactgtggatggtagggaagaaaagtctgcttctgattcttctggaaaacagtctactcaggttatggcagcaagtatgtctgcttttgatcctttaaaaaaccaagatgaaatcaataaaaatgttatgtcagcgtttggcttaacagatgatcaggtttcagggccacccagtgctcctgcagaagatcgttcaggaacacccgacagcattgcttcctcctcctcagcagctcacccaccaggcgttcagccacagcagccaccatatacaggagctcagactcaagcaggtcagattgaaggtcagatgtaccaacagtaccagcaacaggccggctatggtgcacagcagccgcaggctccacctcagcagcctcaacagtatggtattcagtattcagcaagctatagtcagcagactggacctcaacaacctcagcagttccagggatatggccagcaaccaacttcccaggcaccagctcctgccttttctggtcagcctcaacaactgcctgctcagccgccacagcagtaccaggcgagcaattatcctgcacaaacttacactgcccaaacttctcagcctactaattatactgtggctcctgcctctcaacctggaatggctccaagccaacctggggcctatcaaccaagaccaggttttacttcacttcctggaagtaccatgacccctcctccaagtgggcctaatccttatgcgcgtaaccgtcctccctttggtcagggctatacccaacctggacctggttatcgataaggaggctcctctacaccaattaatgtagctgctagctattggcctcccaaaagactccagtactattttaatttgtattgaagaagttcagaaatttaaaagcagagcattttttatgatatcattgttggtgttaattgaaagtataatttgctggaacacaaagaccaaaatgaaagttttttcctccctgcttaaaaatgtagcagcttcttagttactttggaacactactcttacatgtataaagtgattgacttgactttctagcttcccttgtccggaggatattaaaatgctagggtgaggtttagccatcttacttggctttttactattaacatgatgtactaaagtagagccctttgagaatacaagatattatgtataaaatgtaacactgatgataggttaataaagatgattgaatccatta

SEQ ID NO: 329851 - DNA, 2017 bp, Homo sapiens
gtgcatcggggcagctcacgcttcctaaatcccgtcatccagtgagaaagcagggactcttcggcctaggcagccgggacccagccagccctgcgcctcgcgccgtcgcgcatgcgtcctgggtatgtccacgcgcaataaggaggggcgaaaggacatttttttttttcttgctcccgcctctgttcttcccccacctgccacgtacagagcccaagttctcgctaggcttgttgggtcagcgcgattggccggggcccgcgcgagcctgcgagcgaggtgcggcggtcgcgaagggcaaccgagcgggccgtgaccaccgcctccccgcgacgtctttctctagagttgtatatatagaacatcctggagtccaccatgaacggacagttggatctaagtgggaagctaatcatcaaagctcaacttggggaggatattcggcgaattcctattcataatgaagatattacttatgatgaattagtgctaatgatgcaacgagttttcagaggaaaacttctgagtaatgatgaagtaacaataaagtataaagatgaagatggagatcttataacaatttttgatagttctgacctttcctttgcaattcagtgcagtaggatactgaaactgacattatttgttaatggccagccaagaccccttgaatcaagtcaggtgaaatatctccgtcgagaactgatagaacttcgaaataaagtgaatcgtttattggatagcttggaaccacctggagaaccaggaccttccaccaatattcctgaaaatgatactgtggatggtagggaagaaaagtctgcttctgattcttctggaaaacagtctactcaggttatggcagcaagtatgtctgcttttgatcctttaaaaaaccaagatgaaatcaataaaaatgttatgtcagcgtttggcttaacagatgatcaggtttcagggccacccagtgctcctgcagaagatcgttcaggaacacccgacagcattgcttcctcctcctcagcagctcacccaccaggcgttcagccacagcagccaccatatacaggagctcagactcaagcaggtcagattgaaggtcagatgtaccaacagtaccagcaacaggccggctatggtgcacagcagccgcaggctccacctcagcagcctcaacagtatggtattcagtattcagcaagctatagtcagcagactggacctcaacaacctcagcagttccagggatatggccagcaaccaacttcccaggcaccagctcctgccttttctggtcagcctcaacaactgcctgctcagccgccacagcagtaccaggcgagcaattatcctgcacaaacttacactgcccaaacttctcagcctactaattatactgtggctcctgcctctcaacctggaatggctccaagccaacctggggcctatcaaccaagaccaggttttacttcacttcctggaagtaccatgacccctcctccaagtgggcctaatccttatgcgcgtaaccgtcctccctttggtcagggctatacccaacctggacctggttatcgataaggaggctcctctacaccaattaatgtagctgctagctattggcctcccaaaagactccagtactattttaatttgtattgaagaagttcagaaatttaaaagcagagcattttttatgatatcattgttggtgttaattgaaagtataatttgctggaacacaaagaccaaaatgaaagttttttcctccctgcttaaaaatgtagcagcttcttagttactttggaacactactcttacatgtataaagtgattgacttgactttctagcttcccttgtccggaggatattaaaatgctagggtgaggtttagccatcttacttggctttttactattaacatgatgtactaaagtagagccctttgagaatacaagatattatgtataaaatgtaacactgatgataggttaataaagatgattgaatccatta

SEQ ID NO: 329852 - DNA, 2156 bp, Homo sapiens
  misc_feature (2117)..(2117): n is a, c, g, or t
gtgcatcggggcagctcacgcttcctaaatcccgtcatccagtgagaaagcagggactcttcggcctaggcagccgggacccagccagccctgcgcctcgcgccgtcgcgcatgcgtcctgggtatgtccacgcgcaataaggaggggcgaaaggacatttttttttttcttgctcccgcctctgttcttcccccacctgccacgtacagagcccaagttctcgctaggcttgttgggtcagcgcgattggccggggcccgcgcgagcctgcgagcgaggtgcggcggtcgcgaagggcaaccgagcgggccgtgaccaccgcctccccgcgacgccccagtccagtggcctcgcgtccgcccattcagcggagacctgcggagaggcggcggccgcggcctccgcaagccgtctttctctagagttgtatatatagaacatcctggagtccaccatgaacggacagttggatctaagtgggaagctaatcatcaaagctcaacttggggaggatattcggcgaattcctattcataatgaagatattacttatgatgaattagtgctaatgatgcaacgagttttcagaggaaaacttctgagtaatgatgaagtaacaataaagtataaagatgaagatggagatcttataacaatttttgatagttctgacctttcctttgcaattcagtgcagtaggatactgaaactgacattatttgttaatggccagccaagaccccttgaatcaagtcaggtgaaatatctccgtcgagaactgatagaacttcgaaataaagtgaatcgtttattggatagcttggaaccacctggagaaccaggaccttccaccaatattcctgaaaatgatactgtggatggtagggaagaaaagtctgcttctgattcttctggaaaacagtctactcaggttatggcagcaagtatgtctgcttttgatcctttaaaaaaccaagatgaaatcaataaaaatgttatgtcagcgtttggcttaacagatgatcaggtttcagggccacccagtgctcctgcagaagatcgttcaggaacacccgacagcattgcttcctcctcctcagcagctcacccaccaggcgttcagccacagcagccaccatatacaggagctcagactcaagcaggtcagattgaaggtcagatgtaccaacagtaccagcaacaggccggctatggtgcacagcagccgcaggctccacctcagcagcctcaacagtatggtattcagtattcagcaagctatagtcagcagactggacctcaacaacctcagcagttccagggatatggccagcaaccaacttcccaggcaccagctcctgccttttctggtcagcctcaacaactgcctgctcagccgccacagcagtaccaggcgagcaattatcctgcacaaacttacactgcccaaacttctcagcctactaattatactgtggctcctgcctctcaacctggaatggctccaagccaacctggggcctatcaaccaagaccaggttttacttcacttcctggaagtaccatgacccctcctccaagtgggcctaatccttatgcgcgtaaccgtcctccctttggtcagggctatacccaacctggacctggttatcgataaggaggctcctctacaccaattaatgtagctgctagctattggcctcccaaaagactccagtactattttaatttgtattgaagaagttcagaaatttaaaagcagagcattttttatgatatcattgttggtgttaattgaaagtataatttgctggaacacaaagaccaaaatgaaagttttttcctccctgcttaaaaatgtagcagcttcttagttactttggaacactactcttacatgtataaagtgattgacttgactttctagcttcccttgtccggaggatattaaaatgctagggtgaggtttagccatcttacttggctttttactattaacatgatgtactaaagtagagccctttgagaatacaagatattatgtataaaatgtaacactgatgataggttaataaagatgattgaatccattagatccgcgccaccccccccttcnctccactccgaaatgcccctcctggttcgttccctgctt

SEQ ID NO: 329853 - DNA, 1963 bp, Homo sapiens
  misc_feature (1856)..(1856): n is a, c, g, or t
  misc_feature (1867)..(1867): n is a, c, g, or t
  misc_feature (1887)..(1887): n is a, c, g, or t
  misc_feature (1892)..(1892): n is a, c, g, or t
  misc_feature (1894)..(1894): n is a, c, g, or t
  misc_feature (1897)..(1897): n is a, c, g, or t
  misc_feature (1917)..(1917): n is a, c, g, or t
gtgcatcggggcagctcacgcttcctaaatcccgtcatccagtgagaaagcagggactcttcggcctaggcagccgggacccagccagccctgcgcctcgcgccgtcgcgcatgcgtcctgggtatgtccacgcgcaataaggaggggcgaaaggacatttttttttttcttgctcccgcctctgttcttcccccacctgccacgtacagagcccaagttctcgctaggcttgttgggtcagcgcgattggccggggcccgcgcgagcctgcgagcgaggtgcggcggtcgcgaagggcaaccgagcgggccgtgaccaccgcctccccgcgacgccccagtccagtggcctcgcgtccgcccattcagcggagacctgcggagaggcggcggccgcggcctccgcaagccgtctttctctagagttgtatatatagaacatcctggagtccaccatgaacggacagttggatctaagtgggaagctaatcatcaaagctcaacttggggaggatattcggcgaattcctattcataatgaagatattacttatgatgaattagtgctaatgatgcaacgagttttcagaggaaaacttctgagtaatgatgaagtaacaataaagtataaagatgaagatggagatcttataacaatttttgatagttctgacctttcctttgcaattcagtgcagtaggatactgaaactgacattatttgttaatggccagccaagaccccttgaatcaagtcaggtgaaatatctccgtcgagaactgatagaacttcgaaataaagtgaatcgtttattggatagcttggaaccacctggagaaccaggaccttccaccaatattcctgaaaatgatactgtggatggtagggaagaaaagtctgcttctgattcttctggaaaacagtctactcaggttatggcagcaagtatgtctgcttttgatcctttaaaaaaccaagatgaaatcaataaaaatgttatgtcagcgtttggcttaacagatgatcaggtttcagggccacccagtgctcctgcagaagatcgttcaggaacacccgacagcattgcttcctcctcctcagcagctcacccaccaggcgttcagccacagcagccaccatatacaggagctcagactcaagcaggtcagattgaaggtcagatgtaccaacagtaccagcaacaggccggctatggtgcacagcagccgcaggctccacctcagcagcctcaacagtatggtattcagtattcagcaagctatagtcagcagactggacctcaacaacctcagcagttccagggatatggccagcaaccaacttcccaggcaccagctcctgccttttctggtcagcctcaacaactgcctgctcagccgccacagcagtaccaggcgagcaattatcctgcacaaacttacactgcccaaacttctcagcctactaattatactgtggctcctgcctctcaacctggaatggctccaagccaacctggggcctatcaaccaagaccaggttttacttcacttcctggaagtaccatgacccctcctccaagtgggcctaatccttatgcgcgtaaccgtcctccctttggtcagggctatacccaacctggacctggttatcgataaggaggctcctctacaccaattaatgtagctgctagctattggcctcccaaaagactccagtactattttaatttgtattgaagaagttcagaaatttaaaagcagagcattttttatgatatcattgttggtgttaattgaaagtataatttgctggaacacaaagaccaaaatgaaagttttttcctccctgcttangagcacttttnatacttggaactccttaacngtaangntgnctgcttttactcctgccggngattaaacccaggcggccagcccctctggctttcttcaccacggcg

SEQ ID NO: 329854 - DNA, 1880 bp, Homo sapiens
gtgcatcggggcagctcacgcttcctaaatcccgtcatccagtgagaaagcagggactcttcggcctaggcagccgggacccagccagccctgcgcctcgcgccgtcgcgcatgcgtcctgggtatgtccacgcgcaataaggaggggcgaaaggacatttttttttttcttgctcccgcctctgttcttcccccacctgccacgtacagagcccaagttctcgctaggcttgttgggtcagcgcgattggccggggcccgcgcgagcctgcgagcgagtctttctctagagttgtatatatagaacatcctggagtccaccatgaacggacagttggatctaagtgggaagctaatcatcaaagctcaacttggggaggatattcggcgaattcctattcataatgaagatattacttatgatgaattagtgctaatgatgcaacgagttttcagaggaaaacttctgagtaatgatgaagtaacaataaagtataaagatgaagatggagatcttataacaatttttgatagttctgacctttcctttgcaattcagtgcagtaggatactgaaactgacattatttgttaatggccagccaagaccccttgaatcaagtcaggtgaaatatctccgtcgagaactgatagaacttcgaaataaagtgaatcgtttattggatagcttggaaccacctggagaaccaggaccttccaccaatattcctgaaaatgatactgtggatggtagggaagaaaagtctgcttctgattcttctggaaaacagtctactcaggttatggcagcaagtatgtctgggccacccagtgctcctgcagaagatcgttcaggaacacccgacagcattgcttcctcctcctcagcagctcacccaccaggcgttcagccacagcagccaccatatacaggagctcagactcaagcaggtcagattgaaggtcagatgtaccaacagtaccagcaacaggccggctatggtgcacagcagccgcaggctccacctcagcagcctcaacagtatggtattcagtattcagcaagctatagtcagcagactggacctcaacaacctcagcagttccagggatatggccagcaaccaacttcccaggcaccagctcctgccttttctggtcagcctcaacaactgcctgctcagccgccacagcagtaccaggcgagcaattatcctgcacaaacttacactgcccaaacttctcagcctactaattatactgtggctcctgcctctcaacctggaatggctccaagccaacctggggcctatcaaccaagaccaggttttacttcacttcctggaagtaccatgacccctcctccaagtgggcctaatccttatgcgcgtaaccgtcctccctttggtcagggctatacccaacctggacctggttatcgataaggaggctcctctacaccaattaatgtagctgctagctattggcctcccaaaagactccagtactattttaatttgtattgaagaagttcagaaatttaaaagcagagcattttttatgatatcattgttggtgttaattgaaagtataatttgctggaacacaaagaccaaaatgaaagttttttcctccctgcttaaaaatgtagcagcttcttagttactttggaacactactcttacatgtataaagtgattgacttgactttctagcttcccttgtccggaggatattaaaatgctagggtgaggtttagccatcttacttggctttttactattaacatgatgtactaaagtagagccctttgagaatacaagatattatgtataaaatgtaacactgatgataggttaataaagatgattgaatccatta

SEQ ID NO: 329855 - DNA, 1111 bp, Homo sapiens
taattattacacttaatatttctaccttattttgattgtttttttttgtctgggccacccagtgctcctgcagaagatcgttcaggaacacccgacagcattgcttcctcctcctcagcagctcacccaccaggcgttcagccacagcagccaccatatacaggagctcagactcaagcaggtcagattgaaggtcagatgtaccaacagtaccagcaacaggccggctatggtgcacagcagccgcaggctccacctcagcagcctcaacagtatggtattcagtattcagcaagctatagtcagcagactggacctcaacaacctcagcagttccagggatatggccagcaaccaacttcccaggcaccagctcctgccttttctggtcagcctcaacaactgcctgctcagccgccacagcagtaccaggcgagcaattatcctgcacaaacttacactgcccaaacttctcagcctactaattatactgtggctcctgcctctcaacctggaatggctccaagccaacctggggcctatcaaccaagaccaggttttacttcacttcctggaagtaccatgacccctcctccaagtgggcctaatccttatgcgcgtaaccgtcctccctttggtcagggctatacccaacctggacctggttatcgataaggaggctcctctacaccaattaatgtagctgctagctattggcctcccaaaagactccagtactattttaatttgtattgaagaagttcagaaatttaaaagcagagcattttttatgatatcattgttggtgttaattgaaagtataatttgctggaacacaaagaccaaaatgaaagttttttcctccctgcttaaaaatgtagcagcttcttagttactttggaacactactcttacatgtataaagtgattgacttgactttctagcttcccttgtccggaggatattaaaatgctagggtgaggtttagccatcttacttggctttttactattaacatgatgtactaaagtagagccctttgagaatacaagatattatgtataaaatgtaacactgatgataggttaataaagatgattgaatccatta

SEQ ID NO: 329856 - DNA, 1727 bp, Homo sapiens
gtgcatcggggcagctcacgcttcctaaatcccgtcatccagtgagaaagcagggactcttcggcctaggcagccgggacccagccagccctgcgcctcgcgccgtcgcgcatgcgtcctgggtatgtccacgcgcaataaggaggggcgaaaggacatttttttttttcttgctcccgcctctgttcttcccccacctgccacgtacagagcccaagttctcgctaggcttgttgggtcagcgcgattggccggggcccgcgcgagcctgcgagcgaggtgcggcggtcgcgaagggcaaccgagcgggccgtgaccaccgcctccccgcgacgccccagtccagtggcctcgcgtccgcccattcagcggagacctgcggagaggcggcggccgcggcctccgcaagccgtctttctctagagttgtatatatagaacatcctggagtccaccatgaacggacagttggatctaagtgggaagctaatcatcaaagctcaacttggggaggatattcggcgaattcctattcataatgaagatattacttatgatgaattagtgctaatgatgcaacgagttttcagaggaaaacttctgagtaatgatgaagtaacaataaagtataaagatgaagatggagatcttataacaatttttgatagttctgacctttcctttgcaattcagtgcagtaggatactgaaactgacattatttgttaatggccagccaagaccccttgaatcaagtcaggtgaaatatctccgtcgagaactgatagaacttcgaaataaagtgaatcgtttattggatagcttggaaccacctggagaaccaggaccttccaccaatattcctgaaaatgatactgtggatggtagggaagaaaagtctgcttctgattcttctggaaaacagtctactcaggttatggcagcaagtatgtctgcttttgatcctttaaaaaaccaagatgaaatcaataaaaatgttatgtcagcgtttggcttaacagatgatcaggtttcagggccacccagtgctcctgcagaagatcgttcaggaacacccgacagcattgcttcctcctcctcagcagctcacccaccaggcgttcagccacagcagccaccatatacaggagctcagactcaagcaggtcagattgaaggtcagatgtaccaacagtaccagcaacaggccggctatggtgcacagcagccgcaggctccacctcagcagcctcaacagtatggtattcagtattcagcaagctatagtcagcagactggacctcaacaacctcagcagttccagggatatggccagcaaccaacttcccaggcaccagctcctgccttttctggtcagcctcaacaactgcctgctcagccgccacagcagtaccaggcgagcaattatcctgcacaaacttacactgcccaaacttctcagcctactaattatactgtggctcctgcctctcaacctggaatgttaggtctaccccaggtagacctaacgtctttacgtgggtacttgcgcttactttgtagccttcatcagggtttgctgaagatggcggtatgtaggctgagcaagaggtggtgaggttgatcggggtttatcgattacagaacaggctcctctagaggggtatgaagcaccgacaggtcctttgagttttaagctgtggctcgtagtgttctggcgccagttttg

SEQ ID NO: 329857 - DNA, 1239 bp, Homo sapiens
gtgcatcggggcagctcacgcttcctaaatcccgtcatccagtgagaaagcagggactcttcggcctaggcagccgggacccagccagccctgcgcctcgcgccgtcgcgcatgcgtcctgggtatgtccacgcgcaataaggaggggcgaaaggacatttttttttttcttgctcccgcctctgttcttcccccacctgccacgtacagagcccaagttctcgctaggcttgttgggtcagcgcgattggccggggcccgcgcgagcctgcgagcgaggtgcggcggtcgcgaagggcaaccgagcgggccgtgaccaccgcctccccgcgacgccccagtccagtggcctcgcgtccgcccattcagcggagacctgcggagaggcggcggccgcggcctccgcaagccgtctttctctagagttgtatatatagaacatcctggagtccaccatgaacggacagttggatctaagtgggaagctaatcatcaaagctcaacttggggaggatattcggcgaattcctattcataatgaagatattacttatgatgaattagtgctaatgatgcaacgagttttcagaggaaaacttctgagtaatgatgaagtaacaataaagtataaagatgaagatggagatcttataacaatttttgatagttctgacctttcctttgcaattcagtgcagtaggatactgaaactgacattatttgttaatggccagccaagaccccttgaatcaagtcaggtgaaatatctccgtcgagaactgatagaacttcgaaataaagtgaatcgtttattggatagcttggaaccacctggagaaccaggaccttccaccaatattcctgaaaatgatactgtggatggtagggaagaaaagtctgcttctgattcttctggaaaacagtctactcaggttatggcagcaagtatgtctgcttttgatcctttaaaaaaccaagatgaaatcaataaaaatgttatgtcagcgtttggcttaacagatgatcaggtttcagggccacccagtgctcctgcagaagatcgttcaggaacacccgacagcattgcttcctcctcctcagcagctcacccaccaggcgttcagccacagcagccaccatatacaggagctcagactcaagcaggtcagattgacaacagttcagcacagggcggtatggtgccagcaagcgagctcacttcaggctcaaagttgttta

SEQ ID NO: 329858 - DNA, 844 bp, Homo sapiens
cctagatatcccgctgatccgcttacaagctatagtcagcagactggacctcaacaacctcagcagttccagggatatggccagcaaccaacttcccaggcaccagctcctgccttttctggtcagcctcaacaactgcctgctcagccgccacagcagtaccaggcgagcaattatcctgcacaaacttacactgcccaaacttctcagcctactaattatactgtggctcctgcctctcaacctggaatggctccaagccaacctggggcctatcaaccaagaccaggttttacttcacttcctggaagtaccatgacccctcctccaagtgggcctaatccttatgcgcgtaaccgtcctccctttggtcagggctatacccaacctggacctggttatcgataaggaggctcctctacaccaattaatgtagctgctagctattggcctcccaaaagactccagtactattttaatttgtattgaagaagttcagaaatttaaaagcagagcattttttatgatatcattgttggtgttaattgaaagtataatttgctggaacacaaagaccaaaatgaaagttttttcctccctgcttaaaaatgtagcagcttcttagttactttggaacactactcttacatgtataaagtgattgacttgactttctagcttcccttgtccggaggatattaaaatgctagggtgaggtttagccatcttacttggctttttactattaacatgatgtactaaagtagagccctttgagaatacaagatattatgtataaaatgtaacactgatgataggttaataaagatgattgaatccatta

SEQ ID NO: 329859 - DNA, 226 bp, Homo sapiens
  misc_feature (16)..(16): n is a, c, g, or t
  misc_feature (20)..(20): n is a, c, g, or t
  misc_feature (42)..(42): n is a, c, g, or t
cccctcccccccctgngttngggggtgtggggctctggcgcnttctctctttatttgatagtgctgggccacccagtgctcctgcagaagatcgttcaggaacacccgacagcattgcttcctcctcctcagcagctcacccaccaggcgttcagccacagcagccaccatatacaggagctcagactcaagcaggtcagattgaaggtaaaatagagtttagaac

SEQ ID NO: 329860 - DNA, 2169 bp, Homo sapiens
gtgcatcggggcagctcacgcttcctaaatcccgtcatccagtgagaaagcagggactcttcggcctaggcagccgggacccagccagccctgcgcctcgcgccgtcgcgcatgcgtcctgggtatgtccacgcgcaataaggaggggcgaaaggacatttttttttttcttgctcccgcctctgttcttcccccacctgccacgtacagagcccaagttctcgctaggcttgttgggtcagcgcgattggccggggcccgcgcgagcctgcgagcgaggtgcggcggtcgcgaagggcaaccgagcgggccgtgaccaccgcctccccgcgacgccccagtccagtggcctcgcgtccgcccattcagcggagacctgcggagaggcggcggccgcggcctccgcaagccgctttaggaaagaagcactggttcctggccacaagatgtttacagtcaataggaaacacaaaaagtgaatttgcagtctttctctagagttgtatatatagaacatcctggagtccaccatgaacggacagttggatctaagtgggaagctaatcatcaaagctcaacttggggaggatattcggcgaattcctattcataatgaagatattacttatgatgaattagtgctaatgatgcaacgagttttcagaggaaaacttctgagtaatgatgaagtaacaataaagtataaagatgaagatggagatcttataacaatttttgatagttctgacctttcctttgcaattcagtgcagtaggatactgaaactgacattatttgttaatggccagccaagaccccttgaatcaagtcaggtgaaatatctccgtcgagaactgatagaacttcgaaataaagtgaatcgtttattggatagcttggaaccacctggagaaccaggaccttccaccaatattcctgaaaatgatactgtggatggtagggaagaaaagtctgcttctgattcttctggaaaacagtctactcaggttatggcagcaagtatgtctgcttttgatcctttaaaaaaccaagatgaaatcaataaaaatgttatgtcagcgtttggcttaacagatgatcaggtttcagggccacccagtgctcctgcagaagatcgttcaggaacacccgacagcattgcttcctcctcctcagcagctcacccaccaggcgttcagccacagcagccaccatatacaggagctcagactcaagcaggtcagattgaaggtcagatgtaccaacagtaccagcaacaggccggctatggtgcacagcagccgcaggctccacctcagcagcctcaacagtatggtattcagtattcagcaagctatagtcagcagactggacctcaacaacctcagcagttccagggatatggccagcaaccaacttcccaggcaccagctcctgccttttctggtcagcctcaacaactgcctgctcagccgccacagcagtaccaggcgagcaattatcctgcacaaacttacactgcccaaacttctcagcctactaattatactgtggctcctgcctctcaacctggaatggctccaagccaacctggggcctatcaaccaagaccaggttttacttcacttcctggaagtaccatgacccctcctccaagtgggcctaatccttatgcgcgtaaccgtcctccctttggtcagggctatacccaacctggacctggttatcgataaggaggctcctctacaccaattaatgtagctgctagctattggcctcccaaaagactccagtactattttaatttgtattgaagaagttcagaaatttaaaagcagagcattttttatgatatcattgttggtgttaattgaaagtataatttgctggaacacaaagaccaaaatgaaagttttttcctccctgcttaaaaatgtagcagcttcttagttactttggaacactactcttacatgtataaagtgattgacttgactttctagcttcccttgtccggaggatattaaaatgctagggtgaggtttagccatcttacttggctttttactattaacatgatgtactaaagtagagccctttgagaatacaagatattatgtataaaatgtaacactgatgataggttaataaagatgattgaatccatta

SEQ ID NO: 329861 - DNA, 1747 bp, Homo sapiens
gctggtacaggtccggggtgttagggatcagccctgcgcctcgcgccgtcgcgcatgcgtcctggtctttctctagagttgtatatatagaacatcctggagtccaccatgaacggacagttggatctaagtgggaagctaatcatcaaagctcaacttggggaggatattcggcgaattcctattcataatgaagatattacttatgatgaattagtgctaatgatgcaacgagttttcagaggaaaacttctgagtaatgatgaagtaacaataaagtataaagatgaagatggagatcttataacaatttttgatagttctgacctttcctttgcaattcagtgcagtaggatactgaaactgacattatttgttaatggccagccaagaccccttgaatcaagtcaggtgaaatatctccgtcgagaactgatagaacttcgaaataaagtgaatcgtttattggatagcttggaaccacctggagaaccaggaccttccaccaatattcctgaaaatgatactgtggatggtagggaagaaaagtctgcttctgattcttctggaaaacagtctactcaggttatggcagcaagtatgtctgcttttgatcctttaaaaaaccaagatgaaatcaataaaaatgttatgtcagcgtttggcttaacagatgatcaggtttcagggccacccagtgctcctgcagaagatcgttcaggaacacccgacagcattgcttcctcctcctcagcagctcacccaccaggcgttcagccacagcagccaccatatacaggagctcagactcaagcaggtcagattgaaggtcagatgtaccaacagtaccagcaacaggccggctatggtgcacagcagccgcaggctccacctcagcagcctcaacagtatggtattcagtattcagcaagctatagtcagcagactggacctcaacaacctcagcagttccagggatatggccagcaaccaacttcccaggcaccagctcctgccttttctggtcagcctcaacaactgcctgctcagccgccacagcagtaccaggcgagcaattatcctgcacaaacttacactgcccaaacttctcagcctactaattatactgtggctcctgcctctcaacctggaatggctccaagccaacctggggcctatcaaccaagaccaggttttacttcacttcctggaagtaccatgacccctcctccaagtgggcctaatccttatgcgcgtaaccgtcctccctttggtcagggctatacccaacctggacctggttatcgataaggaggctcctctacaccaattaatgtagctgctagctattggcctcccaaaagactccagtactattttaatttgtattgaagaagttcagaaatttaaaagcagagcattttttatgatatcattgttggtgttaattgaaagtataatttgctggaacacaaagaccaaaatgaaagttttttcctccctgcttaaaaatgtagcagcttcttagttactttggaacactactcttacatgtataaagtgattgacttgactttctagcttcccttgtccggaggatattaaaatgctagggtgaggtttagccatcttacttggctttttactattaacatgatgtactaaagtagagccctttgagaatacaagatattatgtataaaatgtaacactgatgataggttaataaagatgattgaatccatta

SEQ ID NO: 329862 - DNA, 1961 bp, Homo sapiens
gtgcatcggggcagctcacgcttcctaaatcccgtcatccagtgagaaagcagggactcttcggcctaggcagccgggacccagccagccctgcgcctcgcgccgtcgcgcatgcgtcctgggtatgtccacgcgcaataaggaggggcgaaaggacatttttttttttcttgctcccgcctctgttcttcccccacctgccacgtacagagcccaagttctcgctaggcttgttgggtcagcgcgattggccggggcccgcgcgagcctgcgagcgagtctttctctagagttgtatatatagaacatcctggagtccaccatgaacggacagttggatctaagtgggaagctaatcatcaaagctcaacttggggaggatattcggcgaattcctattcataatgaagatattacttatgatgaattagtgctaatgatgcaacgagttttcagaggaaaacttctgagtaatgatgaagtaacaataaagtataaagatgaagatggagatcttataacaatttttgatagttctgacctttcctttgcaattcagtgcagtaggatactgaaactgacattatttgttaatggccagccaagaccccttgaatcaagtcaggtgaaatatctccgtcgagaactgatagaacttcgaaataaagtgaatcgtttattggatagcttggaaccacctggagaaccaggaccttccaccaatattcctgaaaatgatactgtggatggtagggaagaaaagtctgcttctgattcttctggaaaacagtctactcaggttatggcagcaagtatgtctgcttttgatcctttaaaaaaccaagatgaaatcaataaaaatgttatgtcagcgtttggcttaacagatgatcaggtttcagggccacccagtgctcctgcagaagatcgttcaggaacacccgacagcattgcttcctcctcctcagcagctcacccaccaggcgttcagccacagcagccaccatatacaggagctcagactcaagcaggtcagattgaaggtcagatgtaccaacagtaccagcaacaggccggctatggtgcacagcagccgcaggctccacctcagcagcctcaacagtatggtattcagtattcagcaagctatagtcagcagactggacctcaacaacctcagcagttccagggatatggccagcaaccaacttcccaggcaccagctcctgccttttctggtcagcctcaacaactgcctgctcagccgccacagcagtaccaggcgagcaattatcctgcacaaacttacactgcccaaacttctcagcctactaattatactgtggctcctgcctctcaacctggaatggctccaagccaacctggggcctatcaaccaagaccaggttttacttcacttcctggaagtaccatgacccctcctccaagtgggcctaatccttatgcgcgtaaccgtcctccctttggtcagggctatacccaacctggacctggttatcgataaggaggctcctctacaccaattaatgtagctgctagctattggcctcccaaaagactccagtactattttaatttgtattgaagaagttcagaaatttaaaagcagagcattttttatgatatcattgttggtgttaattgaaagtataatttgctggaacacaaagaccaaaatgaaagttttttcctccctgcttaaaaatgtagcagcttcttagttactttggaacactactcttacatgtataaagtgattgacttgactttctagcttcccttgtccggaggatattaaaatgctagggtgaggtttagccatcttacttggctttttactattaacatgatgtactaaagtagagccctttgagaatacaagatattatgtataaaatgtaacactgatgataggttaataaagatgattgaatccatta

SEQ ID NO: 329863 - DNA, 2262 bp, Homo sapiens
gtgcatcggggcagctcacgcttcctaaatcccgtcatccagtgagaaagcagggactcttcggcctaggcagccgggacccagccagccctgcgcctcgcgccgtcgcgcatgcgtcctgggtatgtccacgcgcaataaggaggggcgaaaggacatttttttttttcttgctcccgcctctgttcttcccccacctgccacgtacagagcccaagttctcgctaggcttgttgggtcagcgcgattggccggggcccgcgcgagcctgcgagcgaggtgcggcggtcgcgaagggcaaccgagcgggccgtgaccaccgcctccccgcgacgccccagtccagtggcctcgcgtccgcccattcagcggagacctgcggagaggcggcggccgcggcctccgcaagccgtctttctctagagttgtatatatagaacatcctggagtccaccatgaacggacagttggatctaagtgggaagctaatcatcaaagctcaacttggggaggatattcggcgaattcctattcataatgaagatattacttatgatgaattagtgctaatgatgcaacgagttttcagaggaaaacttctgagtaatgatgaagtaacaataaagtataaagatgaagatggagatcttataacaatttttgatagttctgacctttcctttgcaattcagtgcagtaggatactgaaactgacattatttgttaatggccagccaagaccccttgaatcaagtcaggtgaaatatctccgtcgagaactgatagaacttcgaaataaagtgaatcgtttattggatagcttggaaccacctggagaaccaggaccttccaccaatattcctgaaaatgatactgtggatggtagggaagaaaagtctgcttctgattcttctggaaaacagtctactcaggttatggcagcaagtatgtctgcttttgatcctttaaaaaaccaagatgaaatcaataaaaatgttatgtcagcgtttggcttaacagatgatcaggtttcagggccacccagtgctcctgcagaagatcgttcaggaacacccgacagcattgcttcctcctcctcagcagctcacccaccaggcgttcagccacagcagccaccatatacaggagctcagactcaagcaggtcagattgaaggtcagatgtaccaacagtaccagcaacaggccggctatggtgcacagcagccgcaggctccacctcagcagcctcaacagtatggtattcagtattcagcaagctatagtcagcagactggacctcaacaacctcagcagttccagggatatggccagcaaccaacttcccaggcaccagctcctgccttttctggtcagcctcaacaactgcctgctcagccgccacagcagtaccaggcgagcaattatcctgcacaaacttacactgcccaaacttctcagcctactaattatactgtggctcctgcctctcaacctggaatggctccaagccaacctggggcctatcaaccaagaccaggttttacttcacttcctggaagtaccatgacccctcctccaagtgggcctaatccttatgcgcgtaaccgtcctccctttggtcagggctatacccaacctggacctggttatcgataaggaggctcctctacaccaattaatgtagctgctagctattggcctcccaaaagactccagtactattttaatttgtattgaagaagttcagaaatttaaaagcagagcattttttatgatatcattgttggtgttaattgaaagtataatttgctggaacacaaagaccaaaatgaaagttttttcctccctgcttaaaaatgtagcagcttcttagttactttggaacactactcttacatgtataaagtgattgacttgactttctagcttcccttgtccggaggatattaaaatgctagggtgaggtttagccatcttacttggctttttactattaacatgatgtactaaagtagagccctttgagaatacaagatattatgtataaaatgtaacactgatgataggttaataaagatgattgaatccattacaacacaaacaaaaaaaaaaaaaaaaaacaacacaacaccacaaaaccacaagaacacaaaaacaacaacaacaaagaaacaaccaaacccacatccaacacaaacaacaaagaaacaataaacaagcaacaaccgtaaaaacaggcatcataacaaaaataacatcc

SEQ ID NO: 329864 - DNA, 2114 bp, Homo sapiens
gtgcatcggggcagctcacgcttcctaaatcccgtcatccagtgagaaagcagggactcttcggcctaggcagccgggacccagccagccctgcgcctcgcgccgtcgcgcatgcgtcctgggtatgtccacgcgcaataaggaggggcgaaaggacatttttttttttcttgctcccgcctctgttcttcccccacctgccacgtacagagcccaagttctcgctaggcttgttgggtcagcgcgattggccggggcccgcgcgagcctgcgagcgaggtgcggcggtcgcgaagggcaaccgagcgggccgtgaccaccgcctccccgcgacgccccagtccagtggcctcgcgtccgcccattcagcggagacctgcggagaggcggcggccgcggcctccgcaagccgtctttctctagagttgtatatatagaacatcctggagtccaccatgaacggacagttggatctaagtgggaagctaatcatcaaagctcaacttggggaggatattcggcgaattcctattcataatgaagatattacttatgatgaattagtgctaatgatgcaacgagttttcagaggaaaacttctgagtaatgatgaagtaacaataaagtataaagatgaagatggagatcttataacaatttttgatagttctgacctttcctttgcaattcagtgcagtaggatactgaaactgacattatttgttaatggccagccaagaccccttgaatcaagtcaggtgaaatatctccgtcgagaactgatagaacttcgaaataaagtgaatcgtttattggatagcttggaaccacctggagaaccaggaccttccaccaatattcctgaaaatgatactgtggatggtagggaagaaaagtctgcttctgattcttctggaaaacagtctactcaggttatggcagcaagtatgtctgcttttgatcctttaaaaaaccaagatgaaatcaataaaaatgttatgtcagcgtttggcttaacagatgatcaggtttcagggccacccagtgctcctgcagaagatcgttcaggaacacccgacagcattgcttcctcctcctcagcagctcacccaccaggcgttcagccacagcagccaccatatacaggagctcagactcaagcaggtcagattgaaggtcagatgtaccaacagtaccagcaacaggccggctatggtgcacagcagccgcaggctccacctcagcagcctcaacagtatggtattcagtattcagcaagctatagtcagcagactggacctcaacaacctcagcagttccagggatatggccagcaaccaacttcccaggcaccagctcctgccttttctggtcagcctcaacaactgcctgctcagccgccacagcagtaccaggcgagcaattatcctgcacaaacttacactgcccaaacttctcagcctactaattatactgtggctcctgcctctcaacctggaatggctccaagccaacctggggcctatcaaccaagaccaggttttacttcacttcctggaagtaccatgacccctcctccaagtgggcctaatccttatgcgcgtaaccgtcctccctttggtcagggctatacccaacctggacctggttatcgataaggaggctcctctacaccaattaatgtagctgctagctattggcctcccaaaagactccagtactattttaatttgtattgaagaagttcagaaatttaaaagcagagcattttttatgatatcattgttggtgttaattgaaagtataatttgctggaacacaaagaccaaaatgaaagttttttcctccctgcttaaaaatgtagcagcttcttagttactttggaacactactcttacatgtataaagtgattgacttgactttctagcttcccttgtccggaggatattaaaatgctagggtgaggtttagccatcttacttggctttttactattaacatgatgtactaaagtagagccctttgagaatacaagatattatgtataaaatgtaacactgatgataggttaataaagatgattgaatccattaaatccattaaggtcttgaaa

SEQ ID NO: 329865 - DNA, 2011 bp, Homo sapiens
gtgcatcggggcagctcacgcttcctaaatcccgtcatccagtgagaaagcagggactcttcggcctaggcagccgggacccagccagccctgcgcctcgcgccgtcgcgcatgcgtcctgggtatgtccacgcgcaataaggaggggcgaaaggacatttttttttttcttgctcccgcctctgttcttcccccacctgccacgtacagagcccaagttctcgctaggcttgttgggtcagcgcgattggccggggcccgcgcgagcctgcgagcgaggtgcggcggtcgcgaagggcaaccgagcgggccgtgaccaccgcctccccgcgacgccccagtccagtggcctcgcgtccgcccattcagcggagacctgcggagaggcggcggccgcggcctccgcaagccgtctttctctagagttgtatatatagaacatcctggagtccaccatgaacggacagttggatctaagtgggaagctaatcatcaaagctcaacttggggaggatattcggcgaattcctattcataatgaagatattacttatgatgaattagtgctaatgatgcaacgagttttcagaggaaaacttctgagtaatgatgaagtaacaataaagtataaagatgaagatggagatcttataacaatttttgatagttctgacctttcctttgcaattcagtgcagtaggatactgaaactgacattatttgttaatggccagccaagaccccttgaatcaagtcaggtgaaatatctccgtcgagaactgatagaacttcgaaataaagtgaatcgtttattggatagcttggaaccacctggagaaccaggaccttccaccaatattcctgaaaatgatactgtggatggtagggaagaaaagtctgcttctgattcttctggaaaacagtctactcaggttatggcagcaagtatgtctgcttttgatcctttaaaaaaccaagatgaaatcaataaaaatgttatgtcagcgtttggcttaacagatgatcaggtttcagggccacccagtgctcctgcagaagatcgttcaggaacacccgacagcattgcttcctcctcctcagcagctcacccaccaggcgttcagccacagcagccaccatatacaggagctcagactcaagcaggtcagattgaaggtcagatgtaccaacagtaccagcaacaggccggctatggtgcacagcagccgcaggctccacctcagcagcctcaacagtatggtattcagtattcagcaagctatagtcagcagactggacctcaacaacctcagcagttccagggatatggccagcaaccaacttcccaggcaccagctcctgccttttctggtcagcctcaacaactgcctgctcagccgccacagcagtaccaggcgagcaattatcctgcacaaacttacactgcccaaacttctcagcctactaattatactgtggctcctgcctctcaacctggaatggctccaagccaacctggggcctatcaaccaagaccaggttttacttcacttcctggaagtaccatgacccctcctccaagtgggcctaatccttatgcgcgtaaccgtcctccctttggtcagggctatacccaacctggacctggttatcgataaggaggctcctctacaccaattaatgtagctgctagctattggcctcccaaaagactccagtactattttaatttgtattgaagaagttcagaaatttaaaagcagagcattttttatgatatcattgttggtgttaattgaaagtataatttgctggaacacaaagaccaaaatgaaagttttttcctccctgcttaaaaatgtagcagcttcttagttactttggaacactactcttacttggctttttactattaacatgatgtactaaagtagagccctttgagaatacaagatattatgtataaaatgtaacactgatgataggttaataaagatgattgaatccatta

SEQ ID NO: 329866 - DNA, 1940 bp, Homo sapiens
gtgcatcggggcagctcacgcttcctaaatcccgtcatccagtgagaaagcagggactcttcggcctaggcagccgggacccagccagccctgcgcctcgcgccgtcgcgcatgcgtcctgggtatgtccacgcgcaataaggaggggcgaaaggacatttttttttttcttgctcccgcctctgttcttcccccacctgccacgtacagagcccaagttctcgctaggcttgttgggtcagcgcgattggccggggcccgcgcgagcctgcgagcgaggtgcggcggtcgcgaagggcaaccgagcgggccgtgaccaccgcctccccgcgacgccccagtccagtggcctcgcgtccgcccattcagcggagacctgcggagaggcggcggccgcggcctccgcaagccgtctttctctagagttgtatatatagaacatcctggagtccaccatgaacggacagttggatctaagtgggaagctaatcatcaaagctcaacttggggaggatattcggcgaattcctattcataatgaagatattacttatgatgaattagtgctaatgatgcaacgagttttcagaggaaaacttctgagtaatgatgaagtaacaataaagtataaagatgaagatggagatcttataacaatttttgatagttctgacctttcctttgcaattcagtgcagtaggatactgaaactgacattatttgttaatggccagccaagaccccttgaatcaagtcaggtgaaatatctccgtcgagaactgatagaacttcgaaataaagtgaatcgtttattggatagcttggaaccacctggagaaccaggaccttccaccaatattcctgaaaatgatactgtggatggtagggaagaaaagtctgcttctgattcttctggaaaacagtctactcaggttatggcagcaagtatgtctgcttttgatcctttaaaaaaccaagatgaaatcaataaaaatgttatgtcagcgtttggcttaacagatgatcaggtttcagggccacccagtgctcctgcagaagatcgttcaggaacacccgacagcattgcttcctcctcctcagcagctcacccaccaggcgttcagccacagcagccaccatatacaggagctcagactcaagcaggtcagattgaaggtcagatgtaccaacagtaccagcaacaggccggctatggtgcacagcagccgcaggctccacctcagcagcctcaacagtatggtattcagtattcagcaagctatagtcagcagactggacctcaacaacctcagcagttccagggatatggccagcaaccaacttcccaggcaccagctcctgccttttctggtcagcctcaacaactgcctgctcagccgccacagcagtaccaggcgagcaattatcctgcacaaacttacactgcccaaacttctcagcctactaattatactgtggctcctgcctctcaacctggaatggctccaagccaacctggggcctatcaaccaagaccaggttttacttcacttcctggaagtaccatgacccctcctccaagtgggcctaatccttatgcgcgtaaccgtcctccctttggtcagggctatacccaacctggacctggttatcgataaggaggctcctctacaccaattaatgtagctgctagctattggcctcccaaaagactccagtactattttaatttgtattgaagaagttcagaaatttaaaagcagagcattttttatgatatcattgttggtgttaattgaaagtataatttgctggaacacaaagaccaaaatgaaagttttttcctccctgcttaagcggggaaccatcacttttgctaggccacctagccaaagtgaaccaataggattacctgaagtgaaaaagcttatgtacagcca

SEQ ID NO: 329867 - DNA, 1111 bp, Homo sapiens
  misc_feature (40)..(40): n is a, c, g, or t
  misc_feature (52)..(52): n is a, c, g, or t
cggaggggagaaagtaatttaaaaggggtgaaaaataaanaagaaaatttanggccacccagtgctcctgcagaagatcgttcaggaacacccgacagcattgcttcctcctcctcagcagctcacccaccaggcgttcagccacagcagccaccatatacaggagctcagactcaagcaggtcagattgaaggtcagatgtaccaacagtaccagcaacaggccggctatggtgcacagcagccgcaggctccacctcagcagcctcaacagtatggtattcagtattcagcaagctatagtcagcagactggacctcaacaacctcagcagttccagggatatggccagcaaccaacttcccaggcaccagctcctgccttttctggtcagcctcaacaactgcctgctcagccgccacagcagtaccaggcgagcaattatcctgcacaaacttacactgcccaaacttctcagcctactaattatactgtggctcctgcctctcaacctggaatggctccaagccaacctggggcctatcaaccaagaccaggttttacttcacttcctggaagtaccatgacccctcctccaagtgggcctaatccttatgcgcgtaaccgtcctccctttggtcagggctatacccaacctggacctggttatcgataaggaggctcctctacaccaattaatgtagctgctagctattggcctcccaaaagactccagtactattttaatttgtattgaagaagttcagaaatttaaaagcagagcattttttatgatatcattgttggtgttaattgaaagtataatttgctggaacacaaagaccaaaatgaaagttttttcctccctgcttaaaaatgtagcagcttcttagttactttggaacactactcttacatgtataaagtgattgacttgactttctagcttcccttgtccggaggatattaaaatgctagggtgaggtttagccatcttacttggctttttactattaacatgatgtactaaagtagagccctttgagaatacaagatattatgtataaaatgtaacactgatgataggttaataaagatgattgaatccatta

SEQ ID NO: 329868 - DNA, 1096 bp, Homo sapiens
  misc_feature (29)..(29): n is a, c, g, or t
  misc_feature (34)..(34): n is a, c, g, or t
cgtacccccctccgcataacaaagaagangactngagggccacccagtgctcctgcagaagatcgttcaggaacacccgacagcattgcttcctcctcctcagcagctcacccaccaggcgttcagccacagcagccaccatatacaggagctcagactcaagcaggtcagattgaaggtcagatgtaccaacagtaccagcaacaggccggctatggtgcacagcagccgcaggctccacctcagcagcctcaacagtatggtattcagtattcagcaagctatagtcagcagactggacctcaacaacctcagcagttccagggatatggccagcaaccaacttcccaggcaccagctcctgccttttctggtcagcctcaacaactgcctgctcagccgccacagcagtaccaggcgagcaattatcctgcacaaacttacactgcccaaacttctcagcctactaattatactgtggctcctgcctctcaacctggaatggctccaagccaacctggggcctatcaaccaagaccaggttttacttcacttcctggaagtaccatgacccctcctccaagtgggcctaatccttatgcgcgtaaccgtcctccctttggtcagggctatacccaacctggacctggttatcgataaggaggctcctctacaccaattaatgtagctgctagctattggcctcccaaaagactccagtactattttaatttgtattgaagaagttcagaaatttaaaagcagagcattttttatgatatcattgttggtgttaattgaaagtataatttgctggaacacaaagaccaaaatgaaagttttttcctccctgcttaaaaatgtagcagcttcttagttactttggaacactactcttacatgtataaagtgattgacttgactttctagcttcccttgtccggaggatattaaaatgctagggtgaggtttagccatcttacttggctttttactattaacatgatgtactaaagtagagccctttgagaatacaagatattatgtataaaatgtaacactgatgataggttaataaagatgattgaatccatta

SEQ ID NO: 329869 - DNA, 1112 bp, Homo sapiens
  misc_feature (47)..(47): n is a, c, g, or t
  misc_feature (53)..(53): n is a, c, g, or t
cacccccccccccctacaccaactcaccaactcaccgccttcgaggnaccccnggccacccagtgctcctgcagaagatcgttcaggaacacccgacagcattgcttcctcctcctcagcagctcacccaccaggcgttcagccacagcagccaccatatacaggagctcagactcaagcaggtcagattgaaggtcagatgtaccaacagtaccagcaacaggccggctatggtgcacagcagccgcaggctccacctcagcagcctcaacagtatggtattcagtattcagcaagctatagtcagcagactggacctcaacaacctcagcagttccagggatatggccagcaaccaacttcccaggcaccagctcctgccttttctggtcagcctcaacaactgcctgctcagccgccacagcagtaccaggcgagcaattatcctgcacaaacttacactgcccaaacttctcagcctactaattatactgtggctcctgcctctcaacctggaatggctccaagccaacctggggcctatcaaccaagaccaggttttacttcacttcctggaagtaccatgacccctcctccaagtgggcctaatccttatgcgcgtaaccgtcctccctttggtcagggctatacccaacctggacctggttatcgataaggaggctcctctacaccaattaatgtagctgctagctattggcctcccaaaagactccagtactattttaatttgtattgaagaagttcagaaatttaaaagcagagcattttttatgatatcattgttggtgttaattgaaagtataatttgctggaacacaaagaccaaaatgaaagttttttcctccctgcttaaaaatgtagcagcttcttagttactttggaacactactcttacatgtataaagtgattgacttgactttctagcttcccttgtccggaggatattaaaatgctagggtgaggtttagccatcttacttggctttttactattaacatgatgtactaaagtagagccctttgagaatacaagatattatgtataaaatgtaacactgatgataggttaataaagatgattgaatccatta

SEQ ID NO: 329870 - DNA, 1111 bp, Homo sapiens
atatcattcattatttttttattgcatttttaactaaaaaaataaatctcgaggccacccagtgctcctgcagaagatcgttcaggaacacccgacagcattgcttcctcctcctcagcagctcacccaccaggcgttcagccacagcagccaccatatacaggagctcagactcaagcaggtcagattgaaggtcagatgtaccaacagtaccagcaacaggccggctatggtgcacagcagccgcaggctccacctcagcagcctcaacagtatggtattcagtattcagcaagctatagtcagcagactggacctcaacaacctcagcagttccagggatatggccagcaaccaacttcccaggcaccagctcctgccttttctggtcagcctcaacaactgcctgctcagccgccacagcagtaccaggcgagcaattatcctgcacaaacttacactgcccaaacttctcagcctactaattatactgtggctcctgcctctcaacctggaatggctccaagccaacctggggcctatcaaccaagaccaggttttacttcacttcctggaagtaccatgacccctcctccaagtgggcctaatccttatgcgcgtaaccgtcctccctttggtcagggctatacccaacctggacctggttatcgataaggaggctcctctacaccaattaatgtagctgctagctattggcctcccaaaagactccagtactattttaatttgtattgaagaagttcagaaatttaaaagcagagcattttttatgatatcattgttggtgttaattgaaagtataatttgctggaacacaaagaccaaaatgaaagttttttcctccctgcttaaaaatgtagcagcttcttagttactttggaacactactcttacatgtataaagtgattgacttgactttctagcttcccttgtccggaggatattaaaatgctagggtgaggtttagccatcttacttggctttttactattaacatgatgtactaaagtagagccctttgagaatacaagatattatgtataaaatgtaacactgatgataggttaataaagatgattgaatccatta

SEQ ID NO: 329871 - DNA, 1115 bp, Homo sapiens
  misc_feature (56)..(56): n is a, c, g, or t
ccccccacaccttacacaccaccacacgaagcacccgccccctttctagggcactnggccacccagtgctcctgcagaagatcgttcaggaacacccgacagcattgcttcctcctcctcagcagctcacccaccaggcgttcagccacagcagccaccatatacaggagctcagactcaagcaggtcagattgaaggtcagatgtaccaacagtaccagcaacaggccggctatggtgcacagcagccgcaggctccacctcagcagcctcaacagtatggtattcagtattcagcaagctatagtcagcagactggacctcaacaacctcagcagttccagggatatggccagcaaccaacttcccaggcaccagctcctgccttttctggtcagcctcaacaactgcctgctcagccgccacagcagtaccaggcgagcaattatcctgcacaaacttacactgcccaaacttctcagcctactaattatactgtggctcctgcctctcaacctggaatggctccaagccaacctggggcctatcaaccaagaccaggttttacttcacttcctggaagtaccatgacccctcctccaagtgggcctaatccttatgcgcgtaaccgtcctccctttggtcagggctatacccaacctggacctggttatcgataaggaggctcctctacaccaattaatgtagctgctagctattggcctcccaaaagactccagtactattttaatttgtattgaagaagttcagaaatttaaaagcagagcattttttatgatatcattgttggtgttaattgaaagtataatttgctggaacacaaagaccaaaatgaaagttttttcctccctgcttaaaaatgtagcagcttcttagttactttggaacactactcttacatgtataaagtgattgacttgactttctagcttcccttgtccggaggatattaaaatgctagggtgaggtttagccatcttacttggctttttactattaacatgatgtactaaagtagagccctttgagaatacaagatattatgtataaaatgtaacactgatgataggttaataaagatgattgaatccatta

SEQ ID NO: 329872 - DNA, 1401 bp, Homo sapiens
gatgtcatatagttccttgctaccaaagagtttgttcatatggtaatagaggcccatacctttagagggcaaatacagtgctttaggaaggacttagatgatataaatggtatttgtcccttttctcatttttatttactgattttcaactcacttggcttttaatgaacattagcgttacttatctgttggcagctgggttggaaaacatttgtttttctagactttatgaaatggtagccactggtgttgcacttaatgtttattgccagttagttctctgcagttaatccacagcagaggaatcacacttctaaaatggttcattctcttcttcatagacatttaaagttgaacaaatactttcttgtatattgttactctgtttggatggagagggaatgtatatgtatcttaaaaatatttctctttgccacattaaacatgccttttttccttgtgtgtgtgtgtgtgtgttttcaggtcagatgtaccaacagtaccagcaacaggccggctatggtgcacagcagccgcaggctccacctcagcagcctcaacagtatggtattcagtattcagcaagctatagtcagcagactggacctcaacaacctcagcagttccagggatatggccagcaaccaacttcccaggcaccagctcctgccttttctggtcagcctcaacaactgcctgctcagccgccacagcagtaccaggcgagcaattatcctgcacaaacttacactgcccaaacttctcagcctactaattatactgtggctcctgcctctcaacctggaatggctccaagccaacctggggcctatcaaccaagaccaggttttacttcacttcctggaagtaccatgacccctcctccaagtgggcctaatccttatgcgcgtaaccgtcctccctttggtcagggctatacccaacctggacctggttatcgataaggaggctcctctacaccaattaatgtagctgctagctattggcctcccaaaagactccagtactattttaatttgtattgaagaagttcagaaatttaaaagcagagcattttttatgatatcattgttggtgttaattgaaagtataatttgctggaacacaaagaccaaaatgaaagttttttcctccctgcttaaaaatgtagcagcttcttagttactttggaacactactcttacatgtataaagtgattgacttgactttctagcttcccttgtccggaggatattaaaatgctagggtgaggtttagccatcttacttggctttttactattaacatgatgtactaaagtagagccctttgagaatacaagatattatgtataaaatgtaacactgatgataggttaataaagatgattgaatccatta

SEQ ID NO: 329873 - DNA, 1868 bp, Homo sapiens
gtgcatcggggcagctcacgcttcctaaatcccgtcatccagtgagaaagcagggactcttcggcctaggcagccgggacccagccagccctgcgcctcgcgccgtcgcgcatgcgtcctgggtatgtccacgcgcaataaggaggggcgaaaggacatttttttttttcttgctcccgcctctgttcttcccccacctgccacgtacagagcccaagttctcgctaggcttgttgggtcagcgcgattggccggggcccgcgcgagcctgcgagcgaggtgcggcggtcgcgaagggcaaccgagcgggccgtgaccaccgcctccccgcgacgccccagtccagtggcctcgcgtccgcccattcagcggagacctgcggagaggcggcggccgcggcctccgcaagccgtctttctctagagttgtatatatagaacatcctggagtccaccatgaacggacagttggatctaagtgggaagctaatcatcaaagctcaacttggggaggatattcggcgaattcctattcataatgaagatattacttatgatgaattagtgctaatgatgcaacgagttttcagaggaaaacttctgagtaatgatgaagtaacaataaagtataaagatgaagatggagatcttataacaatttttgatagttctgacctttcctttgcaattcagtgcagtaggatactgaaactgacattatttgttaatggccagccaagaccccttgaatcaagtcaggtgaaatatctccgtcgagaactgatagaacttcgaaataaagtgaatcgtttattggatagcttggaaccacctggagaaccaggaccttccaccaatattcctgaaaatgatactgtggatggtagggaagaaaagtctgcttctgattcttctggaaaacagtctactcaggttatggcagcaagtatgtctgcttttgatcctttaaaaaaccaagatgaaatcaataaaaatgttatgtcagcgtttggcttaacagatgatcaggtttcagggccacccagtgctcctgcagaagatcgttcaggaacacccgacagcattgcttcctcctcctcagcagcctcaacagtatggtattcagtattcagcaagctatagtcagcagactggacctcaacaacctcagcagttccagggatatggccagcaaccaacttcccaggcaccagctcctgccttttctggtcagcctcaacaactgcctgctcagccgccacagcagtaccaggcgagcaattatcctgcacaaacttacactgcccaaacttctcagcctactaattatactgtggctcctgcctctcaacctggaatggctccaagccaacctggggcctatcaaccaagaccaggttttacttcacttcctggaagtaccatgacccctcctccaagtgggcctaatccttatgcgcgtaaccgtcctccctttggtcagggctatacccaacctggacctggttatcgataaggaggctcctctacaccaattaatgtagctgctagctattggcctcccaaaagactccagtactattttaatttgtattgaagaagttcagaaatttaaaagcagagcattttttatgatatcattgttggtgttaattgaaagtataatttgctggaacacaaagaccaaaatgaaagttttttcctccctgcttaaaaatgtagcagcttcttagttactttggaacactactcttacttggctttttactattaacatgatgtactaaagtagagccctttgagaatacaagatattatgtataaaatgtaacactgatgataggttaataaagatgattgaatccatta

SEQ ID NO: 329874 - DNA, 506 bp, Homo sapiens
tgacagttgatatccatccaggcactctaatggcacgttagtcaggggagatgtgaagaggccctgatcactgaaccaaccaagagaaagcattctgaagaatctgctggggtcaaagaacccttccaagcaggttggagtccagtggcatgatcataactattaacttcaaatctctgggttcaagcaatacttccgcttcagcctccaaagttgcctagaactactgatgcatgccaccatgcccagctaactttttttttcttttttgtggagacagtctcactatgttgcctgggctacaactcctagcctcaagcgatcctcccacgtcctcacctccagtgccacctcacccagaccaatcaggtttattagtataccttcacacataccacattgacatgaaatcatccttgccctcaggaagcctacagtccaatcagggaaacaaaagcaacacatgtcaacaaatgcaatactgtaatgcagaaacgaagcaagta

SEQ ID NO: 329875 - DNA, 557 bp, Homo sapiens
aaaaaaaaaaagttggttttattagattacagagaatactttctctatccaaaatctgtgattttaatctagaacactgaatgtaggtcagtatccaccccattttcagaaatctgggaagatctttttttgtttttcagcttctcagaataaatactttctaggatgttacaaacatggatgaagttcaccagaacagatccagggttaaccttttaaagtcattagatatggctccagtaaaaggcatgagaaggcacccgtgagaccctgcagaggaagcctcactcctgggcagccttacggctgacgagctaccttactgagcatattcctgcctctacaccagagactcactctgtggtccggtgtcacctcgattctaaattccctgcttcctggtgaatgatgctatcacactttagaaacctggccaataaatgctttgaaatttaaggatagctatcctgaaaaaatttaatataacctaaattgatagtctaatgacatcagtattcagaagaggcattctatttcagcaagtggttttcagaaaa

SEQ ID NO: 329876 - DNA, 417 bp, Homo sapiens
gcaggacagaggaggataagaagctggaggtcaaggaagggaatgctggtggggacggtgtagcaacctccaaggagataagtaatagctgcagcgtgggctggtatgggctggtgactgaggagtaccaggtcctggaaacctacacaggacaatcagagcagcgcagcaggtgcacggtgccgagtgaggagcgagtgcaagagctgtccactctttacagaagcttgtcagtgaaagaaagagaagagggactggggaaacatggagtcttcttactaacagaaaactcagcttgtgggggagggaagaagtctgtgggagggaggcagggagggaacctgcctcagagggaggaggagagagctgacttgggagtgtacgtggaaaaggtactctcgccttgttctggaggag

SEQ ID NO: 329877 - DNA, 4813 bp, Homo sapiens
  misc_feature (1822)..(1822): n is a, c, g, or t
  misc_feature (1887)..(1887): n is a, c, g, or t
  misc_feature (1899)..(1899): n is a, c, g, or t
  misc_feature (1951)..(1951): n is a, c, g, or t
  misc_feature (1959)..(1959): n is a, c, g, or t
  misc_feature (2026)..(2026): n is a, c, g, or t
gggattgttcagaggcaaagtattggaatctatcaatgaacagatagtctttgatctctactccgttgacacttccttgaatgtaaaaataatttttagagtgtggtactttttgttttataaaaagtatgtatcagtctgaatgtttgtttgcttcataaatcaaaacatttccatatttttgaaattacatcagtgttttaaaattcaacttcctagattaaattttacagttgaatgttttgtctcagtattttgcctagttcttatttcttgtctaacagaaactaacactttgggaggccgaggtgcgcagatcacctgaggtcaggaatttgagaccagcctggccggcatggcgaaaccctgtctctactaaaagtacaaaaattagccaggagtggtggcgggtgcctgtagtcccagctactcaggaggctgaggcaggacaatcgcttgaacccgggaggcggaggttgcagtgggctgagattgcgccactgtactccagcctgggcgacaagagtgagactccagcgcaaaaaaaaaaaagggcgggggggctaaagcataaagaggtgagcataattttaaagaattactaagttcagtttaactagagtagctaaaatttgaaagacttgctcattatgtgaagataagtgattccagtaaacaagcaaaaatcactgagaaaagtacattaataatgttagaaaaacctaatcttaatttactattaaaaatattcatcttattctgtcctcttttcacagtttttaccaaagtcaaatgtttttgctagctttggagcactgttaactatagtcctatctgtggtaatgctataatgcccaaattgatagttttataatgctagtgcttaagttatttggagaaatttggctggatgggggcagagcaggtcaggcagatcttacactgcctggaactgcaaatctataggtggcaagagggaattgctttctaaattgaatgctccatttccttaacaagactggtccaggaccaagccaagcttaggtaaatgggcttggaatacagcctttctggggaatttgctatggcttttgagtccttgtgatttggaaaacatctggatataaagagatgtttatagctgatctgaatatatatgtgatctccctgaagtaagtaactacagatcagccgaagaacctcctctgactacttaggattctcttcaagcgtgtcaatcagctagaacgtgaccattctctgagcgttgaacactttacattgccagataatttgtgctgttttcgtcaaacctgaccctaatataacttgactaaataatcttgtctgtggcaaataaagaggtagcagtatatttatgtcctcttttcggaaggtgataaaggaattatttgataaagtacgatatgtattgctactttgcagagtagacctcaagtagatacttgagtagacactctgcatttgtgtgcttttttctattcacacactacagtgggtatgtgaatcagtgaaaaattgccaaaaatatgatcaattgaaaacttttgttaggtggtctttatttgaactatatcttgtcatccattagtaatttagcaagatttgatcagaaccagtcaacgctctttaaatcagttaatcccattaaaggtttttatggaaaggaaaaacagtgctcaacaattgagttgatactaaagctttgctttgaccaaattgcagttaataccagtaaactactttttttttttgagacggagtcttgctctgtcacccagactggagtgcagtgacgctntcttggctcactgcaagctctgcctcccgggttcacatcattctcctgcctcagcttcctgagtngctggggctatnggcacccgtcaccacgcctggttaatttttttttagtacagatggggtttcnccgtgttngccaggatggtctcgatctcctgacctcgtgatctgccagcctcggcctcccagagtgctgggattncaggcgtgagccaccgtgcccagcctatcagtcaactactttttgtttttatcttcatatattaagggaatttttagttaaacaggttgccctcacatacattttatgatcttatattagatacctttggatgtctgtattttttagtaggcagatgaaagtgtttttagttaggattatagggattgctttagtaaaataatatttcctcagagaatctgtcttactccaacaaatactaactctaaagactgttttctgtgttttttagtcggccgtatactaacaaggtaattactttatggtaccgtccacctgaactgctactgggagaagaacgatacacaccagccattgatgtatggagctgtggctgtatccttggcgaactcttcactaaaaaacctatatttcaagcaaatcaggaacttgcacaactagaattaataagccgaatatgtgggagtccatgtcctgcagtgtggcctgatgtaatcaaactaccatatttcaacaccatgaaaccaaagaagcaatatcgtcgaaagttaagagaagaatttgtttttattcctgcagctgcgctagacttatttgattacatgcttgccttggatcctagtaagcgctgcactgctgaacaggctcttcagtgcgagttcctccgagatgtggaaccctcaaaaatgcctccaccagatctccctttatggcaagattgtcatgagttatggagtaaaaagcgaagaagacagaagcagatgggcatgactgatgatgtttccacaattaaagcccccaggaaggacttgtctctgggcttggatgacagcagaaccaacacaccccagggtgtgctgccatcttcacagctgaaatctcagggcagctcaaatgtggcacctgtaaaaacaggccctggacagcacttaaaccacagtgaattggcaattctactaaacctactacaatctaaaacaagtgttaatatggctgattttgtccaagtgttgaacattaaggtaaactctgagactcaacagcagctaaataaaataaaccttcctgctggaattttggcaacaggtgaaaaacagacagatccatcaacaccacaacaggagtcttcgaaaccgttgggaggaattcagccttcttctcagaccatccagcctaaagtggagactgatgctgcccaggcggctgtgcagagtgcatttgcagttctgttgactcagttaataaaggctcagcagtcaaagcagaaagatgtgctactagaagagagggaaaatggatcgggacatgaagcgtcattacaactcaggccacctccagaacctagcactccggtgtcgggacaagatgacctcatccagcatcaagatatgaggatcttggagctaacgccagaaccagaccggcctcgaattctgcctcctgaccaacgacctcccgagcctcctgaaccaccaccagtcactgaggaagatctagattatcggacagaaaaccagcatgtacccaccaccagttcttcattaactgaccctcatgccggagtgaaggcagccctgttacagctgcttgctcagcatcagccccaggatgaccccaaaagagaaggtgggattgattatcaagcaggagacacttacgtgtccacttcagactacaaggacaactttggatcctcttctttctcttctgctccttatgttagcaatgatggtctaggaagcagttctgctccaccactagaacgacgtagtttcattggaaattcagatattcagtctttggataactacagtactgcttcatctcattctggtggtccacctcagccttctgccttttctgagtcatttcccagttcagtagctggatatggagacatttacctcaatgctggtcccatgttgtttagtggagacaaggaccatagatttgaatatagccatggtcctattgcagtcctggcaaacagcagtgacccttccacggggccagagagtactcatcctttgccagcaaagatgcacaactataactatggtggtaacttacaggaaaatccgagtggccccagcctcatgcatggacagacctggacttctcctgcccaaggacctggatattcacaaggatacaggggacatattagcacatcaactggcagaggcagaggcagagggttaccatactgagtatctgtttttcctcaggcacatcatttttatctggaaagacttttctagctgcaatttaaggcagcaatccaagagacttgaataataataattcaacaacagctttatttttatgtggagaagggtcttgcatacaatagtttaaaaaagacaaaaaaaacctttgcttaaattcatgctgttctaaaaactagatcgattgtacatcttcacaaattctagttaacaattttattttgtattcttgcagttttaagtggatgctaattttaggggcataagccttttatggccctcttgcagatcttctgaactatgcacatttgtgctttttttgtaagtttggaccaacttttatgtaacaaacagcccctccccacctccagttttacaacaatcagaaagggcactgatttatttggtatttttctttttacaaagctacctttagtcaaaggtcactgtcagtctttgcacctgctttcagtgttattgtgaaaggtgtactttgtgctcatttcagaaaataaaacacaacctttctcttgatgcaacagttttataaaaaaaaaaa

SEQ ID NO: 329878 - DNA, 4013 bp, Homo sapiens
  misc_feature (2530)..(2530): n is a, c, g, or t
gaaaaactggcttgataacatggcaagctgaatgcttgtagctagtaggctgtcactttctagtaagactatgtatttatcccaccagttgaagagtatgctgaacaggaggtagttgttagttttcaatttttatgctttttattattataattacttagtttaagcgtagatacagtgctttacaaaaactttaagacattgctgtctaattagggatggacaagtaattgtgtaagttagaaaagttataaaaatccaagatgtggtattagattgctttgaaagtgtttttaatttctagatttatttaaagaaatcaaaactaaaaatccttgatgatgtgttatgggtgtggtttgtacaagagagctaatacagaattccattcagtgaatcctctgtttaaagagaaagccttggcctttgtcagaagatgggaaaacaaatgtacatttataaactttcagttaaaataaaatgtttaaattatatatctgtgtatcttttttttttaaacgattccttctaacctttttttttaaacgattccttctaacccatttttttttttgttaaacccaaccagccaactcttggtcctgattgtattggaaactagggcttctattaaagatagttaacatctatttagttcatatacaatatcagcattattcgaagagtttcacttgaattatctcagttaagcttcgtaacaaccctatgtcttctctttatagttaagaaaactgaaccttagagaggtgaagaattcgtccagggtcataaaactagcaagtggcaaaattgagatttaaacactgctaggtgttaccttaggatctaaacttttaaccattactccaaagtacaggctgggtgcggtggctcacgcctgtaatcgcagcactttgggaggccaagacgggtggatcacttgagcccaggagttcaagaccagactaggcaacatgacaaaaccccgtatatactaaaaacaaaaattagccgggcatggtagcacacacctgcaatcccagctccttgggaggctgaggcatgagaattgcttgaacctgggaggcagaggttgcagtcagccaagatcgcaccactccactacagcctgggtgacagagtgagaattggtctcaaaaaataaataaataaactacataggaaataaaactacctggaatcttttcttttacaaaatcaatatgacacacatatcggtacttgacaaagacaacatgaaaaattttataagatattaggccgggaacggtggctcatgcctgtaatcccagcactttgggaggccgaggtgggagggtcacttgaggccaggagtctgaaaccatgcctggccaacatggtgaacgcccccatcccccatatctactaaaaatataaaaattaggctgggcatggtggctcatgcctgtaatcccagcactttgggaggctgaggcgggtggatcacttgaggtcaggagtttgagaccagcccggccagcatggcgaaaccctatctctactaaaaatacaaaaactaaccgggcgtggtggtaggcgcctgtagtcccagctcctcaggaggctgaaacacaataattgcttgaacccagaaggcggaggttgcagtgagccgagattgctctgccgcgctccagcctgggcgattgagactgtctcaaaaaaaaaaaaaaagaaaaattgtataagatattaatccaagaattctaagggaggtactagcaaatagtatccagctttttatcacaaagttaacctgcagaaaaatgatgggagctaagatgatacagagggtcaagaaaggtatctccctttaagtgacatttgagcagagatctgaatgaagaaatggcaaagtaataaagactctgaggcatatttggttttttttttttaggaatatgttctcagtgaaccatatggggggaaagcttggtttatccattttatagcatgctgtactgttactaagaaggaaatagttggtcaggcacaatggctcacgcctctagtcccaacactttgggaggccaaggcgggcggatcacttgaggtcgagttcaggaccagccttgccaacatggtgaatccctgtctctactaaaaatacaaaaattacctgggcgcagtggtgtgtgcctgtaatcccagctacttggaaggctgaggcaggaacatcctgcctcaggtagcttgaacctgggaggcagaggttgcagtgagtcgagattgtgccactgcactccagcctgggtgacagagtgagactatgtctcagaaaaaaaaaaaaaaaaaaggaaacagttgatttggagataaagaaatggaaaagcagcatgaatagttacagaaggctatattgagattgatctcatttaggtaaaacaaaagactcaaattgttaatctgaacatggactttcaagaagactagggaggagaaattttcattttctagtttatatatttcagcatgtttttattttgtnaagatacttataattttataaagagattgaccgggcacagtggctcacacctgtaatctcagcactttggaaggccaaggcaggtggatcactagagcccaggagtttgagaccagcctgggcaacgtggccaaaccccgtctctacaaaaaatacaaaaattaggtgggtgtggtagcacacacctatagcctgagctattgggaggctgcggtacaaggatcacccgaacccaagggaggtcgaggctacagtgaactgtgattgcaccactgccctttagtctgggcagcagagcgagaccttgtctcaaaaaaacagaaataaaacaacaaaacataaaaagatgcttcaattttgatttcatagcattaatttcttttcagacatgaagaaaatgaagtttctgataaacaaatctgactataatgaggcaacggagtataccgaaaagtgtgtggcctttagaatcttacagggttgggttctaatgccagctcagctacttcctgcgcttatggtttagggtcccatatgctcttaagtttttttcttcaaaagtaaaagaggactgataacatgcttagggttgtgagaattaaatgtaaataagttttcagtacatatttcttccctcaccttatttacagtaatgctaggttgtttataggctcaggaatgatgagacctagtgtcagtatagtacagatacatgtaaaactgatcaagagtgataacactaatttgctttaaatggctttacaccatagtgaatgagttattttatttataatttgctttgttccagaaagtattttaggcagattacaaatattttataatagaagtagcatagattaaaaagtgatggagggaggccgggcacggtggctcatacctataatcccagcacttcgggaggccgaggcaggtagatcatctgaggtcagcagtttgagaccagcctggccaacatagtgaaaccccgtctctgctaaaatacaaaacaagccgggcacagtggctcatgcctgtaatcctagcactttgggaggccgaggcggacaggtcatgaggtcatgaggtcaggagatcaagaccatccgggctaacacggtgaaaccccgtctctaccaaaactacaaaaaaaaaaaaaaaaaaaaaaaaaaagccgggcatggcggcgggcacctgtagtcccagctactcaggaggctgaggcaggagaatggcatgaacccaggaggcagagcttgcagtcagccgagatggcgccactgcactccagcctgggcaagagagcgacactccatctcaaaaataaataaaaaaacaattagctgagtgtggtggcacacacctgtaatcccaggtacttgggagtctgaggcaggagaactgcttgaacctgggaggtggaggttgcagtaagcggagattgtgccactgcactccagcctgggcaacagcaagactccatccc

SEQ ID NO: 329879 - DNA, 2878 bp, Homo sapiens
agccccgcgggccgcagagtgcgcgaggccctaggccgggagttgttgtcaggcccaggccacttccgaggcgcctgcggtgtgtcgccgccaccacaggaggacgacgtcgacgccgaggaggaggcggtggaggcgtgttgttgtctcgcccactcccctcccctgaacttgcacccaacgtcagggcgcgatggagtgaagcggcgacgaaggtggtacttccgcgttgcgctgcccgagccgagagcgcggccaaggccgctcccccacccccgggggcacttggaggactcgggactcccccgcaggtcagcgcccggcgcatctggtgttttcgctgccgaggataggacgacgagcgcaatcgggagctccgccgcccggattcctgcttccctggggcccggaggctgctgcgtaccccactgtgacctggaacccagggacccgagtcccgacccggattatcgtggcgcttttcccggccggctctggtgctcggtgtccctccgccgccgctcccgtttccggcgggggagatggccaggatctgacccgggaggaggccgcacccgcgccgcgctctgcggctggctctaggcgatgccgagcagctcggacacggcgctggggggaggcgggggcctgagctgggcggagaagaggttggaggaacgccgcaagcggaggcgattcctgtcccctcagcagccgccgctgctgttgccgctcctgcagccgcagctcctgcaaccgccgccgcccccgccgcctctgctcttcctggctgctcccggcacggccgccgccgcagccgccgccgccgcggcctcctcctcttgcttcagcccgggcccccctctggaggtcaagcggctggcgagaggcaagaggcgcgcaggagggcggcagaagcggcgtcgcgggccccgcgccgggcaggaggcggagaagcgtcgggtcttctcgctgccccagccgcagcaggacggcggtggcggtgctagtagcggcgggggtgtgaccccgctggtggaatacgaggatgtgagctcccagtccgagcaggggctgctgctggggggggccagcgcggcaacggcggcgacggctgccgggggaacggggggcagcggcgggagtccggcctcctcctccggcacccagcggcgcggggaggggtcggagcgcaggccccgccgggaccgccgcagcagcagtggccgcagcaaggagcgccaccgcgagcaccggcggcgggatgggcagcgcggtggcagcgaggcctccaagtcccgcagccgccacagccacagcggcgaggaacgggccgaggtcgccaagagcggcagcagcagcagcagcggcggccgccggaaaagcgcttcggccacatccagcagcagtagcagccgcaaggaccgggactcgaaggcccaccgcagccggactaagtcgtccaaggagccgccttcggcctacaaggaaccgcccaaggcctaccgggaggacaagaccgagcctaaggcctacaggcggcggcggtccctcagcccactgggaggccgggacgacagcccggtgtcccacagggcctctcagagcctgaggagccgcaagtcccccagcccggcaggaggtggcagcagcccctattctcggcggctgccgcgctccccgagcccctacagtcgccgccgctcccccagctacagccgccacagctcctacgagcggggcggcgacgtgtcccctagtccctacagcagcagcagctggcgccgctctcgcagtccctacagccctgtgctcaggtgagttctgccgttctgcctgtgtgtgccttggctgcgctggccagatccccaggaggaagggaaagtggtgcccgggtcctcagaacgactcaggtccaccaccgagacgagacaacaccgcctgagcctcccaggaaggataggcgttttcgcgcgcgtgacacttttttagggggtcgaagggacaaagcaactgggcgaagggaacttttctcctagctgtggcagggaagatttctaaggaagaattaaaagtttcagacttgttgcattaatgtgttaacaggtttctctcagttgctctttgcttttctggtacaatttgggtaaacctagaggtggtttaagtcttaattttgaaagttctgtgaagaggtttcattgttgggaatttaggaatggactgcaacttaagatctagtattgtacaggggaataagaatcaggtactgatgtcagagttagatgtggattgcagatgtttcttatgattattacagaaatgggagaagcagcctttctgtaaagtttattcttttagtatgttaaaaaagcttaggtggaagccgatagttctgaatactgaagttaaaaaaggtatctatttagtgatattcttgtgtgggatagtttttacctgatctttcaaagtcataattatagaaggtagaaaaaatgacaagactgtggtttctttgttggtttgtgatgacacccagttgctaataacattataaatctgggtggtgtaacctagtgtaaccaagtgaatggctgagtacattcttatactattataagcctgtaactgcttactttaaaagctaagtagactttttcttagatatatacccgaaggataaaaacacaatataactagacctttaaatatcaggatctttgtccagaaatctttaaaaggtgtaatttaatttaatgaaattggagtaaaacttttctgtagctttcttgccttgttatataatattctttttaaaaagtgtgccttaaaatatacttatccactaagcaaagtgcattaaaaacaactttcgagt

SEQ ID NO: 329880 - DNA, 1195 bp, Homo sapiens
tatacagatttccttagtttttacctaattctatatcatttttactccaaattttgcattatacagttgagtatagtgtattactttagctggaaagaaacttggacaatagtcttataatgtgaaatactgttgaatattcatgactattgctacttaaatgtaagtcataagcatatttttattagtcaacaaaatttttgttttatttgtctgacttctttcactttcagcttacgaggaaatatttcagtaaaagcagttaaaaaagaagtagaaaagaaactccgatgtcttcttgctgatttaccgctgccccctgagctaccaggaggagatgatctttcaaagagtccagaggaaaagaaaacagcaacacagttacatagtaaaaggaggcctaagtatgtgcttgctttctacctgctcttaaattgaccagcagtgattctgggtcatcagaagttcataaaacactaaattaaggtttaaaataaaaaatgtacttattctttcaacttaaatatatgaattctattagagttttgaaaaaaatcataattgcttgcattcctattcacaatgactaataaaaccaaatttaattttctctcgtaatttgtaatgtattaatttcctggggtattgtatatgttaaagatactttctgttattaagagattgaaataacacaaacactgaaattgggcagagtagaagtcagcatttagtgagaccaaataaaattagtaatgggcaagctgctgtttcctttgcttttagctccattttctcccataaacaaatatattcttcactttgcaagagatggagtagaagaagttttgaaatttgtatcctaaattagcttcaagtaagtgcctaaagagacctctttcccttaaaacctgttaatcagttaaaggcggggaacactggtgcctttttttttttttttttttaacttcttaaccaagggacagtgaagactttaagttagatctgattttagaattgcagttgaggtagtgcctagtgtgtgaatttgaggtcattttctaaactggccgggcacagtggctcatgcctgtaatcccagcactttgggaggcccaggtgggagaatcacttgagtccaggagtttgataccagcctgagcaacacagggagaccccatctctaccaaaaaaaaaa

SEQ ID NO: 329881 - DNA, 6140 bp, Homo sapiens
agccccgcgggccgcagagtgcgcgaggccctaggccgggagttgttgtcaggcccaggccacttccgaggcgcctgcggtgtgtcgccgccaccacaggaggacgacgtcgacgccgaggaggaggcggtggaggcgtgttgttgtctcgcccactcccctcccctgaacttgcacccaacgtcagggcgcgatggagtgaagcggcgacgaaggtggtacttccgcgttgcgctgcccgagccgagagcgcggccaaggccgctcccccacccccgggggcacttggaggactcgggactcccccgcaggtcagcgcccggcgcatctggtgttttcgctgccgaggataggacgacgagcgcaatcgggagctccgccgcccggattcctgcttccctggggcccggaggctgctgcgtaccccactgtgacctggaacccagggacccgagtcccgacccggattatcgtggcgcttttcccggccggctctggtgctcggtgtccctccgccgccgctcccgtttccggcgggggagatggccaggatctgacccgggaggaggccgcacccgcgccgcgctctgcggctggctctaggcgatgccgagcagctcggacacggcgctggggggaggcgggggcctgagctgggcggagaagaggttggaggaacgccgcaagcggaggcgattcctgtcccctcagcagccgccgctgctgttgccgctcctgcagccgcagctcctgcaaccgccgccgcccccgccgcctctgctcttcctggctgctcccggcacggccgccgccgcagccgccgccgccgcggcctcctcctcttgcttcagcccgggcccccctctggaggtcaagcggctggcgagaggcaagaggcgcgcaggagggcggcagaagcggcgtcgcgggccccgcgccgggcaggaggcggagaagcgtcgggtcttctcgctgccccagccgcagcaggacggcggtggcggtgctagtagcggcgggggtgtgaccccgctggtggaatacgaggatgtgagctcccagtccgagcaggggctgctgctggggggggccagcgcggcaacggcggcgacggctgccgggggaacggggggcagcggcgggagtccggcctcctcctccggcacccagcggcgcggggaggggtcggagcgcaggccccgccgggaccgccgcagcagcagtggccgcagcaaggagcgccaccgcgagcaccggcggcgggatgggcagcgcggtggcagcgaggcctccaagtcccgcagccgccacagccacagcggcgaggaacgggccgaggtcgccaagagcggcagcagcagcagcagcggcggccgccggaaaagcgcttcggccacatccagcagcagtagcagccgcaaggaccgggactcgaaggcccaccgcagccggactaagtcgtccaaggagccgccttcggcctacaaggaaccgcccaaggcctaccgggaggacaagaccgagcctaaggcctacaggcggcggcggtccctcagcccactgggaggccgggacgacagcccggtgtcccacagggcctctcagagcctgaggagccgcaagtcccccagcccggcaggaggtggcagcagcccctattctcggcggctgccgcgctccccgagcccctacagtcgccgccgctcccccagctacagccgccacagctcctacgagcggggcggcgacgtgtcccctagtccctacagcagcagcagctggcgccgctctcgcagtccctacagccctgtgctcagacggtctggaaaatcccgaagcagaagcccgtattcatctaggcattcaagatctcgtagcaggcacagattgtctagatccagaagtcgtcattctagtatttctcctagcacactaactctgaagagtagcctggcagctgaattgaacaagaataaaaaagcacgagcagcagaggcagcaagagccgcagaagcagcgaaagctgcagaagcaactaaggctgctgaggctgctgccaaggctgcaaaagcttcaaacacttctacacctaccaaggggaacacggaaactagtgccagtgcatcacaaacaaaccatgtgaaggatgtgaagaaaattaaaattgaacatgcaccttctccctcaagtggtggaactttaaaaaatgacaaagcaaaaacaaagccacctcttcaggtaacgaaggtggaaaataatttgattgtagataaagccaccaagaaagcagtcatagttggaaaggagagtaaatctgctgctacaaaggaggaatcagtatctcttaaagagaaaaccaaaccacttacaccaagcataggagccaaggagaaggagcaacatgtagctttagtcacctctacattaccaccgttacctttgcctcccatgctgcctgaagataaagaagctgatagcttacgaggaaatatttcagtaaaagcagttaaaaaagaagtagaaaagaaactccgatgtcttcttgctgatttaccgctgccccctgagctaccaggaggagatgatctttcaaagagtccagaggaaaagaaaacagcaacacagttacatagtaaaaggaggcctaaaatatgtgggcctcgctatggtgaaaccaaagaaaaagatattgactggggaaaacgctgcgtggataaatttgatatcatcggaattattggagaaggtacttacggacaagtttacaaagccagggataaagacactggagaaatggtagccttaaaaaaagtacgtctggataatgaaaaggaaggctttccaattacagcaattcgagaaattaaaattctccggcagcttacccatcagagtattatcaatatgaaggaaatagtgactgataaagaagatgctttggatttcaagaaggacaaaggtgcattttatctggtgtttgaatatatggaccatgatctgatgggactactggaatcaggcttggttcattttaatgaaaatcacataaagtcatttatgagacagctcatggagggtctggattattgtcataagaagaactttttgcatagagatattaaatgttccaatatccttctaaataatagagggcagataaaacttgcagactttggacttgctcgattgtatagctcagaagaaagtcggccgtatactaacaaggtaattactttatggtaccgtccacctgaactgctactgggagaagaacgatacacaccagccattgatgtatggagctgtggctgtatccttggcgaactcttcactaaaaaacctatatttcaagcaaatcaggaacttgcacaactagaattaataagccgaatatgtgggagtccatgtcctgcagtgtggcctgatgtaatcaaactaccatatttcaacaccatgaaaccaaagaagcaatatcgtcgaaagttaagagaagaatttgttttgtaagaaggggatgtgtaaacatccttattgcatgaatgttttactttaattctagtgaattataaatgttagtctattctctagtgatctgaggtaaacctataattcttctagggcatttaattttgagttctgtttgctacatgcagattaccattttaccattattatggaatcagtgatttgagattgtgtgtttggtttggtgcttacgtgaaagaactttaataagatcatttaaatgttactggaacagctttcaagttacttgagctcaagttttcattttgctttagaaaaaactatactgttcagttcttaatttgtataataacagcaaattaccgataagtaacaatatatactattgtttagaaagtggttacaaaaattatgtaaaaatgaaatatttattcaaaggaaaattcggatttattgaagtaaagtattatgcacatattaaaaaagtatttacaattatttttaaatgatcttagttttagttttaaaatttaattaaaaataatttaagctcctaaagaaacataagcttgtgtctaaagaacacatctaacttttgtaatcctctcatgctagtattcctgcagctgcgctagacttatttgattacatgcttgccttggatcctagtaagcgctgcactgctgaacaggctcttcagtgcgagttcctccgagatgtggaaccctcaaaaatgcctccaccagatctccctttatggcaagattgtcatgagttatggagtaaaaagcgaagaagacagaagcagatgggcatgactgatgatgtttccacaattaaagcccccaggaaggacttgtctctgggcttggatgacagcagaaccaacacaccccagggtgtgctgccatcttcacagctgaaatctcagggcagctcaaatgtggcacctggtgaaaaacagacagatccatcaacaccacaacaggagtcttcgaaaccgttgggaggaattcagccttcttctcagaccatccagcctaaagtggagactgatgctgcccaggcggctgtgcagagtgcatttgcagttctgttgactcagttaataaaggctcagcagtcaaagcagaaagatgtgctactagaagagagggaaaatggatcgggacatgaagcgtcattacaactcaggccacctccagaacctagcactccggtgtcgggacaagatgacctcatccagcatcaagatatgaggatcttggagctaacgccagaaccagaccggcctcgaattctgcctcctgaccaacgacctcccgagcctcctgaaccaccaccagtcactgaggaagatctagattatcggacagaaaaccagcatgtacccaccaccagttcttcattaactgaccctcatgccggagtgaaggcagccctgttacagctgcttgctcagcatcagccccaggatgaccccaaaagagaaggtgggattgattatcaagcaggagacacttacgtgtccacttcagactacaaggacaactttggatcctcttctttctcttctgctccttatgttagcaatgatggtctaggaagcagttctgctccaccactagaacgacgtagtttcattggaaattcagatattcagtctttggataactacagtactgcttcatctcattctggtggtccacctcagccttctgccttttctgagtcatttcccagttcagtagctggatatggagacatttacctcaatgctggtcccatgttgtttagtggagacaaggaccatagatttgaatatagccatggtcctattgcagtcctggcaaacagcagtgacccttccacggggccagagagtactcatcctttgccagcaaagatgcacaactataactatggtggtaacttacaggaaaatccgagtggccccagcctcatgcatggacagacctggacttctcctgcccaaggacctggatattcacaaggatacaggggacatattagcacatcaactggcagaggcagaggcagagggttaccatactgagtatctgtttttcctcaggcacatcatttttatctggaaagacttttctagctgcaatttaaggcagcaatccaagagacttgaataataataattcaacaacagctttatttttatgtggagaagggtcttgcatacaatagtttaaaaaagacaaaaaaaacctttgcttaaattcatgctgttctaaaaactagatcgattgtacatcttcacaaattctagttaacaattttattttgtattcttgcagttttaagtggatgctaattttaggggcataagccttttatggccctcttgcagatcttctgaactatgcacatttgtgctttttttgtaagtttggaccaacttttatgtaacaaacagcccctccccacctccagttttacaacaatcagaaagggcactgatttatttggtatttttctttttacaaagctacctttagtcaaaggtcactgtcagtctttgcacctgctttcagtgttattgtgaaaggtgtactttgtgctcatttcagaaaataaaacacaacctttctcttgatgcaacagttttataaaaaaaaaaa

SEQ ID NO: 329882 - DNA, 6566 bp, Homo sapiens
agccccgcgggccgcagagtgcgcgaggccctaggccgggagttgttgtcaggcccaggccacttccgaggcgcctgcggtgtgtcgccgccaccacaggaggacgacgtcgacgccgaggaggaggcggtggaggcgtgttgttgtctcgcccactcccctcccctgaacttgcacccaacgtcagggcgcgatggagtgaagcggcgacgaaggtggtacttccgcgttgcgctgcccgagccgagagcgcggccaaggccgctcccccacccccgggggcacttggaggactcgggactcccccgcaggtcagcgcccggcgcatctggtgttttcgctgccgaggataggacgacgagcgcaatcgggagctccgccgcccggattcctgcttccctggggcccggaggctgctgcgtaccccactgtgacctggaacccagggacccgagtcccgacccggattatcgtggcgcttttcccggccggctctggtgctcggtgtccctccgccgccgctcccgtttccggcgggggagatggccaggatctgacccgggaggaggccgcacccgcgccgcgctctgcggctggctctaggcgatgccgagcagctcggacacggcgctggggggaggcgggggcctgagctgggcggagaagaggttggaggaacgccgcaagcggaggcgattcctgtcccctcagcagccgccgctgctgttgccgctcctgcagccgcagctcctgcaaccgccgccgcccccgccgcctctgctcttcctggctgctcccggcacggccgccgccgcagccgccgccgccgcggcctcctcctcttgcttcagcccgggcccccctctggaggtcaagcggctggcgagaggcaagaggcgcgcaggagggcggcagaagcggcgtcgcgggccccgcgccgggcaggaggcggagaagcgtcgggtcttctcgctgccccagccgcagcaggacggcggtggcggtgctagtagcggcgggggtgtgaccccgctggtggaatacgaggatgtgagctcccagtccgagcaggggctgctgctggggggggccagcgcggcaacggcggcgacggctgccgggggaacggggggcagcggcgggagtccggcctcctcctccggcacccagcggcgcggggaggggtcggagcgcaggccccgccgggaccgccgcagcagcagtggccgcagcaaggagcgccaccgcgagcaccggcggcgggatgggcagcgcggtggcagcgaggcctccaagtcccgcagccgccacagccacagcggcgaggaacgggccgaggtcgccaagagcggcagcagcagcagcagcggcggccgccggaaaagcgcttcggccacatccagcagcagtagcagccgcaaggaccgggactcgaaggcccaccgcagccggactaagtcgtccaaggagccgccttcggcctacaaggaaccgcccaaggcctaccgggaggacaagaccgagcctaaggcctacaggcggcggcggtccctcagcccactgggaggccgggacgacagcccggtgtcccacagggcctctcagagcctgaggagccgcaagtcccccagcccggcaggaggtggcagcagcccctattctcggcggctgccgcgctccccgagcccctacagtcgccgccgctcccccagctacagccgccacagctcctacgagcggggcggcgacgtgtcccctagtccctacagcagcagcagctggcgccgctctcgcagtccctacagccctgtgctcagacggtctggaaaatcccgaagcagaagcccgtattcatctaggcattcaagatctcgtagcaggcacagattgtctagatccagaagtcgtcattctagtatttctcctagcacactaactctgaagagtagcctggcagctgaattgaacaagaataaaaaagcacgagcagcagaggcagcaagagccgcagaagcagcgaaagctgcagaagcaactaaggctgctgaggctgctgccaaggctgcaaaagcttcaaacacttctacacctaccaaggggaacacggaaactagtgccagtgcatcacaaacaaaccatgtgaaggatgtgaagaaaattaaaattgaacatgcaccttctccctcaagtggtggaactttaaaaaatgacaaagcaaaaacaaagccacctcttcaggtaacgaaggtggaaaataatttgattgtagataaagccaccaagaaagcagtcatagttggaaaggagagtaaatctgctgctacaaaggaggaatcagtatctcttaaagagaaaaccaaaccacttacaccaagcataggagccaaggagaaggagcaacatgtagctttagtcacctctacattaccaccgttacctttgcctcccatgctgcctgaagataaagaagctgatagcttacgaggaaatatttcagtaaaagcagttaaaaaagaagtagaaaagaaactccgatgtcttcttgctgatttaccgctgccccctgagctaccaggaggagatgatctttcaaagagtccagaggaaaagaaaacagcaacacagttacatagtaaaaggaggcctaaaatatgtgggcctcgctatggtgaaaccaaagaaaaagatattgactggggaaaacgctgcgtggataaatttgatatcatcggaattattggagaaggtacttacggacaagtttacaaagccagggataaagacactggagaaatggtagccttaaaaaaagtacgtctggataatgaaaaggaaggctttccaattacagcaattcgagaaattaaaattctccggcagcttacccatcagagtattatcaatatgaaggaaatagtgactgataaagaagatgctttggatttcaagaaggacaaaggtgcattttatctggtgtttgaatatatggaccatgatctgatgggactactggaatcaggcttggttcattttaatgaaaatcacataaagtcatttatgagacagctcatggagggtctggattattgtcataagaagaactttttgcatagagatattaaatgttccaatatccttctaaataatagagggcagataaaacttgcagactttggacttgctcgattgtatagctcagaagaaagtcggccgtatactaacaaggtaattactttatggtaccgtccacctgaactgctactgggagaagaacgatacacaccagccattgatgtatggagctgtggctgtatccttggcgaactcttcactaaaaaacctatatttcaagcaaatcaggaacttgcacaactagaattaataagccgaatatgtgggagtccatgtcctgcagtgtggcctgatgtaatcaaactaccatatttcaacaccatgaaaccaaagaagcaatatcgtcgaaagttaagagaagaatttgtttttattcctgcagctgcgctagacttatttgattacatgcttgccttggatcctagtaagcgctgcactgctgaacaggctcttcagtgcgagttcctccgagatgtggaaccctcaaaaatgcctccaccagatctccctttatggcaagattgtcatgagttatggagtaaaaagcgaagaagacagaagcagatgggcatgactgatgatgtttccacaattaaagcccccaggaaggacttgtctctgggcttggatgacagcagaaccaacacaccccagggtgtgctgccatcttcacagctgaaatctcagggcagctcaaatgtggcacctggtgaaaaacagacagatccatcaacaccacaacaggagtcttcgaaaccgttgggaggaattcagccttcttctcagaccatccagcctaaagtggagactgatgctgcccaggcggctgtgcagagtgcatttgcagttctgttgactcagttaataaaggctcagcagtcaaagcagaaagatgtgctactagaagagagggaaaatggatcgggacatgaagcgtcattacaactcaggccacctccagaacctagcactccggtgtcgggacaagatgacctcatccagcatcaagatatgaggatcttggagctaacgccagaaccagaccggcctcgaattctgcctcctgaccaacgacctcccgagcctcctgaaccaccaccagtcactgaggaagatctagattatcggacagaaaaccagcatgtacccaccaccagttcttcattaactgaccctcatgccggagtgaaggcagccctgttacagctgcttgctcagcatcagccccaggatgaccccaaaagagaaggtgggattgattatcaagcaggagacacttacgtgtccacttcagactacaaggacaactttggatcctcttctttctcttctgctccttatgttagcaatgatggtctaggaagcagttctgctccaccactagaacgacgtagtttcattggaaattcagatattcagtctttggataactacagtactgcttcatctcattctggtggtccacctcagccttctgccttttctgagtcatttcccagttcagtagctggatatggagacatttacctcaatgctggtcccatgttgtttagtggagacaaggaccatagatttgaatatagccatggtcctattgcagtcctggcaaacagcagtgacccttccacggggccagagagtactcatcctttgccagcaaagatgcacaactataactatggtggtaacttacaggaaaatccgagtggccccagcctcatgcatggacagacctggacttctcctgcccaaggacctggatattcacaaggatacaggggacatattagcacatcaactggcagaggcagaggcagagggttaccatactgagtatctgtttttcctcaggcacatcatttttatctggaaagacttttctagctgcaatttaaggcagcaatccaagagacttgaataataataattcaacaacagctttatttttatgtggagaagggtcttgcatacaatagtttaaaaaagacaaaaaaaacctttgcttaaattcatgctgttctaaaaactagatcgattgtacatcttcacaaattctagttaacaattttattttgtattcttgcagttttaagtggatgctaattttaggggcataagccttttatggccctcttgcagatcttctgaactatgcacatttgtgctttttttgtaagtttggaccaacttttatgtaacaaacagcccctccccacctccagttttacaacaatcagaaagggcactgatttatttggtatttttctttttacaaagctacctttagtcaaaggtcactgtcagtctttgcacctgctttcagtgttattgtgaaaggtgtactttgtgctcatttcagaaaataaaacacaacctttctcttgatgcaacagttttataaaaaaaaaaatggtcaacgttatttttgttttgttttgcagattatcaaagcctagcaaaatgcatttaaatgaaatagtgggttttatatgaaaactatgggtggggtggggagggaaagtaagtgccttaacaggtaagcttaaggtctgaaaaaaatagttaacttttacccccatttgtcttttaaagggaatcaatgcattaaaaaggcaagaaactctgaagtttcaggggctgcctgttcagttcctgttaggtccattccctctgcttgtcacactttctccttttctgcctgtctttgggctgtgttgcctttcactaccaccttctcttgataggggagtgagagcaaagaaagggagtagaactgcaatcagtacatattgtttgagaagttctacaaagttttgtcatttaaatggttgaaagtaatagctccaggagaattttagagtaccattttctttcaggctgccatattatccctgtttccatttgccatggataattggagggtcatggtatagaagcaagagttaataacagaacttgcctaaatgtgttaaagttcatgggggaggggtggcaaataccgtattttaagttatgcaattgcccttttaagaaagtcaattctattcacttgttaactagaaacattgcttagattgaatttattgaagcaaaaagaaaaggcaatgagagagaacttttatcttccttcctgtcacattctgtaaagttgattatgacttctgccagacttagagcaacaactttagttcattttaacatttttttttaatgaagagcatcaagaatggggtagtccttatttaaactgtaagggggtccgcctcccctgtgtgcggcctctctcctttttctcccacttttctatctctcgaaagggcccgggggtacacgggcgcccctttctcccgcggacatgtcgggcgccaggcgtgccgcccacactggtggcccaggtcgggcgcccttttggaggccacgcgacgccgcccgcg

SEQ ID NO: 329883 - DNA, 4801 bp, Homo sapiens
agccccgcgggccgcagagtgcgcgaggccctaggccgggagttgttgtcaggcccaggccacttccgaggcgcctgcggtgtgtcgccgccaccacaggaggacgacgtcgacgccgaggaggaggcggtggaggcgtgttgttgtctcgcccactcccctcccctgaacttgcacccaacgtcagggcgcgatggagtgaagcggcgacgaaggtggtacttccgcgttgcgctgcccgagccgagagcgcggccaaggccgctcccccacccccgggggcacttggaggactcgggactcccccgcaggtcagcgcccggcgcatctggtgttttcgctgccgaggataggacgacgagcgcaatcgggagctccgccgcccggattcctgcttccctggggcccggaggctgctgcgtaccccactgtgacctggaacccagggacccgagtcccgacccggattatcgtggcgcttttcccggccggctctggtgctcggtgtccctccgccgccgctcccgtttccggcgggggagatggccaggatctgacccgggaggaggccgcacccgcgccgcgctctgcggctggctctaggcgatgccgagcagctcggacacggcgctggggggaggcgggggcctgagctgggcggagaagaggttggaggaacgccgcaagcggaggcgattcctgtcccctcagcagccgccgctgctgttgccgctcctgcagccgcagctcctgcaaccgccgccgcccccgccgcctctgctcttcctggctgctcccggcacggccgccgccgcagccgccgccgccgcggcctcctcctcttgcttcagcccgggcccccctctggaggtcaagcggctggcgagaggcaagaggcgcgcaggagggcggcagaagcggcgtcgcgggccccgcgccgggcaggaggcggagaagcgtcgggtcttctcgctgccccagccgcagcaggacggcggtggcggtgctagtagcggcgggggtgtgaccccgctggtggaatacgaggatgtgagctcccagtccgagcaggggctgctgctggggggggccagcgcggcaacggcggcgacggctgccgggggaacggggggcagcggcgggagtccggcctcctcctccggcacccagcggcgcggggaggggtcggagcgcaggccccgccgggaccgccgcagcagcagtggccgcagcaaggagcgccaccgcgagcaccggcggcgggatgggcagcgcggtggcagcgaggcctccaagtcccgcagccgccacagccacagcggcgaggaacgggccgaggtcgccaagagcggcagcagcagcagcagcggcggccgccggaaaagcgcttcggccacatccagcagcagtagcagccgcaaggaccgggactcgaaggcccaccgcagccggactaagtcgtccaaggagccgccttcggcctacaaggaaccgcccaaggcctaccgggaggacaagaccgagcctaaggcctacaggcggcggcggtccctcagcccactgggaggccgggacgacagcccggtgtcccacagggcctctcagagcctgaggagccgcaagtcccccagcccggcaggaggtggcagcagcccctattctcggcggctgccgcgctccccgagcccctacagtcgccgccgctcccccagctacagccgccacagctcctacgagcggggcggcgacgtgtcccctagtccctacagcagcagcagctggcgccgctctcgcagtccctacagccctgtgctcagacggtctggaaaatcccgaagcagaagcccgtattcatctaggcattcaagatctcgtagcaggcacagattgtctagatccagaagtcgtcattctagtatttctcctagcacactaactctgaagagtagcctggcagctgaattgaacaagaataaaaaagcacgagcagcagaggcagcaagagccgcagaagcagcgaaagctgcagaagcaactaaggctgctgaggctgctgccaaggctgcaaaagcttcaaacacttctacacctaccaaggggaacacggaaactagtgccagtgcatcacaaacaaaccatgtgaaggatgtgaagaaaattaaaattgaacatgcaccttctccctcaagtggtggaactttaaaaaatgacaaagcaaaaacaaagccacctcttcaggtaacgaaggtggaaaataatttgattgtagataaagccaccaagaaagcagtcatagttggaaaggagagtaaatctgctgctacaaaggaggaatcagtatctcttaaagagaaaaccaaaccacttacaccaagcataggagccaaggagaaggagcaacatgtagctttagtcacctctacattaccaccgttacctttgcctcccatgctgcctgaagataaagaagctgatagcttacgaggaaatatttcagtaaaagcagttaaaaaagaagtagaaaagaaactccgatgtcttcttgctgatttaccgctgccccctgagctaccaggaggagatgatctttcaaagagtccagaggaaaagaaaacagcaacacagttacatagtaaaaggaggcctaaaatatgtgggcctcgctatggtgaaaccaaagaaaaagatattgactggggaaaacgctgcgtggataaatttgatatcatcggaattattggagaaggtacttacggacaagtttacaaagccagggataaagacactggagaaatggtagccttaaaaaaagtacgtctggataatgaaaaggaaggctttccaattacagcaattcgagaaattaaaattctccggcagcttacccatcagagtattatcaatatgaaggaaatagtgactgataaagaagatgctttggatttcaagaaggacaaaggtgcattttatctggtgtttgaatatatggaccatgatctgatgggactactggaatcaggcttggttcattttaatgaaaatcacataaagtcatttatgagacagctcatggagggtctggattattgtcataagaagaactttttgcatagagatattaaatgttccaatatccttctaaataatagagggcagataaaacttgcagactttggacttgctcgattgtatagctcagaagaaagtcggccgtatactaacaaggtaattactttatggtaccgtccacctgaactgctactgggagaagaacgatacacaccagccattgatgtatggagctgtggctgtatccttggcgaactcttcactaaaaaacctatatttcaagcaaatcaggaacttgcacaactagaattaataagccgaatatgtgggagtccatgtcctgcagtgtggcctgatgtaatcaaactaccatatttcaacaccatgaaaccaaagaagcaatatcgtcgaaagttaagagaagaatttgtttttattcctgcagctgcgctagacttatttgattacatgcttgccttggatcctagtaagcgctgcactgctgaacaggctcttcagtgcgagttcctccgagatgtggaaccctcaaaaatgcctccaccagatctccctttatggcaagattgtcatgagttatggagtaaaaagcgaagaagacagaagcagatgggcatgactgatgatgtttccacaattaaagcccccaggaaggacttgtctctgggcttggatgacagcagaaccaacacaccccagggtgtgctgccatcttcacagctgaaatctcagggcagctcaaatgtggcacctggtgaaaaacagacagatccatcaacaccacaacaggagtcttcgaaaccgttgggaggaattcagccttcttctcagaccatccagcctaaagtggagactgatgctgcccaggcggctgtgcagagtgcatttgcagttctgttgactcagttaataaaggctcagcagtcaaagcagaaagatgtgctactagaagagagggaaaatggatcgggacatgaagcgtcattacaactcaggccacctccagaacctagcactccggtgtcgggacaagatgacctcatccagcatcaagatatgaggatcttggagctaacgccagaaccagaccggcctcgaattctgcctcctgaccaacgacctcccgagcctcctgaaccaccaccagtcactgaggaagatctagattatctggaaagacttttctagctgcaatttaaggcagcaatccaagagacttgaataataataattcaacaacagctttatttttatgtggagaagggtcttgcatacaatagtttaaaaaagacaaaaaaaacctttgcttaaattcatgctgttctaaaaactagatcgattgtacatcttcacaaattctagttaacaattttattttgtattcttgcagttttaagtggatgctaattttaggggcataagccttttatggccctcttgcagatcttctgaactatgcacatttgtgctttttttgtaagtttggaccaacttttatgtaacaaacagcccctccccacctccagttttacaacaatcagaaagggcactgatttatttggtatttttctttttacaaagctacctttagtcaaaggtcactgtcagtctttgcacctgctttcagtgttattgtgaaaggtgtactttgtgctcatttcagaaaataaaacacaacctttctcttgatgcaacagttttataaaaaaaaaaa

SEQ ID NO: 329884 - DNA, 5002 bp, Homo sapiens
agccccgcgggccgcagagtgcgcgaggccctaggccgggagttgttgtcaggcccaggccacttccgaggcgcctgcggtgtgtcgccgccaccacaggaggacgacgtcgacgccgaggaggaggcggtggaggcgtgttgttgtctcgcccactcccctcccctgaacttgcacccaacgtcagggcgcgatggagtgaagcggcgacgaaggtggtacttccgcgttgcgctgcccgagccgagagcgcggccaaggccgctcccccacccccgggggcacttggaggactcgggactcccccgcaggtcagcgcccggcgcatctggtgttttcgctgccgaggataggacgacgagcgcaatcgggagctccgccgcccggattcctgcttccctggggcccggaggctgctgcgtaccccactgtgacctggaacccagggacccgagtcccgacccggattatcgtggcgcttttcccggccggctctggtgctcggtgtccctccgccgccgctcccgtttccggcgggggagatggccaggatctgacccgggaggaggccgcacccgcgccgcgctctgcggctggctctaggcgatgccgagcagctcggacacggcgctggggggaggcgggggcctgagctgggcggagaagaggttggaggaacgccgcaagcggaggcgattcctgtcccctcagcagccgccgctgctgttgccgctcctgcagccgcagctcctgcaaccgccgccgcccccgccgcctctgctcttcctggctgctcccggcacggccgccgccgcagccgccgccgccgcggcctcctcctcttgcttcagcccgggcccccctctggaggtcaagcggctggcgagaggcaagaggcgcgcaggagggcggcagaagcggcgtcgcgggccccgcgccgggcaggaggcggagaagcgtcgggtcttctcgctgccccagccgcagcaggacggcggtggcggtgctagtagcggcgggggtgtgaccccgctggtggaatacgaggatgtgagctcccagtccgagcaggggctgctgctggggggggccagcgcggcaacggcggcgacggctgccgggggaacggggggcagcggcgggagtccggcctcctcctccggcacccagcggcgcggggaggggtcggagcgcaggccccgccgggaccgccgcagcagcagtggccgcagcaaggagcgccaccgcgagcaccggcggcgggatgggcagcgcggtggcagcgaggcctccaagtcccgcagccgccacagccacagcggcgaggaacgggccgaggtcgccaagagcggcagcagcagcagcagcggcggccgccggaaaagcgcttcggccacatccagcagcagtagcagccgcaaggaccgggactcgaaggcccaccgcagccggactaagtcgtccaaggagccgccttcggcctacaaggaaccgcccaaggcctaccgggaggacaagaccgagcctaaggcctacaggcggcggcggtccctcagcccactgggaggccgggacgacagcccggtgtcccacagggcctctcagagcctgaggagccgcaagtcccccagcccggcaggaggtggcagcagcccctattctcggcggctgccgcgctccccgagcccctacagtcgccgccgctcccccagctacagccgccacagctcctacgagcggggcggcgacgtgtcccctagtccctacagcagcagcagctggcgccgctctcgcagtccctacagccctgtgctcagacggtctggaaaatcccgaagcagaagcccgtattcatctaggcattcaagatctcgtagcaggcacagattgtctagatccagaagtcgtcattctagtatttctcctagcacactaactctgaagagtagcctggcagctgaattgaacaagaataaaaaagcacgagcagcagaggcagcaagagccgcagaagcagcgaaagctgcagaagcaactaaggctgctgaggctgctgccaaggctgcaaaagcttcaaacacttctacacctaccaaggggaacacggaaactagtgccagtgcatcacaaacaaaccatgtgaaggatgtgaagaaaattaaaattgaacatgcaccttctccctcaagtggtggaactttaaaaaatgacaaagcaaaaacaaagccacctcttcaggtaacgaaggtggaaaataatttgattgtagataaagccaccaagaaagcagtcatagttggaaaggagagtaaatctgctgctacaaaggaggaatcagtatctcttaaagagaaaaccaaaccacttacaccaagcataggagccaaggagaaggagcaacatgtagctttagtcacctctacattaccaccgttacctttgcctcccatgctgcctgaagataaagaagctgatagcttacgaggaaatatttcagtaaaagcagttaaaaaagaagtagaaaagaaactccgatgtcttcttgctgatttaccgctgccccctgagctaccaggaggagatgatctttcaaagagtccagaggaaaagaaaacagcaacacagttacatagtaaaaggaggcctaaaatatgtgggcctcgctatggtgaaaccaaagaaaaagatattgactggggaaaacgctgcgtggataaatttgatatcatcggaattattggagaaggtacttacggacaagtttacaaagccagggataaagacactggagaaatggtagccttaaaaaaagtacgtctggataatgaaaaggaaggctttccaattacagcaattcgagaaattaaaattctccggcagcttacccatcagagtattatcaatatgaaggaaatagtgactgataaagaagatgctttggatttcaagaaggacaaaggtgcattttatctggtgtttgaatatatggaccatgatctgatgggactactggaatcaggcttggttcattttaatgaaaatcacataaagtcatttatgagacagctcatggagggtctggattattgtcataagaagaactttttgcatagagatattaaatgttccaatatccttctaaataatagagggcagataaaacttgcagactttggacttgctcgattgtatagctcagaagaaagtcggccgtatactaacaaggtaattactttatggtaccgtccacctgaactgctactgggagaagaacgatacacaccagccattgatgtatggagctgtggctgtatccttggcgaactcttcactaaaaaacctatatttcaagcaaatcaggaacttgcacaactagaattaataagccgaatatgtgggagtccatgtcctgcagtgtggcctgatgtaatcaaactaccatatttcaacaccatgaaaccaaagaagcaatatcgtcgaaagttaagagaagaatttgtttttattcctgcagctgcgctagacttatttgattacatgcttgccttggatcctagtaagcgctgcactgctgaacaggctcttcagtgcgagttcctccgagatgtggaaccctcaaaaatgcctccaccagatctccctttatggcaagattgtcatgagttatggagtaaaaagcgaagaagacagaagcagatgggcatgactgatgatgtttccacaattaaagcccccaggaaggacttgtctctgggcttggatgacagcagaaccaacacaccccagggtgtgctgccatcttcacagctgaaatctcagggcagctcaaatgtggcacctggtgaaaaacagacagatccatcaacaccacaacaggagtcttcgaaaccgttgggaggaattcagccttcttctcagaccatccagcctaaagtggagactgatgctgcccaggcggctgtgcagagtgcatttgcagttctgttgactcagttaataaaggctcagcagtcaaagcagaaagatgtgctactagaagagagggaaaatggatcgggacatgaagcgtcattacaactcaggccacctccagaacctagcactccggtgtcgggacaagatgacctcatccagcatcaagatatgaggatcttggagctaacgccagaaccagaccggcctcgaattctgcctcctgaccaacgacctcccgagcctcctgaaccaccaccagtcactgaggaagatctagattatcggacagaaaaccagcatgtacccaccaccagttcttcattaactgaccctcatgccggagtgaaggcagccctgttacagctgcttgctcagcatcagccccaggatgaccccaaaagagaaggtgggattgattatcaagcaggagacacttacgtgtccacttcagactacaaggacaactttggatcctcttctttctcttctgctccttatgttagcaatgatggtctaggaagcagttctgctccaccactagaacgacgtagtttcattggaaattcagatattcagtctttggataactacagtactgcttcatctcattctggtggtccacctcagccttctgccttttctgagtcatttcccagttcagtagctggatatggagacatttacctcaatgctggtcccatgttgtttagtggagacaaggaccatagatttgaatatagccatggtcctattgcagtcctggcaaacagcagtgacccttccacggggccagagagtactcatcctttgccagcaaagatgcacaactataactatggtggtaacttacaggaaaatccgagtggccccagcctcatgcatggacagacctggacttctcctgcccaaggacctggatattcacaaggatacaggagaattgcttgaacgcaggaagcaaaggttgcagtgagctgagatcacgccactgcactccagcctgggcaacagacctcgactccatcta

SEQ ID NO: 329885 - DNA, 4949 bp, Homo sapiens
  misc_feature (2138)..(2138): n is a, c, g, or t
  misc_feature (2203)..(2203): n is a, c, g, or t
  misc_feature (2215)..(2215): n is a, c, g, or t
  misc_feature (2267)..(2267): n is a, c, g, or t
  misc_feature (2275)..(2275): n is a, c, g, or t
  misc_feature (2342)..(2342): n is a, c, g, or t
tgaatttgtttagtttctctacgattcaacatacttttaatttttaagattttttaaaaaatacaagacactaaaaatattttttaaagtaaaataaaaattaactatttgtagatagatttatataaatttaaacatttccttgagcctagttatccagttgcacttttataacaccattgtataggtttgatatactcatagatccttgatgtgtttgagaaactagttgtcataatttttacaaattttgttcttccacccagtaaatcatgtgtcatctaaagttagagggcaatatacattaaggtgcctgacctgtgcccagcattgtttgggctttgtgtgtggggttcataataaagaatgttacgaggttttttaactttctgggaaaatacaaaatagggagttaagacaggtaagtatgatgtaaatttaagaatgtgaagataaatatattattaatagagattagactttatgaatatgcatcttttactgtgttgtaaaggaagtatagcacttgaatgagaaaaatagggaaaggattttattaaaaggggataaggcagctgggcacagtggctcacgcctataatcccagcactttgggaggccgaggtgcgcagatcacctgaggtcaggaatttgagaccagcctggccggcatggcgaaaccctgtctctactaaaagtacaaaaattagccaggagtggtggcgggtgcctgtagtcccagctactcaggaggctgaggcaggacaatcgcttgaacccgggaggcggaggttgcagtgggctgagattgcgccactgtactccagcctgggcgacaagagtgagactccagcgcaaaaaaaaaaaagggcgggggggctaaagcataaagaggtgagcataattttaaagaattactaagttcagtttaactagagtagctaaaatttgaaagacttgctcattatgtgaagataagtgattccagtaaacaagcaaaaatcactgagaaaagtacattaataatgttagaaaaacctaatcttaatttactattaaaaatattcatcttattctgtcctcttttcacagtttttaccaaagtcaaatgtttttgctagctttggagcactgttaactatagtcctatctgtggtaatgctataatgcccaaattgatagttttataatgctagtgcttaagttatttggagaaatttggctggatgggggcagagcaggtcaggcagatcttacactgcctggaactgcaaatctataggtggcaagagggaattgctttctaaattgaatgctccatttccttaacaagactggtccaggaccaagccaagcttaggtaaatgggcttggaatacagcctttctggggaatttgctatggcttttgagtccttgtgatttggaaaacatctggatataaagagatgtttatagctgatctgaatatatatgtgatctccctgaagtaagtaactacagatcagccgaagaacctcctctgactacttaggattctcttcaagcgtgtcaatcagctagaacgtgaccattctctgagcgttgaacactttacattgccagataatttgtgctgttttcgtcaaacctgaccctaatataacttgactaaataatcttgtctgtggcaaataaagaggtagcagtatatttatgtcctcttttcggaaggtgataaaggaattatttgataaagtacgatatgtattgctactttgcagagtagacctcaagtagatacttgagtagacactctgcatttgtgtgcttttttctattcacacactacagtgggtatgtgaatcagtgaaaaattgccaaaaatatgatcaattgaaaacttttgttaggtggtctttatttgaactatatcttgtcatccattagtaatttagcaagatttgatcagaaccagtcaacgctctttaaatcagttaatcccattaaaggtttttatggaaaggaaaaacagtgctcaacaattgagttgatactaaagctttgctttgaccaaattgcagttaataccagtaaactactttttttttttgagacggagtcttgctctgtcacccagactggagtgcagtgacgctntcttggctcactgcaagctctgcctcccgggttcacatcattctcctgcctcagcttcctgagtngctggggctatnggcacccgtcaccacgcctggttaatttttttttagtacagatggggtttcnccgtgttngccaggatggtctcgatctcctgacctcgtgatctgccagcctcggcctcccagagtgctgggattncaggcgtgagccaccgtgcccagcctatcagtcaactactttttgtttttatcttcatatattaagggaatttttagttaaacaggttgccctcacatacattttatgatcttatattagatacctttggatgtctgtattttttagtaggcagatgaaagtgtttttagttaggattatagggattgctttagtaaaataatatttcctcagagaatctgtcttactccaacaaatactaactctaaagactgttttctgtgttttttagtcggccgtatactaacaaggtaattactttatggtaccgtccacctgaactgctactgggagaagaacgatacacaccagccattgatgtatggagctgtggctgtatccttggcgaactcttcactaaaaaacctatatttcaagcaaatcaggaacttgcacaactagaattaataagccgaatatgtgggagtccatgtcctgcagtgtggcctgatgtaatcaaactaccatatttcaacaccatgaaaccaaagaagcaatatcgtcgaaagttaagagaagaatttgtttttattcctgcagctgcgctagacttatttgattacatgcttgccttggatcctagtaagcgctgcactgctgaacaggctcttcagtgcgagttcctccgagatgtggaaccctcaaaaatgcctccaccagatctccctttatggcaagattgtcatgagttatggagtaaaaagcgaagaagacagaagcagatgggcatgactgatgatgtttccacaattaaagcccccaggaaggacttgtctctgggcttggatgacagcagaaccaacacaccccagggtgtgctgccatcttcacagctgaaatctcagggcagctcaaatgtggcacctggtgaaaaacagacagatccatcaacaccacaacaggagtcttcgaaaccgttgggaggaattcagccttcttctcagaccatccagcctaaagtggagactgatgctgcccaggcggctgtgcagagtgcatttgcagttctgttgactcagttaataaaggctcagcagtcaaagcagaaagatgtgctactagaagagagggaaaatggatcgggacatgaagcgtcattacaactcaggccacctccagaacctagcactccggtgtcgggacaagatgacctcatccagcatcaagatatgaggatcttggagctaacgccagaaccagaccggcctcgaattctgcctcctgaccaacgacctcccgagcctcctgaaccaccaccagtcactgaggaagatctagattatcggacagaaaaccagcatgtacccaccaccagttcttcattaactgaccctcatgccggagtgaaggcagccctgttacagctgcttgctcagcatcagccccaggatgaccccaaaagagaaggtgggattgattatcaagcaggagacacttacgtgtccacttcagactacaaggacaactttggatcctcttctttctcttctgctccttatgttagcaatgatggtctaggaagcagttctgctccaccactagaacgacgtagtttcattggaaattcagatattcagtctttggataactacagtactgcttcatctcattctggtggtccacctcagccttctgccttttctgagtcatttcccagttcagtagctggatatggagacatttacctcaatgctggtcccatgttgtttagtggagacaaggaccatagatttgaatatagccatggtcctattgcagtcctggcaaacagcagtgacccttccacggggccagagagtactcatcctttgccagcaaagatgcacaactataactatggtggtaacttacaggaaaatccgagtggccccagcctcatgcatggacagacctggacttctcctgcccaaggacctggatattcacaaggatacaggggacatattagcacatcaactggcagaggcagaggcagagggttaccatactgagtatctgtttttcctcaggcacatcatttttatctggaaagacttttctagctgcaatttaaggcagcaatccaagagacttgaataataataattcaacaacagctttatttttatgtggagaagggtcttgcatacaatagtttaaaaaagacaaaaaaaacctttgcttaaattcatgctgttctaaaaactagatcgattgtacatcttcacaaattctagttaacaattttattttgtattcttgcagttttaagtggatgctaattttaggggcataagccttttatggccctcttgcagatcttctgaactatgcacatttgtgctttttttgtaagtttggaccaacttttatgtaacaaacagcccctccccacctccagttttacaacaatcagaaagggcactgatttatttggtatttttctttttacaaagctacctttagtcaaaggtcactgtcagtctttgcacctgctttcagtgttattgtgaaaggtgtactttgtgctcatttcagaaaataaaacacaacctttctcttgatgcaacagttttataaaaaaaaaaa

SEQ ID NO: 329886 - DNA, 4799 bp, Homo sapiens
agccccgcgggccgcagagtgcgcgaggccctaggccgggagttgttgtcaggcccaggccacttccgaggcgcctgcggtgtgtcgccgccaccacaggaggacgacgtcgacgccgaggaggaggcggtggaggcgtgttgttgtctcgcccactcccctcccctgaacttgcacccaacgtcagggcgcgatggagtgaagcggcgacgaaggtggtacttccgcgttgcgctgcccgagccgagagcgcggccaaggccgctcccccacccccgggggcacttggaggactcgggactcccccgcaggtcagcgcccggcgcatctggtgttttcgctgccgaggataggacgacgagcgcaatcgggagctccgccgcccggattcctgcttccctggggcccggaggctgctgcgtaccccactgtgacctggaacccagggacccgagtcccgacccggattatcgtggcgcttttcccggccggctctggtgctcggtgtccctccgccgccgctcccgtttccggcgggggagatggccaggatctgacccgggaggaggccgcacccgcgccgcgctctgcggctggctctaggcgatgccgagcagctcggacacggcgctggggggaggcgggggcctgagctgggcggagaagaggttggaggaacgccgcaagcggaggcgattcctgtcccctcagcagccgccgctgctgttgccgctcctgcagccgcagctcctgcaaccgccgccgcccccgccgcctctgctcttcctggctgctcccggcacggccgccgccgcagccgccgccgccgcggcctcctcctcttgcttcagcccgggcccccctctggaggtcaagcggctggcgagaggcaagaggcgcgcaggagggcggcagaagcggcgtcgcgggccccgcgccgggcaggaggcggagaagcgtcgggtcttctcgctgccccagccgcagcaggacggcggtggcggtgctagtagcggcgggggtgtgaccccgctggtggaatacgaggatgtgagctcccagtccgagcaggggctgctgctggggggggccagcgcggcaacggcggcgacggctgccgggggaacggggggcagcggcgggagtccggcctcctcctccggcacccagcggcgcggggaggggtcggagcgcaggccccgccgggaccgccgcagcagcagtggccgcagcaaggagcgccaccgcgagcaccggcggcgggatgggcagcgcggtggcagcgaggcctccaagtcccgcagccgccacagccacagcggcgaggaacgggccgaggtcgccaagagcggcagcagcagcagcagcggcggccgccggaaaagcgcttcggccacatccagcagcagtagcagccgcaaggaccgggactcgaaggcccaccgcagccggactaagtcgtccaaggagccgccttcggcctacaaggaaccgcccaaggcctaccgggaggacaagaccgagcctaaggcctacaggcggcggcggtccctcagcccactgggaggccgggacgacagcccggtgtcccacagggcctctcagagcctgaggagccgcaagtcccccagcccggcaggaggtggcagcagcccctattctcggcggctgccgcgctccccgagcccctacagtcgccgccgctcccccagctacagccgccacagctcctacgagcggggcggcgacgtgtcccctagtccctacagcagcagcagctggcgccgctctcgcagtccctacagccctgtgctcagacggtctggaaaatcccgaagcagaagcccgtattcatctaggcattcaagatctcgtagcaggcacagattgtctagatccagaagtcgtcattctagtatttctcctagcacactaactctgaagagtagcctggcagctgaattgaacaagaataaaaaagcacgagcagcagaggcagcaagagccgcagaagcagcgaaagctgcagaagcaactaaggctgctgaggctgctgccaaggctgcaaaagcttcaaacacttctacacctaccaaggggaacacggaaactagtgccagtgcatcacaaacaaaccatgtgaaggatgtgaagaaaattaaaattgaacatgcaccttctccctcaagtggtggaactttaaaaaatgacaaagcaaaaacaaagccacctcttcaggtaacgaaggtggaaaataatttgattgtagataaagccaccaagaaagcagtcatagttggaaaggagagtaaatctgctgctacaaaggaggaatcagtatctcttaaagagaaaaccaaaccacttacaccaagcataggagccaaggagaaggagcaacatgtagctttagtcacctctacattaccaccgttacctttgcctcccatgctgcctgaagataaagaagctgatagcttacgaggaaatatttcagtaaaagcagttaaaaaagaagtagaaaagaaactccgatgtcttcttgctgatttaccgctgccccctgagctaccaggaggagatgatctttcaaagagtccagaggaaaagaaaacagcaacacagttacatagtaaaaggaggcctaaaatatgtgggcctcgctatggtgaaaccaaagaaaaagatattgactggggaaaacgctgcgtggataaatttgatatcatcggaattattggagaaggtacttacggacaagtttacaaagccagggataaagacactggagaaatggtagccttaaaaaaagtacgtctggataatgaaaaggaaggctttccaattacagcaattcgagaaattaaaattctccggcagcttacccatcagagtattatcaatatgaaggaaatagtgactgataaagaagatgctttggatttcaagaaggacaaaggtgcattttatctggtgtttgaatatatggaccatgatctgatgggactactggaatcaggcttggttcattttaatgaaaatcacataaagtcatttatgagacagctcatggagggtctggattattgtcataagaagaactttttgcatagagatattaaatgttccaatatccttctaaataatagagggcagataaaacttgcagactttggacttgctcgattgtatagctcagaagaaagtcggccgtatactaacaaggtaattactttatggtaccgtccacctgaactgctactgggagaagaacgatacacaccagccattgatgtatggagctgtggctgtatccttggcgaactcttcactaaaaaacctatatttcaagcaaatcaggaacttgcacaactagaattaataagccgaatatgtgggagtccatgtcctgcagtgtggcctgatgtaatcaaactaccatatttcaacaccatgaaaccaaagaagcaatatcgtcgaaagttaagagaagaatttgtttttattcctgcagctgcgctagacttatttgattacatgcttgccttggatcctagtaagcgctgcactgctgaacaggctcttcagtgcgagttcctccgagatgtggaaccctcaaaaatgcctccaccagatctccctttatggcaagattgtcatgagttatggagtaaaaagcgaagaagacagaagcagatgggcatgactgatgatgtttccacaattaaagcccccaggaaggacttgtctctgggcttggatgacagcagaaccaacacaccccagggtgtgctgccatcttcacagctgaaatctcagggcagctcaaatgtggcacctggtgaaaaacagacagatccatcaacaccacaacaggagtcttcgaaaccgttgggaggaattcagccttcttctcagaccatccagcctaaagtggagactgatgctgcccaggcggctgtgcagagtgcatttgcagttctgttgactcagttaataaaggctcagcagtcaaagcagaaagatgtgctactagaagagagggaaaatggatcgggacatgaagcgtcattacaactcaggccacctccagaacctagcactccggtgtcgggacaagatgacctcatccagcatcaagatatgaggatcttggagctaacgccagaaccagaccggcctcgaattctgcctcctgaccaacgacctcccgagcctcctgaaccaccaccagtcactgaggaagatctagattatcggacagaaaaccagcatgtacccaccaccagttcttcattaactgaccctcatgccggagtgaaggcagccctgttacagctgcttgctcagcatcagccccaggatgaccccaaaagagaaggtgggattgattatcaagcaggagacacttacgtgtccacttcagactacaaggacaactttggatcctcttctttctcttctgctccttatgttagcaatgatggtctaggaagcagttctgctccaccactagaacgacgtagtttcattggaaattcagatattcagtctttggataactacagtactgcttcatctcattctggtggtccacctcagccttctgccttttctgagtcatttcccagttcagtagctggatatggagacatttacctcaatgctggtcccatgttgtttagtggagacaaggaccatagatttgaatatagccatggtcctattgcagtcctggcgaggaaccttccaggggccaagaaacccccctggccaggtgccatatactatgggactcg

SEQ ID NO: 329887 - DNA, 1395 bp, Homo sapiens
agagcatcacggcggtcataatgggtgagagatctcacactaatagtactagcatttgagctagttcgagggcgaaatgtactccagttatcaaagtcatcattgctgtgagagccagggcttgcaggccatttggaaaactgtgatccagggctgtccccagcaccctcctgggtctagccagcctggggtgtgttggttctgctgtcatccaagcccagagacaagtcctccgtgggattgattatcaagcaggagacacttacgtgtccacttcagactacaaggacaactttggatcctcttctttctcttctgctccttatgttagcaatgatggtctaggaagcagttctgctccaccactagaacgacgtagtttcattggaaattcagatattcagtctttggataactacagtactgcttcatctcattctggtggtccacctcagccttctgccttttctgagtcatttcccagttcagtagctggatatggagacatttacctcaatgctggtcccatgttgtttagtggagacaaggaccatagatttgaatatagccatggtcctattgcagtcctggcaaacagcagtgacccttccacggggccagagagtactcatcctttgccagcaaagatgcacaactataactatggtggtaacttacaggaaaatccgagtggccccagcctcatgcatggacagacctggacttctcctgcccaaggacctggatattcacaaggatacaggggacatattagcacatcaactggcagaggcagaggcagagggttaccatactgagtatctgtttttcctcaggcacatcatttttatctggaaagacttttctagctgcaatttaaggcagcaatccaagagacttgaataataataattcaacaacagctttatttttatgtggagaagggtcttgcatacaatagtttaaaaaagacaaaaaaaacctttgcttaaattcatgctgttctaaaaactagatcgattgtacatcttcacaaattctagttaacaattttattttgtattcttgcagttttaagtggatgctaattttaggggcataagccttttatggccctcttgcagatcttctgaactatgcacatttgtgctttttttgtaagtttggaccaacttttatgtaacaaacagcccctccccacctccagttttacaacaatcagaaagggcactgatttatttggtatttttctttttacaaagctacctttagtcaaaggtcactgtcagtctttgcacctgctttcagtgttattgtgaaaggtgtactttgtgctcatttcagaaaataaaacacaacctttctcttgatgcaacagttttataaaaaaaaaaa

SEQ ID NO: 329888 - DNA, 4483 bp, Homo sapiens
agccccgcgggccgcagagtgcgcgaggccctaggccgggagttgttgtcaggcccaggccacttccgaggcgcctgcggtgtgtcgccgccaccacaggaggacgacgtcgacgccgaggaggaggcggtggaggcgtgttgttgtctcgcccactcccctcccctgaacttgcacccaacgtcagggcgcgatggagtgaagcggcgacgaaggtggtacttccgcgttgcgctgcccgagccgagagcgcggccaaggccgctcccccacccccgggggcacttggaggactcgggactcccccgcaggtcagcgcccggcgcatctggtgttttcgctgccgaggataggacgacgagcgcaatcgggagctccgccgcccggattcctgcttccctggggcccggaggctgctgcgtaccccactgtgacctggaacccagggacccgagtcccgacccggattatcgtggcgcttttcccggccggctctggtgctcggtgtccctccgccgccgctcccgtttccggcgggggagatggccaggatctgacccgggaggaggccgcacccgcgccgcgctctgcggctggctctaggcgatgccgagcagctcggacacggcgctggggggaggcgggggcctgagctgggcggagaagaggttggaggaacgccgcaagcggaggcgattcctgtcccctcagcagccgccgctgctgttgccgctcctgcagccgcagctcctgcaaccgccgccgcccccgccgcctctgctcttcctggctgctcccggcacggccgccgccgcagccgccgccgccgcggcctcctcctcttgcttcagcccgggcccccctctggaggtcaagcggctggcgagaggcaagaggcgcgcaggagggcggcagaagcggcgtcgcgggccccgcgccgggcaggaggcggagaagcgtcgggtcttctcgctgccccagccgcagcaggacggcggtggcggtgctagtagcggcgggggtgtgaccccgctggtggaatacgaggatgtgagctcccagtccgagcaggggctgctgctggggggggccagcgcggcaacggcggcgacggctgccgggggaacggggggcagcggcgggagtccggcctcctcctccggcacccagcggcgcggggaggggtcggagcgcaggccccgccgggaccgccgcagcagcagtggccgcagcaaggagcgccaccgcgagcaccggcggcgggatgggcagcgcggtggcagcgaggcctccaagtcccgcagccgccacagccacagcggcgaggaacgggccgaggtcgccaagagcggcagcagcagcagcagcggcggccgccggaaaagcgcttcggccacatccagcagcagtagcagccgcaaggaccgggactcgaaggcccaccgcagccggactaagtcgtccaaggagccgccttcggcctacaaggaaccgcccaaggcctaccgggaggacaagaccgagcctaaggcctacaggcggcggcggtccctcagcccactgggaggccgggacgacagcccggtgtcccacagggcctctcagagcctgaggagccgcaagtcccccagcccggcaggaggtggcagcagcccctattctcggcggctgccgcgctccccgagcccctacagtcgccgccgctcccccagctacagccgccacagctcctacgagcggggcggcgacgtgtcccctagtccctacagcagcagcagctggcgccgctctcgcagtccctacagccctgtgctcagacggtctggaaaatcccgaagcagaagcccgtattcatctaggcattcaagatctcgtagcaggcacagattgtctagatccagaagtcgtcattctagtatttctcctagcacactaactctgaagagtagcctggcagctgaattgaacaagaataaaaaagcacgagcagcagaggcagcaagagccgcagaagcagcgaaagctgcagaagcaactaaggctgctgaggctgctgccaaggctgcaaaagcttcaaacacttctacacctaccaaggggaacacggaaactagtgccagtgcatcacaaacaaaccatgtgaaggatgtgaagaaaattaaaattgaacatgcaccttctccctcaagtggtggaactttaaaaaatgacaaagcaaaaacaaagccacctcttcaggtaacgaaggtggaaaataatttgattgtagataaagccaccaagaaagcagtcatagttggaaaggagagtaaatctgctgctacaaaggaggaatcagtatctcttaaagagaaaaccaaaccacttacaccaagcataggagccaaggagaaggagcaacatgtagctttagtcacctctacattaccaccgttacctttgcctcccatgctgcctgaagataaagaagctgatagcttacgaggaaatatttcagtaaaagcagttaaaaaagaagtagaaaagaaactccgatgtcttcttgctgatttaccgctgccccctgagctaccaggaggagatgatctttcaaagagtccagaggaaaagaaaacagcaacacagttacatagtaaaaggaggcctaaaatatgtgggcctcgctatggtgaaaccaaagaaaaagatattgactggggaaaacgctgcgtggataaatttgatatcatcggaattattggagaaggtacttacggacaagtttacaaagccagggataaagacactggagaaatggtagccttaaaaaaagtacgtctggataatgaaaaggaaggctttccaattacagcaattcgagaaattaaaattctccggcagcttacccatcagagtattatcaatatgaaggaaatagtgactgataaagaagatgctttggatttcaagaaggacaaaggtgcattttatctggtgtttgaatatatggaccatgatctgatgggactactggaatcaggcttggttcattttaatgaaaatcacataaagtcatttatgagacagctcatggagggtctggattattgtcataagaagaactttttgcatagagatattaaatgttccaatatccttctaaataatagagggcagataaaacttgcagactttggacttgctcgattgtatagctcagaagaaagtcggccgtatactaacaaggtaattactttatggtaccgtccacctgaactgctactgggagaagaacgatacacaccagccattgatgtatggagctgtggctgtatccttggcgaactcttcactaaaaaacctatatttcaagcaaatcaggaacttgcacaactagaattaataagacatgaagaaaatgaagtttctgataaacaaatctgactataatgaggcaacggagtataccgaaaagtgtgtggcctttagaatcttacagggttgggttctaatgccagctcagctacttcctgcgcttatggtttagggtcccatatgctcttaagtttttttcttcaaaagtaaaagaggactgataacatgcttagggttgtgagaattaaatgtaaataagttttcagtacatatttcttccctcaccttatttacagtaatgctaggttgtttataggctcaggaatgatgagacctagtgtcagtatagtacagatacatgtaaaactgatcaagagtgataacactaatttgctttaaatggctttacaccatagtgaatgagttattttatttataatttgctttgttccagaaagtattttaggcagattacaaatattttataatagaagtagcatagattaaaaagtgatggagggaggccgggcacggtggctcatacctataatcccagcacttcgggaggccgaggcaggtagatcatctgaggtcagcagtttgagaccagcctggccaacatagtgaaaccccgtctctgctaaaatacaaaacaagccgggcacagtggctcatgcctgtaatcctagcactttgggaggccgaggcggacaggtcatgaggtcatgaggtcaggagatcaagaccatccgggctaacacggtgaaaccccgtctctaccaaaactacaaaaaaaaaaaaaaaaaaaaaaaaaaagccgggcatggcggcgggcacctgtagtcccagctactcaggaggctgaggcaggagaatggcatgaacccaggaggcagagcttgcagtcagccgagatggcgccactgcactccagcctgggcaagagagcgacactccatctcaaaaataaataaaaaaacaattagctgagtgtggtggcacacacctgtaatcccaggtacttgggagtctgaggcaggagaactgcttgaacctgggaggtggaggttgcagtaagcggagattgtgccactgcactccagcctgggcaacagcaagactccatccc

SEQ ID NO: 329889 - DNA, 3439 bp, Homo sapiens
agccccgcgggccgcagagtgcgcgaggccctaggccgggagttgttgtcaggcccaggccacttccgaggcgcctgcggtgtgtcgccgccaccacaggaggacgacgtcgacgccgaggaggaggcggtggaggcgtgttgttgtctcgcccactcccctcccctgaacttgcacccaacgtcagggcgcgatggagtgaagcggcgacgaaggtggtacttccgcgttgcgctgcccgagccgagagcgcggccaaggccgctcccccacccccgggggcacttggaggactcgggactcccccgcaggtcagcgcccggcgcatctggtgttttcgctgccgaggataggacgacgagcgcaatcgggagctccgccgcccggattcctgcttccctggggcccggaggctgctgcgtaccccactgtgacctggaacccagggacccgagtcccgacccggattatcgtggcgcttttcccggccggctctggtgctcggtgtccctccgccgccgctcccgtttccggcgggggagatggccaggatctgacccgggaggaggccgcacccgcgccgcgctctgcggctggctctaggcgatgccgagcagctcggacacggcgctggggggaggcgggggcctgagctgggcggagaagaggttggaggaacgccgcaagcggaggcgattcctgtcccctcagcagccgccgctgctgttgccgctcctgcagccgcagctcctgcaaccgccgccgcccccgccgcctctgctcttcctggctgctcccggcacggccgccgccgcagccgccgccgccgcggcctcctcctcttgcttcagcccgggcccccctctggaggtcaagcggctggcgagaggcaagaggcgcgcaggagggcggcagaagcggcgtcgcgggccccgcgccgggcaggaggcggagaagcgtcgggtcttctcgctgccccagccgcagcaggacggcggtggcggtgctagtagcggcgggggtgtgaccccgctggtggaatacgaggatgtgagctcccagtccgagcaggggctgctgctggggggggccagcgcggcaacggcggcgacggctgccgggggaacggggggcagcggcgggagtccggcctcctcctccggcacccagcggcgcggggaggggtcggagcgcaggccccgccgggaccgccgcagcagcagtggccgcagcaaggagcgccaccgcgagcaccggcggcgggatgggcagcgcggtggcagcgaggcctccaagtcccgcagccgccacagccacagcggcgaggaacgggccgaggtcgccaagagcggcagcagcagcagcagcggcggccgccggaaaagcgcttcggccacatccagcagcagtagcagccgcaaggaccgggactcgaaggcccaccgcagccggactaagtcgtccaaggagccgccttcggcctacaaggaaccgcccaaggcctaccgggaggacaagaccgagcctaaggcctacaggcggcggcggtccctcagcccactgggaggccgggacgacagcccggtgtcccacagggcctctcagagcctgaggagccgcaagtcccccagcccggcaggaggtggcagcagcccctattctcggcggctgccgcgctccccgagcccctacagtcgccgccgctcccccagctacagccgccacagctcctacgagcggggcggcgacgtgtcccctagtccctacagcagcagcagctggcgccgctctcgcagtccctacagccctgtgctcagacggtctggaaaatcccgaagcagaagcccgtattcatctaggcattcaagatctcgtagcaggcacagattgtctagatccagaagtcgtcattctagtatttctcctagcacactaactctgaagagtagcctggcagctgaattgaacaagaataaaaaagcacgagcagcagaggcagcaagagccgcagaagcagcgaaagctgcagaagcaactaaggctgctgaggctgctgccaaggctgcaaaagcttcaaacacttctacacctaccaaggggaacacggaaactagtgccagtgcatcacaaacaaaccatgtgaaggatgtgaagaaaattaaaattgaacatgcaccttctccctcaagtggtggaactttaaaaaatgacaaagcaaaaacaaagccacctcttcaggtaacgaaggtggaaaataatttgattgtagataaagccaccaagaaagcagtcatagttggaaaggagagtaaatctgctgctacaaaggaggaatcagtatctcttaaagagaaaaccaaaccacttacaccaagcataggagccaaggagaaggagcaacatgtagctttagtcacctctacattaccaccgttacctttgcctcccatgctgcctgaagataaagaagctgatagcttacgaggaaatatttcagtaaaagcagttaaaaaagaagtagaaaagaaactccgatgtcttcttgctgatttaccgctgccccctgagctaccaggaggagatgatctttcaaagagtccagaggaaaagaaaacagcaacacagttacatagtaaaaggaggcctaagtatgtgcttgctttctacctgctcttaaattgaccagcagtgattctgggtcatcagaagttcataaaacactaaattaaggtttaaaataaaaaatgtacttattctttcaacttaaatatatgaattctattagagttttgaaaaaaatcataattgcttgcattcctattcacaatgactaataaaaccaaatttaattttctctcgtaatttgtaatgtattaatttcctggggtattgtatatgttaaagatactttctgttattaagagattgaaataacacaaacactgaaattgggcagagtagaagtcagcatttagtgagaccaaataaaattagtaatgggcaagctgctgtttcctttgcttttagctccattttctcccataaacaaatatattcttcactttgcaagagatggagtagaagaagttttgaaatttgtatcctaaattagcttcaagtaagtgcctaaagagacctctttcccttaaaacctgttaatcagttaaaggcggggaacactggtgcctttttttttttttttttttaacttcttaaccaagggacagtgaagactttaagttagatctgattttagaattgcagttgaggtagtgcctagtgtgtgaatttgaggtcattttctaaactggccgggcacagtggctcatgcctgtaatcccagcactttgggaggcccaggtgggagaatcacttgagtccaggagtttgataccagcctgagcaacacagggagaccccatctctaccaaaaaaaaaa

SEQ ID NO: 329890 - DNA, 3592 bp, Homo sapiens
  misc_feature (2109)..(2109): n is a, c, g, or t
gaaaaactggcttgataacatggcaagctgaatgcttgtagctagtaggctgtcactttctagtaagactatgtatttatcccaccagttgaagagtatgctgaacaggaggtagttgttagttttcaatttttatgctttttattattataattacttagtttaagcgtagatacagtgctttacaaaaactttaagacattgctgtctaattagggatggacaagtaattgtgtaagttagaaaagttataaaaatccaagatgtggtattagattgctttgaaagtgtttttaatttctagatttatttaaagaaatcaaaactaaaaatccttgatgatgtgttatgggtgtggtttgtacaagagagctaatacagaattccattcagtgaatcctctgtttaaagagaaagccttggcctttgtcagaagatgggaaaacaaatgtacatttataaactttcagttaaaataaaatgtttaaattatatatctgtgtatcttttttttttaaacgattccttctaacctttttttttaaacgattccttctaacccatttttttttttgttaaacccaaccagccaactcttggtcctgattgtattggaaactagggcttctattaaagatagttaacatctatttagttcatatacaatatcagcattattcgaagagtttcacttgaattatctcagttaagcttcgtaacaaccctatgtcttctctttatagttaagaaaactgaaccttagagaggtgaagaattcgtccagggtcataaaactagcaagtggcaaaattgagatttaaacactgctaggtgttaccttaggatctaaacttttaaccattactccaaagtacaggctgggtgcggtggctcacgcctgtaatcgcagcactttgggaggccaagacgggtggatcacttgagcccaggagttcaagaccagactaggcaacatgacaaaaccccgtatatactaatttttttgtagatatggggttttgccatgatgcccaggctgatctcaaactcctaggctcaagtaatccttctgccttggcttcccaaagtgctgggattataagcatgagcccccatgccaggccaatattattccccaaaagaaggaaattgggtgtgaggtcctgctcctatggtcaccatgagatttttttgtttgttttggactcttgcccaggctggagttgcagtgagccgagattgctctgccgcgctccagcctgggcgattgagactgtctcaaaaaaaaaaaaaaagaaaaattgtataagatattaatccaagaattctaagggaggtactagcaaatagtatccagctttttatcacaaagttaacctgcagaaaaatgatgggagctaagatgatacagagggtcaagaaaggtatctccctttaagtgacatttgagcagagatctgaatgaagaaatggcaaagtaataaagactctgaggcatatttggttttttttttttaggaatatgttctcagtgaaccatatggggggaaagcttggtttatccattttatagcatgctgtactgttactaagaaggaaatagttggtcaggcacaatggctcacgcctctagtcccaacactttgggaggccaaggcgggcggatcacttgaggtcgagttcaggaccagccttgccaacatggtgaatccctgtctctactaaaaatacaaaaattacctgggcgcagtggtgtgtgcctgtaatcccagctacttggaaggctgaggcaggaacatcctgcctcaggtagcttgaacctgggaggcagaggttgcagtgagtcgagattgtgccactgcactccagcctgggtgacagagtgagactatgtctcagaaaaaaaaaaaaaaaaaaggaaacagttgatttggagataaagaaatggaaaagcagcatgaatagttacagaaggctatattgagattgatctcatttaggtaaaacaaaagactcaaattgttaatctgaacatggactttcaagaagactagggaggagaaattttcattttctagtttatatatttcagcatgtttttattttgtnaagatacttataattttataaagagattgaccgggcacagtggctcacacctgtaatctcagcactttggaaggccaaggcaggtggatcactagagcccaggagtttgagaccagcctgggcaacgtggccaaaccccgtctctacaaaaaatacaaaaattaggtgggtgtggtagcacacacctatagcctgagctattgggaggctgcggtacaaggatcacccgaacccaagggaggtcgaggctacagtgaactgtgattgcaccactgccctttagtctgggcagcagagcgagaccttgtctcaaaaaaacagaaataaaacaacaaaacataaaaagatgcttcaattttgatttcatagcattaatttcttttcagacatgaagaaaatgaagtttctgataaacaaatctgactataatgaggcaacggagtataccgaaaagtgtgtggcctttagaatcttacagggttgggttctaatgccagctcagctacttcctgcgcttatggtttagggtcccatatgctcttaagtttttttcttcaaaagtaaaagaggactgataacatgcttagggttgtgagaattaaatgtaaataagttttcagtacatatttcttccctcaccttatttacagtaatgctaggttgtttataggctcaggaatgatgagacctagtgtcagtatagtacagatacatgtaaaactgatcaagagtgataacactaatttgctttaaatggctttacaccatagtgaatgagttattttatttataatttgctttgttccagaaagtattttaggcagattacaaatattttataatagaagtagcatagattaaaaagtgatggagggaggccgggcacggtggctcatacctataatcccagcacttcgggaggccgaggcaggtagatcatctgaggtcagcagtttgagaccagcctggccaacatagtgaaaccccgtctctgctaaaatacaaaacaagccgggcacagtggctcatgcctgtaatcctagcactttgggaggccgaggcggacaggtcatgaggtcatgaggtcaggagatcaagaccatccgggctaacacggtgaaaccccgtctctaccaaaactacaaaaaaaaaaaaaaaaaaaaaaaaaaagccgggcatggcggcgggcacctgtagtcccagctactcaggaggctgaggcaggagaatggcatgaacccaggaggcagagcttgcagtcagccgagatggcgccactgcactccagcctgggcaagagagcgacactccatctcaaaaataaataaaaaaacaattagctgagtgtggtggcacacacctgtaatcccaggtacttgggagtctgaggcaggagaactgcttgaacctgggaggtggaggttgcagtaagcggagattgtgccactgcactccagcctgggcaacagcaagactccatccc

SEQ ID NO: 329891 - DNA, 1348 bp, Homo sapiens
gaaaaactggcttgataacatggcaagctgaatgcttgtagctagtaggctgtcactttctagtaagactatgtatttatcccaccagttgaagagtatgctgaacaggaggtagttgttagttttcaatttttatgctttttattattataattacttagtttaagcgtagatacagtgctttacaaaaactttaagacattgctgtctaattagggatggacaagtaattgtgtaagttagaaaagttataaaaatccaagatgtggtattagattgctttgaaagtgtttttaatttctagatttatttaaagaaatcaaaactaaaaatccttgatgatgtgttatgggtgtggtttgtacaagagagctaatacagaattccattcagtgaatcctctgtttaaagagaaagccttggcctttgtcagaagatgggaaaacaaatgtacatttataaactttcagttaaaataaaatgtttaaattatatatctgtgtatcttttttttttaaacgattccttctaacctttttttttaaacgattccttctaacccatttttttttttgttaaacccaaccagccaactcttggtcctgattgtattggaaactagggcttctattaaagatagttaacatctatttagttcatatacaatatcagcattattcgaagagtttcacttgaattatctcagttaagcttcgtaacaaccctatgtcttctctttatagttaagaaaactgaaccttagagaggtgaagaattcgtccagggtcataaaactagcaagtggcaaaattgagatttaaacactgctaggtgttaccttaggatctaaacttttaaccattactccaaagtacaggctgggtgcggtggctcacgcctgtaatcgcagcactttgggaggccaagacgggtggatcacttgagcccaggagttcaagaccagactaggcaacatgacaaaaccccgtatatactaaaaacaaaaattagccgggcatggtagcacacacctgcaatcccagctccttgggaggctgaggcatgagaattgcttgaacctgggaggcagaggttgcagtcagccaagatcgcaccactccactacagcctgggtgacagagtgagaattggtctcaaaaaataaataaataaactacataggaaataaaactacctggaatcttttcttttacaaaatcaatatgacacacatatcggtacttgacaaagacaacatgaaaaattttataagttacaggcatgagccactgcacctcacttaacaagtacattcttaagtgaaactggcttttctccccaccctgaa

SEQ ID NO: 329892 - DNA, 179 bp, Homo sapiens
tattcctgcagctgcgctagacttatttgattacatgcttgccttggatcctagtaagcgctgcactgctgaacaggctcttcagtgcgagttcctccgagatgtggaaccctcaaaaatgcctccaccagagtaagtgactttttatcctattattattatatattattattatattt

SEQ ID NO: 329893 - DNA, 5542 bp, Homo sapiens
agccccgcgggccgcagagtgcgcgaggccctaggccgggagttgttgtcaggcccaggccacttccgaggcgcctgcggtgtgtcgccgccaccacaggaggacgacgtcgacgccgaggaggaggcggtggaggcgtgttgttgtctcgcccactcccctcccctgaacttgcacccaacgtcagggcgcgatggagtgaagcggcgacgaaggtggtacttccgcgttgcgctgcccgagccgagagcgcggccaaggccgctcccccacccccgggggcacttggaggactcgggactcccccgcaggtcagcgcccggcgcatctggtgttttcgctgccgaggataggacgacgagcgcaatcgggagctccgccgcccggattcctgcttccctggggcccggaggctgctgcgtaccccactgtgacctggaacccagggacccgagtcccgacccggattatcgtggcgcttttcccggccggctctggtgctcggtgtccctccgccgccgctcccgtttccggcgggggagatggccaggatctgacccgggaggaggccgcacccgcgccgcgctctgcggctggctctaggcgatgccgagcagctcggacacggcgctggggggaggcgggggcctgagctgggcggagaagaggttggaggaacgccgcaagcggaggcgattcctgtcccctcagcagccgccgctgctgttgccgctcctgcagccgcagctcctgcaaccgccgccgcccccgccgcctctgctcttcctggctgctcccggcacggccgccgccgcagccgccgccgccgcggcctcctcctcttgcttcagcccgggcccccctctggaggtcaagcggctggcgagaggcaagaggcgcgcaggagggcggcagaagcggcgtcgcgggccccgcgccgggcaggaggcggagaagcgtcgggtcttctcgctgccccagccgcagcaggacggcggtggcggtgctagtagcggcgggggtgtgaccccgctggtggaatacgaggatgtgagctcccagtccgagcaggggctgctgctggggggggccagcgcggcaacggcggcgacggctgccgggggaacggggggcagcggcgggagtccggcctcctcctccggcacccagcggcgcggggaggggtcggagcgcaggccccgccgggaccgccgcagcagcagtggccgcagcaaggagcgccaccgcgagcaccggcggcgggatgggcagcgcggtggcagcgaggcctccaagtcccgcagccgccacagccacagcggcgaggaacgggccgaggtcgccaagagcggcagcagcagcagcagcggcggccgccggaaaagcgcttcggccacatccagcagcagtagcagccgcaaggaccgggactcgaaggcccaccgcagccggactaagtcgtccaaggagccgccttcggcctacaaggaaccgcccaaggcctaccgggaggacaagaccgagcctaaggcctacaggcggcggcggtccctcagcccactgggaggccgggacgacagcccggtgtcccacagggcctctcagagcctgaggagccgcaagtcccccagcccggcaggaggtggcagcagcccctattctcggcggctgccgcgctccccgagcccctacagtcgccgccgctcccccagctacagccgccacagctcctacgagcggggcggcgacgtgtcccctagtccctacagcagcagcagctggcgccgctctcgcagtccctacagccctgtgctcagacggtctggaaaatcccgaagcagaagcccgtattcatctaggcattcaagatctcgtagcaggcacagattgtctagatccagaagtcgtcattctagtatttctcctagcacactaactctgaagagtagcctggcagctgaattgaacaagaataaaaaagcacgagcagcagaggcagcaagagccgcagaagcagcgaaagctgcagaagcaactaaggctgctgaggctgctgccaaggctgcaaaagcttcaaacacttctacacctaccaaggggaacacggaaactagtgccagtgcatcacaaacaaaccatgtgaaggatgtgaagaaaattaaaattgaacatgcaccttctccctcaagtggtggaactttaaaaaatgacaaagcaaaaacaaagccacctcttcaggtaacgaaggtggaaaataatttgattgtagataaagccaccaagaaagcagtcatagttggaaaggagagtaaatctgctgctacaaaggaggaatcagtatctcttaaagagaaaaccaaaccacttacaccaagcataggagccaaggagaaggagcaacatgtagctttagtcacctctacattaccaccgttacctttgcctcccatgctgcctgaagataaagaagctgatagcttacgaggaaatatttcagtaaaagcagttaaaaaagaagtagaaaagaaactccgatgtcttcttgctgatttaccgctgccccctgagctaccaggaggagatgatctttcaaagagtccagaggaaaagaaaacagcaacacagttacatagtaaaaggaggcctaaaatatgtgggcctcgctatggtgaaaccaaagaaaaagatattgactggggaaaacgctgcgtggataaatttgatatcatcggaattattggagaaggtacttacggacaagtttacaaagccagggataaagacactggagaaatggtagccttaaaaaaagtacgtctggataatgaaaaggaaggctttccaattacagcaattcgagaaattaaaattctccggcagcttacccatcagagtattatcaatatgaaggaaatagtgactgataaagaagatgctttggatttcaagaaggacaaaggtgcattttatctggtgtttgaatatatggaccatgatctgatgggactactggaatcaggcttggttcattttaatgaaaatcacataaagtcatttatgagacagctcatggagggtctggattattgtcataagaagaactttttgcatagagatattaaatgttccaatatccttctaaataatagagggcagataaaacttgcagactttggacttgctcgattgtatagctcagaagaaagtcggccgtatactaacaaggtaattactttatggtaccgtccacctgaactgctactgggagaagaacgatacacaccagccattgatgtatggagctgtggctgtatccttggcgaactcttcactaaaaaacctatatttcaagcaaatcaggaacttgcacaactagaattaataagccgaatatgtgggagtccatgtcctgcagtgtggcctgatgtaatcaaactaccatatttcaacaccatgaaaccaaagaagcaatatcgtcgaaagttaagagaagaatttgtttttattcctgcagctgcgctagacttatttgattacatgcttgccttggatcctagtaagcgctgcactgctgaacaggctcttcagtgcgagttcctccgagatgtggaaccctcaaaaatgcctccaccagatctccctttatggcaagattgtcatgagttatggagtaaaaagcgaagaagacagaagcagatgggcatgactgatgatgtttccacaattaaagcccccaggaaggacttgtctctgggcttggatgacagcagaaccaacacaccccagggtgtgctgccatcttcacagctgaaatctcagggcagctcaaatgtggcacctggtgaaaaacagacagatccatcaacaccacaacaggagtcttcgaaaccgttgggaggaattcagccttcttctcagaccatccagcctaaagtggagactgatgctgcccaggcggctgtgcagagtgcatttgcagttctgttgactcagttaataaaggctcagcagtcaaagcagaaagatgtgctactagaagagagggaaaatggatcgggacatgaagcgtcattacaactcaggccacctccagaacctagcactccggtgtcgggacaagatgacctcatccagcatcaagatatgaggatcttggagctaacgccagaaccagaccggcctcgaattctgcctcctgaccaacgacctcccgagcctcctgaaccaccaccagtcactgaggaagatctagattatcggacagaaaaccagcatgtacccaccaccagttcttcattaactgaccctcatgccggagtgaaggcagccctgttacagctgcttgctcagcatcagccccaggatgaccccaaaagagaaggtgggattgattatcaagcaggagacacttacgtgtccacttcagactacaaggacaactttggatcctcttctttctcttctgctccttatgttagcaatgatggtctaggaagcagttctgctccaccactagaacgacgtagtttcattggaaattcagatattcagtctttggataactacagtactgcttcatctcattctggtggtccacctcagccttctgccttttctgagtcatttcccagttcagtagctggatatggagacatttacctcaatgctggtcccatgttgtttagtggagacaaggaccatagatttgaatatagccatggtcctattgcagtcctggcaaacagcagtgacccttccacggggccagagagtactcatcctttgccagcaaagatgcacaactataactatggtggtaacttacaggaaaatccgagtggccccagcctcatgcatggacagacctggacttctcctgcccaaggacctggatattcacaaggatacaggggacatattagcacatcaactggcagaggcagaggcagagggttaccatactgagtatctgtttttcctcaggcacatcatttttatctggaaagacttttctagctgcaatttaaggcagcaatccaagagacttgaataataataattcaacaacagctttatttttatgtggagaagggtcttgcatacaatagtttaaaaaagacaaaaaaaacctttgcttaaattcatgctgttctaaaaactagatcgattgtacatcttcacaaattctagttaacaattttattttgtattcttgcagttttaagtggatgctaattttaggggcataagccttttatggccctcttgcagatcttctgaactatgcacatttgtgctttttttgtaagtttggaccaacttttatgtaacaaacagcccctccccacctccagttttacaacaatcagaaagggcactgatttatttggtatttttctttttacaaagctacctttagtcaaaggtcactgtcagtctttgcacctgctttcagtgttattgtgaaaggtgtactttgtgctcatttcagaaaataaaacacaacctttctcttgatgcaacagttttataaaaaaaaaaa

SEQ ID NO: 329894 - DNA, 5722 bp, Homo sapiens
agccccgcgggccgcagagtgcgcgaggccctaggccgggagttgttgtcaggcccaggccacttccgaggcgcctgcggtgtgtcgccgccaccacaggaggacgacgtcgacgccgaggaggaggcggtggaggcgtgttgttgtctcgcccactcccctcccctgaacttgcacccaacgtcagggcgcgatggagtgaagcggcgacgaaggtggtacttccgcgttgcgctgcccgagccgagagcgcggccaaggccgctcccccacccccgggggcacttggaggactcgggactcccccgcaggtcagcgcccggcgcatctggtgttttcgctgccgaggataggacgacgagcgcaatcgggagctccgccgcccggattcctgcttccctggggcccggaggctgctgcgtaccccactgtgacctggaacccagggacccgagtcccgacccggattatcgtggcgcttttcccggccggctctggtgctcggtgtccctccgccgccgctcccgtttccggcgggggagatggccaggatctgacccgggaggaggccgcacccgcgccgcgctctgcggctggctctaggcgatgccgagcagctcggacacggcgctggggggaggcgggggcctgagctgggcggagaagaggttggaggaacgccgcaagcggaggcgattcctgtcccctcagcagccgccgctgctgttgccgctcctgcagccgcagctcctgcaaccgccgccgcccccgccgcctctgctcttcctggctgctcccggcacggccgccgccgcagccgccgccgccgcggcctcctcctcttgcttcagcccgggcccccctctggaggtcaagcggctggcgagaggcaagaggcgcgcaggagggcggcagaagcggcgtcgcgggccccgcgccgggcaggaggcggagaagcgtcgggtcttctcgctgccccagccgcagcaggacggcggtggcggtgctagtagcggcgggggtgtgaccccgctggtggaatacgaggatgtgagctcccagtccgagcaggggctgctgctggggggggccagcgcggcaacggcggcgacggctgccgggggaacggggggcagcggcgggagtccggcctcctcctccggcacccagcggcgcggggaggggtcggagcgcaggccccgccgggaccgccgcagcagcagtggccgcagcaaggagcgccaccgcgagcaccggcggcgggatgggcagcgcggtggcagcgaggcctccaagtcccgcagccgccacagccacagcggcgaggaacgggccgaggtcgccaagagcggcagcagcagcagcagcggcggccgccggaaaagcgcttcggccacatccagcagcagtagcagccgcaaggaccgggactcgaaggcccaccgcagccggactaagtcgtccaaggagccgccttcggcctacaaggaaccgcccaaggcctaccgggaggacaagaccgagcctaaggcctacaggcggcggcggtccctcagcccactgggaggccgggacgacagcccggtgtcccacagggcctctcagagcctgaggagccgcaagtcccccagcccggcaggaggtggcagcagcccctattctcggcggctgccgcgctccccgagcccctacagtcgccgccgctcccccagctacagccgccacagctcctacgagcggggcggcgacgtgtcccctagtccctacagcagcagcagctggcgccgctctcgcagtccctacagccctgtgctcagacggtctggaaaatcccgaagcagaagcccgtattcatctaggcattcaagatctcgtagcaggcacagattgtctagatccagaagtcgtcattctagtatttctcctagcacactaactctgaagagtagcctggcagctgaattgaacaagaataaaaaagcacgagcagcagaggcagcaagagccgcagaagcagcgaaagctgcagaagcaactaaggctgctgaggctgctgccaaggctgcaaaagcttcaaacacttctacacctaccaaggggaacacggaaactagtgccagtgcatcacaaacaaaccatgtgaaggatgtgaagaaaattaaaattgaacatgcaccttctccctcaagtggtggaactttaaaaaatgacaaagcaaaaacaaagccacctcttcaggtaacgaaggtggaaaataatttgattgtagataaagccaccaagaaagcagtcatagttggaaaggagagtaaatctgctgctacaaaggaggaatcagtatctcttaaagagaaaaccaaaccacttacaccaagcataggagccaaggagaaggagcaacatgtagctttagtcacctctacattaccaccgttacctttgcctcccatgctgcctgaagataaagaagctgatagcttacgaggaaatatttcagtaaaagcagttaaaaaagaagtagaaaagaaactccgatgtcttcttgctgatttaccgctgccccctgagctaccaggaggagatgatctttcaaagagtccagaggaaaagaaaacagcaacacagttacatagtaaaaggaggcctaaaatatgtgggcctcgctatggtgaaaccaaagaaaaagatattgactggggaaaacgctgcgtggataaatttgatatcatcggaattattggagaaggtacttacggacaagtttacaaagccagggataaagacactggagaaatggtagccttaaaaaaagtacgtctggataatgaaaaggaaggctttccaattacagcaattcgagaaattaaaattctccggcagcttacccatcagagtattatcaatatgaaggaaatagtgactgataaagaagatgctttggatttcaagaaggacaaaggtgcattttatctggtgtttgaatatatggaccatgatctgatgggactactggaatcaggcttggttcattttaatgaaaatcacataaagtcatttatgagacagctcatggagggtctggattattgtcataagaagaactttttgcatagagatattaaatgttccaatatccttctaaataatagagggcagataaaacttgcagactttggacttgctcgattgtatagctcagaagaaagtcggccgtatactaacaaggtaattactttatggtaccgtccacctgaactgctactgggagaagaacgatacacaccagccattgatgtatggagctgtggctgtatccttggcgaactcttcactaaaaaacctatatttcaagcaaatcaggaacttgcacaactagaattaataagccgaatatgtgggagtccatgtcctgcagtgtggcctgatgtaatcaaactaccatatttcaacaccatgaaaccaaagaagcaatatcgtcgaaagttaagagaagaatttgtttttattcctgcagctgcgctagacttatttgattacatgcttgccttggatcctagtaagcgctgcactgctgaacaggctcttcagtgcgagttcctccgagatgtggaaccctcaaaaatgcctccaccagatctccctttatggcaagattgtcatgagttatggagtaaaaagcgaagaagacagaagcagatgggcatgactgatgatgtttccacaattaaagcccccaggaaggacttgtctctgggcttggatgacagcagaaccaacacaccccagggtgtgctgccatcttcacagctgaaatctcagggcagctcaaatgtggcacctgtaaaaacaggccctggacagcacttaaaccacagtgaattggcaattctactaaacctactacaatctaaaacaagtgttaatatggctgattttgtccaagtgttgaacattaaggtaaactctgagactcaacagcagctaaataaaataaaccttcctgctggaattttggcaacaggtgaaaaacagacagatccatcaacaccacaacaggagtcttcgaaaccgttgggaggaattcagccttcttctcagaccatccagcctaaagtggagactgatgctgcccaggcggctgtgcagagtgcatttgcagttctgttgactcagttaataaaggctcagcagtcaaagcagaaagatgtgctactagaagagagggaaaatggatcgggacatgaagcgtcattacaactcaggccacctccagaacctagcactccggtgtcgggacaagatgacctcatccagcatcaagatatgaggatcttggagctaacgccagaaccagaccggcctcgaattctgcctcctgaccaacgacctcccgagcctcctgaaccaccaccagtcactgaggaagatctagattatcggacagaaaaccagcatgtacccaccaccagttcttcattaactgaccctcatgccggagtgaaggcagccctgttacagctgcttgctcagcatcagccccaggatgaccccaaaagagaaggtgggattgattatcaagcaggagacacttacgtgtccacttcagactacaaggacaactttggatcctcttctttctcttctgctccttatgttagcaatgatggtctaggaagcagttctgctccaccactagaacgacgtagtttcattggaaattcagatattcagtctttggataactacagtactgcttcatctcattctggtggtccacctcagccttctgccttttctgagtcatttcccagttcagtagctggatatggagacatttacctcaatgctggtcccatgttgtttagtggagacaaggaccatagatttgaatatagccatggtcctattgcagtcctggcaaacagcagtgacccttccacggggccagagagtactcatcctttgccagcaaagatgcacaactataactatggtggtaacttacaggaaaatccgagtggccccagcctcatgcatggacagacctggacttctcctgcccaaggacctggatattcacaaggatacaggggacatattagcacatcaactggcagaggcagaggcagagggttaccatactgagtatctgtttttcctcaggcacatcatttttatctggaaagacttttctagctgcaatttaaggcagcaatccaagagacttgaataataataattcaacaacagctttatttttatgtggagaagggtcttgcatacaatagtttaaaaaagacaaaaaaaacctttgcttaaattcatgctgttctaaaaactagatcgattgtacatcttcacaaattctagttaacaattttattttgtattcttgcagttttaagtggatgctaattttaggggcataagccttttatggccctcttgcagatcttctgaactatgcacatttgtgctttttttgtaagtttggaccaacttttatgtaacaaacagcccctccccacctccagttttacaacaatcagaaagggcactgatttatttggtatttttctttttacaaagctacctttagtcaaaggtcactgtcagtctttgcacctgctttcagtgttattgtgaaaggtgtactttgtgctcatttcagaaaataaaacacaacctttctcttgatgcaacagttttataaaaaaaaaaa

SEQ ID NO: 329895 - DNA, 5488 bp, Homo sapiens
agccccgcgggccgcagagtgcgcgaggccctaggccgggagttgttgtcaggcccaggccacttccgaggcgcctgcggtgtgtcgccgccaccacaggaggacgacgtcgacgccgaggaggaggcggtggaggcgtgttgttgtctcgcccactcccctcccctgaacttgcacccaacgtcagggcgcgatggagtgaagcggcgacgaaggtggtacttccgcgttgcgctgcccgagccgagagcgcggccaaggccgctcccccacccccgggggcacttggaggactcgggactcccccgcaggtcagcgcccggcgcatctggtgttttcgctgccgaggataggacgacgagcgcaatcgggagctccgccgcccggattcctgcttccctggggcccggaggctgctgcgtaccccactgtgacctggaacccagggacccgagtcccgacccggattatcgtggcgcttttcccggccggctctggtgctcggtgtccctccgccgccgctcccgtttccggcgggggagatggccaggatctgacccgggaggaggccgcacccgcgccgcgctctgcggctggctctaggcgatgccgagcagctcggacacggcgctggggggaggcgggggcctgagctgggcggagaagaggttggaggaacgccgcaagcggaggcgattcctgtcccctcagcagccgccgctgctgttgccgctcctgcagccgcagctcctgcaaccgccgccgcccccgccgcctctgctcttcctggctgctcccggcacggccgccgccgcagccgccgccgccgcggcctcctcctcttgcttcagcccgggcccccctctggaggtcaagcggctggcgagaggcaagaggcgcgcaggagggcggcagaagcggcgtcgcgggccccgcgccgggcaggaggcggagaagcgtcgggtcttctcgctgccccagccgcagcaggacggcggtggcggtgctagtagcggcgggggtgtgaccccgctggtggaatacgaggatgtgagctcccagtccgagcaggggctgctgctggggggggccagcgcggcaacggcggcgacggctgccgggggaacggggggcagcggcgggagtccggcctcctcctccggcacccagcggcgcggggaggggtcggagcgcaggccccgccgggaccgccgcagcagcagtggccgcagcaaggagcgccaccgcgagcaccggcggcgggatgggcagcgcggtggcagcgaggcctccaagtcccgcagccgccacagccacagcggcgaggaacgggccgaggtcgccaagagcggcagcagcagcagcagcggcggccgccggaaaagcgcttcggccacatccagcagcagtagcagccgcaaggaccgggactcgaaggcccaccgcagccggactaagtcgtccaaggagccgccttcggcctacaaggaaccgcccaaggcctaccgggaggacaagaccgagcctaaggcctacaggcggcggcggtccctcagcccactgggaggccgggacgacagcccggtgtcccacagggcctctcagagcctgaggagccgcaagtcccccagcccggcaggaggtggcagcagcccctattctcggcggctgccgcgctccccgagcccctacagtcgccgccgctcccccagctacagccgccacagctcctacgagcggggcggcgacgtgtcccctagtccctacagcagcagcagctggcgccgctctcgcagtccctacagccctgtgctcagacggtctggaaaatcccgaagcagaagcccgtattcatctaggcattcaagatctcgtagcaggcacagattgtctagatccagaagtcgtcattctagtatttctcctagcacactaactctgaagagtagcctggcagctgaattgaacaagaataaaaaagcacgagcagcagaggcagcaagagccgcagaagcagcgaaagctgcagaagcaactaaggctgctgaggctgctgccaaggctgcaaaagcttcaaacacttctacacctaccaaggggaacacggaaactagtgccagtgcatcacaaacaaaccatgtgaaggatgtgaagaaaattaaaattgaacatgcaccttctccctcaagtggtggaactttaaaaaatgacaaagcaaaaacaaagccacctcttcaggtaacgaaggtggaaaataatttgattgtagataaagccaccaagaaagcagtcatagttggaaaggagagtaaatctgctgctacaaaggaggaatcagtatctcttaaagagaaaaccaaaccacttacaccaagcataggagccaaggagaaggagcaacatgtagctttagtcacctctacattaccaccgttacctttgcctcccatgctgcctgaagataaagaagctgatagcttacgaggaaatatttcagtaaaagcagttaaaaaagaagtagaaaagaaactccgatgtcttcttgctgatttaccgctgccccctgagctaccaggaggagatgatctttcaaagagtccagaggaaaagaaaacagcaacacagttacatagtaaaaggaggcctaaaatatgtgggcctcgctatggtgaaaccaaagaaaaagatattgactggggaaaacgctgcgtggataaatttgatatcatcggaattattggagaaggtacttacggacaagtttacaaagccagggataaagacactggagaaatggtagccttaaaaaaagtacgtctggataatgaaaaggaaggctttccaattacagcaattcgagaaattaaaattctccggcagcttacccatcagagtattatcaatatgaaggaaatagtgactgataaagaagatgctttggatttcaagaaggacaaaggtgcattttatctggtgtttgaatatatggaccatgatctgatgggactactggaatcaggcttggttcattttaatgaaaatcacataaagtcatttatgagacagctcatggagggtctggattattgtcataagaagaactttttgcatagagatattaaatgttccaatatccttctaaataatagagggcagataaaacttgcagactttggacttgctcgattgtatagctcagaagaaagtcggccgtatactaacaaggtaattactttatggtaccgtccacctgaactgctactgggagaagaacgatacacaccagccattgatgtatggagctgtggctgtatccttggcgaactcttcactaaaaaacctatatttcaagcaaatcaggaacttgcacaactagaattaataagccgaatatgtgggagtccatgtcctgcagtgtggcctgatgtaatcaaactaccatatttcaacaccatgaaaccaaagaagcaatatcgtcgaaagttaagagaagaatttgtttttattcctgcagctgcgctagacttatttgattacatgcttgccttggatcctagtaagcgctgcactgctgaacaggctcttcagtgcgagttcctccgagatgtggaaccctcaaaaatgcctccaccagatctccctttatggcaagattgtcatgagttatggagtaaaaagcgaagaagacagaagcagatgggcatgactgatgatgtttccacaattaaagcccccaggaaggacttgtctctgggcttggatgacagcagaaccaacacaccccagggtgtgctgccatcttcacagctgaaatctcagggcagctcaaatgtggcacctggtgaaaaacagacagatccatcaacaccacaacaggagtcttcgaaaccgttgggaggaattcagccttcttctcagaccatccagcctaaagtggagactgatgctgcccaggcggctgtgcagagtgcatttgcagttctgttgactcagttaataaaggctcagcagtcaaagcagaaagatgtgctactagaagagagggaaaatggatcgggacatgaagcgtcattacaactcaggccacctccagaacctagcactccggtgtcgggacaagatgacctcatccagcatcaagatatgaggatcttggagctaacgccagaaccagaccggcctcgaattctgcctcctgaccaacgacctcccgagcctcctgaaccaccaccagtcactgaggaagatctagattatcggacagaaaaccagcatgtacccaccaccagttcttcattaactgaccctcatgccggagtgaaggcagccctgttacagctgcttgctcagcatcagccccaggatgaccccaaaagagaaggtgggattgattatcaagcaggagacacttacgtgtccacttcagactacaaggacaactttggatcctcttctttctcttctgctccttatgttagcaatgatggtctaggaagcagttctgctccaccactagaacgacgtagtttcattggaaattcagatattcagtctttggataactacagtactgcttcatctcattctggtggtccacctcagccttctgccttttctgagtcatttcccagttcagtagctggatatggagacatttacctcaatgctggtcccatgttgtttagtggagacaaggaccatagatttgaatatagccatggtcctattgcagtcctggcaaacagcagtgacccttccacggggccagagagtactcatcctttgccagcaaagatgcacaactataactatggtggtaacttacaggaaagacctggatattcacaaggatacaggggacatattagcacatcaactggcagaggcagaggcagagggttaccatactgagtatctgtttttcctcaggcacatcatttttatctggaaagacttttctagctgcaatttaaggcagcaatccaagagacttgaataataataattcaacaacagctttatttttatgtggagaagggtcttgcatacaatagtttaaaaaagacaaaaaaaacctttgcttaaattcatgctgttctaaaaactagatcgattgtacatcttcacaaattctagttaacaattttattttgtattcttgcagttttaagtggatgctaattttaggggcataagccttttatggccctcttgcagatcttctgaactatgcacatttgtgctttttttgtaagtttggaccaacttttatgtaacaaacagcccctccccacctccagttttacaacaatcagaaagggcactgatttatttggtatttttctttttacaaagctacctttagtcaaaggtcactgtcagtctttgcacctgctttcagtgttattgtgaaaggtgtactttgtgctcatttcagaaaataaaacacaacctttctcttgatgcaacagttttataaaaaaaaaaa

SEQ ID NO: 329896 - DNA, 5868 bp, Homo sapiens
agccccgcgggccgcagagtgcgcgaggccctaggccgggagttgttgtcaggcccaggccacttccgaggcgcctgcggtgtgtcgccgccaccacaggaggacgacgtcgacgccgaggaggaggcggtggaggcgtgttgttgtctcgcccactcccctcccctgaacttgcacccaacgtcagggcgcgatggagtgaagcggcgacgaaggtggtacttccgcgttgcgctgcccgagccgagagcgcggccaaggccgctcccccacccccgggggcacttggaggactcgggactcccccgcaggtcagcgcccggcgcatctggtgttttcgctgccgaggataggacgacgagcgcaatcgggagctccgccgcccggattcctgcttccctggggcccggaggctgctgcgtaccccactgtgacctggaacccagggacccgagtcccgacccggattatcgtggcgcttttcccggccggctctggtgctcggtgtccctccgccgccgctcccgtttccggcgggggagatggccaggatctgacccgggaggaggccgcacccgcgccgcgctctgcggctggctctaggcgatgccgagcagctcggacacggcgctggggggaggcgggggcctgagctgggcggagaagaggttggaggaacgccgcaagcggaggcgattcctgtcccctcagcagccgccgctgctgttgccgctcctgcagccgcagctcctgcaaccgccgccgcccccgccgcctctgctcttcctggctgctcccggcacggccgccgccgcagccgccgccgccgcggcctcctcctcttgcttcagcccgggcccccctctggaggtcaagcggctggcgagaggcaagaggcgcgcaggagggcggcagaagcggcgtcgcgggccccgcgccgggcaggaggcggagaagcgtcgggtcttctcgctgccccagccgcagcaggacggcggtggcggtgctagtagcggcgggggtgtgaccccgctggtggaatacgaggatgtgagctcccagtccgagcaggggctgctgctggggggggccagcgcggcaacggcggcgacggctgccgggggaacggggggcagcggcgggagtccggcctcctcctccggcacccagcggcgcggggaggggtcggagcgcaggccccgccgggaccgccgcagcagcagtggccgcagcaaggagcgccaccgcgagcaccggcggcgggatgggcagcgcggtggcagcgaggcctccaagtcccgcagccgccacagccacagcggcgaggaacgggccgaggtcgccaagagcggcagcagcagcagcagcggcggccgccggaaaagcgcttcggccacatccagcagcagtagcagccgcaaggaccgggactcgaaggcccaccgcagccggactaagtcgtccaaggagccgccttcggcctacaaggaaccgcccaaggcctaccgggaggacaagaccgagcctaaggcctacaggcggcggcggtccctcagcccactgggaggccgggacgacagcccggtgtcccacagggcctctcagagcctgaggagccgcaagtcccccagcccggcaggaggtggcagcagcccctattctcggcggctgccgcgctccccgagcccctacagtcgccgccgctcccccagctacagccgccacagctcctacgagcggggcggcgacgtgtcccctagtccctacagcagcagcagctggcgccgctctcgcagtccctacagccctgtgctcagacggtctggaaaatcccgaagcagaagcccgtattcatctaggcattcaagatctcgtagcaggcacagattgtctagatccagaagtcgtcattctagtatttctcctagcacactaactctgaagagtagcctggcagctgaattgaacaagaataaaaaagcacgagcagcagaggcagcaagagccgcagaagcagcgaaagctgcagaagcaactaaggctgctgaggctgctgccaaggctgcaaaagcttcaaacacttctacacctaccaaggggaacacggaaactagtgccagtgcatcacaaacaaaccatgtgaaggatgtgaagaaaattaaaattgaacatgcaccttctccctcaagtggtggaactttaaaaaatgacaaagcaaaaacaaagccacctcttcaggtaacgaaggtggaaaataatttgattgtagataaagccaccaagaaagcagtcatagttggaaaggagagtaaatctgctgctacaaaggaggaatcagtatctcttaaagagaaaaccaaaccacttacaccaagcataggagccaaggagaaggagcaacatgtagctttagtcacctctacattaccaccgttacctttgcctcccatgctgcctgaagataaagaagctgatagcttacgaggaaatatttcagtaaaagcagttaaaaaagaagtagaaaagaaactccgatgtcttcttgctgatttaccgctgccccctgagctaccaggaggagatgatctttcaaagagtccagaggaaaagaaaacagcaacacagttacatagtaaaaggaggcctaaaatatgtgggcctcgctatggtgaaaccaaagaaaaagatattgactggggaaaacgctgcgtggataaatttgatatcatcggaattattggagaaggtacttacggacaagtttacaaagccagggataaagacactggagaaatggtagccttaaaaaaagtacgtctggataatgaaaaggaaggctttccaattacagcaattcgagaaattaaaattctccggcagcttacccatcagagtattatcaatatgaaggaaatagtgactgataaagaagatgctttggatttcaagaaggacaaaggtgcattttatctggtgtttgaatatatggaccatgatctgatgggactactggaatcaggcttggttcattttaatgaaaatcacataaagtcatttatgagacagctcatggagggtctggattattgtcataagaagaactttttgcatagagatattaaatgttccaatatccttctaaataatagagggcagataaaacttgcagactttggacttgctcgattgtatagctcagaagaaagtcggccgtatactaacaaggtaattactttatggtaccgtccacctgaactgctactgggagaagaacgatacacaccagccattgatgtatggagctgtggctgtatccttggcgaactcttcactaaaaaacctatatttcaagcaaatcaggaacttgcacaactagaattaataagccgaatatgtgggagtccatgtcctgcagtgtggcctgatgtaatcaaactaccatatttcaacaccatgaaaccaaagaagcaatatcgtcgaaagttaagagaagaatttgtttttattcctgcagctgcgctagacttatttgattacatgcttgccttggatcctagtaagcgctgcactgctgaacaggctcttcagtgcgagttcctccgagatgtggaaccctcaaaaatgcctccaccagatctccctttatggcaagattgtcatgagttatggagtaaaaagcgaagaagacagaagcagatgggcatgactgatgatgtttccacaattaaagcccccaggaaggacttgtctctgggcttggatgacagcagaaccaacacaccccagggtgtgctgccatcttcacagctgaaatctcagggcagctcaaatgtggcacctggtgaaaaacagacagatccatcaacaccacaacaggagtcttcgaaaccgttgggaggaattcagccttcttctcagaccatccagcctaaagtggagactgatgctgcccaggcggctgtgcagagtgcatttgcagttctgttgactcagttaataaaggctcagcagtcaaagcagaaagatgtgctactagaagagagggaaaatggatcgggacatgaagcgtcattacaactcaggccacctccagaacctagcactccggtgtcgggacaagatgacctcatccagcatcaagatatgaggatcttggagctaacgccagaaccagaccggcctcgaattctgcctcctgaccaacgacctcccgagcctcctgaaccaccaccagtcactgaggaagatctagattatcggacagaaaaccagcatgtacccaccaccagttcttcattaactgaccctcatgccggagtgaaggcagccctgttacagctgcttgctcagcatcagccccaggatgaccccaaaagagaaggtgggattgattatcaagcaggagacacttacgtgtccacttcagactacaaggacaactttggatcctcttctttctcttctgctccttatgttagcaatgatggtctaggaagcagttctgctccaccactagaacgacgtagtttcattggaaattcagatattcagtctttggataactacagtactgcttcatctcattctggtggtccacctcagccttctgccttttctgagtcatttcccagttcagtagctggatatggagacatttacctcaatgctggtcccatgttgtttagtggagacaaggaccatagatttgaatatagccatggtcctattgcagtcctggcaaacagcagtgacccttccacggggccagagagtactcatcctttgccagcaaagatgcacaactataactatggtggtaacttacaggaaaatccgagtggccccagcctcatgcatggacagacctggacttctcctgcccaaggacctggatattcacaaggatacaggggacatattagcacatcaactggcagaggcagaggcagagggttaccatactgagtatctgtttttcctcaggcacatcatttttatctggaaagacttttctagctgcaatttaaggcagcaatccaagagacttgaataataataattcaacaacagctttatttttatgtggagaagggtcttgcatacaatagtttaaaaaagacaaaaaaaacctttgcttaaattcatgctgttctaaaaactagatcgattgtacatcttcacaaattctagttaacaattttattttgtattcttgcagttttaagtggatgctaattttaggggcataagccttttatggccctcttgcagatcttctgaactatgcacatttgtgctttttttgtaagtttggaccaacttttatgtaacaaacagcccctccccacctccagttttacaacaatcagaaagggcactgatttatttggtatttttctttttacaaagctacctttagtcaaaggtcactgtcagtctttgcacctgctttcagtgttattgtgaaaggtgtactttgtgctcatttcagaaaataaaacacaacctttctcttgatgcaacagttttataaaaaaaaaaaaaaaaacaaagaaaaaaaacttttggggcgggcctgggccccggaaaaggttttcaaacccaattggtgtggggggcgggggccgcacgatgggatagggtgacagggggcaaacagagggtgtcccaagagaaaaccgcgggggcccaagacaaacaagggcgcgggaacgtcctccccgaattaaaaaaagccccgggggggaaaccacgagagtgttcttgagacaaatcccgaggaggagggtacaaggagggccaaactaaggggctctattcacaccaagggagtcctacaggagaggccccgatataaatataccgcgg

SEQ ID NO: 329897 - DNA, 6512 bp, Homo sapiens
agccccgcgggccgcagagtgcgcgaggccctaggccgggagttgttgtcaggcccaggccacttccgaggcgcctgcggtgtgtcgccgccaccacaggaggacgacgtcgacgccgaggaggaggcggtggaggcgtgttgttgtctcgcccactcccctcccctgaacttgcacccaacgtcagggcgcgatggagtgaagcggcgacgaaggtggtacttccgcgttgcgctgcccgagccgagagcgcggccaaggccgctcccccacccccgggggcacttggaggactcgggactcccccgcaggtcagcgcccggcgcatctggtgttttcgctgccgaggataggacgacgagcgcaatcgggagctccgccgcccggattcctgcttccctggggcccggaggctgctgcgtaccccactgtgacctggaacccagggacccgagtcccgacccggattatcgtggcgcttttcccggccggctctggtgctcggtgtccctccgccgccgctcccgtttccggcgggggagatggccaggatctgacccgggaggaggccgcacccgcgccgcgctctgcggctggctctaggcgatgccgagcagctcggacacggcgctggggggaggcgggggcctgagctgggcggagaagaggttggaggaacgccgcaagcggaggcgattcctgtcccctcagcagccgccgctgctgttgccgctcctgcagccgcagctcctgcaaccgccgccgcccccgccgcctctgctcttcctggctgctcccggcacggccgccgccgcagccgccgccgccgcggcctcctcctcttgcttcagcccgggcccccctctggaggtcaagcggctggcgagaggcaagaggcgcgcaggagggcggcagaagcggcgtcgcgggccccgcgccgggcaggaggcggagaagcgtcgggtcttctcgctgccccagccgcagcaggacggcggtggcggtgctagtagcggcgggggtgtgaccccgctggtggaatacgaggatgtgagctcccagtccgagcaggggctgctgctggggggggccagcgcggcaacggcggcgacggctgccgggggaacggggggcagcggcgggagtccggcctcctcctccggcacccagcggcgcggggaggggtcggagcgcaggccccgccgggaccgccgcagcagcagtggccgcagcaaggagcgccaccgcgagcaccggcggcgggatgggcagcgcggtggcagcgaggcctccaagtcccgcagccgccacagccacagcggcgaggaacgggccgaggtcgccaagagcggcagcagcagcagcagcggcggccgccggaaaagcgcttcggccacatccagcagcagtagcagccgcaaggaccgggactcgaaggcccaccgcagccggactaagtcgtccaaggagccgccttcggcctacaaggaaccgcccaaggcctaccgggaggacaagaccgagcctaaggcctacaggcggcggcggtccctcagcccactgggaggccgggacgacagcccggtgtcccacagggcctctcagagcctgaggagccgcaagtcccccagcccggcaggaggtggcagcagcccctattctcggcggctgccgcgctccccgagcccctacagtcgccgccgctcccccagctacagccgccacagctcctacgagcggggcggcgacgtgtcccctagtccctacagcagcagcagctggcgccgctctcgcagtccctacagccctgtgctcagacggtctggaaaatcccgaagcagaagcccgtattcatctaggcattcaagatctcgtagcaggcacagattgtctagatccagaagtcgtcattctagtatttctcctagcacactaactctgaagagtagcctggcagctgaattgaacaagaataaaaaagcacgagcagcagaggcagcaagagccgcagaagcagcgaaagctgcagaagcaactaaggctgctgaggctgctgccaaggctgcaaaagcttcaaacacttctacacctaccaaggggaacacggaaactagtgccagtgcatcacaaacaaaccatgtgaaggatgtgaagaaaattaaaattgaacatgcaccttctccctcaagtggtggaactttaaaaaatgacaaagcaaaaacaaagccacctcttcaggtaacgaaggtggaaaataatttgattgtagataaagccaccaagaaagcagtcatagttggaaaggagagtaaatctgctgctacaaaggaggaatcagtatctcttaaagagaaaaccaaaccacttacaccaagcataggagccaaggagaaggagcaacatgtagctttagtcacctctacattaccaccgttacctttgcctcccatgctgcctgaagataaagaagctgatagcttacgaggaaatatttcagtaaaagcagttaaaaaagaagtagaaaagaaactccgatgtcttcttgctgatttaccgctgccccctgagctaccaggaggagatgatctttcaaagagtccagaggaaaagaaaacagcaacacagttacatagtaaaaggaggcctaaaatatgtgggcctcgctatggtgaaaccaaagaaaaagatattgactggggaaaacgctgcgtggataaatttgatatcatcggaattattggagaaggtacttacggacaagtttacaaagccagggataaagacactggagaaatggtagccttaaaaaaagtacgtctggataatgaaaaggaaggctttccaattacagcaattcgagaaattaaaattctccggcagcttacccatcagagtattatcaatatgaaggaaatagtgactgataaagaagatgctttggatttcaagaaggacaaaggtgcattttatctggtgtttgaatatatggaccatgatctgatgggactactggaatcaggcttggttcattttaatgaaaatcacataaagtcatttatgagacagctcatggagggtctggattattgtcataagaagaactttttgcatagagatattaaatgttccaatatccttctaaataatagagggcagataaaacttgcagactttggacttgctcgattgtatagctcagaagaaagtcggccgtatactaacaaggtaattactttatggtaccgtccacctgaactgctactgggagaagaacgatacacaccagccattgatgtatggagctgtggctgtatccttggcgaactcttcactaaaaaacctatatttcaagcaaatcaggaacttgcacaactagaattaataagccgaatatgtgggagtccatgtcctgcagtgtggcctgatgtaatcaaactaccatatttcaacaccatgaaaccaaagaagcaatatcgtcgaaagttaagagaagaatttgtttttattcctgcagctgcgctagacttatttgattacatgcttgccttggatcctagtaagcgctgcactgctgaacaggctcttcagtgcgagttcctccgagatgtggaaccctcaaaaatgcctccaccagatctccctttatggcaagattgtcatgagttatggagtaaaaagcgaagaagacagaagcagatgggcatgactgatgatgtttccacaattaaagcccccaggaaggacttgtctctgggcttggatgacagcagaaccaacacaccccagggtgtgctgccatcttcacagctgaaatctcagggcagctcaaatgtggcacctggtgaaaaacagacagatccatcaacaccacaacaggagtcttcgaaaccgttgggaggaattcagccttcttctcagaccatccagcctaaagtggagactgatgctgcccaggcggctgtgcagagtgcatttgcagttctgttgactcagttaataaaggctcagcagtcaaagcagaaagatgtgctactagaagagagggaaaatggatcgggacatgaagcgtcattacaactcaggccacctccagaacctagcactccggtgtcgggacaagatgacctcatccagcatcaagatatgaggatcttggagctaacgccagaaccagaccggcctcgaattctgcctcctgaccaacgacctcccgagcctcctgaaccaccaccagtcactgaggaagatctagattatcggacagaaaaccagcatgtacccaccaccagttcttcattaactgaccctcatgccggagtgaaggcagccctgttacagctgcttgctcagcatcagccccaggatgaccccaaaagagaaggtgggattgattatcaagcaggagacacttacgtgtccacttcagactacaaggacaactttggatcctcttctttctcttctgctccttatgttagcaatgatggtctaggaagcagttctgctccaccactagaacgacgtagtttcattggaaattcagatattcagtctttggataactacagtactgcttcatctcattctggtggtccacctcagccttctgccttttctgagtcatttcccagttcagtagctggatatggagacatttacctcaatgctggtcccatgttgtttagtggagacaaggaccatagatttgaatatagccatggtcctattgcagtcctggcaaacagcagtgacccttccacggggccagagagtactcatcctttgccagcaaagatgcacaactataactatggtggtaacttacaggaaaatccgagtggccccagcctcatgcatggacagacctggacttctcctgcccaaggacctggatattcacaaggatacaggggacatattagcacatcaactggcagaggcagaggcagagggttaccatactgagtatctgtttttcctcaggcacatcatttttatctggaaagacttttctagctgcaatttaaggcagcaatccaagagacttgaataataataattcaacaacagctttatttttatgtggagaagggtcttgcatacaatagtttaaaaaagacaaaaaaaacctttgcttaaattcatgctgttctaattcttgcagttttaagtggatgctaattttaggggcataagccttttatggccctcttgcagatcttctgaactatgcacatttgtgctttttttgtaagtttggaccaacttttatgtaacaaacagcccctccccacctccagttttacaacaatcagaaagggcactgatttatttggtatttttctttttacaaagctacctttagtcaaaggtcactgtcagtctttgcacctgctttcagtgttattgtgaaaggtgtactttgtgctcatttcagaaaataaaacacaacctttctcttgatgcaacagttttataaaaaaaaaaatggtcaacgttatttttgttttgttttgcagattatcaaagcctagcaaaatgcatttaaatgaaatagtgggttttatatgaaaactatgggtggggtggggagggaaagtaagtgccttaacaggtaagcttaaggtctgaaaaaaatagttaacttttacccccatttgtcttttaaagggaatcaatgcattaaaaaggcaagaaactctgaagtttcaggggctgcctgttcagttcctgttaggtccattccctctgcttgtcacactttctccttttctgcctgtctttgggctgtgttgcctttcactaccaccttctcttgataggggagtgagagcaaagaaagggagtagaactgcaatcagtacatattgtttgagaagttctacaaagttttgtcatttaaatggttgaaagtaatagctccaggagaattttagagtaccattttctttcaggctgccatattatccctgtttccatttgccatggataattggagggtcatggtatagaagcaagagttaataacagaacttgcctaaatgtgttaaagttcatgggggaggggtggcaaataccgtattttaagttatgcaattgcccttttaagaaagtcaattctattcacttgttaactagaaacattgcttagattgaatttattgaagcaaaaagaaaaggcaatgagagagaacttttatcttccttcctgtcacattctgtaaagttgattatgacttctgccagacttagagcaacaactttagttcattttaacatttttttttaatgaagagcatcaagaatggggtagtccttatttaaactgtaagggggtccgcctcccctgtgtgcggcctctctcctttttctcccacttttctatctctcgaaagggcccgggggtacacgggcgcccctttctcccgcggacatgtcgggcgccaggcgtgccgcccacactggtggcccaggtcgggcgcccttttggaggccacgcgacgccgcccgcg

SEQ ID NO: 329898 - DNA, 2915 bp, Homo sapiens
ccagatcgacgaatgagcaccgagttacactgcttccttagatataattcacacaaaatgttatttctgcctagaaataaactccacttgatctgcctcagagaacacaagtaaaaggccattttctgtgctactttatcaagagattacctattaatacgccgaatatgtgggagtccatgtcctgcagtgtggcctgatgtaatcaaactaccatatttcaacaccatgaaaccaaagaagcaatatcgtcgaaagttaagagaagaatttgttttgtaagaaggggatgtgtaaacatccttattgcatgaatgttttactttaattctagtgaattataaatgttagtctattctctagtgatctgaggtaaacctataattcttctagggcatttaattttgagttctgtttgctacatgcagattaccattttaccattattatggaatcagtgatttgagattgtgtgtttggtttggtgcttacgtgaaagaactttaataagatcatttaaatgttactggaacagctttcaagttacttgagctcaagttttcattttgctttagaaaaaactatactgttcagttcttaatttgtataataacagcaaattaccgataagtaacaatatatactattgtttagaaagtggttacaaaaattatgtaaaaatgaaatatttattcaaaggaaaattcggatttattgaagtaaagtattatgcacatattaaaaaagtatttacaattatttttaaatgatcttagttttagttttaaaatttaattaaaaataatttaagctcctaaagaaacataagcttgtgtctaaagaacacatctaacttttgtaatcctctcatgctagtattcctgcagctgcgctagacttatttgattacatgcttgccttggatcctagtaagcgctgcactgctgaacaggctcttcagtgcgagttcctccgagatgtggaaccctcaaaaatgcctccaccagatctccctttatggcaagattgtcatgagttatggagtaaaaagcgaagaagacagaagcagatgggcatgactgatgatgtttccacaattaaagcccccaggaaggacttgtctctgggcttggatgacagcagaaccaacacaccccagggtgtgctgccatcttcacagctgaaatctcagggcagctcaaatgtggcacctggtgaaaaacagacagatccatcaacaccacaacaggagtcttcgaaaccgttgggaggaattcagccttcttctcagaccatccagcctaaagtggagactgatgctgcccaggcggctgtgcagagtgcatttgcagttctgttgactcagttaataaaggctcagcagtcaaagcagaaagatgtgctactagaagagagggaaaatggatcgggacatgaagcgtcattacaactcaggccacctccagaacctagcactccggtgtcgggacaagatgacctcatccagcatcaagatatgaggatcttggagctaacgccagaaccagaccggcctcgaattctgcctcctgaccaacgacctcccgagcctcctgaaccaccaccagtcactgaggaagatctagattatcggacagaaaaccagcatgtacccaccaccagttcttcattaactgaccctcatgccggagtgaaggcagccctgttacagctgcttgctcagcatcagccccaggatgaccccaaaagagaaggtgggattgattatcaagcaggagacacttacgtgtccacttcagactacaaggacaactttggatcctcttctttctcttctgctccttatgttagcaatgatggtctaggaagcagttctgctccaccactagaacgacgtagtttcattggaaattcagatattcagtctttggataactacagtactgcttcatctcattctggtggtccacctcagccttctgccttttctgagtcatttcccagttcagtagctggatatggagacatttacctcaatgctggtcccatgttgtttagtggagacaaggaccatagatttgaatatagccatggtcctattgcagtcctggcaaacagcagtgacccttccacggggccagagagtactcatcctttgccagcaaagatgcacaactataactatggtggtaacttacaggaaaatccgagtggccccagcctcatgcatggacagacctggacttctcctgcccaaggacctggatattcacaaggatacaggggacatattagcacatcaactggcagaggcagaggcagagggttaccatactgagtatctgtttttcctcaggcacatcatttttatctggaaagacttttctagctgcaatttaaggcagcaatccaagagacttgaataataataattcaacaacagctttatttttatgtggagaagggtcttgcatacaatagtttaaaaaagacaaaaaaaacctttgcttaaattcatgctgttctaaaaactagatcgattgtacatcttcacaaattctagttaacaattttattttgtattcttgcagttttaagtggatgctaattttaggggcataagccttttatggccctcttgcagatcttctgaactatgcacatttgtgctttttttgtaagtttggaccaacttttatgtaacaaacagcccctccccacctccagttttacaacaatcagaaagggcactgatttatttggtatttttctttttacaaagctacctttagtcaaaggtcactgtcagtctttgcacctgctttcagtgttattgtgaaaggtgtactttgtgctcatttcagaaaataaaacacaacctttctcttgatgcaacagttttataaaaaaaaaaa

SEQ ID NO: 329899 - DNA, 3513 bp, Homo sapiens
agccccgcgggccgcagagtgcgcgaggccctaggccgggagttgttgtcaggcccaggccacttccgaggcgcctgcggtgtgtcgccgccaccacaggaggacgacgtcgacgccgaggaggaggcggtggaggcgtgttgttgtctcgcccactcccctcccctgaacttgcacccaacgtcagggcgcgatggagtgaagcggcgacgaaggtggtacttccgcgttgcgctgcccgagccgagagcgcggccaaggccgctcccccacccccgggggcacttggaggactcgggactcccccgcaggtcagcgcccggcgcatctggtgttttcgctgccgaggataggacgacgagcgcaatcgggagctccgccgcccggattcctgcttccctggggcccggaggctgctgcgtaccccactgtgacctggaacccagggacccgagtcccgacccggattatcgtggcgcttttcccggccggctctggtgctcggtgtccctccgccgccgctcccgtttccggcgggggagatggccaggatctgacccgggaggaggccgcacccgcgccgcgctctgcggctggctctaggcgatgccgagcagctcggacacggcgctggggggaggcgggggcctgagctgggcggagaagaggttggaggaacgccgcaagcggaggcgattcctgtcccctcagcagccgccgctgctgttgccgctcctgcagccgcagctcctgcaaccgccgccgcccccgccgcctctgctcttcctggctgctcccggcacggccgccgccgcagccgccgccgccgcggcctcctcctcttgcttcagcccgggcccccctctggaggtcaagcggctggcgagaggcaagaggcgcgcaggagggcggcagaagcggcgtcgcgggccccgcgccgggcaggaggcggagaagcgtcgggtcttctcgctgccccagccgcagcaggacggcggtggcggtgctagtagcggcgggggtgtgaccccgctggtggaatacgaggatgtgagctcccagtccgagcaggggctgctgctggggggggccagcgcggcaacggcggcgacggctgccgggggaacggggggcagcggcgggagtccggcctcctcctccggcacccagcggcgcggggaggggtcggagcgcaggccccgccgggaccgccgcagcagcagtggccgcagcaaggagcgccaccgcgagcaccggcggcgggatgggcagcgcggtggcagcgaggcctccaagtcccgcagccgccacagccacagcggcgaggaacgggccgaggtcgccaagagcggcagcagcagcagcagcggcggccgccggaaaagcgcttcggccacatccagcagcagtagcagccgcaaggaccgggactcgaaggcccaccgcagccggactaagtcgtccaaggagccgccttcggcctacaaggaaccgcccaaggcctaccgggaggacaagaccgagcctaaggcctacaggcggcggcggtccctcagcccactgggaggccgggacgacagcccggtgtcccacagggcctctcagagcctgaggagccgcaagtcccccagcccggcaggaggtggcagcagcccctattctcggcggctgccgcgctccccgagcccctacagtcgccgccgctcccccagctacagccgccacagctcctacgagcggggcggcgacgtgtcccctagtccctacagcagcagcagctggcgccgctctcgcagtccctacagccctgtgctcagacggtctggaaaatcccgaagcagaagcccgtattcatctaggcattcaagatctcgtagcaggcacagattgtctagatccagaagtcgtcattctagtatttctcctagcacactaactctgaagagtagcctggcagctgaattgaacaagaataaaaaagcacgagcagcagaggcagcaagagccgcagaagcagcgaaagctgcagaagcaactaaggctgctgaggctgctgccaaggctgcaaaagcttcaaacacttctacacctaccaaggggaacacggaaactagtgccagtgcatcacaaacaaaccatgtgaaggatgtgaagaaaattaaaattgaacatgcaccttctccctcaagtggtggaactttaaaaaatgacaaagcaaaaacaaagccacctcttcaggtaacgaaggtggaaaataatttgattgtagataaagccaccaagaaagcagtcatagttggaaaggagagtaaatctgctgctacaaaggaggaatcagtatctcttaaagagaaaaccaaaccacttacaccaagcataggagccaaggagaaggagcaacatgtagctttagtcacctctacattaccaccgttacctttgcctcccatgctgcctgaagataaagaagctgatagcttacgaggaaatatttcagtaaaagcagttaaaaaagaagtagaaaagaaactccgatgtcttcttgctgatttaccgctgccccctgagctaccaggaggagatgatctttcaaagagtccagaggaaaagaaaacagcaacacagttacatagtaaaaggaggcctaaaatatgtgggcctcgctatggtgaaaccaaagaaaaagatattgactggggaaaacgctgcgtggataaatttgatatcatcggaattattggagaaggtacttacggacaagtttacaaagccagggataaagacactggagaaatggtagccttaaaaaaagtacgtctggataatgaaaaggaaggctttccaattacagcaattcgagaaattaaaattctccggcagcttacccatcagagtattatcaatatgaaggaaatagtgactgataaagaagatgctttggatttcaagaaggacaaaggtgcattttatctggtgtttgaatatatggaccatgatctgatgggactactggaatcaggcttggttcattttaatgaaaatcacataaagtcatttatgagacagctcatggagggtctggattattgtcataagaagaactttttgcatagagatattaaatgttccaatatccttctaaataatagagggcagataaaacttgcagactttggacttgctcgattgtatagctcagaagaaaggtaagcataccttcaaatgaatattgtagatactagagtttagtattagaagctatactaagaataccttattgatagttttattttttaaaagagaagtttacttttcatggttagtacataaaacattgaaattttataccatattgggttgattattgtaattacaatattttatacattatctcaatttaaaaattgatcttcaacaggtaaaaatgatttttttaaatgaacatctttaagtgtaactgaagtgaacttaaatttctaatacgtattcagatattaaatattcttaatgaaa

SEQ ID NO: 329900 - DNA, 394 bp, Homo sapiens
tctccctttatggcaagattgtcatgagttatggagtaaaaagcgaagaagacagaagcagatgggcatgactgatgatgtttccacaattaaagcccccaggaaggacttgtctctgggcttggatgacagcagaaccaacacaccccagggtgtgctgccatcttcacagctgaaatctcagggcagctcaaatgtggcacctggtcagtaatgcttccatgggttggttttcttcacattgttttgcagttaattctgatcatattgctctaatgttaaagcatcttgtggctaacaatgaaaattaacatttattcactgaactagacatttctttgtgccagtacagaagtttcattgctattggcaccacaattttaagtaatcttaa

SEQ ID NO: 329901 - DNA, 85 bp, Homo sapiens
ccaccactctacagaggtaactatttgtcactatgaagaatgccaaagaaaatatttcctcgtaaaatttaactgcttactgtga

SEQ ID NO: 329902 - DNA, 511 bp, Homo sapiens
atatttgtagtcagtatgtgtgctcttaaccagaatcctttatgacttttcaacttccgttgtcttttaggaaataggtcaacaattatttgcttccattacaatatgataagaaaatggaactgccagtgaagacagaaaagaccttacatgtttattcaaatgctttgttacataccctgaatttttatccatataaaggcacagctggtaaaatatatggtatttgtaaaaggatgaatgtatttgcattttgcatgtaatatcacaagactctatgtatcgttaaaagagtcagtctctgcattattccatattgaattccttaattatgtatctctgtataataaaaggaaaagtgctgacagaatgcagtagaaaaatctaaattcttttcttgcaataaatgtgacacagattgtataaagcaatatttttgcccttgaaatgtttagaagcattgacattctgtccactaaattgtcagcttgtctttaaggttagagcttct

SEQ ID NO: 329903 - DNA, 437 bp, Homo sapiens
cccgccagctaataaacacctgggtcctgtcactgctaacagaaaacttacggcaattggaagagagtggccatgtatttccgaagctctagattgtaacattccaaaaataaaaacctagagttggggaggaccaaaagaggctgccttttaaaatcaaccctaagtcccaacatcaccgttcacaagatggtaacatcactggtgctggcggaacgcaggtcagctatattttcactaattccctctattcccaagtggtgagagaagctaagtgtttgcggcagttagcaggttcaaggacatttactgcataataaactgcgagcttagccattgcttctgatttggggggatctctttaccaccaatcaagaacttgactttcagtttgtagacaagttcttgagtggtggcatcgataaacaccgggtacc

SEQ ID NO: 329904 - DNA, 339 bp, Homo sapiens
ggagagaatggctacactgctgctgaatccaaagcccaccctggaggggaagcaggcggcggccacctctgctgctcacgtcgcggggcctgcctctctgcctctctgctgctcctcctggcaactgtggcggccctcatcgccttggtcaccattcttggactcccatcatgcaccccaggagcccaagcttgtataacactgacaaacaggacaggcttcttgtgccatgaccagaggagctgcattccagccagtggggtctgtgatggcgttcgcacctgtacccacggcgaggacgaggatgagagcttgtgccgtgagtacccgctcggtgct

SEQ ID NO: 329905 - DNA, 460 bp, Homo sapiens
gggaaggggaaacagaaacaataggacaaataggaagcatgtgttaagatatagatttaaacccaaatatatcagaaattacattaaatgtaaaggtaaagatttcagttaagagtcaaagaatctcaaagtatgtaaaaagattaaaaacccaactctaggccaggcgaggtggctcacacctgtaatctcagcactttgggaggccgaggcaggcggatcaactgaggtcaggagttcgagaccagcctggccaacatggcgaaaccccgtctctactaaaaatacaaaaaaattagccaggcgtggtgttggtcacctgtaatcccagctacttgggaggctgaggcaagagaatcgcttgaacccgggagtcggaggttgcagtgagctgaggtagtgctgttgcactccagcctgcgcgatagagcaggactgcatctcaaaaaaaaaaaaaaag

SEQ ID NO: 329906 - DNA, 197 bp, Homo sapiens
atataagtcaatctgatcccaatttacagttttagtctgacattcacagggcatctgagtaattatttgtacgtgtaaacattcacatttattagaaatatcagaaccagaaagttaaggaatatattctagacattaaaaataatgccttatttacattgtatatagtagttgcttgataaatatttgctagatgg

SEQ ID NO: 329907 - DNA, 108 bp, Homo sapiens
tttttctatcacaatttccctaccctttccctgtcctcactaaccttccttccttccagccaattcaaaccccattttcctttccctcaccaatttcccccaactcca

SEQ ID NO: 329908 - DNA, 360 bp, Homo sapiens
gtcctctatatcctggctaatggaaatggcaatgaaacccacaaggtagtaaaccataagctgtttgttccttaggaaatgggtaaagaacactgcacagaaggcacaagagattcttactgagaccctcaaattgggaattccgactttctggttaagtttttctgcccttcctgggacccctaaaaacatcgagctgtcggaggaagcagtgagtagtaccctccagtttttgttttttagacagtttagctcttgttgcccaggctggcgtgcaatggcacaatattggctcactgtgacctgtgcctcccaggttcaagcaattctgtctcagcctcccaagtagctgggattaca

SEQ ID NO: 329909 - DNA, 241 bp, Homo sapiens
gtcactgacatcgaacacctttaaacatccactgtcagcaaaatatcagtcaccgtttgaattattggcagaacggagtgaactcacagtgagcgagcagtcagtggacatgtcggaggtgcataacatccgaaagttatttaaaataaaccaaatgtgtttgttaattgaggagagtggacgacaaatggggaacgggtgggcgtgggtgagtgagtccgtggtggtgttgacggccaca

SEQ ID NO: 329910 - DNA, 424 bp, Homo sapiens
atactctgcatgctgcatactcttagttttctgttgtattcttttccattattttttaaatgctgggtcatggcttaaacttctcccttgccattcatttgattgttaacagaccataacagctatttggtggcttagccaaagaacctgcaaacacgtggggccatgatggggctaaaaggcaagattgaccttggaaagctaagattttattcttatcagtggttcatatacagcaaggtttcttagtgtcagctctactgacattttcttgtaggaaactgtcctgtgttgtagtatggttagcggcatctctggcctctaccaagtaccatccccccacccccagttgtgacaacaaaaaatgtcttcaggcattgctagtttctttgtattctttgtagtcttcttcccacttaaattg

SEQ ID NO: 329911 - DNA, 1792 bp, Homo sapiens
agcccgggggcgtgtcctggtgctggccgcacccgcgccccgccccgccccgcccggtcgcggagctgcggccagctttgggagggccggccccgggatgctacacacaacccagctgtaccagcatgtgccagagacacgctggccaatcgtgtactcgccgcgctacaacatcaccttcatgggcctggagaagctgcatccctttgatgccggaaaatggggcaaagtgatcaatttcctaaaagaagagaagcttctgtctgacagcatgctggtggaggcgcgggaggcctcggaggaggacctgctggtggtgcacacgaggcgctatcttaatgagctcaagtggtcctttgctgttgctaccatcacagaaatcccccccgttatcttcctccccaacttccttgtgcagaggaaggtgctgaggccccttcggacccagacaggaggaaccataatggcggggaagctggctgtggagcgaggctgggccatcaacgtggggggtggcttccaccactgctccagcgaccgtggcgggggcttctgtgcctatgcggacatcacgctcgccatcaagtttctgtttgagcgtgtggagggcatctccagggctaccatcattgatcttgatgcccatcagggcaatgggcatgagcgagacttcatggacgacaagcgtgtgtacatcatggatgtctacaaccgccacatctacccaggggaccgctttgccaagcaggccatcaggcggaaggtggagctggagtggggcacagaggatgatgagtacctggataaggtggagaggaacatcaagaaatccctccaggagcacctgcccgacgtggtggtatacaatgcaggcaccgacatcctcgagggggaccgccttggggggctgtccatcagcccagcgggcatcgtgaagcgggatgagctggtgttccggatggtccgtggccgccgggtgcccatccttatggtgacctcaggcgggtaccagaagcgcacagcccgcatcattgctgactccatacttaatctgtttggcctggggctcattgggcctgagtcacccagcgtctccgcacagaactcagacacaccgctgcttccccctgcagtgccctgacccttgctgccctgcctgtcacgtggccctgcctatccgccccttagtgctttttgttttctaacctcatggggtggtggaggcagccttcagtgagcatggaggggcagggccatccctggctggggcctggagctggcccttcctctacttttccctgctggaagccagaagggcttgaggcctctatgggtgggggcagaaggcagagcctgtgtcccagggggacccacacgaagtcaccagcccataggtccagggaggcaggcagttaactgagaattggagaggacaggctaggtcccaggcacagcgagggccctgggcttggggtgttctggttttgagaacggcagacccaggtcggagtgaggaagcttccacctccatcctgactaggcctgcatcctaactgggcctccctccctccccttggtcatgggatttgctgccctctttgccccagagctgaagagctataggcactggtgtggatggcccaggaggtgctggagctaggtctccaggtgggcctggttcccaggcagcaggtgggaaccctgggcctggatgtgaggggcggtcaggaaggggtacaggtgggttccctcatctggagttccccctcaataaagcaaggtctggacctgc

SEQ ID NO: 329912 - DNA, 2874 bp, Homo sapiens
agcccgggggcgtgtcctggtgctggccgcacccgcgccccgccccgccccgcccggtcgcggagctgcggccagctttgggagggccggccccgggatgctacacacaacccagctgtaccagcatgtgccagagacacgctggccaatcgtgtactcgccgcgctacaacatcaccttcatgggcctggagaagctgcatccctttgatgccggaaaatggggcaaagtgatcaatttcctaaaagaagagaagcttctgtctgacagcatgctggtggaggcgcgggaggcctcggaggaggacctgctggtggtgcacacgaggcgctatcttaatgagctcaagtggtcctttgctgttgctaccatcacagaaatcccccccgttatcttcctccccaacttccttgtgcagaggaaggtgctgaggccccttcggacccagacaggaggaaccataatggcggggaagctggctgtggagcgaggctgggccatcaacgtggggggtggcttccaccactgctccagcgaccgtggcgggggcttctgtgcctatgcggacatcacgctcgccatcaagtttctgtttgagcgtgtggagggcatctccagggctaccatcattgatcttgatgcccatcagggcaatgggcatgagcgagacttcatggacgacaagcgtgtgtacatcatggatgtctacaaccgccacatctacccaggggaccgctttgccaagcaggccatcaggcggaaggtggagctggagtggggcacagaggatgatgagtacctggataaggtggagaggaacatcaagaaatccctccaggagcacctgcccgacgtggtggtatacaatgcaggcaccgacatcctcgagggggaccgccttggggggctgtccatcagcccagcgggcatcgtgaagcgggatgagctggtgttccggatggtccgtggccgccgggtgcccatccttatggtgacctcaggcgggtaccagaagcgcacagcccgcatcattgctgactccatacttaatctgtttggcctggggctcattgggcctgagtcacccagcgtctccgcacagaactcagacacaccgctgcttccccctgcagtgccctgacccttgctgccctgcctgtcacgtggccctgcctatccgccccttagtgctttttgttttctaacctcatggggtggtggaggcagccttcagtgagcatggaggggcagggccatccctggctggggcctggagctggcccttcctctacttttccctgctggaagccagaagggcttgaggcctctatgggtgggggcagaaggcagagcctgtgtcccagggggacccacacgaagtcaccagcccataggtccagggaggcaggcagttaactgagaattggagaggacaggctaggtcccaggcacagcgagggccctgggcttggggtgttctggttttgagaacggcagacccaggtcggagtgaggaagcttccacctccatcctgactaggcctgcatcctaactgggcctccctccctccccttggtcatgggatttgctgccctctttgccccagagctgaagagctataggcactggtgtggatggcccaggaggtgctggagctaggtctccaggtgggcctggttcccaggcagcaggtgggaaccctgggcctggatgtgaggggcggtcaggaaggggtacaggtgggttccctcatctggagttccccctcaataaagcaaggtctggacctgccttcccaggcccttctgtgggggtgaaggtggggaaggcctgcggcgcccagatcactgccttagcagtagtcttgcctgttcagtgcaaggggcaggttttggggggaggaattcttagcgcaaggacgggcctcagccctgtcgcctccagggggccgctgacccaggtggggagagggcagaagaagggtgggggacgtgggcaggccaggctcacaggtggaaatcagggatgcagggtggtgcccaagccaggtcctgcaggaacccaggcccagggagggacccagacactggtgaggcggggcaggggttcctggagagagggcagcgaggatctctatcctggcctggggattatgaacataggtagccggggcagggccctgggtgggactgtggcctccactggcctcaccaaagtgcctgggccccaatccttctccatgcccaggggccccaggtgggccagacctctggcctgttcctcagccctactcatggggacattcagggacctccaggaagtgggcgggggagcatccacccctgctagccggcagctgtggccctgatcaaatcaggggctggggagggaaagtgggtccattgaggtggccctgctccatcagccccctacgggacttgtgttcattacagtgagggggtgctcccactgtctcccggcctccctaatgctccctctgctgcagggagaagggttccaagatcacaaaatgtcaacaatgctggcctcctggaccagaccccgaggctctaacaatgcactctgagatccctacccttgccgttggtctctgtcgctgactcgaggcacctaacatccattcacacccaacacaggccagcgacttctggggctcagccacagacatggtttgtcactgttgagcttctgttcctagagaatcctagaggcttgattggcccaggctgctgtgtgtgctggaggcaaagaatccctacctcctaggggtgaaaggaaatgaaaatggaaagttcttgtagcgcaaggcctgacatgggtagctgctcaataaatgctagtgtgttatttca

SEQ ID NO: 329913 - DNA, 2574 bp, Homo sapiens
agcccgggggcgtgtcctggtgctggccgcacccgcgccccgccccgccccgcccggtcgcggagctgcggccagctttgggagggccggccccgggatgctacacacaacccagctgtaccagcatgtgccagagacacgctggccaatcgtgtactcgccgcgctacaacatcaccttcatgggcctggagaagctgcatccctttgatgccggaaaatggggcaaagtgatcaatttcctaaaagaagagaagcttctgtctgacagcatgctggtggaggcgcgggaggcctcggaggaggacctgctggtggtgcacacgaggcgctatcttaatgagctcaagggcaatgggcatgagcgagacttcatggacgacaagcgtgtgtacatcatggatgtctacaaccgccacatctacccaggggaccgctttgccaagcaggccatcaggcggaaggtggagctggagtggggcacagaggatgatgagtacctggataaggtggagaggaacatcaagaaatccctccaggagcacctgcccgacgtggtggtatacaatgcaggcaccgacatcctcgagggggaccgccttggggggctgtccatcagcccagcgggcatcgtgaagcgggatgagctggtgttccggatggtccgtggccgccgggtgcccatccttatggtgacctcaggcgggtaccagaagcgcacagcccgcatcattgctgactccatacttaatctgtttggcctggggctcattgggcctgagtcacccagcgtctccgcacagaactcagacacaccgctgcttccccctgcagtgccctgacccttgctgccctgcctgtcacgtggccctgcctatccgccccttagtgctttttgttttctaacctcatggggtggtggaggcagccttcagtgagcatggaggggcagggccatccctggctggggcctggagctggcccttcctctacttttccctgctggaagccagaagggcttgaggcctctatgggtgggggcagaaggcagagcctgtgtcccagggggacccacacgaagtcaccagcccataggtccagggaggcaggcagttaactgagaattggagaggacaggctaggtcccaggcacagcgagggccctgggcttggggtgttctggttttgagaacggcagacccaggtcggagtgaggaagcttccacctccatcctgactaggcctgcatcctaactgggcctccctccctccccttggtcatgggatttgctgccctctttgccccagagctgaagagctataggcactggtgtggatggcccaggaggtgctggagctaggtctccaggtgggcctggttcccaggcagcaggtgggaaccctgggcctggatgtgaggggcggtcaggaaggggtacaggtgggttccctcatctggagttccccctcaataaagcaaggtctggacctgccttcccaggcccttctgtgggggtgaaggtggggaaggcctgcggcgcccagatcactgccttagcagtagtcttgcctgttcagtgcaaggggcaggttttggggggaggaattcttagcgcaaggacgggcctcagccctgtcgcctccagggggccgctgacccaggtggggagagggcagaagaagggtgggggacgtgggcaggccaggctcacaggtggaaatcagggatgcagggtggtgcccaagccaggtcctgcaggaacccaggcccagggagggacccagacactggtgaggcggggcaggggttcctggagagagggcagcgaggatctctatcctggcctggggattatgaacataggtagccggggcagggccctgggtgggactgtggcctccactggcctcaccaaagtgcctgggccccaatccttctccatgcccaggggccccaggtgggccagacctctggcctgttcctcagccctactcatggggacattcagggacctccaggaagtgggcgggggagcatccacccctgctagccggcagctgtggccctgatcaaatcaggggctggggagggaaagtgggtccattgaggtggccctgctccatcagccccctacgggacttgtgttcattacagtgagggggtgctcccactgtctcccggcctccctaatgctccctctgctgcagggagaagggttccaagatcacaaaatgtcaacaatgctggcctcctggaccagaccccgaggctctaacaatgcactctgagatccctacccttgccgttggtctctgtcgctgactcgaggcacctaacatccattcacacccaacacaggccagcgacttctggggctcagccacagacatggtttgtcactgttgagcttctgttcctagagaatcctagaggcttgattggcccaggctgctgtgtgtgctggaggcaaagaatccctacctcctaggggtgaaaggaaatgaaaatggaaagttcttgtagcgcaaggcctgacatgggtagctgctcaataaatgctagtgtgttatttca

SEQ ID NO: 329914 - DNA, 3920 bp, Homo sapiens
agcccgggggcgtgtcctggtgctggccgcacccgcgccccgccccgccccgcccggtcgcggagctgcggccagctttgggagggccggccccgggatgtgagtgccgcggggcgagggcgggggtgggctcccagggtcccggtgggcgggcgcgctagggcgagggcggggacggccgggcgggcgcgccaggctacacacaacccagctgtaccagcatgtgccagagacacgctggccaatcgtgtactcgccgcgctacaacatcaccttcatgggcctggagaagctgcatccctttgatgccggaaaatggggcaaagtgatcaatttcctaaaagaagagaagcttctgtctgacagcatgctggtggaggcgcgggaggcctcggaggaggacctgctggtggtgcacacgaggcgctatcttaatgagctcaagtggtcctttgctgttgctaccatcacagaaatcccccccgttatcttcctccccaacttccttgtgcagaggaaggtgctgaggccccttcggacccagacaggaggaaccataatggcggggaagctggctgtggagcgaggctgggccatcaacgtggggggtggcttccaccactgctccagcgaccgtggcgggggcttctgtgcctatgcggacatcacgctcgccatcaagtttctgtttgagcgtgtggagggcatctccagggctaccatcattgatcttgatgcccatcaggtgagtgccctgcaggggctggactcttaggggacctgccacccccagttccagaatcttcccggggcaggagagtctccctcctcatgtccccacggctctcacggcttctgtcttctgtctctcgggctacaaatgcagggtctgtctttgtcactctgtccaggacagcgggtcctcctcattgctcccgagggtcctccctccctcctcctgactgcccccacatgaggctcttcctgaagcccactctgatgggactgctctcgtgtgcagagctctgctgtgggtccccattgcttatgaataatttggggcactgccccctgcccagagctgctgagcactggccacctgcccctcaggcggatgcccacacacatggcttggctcgggcacctggggtcaccatttaagaactcggcgcctagggagtaaagtgtcaaagcagagggttacctcctcctcaggacccctaatgaggccagtgcctctggtcagacagggaggggacccagtgggctccggaaggcacccccctgcaccattactgctgtggctttgtgctagttggggccctgccttgggttcttgcgaccccgaactcctgagccaggtcacatgtggacagtcctttacagtttgcttttcacatccctgatcccaaccagtcccaccacagacttgagagggtggcagagcgggatttcttcctctgatagggaacctaagagcactgggcttgctcaagcccatgctagaaggtgtcggggcctggttttaaggttgaatcccagctctgccccttaacagtcatgagacctgctgcccccgagagcaggccgtgctgccctggcaaatggggagtttcctgaggggtgggtgggtggcagagccccagccttgcctagggcacctacccgagagcggctactgtgacctccccacagggcaatgggcatgagcgagacttcatggacgacaagcgtgtgtacatcatggatgtctacaaccgccacatctacccaggggaccgctttgccaagcaggccatcaggcggaaggtggagctggagtggggcacagaggatgatgagtacctggataaggtggagaggaacatcaagaaatccctccaggagcacctgcccgacgtggtggtatacaatgcaggcaccgacatcctcgagggggaccgccttggggggctgtccatcagcccagcgggcatcgtgaagcgggatgagctggtgttccggatggtccgtggccgccgggtgcccatccttatggtgacctcaggcgggtaccagaagcgcacagcccgcatcattgctgactccatacttaatctgtttggcctggggctcattgggcctgagtcacccagcgtctccgcacagaactcagacacaccgctgcttccccctgcagtgccctgacccttgctgccctgcctgtcacgtggccctgcctatccgccccttagtgctttttgttttctaacctcatggggtggtggaggcagccttcagtgagcatggaggggcagggccatccctggctggggcctggagctggcccttcctctacttttccctgctggaagccagaagggcttgaggcctctatgggtgggggcagaaggcagagcctgtgtcccagggggacccacacgaagtcaccagcccataggtccagggaggcaggcagttaactgagaattggagaggacaggctaggtcccaggcacagcgagggccctgggcttggggtgttctggttttgagaacggcagacccaggtcggagtgaggaagcttccacctccatcctgactaggcctgcatcctaactgggcctccctccctccccttggtcatgggatttgctgccctctttgccccagagctgaagagctataggcactggtgtggatggcccaggaggtgctggagctaggtctccaggtgggcctggttcccaggcagcaggtgggaaccctgggcctggatgtgaggggcggtcaggaaggggtacaggtgggttccctcatctggagttccccctcaataaagcaaggtctggacctgccttcccaggcccttctgtgggggtgaaggtggggaaggcctgcggcgcccagatcactgccttagcagtagtcttgcctgttcagtgcaaggggcaggttttggggggaggaattcttagcgcaaggacgggcctcagccctgtcgcctccagggggccgctgacccaggtggggagagggcagaagaagggtgggggacgtgggcaggccaggctcacaggtggaaatcagggatgcagggtggtgcccaagccaggtcctgcaggaacccaggcccagggagggacccagacactggtgaggcggggcaggggttcctggagagagggcagcgaggatctctatcctggcctggggattatgaacataggtagccggggcagggccctgggtgggactgtggcctccactggcctcaccaaagtgcctgggccccaatccttctccatgcccaggggccccaggtgggccagacctctggcctgttcctcagccctactcatggggacattcagggacctccaggaagtgggcgggggagcatccacccctgctagccggcagctgtggccctgatcaaatcaggggctggggagggaaagtgggtccattgaggtggccctgctccatcagccccctacgggacttgtgttcattacagtgagggggtgctcccactgtctcccggcctccctaatgctccctctgctgcagggagaagggttccaagatcacaaaatgtcaacaatgctggcctcctggaccagaccccgaggctctaacaatgcactctgagatccctacccttgccgttggtctctgtcgctgactcgaggcacctaacatccattcacacccaacacaggccagcgacttctggggctcagccacagacatggtttgtcactgttgagcttctgttcctagagaatcctagaggcttgattggcccaggctgctgtgtgtgctggaggcaaagaatccctacctcctaggggtgaaaggaaatgaaaatggaaagttcttgtagcgcaaggcctgacatgggtagctgctcaataaatgctagtgtgttatttca

SEQ ID NO: 329915 - DNA, 2376 bp, Homo sapiens
agcccgggggcgtgtcctggtgctggccgcacccgcgccccgccccgccccgcccggtcgcggagctgcggccagctttgggagggccggccccgggatgctacacacaacccagctgtaccagcatgtgccagagacacgctggccaatcgtgtactcgccgcgctacaacatcaccttcatgggcctggagaagctgcatccctttgatgccggaaaatggggcaaagtgatcaatttcctaaaagaggccatcaggcggaaggtggagctggagtggggcacagaggatgatgagtacctggataaggtggagaggaacatcaagaaatccctccaggagcacctgcccgacgtggtggtatacaatgcaggcaccgacatcctcgagggggaccgccttggggggctgtccatcagcccagcgggcatcgtgaagcgggatgagctggtgttccggatggtccgtggccgccgggtgcccatccttatggtgacctcaggcgggtaccagaagcgcacagcccgcatcattgctgactccatacttaatctgtttggcctggggctcattgggcctgagtcacccagcgtctccgcacagaactcagacacaccgctgcttccccctgcagtgccctgacccttgctgccctgcctgtcacgtggccctgcctatccgccccttagtgctttttgttttctaacctcatggggtggtggaggcagccttcagtgagcatggaggggcagggccatccctggctggggcctggagctggcccttcctctacttttccctgctggaagccagaagggcttgaggcctctatgggtgggggcagaaggcagagcctgtgtcccagggggacccacacgaagtcaccagcccataggtccagggaggcaggcagttaactgagaattggagaggacaggctaggtcccaggcacagcgagggccctgggcttggggtgttctggttttgagaacggcagacccaggtcggagtgaggaagcttccacctccatcctgactaggcctgcatcctaactgggcctccctccctccccttggtcatgggatttgctgccctctttgccccagagctgaagagctataggcactggtgtggatggcccaggaggtgctggagctaggtctccaggtgggcctggttcccaggcagcaggtgggaaccctgggcctggatgtgaggggcggtcaggaaggggtacaggtgggttccctcatctggagttccccctcaataaagcaaggtctggacctgccttcccaggcccttctgtgggggtgaaggtggggaaggcctgcggcgcccagatcactgccttagcagtagtcttgcctgttcagtgcaaggggcaggttttggggggaggaattcttagcgcaaggacgggcctcagccctgtcgcctccagggggccgctgacccaggtggggagagggcagaagaagggtgggggacgtgggcaggccaggctcacaggtggaaatcagggatgcagggtggtgcccaagccaggtcctgcaggaacccaggcccagggagggacccagacactggtgaggcggggcaggggttcctggagagagggcagcgaggatctctatcctggcctggggattatgaacataggtagccggggcagggccctgggtgggactgtggcctccactggcctcaccaaagtgcctgggccccaatccttctccatgcccaggggccccaggtgggccagacctctggcctgttcctcagccctactcatggggacattcagggacctccaggaagtgggcgggggagcatccacccctgctagccggcagctgtggccctgatcaaatcaggggctggggagggaaagtgggtccattgaggtggccctgctccatcagccccctacgggacttgtgttcattacagtgagggggtgctcccactgtctcccggcctccctaatgctccctctgctgcagggagaagggttccaagatcacaaaatgtcaacaatgctggcctcctggaccagaccccgaggctctaacaatgcactctgagatccctacccttgccgttggtctctgtcgctgactcgaggcacctaacatccattcacacccaacacaggccagcgacttctggggctcagccacagacatggtttgtcactgttgagcttctgttcctagagaatcctagaggcttgattggcccaggctgctgtgtgtgctggaggcaaagaatccctacctcctaggggtgaaaggaaatgaaaatggaaagttcttgtagcgcaaggcctgacatgggtagctgctcaataaatgctagtgtgttatttca

SEQ ID NO: 329916 - DNA, 751 bp, Homo sapiens
aggatatctatacttgcgtggcgggaaaaaaaaaaaaaaaggaaccggcagagggccctgggtgggactgtggcctccactggcctcaccaaagtgcctgggccccaatccttctccatgcccaggggccccaggtgggccagacctctggcctgttcctcagccctactcatggggacattcagggacctccaggaagtgggcgggggagcatccacccctgctagccggcagctgtggccctgatcaaatcaggggctggggagggaaagtgggtccattgaggtggccctgctccatcagccccctacgggacttgtgttcattacagtgagggggtgctcccactgtctcccggcctccctaatgctccctctgctgcagggagaagggttccaagatcacaaaatgtcaacaatgctggcctcctggaccagaccccgaggctctaacaatgcactctgagatccctacccttgccgttggtctctgtcgctgactcgaggcacctaacatccattcacacccaacacaggccagcgacttctggggctcagccacagacatggtttgtcactgttgagcttctgttcctagagaatcctagaggcttgattggcccaggctgctgtgtgtgctggaggcaaagaatccctacctcctaggggtgaaaggaaatgaaaatggaaagttcttgtagcgcaaggcctgacatgggtagctgctcaataaatgctagtgtgttatttca

SEQ ID NO: 329917 - DNA, 2016 bp, Homo sapiens
agcccgggggcgtgtcctggtgctggccgcacccgcgccccgccccgccccgcccggtcgcggagctgcggccagctttgggagggccggccccgggatgtgagtgccgcggggcgagggcgggggtgggctcccagggtcccggtgggcgggcgcgctagggcgagggcggggacggccgggcgggcgcgccaggctacacacaacccagctgtaccagcatgtgccagagacacgctggccaatcgtgtactcgccgcgctacaacatcaccttcatgggcctggagaagctgcatccctttgatgccggaaaatggggcaaagtgatcaatttcctaaaagaagagaagcttctgtctgacagcatgctggtggaggcgcgggaggcctcggaggaggacctgctggtggtgcacacgaggcgctatcttaatgagctcaagtggtcctttgctgttgctaccatcacagaaatcccccccgttatcttcctccccaacttccttgtgcagaggaaggtgctgaggccccttcggacccagacaggaggaaccataatggcggggaagctggctgtggagcgaggctgggccatcaacgtggggggtggcttccaccactgctccagcgaccgtggcgggggcttctgtgcctatgcggacatcacgctcgccatcaagtttctgtttgagcgtgtggagggcatctccagggctaccatcattgatcttgatgcccatcaggtgagtgccctgcaggggctggactcttaggggacctgccacccccagttccagaatcttcccggggcaggagagtctccctcctcatgtccccacggctctcacggcttctgtcttctgtctctcgggctacaaatgcagggtctgtctttgtcactctgtccaggacagcgggtcctcctcattgctcccgagggtcctccctccctcctcctgactgcccccacatgaggctcttcctgaagcccactctgatgggactgctctcgtgtgcagagctctgctgtgggtccccattgcttatgaataatttggggcactgccccctgcccagagctgctgagcactggccacctgcccctcaggcggatgcccacacacatggcttggctcgggcacctggggtcaccatttaagaactcggcgcctagggagtaaagtgtcaaagcagagggttacctcctcctcaggacccctaatgaggccagtgcctctggtcagacagggaggggacccagtgggctccggaaggcacccccctgcaccattactgctgtggctttgtgctagttggggccctgccttgggttcttgcgaccccgaactcctgagccaggtcacatgtggacagtcctttacagtttgcttttcacatccctgatcccaaccagtcccaccacagacttgagagggtggcagagcgggatttcttcctctgatagggaacctaagagcactgggcttgctcaagcccatgctagaaggtgtcggggcctggttttaaggttgaatcccagctctgccccttaacagtcatgagacctgctgcccccgagagcaggccgtgctgccctggcaaatggggagtttcctgaggggtgggtgggtggcagagccccagccttgcctagggcacctacccgagagcggctactgtgacctccccacagggcaatgggcatgagcgagacttcatggacgacaagcgtgtgtacatcatggatgtctacaaccgccacatctacccaggggaccgctttgccaagcgtaagctgctgcccctaccctcatcttgggtgtgtccttgtggatgaggctctctcctgagtgtctcctgtctgctaggccctgcagaagccactgcagtggttcatagcatccctgtgaggtgatcctttccattttacagatgaggaaaccgagacctggagaagtcactcgacccacccaagatcacataacccttacaataaacatgcatttgtctggca

SEQ ID NO: 329918 - DNA, 280 bp, Homo sapiens
tcactgttgagcttctgttcctagagaatcctagaggcttgattggcccaggctgctgtgtgtgctggaggcaaagaatccctacctcctaggggtgaaaggaaatgaaaatggaaagttcttgtagcgcaaggcctgacatgggtagctgctcaataaatgctagtgtgttatttcatcttctgagtcctgtggagttggtaatgattcccatttcacagatgaggaaactgaggcttggcaggggtgagaaatttgccccaggccacacctcccagca

SEQ ID NO: 329919 - DNA, 373 bp, Homo sapiens
cctgagtcaccctcctcttcccctaacagggcatcgtgaagcgggatgagctggtgttccggatggtccgtggccgccgggtgcccatccttatggtgacctcaggcgggtaccagaagcgcacagcccgcatcattgctgactccatacttaatctgtttggcctggggctcattgggcctgagtcacccagcgtctccgcacagaactcagacacaccgctgcttccccctgcagtgccctgacccttgctgccctgcctgtcacgtggccctgcctatccgccccttagtgctttttgttttctaacctcatggggtggtggaggcagccttcagtgagcatggaggggcagggccatccctggctgggg

SEQ ID NO: 329920 - DNA, 678 bp, Homo sapiens
atgccctccacgctgcttcggttgcatcttaagggccaagtgttgacgacagggggcagagggctggagcagcgcactagggcctggcagagcagaaacggcacgagaagcacaggcaagttcgacttcgcgccatccctgaccaccgaagagaccagcgcgagaaaagtcccggcagccagcgatcgccgagttgttctgattgggataattcagaaattcctaatattatctttcggcagaatggccaccctaaaacaaatactgaatgcctttaaaaaaaaaaaaagttgtggttttttgtttttttttttttttttttttggtcgagaactactaatttcatgctatttctttctctctccctttgttgttatttgatttgggggaagggagtgaggcttgtgcagatttgagctatctgaagacatgaacagaagtcaaataccagccatatcagtagagccttccattcaaaagtgaacacacttggtagctgaaccatatctgagcagcgtgattctgttgtcttgcatatgttattctctcaggctgctgtgtgtgctggaggcaaagaatccctacctcctaggggtgaaaggaaatgaaaatggaaagttcttgtagcgcaaggcctgacatgggtagctgctcaataaatgctagtgtgttatttca

SEQ ID NO: 329921 - DNA, 2970 bp, Homo sapiens
agcccgggggcgtgtcctggtgctggccgcacccgcgccccgccccgccccgcccggtcgcggagctgcggccagctttgggagggccggccccgggatgtgagtgccgcggggcgagggcgggggtgggctcccagggtcccggtgggcgggcgcgctagggcgagggcggggacggccgggcgggcgcgccaggctacacacaacccagctgtaccagcatgtgccagagacacgctggccaatcgtgtactcgccgcgctacaacatcaccttcatgggcctggagaagctgcatccctttgatgccggaaaatggggcaaagtgatcaatttcctaaaagaagagaagcttctgtctgacagcatgctggtggaggcgcgggaggcctcggaggaggacctgctggtggtgcacacgaggcgctatcttaatgagctcaagtggtcctttgctgttgctaccatcacagaaatcccccccgttatcttcctccccaacttccttgtgcagaggaaggtgctgaggccccttcggacccagacaggaggaaccataatggcggggaagctggctgtggagcgaggctgggccatcaacgtggggggtggcttccaccactgctccagcgaccgtggcgggggcttctgtgcctatgcggacatcacgctcgccatcaagtttctgtttgagcgtgtggagggcatctccagggctaccatcattgatcttgatgcccatcagggcaatgggcatgagcgagacttcatggacgacaagcgtgtgtacatcatggatgtctacaaccgccacatctacccaggggaccgctttgccaagcaggccatcaggcggaaggtggagctggagtggggcacagaggatgatgagtacctggataaggtggagaggaacatcaagaaatccctccaggagcacctgcccgacgtggtggtatacaatgcaggcaccgacatcctcgagggggaccgccttggggggctgtccatcagcccagcgggcatcgtgaagcgggatgagctggtgttccggatggtccgtggccgccgggtgcccatccttatggtgacctcaggcgggtaccagaagcgcacagcccgcatcattgctgactccatacttaatctgtttggcctggggctcattgggcctgagtcacccagcgtctccgcacagaactcagacacaccgctgcttccccctgcagtgccctgacccttgctgccctgcctgtcacgtggccctgcctatccgccccttagtgctttttgttttctaacctcatggggtggtggaggcagccttcagtgagcatggaggggcagggccatccctggctggggcctggagctggcccttcctctacttttccctgctggaagccagaagggcttgaggcctctatgggtgggggcagaaggcagagcctgtgtcccagggggacccacacgaagtcaccagcccataggtccagggaggcaggcagttaactgagaattggagaggacaggctaggtcccaggcacagcgagggccctgggcttggggtgttctggttttgagaacggcagacccaggtcggagtgaggaagcttccacctccatcctgactaggcctgcatcctaactgggcctccctccctccccttggtcatgggatttgctgccctctttgccccagagctgaagagctataggcactggtgtggatggcccaggaggtgctggagctaggtctccaggtgggcctggttcccaggcagcaggtgggaaccctgggcctggatgtgaggggcggtcaggaaggggtacaggtgggttccctcatctggagttccccctcaataaagcaaggtctggacctgccttcccaggcccttctgtgggggtgaaggtggggaaggcctgcggcgcccagatcactgccttagcagtagtcttgcctgttcagtgcaaggggcaggttttggggggaggaattcttagcgcaaggacgggcctcagccctgtcgcctccagggggccgctgacccaggtggggagagggcagaagaagggtgggggacgtgggcaggccaggctcacaggtggaaatcagggatgcagggtggtgcccaagccaggtcctgcaggaacccaggcccagggagggacccagacactggtgaggcggggcaggggttcctggagagagggcagcgaggatctctatcctggcctggggattatgaacataggtagccggggcagggccctgggtgggactgtggcctccactggcctcaccaaagtgcctgggccccaatccttctccatgcccaggggccccaggtgggccagacctctggcctgttcctcagccctactcatggggacattcagggacctccaggaagtgggcgggggagcatccacccctgctagccggcagctgtggccctgatcaaatcaggggctggggagggaaagtgggtccattgaggtggccctgctccatcagccccctacgggacttgtgttcattacagtgagggggtgctcccactgtctcccggcctccctaatgctccctctgctgcagggagaagggttccaagatcacaaaatgtcaacaatgctggcctcctggaccagaccccgaggctctaacaatgcactctgagatccctacccttgccgttggtctctgtcgctgactcgaggcacctaacatccattcacacccaacacaggccagcgacttctggggctcagccacagacatggtttgtcactgttgagcttctgttcctagagaatcctagaggcttgattggcccaggctgctgtgtgtgctggaggcaaagaatccctacctcctaggggtgaaaggaaatgaaaatggaaagttcttgtagcgcaaggcctgacatgggtagctgctcaataaatgctagtgtgttatttca

SEQ ID NO: 329922 - DNA, 1706 bp, Homo sapiens
agcccgggggcgtgtcctggtgctggccgcacccgcgccccgccccgccccgcccggtcgcggagctgcggccagctttgggagggccggccccgggatgctacacacaacccagctgtaccagcatgtgccagagacacgctggccaatcgtgtactcgccgcgctacaacatcaccttcatgggcctggagaagctgcatccctttgatgccggaaaatggggcaaagtgatcaatttcctaaaagaagagaagcttctgtctgacagcatgctggtggaggcgcgggaggcctcggaggaggacctgctggtggtgcacacgaggcgctatcttaatgagctcaagtggtcctttgctgttgctaccatcacagaaatcccccccgttatcttcctccccaacttccttgtgcagaggaaggtgctgaggccccttcggacccagacaggaggaaccataatggcggggaagctggctgtggagcgaggctgggccatcaacgtggggggtggcttccaccactgctccagcgaccgtggcgggggcttctgtgcctatgcggacatcacgctcgccatcaagtttctgtttgagcgtgtggagggcatctccagggctaccatcattgatcttgatgcccatcagggcaatgggcatgagcgagacttcatggacgacaagcgtgtgtacatcatggatgtctacaaccgccacatctacccaggggaccgctttgccaagcaggccatcaggcggaaggtggagctggagtggggcacagaggatgatgagtacctggataaggtggagaggaacatcaagaaatccctccaggagcacctgcccgacgtggtggtatacaatgcaggcaccgacatcctcgagggggaccgccttggggggctgtccatcagcccagcgggcatcgtgaagcgggatgagctggtgttccggatggtccgtggccgccgggtgcccatccttatggtgacctcaggcgggtaccagaagcgcacagcccgcatcattgctgactccatacttaatctgtttggcctggggctcattgggcctgagtcacccagcgtctccgcacagaactcagacacaccgctgcttccccctgcagtgccctgacccttgctgccctgcctgtcacgtggccctgcctatccgccccttagtgctttttgttttctaacctcatggggtggtggaggcagccttcagtgagcatggaggggcagggccatccctggctggggcctggagctggcccttcctctacttttccctgctggaagccagaagggcttgaggcctctatgggtgggggcagaaggcagagcctgtgtcccagggggacccacacgaagtcaccagcccagaccccgaggctctaacaatgcactctgagatccctacccttgccgttggtctctgtcgctgactcgaggcacctaacatccattcacacccaacacaggccagcgacttctggggctcagccacagacatggtttgtcactgttgagcttctgttcctagagaatcctagaggcttgattggcccaggctgctgtgtgtgctggaggcaaagaatccctacctcctaggggtgaaaggaaatgaaaatggaaagttcttgtagcgcaaggcctgacatgggtagctgctcaataaatgctagtgtgttatttca

SEQ ID NO: 329923 - DNA, 1223 bp, Homo sapiens
agcccgggggcgtgtcctggtgctggccgcacccgcgccccgccccgccccgcccggtcgcggagctgcggccagctttgggagggccggccccgggatgctacacacaacccagctgtaccagcatgtgccagagacacgctggccaatcgtgtactcgccgcgctacaacatcaccttcatgggcctggagaagctgcatccctttgatgccggaaaatggggcaaagtgatcaatttcctaaaagaagagaagcttctgtctgacagcatgctggtggaggcgcgggaggcctcggaggaggacctgctggtggtgcacacgaggcgctatcttaatgagctcaagtggtcctttgctgttgctaccatcacagaaatcccccccgttatcttcctccccaacttccttgtgcagaggaaggtgctgaggccccttcggacccagacaggaggaaccataatggcggggaagctggctgtggagcgaggctgggccatcaacgtggggggtggcttccaccactgctccagcgaccgtggcgggggcttctgtgcctatgcggacatcacgctcgccatcaagtttctgtttgagcgtgtggagggcatctccagggctaccatcattgatcttgatgcccatcagggcaatgggcatgagcgagacttcatggacgacaagcgtgtgtacatcatggatgtctacaaccgccacatctacccaggggaccgctttgccaagcaggccatcaggcggaaggtggagctggagtggggcacagaggatgatgagtacctggataaggtggagaggaacatcaagaaatccctccaggagcacctgcccgacgtggtggtatacaatgcaggcaccgacatcctcgagggggaccgccttggggggctgtccatcagcccagcgggcatcgtgaagcgggatgagctggtgttccggatggtccgtggccgccgggtgcccatccttatggtgacctcaggcgggtaccagaagcgcacagcccgcatcattgctgactccatacttaatctgtttggcctggggctcattgggcctgagtcacccagcgtctccgcacagaactcagacacaccccgtcgggtggagcaccccgtcgggtggagcaccccgtcgggtggagcaccccgtcgggtggagcaccccgtcgggtggagcaccccgtcgggtggagcggggatcc

SEQ ID NO: 329924 - DNA, 499 bp, Homo sapiens
ctgacaggtgaatgcacaagcagctcttgcagttgttcaggctcacatgaagccctggacaatgctgtgctgctgtggctgcacctgctaccagccttgacactgcatgttctctatacaaatgctactgctcttgaaggggtaaaactggttcttgggaagacatgagaaaatctcactttagaaaatattaatataggccgggcacggtggctcatgcctgtaatcccagcactttgggaggccgaggcgggcagatcacttgaggtcgggagttctagaccagcctggccaacatggtgaaaccccatctctaccaaaaatacatgtataaaaaattagccgggtatggtggtgcatgcctataatcccagctactcgggaggctgaggcaggagaatcacttgaacccaggaagcgaaagttgcagtgagctgagatcacgccactgcactccagcctgggtgacaagactccatctcaaaaaaaaaaaaaaaaa

SEQ ID NO: 329925 - DNA, 417 bp, Homo sapiens
aagagttgttggtagatgaaactgaaaggaaatccttagtgggaaaagagaaaagctagtgaagagtatgatatgggagctaacagatcaagtgtttagggaggaagttcaagaaagaatgttgctgagagatcaaggatgaagaaaaaagtttcttattcatttgatagtatctggtcgtgacaagcggtttaagggaatggtagggaaagccagatggaagtgggttgaagagttactggaatgggaaaagtagagacaatggatgtagatgacattcaagaagtttcgctgtgaaagggagcaagaattggggcagtaactagaaggcaatgtgggatcaaaggagggtttttgtgtttgtttttaaagatgagagagattggagagtatatgttcataggagagggacaaatt

SEQ ID NO: 329926 - DNA, 2224 bp, Homo sapiens
ccaggccgggggcgggtccaggacacagccaggcttccctggccgcagtgcccaactgcccgcagtgcccatggtggctcggatgggaggaaccaccgcggagccggggacagggggagcagggcagtgctctgctgggtgaggggcacccagctccagaggctaggtgggcgtcgctggtgggtggactcctgggcgctgcgcggagccgcgccggctgggttagcgcgggcggggcgcttagtcccacccccagaggaggcggaagaggagcccgagcctggccgcgggctgggccccgccgcagctccagctggccggcttggtcctgcggtcccttctctgggaggcccgaccccggccgcgcccagcccccaccatgccacccgcggggctccgccgggccgcgccgctcaccgcaatcgctctgttggtgctgggggctcccctggtgctggccggcgaggactgcctgtggtacctggaccggaatggctcctggcatccggggtttaactgcgagttcttcaccttctgctgcgggacctgctaccatcggtactgctgcagggacctgaccttgcttatcaccgagaggcagcagaagcactgcctggccttcagccccaagaccatagcaggcatcgcctcagctgtgatcctctttgttgctgtggttgccaccaccatctgctgcttcctctgttcctgttgctacctgtaccgccggcgccagcagctccagagcccatttgaaggccaggagattccaatgacaggcatcccagtgcagccagtatacccatacccccaggaccccaaagctggccctgcacccccacagcctggcttcatgtacccacctagtggtcctgctccccaatatccactctacccagctgggcccccagtctacaaccctgcagctcctcctccctatatgccaccacagccctcttacccgggagcctgaggaaccagccatgtctctgctgccccttcagtgatgccaaccttgggagatgccctcatcctgtacctgcatctggtcctgggggtggcaggagtcctccagccaccaggccccagaccaagccaagccctgggccctactggggacagagccccagggaagtggaacaggagctgaactagaactatgaggggttggggggagggcttggaattatgggctatttttactgggggcaagggagggagatgacagcctgggtcacagtgcctgttttcaaatagtccctctgctcccaagatcccagccaggaaggctggggccctactgtttgtcccctctgggctggggtggggggagggaggaggttccgtcagcagctggcagtagccctcctctctggctgccccactggccacatctctggcctgctagattaaagctgtaaagacataactcatatcagtcgcatcattggacccatccacaccttccaggaacaccgccttcagctgggcccagactgttgcccactccatattccaaaagtaggggagggccagcaccagcatcggagcacagcaccatcctcacccccatccacaagcagaccaaggcggactgttcctggcttcctaaaggcttcctaaagacaatgaggtgaattttgccacagctctgaagagatgctcgtttgcactacagatattccctgctagggatcaacagctctacaacagctgaggcactgctaactgtacaaaggcagttcccattcaggtacccttagattcattctgggccccaccactttctgaccttggccatgtctccaaaggttcccaagcctcaatgtccttatctatagaatggagataggacaggtgcggtagctcatgcctgtaatctcagtactttgagaggccaagggggggggatcgcctgaggtcaggagttcaagaccagcctggccaacatggtgaatccctgtctctgctaatatacaaaaaaaaattagccaggcattgtggcaggcgcctgtaatcccagctactcgggaggctaaggcaggagaatcgcttgaacccaggaggctggggttacattgagccgagattgcgccactgtactccagcctgggcaacagaaccaggatctgtctctaaataaataaataaaaataaataaataaataaatcaaatggggataataccccatggctgtcaggagggtgaaatagtatgtacatg

SEQ ID NO: 329927 - DNA, 2601 bp, Homo sapiens
ccaggccgggggcgggtccaggacacagccaggcttccctggccgcagtgcccaactgcccgcagtgcccatggtggctcggatgggaggaaccaccgcggagccggggacagggggagcagggcagtgctctgctgggtgaggggcacccagctccagaggctaggtgggcgtcgctggtgggtggactcctgggcgctgcgcggagccgcgccggctgggttagcgcgggcggggcgcttagtcccacccccagaggaggcggaagaggagcccgagcctggccgcgggctgggccccgccgcagctccagctggccggcttggtcctgcggtcccttctctgggaggcccgaccccggccgcgcccagcccccaccatgccacccgcggggctccgccgggccgcgccgctcaccgcaatcgctctgttggtgctgggggctcccctgggtaaggggatggggagagatgcggcaggagtgggatgggggcggaggaaggggagggaccgatccgaggggcttgggctcggggcttctccgagaccctccggctgccacgggagccttgggtgttgctgggtcctcaagaagcgggaagagggagctccaggatgctgggccatgggaggctgatcccggggtgcagggtcagcttcaggcagaggcctcgggggctctggggctgagaccctcagggtggagacaaggggcaaccctcagtgttcgggagccgtcaggctggggaccgccgggggagtggggccgagcgcggctggggatgaactggcctggtggccactgggcacccccaatccctgcccgcagtgctggccggcgaggactgcctgtggtacctggaccggaatggctcctggcatccggggtttaactgcgagttcttcaccttctgctgcgggacctgctaccatcggtactgctgcagggacctgaccttgcttatcaccgagaggcagcagaagcactgcctggccttcagccccaagaccatagcaggcatcgcctcagctgtgatcctctttgttgctgtggttgccaccaccatctgctgcttcctctgttcctgttgctacctgtaccgccggcgccagcagctccagagcccatttgaaggccaggagattccaatgacaggcatcccagtgcagccagtatacccatacccccaggaccccaaagctggccctgcacccccacagcctggcttcatgtacccacctagtggtcctgctccccaatatccactctacccagctgggcccccagtctacaaccctgcagctcctcctccctatatgccaccacagccctcttacccgggagcctgaggaaccagccatgtctctgctgccccttcagtgatgccaaccttgggagatgccctcatcctgtacctgcatctggtcctgggggtggcaggagtcctccagccaccaggccccagaccaagccaagccctgggccctactggggacagagccccagggaagtggaacaggagctgaactagaactatgaggggttggggggagggcttggaattatgggctatttttactgggggcaagggagggagatgacagcctgggtcacagtgcctgttttcaaatagtccctctgctcccaagatcccagccaggaaggctggggccctactgtttgtcccctctgggctggggtggggggagggaggaggttccgtcagcagctggcagtagccctcctctctggctgccccactggccacatctctggcctgctagattaaagctgtaaagacataactcatatcagtcgcatcattggacccatccacaccttccaggaacaccgccttcagctgggcccagactgttgcccactccatattccaaaagtaggggagggccagcaccagcatcggagcacagcaccatcctcacccccatccacaagcagaccaaggcggactgttcctggcttcctaaaggcttcctaaagacaatgaggtgaattttgccacagctctgaagagatgctcgtttgcactacagatattccctgctagggatcaacagctctacaacagctgaggcactgctaactgtacaaaggcagttcccattcaggtacccttagattcattctgggccccaccactttctgaccttggccatgtctccaaaggttcccaagcctcaatgtccttatctatagaatggagataggacaggtgcggtagctcatgcctgtaatctcagtactttgagaggccaagggggggggatcgcctgaggtcaggagttcaagaccagcctggccaacatggtgaatccctgtctctgctaatatacaaaaaaaaattagccaggcattgtggcaggcgcctgtaatcccagctactcgggaggctaaggcaggagaatcgcttgaacccaggaggctggggttacattgagccgagattgcgccactgtactccagcctgggcaacagaaccaggatctgtctctaaataaataaataaaaataaataaataaataaatcaaatggggataataccccatggctgtcaggagggtgaaatagtatgtacatg

SEQ ID NO: 329928 - DNA, 1973 bp, Homo sapiens
ccaggccgggggcgggtccaggacacagccaggcttccctggccgcagtgcccaactgcccgcagtgcccatggtggctcggatgggaggaaccaccgcggagccggggacagggggagcagggcagtgctctgctgggtgaggggcacccagctccagaggctaggtgggcgtcgctggtgggtggactcctgggcgctgcgcggagccgcgccggctgggttagcgcgggcggggcgcttagtcccacccccagaggaggcggaagaggagcccgagcctggccgcgggctgggccccgccgcagctccagctggccggcttggtcctgcggtcccttctctgggaggcccgaccccggccgcgcccagcccccaccatgccacccgcggggctccgccgggccgcgccgctcaccgcaatcgctctgttggtgctgggggctcccctggtgctggccggcgaggactgcctgtggtacctggaccggaatggctcctggcatccggggtttaactgcgagttcttcaccttctgctgcgggacctgctaccatcggtactgctgcagggacctgaccttgcttatcaccgagaggcagcagaagcactgcctggccttcagccccaagaccatagcaggcatcgcctcagctgtgatcctctttgttgctgtggttgccaccaccatctgctgcttcctctgttcctgttgctacctgtaccgccggcgccagcagctccagagcccatttgaaggccaggagattccaatgacaggcatcccagtgcagccagtatacccatacccccaggaccccaaagctggccctgcacccccacagccaagccctgggccctactggggacagagccccagggaagtggaacaggagctgaactagaactatgaggggttggggggagggcttggaattatgggctatttttactgggggcaagggagggagatgacagcctgggtcacagtgcctgttttcaaatagtccctctgctcccaagatcccagccaggaaggctggggccctactgtttgtcccctctgggctggggtggggggagggaggaggttccgtcagcagctggcagtagccctcctctctggctgccccactggccacatctctggcctgctagattaaagctgtaaagacataactcatatcagtcgcatcattggacccatccacaccttccaggaacaccgccttcagctgggcccagactgttgcccactccatattccaaaagtaggggagggccagcaccagcatcggagcacagcaccatcctcacccccatccacaagcagaccaaggcggactgttcctggcttcctaaaggcttcctaaagacaatgaggtgaattttgccacagctctgaagagatgctcgtttgcactacagatattccctgctagggatcaacagctctacaacagctgaggcactgctaactgtacaaaggcagttcccattcaggtacccttagattcattctgggccccaccactttctgaccttggccatgtctccaaaggttcccaagcctcaatgtccttatctatagaatggagataggacaggtgcggtagctcatgcctgtaatctcagtactttgagaggccaagggggggggatcgcctgaggtcaggagttcaagaccagcctggccaacatggtgaatccctgtctctgctaatatacaaaaaaaaattagccaggcattgtggcaggcgcctgtaatcccagctactcgggaggctaaggcaggagaatcgcttgaacccaggaggctggggttacattgagccgagattgcgccactgtactccagcctgggcaacagaaccaggatctgtctctaaataaataaataaaaataaataaataaataaatcaaatggggataataccccatggctgtcaggagggtgaaatagtatgtacatg

SEQ ID NO: 329929 - DNA, 932 bp, Homo sapiens
ccgagaggcagcagaagcactgcctggccttcaggtgggttcctgcctcctcaccctcaccacctcctctatccttttctccagaggcctcctcttcctccctcccggactcctgcctcctccgttgtcgacctccacattcttagctgaatagagtcaccaggactcaagcctggcggcagagctaggtgcttaggtgctggtgcctgggagttccagaaaaggcatgttagttaccttcataggctttgactgggcccggggtttccaggttctttctggagccctccctttggtcctgccaggtcatggggagggagggttcaaggttaacacccggacgacagtgtagctttgtggaagaagctctggcacaaaggcaggagacttgggtttgattcccaggtccacttcttactagctgtgtgatcttggagaagacacttgccttctatgggtcattgcttgccaaattagtggttgtcaaacttttttttaatatatcatatataaaatagatatagagacttctgattgaagcggggtttggaaaaaatggctctagattatttctaaggctcctttcagtgttatgctgtatgtctaatcatttaagttgtagatataaaagcaatggttgggggcgcactgcaaatccccgtatgcttcacactagccagccaggcagcatagccttctgggaagtggaggtcctctaagatctccttcacagggactgggcagagccccacaaggaaccccaaatctcagcatgccatggcccccctgctggccaggagttggagccagcataatgaggactccgtcctatgagtgttggaaggtgagaggacctgttctttgtctaaagccccaagaccatagcaggcatcgcctcagctgtgatcctctttgttgctgtggttgccacc

SEQ ID NO: 329930 - DNA, 1938 bp, Homo sapiens
ccaggccgggggcgggtccaggacacagccaggcttccctggccgcagtgcccaactgcccgcagtgcccatggtggctcggatgggaggaaccaccgcggagccggggacagggggagcagggcagtgctctgctgggtgaggggcacccagctccagaggctagtgctggccggcgaggactgcctgtggtacctggaccggaatggctcctggcatccggggtttaactgcgagttcttcaccttctgctgcgggacctgctaccatcggtactgctgcagggacctgaccttgcttatcaccgagaggcagcagaagcactgcctggccttcagccccaagaccatagcaggcatcgcctcagctgtgatcctctttgttgctgtggttgccaccaccatctgctgcttcctctgttcctgttgctacctgtaccgccggcgccagcagctccagagcccatttgaaggccaggagattccaatgacaggcatcccagtgcagccagtatacccatacccccaggaccccaaagctggccctgcacccccacagcctggcttcatgtacccacctagtggtcctgctccccaatatccactctacccagctgggcccccagtctacaaccctgcagctcctcctccctatatgccaccacagccctcttacccgggagcctgaggaaccagccatgtctctgctgccccttcagtgatgccaaccttgggagatgccctcatcctgtacctgcatctggtcctgggggtggcaggagtcctccagccaccaggccccagaccaagccaagccctgggccctactggggacagagccccagggaagtggaacaggagctgaactagaactatgaggggttggggggagggcttggaattatgggctatttttactgggggcaagggagggagatgacagcctgggtcacagtgcctgttttcaaatagtccctctgctcccaagatcccagccaggaaggctggggccctactgtttgtcccctctgggctggggtggggggagggaggaggttccgtcagcagctggcagtagccctcctctctggctgccccactggccacatctctggcctgctagattaaagctgtaaagacataactcatatcagtcgcatcattggacccatccacaccttccaggaacaccgccttcagctgggcccagactgttgcccactccatattccaaaagtaggggagggccagcaccagcatcggagcacagcaccatcctcacccccatccacaagcagaccaaggcggactgttcctggcttcctaaaggcttcctaaagacaatgaggtgaattttgccacagctctgaagagatgctcgtttgcactacagatattccctgctagggatcaacagctctacaacagctgaggcactgctaactgtacaaaggcagttcccattcaggtacccttagattcattctgggccccaccactttctgaccttggccatgtctccaaaggttcccaagcctcaatgtccttatctatagaatggagataggacaggtgcggtagctcatgcctgtaatctcagtactttgagaggccaagggggggggatcgcctgaggtcaggagttcaagaccagcctggccaacatggtgaatccctgtctctgctaatatacaaaaaaaaattagccaggcattgtggcaggcgcctgtaatcccagctactcgggaggctaaggcaggagaatcgcttgaacccaggaggctggggttacattgagccgagattgcgccactgtactccagcctgggcaacagaaccaggatctgtctctaaataaataaataaaaataaataaataaataaatcaaatggggataataccccatggctgtcaggagggtgaaatagtatgtacatg

SEQ ID NO: 329931 - DNA, 1386 bp, Homo sapiens
ccaggccgggggcgggtccaggacacagccaggcttccctggccgcagtgcccaactgcccgcagtgcccatggtggctcggatgggaggaaccaccgcggagccggggacagggggagcagggcagtgctctgctgggtgaggggcacccagctccagaggctaggtgggcgtcgctggtgggtggactcctgggcgctgcgcggagccgcgccggctgggttagcgcgggcggggcgcttagtcccacccccagaggaggcggaagaggagcccgagcctggccgcgggctgggccccgccgcagctccagctggccggcttggtcctgcggtcccttctctgggaggcccgaccccggccgcgcccagcccccaccatgccacccgcggggctccgccgggccgcgccgctcaccgcaatcgctctgttggtgctgggggctcccctggtgctggccggcgaggactgcctgtggtacctggaccggaatggctcctggcatccggggtttaactgcgagttcttcaccttctgctgcgggacctgctaccatcggtactgctgcagggacctgaccttgcttatcaccgagaggcagcagaagcactgcctggccttcagccccaagaccatagcaggcatcgcctcagctgtgatcctctttgttgctgtggttgccaccaccatctgctgcttcctctgttcctgttgctacctgtaccgccggcgccagcagctccagagcccatttgaaggccaggagattccaatgacaggcatcccagtgcagccagtatacccatacccccaggaccccaaagctggccctgcacccccacagcctggcttcatgtacccacctagtggtcctgctccccaatatccactctacccagctgggcccccagtctacaaccctgcagctcctcctccctatatgccaccacagccctcttacccgggagcctgaggaaccagccatgtctctgctgccccttcagtgatgccaaccttgggagatgccctcatcctgtacctgcatctggtcctgggggtggcaggagtcctccagccaccaggccccagaccaagcctggggtggggggagggaggaggttccgtcagcagctggcagtagcccttccttgtgcatgcatttgctgtaatagtgtagatataaaaaaagggcgttaattctaggcagtagtacagttgtcaatgtctatgggagtgtattagtagagcggttaagtgtgatgaatgtatggatctggagacttttggtgtgctatggcaatactagaattagttaggtattaatttagtgttatgggtatagtgttgctggtgaagtgtctggttgtttgacattatcgatggtag

SEQ ID NO: 329932 - DNA, 1201 bp, Homo sapiens
gaaagaatttgtactttgaaaagccaagacaagtactacccctcaccatcagcctaaaaataaacttactgacatattacataaataagaaagggtgctcacaccgcacgctgagctctgtgatgtagccgcttgcggagactgcaagcagccgcggcgcgcccggccctccctcttccgctgccgccgtgggaatggaaacatctgccccacgtgccggaagccaagtggtggcgacaactgcgcgccactccgcggcctaccgcgcagatcctctacgtgtgtcctcgcgagacaagctcaccgaaatggccgcgtccagtcaaggaaactttgagggaaattttgagtcactggaccttgcggaatttgctaagaagcagccatggtggcgtaagctgttcgggcaggaatctggaccttcagcagaaaagtatagcgtggcaacccagctgttcattggaggtgtcactggatggtgcacaggtttcatattccagaaggttggaaagttggctgcaacagctgtgggaggtggattttttctccttcagcttgcaaaccatactgggtacatcaaagttgactggcaacgagtggagaaggacatgaagaaagccaaagagcagctgaagatccgtaagagcaatcagatacctactgaggtcaggagcaaagctgaggaggtggtgtcatttgtgaagaagaatgttctagtaactgggggatttttcggaggctttctgcttggcatggcatcctaaggaagatgacctcatgttcattgttcctggttttttccagccagcagcctctacactccatcataggacatcgagtccctcctcctcttctcccatgccttcttccctgccatggcaaatctgagtggcttctctaagcatctgctggtacaagtcaatgtggcaccatgagcttcatggtggcagaagagacaatagtccttagctctcctcccagtacaccccctacttggccagtctgtaggccaacaagaaggttcctttacccccatgcaagacacttatgagaacacattacaagatggctgaccgtggaggatgagtggatcctgaaaggttgtcccaaactgttgatttggaaaagaaataagcacatagataaccttattgtgtgctgcatggaaaggaactgaatacatttgcctttaagcatgaaa

SEQ ID NO: 329933 - DNA, 2027 bp, Homo sapiens
acgctttctggcacgctttttttggtgcatctgttgggcgggaccgcggggcctgtgacaccgcacgctgagctctgtgatgtagccgcttgcggagactgcaagcagccgcggcgcgcccggccctccctcttccgctgccgccgtgggaatggaaacatctgccccacgtgccggaagccaagtggtggcgacaactgcgcgccactccgcggcctaccgcgcagatcctctacgtgtgtcctcgcgagacaagctcaccgaaatggccgcgtccagtcaaggaaactttgagggaaattttgagtcactggaccttgcggaatttgctaagaagcagccatggtggcgtaagctgttcgggcaggaatctggaccttcagcagaaaagtatagcgtggcaacccagctgttcattggaggtgtcactggatggtgcacaggtttcatattccagaaggttggaaagttggctgcaacagctgtgggaggtggattttttctccttcagcttgcaaaccatactgggtacatcaaagttgactggcaacgagtggagaaggacatgaagaaagccaaagagcagctgaagatccgtaagagcaatcagatacctactgaggtcaggagcaaagctgaggaggtggtgtcatttgtgaagaagaatgttctagtaactgggggatttttcggaggctttctgcttggcatggcatcctaaggaagatgacctcatgttcattgttcctggttttttccagccagcagcctctacactccatcataggacatcgagtccctcctcctcttctcccatgccttcttccctgccatggcaaatctgagtggcttctctaagcatctgctggtacaagtcaatgtggcaccatgagcttcatggtggcagaagagacaatagtccttagctctcctcccagtacaccccctacttggccagtctgtaggccaacaagaaggttcctttacccccatgcaagacacttatgagaacacattacaagatggctgaccgtggaggatgagtggatcctgaaaggttgtcccaaactgttgatttggaaaagaaataagcacatagataaccttattgtgtgctgcatggaaaggaactgaatacatttgcctttaagcatgaaagattttggtatcttggtgtctactttcttttttagttggttttacattacagaaagctatttaaatgtgttataattatgccgacaaaattggcagcataattactgtaattgaaaaatctgatattgtccaggaatgctttctaccgtacaggataatgtatctcatggctgtttccaaagggtttatttattgtaaaacaagtgatttaggtgggaaagggaagattttggatttttattttgtagaaaaggttttaagctttgaaatgtgaatgaaatatccttatcaaaacattaggggtggccataactcctctgtgccacttctactatttttttttttaatctagttagtatgaaatacaacatttaaaccggaattttaaagaagtagctttccaggggattcagaattaagaaagatagtgataggacatgagaaataaatttccatcaagtgtaatctaccgtctcatgatgaccacaaccctgagaattattctttaaaagcttacacacacacacacacacgggcacacacgcacacacagaatcttaccacattttgctgtagtggcatgttaccatgtctacagtccctactagaatatcagtcagctttcagagggcaagacttctgtcttcaccattatactcacagggcctagcacttaataggtgctgagtatttgaataatgactttatagaaagaaaactcactattaaaggttagttttactcagaattgttaatcttggagatgatctcttgtgaaatatgagtgtgtttctaaggccatacatttaaaaatgtttgcattttaacccgtcttgagaatgatgtattgaatttgaaaatcaaaacta

SEQ ID NO: 329934 - DNA, 885 bp, Homo sapiens
gctgacgactactactactaaattcgcggccgctcagacgtccagtcaaggaaactttgagggaaattttgagtcactggaccttgcggaatttgctaagaagcagccatggtggcgtaagctgttcgggcaggaatctggaccttcagcagaaaagtatagcgtggcaacccagctgttcattggaggtgtcactggatggtgcacaggtttcatattccagaaggttggaaagttggctgcaacagctgtgggaggtggattttttctccttcagcttgcaaaccatactgggtacatcaaagttgactggcaacgagtggagaaggacatgaagaaagccaaagagcagctgaagatccgtaagagcaatcagatacctactgaggtcaggagcaaagctgaggaggtggtgtcatttgtgaagaagaatgttctagtaactgggggatttttcggaggctttctgcttggcatggcatcctaaggaagatgacctcatgttcattgttcctggttttttccagccagcagcctctacactccatcataggacatcgagtccctcctcctcttctcccatgccttcttccctgccatggcaaatctgagtggcttctctaagcatctgctggtacaagtcaatgtggcaccatgagcttcatggtggcagaagagacaatagtccttagctctcctcccagtacaccccctacttggccagtctgtaggccaacaagaaggttcctttacccccatgcaagacacttatgagaacctcacacatggtggccggggggagaggggcccgcaagggtccccccgtcttgtgggaaagccccatactctttggggggaggagcgacattgcgttcggggaaaaaa

SEQ ID NO: 329935 - DNA, 1158 bp, Homo sapiens
acgctttctggcacgctttttttggtgcatctgttgggcgggaccgcggggcctgtgacaccgcacgctgagctctgtgatgtagccgcttgcggagactgcaagcagccgcggcgcgcccggccctccctcttccgctgccgccgtgggaatggaaacatctgccccacgtgccggaagccaagtggtggcgacaactgcgcgccactccgcggcctaccgcgcagatcctctacgtgtgtcctcgcgagacaagctcaccgaaatggccgcgtccagtcaaggaaactttgagggaaattttgagtcactggaccttgcggaatttgctaagaagcagccatggtggcgtaagctgttcgggcaggaatctggaccttcagcagaaaagtatagcgtggcaacccagctgttcattggaggtgtcactggatggtgcacaggtttcatattccagaaggttggaaagttggctgcaacagctgtgggaggtggattttttctccttcagcttgcaaaccatactgggtacatcaaagttgactggcaacgagtggagaaggacatgaagaaagccaaagagcagctgaagatccgtaagagcaatcagatacctactgaggtcaggagcaaagctgaggaggtggtgtcatttgtgaagaagaatgttctagtaactgggggatttttcggaggctttctgcttggcatggcatcctaaggaagatgacctcatgttcattgttcctggttttttccagccagcagcctctacactccatcataggacatcgagtccctcctcctcttctcccatgccttcttccctgccatggcaaatctgagtggcttctctaagcatctgctggtacaagtcaatgtggcaccatgagcttcatggtggcagaagagacaatagtccttagctctcctcccagtacaccccctacttggccagtctgtaggccaacaagaaggttcctttacccccatgcaagacacttatgagaacacattacaagatggctgaccgtggaggatgagtggatcctgaaaggttgtcccaaactgttgatttggaaaagaaataagcacatagataaccttattgtgtgctgcatggaaaggaactgaatacatttgcctttaagcatgaaa

SEQ ID NO: 329936 - DNA, 1231 bp, Homo sapiens
acgctttctggcacgctttttttggtgcatctgttgggcgggaccgcggggcctgtgacaccgcacgctgagctctgtgatgtagccgcttgcggagactgcaagcagccgcggcgcgcccggccctccctcttccgctgccgccgtgggaatggaaacatctgccccacgtgccggaagccaagtggtggcgacaactgcgcgccactccgcggcctaccgcgcagatcctctacgtgtgtcctcgcgagacaagctcaccgaaatggccgcgtccagtcaaggaaactttgagggaaattttgagtcactggaccttgcggaatttgctaagaagcagccatggtggcgtaagctgttcgggcaggaatctggaccttcagcagaaaagtatagcgtggcaacccagctgttcattggaggtgtcactggatggtgcacaggtttcatattccagaaggttggaaagttggctgcaacagctgtgggaggtggattttttctccttcagcttgcaaaccatactgggtacatcaaagttgactggcaacgagtggagaaggacatgaagaaagccaaagagcagctgaagatccgtaagagcaatcagatacctactgaggtcaggagcaaagctgaggaggtggtgtcatttgtgaagaagaatgttctagtaactgggggatttttcggaggctttctgcttggcatggcatcctaaggaagatgacctcatgttcattgttcctggttttttccagccagcagcctctacactccatcataggacatcgagtccctcctcctcttctcccatgccttcttccctgccatggcaaatctgagtggcttctctaagcatctgctggtacaagtcaatgtggcaccatgagcttcatggtggcagaagagacaatagtccttagctctcctcccagtacaccccctacttggccagtctgtaggccaacaagaaggttcctttacccccatgcaagacacttatgagaacacattacaagatggctgaccgtggaggatgagtggatcctgaaaggttgtcccaaactgttgatttggaaaagaaataagcacatagataaccttattgtgtgctgcatggaaaggaactgaatacatttgcctttaagcatgaaaaaaaaataaataaaaactcgagggggggcccggtcccaattcggccttataggaatcggtttacaattcactg

SEQ ID NO: 329937 - DNA, 1119 bp, Homo sapiens
acgctttctggcacgctttttttggtgcatctgttgggcgggaccgcggggcctgtgacaccgcacgctgagctctgtgatgtagccgcttgcggagactgcaagcagccgcggcgcgcccggccctccctcttccgctgccgccgtgggaatggaaacatctgccccacgtgccggaagccaagtggtggcgacaactgcgcgccactccgcggcctaccgcgcagatcctctacgtgtgtcctcgcgagacaagctcaccgaaatggccgcgtccagtcaaggaaactttgagggaaattttgagtcactggaccttgcggaatttgctaagaagcagccatggtggcgtaagctgttcgggcaggaatctggaccttcagcagaaaagtatagcgtggcaacccagctgttcattggaggtgtcactggatggtgcacaggtttcatattccagaaggttggaaagttggctgcaacagctgtgggaggtggattttttctccttcagcttgcaaaccatactgggtacatcaaagttgactggcaacgagtggagaaggacatgaagaaagccaaagagcagctgaagatccgtaagagcaatcagatacctactgaggtcaggagcaaagctgaggaggtggtgtcatttgtgaagaagaatgttctagtaactgggggatttttcggaggctttctgcttggcatggcatcctaaggaagatgacctcatgttcattgttcctggttttttccagccagcagcctctacactccatcataggacatcgagtccctcctcctcttctcccatgccttcttccctgccatggcaaatctgagtggcttctctaagcatctgctggtacaagtcaatgtggcaccatgagcttcatggtggcagaagagacaatagtccttagctctcctcccagtacaccccctacttggccagtctgtaggccaacaagaaggttcctttacccccatgcaagacacttatgagaacctcacacatggtggccggggggagaggggcccgcaagggtccccccgtcttgtgggaaagccccatactctttggggggaggagcgacattgcgttcggggaaaaaa

SEQ ID NO: 329938 - DNA, 1116 bp, Homo sapiens
ggactacaggcggccgccaccatgcccggctaattttttgtatttttagtagagacggggtttcaccatgttagccaggatggcctcgatctcctgaccgcgtgatccgcccgcctcggcctccgaaactgctgaaattacaggcgtgagccaccgcgcccggccagataagtgagtcataggtaaaatattcttcaccaggcgaggattgagtcgcagtcgcgtcaggaactcgcctccaggaaactttgagggaaattttgagtcactggaccttgcggaatttgctaagaagcagccatggtggcgtaagctgttcgggcaggaatctggaccttcagcagaaaagtatagcgtggcaacccagctgttcattggaggtgtcactggatggtgcacaggtttcatattccagaaggttggaaagttggctgcaacagctgtgggaggtggattttttctccttcagcttgcaaaccatactgggtacatcaaagttgactggcaacgagtggagaaggacatgaagaaagccaaagagcagctgaagatccgtaagagcaatcagatacctactgaggtcaggagcaaagctgaggaggtggtgtcatttgtgaagaagaatgttctagtaactgggggatttttcggaggctttctgcttggcatggcatcctaaggaagatgacctcatgttcattgttcctggttttttccagccagcagcctctacactccatcataggacatcgagtccctcctcctcttctcccatgccttcttccctgccatggcaaatctgagtggcttctctaagcatctgctggtacaagtcaatgtggcaccatgagcttcatggtggcagaagagacaatagtccttagctctcctcccagtacaccccctacttggccagtctgtaggccaacaagaaggttcctttacccccatgcaagacacttatgagaacacattacaagatggctgaccgtggaggatgagtggatcctgaaaggttgtcccaaactgttgatttggaaaagaaataagcacatagataaccttattgtgtgctgcatggaaaggaactgaatacatttgcctttaagcatgaaa

SEQ ID NO: 329939 - DNA, 924 bp, Homo sapiens
gctgacgactactactactaaattcgcggccgctcagacgtccagtcaaggaaactttgagggaaattttgagtcactggaccttgcggaatttgctaagaagcagccatggtggcgtaagctgttcgggcaggaatctggaccttcagcagaaaagtatagcgtggcaacccagctgttcattggaggtgtcactggatggtgcacaggtttcatattccagaaggttggaaagttggctgcaacagctgtgggaggtggattttttctccttcagcttgcaaaccatactgggtacatcaaagttgactggcaacgagtggagaaggacatgaagaaagccaaagagcagctgaagatccgtaagagcaatcagatacctactgaggtcaggagcaaagctgaggaggtggtgtcatttgtgaagaagaatgttctagtaactgggggatttttcggaggctttctgcttggcatggcatcctaaggaagatgacctcatgttcattgttcctggttttttccagccagcagcctctacactccatcataggacatcgagtccctcctcctcttctcccatgccttcttccctgccatggcaaatctgagtggcttctctaagcatctgctggtacaagtcaatgtggcaccatgagcttcatggtggcagaagagacaatagtccttagctctcctcccagtacaccccctacttggccagtctgtaggccaacaagaaggttcctttacccccatgcaagacacttatgagaacacattacaagatggctgaccgtggaggatgagtggatcctgaaaggttgtcccaaactgttgatttggaaaagaaataagcacatagataaccttattgtgtgctgcatggaaaggaactgaatacatttgcctttaagcatgaaa

SEQ ID NO: 329940 - DNA, 1146 bp, Homo sapiens
gaaagaatttgtactttgaaaagccaagacaagtactacccctcaccatcagcctaaaaataaacttactgacatattacataaataagaaagggtgctcacaccgcacgctgagctctgtgatgtagccgcttgcggagactgcaagcagccgcggcgcgcccggccctccctcttccgctgccgccgtgggaatggaaacatctgccccacgtgccggaagccaagtggtggcgacaactgcgcgccactccgcggcctaccgcgcagatcctctacgtgtgtcctcgcgagacaagctcaccttgcggaatttgctaagaagcagccatggtggcgtaagctgttcgggcaggaatctggaccttcagcagaaaagtatagcgtggcaacccagctgttcattggaggtgtcactggatggtgcacaggtttcatattccagaaggttggaaagttggctgcaacagctgtgggaggtggattttttctccttcagcttgcaaaccatactgggtacatcaaagttgactggcaacgagtggagaaggacatgaagaaagccaaagagcagctgaagatccgtaagagcaatcagatacctactgaggtcaggagcaaagctgaggaggtggtgtcatttgtgaagaagaatgttctagtaactgggggatttttcggaggctttctgcttggcatggcatcctaaggaagatgacctcatgttcattgttcctggttttttccagccagcagcctctacactccatcataggacatcgagtccctcctcctcttctcccatgccttcttccctgccatggcaaatctgagtggcttctctaagcatctgctggtacaagtcaatgtggcaccatgagcttcatggtggcagaagagacaatagtccttagctctcctcccagtacaccccctacttggccagtctgtaggccaacaagaaggttcctttacccccatgcaagacacttatgagaacacattacaagatggctgaccgtggaggatgagtggatcctgaaaggttgtcccaaactgttgatttggaaaagaaataagcacatagataaccttattgtgtgctgcatggaaaggaactgaatacatttgcctttaagcatgaaa

SEQ ID NO: 329941 - DNA, 983 bp, Homo sapiens
tgagactgcttaggagagactaacaagcaagacttgaaaaagggagcagtttctccaaaaacaaaagaaaactgacatttgattgtattaggcatacatttcttagctctgtggcattggtattcaaatttggctccacattggaatcacctaggagtttttaaaagagccaacgtgtgccactcctgacccacagtctgatttcattggaaaacttaaaactcctgaggtgattctgctgtgctgtgggagccataacttgctgaatcatgccagagtctctgaattcacagccgtttgtctcttcccacagttggcaaccctcacttttgcaagcttgcaaaccatactgggtacatcaaagttgactggcaacgagtggagaaggacatgaagaaagccaaagagcagctgaagatccgtaagagcaatcagatacctactgaggtcaggagcaaagctgaggaggtggtgtcatttgtgaagaagaatgttctagtaactgggggatttttcggaggctttctgcttggcatggcatcctaaggaagatgacctcatgttcattgttcctggttttttccagccagcagcctctacactccatcataggacatcgagtccctcctcctcttctcccatgccttcttccctgccatggcaaatctgagtggcttctctaagcatctgctggtacaagtcaatgtggcaccatgagcttcatggtggcagaagagacaatagtccttagctctcctcccagtacaccccctacttggccagtctgtaggccaacaagaaggttcctttacccccatgcaagacacttatgagaacacattacaagatggctgaccgtggaggatgagtggatcctgaaaggttgtcccaaactgttgatttggaaaagaaataagcacatagataaccttattgtgtgctgcatggaaaggaactgaatacatttgcctttaagcatgaaa

SEQ ID NO: 329942 - DNA, 1098 bp, Homo sapiens
cgccagtcgcgaccgagctccccggggagtccaagcggcgcggggacggggagggcgctcggggatcgcccctggctcagccgctcccagggtccggccaaggtcacgcgcgtgtctggggcctaaccaccctggggtgtcgtctccagtggagctcacccagccttccggcgccgcccccggcgcagaagcccgaagacattctgtccccgttctcggaagcggaaactttgagggaaattttgagtcactggaccttgcggaatttgctaagaagcagccatggtggcgtaagctgttcgggcaggaatctggaccttcagcagaaaagtatagcgtggcaacccagctgttcattggaggtgtcactggatggtgcacaggtttcatattccagaaggttggaaagttggctgcaacagctgtgggaggtggattttttctccttcagcttgcaaaccatactgggtacatcaaagttgactggcaacgagtggagaaggacatgaagaaagccaaagagcagctgaagatccgtaagagcaatcagatacctactgaggtcaggagcaaagctgaggaggtggtgtcatttgtgaagaagaatgttctagtaactgggggatttttcggaggctttctgcttggcatggcatcctaaggaagatgacctcatgttcattgttcctggttttttccagccagcagcctctacactccatcataggacatcgagtccctcctcctcttctcccatgccttcttccctgccatggcaaatctgagtggcttctctaagcatctgctggtacaagtcaatgtggcaccatgagcttcatggtggcagaagagacaatagtccttagctctcctcccagtacaccccctacttggccagtctgtaggccaacaagaaggttcctttacccccatgcaagacacttatgagaacacattacaagatggctgaccgtggaggatgagtggatcctgaaaggttgtcccaaactgttgatttggaaaagaaataagcacatagataaccttattgtgtgctgcatggaaaggaactgaatacatttgcctttaagcatgaaa

SEQ ID NO: 329943 - DNA, 1153 bp, Homo sapiens
gaaagaatttgtactttgaaaagccaagacaagtactacccctcaccatcagcctaaaaataaacttactgacatattacataaataagaaagggtgctcacaccgcacgctgagctctgtgatgtagccgcttgcggagactgcaagcagccgcggcgcgcccggccctccctcttccgctgccgccgtgggaatggaaacatctgccccacgtgccggaagccaagtggtggcgacaactgcgcgccactccgcggcctaccgcgcagatcctctacgtgtgtcctcgcgagacaagctcaccgaaatggccgcgtccagtcaaggaaactttgagggaaattttgagtcactggaccttgcggaatttgctaagaagcagccatggtggcgtaagctgttcgggcaggaatctggaccttcagcagagtgcacaggtttcatattccagaaggttggaaagttggctgcaacagctgtgggaggtggattttttctccttcagcttgcaaaccatactgggtacatcaaagttgactggcaacgagtggagaaggacatgaagaaagccaaagagcagctgaagatccgtaagagcaatcagatacctactgaggtcaggagcaaagctgaggaggtggtgtcatttgtgaagaagaatgttctagtaactgggggatttttcggaggctttctgcttggcatggcatcctaaggaagatgacctcatgttcattgttcctggttttttccagccagcagcctctacactccatcataggacatcgagtccctcctcctcttctcccatgccttcttccctgccatggcaaatctgagtggcttctctaagcatctgctggtacaagtcaatgtggcaccatgagcttcatggtggcagaagagacaatagtccttagctctcctcccagtacaccccctacttggccagtctgtaggccaacaagaaggttcctttacccccatgcaagacacttatgagaacacattacaagatggctgaccgtggaggatgagtggatcctgaaaggttgtcccaaactgttgatttggaaaagaaataagcacatagataaccttattgtgtgctgcatggaaaggaactgaatacatttgcctttaagcatgaaa

SEQ ID NO: 329944 - DNA, 342 bp, Homo sapiens
caaggaagaagaatacaggcaggagaacagacacaggtgccatcaagggtgttcattctactgctccatgccgtcctgcaaaaggaaatctggtcctcctcctacacttgcatggccaacacatgggaaacacctgagctaaccctgacttggagaattgttccatgtggttactttcaatgctcctgcctctcttgaacaagacacagagatgtccagaacccagtataacttggtataatcctccagtcctgtatgtctccctttaagcctcctccttccactgagcctaaggcaaatcttttgacccggggtggacccggagggatgaggatgctgagg

SEQ ID NO: 329945 - DNA, 256 bp, Homo sapiens
tgcaggctcttgactactactttctgttcagcctctatgccttactttgaattgttgactaccttaaggatatataaggctcactttagtaagttttctctttactctgggattttattctctcaggtcctggctgtcttgtctgttctctgatgactttgcgcattgttttttaaattgttttttgtttttttgagatgaagtcttgctttatggccaggctagagtacagtggtaagatcacagctcaccacag

SEQ ID NO: 329946 - DNA, 515 bp, Homo sapiens
gatctcggctcactgcaacctccacccccctggattcaagcaattctcctgcctcagcctcctgagtagctgggattacaggcgcctgccaccatgcccagctaatttttgtatttttagtagagacagggtttcaccgtgttgcccaggctagtctcaaacttctgaccttaggtgatctgccgagctctgcttcccaaagtgctgggatttcaggcttcaggcatgagccactgcgcccagcctcgattcacttttcatcctgttcccagaattgccttctagaaacaatttgatgtgtgtgccttgcagacctatgctggttctctgttgtctgcaggataaagtccagactacgcagtggggccctaggacaccctcactgaccccacgatggtacagatgctcctcagcttacaatggagttacatcctggtagacccattgtaagctgaaaatagcataaatcgaaaataaatacatctaatgcacctaacctactgaacaccatagtt

SEQ ID NO: 329947 - DNA, 2434 bp, Homo sapiens
tctgattgacttcaagaaggagtcagagatcagcttaagggcaaaggctggaagcagagcgaactgggagcagagcacacagagccgtggagcgagagatgccggccctgggctgggccgtggctgccatcctgatgctgcagacggccatggcggagccctccccggggactctgcccaggaaggcaggggtgttttcagacctaagcaaccaagagctgaaggcagtgcacagcttcctctggtccaagaaggagctgaggctgcagccctccagtaccaccaccatggccaagaacaccgtgtttctcatcgagatgctgctgcccaagaagtaccatgtgctgaggtttctggataaaggtgaaaggcatcctgtgcgggaagcccgtgccgtcatcttctttggtgaccaggagcatcccaatgtcaccgagtttgctgtggggcccctgccagggccctgctacatgcgagcactgtcccccaggcctgggtaccagtcctcctgggcatcgaggcccatctccacagcagagtatgccctcctctaccacaccctgcaggaagccaccaagcccctgcatcagttcttcctcaataccacaggcttctcattccaagactgccatgacagatgcctggccttcaccgatgtggccccccggggtgtggcttctggccagcgccgcagttggcttatcatacagcgctatgtagaaggctactttctgcaccccactgggctggagctcctcgtggatcatgggagcacagatgctgggcactgggccgtggagcaggtgtggtacaacgggaagttctatgggagcccagaggaactggctcggaagtatgcagatggagaggtggacgtggtggtcctggaggacccgctgcctgggggcaaggggcatgacagcacagaggagccgcccctcttctcctcccacaagccccgcggggacttccccagccccatccatgtgagcggcccccgcttggtccagccccacggccctcgcttcaggctggagggcaacgctgtgctctacggcggctggagctttgccttccggctgcgctcctcctccgggctgcaggtcctgaacgtgcacttcggcggagagcgcattgcctatgaggtcagcgtgcaagaggcagtggcgctgtatggaggacacacacctgcaggcatgcagaccaagtacctcgatgtcggctggggcctgggcagcgtcactcatgagttagcccccggcatcgactgcccggagaccgccaccttcctggacactttccactactatgatgccgatgacccggtccattatccccgagccctctgcctctttgaaatgcccacaggggtgccccttcggcggcactttaattccaactttaaaggtggcttcaacttctatgcggggctgaagggccaggtgctggtgctgcggacaacttcaactgtctacaattatgattacatttgggactttatcttctaccccaacggggtgatggaggccaagatgcatgccactggctacgtccacgccaccttctacacccccgaggggctgcgccacggcactcgcctgcacacccacctgattggcaacatacacactcacttggtgcactaccgcgtagacctggatgtggcaggcaccaagaacagcttccagacactgcagatgaagctagaaaacatcaccaacccctggagcccaagacaccgcgtggtccagccaactctggagcagacgcagtactcctgggagcgccaggcggccttccgcttcaaaaggaagctgcctaagtacctgctctttaccagcccccaggagaacccctggggccacaagcgcagctaccgcctgcagatccactccatggccgaccaggtgctgcccccaggctggcaggaggagcaggccatcacctgggcaaggtaccccctggcagtgaccaagtaccgggagtcggagctgtgcagcagcagcatctaccaccagaacgacccctggcacccgcccgtggtctttgagcagtttcttcacaacaacgagaacattgaaaatgaggacctggtggcctgggtgacggtgggcttcctgcacatcccccactcagaggacattcccaacacagccacacctgggaactccgtgggcttcctgctccggccattcaacttcttcccagaggacccctccctggcatccagagacactgtgatcgtgtggcctcgggacaacggccccaactacgtccagcgctggatccctgaggacagggactgctcgatgcctcccccttttagctacaatgggacctatagacctgtgtgaccagcccccagttcctcccccagttcctcccaggaagcccaggagcctcactggggcagacaataaaccctcagagcctc

SEQ ID NO: 329948 - DNA, 1702 bp, Homo sapiens
cgaagctgcaggacacggccagagtgttcacactacgaaggagggcccgggtgtcctaacgccgggttcacacgtgtgttcacagagctacggccacacacacgccttccaaggtggcaagctacaacacctctgaactggcactttcacatttttacaaatgcagctgctgcttctcaaaaaaacaaacaaacaaacaaaaaaccctccaattcagtttttataaatattaagcatgaatattaaaaggtgcttctacttttggttgtaaaaacacctgaatgactctaagactgatatgtattttcaagtctaagctgtcttacagaagatcttttataaatgtttccttataaatatctcaccattacaacaaattgttttaactgtttttctattagctctagctgcatatttgatgtaaatgacaattactgaaaaaatgtcagaaaaaacattttcagtactaacattaaagtgccatatgtaaaaaagaaaaatgtgatttgtataactaaataacacacaaacatcaagaggctatttatacaaataatttatttccactagggaaagtgcattactggtgaaggtattatcaatttattctacttgcttataatgttacagtgaatgttctggcttactctgcctcactttccattccccaaaatgatgtgtatgttgctaattttccaataaactcatatgaaccataaggaaacataaaaaaaaaaaaaaaaaaaaaaaaaaaactcggggactttatcttctaccccaacggggtgatggaggccaagatgcatgccactggctacgtccacgccaccttctacacccccgaggggctgcgccacggcactcgcctgcacacccacctgattggcaacatacacactcacttggtgcactaccgcgtagacctggatgtggcaggcaccaagaacagcttccagacactgcagatgaagctagaaaacatcaccaacccctggagcccaagacaccgcgtggtccagccaactctggagcagacgcagtactcctgggagcgccaggcggccttccgcttcaaaaggaagctgcctaagtacctgctctttaccagcccccaggagaacccctggggccacaagcgcagctaccgcctgcagatccactccatggccgaccaggtgctgcccccaggctggcaggaggagcaggccatcacctgggcaaggtaccccctggcagtgaccaagtaccgggagtcggagctgtgcagcagcagcatctaccaccagaacgacccctggcacccgcccgtggtctttgagcagtttcttcacaacaacgagaacattgaaaatgaggacctggtggcctgggtgacggtgggcttcctgcacatcccccactcagaggacattcccaacacagccacacctgggaactccgtgggcttcctgctccggccattcaacttcttcccagaggacccctccctggcatccagagacactgtgatcgtgtggcctcgggacaacggccccaactacgtccagcgctggatccctgaggacagggactgctcgatgcctcccccttttagctacaatgggacctatagacctgtgtgaccagcccccagttcctcccccagttcctcccaggaagcccaggagcctcactggggcagacaataaaccctcagagcctc

SEQ ID NO: 329949 - DNA, 508 bp, Homo sapiens
gcaagttcagaggtcacaacagagctgctcatctctttaaaaaggggctggagaggaattcagcaagtttccaggcagaactgaaaatgaccaaaggctagagtggcctccagtggtcagtactcagccctgcccactgaagcccaccctgtctcctgcaggacctggtggcctgggtgacggtgggcttcctgcacatcccccactcagaggacattcccaacacagccacacctgggaactccgtgggcttcctgctccggccattcaacttcttcccagaggacccctccctggcatccagagacactgtgatcgtgtggcctcgggacaacggccccaactacgtccagcgctggatccctgaggacagggactgctcgatgcctcccccttttagctacaatgggacctatagacctgtgtgaccagcccccagttcctcccccagttcctcccaggaagcccaggagcctcactggggcagacaataaaccctcagagcctc

SEQ ID NO: 329950 - DNA, 2491 bp, Homo sapiens
tctgattgacttcaagaaggagtcagagatcagcttaagggcaaaggctggaagcagagcgaactgggagcagagcacacagagccgtggagcgagagatgccggccctgggctgggccgtggctgccatcctgatgctgcagacggccatggcggagccctccccggggactctgcccaggaaggcaggggtgttttcagacctaagcaaccaagagctgaaggcagtgcacagcttcctctggtccaagaaggagctgaggctgcagccctccagtaccaccaccatggccaagaacaccgtgtttctcatcgagatgctgctgcccaagaagtaccatgtgctgaggtttctggataaaggtgaaaggcatcctgtgcgggaagcccgtgccgtcatcttctttggtgaccaggagcatcccaatgtcaccgagtttgctgtggggcccctgccagggccctgctacatgcgagcactgtcccccaggcctgggtaccagtcctcctgggcatcgaggcccatctccacagcagagtatgccctcctctaccacaccctgcaggaagccaccaagcccctgcatcagttcttcctcaataccacaggcttctcattccaagactgccatgacagatgcctggccttcaccgatgtggccccccggggtgtggcttctggccagcgccgcagttggcttatcatacagcgctatgtagaaggctactttctgcaccccactgggctggagctcctcgtggatcatgggagcacagatgctgggcactgggccgtggagcaggtgtggtacaacgggaagttctatgggagcccagaggaactggctcggaagtatgcagatggagaggtggacgtggtggtcctggaggacccgctgcctgggggcaaggggcatgacagcacagaggagccgcccctcttctcctcccacaagccccgcggggacttccccagccccatccatgtgagcggcccccgcttggtccagccccacggccctcgcttcaggctggagggcaacgctgtgctctacggcggctggagctttgccttccggctgcgctcctcctccgggctgcaggtcctgaacgtgcacttcggcggagagcgcattgcctatgaggtcagcgtgcaagaggcagtggcgctgtatggaggacacacacctgcaggcatgcagaccaagtacctcgatgtcggctggggcctgggcagcgtcactcatgagttagcccccggcatcgactgcccggagaccgccaccttcctggacactttccactactatgatgccgatgacccggtccattatccccgagccctctgcctctttgaaatgcccacaggggtgccccttcggcggcactttaattccaactttaaaggtggcttcaacttctatgcggggctgaagggccaggtgctggtgctgcggacaacttcaactgtctacaattatgattacatttgggactttatcttctaccccaacggggtgatggaggccaagatgcatgccactggctacgtccacgccaccttctacacccccgaggggctgcgccacggcactcgcctgcacacccacctgattggcaacatacacactcacttggtgcactaccgcgtagacctggatgtggcaggcaccaagaacagcttccagacactgcagatgaagctagaaaacatcaccaacccctggagcccaagacaccgcgtggtccagccaactctggagcagacgcagtactcctgggagcgccaggcggccttccgcttcaaaaggaagctgcctaagtacctgctctttaccagcccccaggagaacccctggggccacaagcgcagctaccgcctgcagatccactccatggccgaccaggtgctgcccccaggctggcaggaggagcaggccatcacctgggcaaggactgaggggggccagcccagggccctgagccaagctgcttcgcctgtgcctggcaggtaccccctggcagtgaccaagtaccgggagtcggagctgtgcagcagcagcatctaccaccagaacgacccctggcacccgcccgtggtctttgagcagtttcttcacaacaacgagaacattgaaaatgaggacctggtggcctgggtgacggtgggcttcctgcacatcccccactcagaggacattcccaacacagccacacctgggaactccgtgggcttcctgctccggccattcaacttcttcccagaggacccctccctggcatccagagacactgtgatcgtgtggcctcgggacaacggccccaactacgtccagcgctggatccctgaggacagggactgctcgatgcctcccccttttagctacaatgggacctatagacctgtgtgaccagcccccagttcctcccccagttcctcccaggaagcccaggagcctcactggggcagacaataaaccctcagagcctc

SEQ ID NO: 329951 - DNA, 2923 bp, Homo sapiens
agcgactgggaagacatgaccttacacaccttggttctttaacttgaccttgggaagacagggccagccagcaaggtggctggggagaaggccgaggtccccgggccgcagacgggaattgagggtcaggagccgaagtgaaactggagccggcgccacgagatgcagccctgaagggcacctccacccagtggccctcccccaccccactcccggggccctcctggcccagcgtcaccctgctgcgctaggacctacaagggcggcctctgggagccctctgctttacctcctctcctgggtcaggctgcagaaagaacaagctcctccaccctgcctgctttcaaatctgtacctgttgatgagagaacctccaggtttgtcccctactaccaatgatgaggcaaacacagagagaggaacccctttgactaaagctgaattgtaaaggactaaagccctaacttctcttcgaatgacctgcattcaaatcaagagcggttgaattctctgttttgctgtgggtgccagcctctatcagcccctgccctggtccatctgtcagcttcagagccgtggagcgagagatgccggccctgggctgggccgtggctgccatcctgatgctgcagacggccatggcggagccctccccggggactctgcccaggaaggcaggggtgttttcagacctaagcaaccaagagctgaaggcagtgcacagcttcctctggtccaagaaggagctgaggctgcagccctccagtaccaccaccatggccaagaacaccgtgtttctcatcgagatgctgctgcccaagaagtaccatgtgctgaggtttctggataaaggtgaaaggcatcctgtgcgggaagcccgtgccgtcatcttctttggtgaccaggagcatcccaatgtcaccgagtttgctgtggggcccctgccagggccctgctacatgcgagcactgtcccccaggcctgggtaccagtcctcctgggcatcgaggcccatctccacagcagagtatgccctcctctaccacaccctgcaggaagccaccaagcccctgcatcagttcttcctcaataccacaggcttctcattccaagactgccatgacagatgcctggccttcaccgatgtggccccccggggtgtggcttctggccagcgccgcagttggcttatcatacagcgctatgtagaaggctactttctgcaccccactgggctggagctcctcgtggatcatgggagcacagatgctgggcactgggccgtggagcaggtgtggtacaacgggaagttctatgggagcccagaggaactggctcggaagtatgcagatggagaggtggacgtggtggtcctggaggacccgctgcctgggggcaaggggcatgacagcacagaggagccgcccctcttctcctcccacaagccccgcggggacttccccagccccatccatgtgagcggcccccgcttggtccagccccacggccctcgcttcaggctggagggcaacgctgtgctctacggcggctggagctttgccttccggctgcgctcctcctccgggctgcaggtcctgaacgtgcacttcggcggagagcgcattgcctatgaggtcagcgtgcaagaggcagtggcgctgtatggaggacacacacctgcaggcatgcagaccaagtacctcgatgtcggctggggcctgggcagcgtcactcatgagttagcccccggcatcgactgcccggagaccgccaccttcctggacactttccactactatgatgccgatgacccggtccattatccccgagccctctgcctctttgaaatgcccacaggggtgccccttcggcggcactttaattccaactttaaaggtggcttcaacttctatgcggggctgaagggccaggtgctggtgctgcggacaacttcaactgtctacaattatgattacatttgggactttatcttctaccccaacggggtgatggaggccaagatgcatgccactggctacgtccacgccaccttctacacccccgaggggctgcgccacggcactcgcctgcacacccacctgattggcaacatacacactcacttggtgcactaccgcgtagacctggatgtggcaggcaccaagaacagcttccagacactgcagatgaagctagaaaacatcaccaacccctggagcccaagacaccgcgtggtccagccaactctggagcagacgcagtactcctgggagcgccaggcggccttccgcttcaaaaggaagctgcctaagtacctgctctttaccagcccccaggagaacccctggggccacaagcgcagctaccgcctgcagatccactccatggccgaccaggtgctgcccccaggctggcaggaggagcaggccatcacctgggcaaggtaccccctggcagtgaccaagtaccgggagtcggagctgtgcagcagcagcatctaccaccagaacgacccctggcacccgcccgtggtctttgagcagtttcttcacaacaacgagaacattgaaaatgaggacctggtggcctgggtgacggtgggcttcctgcacatcccccactcagaggacattcccaacacagccacacctgggaactccgtgggcttcctgctccggccattcaacttcttcccagaggacccctccctggcatccagagacactgtgatcgtgtggcctcgggacaacggccccaactacgtccagcgctggatccctgaggacagggactgctcgatgcctcccccttttagctacaatgggacctatagacctgtgtgaccagcccccagttcctcccccagttcctcccaggaagcccaggagcctcactggggcagacaataaaccctcagagcctc

SEQ ID NO: 329952 - DNA, 1956 bp, Homo sapiens
tctgattgacttcaagaaggagtcagagatcagcttaagggcaaaggctggaagcagagcgaactgggagcagagcacacagagccgtggagcgagagatgccggccctgggctgggccgtggctgccatcctgatgctgcagacggccatggcggagccctccccggggactctgcccaggaaggcaggggtgttttcagacctaagcaaccaagagctgaaggcagtgcacagcttcctctggtccaagaaggagctgaggctgcagccctccagtaccaccaccatggccaagaacaccgtgtttctcatcgagatgctgctgcccaagaagtaccatgtgctgaggtttctggataaaggtgaaaggcatcctgtgcgggaagcccgtgccgtcatcttctttggtgaccaggagcatcccaatgtcaccgagtttgctgtggggcccctgccagggccctgctacatgcgagcactgtcccccaggcctgggtaccagtcctcctgggcatcgaggcccatctccacagcagagtatgccctcctctaccacaccctgcaggaagccaccaagcccctgcatcagttcttcctcaataccacaggcttctcattccaagactgccatgacagatgcctggccttcaccgatgtggccccccggggtgtggcttctggccagcgccgctgtatggaggacacacacctgcaggcatgcagaccaagtacctcgatgtcggctggggcctgggcagcgtcactcatgagttagcccccggcatcgactgcccggagaccgccaccttcctggacactttccactactatgatgccgatgacccggtccattatccccgagccctctgcctctttgaaatgcccacaggggtgccccttcggcggcactttaattccaactttaaaggtggcttcaacttctatgcggggctgaagggccaggtgctggtgctgcggacaacttcaactgtctacaattatgattacatttgggactttatcttctaccccaacggggtgatggaggccaagatgcatgccactggctacgtccacgccaccttctacacccccgaggggctgcgccacggcactcgcctgcacacccacctgattggcaacatacacactcacttggtgcactaccgcgtagacctggatgtggcaggcaccaagaacagcttccagacactgcagatgaagctagaaaacatcaccaacccctggagcccaagacaccgcgtggtccagccaactctggagcagacgcagtactcctgggagcgccaggcggccttccgcttcaaaaggaagctgcctaagtacctgctctttaccagcccccaggagaacccctggggccacaagcgcagctaccgcctgcagatccactccatggccgaccaggtgctgcccccaggctggcaggaggagcaggccatcacctgggcaaggtaccccctggcagtgaccaagtaccgggagtcggagctgtgcagcagcagcatctaccaccagaacgacccctggcacccgcccgtggtctttgagcagtttcttcacaacaacgagaacattgaaaatgaggacctggtggcctgggtgacggtgggcttcctgcacatcccccactcagaggacattcccaacacagccacacctgggaactccgtgggcttcctgctccggccattcaacttcttcccagaggacccctccctggcatccagagacactgtgatcgtgtggcctcgggacaacggccccaactacgtccagcgctggatccctgaggacagggactgctcgatgcctcccccttttagctacaatgggacctatagacctgtgtgaccagcccccagttcctcccccagttcctcccaggaagcccaggagcctcactggggcagacaataaaccctcagagcctc

SEQ ID NO: 329953 - DNA, 2573 bp, Homo sapiens
tctgattgacttcaagaaggagtcagagatcagcttaagggcaaaggctggaagcagagcgaactgggagcagagcacacagagccgtggagcgagagatgccggccctgggctgggccgtggctgccatcctgatgctgcagacggccatggcggagccctccccggggactctgcccaggaaggcaggggtgttttcagacctaagcaaccaagagctgaaggcagtgcacagcttcctctggtccaagaaggagctgaggctgcagccctccagtaccaccaccatggccaagaacaccgtgtttctcatcgagatgctgctgcccaagaagtaccatgtgctgaggtttctggataaaggtgaaaggcatcctgtgcgggaagcccgtgccgtcatcttctttggtgaccaggagcatcccaatgtcaccgagtttgctgtggggcccctgccagggccctgctacatgcgagcactgtcccccaggcctgggtaccagtcctcctgggcatcgaggcccatctccacagcagagtatgccctcctctaccacaccctgcaggaagccaccaagcccctgcatcagttcttcctcaataccacaggcttctcattccaagactgccatgacagatgcctggccttcaccgatgtggccccccggggtgtggcttctggccagcgccgcagttggcttatcatacagcgctatgtagaaggctactttctgcaccccactgggctggagctcctcgtggatcatgggagcacagatgctgggcactgggccgtggagcaggtgtggtacaacgggaagttctatgggagcccagaggaactggctcggaagtatgcagatggagaggtggacgtggtggtcctggaggacccgctgcctgggggcaaggggcatgacagcacagaggagccgcccctcttctcctcccacaagccccgcggggacttccccagccccatccatgtgagcggcccccgcttggtccagccccacggccctcgcttcaggctggagggcaacgctgtgctctacggcggctggagctttgccttccggctgcgctcctcctccgggctgcaggtcctgaacgtgcacttcggcggagagcgcattgcctatgaggtcagcgtgcaagaggcagtggcgctgtatggaggacacacacctgcaggcatgcagaccaagtacctcgatgtcggctggggcctgggcagcgtcactcatgagttagcccccggcatcgactgcccggagaccgccaccttcctggacactttccactactatgatgccgatgacccggtccattatccccgagccctctgcctctttgaaatgcccacaggggtgccccttcggcggcactttaattccaactttaaaggtggcttcaacttctatgcggggctgaagggccaggtgctggtgctgcggacaacttcaactgtctacaattatgattacatttgggactttatcttctaccccaacggggtgatggaggccaagatgcatgccactggctacgtccacgccaccttctacacccccgaggggctgcgccacggcactcgcctgcacacccacctgattggcaacatacacactcacttggtgcactaccgcgtagacctggatgtggcaggcaccaagaacagcttccagacactgcagatgaagctagaaaacatcaccaacccctggagcccaagacaccgcgtggtccagccaactctggagcagacgcagtactcctgggagcgccaggcggccttccgcttcaaaaggaagctgcctaagtacctgctctttaccagcccccaggagaacccctggggccacaagcgcagctaccgcctgcagatccactccatggccgaccaggtgctgcccccaggctggcaggaggagcaggccatcacctgggcaagtgggctgaggaagaggaggaggaggggctggtcttgctgtctcacggtggcagaggcggaagaaactccaaatgaaagtggacttgtgtgctgggcgcaggagctcacgcctgtaatcccagcactttgggaggccaaggtaccccctggcagtgaccaagtaccgggagtcggagctgtgcagcagcagcatctaccaccagaacgacccctggcacccgcccgtggtctttgagcagtttcttcacaacaacgagaacattgaaaatgaggacctggtggcctgggtgacggtgggcttcctgcacatcccccactcagaggacattcccaacacagccacacctgggaactccgtgggcttcctgctccggccattcaacttcttcccagaggacccctccctggcatccagagacactgtgatcgtgtggcctcgggacaacggccccaactacgtccagcgctggatccctgaggacagggactgctcgatgcctcccccttttagctacaatgggacctatagacctgtgtgaccagcccccagttcctcccccagttcctcccaggaagcccaggagcctcactggggcagacaataaaccctcagagcctc

SEQ ID NO: 329954 - DNA, 2183 bp, Homo sapiens
tctgattgacttcaagaaggagtcagagatcagcttaagggcaaaggctggaagcagagcgaactgggagcagagcacacagagccgtggagcgagagatgccggccctgggctgggccgtggctgccatcctgatgctgcagacggccatggcggagccctccccggggactctgcccaggaaggcaggggtgttttcagacctaagcaaccaagagctgaaggcagtgcacagcttcctctggtccaagaaggagctgaggctgcagccctccagtaccaccaccatggccaagaacaccgtgtttctcatcgagatgctgctgcccaagaagtaccatgtgctgaggtttctggataaaggtgaaaggcatcctgtgcgggaagcccgtgccgtcatcttctttggtgaccaggagcatcccaatgtcaccgagtttgctgtggggcccctgccagggccctgctacatgcgagcactgtcccccaggcctgggtaccagtcctcctgggcatcgaggcccatctccacagcagagtatgccctcctctaccacaccctgcaggaagccaccaagcccctgcatcagttcttcctcaataccacaggcttctcattccaagactgccatgacagatgcctggccttcaccgatgtggccccccggggtgtggcttctggccagcgccgcagttggcttatcatacagcgctatgtagaaggctactttctgcaccccactgggctggagctcctcgtggatcatgggagcacagatgctgggcactgggccgtggagcaggtgtggtacaacgggaagttctatgggagcccagaggaactggctcggaagtatgcagatggagaggtggacgtggtggtcctggaggacccgctgcctgggggcaaggggcatgacagcacagaggagccgcccctcttctcctcccacaagccccgcggggacttccccagccccatccatgtgagcggcccccgcttggtccagccccacggccctcgcttcaggctggagggcaacgctgtgctctacggcggctggagctttgccttccggctgcgctcctcctccgggctgcaggtcctgaacgtgcacttcggcggagagcgcattgcctatgaggtcagcgtgcaagaggcagtggcgctgtatggaggacacacacctgcaggcatgcagaccaagtacctcgatgtcggctggggcctgggcagcgtcactcatgagttagcccccggcatcgactgcccggagaccgccaccttcctggacactttccactactatgatgccgatgacccggtccattatccccgagccctctgcctctttgaaatgcccacaggggtgccccttcggcggcactttaattccaactttaaaggtggcttcaacttctatgcggggctgaagggccaggtgctggtgctgcggacaacttcaactgtctacaattatgattacatttgggactttatcttctaccccaacggggtgatggaggccaagatgcatgccactggctacgtccacgccaccttctacacccccgaggggctgcgccacggcactcgcctgcacacccacctgattggcaacatacacactcacttggtgcactaccgcgtagacctggatgtggcaggcaccaagaacagcttccagacactgcagatgaagctagaaaacatcaccaacccctggagcccaagacaccgcgtggtccagccaactctggagcagacgcagtactcctgggagcgccaggcggccttccgcttcaaaaggaagctgcctaagtacctgctctttaccagcccccaggagaacccctggggccacaagcgcagctaccgcctgcagatccactccatggccgaccaggtgctgcccccaggctggcaggaggagcaggccatcacctgggcaaggtaccccctggcagtgaccaagtaccgggagtcggagctgtgcagcagcagcatctaccaccagaacgacccctggcacccgcccgtggtctttgagcagtttcttcacaacaacgagaacattgaaaatgaggacctggtggcctgggtgacggtgggcttcctgcacatcccccactcagaggacattcccaacacagccacacctcagagcctcgctctgtgtgct

SEQ ID NO: 329955 - DNA, 2307 bp, Homo sapiens
tctgattgacttcaagaaggagtcagagatcagcttaagggcaaaggctggaagcagagcgaactgggagcagagcacacagagccgtggagcgagagatgccggccctgggctgggccgtggctgccatcctgatgctgcagacggccatggcggagccctccccggggactctgcccaggaaggcaggggtgttttcagacctaagcaaccaagagctgaaggcagtgcacagcttcctctggtccaagaaggagctgaggctgcagccctccagtaccaccaccatggccaagaacaccgtgtttctcatcgagatgctgctgcccaagaagtaccatgtgctgaggtttctggataaaggtgaaaggcatcctgtgcgggaagcccgtgccgtcatcttctttggtgaccaggagcatcccaatgtcaccgagtttgctgtggggcccctgccagggccctgctacatgcgagcactgtcccccaggcctgggtaccagtcctcctgggcatcgaggcccatctccacagcagagtatgccctcctctaccacaccctgcaggaagccaccaagcccctgcatcagttcttcctcaataccacaggcttctcattccaagactgccatgacagatgcctggccttcaccgatgtggccccccggggtgtggcttctggccagcgccgcagttggcttatcatacagcgctatgtagaaggctactttctgcaccccactgggctggagctcctcgtggatcatgggagcacagatgctgggcactgggccgtggagcaggtgtggtacaacgggaagttctatgggagcccagaggaactggctcggaagtatgcagatggagaggtggacgtggtggtcctggaggacccgctgcctgggggcaaggggcatgacagcacagaggagccgcccctcttctcctcccacaagccccgcggggacttccccagccccatccatgtgagcggcccccgcttggtccagccccacggccctcgcttcaggctggagggcaacgctgtgctctacggcggctggagctttgccttccggctgcgctcctcctccgggctgcaggtcctgaacgtgcacttcggcggagagcgcattgcctatgaggtcagcgtgcaagaggcagtggcgctgtatggaggacacacacctgcaggcatgcagaccaagtacctcgatgtcggctggggcctgggcagcgtcactcatgagttagcccccggcatcgactgcccggagaccgccaccttcctggacactttccactactatgatgccgatgacccggtccattatccccgagccctctgcctctttgaaatgcccacaggggtgccccttcggcggcactttaattccaactttaaaggtggcttcaacttctatgcggggctgaagggccaggtgctggtgctgcggacaacttcaactgtctacaattatgattacatttgggactttatcttctaccccaacggggtgatggaggccaagatgcatgccactggctacgtccacgccaccttctacacccccgaggggctgcgccacggcactcgcctgcacacccacctgattggcaacatacacactcacttggtgcactaccgcgtagacctggatgtggcaggcaccaagaacagcttccagacactgcagatgaagctagaaaacatcaccaacccctggagcccaagacaccgcgtggtccagccaactctggagcagacgcagtactcctgggagcgccaggcggccttccgcttcaaaaggaagctgcctaagtacctgctctttaccagcccccaggagaacccctggggccacaagcgcagctaccgcctgcagatccactccatggccgaccaggtgctgcccccaggctggcaggaggagcaggccatcacctgggcaaggtgaggaagacccagggggcctgggggagggtcagtggcttccctcagtgtgtgtgtctgtgtctgtctgtgtttgtgtctatggggttcctagtctatgtggatatacacatatacgtatgtgtatatctgtgtgtacaattgaccctgaacaatatggggggtaggggtgccaaccccccaaagcagtaaagaagccaagtgtaactatgactcccccacaacgtaactacgaatagcctactgttaaccggaagccttaccactaacagaaacattccgtgaacacatattttgtaggttctgtgtgtcagatactgtgttcttacaataaagtaagctagagaaaagaa

SEQ ID NO: 329956 - DNA, 536 bp, Homo sapiens
tacttggtcactgccagggggtaccttgcccaggtgatggcctgctcctcctgccagcctgggggcagcacctggtcggccatggagtcggagctgtgcagcagcagcatctaccaccagaacgacccctggcacccgcccgtggtctttgagcagtttcttcacaacaacgagaacattgaaaatgaggacctggtggcctgggtgacggtgggcttcctgcacatcccccactcagaggacattcccaacacagccacacctgggaactccgtgggcttcctgctccggccattcaacttcttcccagaggacccctccctggcatccagagacactgtgatcgtgtggcctcgggacaacggccccaactacgtccagcgctggatccctgaggacagggactgctcgatgcctcccccttttagctacaatgggacctatagacctgtgtgaccagcccccagttcctcccccagttcctcccaggaagcccaggagcctcactggggcagacaataaaccctcagagcctc

SEQ ID NO: 329957 - DNA, 424 bp, Homo sapiens
tctgattgacttcaagaaggagtcagagatcagcttaagggcaaaggctggaagcagagcgaactgggagcagagcacacagagccgtggagcgagagatgccggccctgggctgggccgtggctgccatcctgatgctgcagacggccatggcggagccctccccggggactctgcccaggaaggcaggggtgttttcagacctaagcaaccagagacactgtgatcgtgtggcctcgggacaacggccccaactacgtccagcgctggatccctgtcctcagggatcctctgggaagacaccgaaaacgagccgaaccaaggaggcaaaatcgaaaaaaaaaggcagagcacaggaacactcgagaacagaaacgaaaacaacgacaagagaaacaaaggcaaggaaaacaacggaggagaa

SEQ ID NO: 329958 - DNA, 299 bp, Homo sapiens
ggagccctctgctttacctcctctcctgggtcaggctgcagaaagaacaagctcctccaccctgcctggtaggcatggaaggagggcaagtgttggtagccatggtaactcggggtagccatattttcgtgcagtcactctgaccccatctcgatggacaaggattgtcccatctgtttctacaactgtttcccaaacaggcagtgctgtcctaaggaagcacccacctggcccaaacatgctgtgctttctttgtggctgccttgcctccccaaccaattgtaaccccttggaatcag

SEQ ID NO: 329959 - DNA, 2405 bp, Homo sapiens
aggctggtactggtctgagtcgtaggatagcgaactgggagcagagcacacagagccgtggagcgagagatgccggccctgggctgggccgtggctgccatcctgatgctgcagacggccatggcggagccctccccggggactctgcccaggaaggcaggggtgttttcagacctaagcaaccaagagctgaaggcagtgcacagcttcctctggtccaagaaggagctgaggctgcagccctccagtaccaccaccatggccaagaacaccgtgtttctcatcgagatgctgctgcccaagaagtaccatgtgctgaggtttctggataaaggtgaaaggcatcctgtgcgggaagcccgtgccgtcatcttctttggtgaccaggagcatcccaatgtcaccgagtttgctgtggggcccctgccagggccctgctacatgcgagcactgtcccccaggcctgggtaccagtcctcctgggcatcgaggcccatctccacagcagagtatgccctcctctaccacaccctgcaggaagccaccaagcccctgcatcagttcttcctcaataccacaggcttctcattccaagactgccatgacagatgcctggccttcaccgatgtggccccccggggtgtggcttctggccagcgccgcagttggcttatcatacagcgctatgtagaaggctactttctgcaccccactgggctggagctcctcgtggatcatgggagcacagatgctgggcactgggccgtggagcaggtgtggtacaacgggaagttctatgggagcccagaggaactggctcggaagtatgcagatggagaggtggacgtggtggtcctggaggacccgctgcctgggggcaaggggcatgacagcacagaggagccgcccctcttctcctcccacaagccccgcggggacttccccagccccatccatgtgagcggcccccgcttggtccagccccacggccctcgcttcaggctggagggcaacgctgtgctctacggcggctggagctttgccttccggctgcgctcctcctccgggctgcaggtcctgaacgtgcacttcggcggagagcgcattgcctatgaggtcagcgtgcaagaggcagtggcgctgtatggaggacacacacctgcaggcatgcagaccaagtacctcgatgtcggctggggcctgggcagcgtcactcatgagttagcccccggcatcgactgcccggagaccgccaccttcctggacactttccactactatgatgccgatgacccggtccattatccccgagccctctgcctctttgaaatgcccacaggggtgccccttcggcggcactttaattccaactttaaaggtggcttcaacttctatgcggggctgaagggccaggtgctggtgctgcggacaacttcaactgtctacaattatgattacatttgggactttatcttctaccccaacggggtgatggaggccaagatgcatgccactggctacgtccacgccaccttctacacccccgaggggctgcgccacggcactcgcctgcacacccacctgattggcaacatacacactcacttggtgcactaccgcgtagacctggatgtggcaggcaccaagaacagcttccagacactgcagatgaagctagaaaacatcaccaacccctggagcccaagacaccgcgtggtccagccaactctggagcagacgcagtactcctgggagcgccaggcggccttccgcttcaaaaggaagctgcctaagtacctgctctttaccagcccccaggagaacccctggggccacaagcgcagctaccgcctgcagatccactccatggccgaccaggtgctgcccccaggctggcaggaggagcaggccatcacctgggcaaggtaccccctggcagtgaccaagtaccgggagtcggagctgtgcagcagcagcatctaccaccagaacgacccctggcacccgcccgtggtctttgagcagtttcttcacaacaacgagaacattgaaaatgaggacctggtggcctgggtgacggtgggcttcctgcacatcccccactcagaggacattcccaacacagccacacctgggaactccgtgggcttcctgctccggccattcaacttcttcccagaggacccctccctggcatccagagacactgtgatcgtgtggcctcgggacaacggccccaactacgtccagcgctggatccctgaggacagggactgctcgatgcctcccccttttagctacaatgggacctatagacctgtgtgaccagcccccagttcctcccccagttcctcccaggaagcccaggagcctcactggggcagacaataaaccctcagagcctc

SEQ ID NO: 329960 - DNA, 2616 bp, Homo sapiens
  misc_feature (2444)..(2444): n is a, c, g, or t
  misc_feature (2449)..(2449): n is a, c, g, or t
tctgattgacttcaagaaggagtcagagatcagcttaagggcaaaggctggaagcagagcgaactgggagcagagcacacagagccgtggagcgagagatgccggccctgggctgggccgtggctgccatcctgatgctgcagacggccatggcggagccctccccggggactctgcccaggaaggcaggggtgttttcagacctaagcaaccaagagctgaaggcagtgcacagcttcctctggtccaagaaggagctgaggctgcagccctccagtaccaccaccatggccaagaacaccgtgtttctcatcgagatgctgctgcccaagaagtaccatgtgctgaggtttctggataaaggtgaaaggcatcctgtgcgggaagcccgtgccgtcatcttctttggtgaccaggagcatcccaatgtcaccgagtttgctgtggggcccctgccagggccctgctacatgcgagcactgtcccccaggcctgggtaccagtcctcctgggcatcgaggcccatctccacagcagagtatgccctcctctaccacaccctgcaggaagccaccaagcccctgcatcagttcttcctcaataccacaggcttctcattccaagactgccatgacagatgcctggccttcaccgatgtggccccccggggtgtggcttctggccagcgccgcagttggcttatcatacagcgctatgtagaaggctactttctgcaccccactgggctggagctcctcgtggatcatgggagcacagatgctgggcactgggccgtggagcaggtgtggtacaacgggaagttctatgggagcccagaggaactggctcggaagtatgcagatggagaggtggacgtggtggtcctggaggacccgctgcctgggggcaaggggcatgacagcacagaggagccgcccctcttctcctcccacaagccccgcggggacttccccagccccatccatgtgagcggcccccgcttggtccagccccacggccctcgcttcaggctggagggcaacgctgtgctctacggcggctggagctttgccttccggctgcgctcctcctccgggctgcaggtcctgaacgtgcacttcggcggagagcgcattgcctatgaggtcagcgtgcaagaggcagtggcgctgtatggaggacacacacctgcaggcatgcagaccaagtacctcgatgtcggctggggcctgggcagcgtcactcatgagttagcccccggcatcgactgcccggagaccgccaccttcctggacactttccactactatgatgccgatgacccggtccattatccccgagccctctgcctctttgaaatgcccacaggggtgccccttcggcggcactttaattccaactttaaaggtggcttcaacttctatgcggggctgaagggccaggtgctggtgctgcggacaacttcaactgtctacaattatgattacatttgggactttatcttctaccccaacggggtgatggaggccaagatgcatgccactggctacgtccacgccaccttctacacccccgaggggctgcgccacggcactcgcctgcacacccacctgattggcaacatacacactcacttggtgcactaccgcgtagacctggatgtggcaggcaccaagaacagcttccagacactgcagatgaagctagaaaacatcaccaacccctggagcccaagacaccgcgtggtccagccaactctggagcagacgcagtactcctgggagcgccaggcggccttccgcttcaaaaggaagctgcctaagtacctgctctttaccagcccccaggagaacccctggggccacaagcgcagctaccgcctgcagatccactccatggccgaccaggtgctgcccccaggctggcaggaggagcaggccatcacctgggcaaggtaccccctggcagtgaccaagtaccgggagtcggagctgtgcagcagcagcatctaccaccagaacgacccctggcacccgcccgtggtctttgagcagtttcttcacaacaacgagaacattgaaaatgaggacctggtggcctgggtgacggtgggcttcctgcacatcccccactcagaggacattcccaacacagccacacctgggaactccgtgggcttcctgctccggccattcaacttcttcccagaggacccctccctggcatccagagacactgtgatcgtgtggcctcgggacaacggccccaactacgtccagcgctggatccctgaggacagggactgctcgatgcctcccccttttagctacaatgggacctatagacctgtgtgaccagcccccagttcctcccccagttcctcccaggaagcccaggagcctcactggggcagacaataaaccctcagagcctcaaaaaaaaanaaaanaaaaaaaaaaaaaaaaaaaaaaaaaaaaaaacttgtgggccgctttgcccaagtgaattttagactggagcaagtttatcattgcggcccaatttggggctacctgggcaattcgccctatggggggggtataaattcaagggcccgggtttaaaagggtgggacgg

SEQ ID NO: 329961 - DNA, 2457 bp, Homo sapiens
tctgattgacttcaagaaggagtcagagatcagcttaagggcaaaggctggaagcagagcgaactgggagcagagcacacagagccgtggagcgagagatgccggccctgggctgggccgtggctgccatcctgatgctgcagacggccatggcggagccctccccggggactctgcccaggaaggcaggggtgttttcagacctaagcaaccaagagctgaaggcagtgcacagcttcctctggtccaagaaggagctgaggctgcagccctccagtaccaccaccatggccaagaacaccgtgtttctcatcgagatgctgctgcccaagaagtaccatgtgctgaggtttctggataaaggtgaaaggcatcctgtgcgggaagcccgtgccgtcatcttctttggtgaccaggagcatcccaatgtcaccgagtttgctgtggggcccctgccagggccctgctacatgcgagcactgtcccccaggcctgggtaccagtcctcctgggcatcgaggcccatctccacagcagagtatgccctcctctaccacaccctgcaggaagccaccaagcccctgcatcagttcttcctcaataccacaggcttctcattccaagactgccatgacagatgcctggccttcaccgatgtggccccccggggtgtggcttctggccagcgccgcagttggcttatcatacagcgctatgtagaaggctactttctgcaccccactgggctggagctcctcgtggatcatgggagcacagatgctgggcactgggccgtggagcaggtgtggtacaacgggaagttctatgggagcccagaggaactggctcggaagtatgcagatggagaggtggacgtggtggtcctggaggacccgctgcctgggggcaaggggcatgacagcacagaggagccgcccctcttctcctcccacaagccccgcggggacttccccagccccatccatgtgagcggcccccgcttggtccagccccacggccctcgcttcaggctggagggcaacgctgtgctctacggcggctggagctttgccttccggctgcgctcctcctccgggctgcaggtcctgaacgtgcacttcggcggagagcgcattgcctatgaggtcagcgtgcaagaggcagtggcgctgtatggaggacacacacctgcaggcatgcagaccaagtacctcgatgtcggctggggcctgggcagcgtcactcatgagttagcccccggcatcgactgcccggagaccgccaccttcctggacactttccactactatgatgccgatgacccggtccattatccccgagccctctgcctctttgaaatgcccacaggggtgccccttcggcggcactttaattccaactttaaaggtggcttcaacttctatgcggggctgaagggccaggtgctggtgctgcggacaacttcaactgtctacaattatgattacatttgggactttatcttctaccccaacggggtgatggaggccaagatgcatgccactggctacgtccacgccaccttctacacccccgaggggctgcgccacggcactcgcctgcacacccacctgattggcaacatacacactcacttggtgcactaccgcgtagacctggatgtggcaggcaccaagaacagcttccagacactgcagatgaagctagaaaacatcaccaacccctggagcccaagacaccgcgtggtccagccaactctggagcagacgcagtactcctgggagcgccaggcggccttccgcttcaaaaggaagctgcctaagtacctgctctttaccagcccccaggagaacccctggggccacaagcgcagctaccgcctgcagatccactccatggccgaccaggtgctgcccccaggctggcaggaggagcaggccatcacctgggcaaggtaccccctggcagtgaccaagtaccgggagtcggagctgtgcagcagcagcatctaccaccagaacgacccctggcacccgcccgtggtctttgagcagtttcttcacaacaacgagaacattgaaaatgaggacctggtggcctgggtgacggtgggcttcctgcacatcccccactcagaggacattcccaacacagccacacctgggaactccgtgggcttcctgctccggccattcaacttcttcccagaggacccctccctggcatccagagacactgtgatcgtgtggcctcgggacaacggccccaactacgtccagcgctggatccctgaggacagggactgctcgatgcctcccccttttagctacaatgggacctatagacctgtgtgaccagcccccagttcctcccccagttcctcccaggaagcccaggagcctcactggggcagacaataaaccctcagagcctcctcagagcctcgctctgtgtgct

SEQ ID NO: 329962 - DNA, 2342 bp, Homo sapiens
tctgattgacttcaagaaggagtcagagatcagcttaagggcaaaggctggaagcagagcgaactgggagcagagcacacagagccgtggagcgagagatgccggccctgggctgggccgtggctgccatcctgatgctgcagacggccatggcggagccctccccggggactctgcccaggaaggcaggggtgttttcagacctaagcaaccaagagctgaaggcagtgcacagcttcctctggtccaagaaggagctgaggctgcagccctccagtaccaccaccatggccaagaacaccgtgtttctcatcgagatgctgctgcccaagaagtaccatgtgctgaggtttctggataaaggtgaaaggcatcctgtgcgggaagcccgtgccgtcatcttctttggtgaccaggagcatcccaatgtcaccgagtttgctgtggggcccctgccagggccctgctacatgcgagcactgtcccccaggcctgggtaccagtcctcctgggcatcgaggcccatctccacagcagagtatgccctcctctaccacaccctgcaggaagccaccaagcccctgcatcagttcttcctcaataccacaggcttctcattccaagactgccatgacagatgcctggccttcaccgatgtggccccccggggtgtggcttctggccagcgccgcagttggcttatcatacagcgctatgtagaaggctactttctgcaccccactgggctggagctcctcgtggatcatgggagcacagatgctgggcactgggccgtggagcaggtgtggtacaacgggaagttctatgggagcccagaggaactggctcggaagtatgcagatggagaggtggacgtggtggtcctggaggacccgctgcctgggggcaaggggcatgacagcacagaggagccgcccctcttctcctcccacaagccccgcggggacttccccagccccatccatgtgagcggcccccgcttggtccagccccacggccctcgcttcaggctggagggcaacgctgtgctctacggcggctggagctttgccttccggctgcgctcctcctccgggctgcaggtcctgaacgtgcacttcggcggagagcgcattgcctatgaggtcagcgtgcaagaggcagtggcgctgtatggaggacacacacctgcaggcatgcagaccaagtacctcgatgtcggctggggcctgggcagcgtcactcatgagttagcccccggcatcgactgcccggagaccgccaccttcctggacactttccactactatgatgccgatgacccggtccattatccccgagccctctgcctctttgaaatgcccacaggggtgccccttcggcggcactttaattccaactttaaaggtggcttcaacttctatgcggggctgaagggccaggtgctggtgctgcggacaacttcaactgtctacaattatgattacatttgggactttatcttctaccccaacggggtgatggaggccaagatgcatgccactggctacgtccacgccaccttctacacccccgaggggctgcgccacggcactcgcctgcacacccacctgattggcaacatacacactcacttggtgcactaaccgcgtggtccagccaactctggagcagacgcagtactcctgggagcgccaggcggccttccgcttcaaaaggaagctgcctaagtacctgctctttaccagcccccaggagaacccctggggccacaagcgcagctaccgcctgcagatccactccatggccgaccaggtgctgcccccaggctggcaggaggagcaggccatcacctgggcaaggtaccccctggcagtgaccaagtaccgggagtcggagctgtgcagcagcagcatctaccaccagaacgacccctggcacccgcccgtggtctttgagcagtttcttcacaacaacgagaacattgaaaatgaggacctggtggcctgggtgacggtgggcttcctgcacatcccccactcagaggacattcccaacacagccacacctgggaactccgtgggcttcctgctccggccattcaacttcttcccagaggacccctccctggcatccagagacactgtgatcgtgtggcctcgggacaacggccccaactacgtccagcgctggatccctgaggacagggactgctcgatgcctcccccttttagctacaatgggacctatagacctgtgtgaccagcccccagttcctcccccagttcctcccaggaagcccaggagcctcactggggcagacaataaaccctcagagcctc

SEQ ID NO: 329963 - DNA, 2385 bp, Homo sapiens
tctgattgacttcaagaaggagtcagagatcagcttaagggcaaaggctggaagcagagcgaactgggagcagagcacacagagccgtggagcgagagatgccggccctgggctgggccgtggctgccatcctgatgctgcagacggccatggcggagccctccccggggactctgcccaggaaggcaggggtgttttcagacctaagcaaccaagagctgaaggcagtgcacagcttcctctggtccaagaaggagctgaggctgcagccctccagtaccaccaccatggccaagaacaccgtgtttctcatcgagatgctgctgcccaagaagtaccatgtgctgaggtttctggataaaggtgaaaggcatcctgtgcgggaagcccgtgccgtcatcttctttggtgaccaggagcatcccaatgtcaccgagtttgctgtggggcccctgccagggccctgctacatgcgagcactgtcccccaggcctgggtaccagtcctcctgggcatcgaggcccatctccacagcagagtatgccctcctctaccacaccctgcaggaagccaccaagcccctgcatcagttcttcctcaataccacaggcttctcattccaagactgccatgacagatgcctggccttcaccgatgtggccccccggggtgtggcttctggccagcgccgcagttggcttatcatacagcgctatgtagaaggctactttctgcaccccactgggctggagctcctcgtggatcatgggagcacagatgctgggcactgggccgtggagcaggtgtggtacaacgggaagttctatgggagcccagaggaactggctcggaagtatgcagatggagaggtggacgtggtggtcctggaggacccgctgcctgggggcaaggggcatgacagcacagaggagccgcccctcttctcctcccacaagccccgcggggacttccccagccccatccatgtgagcggcccccgcttggtccagccccacggccctcgcttcaggctggagggcaacgctgtgctctacggcggctggagctttgccttccggctgcgctcctcctccgggctgcaggtcctgaacgtgcacttcggcggagagcgcattgcctatgaggtcagcgtgcaagaggcagtggcgctgtatggaggacacacacctgcaggcatgcagaccaagtacctcgatgtcggctggggcctgggcagcgtcactcatgagttagcccccggcatcgactgcccggagaccgccaccttcctggacactttccactactatgatgccgatgacccggtccattatccccgagccctctgcctctttgaaatgcccacaggggtgccccttcggcggcactttaattccaactttaaaggtggcttcaacttctatgcggggctgaagggccaggtgctggtgctgcggacaacttcaactgtctacaattatgattacatttgggactttatcttctaccccaacggggtgatggaggccaagatgcatgccactggctacgtccacgccaccttctacacccccgaggggctgcgccacggcactcgcctgcacacccacctgattggcaacatacacactcacttggtgcactaccgcgtagacctggatgtggcaggcaccaagaacagcttccagacactgcagatgaagctagaaaacatcaccaacccctggagcccaagacaccgcgtggtccagccaactctggagcagacgcagtactcctgggagcgccaggcggccttccgcttcaaaaggaagctgcctaagtacctgctctttaccagcccccaggagaacccctggggccacaagcgcagctaccgcctgcagatccactccatggccgaccaggtgctgcccccaggctggcaggaggagcaggccatcacctgggcaaggtaccccctggcagtgaccaagtaccgggagtcggagctgtgcagcagcagcatctaccaccagaacgacccctggcacccgcccgtggtctttgagcagtttcttcacaacaacgagaacattgaaaatgaggacctggtggcctgggtgacggtgggcttcctgcacatcccccactcagaggacccctccctggcatccagagacactgtgatcgtgtggcctcgggacaacggccccaactacgtccagcgctggatccctgaggacagggactgctcgatgcctcccccttttagctacaatgggacctatagacctgtgtgaccagcccccagttcctcccccagttcctcccaggaagcccaggagcctcactggggcagacaataaaccctcagagcctcctcagagcctcgctctgtgtgct

SEQ ID NO: 329964 - DNA, 1963 bp, Homo sapiens
tctgattgacttcaagaaggagtcagagatcagcttaagggcaaaggctggaagcagagcgaactgggagcagagcacacagagccgtggagcgagagatgccggccctgggctgggccgtggctgccatcctgatgctgcagacggccatggcggagccctccccggggactctgcccaggaaggcaggggtgttttcagacctaagcaaccaagagctgaaggcagtgcacagcttcctctggtccaagaaggagctgaggctgcagccctccagtaccaccaccatggccaagaacaccgtgtttctcatcgagatgctgctgcccaagaagtaccatgtgctgaggtttctggataaaggtgaaaggcatcctgtgcgggaagcccgtgccgtcatcttctttggtgaccaggagcatcccaatgtcaccgagtttgctgtggggcccctgccagggccctgctacatgcgagcactgtcccccaggcctgggtaccagtcctcctgggcatcgaggcccatctccacagcagagtatgccctcctctaccacaccctgcaggaagccaccaagcccctgcatcagttcttcctcaataccacaggcttctcattccaagactgccatgacagatgcctggccttcaccgatgtggccccccggggtgtggcttctggccagcgccgcagttggcttatcatacagcgctatgtagaaggctactttctgcaccccactgggctggagctcctcgtggatcatgggagcacagatgctgggcactgggccgtggagcaggtgtggtacaacgggaagttctatgggagcccagaggaactggctcggaagtatgcagatggagaggtggacgtggtggtcctggaggacccgctgcctgggggcaaggggcatgacagcacagaggagccgcccctcttctcctcccacaagccccgcggggacttccccagccccatccatgtgagcggcccccgcttggtccagccccacggccctcgcttcaggctggagggcaacgctgtgctctacggcggctggagctttgccttccggctgcgctcctcctccgggctgcaggtcctgaacgtgcacttcggcggagagcgcattgcctatgaggtcagcgtgcaagaggcagtggcgctgtatggaggacacacacctgcaggcatgcagaccaagtacctcgatgtcggctggggcctgggcagcgtcactcatgagttagcccccggcatcgactgcccggagaccgccaccttcctggacactttccactactatgatgccgatgacccggtccattatccccgagccctctgcctctttgaaatgcccacaggggtgccccttcggcggcactttaattccaactttaaaggtggcttcaacttctatgcggggctgaagggccaggtgctggtgctgcggacaacttcaactgtctacaattatgattacatttgggactttatcttctaccccaacggggtgatggaggccaagatgcatgccactggctacgtccacgccaccttctacacccccgaggggctgcgccacggcactcgcctgcacacccacctgattggcaacatacacactcacttggtgcactaccgcgtagacctggatgtggcaggcaccaagaacagcttccagacactgcagatgaagctagaaaacatcaccaacccctggagcccaagacaccgcgtggtccagccaactctggagcagacgcagtactcctgggagcgccaggcggccttccgcttcaaaaggaagctgcctaagtacctgctctttaccagcccccaggagaacccctggggccacaagcgcagctaccgcctgcagatccactccatgccacaacgcagggttgcgcaactcaagaacgtcaaggaagacacaggccatcacaaagagcagaa

SEQ ID NO: 329965 - DNA, 1017 bp, Homo sapiens
  misc_feature (901)..(901): n is a, c, g, or t
  misc_feature (904)..(904): n is a, c, g, or t
  misc_feature (915)..(916): n is a, c, g, or t
  misc_feature (921)..(921): n is a, c, g, or t
  misc_feature (999)..(999): n is a, c, g, or t
agcgactgggaagacatgaccttacacaccttggttctttaacttgaccttgggaagacagggccagccagcaaggtggctggggagaaggccgaggtccccgggccgcagacgggaattgagggtcaggagccgaagtgaaactggagccggcgccacgagatgcagccctgaagggcacctccacccagtggccctcccccaccccactcccggggccctcctggcccagcgtcaccctgctgcgctaggacctacaagggcggcctctgggagccctctgctttacctcctctcctgggtcaggctgcagaaagaacaagctcctccaccctgcctgctttcaaatctgtacctgttgatgagagaacctccaggtttgtcccctactaccaatgatgaggcaaacacagagagaggaacccctttgactaaagctgaattgtaaaggactaaagccctaacttctcttcgaatgacctgcattcaaatcaagagcggttgaattctctgttttgctgtgggtgccagcctctatcagcccctgccctggtccatctgtcagcttcagagccgtggagcgagagatgccggccctgggctgggccgtggctgccatcctgatgctgcagacggccatggcggagccctccccggggactctgcccaggaaggcaggggtgttttcagacctaagcaaccaagagctgaaggcagtgcacagcttcctctggtccaagaaggagctgaggctgcagccctccagtaccaccaccatggccaagaacaccgtgtttctcatcgagatgctgctgcccaagaagtaccatgtgctgaggtttctggataaaggtgaaaggcatcctgtgcgggaagcccgtgccgtcatcttctttttttnggnttctgctgggnntttgnggtctttttgtttttttggggttggattatgggattgtcgcttgtctgaatttgggggcttggaaataaggcttggtngtattgatgtcatgggct

SEQ ID NO: 329966 - DNA, 124 bp, Homo sapiens
ggatgattggaggagagagactaattagtttattaagcatgaaagagttttttcttctttgggaagctttttttatatatagctcagtcttctaagaagtaagttcacaatttttcctttgttt

SEQ ID NO: 329967 - DNA, 616 bp, Homo sapiens
ggctggaaactcaggacgctgcagctgaaacgttccggctccggctctgctggccggtctaaagcggcagccgccggggcgcaatgcgagcggctggcgtaggcttggtggactgtcactgccacctctccgccccggactttgaccgcgtatgtgagggcgatacgggaccagagggagcagggaggcccccgtcctttcccctcgtgttatctttgctctcctcccttgggacgaaaccccatatcccccgcccagacccttgtttatggccatatgaccttgcccctcatttccctattccctatttaacctcagacataccgatttttttttcctgattcagtagcggtaagctatctccacaaggcttttgtttgctcttctgagttcctggaatcgttccctcactccccttggctggcctgtttttcccctcggggctctcacctcctggctgagatgccactctttgtgggaagcggtcctcgaaacgcgttcaaatcggggagaggtcgggcgcgggctcacgcccgtaatcccagcactttgggaggccgaggcgggcgctgcgcatctcctgtgtccaggagatcgtgaccagcctgggcaacat

SEQ ID NO: 329968 - DNA, 2466 bp, Homo sapiens
ggctggaaactcaggacgctgcagctgaaacgttccggctccggctctgctggccggtctaaagcggcagccgccggggcgcaatgcgagcggctggcgtaggcttggtggactgtcactgccacctctccgccccggactttgaccgcgatttggatgatgtgttggagaaagccaagaaggccaatgttgtggcccttgtggcagttgccgaacattcaggagaatttgaaaagattatgcaactttcagaaaggtataatgggtttgtcctgccatgcttgggtgttcatccagttcaaggacttccaccagaagaccaaagaagtgtcacactaaaggatttggatgtagctttgcccattattgagaattataaggatcggttgttggcaattggagaggttggactagatttctcccccagatttgctggcactggtgaacagaaggaagagcaaagacaagtcctaatcagacagatccagttagccaaaagactaaatttgcctgtaaatgtgcactcacgctctgctggaagacctaccatcaaccttttacaagagcaaggtgctgagaaggtactgctgcatgcatttgatggtcggccatctgtagccatggaaggagtaagagctgggtacttcttctcaattcccccttctatcataagaagtggacagcagaaacttgtgaaacaattgcctttaacttctatatgcttagaaacagattcacctgcactaggaccagaaaaacaggtacggaatgagccctggaacatttctatttcagcagaatatattgcccaggtgaaagggatctcagtggaagaagttatagaagtgacgacacagaatgcattaaaactgtttcctaagctccgacacttgctccagaaatagcttcaaaaccatccattacaaaatcgaatcaactgcagggggcagcatttgaaaaatagaaatgttctgatgaagaatctgaactgaagaagctgttttatagggttatagaagattgtaattgtagagaaatatttctcttagaaataaaactgggcttggatcctgaaaccctgggttctgattctagccttgtgctgcttttcaattagccgagttctggcaggatattgggaaaatactgctacttcttacattgcccttttatatagaaccaccacctgaactgaaaccattgctactgggaagggtggctcccacaggaagagtataagcactactgtgatgaggatggagtaagctaaagtatacttttttttttttttgatggagtttcgctgttgttgcccaggctggagtgcaatggcacgatcttggctcactgcaacctccacttcccaggttctagcgagtctcctccctcagcctcacaagtagctgggattacaggcatgtgccaccatgcccagctaattttgtatttttagtagagacagggtttctccatgttggtcaggctggtctcgaactcccgacctcaggtgatccgcccgcctcggcctcccaaagtgctgggattacaggcatgagccactgcgccagcctaaagtgtgttcttaccacctatttttcttcccataggagttagccagtgaagggagaatgtctggttttctatgctgtcagaaatctcttttctaggtttgtaaaattgaacttttagtacttcgaattatttctctttaagataaaaatgcatacgatttttacactgatcttagatttttgacttatgaggccagtggtttaaacaatcattattgaataccaagcccaaaagtttagttaatacaccaattgtaagttctggtctgaattttgtcaacatatttagaatgtaaatggcattattaaaaatgtatctgatttctctgtgaacagtaatatttcatatttttaagtttaaaaatgttagtgtaagccaggcacagtggcattcacctgtagtgccaaccactcaggaggctgagatgggagaccttttaagcctgagtttgagtcaggcctgggcaacatagatgtgagcacctatctctaaaaatgtaaataaataaaaatctcaaaaaaattaaaaatctcaagtgtaaaaacagttctgtagatagatggtagtgatggtagcacatcaatgtgaaggtatttaatgccactgaactgtacacttataacgaattaggataaattttatgttatgtgtatttactacaattttttaaaaatcgtatatgtagtttaacaggtgtggtcaatatcaaaacttaggtatttaatcttgttaaattatataagcagaaaatgctggaaaaagtacctgtcatagaaaaaaataaacttcctaaatcaaaaaaaaaacaaactcaaaaacaataaaatgacagatcagacaaagaacaaaaacccaacaacagactggaaaacggaaaacaaagaacaaaatggt

SEQ ID NO: 329969 - DNA, 2490 bp, Homo sapiens
ggctggaaactcaggacgctgcagctgaaacgttccggctccggctctgctggccggtctaaagcggcagccgccggggcgcaatgcgagcggctggcgtaggcttggtggactgtcactgccacctctccgccccggactttgaccgcgatttggatgatgtgttggagaaagccaagaaggccaatgttgtggcccttgtggcagttgccgaacattcaggagaatttgaaaagattatgcaactttcagaaaggtataatgggtttgtcctgccatgcttgggtgttcatccagttcaaggacttccaccagaagaccaaagaagtgtcacactaaaggatttggatgtagctttgcccattattgagaattataaggatcggttgttggcaattggagaggttggactagatttctcccccagatttgctggcactggtgaacagaaggaagagcaaagacaagtcctaatcagacagatccagttagccaaaagactaaatttgcctgtaaatgtgcactcacgctctgctggaagacctaccatcaaccttttacaagagcaaggtgctgagaaggtactgctgcatgcatttgatggtcggccatctgtagccatggaaggagtaagagctgggtacttcttctcaattcccccttctatcataagaagtggacagctgctttctcttttctctaagaagcagaaacttgtgaaacaattgcctttaacttctatatgcttagaaacagattcacctgcactaggaccagaaaaacaggtacggaatgagccctggaacatttctatttcagcagaatatattgcccaggtgaaagggatctcagtggaagaagttatagaagtgacgacacagaatgcattaaaactgtttcctaagctccgacacttgctccagaaatagcttcaaaaccatccattacaaaatcgaatcaactgcagggggcagcatttgaaaaatagaaatgttctgatgaagaatctgaactgaagaagctgttttatagggttatagaagattgtaattgtagagaaatatttctcttagaaataaaactgggcttggatcctgaaaccctgggttctgattctagccttgtgctgcttttcaattagccgagttctggcaggatattgggaaaatactgctacttcttacattgcccttttatatagaaccaccacctgaactgaaaccattgctactgggaagggtggctcccacaggaagagtataagcactactgtgatgaggatggagtaagctaaagtatacttttttttttttttgatggagtttcgctgttgttgcccaggctggagtgcaatggcacgatcttggctcactgcaacctccacttcccaggttctagcgagtctcctccctcagcctcacaagtagctgggattacaggcatgtgccaccatgcccagctaattttgtatttttagtagagacagggtttctccatgttggtcaggctggtctcgaactcccgacctcaggtgatccgcccgcctcggcctcccaaagtgctgggattacaggcatgagccactgcgccagcctaaagtgtgttcttaccacctatttttcttcccataggagttagccagtgaagggagaatgtctggttttctatgctgtcagaaatctcttttctaggtttgtaaaattgaacttttagtacttcgaattatttctctttaagataaaaatgcatacgatttttacactgatcttagatttttgacttatgaggccagtggtttaaacaatcattattgaataccaagcccaaaagtttagttaatacaccaattgtaagttctggtctgaattttgtcaacatatttagaatgtaaatggcattattaaaaatgtatctgatttctctgtgaacagtaatatttcatatttttaagtttaaaaatgttagtgtaagccaggcacagtggcattcacctgtagtgccaaccactcaggaggctgagatgggagaccttttaagcctgagtttgagtcaggcctgggcaacatagatgtgagcacctatctctaaaaatgtaaataaataaaaatctcaaaaaaattaaaaatctcaagtgtaaaaacagttctgtagatagatggtagtgatggtagcacatcaatgtgaaggtatttaatgccactgaactgtacacttataacgaattaggataaattttatgttatgtgtatttactacaattttttaaaaatcgtatatgtagtttaacaggtgtggtcaatatcaaaacttaggtatttaatcttgttaaattatataagcagaaaatgctggaaaaagtacctgtcatagaaaaaaataaacttcctaaatcaaaaaaaaaacaaactcaaaaacaataaaatgacagatcagacaaagaacaaaaacccaacaacagactggaaaacggaaaacaaagaacaaaatggt

SEQ ID NO: 329970 - DNA, 2353 bp, Homo sapiens
ggctggaaactcaggacgctgcagctgaaacgttccggctccggctctgctggccggtctaaagcggcagccgccggggcgcaatgcgagcggctggcgtaggcttggtggactgtcactgccacctctccgccccggactttgaccgcgatttggatgatgtgttggagaaagccaagaaggccaatgttgtggcccttgtggcagttgccgaacattcaggagaatttgaaaagattatgcaactttcagaaaggtataatgggtttgtcctgccatgcttgggtgttcatccagttcaaggacttccaccagaagaccaaagaagtgtcacactaaaggatttggatgtagctttgcccattattgagaattataaggatcggttgttggcaattggagaggttggactagatttctcccccagatttgctggcactggtgaacagaaggaagagcaaagacaagtcctaatcagacagatccagttagccaaaagactaaatttgcctgtaaatgtgcactcacgctctgctggaagacctaccatcaaccttttacaagagcaagcagaaacttgtgaaacaattgcctttaacttctatatgcttagaaacagattcacctgcactaggaccagaaaaacaggtacggaatgagccctggaacatttctatttcagcagaatatattgcccaggtgaaagggatctcagtggaagaagttatagaagtgacgacacagaatgcattaaaactgtttcctaagctccgacacttgctccagaaatagcttcaaaaccatccattacaaaatcgaatcaactgcagggggcagcatttgaaaaatagaaatgttctgatgaagaatctgaactgaagaagctgttttatagggttatagaagattgtaattgtagagaaatatttctcttagaaataaaactgggcttggatcctgaaaccctgggttctgattctagccttgtgctgcttttcaattagccgagttctggcaggatattgggaaaatactgctacttcttacattgcccttttatatagaaccaccacctgaactgaaaccattgctactgggaagggtggctcccacaggaagagtataagcactactgtgatgaggatggagtaagctaaagtatacttttttttttttttgatggagtttcgctgttgttgcccaggctggagtgcaatggcacgatcttggctcactgcaacctccacttcccaggttctagcgagtctcctccctcagcctcacaagtagctgggattacaggcatgtgccaccatgcccagctaattttgtatttttagtagagacagggtttctccatgttggtcaggctggtctcgaactcccgacctcaggtgatccgcccgcctcggcctcccaaagtgctgggattacaggcatgagccactgcgccagcctaaagtgtgttcttaccacctatttttcttcccataggagttagccagtgaagggagaatgtctggttttctatgctgtcagaaatctcttttctaggtttgtaaaattgaacttttagtacttcgaattatttctctttaagataaaaatgcatacgatttttacactgatcttagatttttgacttatgaggccagtggtttaaacaatcattattgaataccaagcccaaaagtttagttaatacaccaattgtaagttctggtctgaattttgtcaacatatttagaatgtaaatggcattattaaaaatgtatctgatttctctgtgaacagtaatatttcatatttttaagtttaaaaatgttagtgtaagccaggcacagtggcattcacctgtagtgccaaccactcaggaggctgagatgggagaccttttaagcctgagtttgagtcaggcctgggcaacatagatgtgagcacctatctctaaaaatgtaaataaataaaaatctcaaaaaaattaaaaatctcaagtgtaaaaacagttctgtagatagatggtagtgatggtagcacatcaatgtgaaggtatttaatgccactgaactgtacacttataacgaattaggataaattttatgttatgtgtatttactacaattttttaaaaatcgtatatgtagtttaacaggtgtggtcaatatcaaaacttaggtatttaatcttgttaaattatataagcagaaaatgctggaaaaagtacctgtcatagaaaaaaataaacttcctaaatcaaaaaaaaaacaaactcaaaaacaataaaatgacagatcagacaaagaacaaaaacccaacaacagactggaaaacggaaaacaaagaacaaaatggt

SEQ ID NO: 329971 - DNA, 194 bp, Homo sapiens
gttggactagatttctcccccagatttgctggcactggtgaacagaaggaagagcaaagacaagtcctaatcagacagatccagttagccaaaagactaaatttgcctgtgtaggttaattattttcctatgttaatagctatagagcaaattaaataatgatcagagttctcctgaaatggaactctacattt

SEQ ID NO: 329972 - DNA, 2376 bp, Homo sapiens
aatcctcccaggagctgacacttaaggctgaaaagacaaggagccacccaagcaagggggatttggatgatgtgttggagaaagccaagaaggccaatgttgtggcccttgtggcagttgccgaacattcaggagaatttgaaaagattatgcaactttcagaaaggtataatgggtttgtcctgccatgcttgggtgttcatccagttcaaggacttccaccagaagaccaaagaagtgtcacactaaaggatttggatgtagctttgcccattattgagaattataaggatcggttgttggcaattggagaggttggactagatttctcccccagatttgctggcactggtgaacagaaggaagagcaaagacaagtcctaatcagacagatccagttagccaaaagactaaatttgcctgtaaatgtgcactcacgctctgctggaagacctaccatcaaccttttacaagagcaaggtgctgagaaggtactgctgcatgcatttgatggtcggccatctgtagccatggaaggagtaagagctgggtacttcttctcaattcccccttctatcataagaagtggacagcagaaacttgtgaaacaattgcctttaacttctatatgcttagaaacagattcacctgcactaggaccagaaaaacaggtacggaatgagccctggaacatttctatttcagcagaatatattgcccaggtgaaagggatctcagtggaagaagttatagaagtgacgacacagaatgcattaaaactgtttcctaagctccgacacttgctccagaaatagcttcaaaaccatccattacaaaatcgaatcaactgcagggggcagcatttgaaaaatagaaatgttctgatgaagaatctgaactgaagaagctgttttatagggttatagaagattgtaattgtagagaaatatttctcttagaaataaaactgggcttggatcctgaaaccctgggttctgattctagccttgtgctgcttttcaattagccgagttctggcaggatattgggaaaatactgctacttcttacattgcccttttatatagaaccaccacctgaactgaaaccattgctactgggaagggtggctcccacaggaagagtataagcactactgtgatgaggatggagtaagctaaagtatacttttttttttttttgatggagtttcgctgttgttgcccaggctggagtgcaatggcacgatcttggctcactgcaacctccacttcccaggttctagcgagtctcctccctcagcctcacaagtagctgggattacaggcatgtgccaccatgcccagctaattttgtatttttagtagagacagggtttctccatgttggtcaggctggtctcgaactcccgacctcaggtgatccgcccgcctcggcctcccaaagtgctgggattacaggcatgagccactgcgccagcctaaagtgtgttcttaccacctatttttcttcccataggagttagccagtgaagggagaatgtctggttttctatgctgtcagaaatctcttttctaggtttgtaaaattgaacttttagtacttcgaattatttctctttaagataaaaatgcatacgatttttacactgatcttagatttttgacttatgaggccagtggtttaaacaatcattattgaataccaagcccaaaagtttagttaatacaccaattgtaagttctggtctgaattttgtcaacatatttagaatgtaaatggcattattaaaaatgtatctgatttctctgtgaacagtaatatttcatatttttaagtttaaaaatgttagtgtaagccaggcacagtggcattcacctgtagtgccaaccactcaggaggctgagatgggagaccttttaagcctgagtttgagtcaggcctgggcaacatagatgtgagcacctatctctaaaaatgtaaataaataaaaatctcaaaaaaattaaaaatctcaagtgtaaaaacagttctgtagatagatggtagtgatggtagcacatcaatgtgaaggtatttaatgccactgaactgtacacttataacgaattaggataaattttatgttatgtgtatttactacaattttttaaaaatcgtatatgtagtttaacaggtgtggtcaatatcaaaacttaggtatttaatcttgttaaattatataagcagaaaatgctggaaaaagtacctgtcatagaaaaaaataaacttcctaaatcaaaaaaaaaacaaactcaaaaacaataaaatgacagatcagacaaagaacaaaaacccaacaacagactggaaaacggaaaacaaagaacaaaatggt

SEQ ID NO: 329973 - DNA, 385 bp, Homo sapiens
tgcatgcggtggattaaaatatgttcaccctgacagaaatcttttagttgaagtgaaaaagcctccgtcaattctgattgcaacaaaggttgctgctgcgagtgagagggacttgccaagactgcaagtttttcaagctctattctggagatacgtttgttacttggttctcagctttgacttggttataatcttgtcttggcttgttctctttccagaatacactagttttcatttttctttggccttttctcaagatttatgaaagggggtatttagctttttgtctggcaaatagcaaaggctgtttgagttccctaatcaataattgtaaaataactagaaattgatctatgccagctgtaaacccatgcatgcatttatt

SEQ ID NO: 329974 - DNA, 672 bp, Homo sapiens
acagagtacgagtacatctggttgaaagagaaaaggcagagagaaaagcagactttttggagttgttgttctcaggcactaacagattcatcccttatatgcatatgaatggacaataagatttcttggatattttcatggcaaagggtaagagtgaagctatcctggacaagaactttgacaggacaatactattcactctgaaggaccaaaaaatgagcagaaaatttgggataaatgtcaacaagatttgaaccctaaagaaaagcaagcatcgagttagacagacgtccatattcattcaactgggaaaataaaactgcagtcccaacatcagaatttccttggtcagttggttattgcgggacagcattcttctgcatgacagtattgtctccttaccagccacagaggaggctgtgagagagaggatttgggaaattggtgcaaatgagaaatcttggaaatctagaactaaagcctttcagcaggaaatccagatgctcactaagtgactagagcagctgcatcatctttaagaagaaggtgctcaagaatcatcccaagctgaagaaaaaagtattgggaacaaaaaagacccttgaaatgtctagaaagaaaaattgagatcaaggactttttcaagagagattagacttggacaggaagaaa

SEQ ID NO: 329975 - DNA, 129 bp, Homo sapiens
cttctaggaagtggcgccagctggggtgagatcacttcctcacccgcctgcctggccccccttggcttcctctccccatggccccatttggcctgcccagggctcaatgaggggggagcttggccatgc

SEQ ID NO: 329976 - DNA, 144 bp, Homo sapiens
aacactggaaacactttgtcaattttttaaaagtttgacttgggaaacaaaccaatggaagagcccataagtgaggaaaagagtcagtgggagtgagctagagtattgcttgctttatgccagagtatatcaaccacaggcctc

SEQ ID NO: 329977 - DNA, 128 bp, Homo sapiens
tacctatgctttattttataataaagagattcacaaaaataaaatatggcaataatggcccatatccttctccagctccctccccaacccccttacccaataatcagctagacctccattttgcacag

SEQ ID NO: 329978 - DNA, 409 bp, Homo sapiens
gggtccccgaatgtggaggaggaggaagaggatggacggagtggagaagttcagggagacccgagagtagatgcagagtagatgactgaacaacagaatatgccaaatggtatttgacaaatgattgaggaatgttagcagttgcattagttatgaatcttgttgaaacaccagaaaccaactcaagatagcttaaacaagttgggggcagaggggaggatgaagagaggtgggttaaagggtacaaacatacagttagatagaaggcataaattcaatgtttgatagcagagtaaggtgactaccgttaataaaaatgtattgtattgggaggatggacaccctaaaaaccctgacttctttgttatgtattatatacatgtaataaaatttcacatgtaccccatgg

SEQ ID NO: 329979 - DNA, 218 bp, Homo sapiens
ggcagcaaagccaagaggaaacaggctcgacctcagccaactcctcgggtcgggatccccaagaggcttcccacacgcaacctgctgggactccggcacccatcatgcagaaacgcaagcaggaccctagaacagctaccctgagcctcagagtccagctctgccctcaggttgagagccctcagccctgtcctttctagattggaggactgtcctcc

SEQ ID NO: 329980 - DNA, 192 bp, Homo sapiens
gactatgctaattcttttacaaatataatctcatctaagccccatgacaatcctgaaaggtgagttttattgtcatcagcccatttagaggtagagaaactatggattagacagattagaaaactggtaggacatcatgcagctattaagtgtcgagctgggagtcctatttcggttggctctaaaactctt

SEQ ID NO: 329981 - DNA, 458 bp, Homo sapiens
catgggtggacagcggggaactgtggagagcacggggcttgcccttgtcagtaggaaggccctgagcatctagattccatctgaaactggaaaggcttgaggacgcgcagggcagggcctgggccttgaagagagggcctgttaacctccctgtggacagcaccaggcaagggctcttggaggaggaagtgctcattcctgggataaaaattcctttccaggatatgctggtttggaaggaagtctttgccgtcttcttggtctaacagtgtgtcctgccttcctctgggtggaagccttatattaatactaacgaggctaattttcttctcttaggcaggcagacagacccactgaggtttttgaccaaaggagagagtcaggatcccaggcatatgctaaactggttggcccaaatccaacagattgcaaagagtggcagggcctggcagctgtct

SEQ ID NO: 329982 - DNA, 560 bp, Homo sapiens
tgcagatcactgcactccagcctatgtgatagagggagacgccgtcttaaaaaaaaaaaaaatcaactcaacacggctgaaggaattaaatctaagatctgaaactgtaaaaattctgggagataacatcagaaaaaccattttaggcattggcttaggcaaagacttcatgaccaagaacccaaaagtaaatgcaacaaagacagataaatagatgggacttaattaaattgaaaagcttcagcacagcaaaagaaataatcagcaaagttaatagacaacccacagagtgggagaaagtttttgtagtctatacatctaacaatcaatgctcagactctacaaagaactcaaacaaattagcaagaagtaaacaaacaatactatcaaaaagtgggctaaagacatgaagagacagttttcaaaagaagatatagaaatggccaacaaacatatgaagaaatgctcaacatcactaatgatcagggaaatgcaaatcaaaaccacaatgtgataccatcctattccttcaagatcggccataatcacaaaatcaaaaa

SEQ ID NO: 329983 - DNA, 163 bp, Homo sapiens
cttggcttacgggaactttgcatctttaaaaaaaaaaataccatgaaaatccatcctttgcttcagacacactaggctaaaaatagctcagtcagccagtaagtgtgtgtaatttttcctttgtgcatctccctatccactgatttcttcctctcagcagaca

SEQ ID NO: 329984 - DNA, 113 bp, Homo sapiens
tgagaggctcttcctggatcccttattttctacaggagaggaggaaaacacctgggatgctccagtgctcttacgcagataatgatcattaacatcagcctctctgatcaaag

SEQ ID NO: 329985 - DNA, 2888 bp, Homo sapiens
gggttcgggcttgtcaggttctagctcatgttttttggctagacctatgaccattttcgctagacttcactgcacgttttctcaagtatcttctttgtccctaatgtgtgacacctcatcatggacacgctactttagctaaggcatgaccagcaatgaacagtagtaagagatggggtcgcgctttgttgcctaggctgatcttgaactcctgggctcaagcaatatgcctgctttggcctctcagagtgctgggattacagatatgtgctgattagaaggctcacttgtgcagtgtggaggataaccagtgccttacaaaatggggtttgggagtgacctgaagaattcacatgaagcagtgttaaaattgcaagactgggaattacggttactggaaacagtaaagaaatttatggccctgagaataaaaagtgataaagaatatgcatctactttacagaacctttgtaatcaagttgataaggaaagtactgtccaaatgaattatgtcagcaacgtatccaagtcttggctacttatgattcagcagacagaacaacttagtaggataatgaagacacatgcagaggacttgaactctggacctttacacaggctcaccatgatgattaaggacaagcagcaggtgaagaaaagttacataggtgttcatcagcagatagaggcagagatgatcaaggttaccaaaacagaattggagaagttaaaatgcagctatagacaattaataaaagaaatgaattctgccaaagagaaatataaagaagctttagctaaagggaaggaaactgaaaaggccaaggaacgatacgacaaagccacaatgaaacttcatatgttgcacaatcagtatgtattggcgttgaaaggggcacagctccatcagaatcagtattatgatatcacacttcccctgcttctggactccttacaaaagatgcaagaagaaatgataaaagcactcaaaggtatatttgatgaatacagccagataaccagtcttgtcacagaggaaatagtgaatgtccataaagagattcaaatgtcggttgaacagatagatcctagtacagaatacaataatttcatagatgttcacagaacaacggctgctaaagaacaagaaatagagtttgatacttccttactggaagaaaatgaaaatcttcaggcaaatgagatcatgtggaataacttaacagcagaaagtttgcaagtaatgttgaaaacgttagcggaagaacttatgcaaacacagcagatgcttttaaacaaggaggaggctgttttggagttagagaagagaattgaagaatcttctgaaacttgtgagaagaagtctgatattgtgcttctgctaagccaaaaacaggcacttgaagaactgaaacagtcagtccagcagctgagatgcactgaagcaaagttttcagcacagaaggaattactagagcaaaaagtgcaagaaaatgatgggaaagagccacctccagtagtaaattatgaagaagatgcacgatcagttacatctatggaaagaaaggagaggctatccaaatttgaatctattcgtcattcaattgctggaataattaggtctccaaaatctgcagtgggctcttcagcactttctgatatgatctccatcagtgagaagcctttggcagaacaggactggtaccatggtgcaattcccagaatagaagctcaagaactgttaaaaaaacaaggagactttttggtgcgagagagtcatgggaaacctggtgaatatgtcctttctgtatattctgatggacagaggagacattttatcatacaatatgttgataacatgtatcgattcgagggcactgggttttcaaacattcctcaacttatagatcatcactatacaacaaaacaggtcatcactaagaaatcaggtgtagttctgctgaatcctattcctaaggacaagaaatggattctcagtcatgaagatgtcatattgggagaattactgggcaagggaaattttggtgaagtatataagggcacattaaaggataaaacttctgttgctgttaaaacatgtaaagaagatcttcctcaggaattgaaaataaaatttttacaagaagccaaaattctcaagcaatatgatcatcccaatattgtcaaacttataggagtttgcacacaaagacagcctgtctacatcattatggaactggtttcaggaggtgatttcctcacctttctgagaaggaagaaggatgaactaaaactcaaacagttagtgaaattttcattagacgctgctgctggtatgttgtatctcgagagtaaaaactgtatacacagggaccttgctgcaagaaactgcctggtaggtgaaaataatgttctgaaaatcagtgactttggaatgtctcgtcaagaggatggtggagtgtattcatcttctggcttaaagcagattcccattaaatggacagcaccggaagctcttaattatgggagatacagttcagagagtgacgtgtggagctttggcatccttctctgggagaccttcagcttaggggtttgtccgtaccctggaatgacaaatcagcaagcaagagagcaagtagaaagaggataccggatgtcagctccccagcactgtccagaggatatttccaaaatcatgatgaagtgttgggattataaacctgaaaatcgccctaagttcagtgaacttcagaaagagctcactatcatcaagagaaaactcacatagtgacaggatggcgccaaactcagccttcaggactctgtcctccagcagagtaacattattgttctcattaacaatgaatttataccacattaccttc

SEQ ID NO: 329986 - DNA, 3835 bp, Homo sapiens
tttagtagacaaaacacttttattactgaataagcattaaacgagactgtgatacacatcacaggcaatttgctaagagattgcaaagacagaaatcttgcccttttgtatagccaagtatatacgacccattacatacacgttttcaagttgaacaataactagtcctcaagtaagaggacctgacatttgtgacattaactttacttaataattggggtgaccatctgtgttagttaattggttttatccagaggaaaaacaaacttctcctgtctttatgacggaaggtagttttgcaacacggagcaagttgctcaccgaagttacgctcctactctctcacagaaactgggagatagggaaggatgctactccgttgatatgtgcagcatttcaaaaaaaaaaaaaaaaaaaaggtccagagacattcctgactgagcatacagttgacaagacctatctagtcctcaagtggatttatacacatttcaaagagttgagaaagtacttaacaattaagaaagtacttaagttttctaagacaaatgctcggagagaaagggacgggaaatctcatcctccattttcaatagggagaattaagcctcttatttaaaatttttatgttggtttttgtttatttagctttaaaacagtagacttaaaaaaagtccaacttaagatttatgtttttttatgtgtagggctgttctctacggttaaataaataaccctgcttagagaaaatattcaccactcttctttggctcctatgtaactcagtttttgagagggaggggaaataccggattgacgctatgtggttcaaccaatgcaaaagataacaccgccttaaaaagtctactacaggaacatgggagggtcacaccctcgaataatgacgcatacctatcctactgttactgatcacctagtaataatcttgtagttcacattactcatttttcaccaaattcttttggtgaaggacgcttcagaaacggccatcactgaagagcagacccgtttgggttctccacgcattctagactcccgaagagctcatgttttttggctagacctatgaccattttcgctagacttcactgcacgttttctcaagtatcttctttgtccctaatgtgtgacacctcatcatggacacgctactttagctaaggcatgaccagcaatgaacagtagtaagatatgtgctgattagaaggctcacttgtgcagtgtggaggataaccagtgccttacaaaatggggtttgggagtgacctgaagaattcacatgaagcagtgttaaaattgcaagactgggaattacggttactggaaacagtaaagaaatttatggccctgagaataaaaagtgataaagaatatgcatctactttacagaacctttgtaatcaagttgataaggaaagtactgtccaaatgaattatgtcagcaacgtatccaagtcttggctacttatgattcagcagacagaacaacttagtaggataatgaagacacatgcagaggacttgaactctggacctttacacaggctcaccatgatgattaaggacaagcagcaggtgaagaaaagttacataggtgttcatcagcagatagaggcagagatgatcaaggttaccaaaacagaattggagaagttaaaatgcagctatagacaattaataaaagaaatgaattctgccaaagagaaatataaagaagctttagctaaagggaaggaaactgaaaaggccaaggaacgatacgacaaagccacaatgaaacttcatatgttgcacaatcagtatgtattggcgttgaaaggggcacagctccatcagaatcagtattatgatatcacacttcccctgcttctggactccttacaaaagatgcaagaagaaatgataaaagcactcaaaggtatatttgatgaatacagccagataaccagtcttgtcacagaggaaatagtgaatgtccataaagagattcaaatgtcggttgaacagatagatcctagtacagaatacaataatttcatagatgttcacagaacaacggctgctaaagaacaagaaatagagtttgatacttccttactggaagaaaatgaaaatcttcaggcaaatgagatcatgtggaataacttaacagcagaaagtttgcaagtaatgttgaaaacgttagcggaagaacttatgcaaacacagcagatgcttttaaacaaggaggaggctgttttggagttagagaagagaattgaagaatcttctgaaacttgtgagaagaagtctgatattgtgcttctgctaagccaaaaacaggcacttgaagaactgaaacagtcagtccagcagctgagatgcactgaagcaaagttttcagcacagaaggaattactagagcaaaaagtgcaagaaaatgatgggaaagagccacctccagtagtaaattatgaagaagatgcacgatcagttacatctatggaaagaaaggagaggctatccaaatttgaatctattcgtcattcaattgctggaataattaggtctccaaaatctgcagtgggctcttcagcactttctgatatgatctccatcagtgagaagcctttggcagaacaggactggtaccatggtgcaattcccagaatagaagctcaagaactgttaaaaaaacaaggagactttttggtgcgagagagtcatgggaaacctggtgaatatgtcctttctgtatattctgatggacagaggagacattttatcatacaatatgttgataacatgtatcgattcgagggcactgggttttcaaacattcctcaacttatagatcatcactatacaacaaaacaggtcatcactaagaaatcaggtgtagttctgctgaatcctattcctaaggacaagaaatggattctcagtcatgaagatgtcatattgggagaattactgggcaagggaaattttggtgaagtatataagggcacattaaaggataaaacttctgttgctgttaaaacatgtaaagaagatcttcctcaggaattgaaaataaaatttttacaagaagccaaaattctcaagcaatatgatcatcccaatattgtcaaacttataggagtttgcacacaaagacagcctgtctacatcattatggaactggtttcaggaggtgatttcctcacctttctgagaaggaagaaggatgaactaaaactcaaacagttagtgaaattttcattagacgctgctgctggtatgttgtatctcgagagtaaaaactgtatacacagggaccttgctgcaagaaactgcctggtaggtgaaaataatgttctgaaaatcagtgactttggaatgtctcgtcaagaggatggtggagtgtattcatcttctggcttaaagcagattcccattaaatggacagcaccggaagctcttaattatgggagatacagttcagagagtgacgtgtggagctttggcatccttctctgggagaccttcagcttaggggtttgtccgtaccctggaatgacaaatcagcaagcaagagagcaagtagaaagaggataccggatgtcagctccccagcactgtccagaggatatttccaaaatcatgatgaagtgttgggattataaacctgaaaatcgccctaagttcagtgaacttcagaaagagctcactatcatcaagagaaaactcacatagtgacaggatggcgccaaactcagccttcaggactctgtcctccagcagagtaacattattgttctcattaacaatgaatttataccacattaccttc

SEQ ID NO: 329987 - DNA, 633 bp, Homo sapiens
catgctgggacctcagtgacagaatccaatgggatggggtaaccagggtagcccgtgtctatcccaaagcctccaatctggaggttggggcaatgctttagggccataatgatgctcaacgtgaaatggggcttcacctgtacttgggcattgggctctggtcctcagggcaaagatcctaggcaagaggatcaatgactgggccccagccaagctgcttaaaagccagggcagcactagaggaccagttggaagtccagagtcttgggaaaaggaggcaaaatctcaacccctatgtatagagcaacatgacgctcggagggaaggaagaaggcaatgcagtggtcctgggcttctacgttaattctgagagtggccccgcaactcttcatctttctcttccctggctttaggcatgtatcttgcaactagcacttgcttaattgatttgacacacctccctacacttacccctttccatacaaagtgccaggtcctctgaaagctccctatatcacctggccaattggaattttcacagccaaggcagaaaacaggtgaggtttggttgtcaatctccatcttaggcattgaacaggatgtgtagccagttcatggaagacctttttcact

SEQ ID NO: 329988 - DNA, 997 bp, Homo sapiens
caacgggctacgagcggttaagagactacagctcccaggatgtacggtgatggcacccgtttggactccgcccctctgcgcgtctagagctgttctcccgtgcggaggggatcctggctgttcccaaatctcgcctgcctgcgaggagccagcgtggcccgggcagctgatctcaacctgtgattgtgacatcacccctacctgaggaagcctcttccagcctgctcaaggttgccgtagttaggtttaccctcccttccttccctcaccccgtcctttccctcatccctgccccttcctctgtcccacgcggctttcagacatgcatagtgcagcccctcagtaaaggtgcagctaatggcccgtgggcctagcagttgtcaggccttttgggagcccatgatgggagctccctggtaagtgaaaccgtcaattaactgcctaaaatgacaataccccgtctctggtatctttgcacttgcctcttcaaagccaccttttcctttctctctctctggactgtcacagatcctcctctgtaccccaagaacaccccattggatttccgggctggctgcttggcctacacacctgggtcaggcctctcgcagggatgcgcctgccactgtaataaagaggagaaaacgtcacacgggaaaggcctgactccttcgtacaatcagaatactcaactgcacagagaagggacccctttaagccactttgggagccacatccaccactctgtgactcccacacaggctggttcccaggtatcaggtgtcctagtgttaacacgggccaaaaggacaaaacaggaccctaggtccttcccaaaacattaggaaagtttgtgtactgaggtaatgtacaatgtctttttgccctgaatagggctcccttaaaaactcttttaataatcatttttaaatatatctctggaaccacttttagtaatttgctgaaggaacataaaagtaattaccttaattcatgt

SEQ ID NO: 329989 - DNA, 296 bp, Homo sapiens
ttattttccttctttattgcttaatttgggtttaattacattttcatttccttaagatgggaaaaaacaatttatactcttttaaaggagatggcttatctcattcttatttcctaaactgtgattctaaaagtcagatttatttcatcaataaaaagatacttatatttttcataatttatagacagcttccctgcctctagctatatcctagggtctccaaaccactctaaaaacatccagggctttagtcttcttgtgtgtgcactcccacatagaataatgtcaataaagaa

SEQ ID NO: 329990 - DNA, 803 bp, Homo sapiens
gtgactattagtttaataggactgccgcaacaaattaccacactctttggggggggagggaggcttagaaaaactgaaatttattatttgacagttctggaggctggaagtccaaactcagggtgtcagcagcagcatagattcctttttagaggctctagaagaatccattcttctggttttgccagtagcccttgaccttttttggcttgtagattcatcattttgatctctgcctctgtggacttctccctgagtgtctctgtccaacattgccttattttttttaataaggacacctgtcattgtattggggtcttccctgatccagtgtaacttcatcttaatttggttatctgcaaatacctcatttccaaagaaggttatattcacagattaggatttgaatttgtcttttggggggacacagctctacctgttagggtgacatttataaagttgagtattcaggaattgttattagtttgtttgtttgtttgtttgagacggagtctctccttgctctgttgcccaggctggagtgctgtggcgccatctctgctcactgcaaactccacctctcaggttcaagggattgtcctgcatcagcctcctgaacaacaggtgtgcaccaccacgcccagctaatttttctatttttagaagagatgggggtttccaccatgttgtccagaatggtctttaactcctgacctcaagtggtccacctgccttgtcctaccaaagtgctgggattacaagcgtgagccactgcacctggcctgttattcgcattcttaaat

SEQ ID NO: 329991 - DNA, 350 bp, Homo sapiens
tcaggagactgaggtgggaggatcacttgactctgggaggttgagctgcagtgagccatgattgcaccactgtactccagcctgagtgacagagcgagactgtgtctcaaaaaaagaaaaagagtaatggggtaaaggaattgttattattcatttgcaatataatttatgtcacagagtagtgagcttggaaatggaggggagaaaatgctatcccaaagcatatgcttcagttagagttgatgaagtggacctgaacaaagttaggacacacatgacctgggtactgggctataacaggacaaaactcaaaagccaagcaaatgtttataatagtaacagggtcaggg

SEQ ID NO: 329992 - DNA, 759 bp, Homo sapiens
ggaagcccttctctttcttactccccgttaggtgcatcctggcagatgcgttccttgggagaacaccatgcagggtgcattcccatcaactgtaagagtttgaaggactagagagacttcatcctaatccgttcttaagtagcaggtccttagaaattcacccaggttttccgttttgtttgttagtgttgttgtttgttttggaggggaggtccacaaagccattttcaatatgtcagtatgtctattggcgacgtcttgccttcctctaatgtggatagctggggagctgggattacatcatgtattgtggtcacactctggatctcatttgatcaaaagttccatttgccactggtgacatcactaagatatcagatggttgatggggtctagaaagtaattaaagggctctgaggacccatgggggtcaacgtcaacccttccatggctctttgatattaagaatcaacttgcagaccaggtgcggtggctcgtgcctgtaatcccagcactttgagaggccaaggtgggcagattgcctgagctcaggagttcaagaccagcctgggcaacatggtccgtgggctgctggacaccctggtgaccgacctgatggtcctggctgatgagctcagccccataaagaatgtcgaggaggctttgcgcctctgcaggtgactctcgggcccaagcaaccttctggaaaacgggttaataaataaatcaataaagaaccttcaagtttctactaaaacc

SEQ ID NO: 329993 - DNA, 1224 bp, Homo sapiens
  misc_feature (1072)..(1072): n is a, c, g, or t
ggcgtcacaggccgggcccgcagggctttctaggggtccgtcgctcttgaagccgccggcggcgggcgcgtgcgcggcccgatgaagaaggaggtttccaagccgtctccgcccaagttgatcggtggatgcgcgcccccgcgcggggcaccggttgctgtggacgcagtggcggccgttggctggcgggtgcggcgcagcctcggtgtctctgggccggcggtgcagggcaacgtttcatggtgccgggcggcaccatgaagtctctaaagaaggattcccgcctcagaataactccgaccagattattagaggcctcagagaatgtcaaagaaaagaagcgggcaaagggacctgaacaacccacacccacaattcaggaagagcctgaacctgttagcaatgtcctacaaggagatgacattcttgccttggccattaagaaggaagacttgaaggagcaacacattcctcgccttactgaaaaggaagataaacgtgtcatcacccagaaatttatcatccgtaaactcaaacccatggatcctaggaggaaggtctgccaccttgtagcacgtcctgcgaatcctgatgaagccacaaagcctctggactactccggtacacccagtctcagccctggcttcactgtctttcaactcatgggtcccggtgacagcttcgatggcagtgaccagatcctgccccaccacatcttggggagtctccaggattttaagagaattgcacttgctcgagggaacacccagctggctgagcggatacctacctcaccctgtctgatgaccctcatctctgctgaaggagagtcaaagcaaaaagccccaaaagaagagaagagacctccctgggccccacctcctcagcacaactttctgaaaaactggcagcgtaacacagccctgcggaagaagcagcaggaagccctcagcgaacacctaaagaaggcaggaagtggacactgctccatggccaaaccggggagaacctacagaacgcgacccaggacggaccggggacacccaattgcactgccacatatcaaaccccngggtgaaaggaaacaacggggagaaacaagcggggtccggggagcgagacggcgataactcgggaacagtaacataaaaggagtgggcatgacgcccaacagagaaaccaaggggtggcatagggacatcaaaacatagtgagccccacaca

SEQ ID NO: 329994 - DNA, 449 bp, Homo sapiens
gggagaatcacctgagccagggaagtcaaggctgcagtgagccatgatcacaccactggactccagcctgggtgacagagtgagatcctgtcaaaaaaaaaaaaaatctgcaaaaccaaaaattatttcacaagaactttgaacttgtgaaattctttcacaaacaactggtttctttcccctctccagctattctctcacagcatagttcatatataggtgcttcccacagagtaaactctgcctgtgatgttgtcccgttcttccaggtccgtgggctgctggacaccctggtgaccgacctgatggtcctggctgatgagctcagccccataaagaatgtcgaggaggctttgcgcctctgcaggtgactctcgggcccaagcaaccttctggaaaacgggttaataaataaatcaataaagaaccttcaagtttctactaaaacc

SEQ ID NO: 329995 - DNA, 775 bp, Homo sapiens
ggaagcccttctctttcttactccccgttaggtgcatcctggcagatgcgttccttgggagaacaccatgcagggtgcattcccatcaactgtaagagtttgaaggactagagagacttcatcctaatccgttcttaagtagcaggtccttagaaattcacccaggttttccgttttgtttgttagtgttgttgtttgttttggaggggaggtccacaaagccattttcaatatgtcagtatgtctattggcgacgtcttgccttcctctaatgtggatagctggggagctgggattacatcatgtattgtggtcacactctggatctcatttgatcaaaagttccatttgccactggtgacatcactaagatatcagatggttgatggggtctagaaagtaattaaagggctctgaggacccatgggggtcaacgtcaacccttccatggctctttgatattaagaatcaacttgcagaccaggtgcggtggctcgtgcctgtaatcccagcactttgagaggccaaggtgggcagattgcctgagctcaggagttcaagaccagcctgggcaacatggtaagatcccgtttctactaaaaattcaaaaaattagccaggcatggtgacactcacctgtagtcccagctacttgggtggctgaggcacaataatcgcttgaacccgggaagtggaggttgcagtgagccgagatcacgccatttcactccagcttgggtgacaagagtgagactcttacctccaaaaaaaaaga

SEQ ID NO: 329996 - DNA, 772 bp, Homo sapiens
ggcgtcacaggccgggcccgcagggctttctaggggtccgtcgctcttgaagccgccggcggcgggcgcgtgcgcggcccgatgaagaaggaggtttccaagccgtctccgcccaagttgatcggtggatgcgcgcccccgcgcggggcaccggttgctgtggacgcagtggcggccgttggctggcgggtgcggcgcagcctcggtgtctctgggccggcggtgcagggcaacgtttcatggtgccgggcggcaccatgaagtctctaaagaaggattcccgcctcagaataactccgaccagattattagaggcctcagagaatgtcaaagggtggcatgcaggaggcaggatccccggactggatgaagtgcagaagagccaggaaagagtttaagggtagaagggccaggaattggggtccttgggaagaggaaagaatgaagtgttgaaaccagccaccttgatgggattatttggtagaggagggtcggggagcggggcaggcgtcacttaggattcctgctggaaaaacccagaagaaaggccttgcttggctagttctctttttgactgccttttcctaccacgtgcactttccagctggatgacacttatccagctcctttagcctggaaagaatcgctagatatgactgcttcctaccctctacagctttcttctggttgcacctgggagagccacagggcgtctgatagcggactgacttccatggacatgttctcacttgcaacccacccccttttgatc

SEQ ID NO: 329997 - DNA, 3266 bp, Homo sapiens
ggcgtcacaggccgggcccgcagggctttctaggggtccgtcgctcttgaagccgccggcggcgggcgcgtgcgcggcccgatgaagaaggaggtttccaagccgtctccgcccaagttgatcggtggatgcgcgcccccgcgcggggcaccggttgctgtggacgcagtggcggccgttggctggcgggtgcggcgcagcctcggtgtctctgggccggcggtgcagggcaacgtttcatggtgccgggcggcaccatgaagtctctaaagaaggattcccgcctcagaataactccgaccagattattagaggcctcagagaatgtcaaagagcccagactggtcttgaactcctgggctcaagcgatctgcctgccttggcctcccaagatcttgcaactcttaatccattccttggcatgccattgcccatgggaaaagaagcgggcaaagggacctgaacaacccacacccacaattcaggaagagcctgaacctgttagcaatgtcctacaaggagatgacattcttgccttggccattaagaaggaagacttgaaggagcaacacattcctcgccttactgaaaaggaagataaacgtgtcatcacccagaaatttatcatccgtaaactcaaacccatggatcctaggaggaaggtctgccaccttgtagcacgtcctgcgaatcctgatgaagccacaaagcctctggactactccggtcccggtgacagcttcgatggcagtgaccagatcctgccccaccacatcttggggagtctccaggattttaagagaattgcacttgctcgagggaacacccagctggctgagcggatacctacctcaccctgtctgatgaccctcatctctgctgaaggagagtcaaagcaaaaagccccaaaagaagagaagagacctccctgggccccacctcctcagcacaactttctgaaaaactggcagcgtaacacagccctgcggaagaagcagcaggaagccctcagcgaacacctaaagaagccagtgagtgagctgctcatgcacaccggggagacctacagacggatccaggaggagcgggagctcattgactgcacacttccaacccggcgtgataggaaaagctgggagaacagtgggttctggagtcgactggaatacttgggagatgagatgacaggtctggtcatgaccaagacaaaaactcagcgtggcctcatggagcccatcactcatatcaggaagccccactccatccgggtggagacaggattaccagcccagagggacgcttcataccgctacacctgggatcggagtctgtttctgatctaccgacgcaaggagctgcagagaatcatggaagagctggatttcagccagcaggatattgatggcctggaggtggtgggcaaagggtggcccttctcggctgttactgtggaagactacacagtgtttgaaagaagtcagggaagctcctctgaagacacaacatacttaggcacattggccagttcctctgatgtctccatgcctattctcggcccttctctgctgttctgtgggaagccagcttgctggatcagaggcagtaatccacaggacaagaggcaggttgggattgctgctcacttgacctttgaaaccctagaaggcgagaaaacctcctcagaactgactgtggtcaataatggcaccgtggccatttggtatgactggcgacggcagcaccagccggacactttccaagaccttaagaaaaacaggatgcagcgattttactttgacaaccgggaaggtgtgattctgcctggagaaattaaaacatttaccttcttcttcaagtctttgactgctggggtcttcagggaattttgggagtttcgaacccatcctactctattaggaggtgctatactgcaggtcaatctccacgcggtctccctgacccaggacgtttttgaggatgagaggaaagtactggagagcaagctgactgcccatgaggcagtcaccgtcgttcgcgaagtgctgcaggagctgctgatgggggtcttgaccccggagcgcacaccatcacctgtggatgcctatctcaccgaggaagacttgttccggcacagaaatcctccgctgcattatgagcaccaagtggtgcaaagcctgcaccaactgtggcgccagtacatgaccctgcccgccaaggctgaggaggccaggccaggggacaaggagcacgtcagccccatagccacagagaaggcctctgtgaatgctgagctgttaccacgctttaggagccccatctccgaaactcaagtgccccggcctgagaacgaggccctcagggaatccgggtcccagaaggccagagtggggaccaagagtcctcagcggaagagcatcatggaggagatcctggtggaggaaagcccagatgtggacagcaccaagagcccctgggagccggatggccttcccctgctggagtggaacctctgcttggaggacttcagaaaggcagtgatggtgctccctgatgagaaccacagagaggatgcgttgatgaggctcaacaaagcagccctggagctgtgccagaagccaaggccattgcagtccaacctcctgcaccagatgtgtttgcagctgtggcgagatgtgattgacagcctggtgggccattccatgtggctgaggtctgtgctgggcctgcctgagaaggagaccatctatttgaatgtgcctgaagagcaagatcaaaaatcacctcctatcatggaagtgaaggtacctgtggggaaagctgggaaggaggagcggaaaggagcagcccaggaaaagaagcaactggggatcaaagacaaagaagacaagaaaggagccaagctgctcgggaaagaggaccgtcccaacagcaagaagcacaaggcaaaggatgacaagaaagtcataaaatctgcaagtcaggacaggttttctttggaagaccctacccctgacatcatcctctcttctcaagaacccatagaccccctggtcatggggaaatacacccagaggctgcacagtgaggtccgtgggctgctggacaccctggtgaccgacctgatggtcctggctgatgagctcagccccataaagaatgtcgaggaggctttgcgcctctgcaggtgactctcgggcccaagcaaccttctggaaaacgggttaataaataaatcaataaagaaccttcaagtttctactaaaacc

SEQ ID NO: 329998 - DNA, 2299 bp, Homo sapiens
ggcgtcacaggccgggcccgcagggctttctaggggtccgtcgctcttgaagccgccggcggcgggcgcgtgcgcggcccgatgaagaaggaggtttccaagccgtctccgcccaagttgatcggtggatgcgcgcccccgcgcggggcaccggttgctgtggacgcagtggcggccgttggctggcgggtgcggcgcagcctcggtgtctctgggccggcggtgcagggcaacgtttcatggtgccgggcggcaccatgaagtctctaaagaaggattcccgcctcagaataactccgaccagattattagaggcctcagagaatgtcaaagaaaagaagcgggcaaagggacctgaacaacccacacccacaattcaggaagagcctgaacctgttagcaatgtcctacaaggagatgacattcttgccttggccattaagaaggaagacttgaaggagcaacacattcctcgccttactgaaaaggaagataaacgtgtcatcacccagaaatttatcatccgtaaactcaaacccatggatcctaggaggaaggtctgccaccttgtagcacgtcctgcgaatcctgatgaagccacaaagcctctggactactccggtcccggtgacagcttcgatggcagtgaccagatcctgccccaccacatcttggggagtctccaggattttaagagaattgcacttgctcgagggaacacccagctggctgagcggatacctacctcaccctgtctgatgaccctcatctctgctgaaggagagtcaaagcaaaaagccccaaaagaagagaagagacctccctgggccccacctcctcagcacaactttctgaaaaactggcagcgtaacacagccctgcggaagaagcagcaggaagccctcagcgaacacctaaagaagccagtgagtgagctgctcatgcacaccggggagacctacagacggatccaggaggagcgggagctcattgactgcacacttccaacccggcgtgataggaaaagctgggagaacagtgggttctggagtcgactggaatacttgggagatgagatgacaggtctggtcatgaccaagacaaaaactcagcgtggcctcatggagcccatcactcatatcaggaagccccactccatccgggtggagacaggattaccagcccagagggacgcttcataccgctacacctgggatcggagtctgtttctgatctaccgacgcaaggagctgcagagaatcatggaagagctggatttcagccagcaggatattgatggcctggaggtggtgggcaaagggtggcccttctcggctgttactgtggaagactacacagtgtttgaaagaagtcagggaagctcctctgaagacacaacatacttaggcacattggccagttcctctgatgtctccatgcctattctcggcccttctctgctgttctgtgggaagccagcttgctggatcagaggcagtaatccacaggacaagaggcaggttgggattgctgctcacttgacctttgaaaccctagaaggcgagaaaacctcctcagaactgactgtggtcaataatggcaccgtggccatttggtatgactggcgacggcagcaccagccggacactttccaagaccttaagaaaaacaggatgcagcgattttactttgacaaccgggaaggtgtgattctgcctggagaaattaaaacatttaccttcttcttcaagtctttgactgctggggtcttcagggaattttgggagtttcgaacccatcctactctattaggaggtgctatactgcaggtcaatctccacgcggtctccctgacccaggacgtttttgaggatgagaggaaagtactggagagcaagctgactgcccatgaggcagtcaccgtcgttcgcgaagtgctgcaggagctgctgatgggggtcttgaccccggagcgcacaccatcacctgtggatgcctatctcaccgaggaagacttgttccggcacagaaatcctccggtgaggcccagcgccagcccctgccccctcatgtgtgccctgcgtcaagggtccccaacccgcaggccgcacagcggcaggtccgtgggctgctggacaccctggtgaccgacctgatggtcctggctgatgagctcagccccataaagaatgtcgaggaggctttgcgcctctgcaggtgactctcgggcccaagcaaccttctggaaaacgggttaataaataaatcaataaagaaccttcaagtttctactaaaacc

SEQ ID NO: 329999 - DNA, 2853 bp, Homo sapiens
  misc_feature (2723)..(2723): n is a, c, g, or t
ggcgtcacaggccgggcccgcagggctttctaggggtccgtcgctcttgaagccgccggcggcgggcgcgtgcgcggcccgatgaagaaggaggtttccaagccgtctccgcccaagttgatcggtggatgcgcgcccccgcgcggggcaccggttgctgtggacgcagtggcggccgttggctggcgggtgcggcgcagcctcggtgtctctgggccggcggtgcagggcaacgtttcatggtgccgggcggcaccatgaagtctctaaagaaggattcccgcctcagaataactccgaccagattattagaggcctcagagaatgtcaaagaaaagaagcgggcaaagggacctgaacaacccacacccacaattcaggaagagcctgaacctgttagcaatgtcctacaaggagatgacattcttgccttggccattaagaaggaagacttgaaggagcaacacattcctcgccttactgaaaaggaagataaacgtgtcatcacccagaaatttatcatccgtaaactcaaacccatggatcctaggaggaaggtctgccaccttgtagcacgtcctgcgaatcctgatgaagccacaaagcctctggactactccggtcccggtgacagcttcgatggcagtgaccagatcctgccccaccacatcttggggagtctccaggattttaagagaattgcacttgctcgagggaacacccagctggctgagcggatacctacctcaccctgtctgatgaccctcatctctgctgaaggagagtcaaagcaaaaagccccaaaagaagagaagagacctccctgggccccacctcctcagcacaactttctgaaaaactggcagcgtaacacagccctgcggaagaagcagcaggaagccctcagcgaacacctaaagaagccagtgagtgagctgctcatgcacaccggggagacctacagacggatccaggaggagcgggagctcattgactgcacacttccaacccggcgtgataggaaaagctgggagaacagtgggttctggagtcgactggaatacttgggagatgagatgacaggtctggtcatgaccaagacaaaaactcagcgtggcctcatggagcccatcactcatatcaggaagccccactccatccgggtggagacaggattaccagcccagagggacgcttcataccgctacacctgggatcggagtctgtttctgatctaccgacgcaaggagctgcagagaatcatggaagagctggatttcagccagcaggatattgatggcctggaggtggtgggcaaagggtggcccttctcggctgttactgtggaagactacacagtgtttgaaagaagtcagggaagctcctctgaagacacaacatacttaggcacattggccagttcctctgatgtctccatgcctattctcggcccttctctgctgttctgtgggaagccagcttgctggatcagaggcagtaatccacaggacaagaggcaggttgggattgctgctcacttgacctttgaaaccctagaaggcgagaaaacctcctcagaactgactgtggtcaataatggcaccgtggccatttggtatgactggcgacggcagcaccagccggacactttccaagaccttaagaaaaacaggatgcagcgattttactttgacaaccgggaaggtgtgattctgcctggagaaattaaaacatttaccttcttcttcaagtctttgactgctggggtcttcagggaattttgggagtttcgaacccatcctactctattaggaggtgctatactgcaggtcaatctccacgcggtctccctgacccaggacgtttttgaggatgagaggaaagtactggagagcaagctgactgcccatgaggcagtcaccgtcgttcgcgaagtgctgcaggagctgctgatgggggtcttgaccccggagcgcacaccatcacctgtggatgcctatctcaccgaggaagacttgttccggcacagaaatcctccgctgcattatgagcaccaagtggtgcaaagcctgcaccaactgtggcgccagtacatgaccctgcccgccaaggctgaggaggccaggccaggggacaaggagcacgtcagccccatagccacagagaaggcctctgtgaatgctgagctgttaccacgctttaggagccccatctccgaaactcaagtgccccggcctgagaacgaggccctcagggaatccgggtcccagaaggccagagtggggaccaagagtcctcagcggaagagcatcatggaggagatcctggtggaggaaagcccagatgtggacagcaccaagagcccctgggagccggatggccttcccctgctggagtggaacctctgcttggaggacttcagaaaggcagtgatggtgctccctgatgagaaccacagagaggatgcgttgatgaggctcaacaaagcagccctggagctgtgccagaagccaaggccattgcagtccaacctcctgcaccagatgtgtttgcagctgtggcgagatgtgattgacagcctggtgggccattccatgtggctgaggtctgtgctgggcctgcctgagaaggagaccatctatttgaatgtgcctgaagagcaagatcaaaaatcacctcctatcatggaagtgaaggtacctgcccgggcggccaagggcgtngtgcggagggcggtaccaagttgaacaggacaggggactggaagacgaacagcccgagacatcttttccagctactgcttaagctaggcaggccatgaagaaataacggtctcagtaacctccatgctcg

SEQ ID NO: 330000 - DNA, 3161 bp, Homo sapiens
ggcgtcacaggccgggcccgcagggctttctaggggtccgtcgctcttgaagccgccggcggcgggcgcgtgcgcggcccgatgaagaaggaggtttccaagccgtctccgcccaagttgatcggtggatgcgcgcccccgcgcggggcaccggttgctgtggacgcagtggcggccgttggctggcgggtgcggcgcagcctcggtgtctctgggccggcggtgcagggcaacgtttcatggtgccgggcggcaccatgaagtctctaaagaaggattcccgcctcagaataactccgaccagattattagaggcctcagagaatgtcaaagaaaagaagcgggcaaagggacctgaacaacccacacccacaattcaggaagagcctgaacctgttagcaatgtcctacaaggagatgacattcttgccttggccattaagaaggaagacttgaaggagcaacacattcctcgccttactgaaaaggaagataaacgtgtcatcacccagaaatttatcatccgtaaactcaaacccatggatcctaggaggaaggtctgccaccttgtagcacgtcctgcgaatcctgatgaagccacaaagcctctggactactccggtcccggtgacagcttcgatggcagtgaccagatcctgccccaccacatcttggggagtctccaggattttaagagaattgcacttgctcgagggaacacccagctggctgagcggatacctacctcaccctgtctgatgaccctcatctctgctgaaggagagtcaaagcaaaaagccccaaaagaagagaagagacctccctgggccccacctcctcagcacaactttctgaaaaactggcagcgtaacacagccctgcggaagaagcagcaggaagccctcagcgaacacctaaagaagccagtgagtgagctgctcatgcacaccggggagacctacagacggatccaggaggagcgggagctcattgactgcacacttccaacccggcgtgataggaaaagctgggagaacagtgggttctggagtcgactggaatacttgggagatgagatgacaggtctggtcatgaccaagacaaaaactcagcgtggcctcatggagcccatcactcatatcaggaagccccactccatccgggtggagacaggattaccagcccagagggacgcttcataccgctacacctgggatcggagtctgtttctgatctaccgacgcaaggagctgcagagaatcatggaagagctggatttcagccagcaggatattgatggcctggaggtggtgggcaaagggtggcccttctcggctgttactgtggaagactacacagtgtttgaaagaagtcagggaagctcctctgaagacacaacatacttaggcacattggccagttcctctgatgtctccatgcctattctcggcccttctctgctgttctgtgggaagccagcttgctggatcagaggcagtaatccacaggacaagaggcaggttgggattgctgctcacttgacctttgaaaccctagaaggcgagaaaacctcctcagaactgactgtggtcaataatggcaccgtggccatttggtatgactggcgacggcagcaccagccggacactttccaagaccttaagaaaaacaggatgcagcgattttactttgacaaccgggaaggtgtgattctgcctggagaaattaaaacatttaccttcttcttcaagtctttgactgctggggtcttcagggaattttgggagtttcgaacccatcctactctattaggaggtgctatactgcaggtcaatctccacgcggtctccctgacccaggacgtttttgaggatgagaggaaagtactggagagcaagctgactgcccatgaggcagtcaccgtcgttcgcgaagtgctgcaggagctgctgatgggggtcttgaccccggagcgcacaccatcacctgtggatgcctatctcaccgaggaagacttgttccggcacagaaatcctccgctgcattatgagcaccaagtggtgcaaagcctgcaccaactgtggcgccagtacatgaccctgcccgccaaggctgaggaggccaggccaggggacaaggagcacgtcagccccatagccacagagaaggcctctgtgaatgctgagctgttaccacgctttaggagccccatctccgaaactcaagtgccccggcctgagaacgaggccctcagggaatccgggtcccagaaggccagagtggggaccaagagtcctcagcggaagagcatcatggaggagatcctggtggaggaaagcccagatgtggacagcaccaagagcccctgggagccggatggccttcccctgctggagtggaacctctgcttggaggacttcagaaaggcagtgatggtgctccctgatgagaaccacagagaggatgcgttgatgaggctcaacaaagcagccctggagctgtgccagaagccaaggccattgcagtccaacctcctgcaccagatgtgtttgcagctgtggcgagatgtgattgacagcctggtgggccattccatgtggctgaggtctgtgctgggcctgcctgagaaggagaccatctatttgaatgtgcctgaagagcaagatcaaaaatcacctcctatcatggaagtgaaggtacctgtggggaaagctgggaaggaggagcggaaaggagcagcccaggaaaagaagcaactggggatcaaagacaaagaagacaagaaaggagccaagctgctcgggaaagaggaccgtcccaacagcaagaagcacaaggcaaaggatgacaagaaagtcataaaatctgcaagtcaggacaggttttctttggaagaccctacccctgacatcatcctctcttctcaagaacccatagaccccctggtcatggggaaatacacccagaggctgcacagtgaggtccgtgggctgctggacaccctggtgaccgacctgatggtcctggctgatgagctcagccccataaagaatgtcgaggaggctttgcgcctctgcaggtgactctcgggcccaagcaaccttctggaaaacgggttaataaataaatcaataaagaaccttcaagtttctactaaaacc

SEQ ID NO: 330001 - DNA, 275 bp, Homo sapiens
tttgcagctgtggcgagatgtgattgacagcctggtgggccattccatgtggctgaggtctgtgctgggcctgcctgagaaggagaccatctatttgaatgtgcctgaagagcaaggtcagatcttgtgcaaccaaccacacctctgcatagccctcctcatctctctgaatggacaagcagcagtgcctgggccagtcatactcctttggtggaagctctgctaggttgagcccatggagtaggccccttacccctttctgtccgctgccagga

SEQ ID NO: 330002 - DNA, 267 bp, Homo sapiens
tggctctgactaatgatacagtaggtagaattcagtagaagtgatgctgttccaggcctaggccctttttaaaaggcctgacagctgccatgttcactctcttgtaccctggccaccatgacagaaggaagtccaggctatcctgccgaaggccacatggaaagccctggagaaggtgccatcacctgtggagagagttgcttgaagaactgaggcctctagccgggcgtggtggctcacacctgcaatcccagcactttgggaggc

SEQ ID NO: 330003 - DNA, 322 bp, Homo sapiens
agcaagtatgtaatactgtgatagtacaaatgagttgtcaaagagagaaaggaaggaatgagggaggaaggagattgatgaacacttgtgctgccagggctttaactgctttaaatttaatagacaactgtctaaactgttctttcagtcaacaaaccgttattaagtatccaccaggtaccaagtgtcaggagcactaactctgcaacccagaacttacattctggcaggaagaatcaacaattactcacaagcagtgaggggtgttacaaagttagaacagggtcctaaagggcacactgcaaaggggcttacttgtaca

SEQ ID NO: 330004 - DNA, 387 bp, Homo sapiens
tgagtccttcatgccctctggacccgattaactatttctatcatgtcactgaggagcatgttattgctctcagttactaactccaaactccttgagggcaaggaaacctgactgatttatttattctacccagcaagtgcctgatgcatggtctcataaaattttttgaaagaatgaatgcatagtgcctatcacatattaacatagacttctgataagccagagagctcacatgaaaacaaattaattagaaacttctgcaacctaatgcagaagttctcaagctttgcgatgcattggaatcacctgggagcttttaaaaactgccactgtcgccaggtatggtagctcgcacctgtaatcccaacacattgggaggtaaaggtg

SEQ ID NO: 330005 - DNA, 339 bp, Homo sapiens
tgagcttggggatggggcagtcccgcagaagcggggtcttgtcgaggaccgagtcaaagaagggggcacgtggagtccgcccagtgacactgtgggaatgttgagggagggatgggaggttggggagagtcagccgatgggggcgtggtcagggtggttatcctaagaccagagaggcatcgacggggcgaggttagcagcgagaagagacagggatggggtcaaaacagaggggcgtggccaacgcagggtaggggcggggtcggctctggatggggcagcattcagatcctcatccccttccccaggtcttgagtccacagttagatcccgccgtcc

SEQ ID NO: 330006 - DNA, 357 bp, Homo sapiens
agagagagagagagagagagagagagagagagagagagaggaggagaggaggccaaaaaggacagtttaattttgtacagattatgcttacctcaggtttctttagtgtgcttgaatgcccttctttccatataacacttatcttcttcttaattcggcaatggaatatcttttaagttttaaaaaaactggaataattatatctatcttttttgccgtttatatttaggggtttttgttgataaaatcaagtcttggttgtggcttgctgaattaaatatttatgagtggtgcatttttaagtatagtgaacaagacaccatattaagtacagtgataaagcatctatattctgta

SEQ ID NO: 330007 - DNA, 407 bp, Homo sapiens
aagcatctatattctgtaaaaaaaaaaaaaatctgcctatgcatgttttttaagaaaaaaaaaatggctgtatcggcctgtatgggactgtaatgcgcttagtggtctgacatatactggaaatgtatgtatactggcgtactttatattctctaatgtgcttgaatgcccttctttccatataacacttatcttcttcttaattcggcaatggaatatcttttaagttttaaaaaaactggaataattatatctatcttttttgccgtttatatttaggggtttttgttgataaaatcaagtcttggttgtggcttgctgaattaaatatttatgagtggtgcatttttaagtatagtgaacaagacaccatattaagtacagtgataaagcatctatattctgta

SEQ ID NO: 330008 - DNA, 4464 bp, Homo sapiens
gcggccgcctctccgccgccggggacgccaaggtgcggctggtggcactgacatcggcggccctgcctctcctccctcgcccccggccttccccatgtgatcggtcttaatcctggccgtgtgtgcgcgcgtggggctccattccgcggtgctgggtctccgtgccggggtgggtgctcgtgtgtgcgcttctcctccccatcccccttcccccaagaataaaagaagaaccgggaggcgtgctcagaaaataaataaataaccaccacacacgcgcagcccggagcgagtcggcggggctggcggcagcggcggaggaggagtgaaggcggcggcggcggaggagggacgcgcggaaaaggcagcaactttaaagccagctcagagcctagacctccagccgagcggtttgcagcgcggcggcggcggcggcggcggcggcggcgttgagtgtctggcccgccggtccggtcggggtgtgcagtcggacggacgagcagcgcgtcgctgtcctccggcagctggagatgtccgagcccaaggcaattgatcccaagttgtcgacgaccgacagggtggtgaaagctgttccatttcctccaagtcaccggcttacagcaaaagaagtgtttgataatgatggaaaacctcgtgtggatatcttaaaggcgcatcttatgaaggagggaaggctggaagagagtgttgcattgagaataataacagagggtgcatcaattcttcgacaggaaaaaaatttgctggatattgatgcgccagtcactgtttgtggggacattcatggacaattctttgatttgatgaagctctttgaagtcgggggatctcctgccaacactcgctacctcttcttaggggactatgttgacagagggtacttcagtattgaatgtgtgctgtatttgtgggccttgaaaattctctaccccaaaacactgtttttacttcgtggaaatcatgaatgtagacatctaacagagtatttcacatttaaacaagaatgtaaaataaagtattcagaacgcgtatatgatgcctgtatggatgcctttgactgccttcccctggctgccctgatgaaccaacagttcctgtgtgtgcatggtggtttgtctccagagattaacactttagatgatatcagaaaattagaccgattcaaagaaccacctgcatatggacctatgtgtgatatcctgtggtcagaccccctggaagattttggaaatgagaagactcaggaacatttcactcacaacacagtcagggggtgttcatacttctacagttacccggctgtatgtgaattcttacagcacaataacttgttatctatactccgagcccacgaagcccaagatgcagggtaccgcatgtacaggaaaagccaaacaacaggcttcccttctctaattacaattttttcagcaccaaattacttagatgtatacaataacaaagctgcagtattgaagtatgagaacaatgttatgaatatcaggcaattcaactgttctcctcatccatactggcttccaaatttcatggatgtttttacttggtcccttccatttgttggggaaaaagtgactgagatgctggtaaatgtcctcaacatctgctcagatgatgaactagggtcagaagaagatggatttgatggtgcaacagctgcagcccggaaagaggtgataaggaacaagatccgagcaataggcaaaatggccagagtgttctcagtgctcagagaagagagtgagagtgtgctgacgctgaaaggcttgaccccaactggcatgctccccagcggagtactttctggagggaagcaaaccctgcaaagcgctactgttgaggctattgaggctgatgaagctatcaaaggattttcaccacaacataagatcactagcttcgaggaagccaagggcttagaccgaattaatgagaggatgccgcctcgcagagatgccatgccctctgacgccaaccttaactccatcaacaaggctctcacctcagagactaacggcacggacagcaatggcagtaatagcagcaatattcagtgaccacttcctgttcactttttttttttttttttttttttttttttgagctgcggggcatgatggggattgctgcatatcagcagttggatgttcttgcctctgacagtagcttatttgctctgggggccaggaattggattcagtttacactatcattaaaaaagagggagagagataataaactatattttggtggggatggtgattaaacacctcttttgggtatgccttttaaaaatgcttatagagaaaaaaaattttaaaaagaaagctaatgctagtatatactgcaatgttaggggaatgaacatgttttcctactgcattggggacttctagataggttaatgaaaggccttttattctgttactggacatgaaaactttgtctaatttcttactctattgtacgtttacagtcgcagcactaaaaatggatgacatcaaacatttttaacaaaatgatgtacaaactaaggactatttattgataatgttttgctactcttgtcagacaatggctataaactgaattaggcagtcttaaaaaaaaaaaaaaaacagaaaaagaaaaaaaagaacgttgcaaatttgttaaaatgccaaaaaggacagtttaattttgtacagattatgcttacctcaggtttctttagtgtgcttgaatgcccttctttccatataacacttatcttcttcttaattcggcaatggaatatcttttaagttttaaaaaaactggaataattatatctatcttttttgccgtttatatttaggggtttttgttgataaaatcaagtcttggttgtggcttgctgaattaaatatttatgagtggtgcatttttaagtatagtgaacaagacaccatattaagtacagtgataaagcatctatattctgtaaaaaaaaaaaaaatctgcctatgcatgttttttaagaaaaaaaaaatggctgtatcggcctgtatgggactgtaatgcgcttagtggtctgacatatactggaaatgtatgtatactggcgtactttatattctctaaaatgcttaatgcctttgaaattttgtaatcaaaaaaaagctttgaaaaaatctaaaggggagagtattctttaaagtttttaacataagcttgtcaatgcacatgtagatggttagcatgtttagcaaaccttgtgaaattataataagtttgtagttacatgtgaaactctaaatgcatggcaactgttaatgtcataacagtttagttattttgttctgttctgtcatgtgccacaaaatatgtacttttttcacttttttccctttgtatatcagttacgggttacaactggttcattctgaaaacaacaacaacaaaagtccattcatattttttaacaattgtataagtgcccaagtaattcactacagcctaaagccttgcctttgtaatttgacttctgacatgttggcaatcaaagcatgcacttgtaacaatgaaaaagaaaaagcattttatattactactcaataaaatgtgcatgaacttacagaattctcatccttccactgagtccgctgaagggatttatgtgcacaaccaccatgtgtcttctaggtgctggcccaccaccacacatcacaggctgatttccacaggcttcttcctaggggcctcgtgatctgaggggtggtgcctacttccactgtaagaaagaatcttggtggatttgtgtctcaaatcagataagagaagcctgtttaaagagcagatgccatcttctggcttcctcaaggagccagttaaaaaaccagagcattcctttttattgaaaaataaaattaatttgttatcagagaaaagagttgcatttgtattaacaagaaatttgtatacccacgcttcagctactatctaatcatcacccgaagatttaagatacaccaaatttcagtttgtttgtaacattgttcatctttagtgcactttgttttatataataaagtatgcctgttatattaaataataagaatatggcaattagcgatatagcatacccaaacaaagatgttctcgatacagtctggcaaagactatcccaaggttattttaatgaattcagacattttttcctgtggatatttctccatcctaaaaaaagtggcaaccaaggaaaatatttagatgcaacttactagagtgatgatgtgaaagaaatggtgattctggtatcatggtgtttattttctttcttataactgcagagaaaatatcctgactaaaaaaaattcatttttttggattcctttcttttacaaattgtgctgaggcaactatggcatagaaataaacatttgacattaaaataaaaaaacagttgat

SEQ ID NO: 330009 - DNA, 4511 bp, Homo sapiens
gcggccgcctctccgccgccggggacgccaaggtgcggctggtggcactgacatcggcggccctgcctctcctccctcgcccccggccttccccatgtgatcggtcttaatcctggccgtgtgtgcgcgcgtggggctccattccgcggtgctgggtctccgtgccggggtgggtgctcgtgtgtgcgcttctcctccccatcccccttcccccaagaataaaagaagaaccgggaggcgtgctcagaaaataaataaataaccaccacacacgcgcagcccggagcgagtcggcggggctggcggcagcggcggaggaggagtgaaggcggcggcggcggaggagggacgcgcggaaaaggcagcaactttaaagccagctcagagcctagacctccagccgagcggtttgcagcgcggcggcggcggcggcggcggcggcggcgttgagtgtctggcccgccggtccggtcggggtgtgcagtcggacggacgagcagcgcgtcgctgtcctccggcagctggagatgtccgagcccaaggcaattgatcccaagttgtcgacgaccgacagggtggtgaaagctgttccatttcctccaagtcaccggcttacagcaaaagaagtgtttgataatgatggaaaacctcgtgtggatatcttaaaggcgcatcttatgaaggagggaaggctggaagagagtgttgcattgagaataataacagagggtgcatcaattcttcgacaggaaaaaaatttgctggatattgatgcgccagtcactgtttgtggggacattcatggacaattctttgatttgatgaagctctttgaagtcgggggatctcctgccaacactcgctacctcttcttaggggactatgttgacagagggtacttcagtattgaatgtgtgctgtatttgtgggccttgaaaattctctaccccaaaacactgtttttacttcgtggaaatcatgaatgtagacatctaacagagtatttcacatttaaacaagaatgtaaaataaagtattcagaacgcgtatatgatgcctgtatggatgcctttgactgccttcccctggctgccctgatgaaccaacagttcctgtgtgtgcatggtggtttgtctccagagattaacactttagatgatatcagaaaattagaccgattcaaagaaccacctgcatatggacctatgtgtgatatcctgtggtcagaccccctggaagattttggaaatgagaagactcaggaacatttcactcacaacacagtcagggggtgttcatacttctacagttacccggctgtatgtgaattcttacagcacaataacttgttatctatactccgagcccacgaagcccaagatgcagggtaccgcatgtacaggaaaagccaaacaacaggcttcccttctctaattacaattttttcagcaccaaattacttagatgtatacaataacaaagctgcagtattgaagtatgagaacaatgttatgaatatcaggcaattcaactgttctcctcatccatactggcttccaaatttcatggatgtttttacttggtcccttccatttgttggggaaaaagtgactgagatgctggtaaatgtcctcaacatctgctcagatgatgaactagggtcagaagaagatggatttgatggtgcaacagctgcagcccggaaagaggtgataaggaacaagatccgagcaataggcaaaatggccagagtgttctcagtgctcagagaagagagtgagagtgtgctgacgctgaaaggcttgaccccaactggcatgctccccagcggagtactttctggagggaagcaaaccctgcaaagcgctatcaaaggattttcaccacaacataagatcactagcttcgaggaagccaagggcttagaccgaattaatgagaggatgccgcctcgcagagatgccatgccctctgacgccaaccttaactccatcaacaaggctctcacctcagagactaacggcacggacagcaatggcagtaatagcagcaatattcagtgaccacttcctgttcactttttttttttttttttttttttttttttgagctgcggggcatgatggggattgctgcatatcagcagttggatgttcttgcctctgacagtagcttatttgctctgggggccaggaattggattcagtttacactatcattaaaaaagagggagagagataataaactatattttggtggggatggtgattaaacacctcttttgggtatgccttttaaaaatgcttatagagaaaaaaaattttaaaaagaaagctaatgctagtatatactgcaatgttaggggaatgaacatgttttcctactgcattggggacttctagataggttaatgaaaggccttttattctgttactggacatgaaaactttgtctaatttcttactctattgtacgtttacagtcgcagcactaaaaatggatgacatcaaacatttttaacaaaatgatgtacaaactaaggactatttattgataatgttttgctactcttgtcagacaatggctataaactgaattaggcagtcttaaaaaaaaaaaaaaaacagaaaaagaaaaaaaagaacgttgcaaatttgttaaaatgccaaaaaggacagtttaattttgtacagattatgcttacctcaggtttctttagtgtgcttgaatgcccttctttccatataacacttatcttcttcttaattcggcaatggaatatcttttaagttttaaaaaaactggaataattatatctatcttttttgccgtttatatttaggggtttttgttgataaaatcaagtcttggttgtggcttgctgaattaaatatttatgagtggtgcatttttaagtatagtgaacaagacaccatattaagtacagtgataaagcatctatattctgtaaaaaaaaaaaaaatctgcctatgcatgttttttaagaaaaaaaaaatggctgtatcggcctgtatgggactgtaatgcgcttagtggtctgacatatactggaaatgtatgtatactggcgtactttatattctctaaaatgcttaatgcctttgaaattttgtaatcaaaaaaaagctttgaaaaaatctaaaggggagagtattctttaaagtttttaacataagcttgtcaatgcacatgtagatggttagcatgtttagcaaaccttgtgaaattataataagtttgtagttacatgtgaaactctaaatgcatggcaactgttaatgtcataacagtttagttattttgttctgttctgtcatgtgccacaaaatatgtacttttttcacttttttccctttgtatatcagttacgggttacaactggttcattctgaaaacaacaacaacaaaagtccattcatattttttaacaattgtataagtgcccaagtaattcactacagcctaaagccttgcctttgtaatttgacttctgacatgttggcaatcaaagcatgcacttgtaacaatgaaaaagaaaaagcattttatattactactcaataaaatgtgcatgaacttacagaattctcatccttccactgagtccgctgaagggatttatgtgcacaaccaccatgtgtcttctaggtgctggcccaccaccacacatcacaggctgatttccacaggcttcttcctaggggcctcgtgatctgaggggtggtgcctacttccactgtaagaaagaatcttggtggatttgtgtctcaaatcagataagagaagcctgtttaaagagcagatgccatcttctggcttcctcaaggagccagttaaaaaaccagagcattcctttttattgaaaaataaaattaatttgttatcaggttgtttcagttgtattggatgccctatctatctgctaaagcaaaaagtactaggctactaagtgcattttcatcacagaaaagagttgcatttgtattaacaagaaatttgtatacccacgcttcagctactatctaatcatcacccgaagatttaagatacaccaaatttcagtttgtttgtaacattgttcatctttagtgcactttgttttatataataaagtatgcctgttatattaaataataagaatatggcaattagcgatatagcatacccaaacaaagatgttctcgatacagtctggcaaagactatcccaaggttattttaatgaattcagacattttttcctgtggatatttctccatcctaaaaaaagtggcaaccaaggaaaatatttagatgcaacttactagagtgatgatgtgaaagaaatggtgattctggtatcatggtgtttattttctttcttataactgcagagaaaatatcctgactaaaaaaaattcatttttttggattcctttcttttacaaattgtgctgaggcaactatggcatagaaataaacatttgacattaaaataaaaaaacagttgat

SEQ ID NO: 330010 - DNA, 3927 bp, Homo sapiens
gcggccgcctctccgccgccggggacgccaaggtgcggctggtggcactgacatcggcggccctgcctctcctccctcgcccccggccttccccatgtgatcggtcttaatcctggccgtgtgtgcgcgcgtggggctccattccgcggtgctgggtctccgtgccggggtgggtgctcgtgtgtgcgcttctcctccccatcccccttcccccaagaataaaagaagaaccgggaggcgtgctcagaaaataaataaataaccaccacacacgcgcagcccggagcgagtcggcggggctggcggcagcggcggaggaggagtgaaggcggcggcggcggaggagggacgcgcggaaaaggcagcaactttaaagccagctcagagcctagacctccagccgagcggtttgcagcgcggcggcggcggcggcggcggcggcggcgttgagtgtctggcccgccggtccggtcggggtgtgcagtcggacggacgagcagcgcgtcgctgtcctccggcagctggagatgtccgagcccaaggcaattgatcccaagttgtcgacgaccgacagggtggtgaaagctgttccatttcctccaagtcaccggcttacagcaaaagaagtgtttgataatgatggaaaacctcgtgtggatatcttaaaggcgcatcttatgaaggagggaaggctggaagagagtgttgcattgagaataataacagagggtgcatcaattcttcgacaggaaaaaaatttgctggatattgatgcgccagtcactgtttgtggggacattcatggacaattctttgatttgatgaagctctttgaagtcgggggatctcctgccaacactcgctacctcttcttaggggactatgttgacagagggtacttcagtattgaatgtgtgctgtatttgtgggccttgaaaattctctaccccaaaacactgtttttacttcgtggaaatcatgaatgtagacatctaacagagtatttcacatttaaacaagaatgtaaaataaagtattcagaacgcgtatatgatgcctgtatggatgcctttgactgccttcccctggctgccctgatgaaccaacagttcctgtgtgtgcatggtggtttgtctccagagattaacactttagatgatatcagaaaattagaccgattcaaagaaccacctgcatatggacctatgtgtgatatcctgtggtcagaccccctggaagattttggaaatgagaagactcaggaacatttcactcacaacacagtcagggggtgttcatacttctacagttacccggctgtatgtgaattcttacagcacaataacttgttatctatactccgagcccacgaagcccaagatgcagggtaccgcatgtacaggaaaagccaaacaacaggcttcccttctctaattacaattttttcagcaccaaattacttagatgtatacaataacaaagctgcagtattgaagtatgagaacaatgttatgaatatcaggcaattcaactgttctcctcatccatactggcttccaaatttcatggatgtttttacttggtcccttccatttgttggggaaaaagtgactgagatgctggtaaatgtcctcaacatctgctcagatgatgaactagggtcagaagaagatggatttgatggtgcaacagctgcagcccggaaagaggtgataaggaacaagatccgagcaataggcaaaatggccagagtgttctcagtgctcagagaagagagtgagagtgtgctgacgctgaaaggcttgaccccaactggcatgctccccagcggagtactttctggagggaagcaaaccctgcaaagcgctactgttgaggctattgaggctgatgaagctatcaaaggattttcaccacaacataagatcactagcttcgaggaagccaagggcttagaccgaattaatgagaggatgccgcctcgcagagatgccatgccctctgacgccaaccttaactccatcaacaaggctctcacctcagagactaacggcacggacagcaatggcagtaatagcagcaatattcagtgaccacttcctgttcactttttttttttttttttttttttttttttgagctgcggggcatgatggggattgctgcatatcagcagttggatgttcttgcctctgacagtagcttatttgctctgggggccaggaattggattcagtttacactatcattaaaaaagagggagagagataataaactatattttggtggggatggtgattaaacacctcttttgggtatgccttttaaaaatgcttatagagaaaaaaaattttaaaaagaaagctaatgctagtatatactgcaatgttaggggaatgaacatgttttcctactgcattggggacttctagataggttaatgaaaggccttttattctgttactggacatgaaaactttgtctaatttcttactctattgtacgtttacagtcgcagcactaaaaatggatgacatcaaacatttttaacaaaatgatgtacaaactaaggactatttattgataatgttttgctactcttgtcagacaatggctataaactgaattaggcagtcttaaaaaaaaaaaaaaaacagaaaaagaaaaaaaagaacgttgcaaatttgttaaaatgccaaaaaggacagtttaattttgtacagattatgcttacctcaggtttctttagtgtgcttgaatgcccttctttccatataacacttatcttcttcttaattcggcaatggaatatcttttaagttttaaaaaaactggaataattatatctatcttttttgccgtttatatttaggggtttttgttgataaaatcaagtcttggttgtggcttgctgaattaaatatttatgagtggtgcatttttaagtatagtgaacaagacaccatattaagtacagtgataaagcatctatattctgtaaaaaaaaaaaaaatctgcctatgcatgttttttaagaaaaaaaaaatgggttggtcagacaatgggttataaactggaattacggcaggtcttaaaaaaaaaaaaaaccaagaaaaagagaaaaaaaaagaagtgtggcacaaattgttggttaacagtggcccaaaaggggacggcttaaacttgtgggtaccagcataagtgcctaaccccgagggtctactatacagggtgggcctggaaaagtgccccctttcttccccattattaaccctttcattcagtcctccaccaatttcctatttcatcagggggccattctcctgtaggaaacatctcggtgtgagcggccctttgattcccaaagggcctatacgggtcttcccaccacgtttagtatgttataagcgcccctttataacgtggggacacgagaacaagccaccgctttaacacttacagaagagataccgacatcatacactagataaccgcacaaacaagtttggtgggcggccgcccggcgggacccccgcagagaaagaagaagttctctgaaagaaaacacaacaggagattatgcgcagaaaggcgggaccccaaatgaggcaagcaagcgacagaccagcagtggggcaaacagtacgtaggtgcgcccaacagcaaaaaaaaccccggggcgacagacaaagcaaaaaaagtaggtggtacaagcagacagctaccagacaacaaataaagatcaaaagccagccgggggggaaacacaacccacgcagcaggtgcatggcagaaaacaacactaacgacgcaacgtaggagaaccgcgcagcgagagccaccacaatacagggggacaaacaaacaaacgagggagagagaacacacacaggagcaccgccgaaacattaaaaaatagccccgcgc

SEQ ID NO: 330011 - DNA, 2306 bp, Homo sapiens
gcggccgcctctccgccgccggggacgccaaggtgcggctggtggcactgacatcggcggccctgcctctcctccctcgcccccggccttccccatgtgatcggtcttaatcctggccgtgtgtgcgcgcgtggggctccattccgcggtgctgggtctccgtgccggggtgggtgctcgtgtgtgcgcttctcctccccatcccccttcccccaagaataaaagaagaaccgggaggcgtgctcagaaaataaataaataaccaccacacacgcgcagcccggagcgagtcggcggggctggcggcagcggcggaggaggagtgaaggcggcggcggcggaggagggacgcgcggaaaaggcagcaactttaaagccagctcagagcctagacctccagccgagcggtttgcagcgcggcggcggcggcggcggcggcggcggcgttgagtgtctggcccgccggtccggtcggggtgtgcagtcggacggacgagcagcgcgtcgctgtcctccggcagctggagatgtccgagcccaaggcaattgatcccaagttgtcgacgaccgacagggtggtgaaagctgttccatttcctccaagtcaccggcttacagcaaaagaagtgtttgataatgatggaaaacctcgtgtggatatcttaaaggcgcatcttatgaaggagggaaggctggaagagagtgttgcattgagaataataacagagggtgcatcaattcttcgacaggaaaaaaatttgctggatattgatgcgccagtcactgtttgtggggacattcatggacaattctttgatttgatgaagctctttgaagtcgggggatctcctgccaacactcgctacctcttcttaggggactatgttgacagagggtacttcagtattgaatgtgtgctgtatttgtgggccttgaaaattctctaccccaaaacactgtttttacttcgtggaaatcatgaatgtagacatctaacagagtatttcacatttaaacaagaatgtaaaataaagtattcagaacgcgtatatgatgcctgtatggatgcctttgactgccttcccctggctgccctgatgaaccaacagttcctgtgtgtgcatggtggtttgtctccagagattaacactttagatgatatcagaaaattagaccgattcaaagaaccacctgcatatggacctatgtgtgatatcctgtggtcagaccccctggaagattttggaaatgagaagactcaggaacatttcactcacaacacagtcagggggtgttcatacttctacagttacccggctgtatgtgaattcttacagcacaataacttgttatctatactccgagcccacgaagcccaagatgcagggtaccgcatgtacaggaaaagccaaacaacaggcttcccttctctaattacaattttttcagcaccaaattacttagatgtatacaataacaaagctgcagtattgaagtatgagaacaatgttatgaatatcaggcaattcaactgttctcctcatccatactggcttccaaatttcatggatgtttttacttggtcccttccatttgttggggaaaaagtgactgagatgctggtaaatgtcctcaacatctgctcagatgatgaactagggtcagaagaagatggatttgatggtgcaacagctgcagcccggaaagaggtgataaggaacaagatccgagcaataggcaaaatggccagagtgttctcagtgctcagagaagagagtgagagtgtgctgacgctgaaaggcttgaccccaactggcatgatggggattgctgcatatcagcagttggatgttcttgcctctgacagtagcttatttgctctgggggccaggaattggattcagtttacactatcattaaaaaagagggagagagataataaactatattttggtggggatggtgattaaacacctcttttgggtatgccttttaaaaatgcttatagagaaaaaaaattttaaaaagaaagctaatgctagtatatactgcaatgttaggggaatgaacatgttttcctactgcattggggacttctagataggttaatgaaaggccttttattctgttactggacatgaaaactttgtctaatttcttactctattgtacgtttacagtcgcagcactaaaaatggatgacatcaaacatttttaacaaaatgatgtacaaactaaggactatttattgataatgttttgctactcttgtcagacaatggctataaactgaattaggcagtctt

SEQ ID NO: 330012 - DNA, 600 bp, Homo sapiens
gtaagtcctgaggagggaggttgcccacttgtatacacattttgttgtttatagcatgaaatcaaaagtcctagttaccagtgagtcttcaaataccttacccatcataatcttttactgttgaatctatacattagagtagtaagtatattatacatatatacacatattttcatgtgttaaatatctgtaagattgcaatgctctaaaaagtggaatgcaacttagagatggtgatgatttctgaagtgatactttaagaagtgatattgtttttaagtagaaatactaagtggcacacaggatattcattgggaaagattagacaaagtatcccgagacttccacaatggttgagtaagggtataagttaaaacagtggttttcaaagtgtgatccccagactgatagtatcatcatcatcaccatttgaaacttgttaaaatatgcattcttaggccccactccagcctactgaatcacagtacctggggtgagacccaacaatctgtgtcttatccagccctctgtgtgattctgatgcacattaaagtttgagaagcactgaactttcggaagaaggacacatttttttctctt

SEQ ID NO: 330013 - DNA, 449 bp, Homo sapiens
agaagagagtgagagtgtgctgacgctgaaaggcttgaccccaactggcatgctccccagcggagtactttctggagggaagcaaaccctgcaaagcggtaagcaggctgatgggtatgactgtgtgctggggcatcgcagtcagctgtgtcattagagccctgatttattcattcatttaagctctgtcttggtcttcggttcttcttctcagctggcagaagggctgaaaccccaatcagtttgatcagtcatgtccaacataatagctccctcattctctggaatgtggtctttactccacctttcccccattccctcattcacatgttaatctacatattcagcctagctacaggacaactcatttaggttgcctacatgcacaataggtttgactactttgagccactccgttgtcaaaaacaactttttaatcacatttttaa

SEQ ID NO: 330014 - DNA, 482 bp, Homo sapiens
ggtttaagtccataagttgtataagcattctgggatgcctaaggtgtgagcctggatgttttggaacttcagtcaaatggttgaattttcttgatgagctaaagccatacatagaagcagaaatatgttctgtgttcctaacatcctcttttggttatttttagctgcagtattgaagtatgagaacaatgttatgaatatcaggcaattcaactgttctcctcatccatactggcttccaaatttcatggatgtttttacttggtcccttccatttgttggggaaaaaggtatgttgtggaatcctgagatgttcttcttaaaatagtttaggaaggaaggaaaggagattaaacactcagaaagagaagaactttggcccagccaataaaattcacaagttgtacaatgaaagatgtgatttggaagtggcagtgtgtcactctgtatcctattaacaggacacaattggtgaatgaggg

SEQ ID NO: 330015 - DNA, 4541 bp, Homo sapiens
gcggccgcctctccgccgccggggacgccaaggtgcggctggtggcactgacatcggcggccctgcctctcctccctcgcccccggccttccccatgtgatcggtcttaatcctggccgtgtgtgcgcgcgtggggctccattccgcggtgctgggtctccgtgccggggtgggtgctcgtgtgtgcgcttctcctccccatcccccttcccccaagaataaaagaagaaccgggaggcgtgctcagaaaataaataaataaccaccacacacgcgcagcccggagcgagtcggcggggctggcggcagcggcggaggaggagtgaaggcggcggcggcggaggagggacgcgcggaaaaggcagcaactttaaagccagctcagagcctagacctccagccgagcggtttgcagcgcggcggcggcggcggcggcggcggcggcgttgagtgtctggcccgccggtccggtcggggtgtgcagtcggacggacgagcagcgcgtcgctgtcctccggcagctggagatgtccgagcccaaggcaattgatcccaagttgtcgacgaccgacagggtggtgaaagctgttccatttcctccaagtcaccggcttacagcaaaagaagtgtttgataatgatggaaaacctcgtgtggatatcttaaaggcgcatcttatgaaggagggaaggctggaagagagtgttgcattgagaataataacagagggtgcatcaattcttcgacaggaaaaaaatttgctggatattgatgcgccagtcactgtttgtggggacattcatggacaattctttgatttgatgaagctctttgaagtcgggggatctcctgccaacactcgctacctcttcttaggggactatgttgacagagggtacttcagtattgaatgtgtgctgtatttgtgggccttgaaaattctctaccccaaaacactgtttttacttcgtggaaatcatgaatgtagacatctaacagagtatttcacatttaaacaagaatgtaaaataaagtattcagaacgcgtatatgatgcctgtatggatgcctttgactgccttcccctggctgccctgatgaaccaacagttcctgtgtgtgcatggtggtttgtctccagagattaacactttagatgatatcagaaaattagaccgattcaaagaaccacctgcatatggacctatgtgtgatatcctgtggtcagaccccctggaagattttggaaatgagaagactcaggaacatttcactcacaacacagtcagggggtgttcatacttctacagttacccggctgtatgtgaattcttacagcacaataacttgttatctatactccgagcccacgaagcccaagatgcagggtaccgcatgtacaggaaaagccaaacaacaggcttcccttctctaattacaattttttcagcaccaaattacttagatgtatacaataacaaagctgcagtattgaagtatgagaacaatgttatgaatatcaggcaattcaactgttctcctcatccatactggcttccaaatttcatggatgtttttacttggtcccttccatttgttggggaaaaagtgactgagatgctggtaaatgtcctcaacatctgctcagatgatgaactagggtcagaagaagatggatttgatggtgcaacagctgcagcccggaaagaggtgataaggaacaagatccgagcaataggcaaaatggccagagtgttctcagtgctcagagaagagagtgagagtgtgctgacgctgaaaggcttgaccccaactggcatgctccccagcggagtactttctggagggaagcaaaccctgcaaagcgctactgttgaggctattgaggctgatgaagctatcaaaggattttcaccacaacataagatcactagcttcgaggaagccaagggcttagaccgaattaatgagaggatgccgcctcgcagagatgccatgccctctgacgccaaccttaactccatcaacaaggctctcacctcagagactaacggcacggacagcaatggcagtaatagcagcaatattcagtgaccacttcctgttcactttttttttttttttttttttttttttttgagctgcggggcatgatggggattgctgcatatcagcagttggatgttcttgcctctgacagtagcttatttgctctgggggccaggaattggattcagtttacactatcattaaaaaagagggagagagataataaactatattttggtggggatggtgattaaacacctcttttgggtatgccttttaaaaatgcttatagagaaaaaaaattttaaaaagaaagctaatgctagtatatactgcaatgttaggggaatgaacatgttttcctactgcattggggacttctagataggttaatgaaaggccttttattctgttactggacatgaaaactttgtctaatttcttactctattgtacgtttacagtcgcagcactaaaaatggatgacatcaaacatttttaacaaaatgatgtacaaactaaggactatttattgataatgttttgctactcttgtcagacaatggctataaactgaattaggcagtcttaaaaaaaaaaaaaaaacagaaaaagaaaaaaaagaacgttgcaaatttgttaaaatgccaaaaaggacagtttaattttgtacagattatgcttacctcaggtttctttagtgtgcttgaatgcccttctttccatataacacttatcttcttcttaattcggcaatggaatatcttttaagttttaaaaaaactggaataattatatctatcttttttgccgtttatatttaggggtttttgttgataaaatcaagtcttggttgtggcttgctgaattaaatatttatgagtggtgcatttttaagtatagtgaacaagacaccatattaagtacagtgataaagcatctatattctgtaaaaaaaaaaaaaatctgcctatgcatgttttttaagaaaaaaaaaatggctgtatcggcctgtatgggactgtaatgcgcttagtggtctgacatatactggaaatgtatgtatactggcgtactttatattctctaaaatgcttaatgcctttgaaattttgtaatcaaaaaaaagctttgaaaaaatctaaaggggagagtattctttaaagtttttaacataagcttgtcaatgcacatgtagatggttagcatgtttagcaaaccttgtgaaattataataagtttgtagttacatgtgaaactctaaatgcatggcaactgttaatgtcataacagtttagttattttgttctgttctgtcatgtgccacaaaatatgtacttttttcacttttttccctttgtatatcagttacgggttacaactggttcattctgaaaacaacaacaacaaaagtccattcatattttttaacaattgtataagtgcccaagtaattcactacagcctaaagccttgcctttgtaatttgacttctgacatgttggcaatcaaagcatgcacttgtaacaatgaaaaagaaaaagcattttatattactactcaataaaatgtgcatgaacttacagaattctcatccttccactgagtccgctgaagggatttatgtgcacaaccaccatgtgtcttctaggtgctggcccaccaccacacatcacaggctgatttccacaggcttcttcctaggggcctcgtgatctgaggggtggtgcctacttccactgtaagaaagaatcttggtggatttgtgtctcaaatcagataagagaagcctgtttaaagagcagatgccatcttctggcttcctcaaggagccagttaaaaaaccagagcattcctttttattgaaaaataaaattaatttgttatcaggttgtttcagttgtattggatgccctatctatctgctaaagcaaaaagtactaggctactaagtgcattttcatcacagaaaagagttgcatttgtattaacaagaaatttgtatacccacgcttcagctactatctaatcatcacccgaagatttaagatacaccaaatttcagtttgtttgtaacattgttcatctttagtgcactttgttttatataataaagtatgcctgttatattaaataataagaatatggcaattagcgatatagcatacccaaacaaagatgttctcgatacagtctggcaaagactatcccaaggttattttaatgaattcagacattttttcctgtggatatttctccatcctaaaaaaagtggcaaccaaggaaaatatttagatgcaacttactagagtgatgatgtgaaagaaatggtgattctggtatcatggtgtttattttctttcttataactgcagagaaaatatcctgactaaaaaaaattcatttttttggattcctttcttttacaaattgtgctgaggcaactatggcatagaaataaacatttgacattaaaataaaaaaacagttgat

SEQ ID NO: 330016 - DNA, 3631 bp, Homo sapiens
gcggccgcctctccgccgccggggacgccaaggtgcggctggtggcactgacatcggcggccctgcctctcctccctcgcccccggccttccccatgtgatcggtcttaatcctggccgtgtgtgcgcgcgtggggctccattccgcggtgctgggtctccgtgccggggtgggtgctcgtgtgtgcgcttctcctccccatcccccttcccccaagaataaaagaagaaccgggaggcgtgctcagaaaataaataaataaccaccacacacgcgcagcccggagcgagtcggcggggctggcggcagcggcggaggaggagtgaaggcggcggcggcggaggagggacgcgcggaaaaggcagcaactttaaagccagctcagagcctagacctccagccgagcggtttgcagcgcggcggcggcggcggcggcggcggcggcgttgagtgtctggcccgccggtccggtcggggtgtgcagtcggacggacgagcagcgcgtcgctgtcctccggcagctggagatgtccgagcccaaggcaattgatcccaagttgtcgacgaccgacagggtggtgaaagctgttccatttcctccaagtcaccggcttacagcaaaagaagtgtttgataatgatggaaaacctcgtgtggatatcttaaaggcgcatcttatgaaggagggaaggctggaagagagtgttgcattgagaataataacagagggtgcatcaattcttcgacaggaaaaaaatttgctggatattgatgcgccagtcactgtttgtggggacattcatggacaattctttgatttgatgaagctctttgaagtcgggggatctcctgccaacactcgctacctcttcttaggggactatgttgacagagggtacttcagtattgaatgtgtgctgtatttgtgggccttgaaaattctctaccccaaaacactgtttttacttcgtggaaatcatgaatgtagacatctaacagagtatttcacatttaaacaagaatgtaaaataaagtattcagaacgcgtatatgatgcctgtatggatgcctttgactgccttcccctggctgccctgatgaaccaacagttcctgtgtgtgcatggtggtttgtctccagagattaacactttagatgatatcagaaaattagaccgattcaaagaaccacctgcatatggacctatgtgtgatatcctgtggtcagaccccctggaagattttggaaatgagaagactcaggaacatttcactcacaacacagtcagggggtgttcatacttctacagttacccggctgtatgtgaattcttacagcacaataacttgttatctatactccgagcccacgaagcccaagatgcagggtaccgcatgtacaggaaaagccaaacaacaggcttcccttctctaattacaattttttcagcaccaaattacttagatgtatacaataacaaagctgcagtattgaagtatgagaacaatgttatgaatatcaggcaattcaactgttctcctcatccatactggcttccaaatttcatggatgtttttacttggtcccttccatttgttggggaaaaagtgactgagatgctggtaaatgtcctcaacatctgctcagatgatgaactagggtcagaagaagatggatttgatggtgcaacagctgcagcccggaaagaggtgataaggaacaagatccgagcaataggcaaaatggccagagtgttctcagtgctcagagaagagagtgagagtgtgctgacgctgaaaggcttgaccccaactggcatgctccccagcggagtactttctggagggaagcaaaccctgcaaagcgctactgttgaggctattgaggctgatgaagctatcaaaggattttcaccacaacataagatcactagcttcgaggaagccaagggcttagaccgaattaatgagaggatgccgcctcgcagagatgccatgccctctgacgccaaccttaactccatcaacaaggctctcacctcagagactaacggcacggacagcaatggcagtaatagcagcaatattcagtgaccacttcctgttcactttttttttttttttttttttttttttttgagctgcggggcatgatggggattgctgcatatcagcagttggatgttcttgcctctgacagtagcttatttgctctgggggccaggaattggattcagtttacactatcattaaaaaagagggagagagataataaactatattttggtggggatggtgattaaacacctcttttgggtatgccttttaaaaatgcttatagagaaaaaaaattttaaaaagaaagctaatgctagtatatactgcaatgttaggggaatgaacatgttttcctactgcattggggacttctagataggttaatgaaaggccttttattctgttactggacatgaaaactttgtctaatttcttactctattgtacgtttacagtcgcagcactaaaaatggatgacatcaaacatttttaacaaaatgatgtacaaactaaggactatttattgataatgttttgctactcttgtcagacaatggctataaactgaattaggcagtcttaaaaaaaaaaaaaaaacagaaaaagaaaaaaaagaacgttgcaaatttgttaaaatgccaaaaaggacagtttaattttgtacagattatgcttacctcaggtttctttagtgtgcttgaatgcccttctttccatataacacttatcttcttcttaattcggcaatggaatatcttttaagttttaaaaaaactggaataattatatctatcttttttgccgtttatatttaggggtttttgttgataaaatcaagtcttggttgtggcttgctgaattaaatatttatgagtggtgcatttttaagtatagtgaacaagacaccatattaagtacagtgataaagcatctatattctgtaaaaaaaaaaaaaatctgcctatgcatgttttttaagaaaaaaaaaatggctgtatcggcctgtatgggactgtaatgcgcttagtggtctgacatatactggaaatgtatgtatactggcgtactttatattctctaaaatgcttaatgcctttgaaattttgtaatcaaaaaaaagctttgaaaaaatctaaaggggagagtattctttaaagtttttaacataagcttgtcaatgcacatgtagatggttagcatgtttagcaaaccttgtgaaattataataagtttgtagttacatgtgaaactctaaatgcatggcaactgttaatgtcataacagtttagttattttgttctgttctgtcatgtgccacaaaatatgtacttttttcacttttttccctttgtatatcagttacgggttacaactggttcattctgaaaacaacaacaacaaaagtccattcatattttttaacaattgtataagtgcccaagtaattcactacagcctaaagccttgcctttgtaatttgacttctgacatgttggcaatcaaagcatgcacttgtaacaatgaaaaagaaaaagcattttatattactactcaataaaatgtgcatgaactta

SEQ ID NO: 330017 - DNA, 3000 bp, Homo sapiens
gcggccgcctctccgccgccggggacgccaaggtgcggctggtggcactgacatcggcggccctgcctctcctccctcgcccccggccttccccatgtgatcggtcttaatcctggccgtgtgtgcgcgcgtggggctccattccgcggtgctgggtctccgtgccggggtgggtgctcgtgtgtgcgcttctcctccccatcccccttcccccaagaataaaagaagaaccgggaggcgtgctcagaaaataaataaataaccaccacacacgcgcagcccggagcgagtcggcggggctggcggcagcggcggaggaggagtgaaggcggcggcggcggaggagggacgcgcggaaaaggcagcaactttaaagccagctcagagcctagacctccagccgagcggtttgcagcgcggcggcggcggcggcggcggcggcggcgttgagtgtctggcccgccggtccggtcggggtgtgcagtcggacggacgagcagcgcgtcgctgtcctccggcagctggagatgtccgagcccaaggcaattgatcccaagttgtcgacgaccgacagggtggtgaaagctgttccatttcctccaagtcaccggcttacagcaaaagaagtgtttgataatgatggaaaacctcgtgtggatatcttaaaggcgcatcttatgaaggagggaaggctggaagagagtgttgcattgagaataataacagagggtgcatcaattcttcgacaggaaaaaaatttgctggatattgatgcgccagtcactgtttgtggggacattcatggacaattctttgatttgatgaagctctttgaagtcgggggatctcctgccaacactcgctacctcttcttaggggactatgttgacagagggtacttcagtattgaatgtgtgctgtatttgtgggccttgaaaattctctaccccaaaacactgtttttacttcgtggaaatcatgaatgtagacatctaacagagtatttcacatttaaacaagaatgtaaaataaagtattcagaacgcgtatatgatgcctgtatggatgcctttgactgccttcccctggctgccctgatgaaccaacagttcctgtgtgtgcatggtggtttgtctccagagattaacactttagatgatatcagaaaattagaccgattcaaagaaccacctgcatatggacctatgtgtgatatcctgtggtcagaccccctggaagattttggaaatgagaagactcaggaacatttcactcacaacacagtcagggggtgttcatacttctacagttacccggctgtatgtgaattcttacagcacaataacttgttatctatactccgagcccacgaagcccaagatgcagggtaccgcatgtacaggaaaagccaaacaacaggcttcccttctctaattacaattttttcagcaccaaattacttagatgtatacaataacaaagctgcagtattgaagtatgagaacaatgttatgaatatcaggcaattcaactgttctcctcatccatactggcttccaaatttcatggatgtttttacttggtcccttccatttgttggggaaaaagtgactgagatgctggtaaatgtcctcaacatctgctcagatgatgaactagggtcagaagaagatggatttgatggtgcaacagctgcagcccggaaagaggtgataaggaacaagatccgagcaataggcaaaatggccagagtgttctcagtgctcagagaagagagtgagagtgtgctgacgctgaaaggcttgaccccaactggcatgctccccagcggagtactttctggagggaagcaaaccctgcaaagcgctactgttgaggctattgaggctgatgaagctatcaaaggattttcaccacaacataagatcactagcttcgaggaagccaagggcttagaccgaattaatgagaggatgccgcctcgcagagatgccatgccctctgacgccaaccttaactccatcaacaaggctctcacctcagagactaacggcacggacagcaatggcagtaatagcagcaatattcagtgaccacttcctgttcactttttttttttttttttttttttttttttgagctgcggggcatgatggggattgctgcatatcagcagttggatgttcttgcctctgacagtagcttatttgctctgggggccaggaattggattcagtttacactatcattaaaaaagagggagagagataataaactatattttggtggggatggtgattaaacacctcttttgggtatgccttttaaaaatgcttatagagaaaaaaaattttaaaaagaaagctaatgctagtatatactgcaatgttaggggaatgaacatgttttcctactgcattggggacttctagataggttaatgaaaggccttttattctgttactggacatgaaaactttgtctaatttcttactctattgtacgtttacagtcgcagcactaaaaatggatgacatcaaacatttttaacaaaatgatgtacaaactaaggactatttattgataatgttttgctactcttgtcagacaatggctataaactgaattaggcagtcttaaaaaaaaaaaaaaaacagaaaaagaaaaaaaagaacgttgcaaatttgttaaaatgccaaaaaggacagtttaattttgtacagattatgcttacctcaggtttctttagtgtgcttgaatgcccttctttccatataacacttatcttcttcttaattcggcaatggaatatcttttaagttttaaaaaaactggaataattatatctatcttttttgccgtttatatttaggggtttttgttgataaaatcaagtcttggttgtggcttgctgaattaaatatttatgagtggtgcatttttaagtatagtgaacaagacaccatattaagtacagtgataaagcatctatattctgta

SEQ ID NO: 330018 - DNA, 2608 bp, Homo sapiens
gcggccgcctctccgccgccggggacgccaaggtgcggctggtggcactgacatcggcggccctgcctctcctccctcgcccccggccttccccatgtgatcggtcttaatcctggccgtgtgtgcgcgcgtggggctccattccgcggtgctgggtctccgtgccggggtgggtgctcgtgtgtgcgcttctcctccccatcccccttcccccaagaataaaagaagaaccgggaggcgtgctcagaaaataaataaataaccaccacacacgcgcagcccggagcgagtcggcggggctggcggcagcggcggaggaggagtgaaggcggcggcggcggaggagggacgcgcggaaaaggcagcaactttaaagccagctcagagcctagacctccagccgagcggtttgcagcgcggcggcggcggcggcggcggcggcggcgttgagtgtctggcccgccggtccggtcggggtgtgcagtcggacggacgagcagcgcgtcgctgtcctccggcagctggagatgtccgagcccaaggcaattgatcccaagttgtcgacgaccgacagggtggtgaaagctgttccatttcctccaagtcaccggcttacagcaaaagaagtgtttgataatgatggaaaacctcgtgtggatatcttaaaggcgcatcttatgaaggagggaaggctggaagagagtgttgcattgagaataataacagagggtgcatcaattcttcgacaggaaaaaaatttgctggatattgatgcgccagtcactgtttgtggggacattcatggacaattctttgatttgatgaagctctttgaagtcgggggatctcctgccaacactcgctacctcttcttaggggactatgttgacagagggtacttcagtattgaatgtgtgctgtatttgtgggccttgaaaattctctaccccaaaacactgtttttacttcgtggaaatcatgaatgtagacatctaacagagtatttcacatttaaacaagaatgtaaaataaagtattcagaacgcgtatatgatgcctgtatggatgcctttgactgccttcccctggctgccctgatgaaccaacagttcctgtgtgtgcatggtggtttgtctccagagattaacactttagatgatatcagaaaattagaccgattcaaagaaccacctgcatatggacctatgtgtgatatcctgtggtcagaccccctggaagattttggaaatgagaagactcaggaacatttcactcacaacacagtcagggggtgttcatacttctacagttacccggctgtatgtgaattcttacagcacaataacttgttatctatactccgagcccacgaagcccaagatgcagggtaccgcatgtacaggaaaagccaaacaacaggcttcccttctctaattacaattttttcagcaccaaattacttagatgtatacaataacaaagctgcagtattgaagtatgagaacaatgttatgaatatcaggcaattcaactgttctcctcatccatactggcttccaaatttcatggatgtttttacttggtcccttccatttgttggggaaaaagtgactgagatgctggtaaatgtcctcaacatctgctcagatgatgaactagggtcagaagaagatggatttgatggtgcaacagctgcagcccggaaagaggtgataaggaacaagatccgagcaataggcaaaatggccagagtgttctcagtgctcagagaagagagtgagagtgtgctgacgctgaaaggcttgaccccaactggcatgctccccagcggagtactttctggagggaagcaaaccctgcaaagcgctatcaaaggattttcaccacaacataagatcactagcttcgaggaagccaagggcttagaccgaattaatgagaggatgccgcctcgcagagatgccatgccctctgacgccaaccttaactccatcaacaaggctctcacctcagagactaacggcacggacagcaatggcagtaatagcagcaatattcagtgaccacttcctgttcactttttttttttttttttttttttttttttgagctgcggggcatgatggggattgctgcatatcagcagttggatgttcttgcctctgacagtagcttatttgctctgggggccaggaattggattcagtttacactatcattaaaaaagagggagagagataataaactatattttggtggggatggtgattaaacacctcttttgggtatgccttttaaaaatgcttatagagaaaaaaaattttaaaaagaaagctaatgctagtatatactgcaatgttaggggaatgaacatgttttcctactgcattggggacttctagataggttaatgaaaggccttttattctgttactggacatgaaaactttgtctaatttcttactctattgtacgtttacagtcgcagcactaaaaatggatgacatcaaacatttttaacaaaatgatgtacaaactaaggactatttattgataatgttttgctactcttgtcagacaatggctataaactgaattaggcagtctt

SEQ ID NO: 330019 - DNA, 325 bp, Homo sapiens
atagtaactaacttgataaacttggttctaggttaagttaaacagggccactatgaatcatgtgcagtactcaatctgtaatctttacagggtagctgtagctgattaggtcttcaaaagtttttcatacccacagatcagggggatgtcacatctggacaccaagaaggaacttttcttgctccaggagagaaagaaaagtgttaaaagtgactgtggtacctcaaaccatgaaatattaaacagcaataaaaacctgctatttagataatggctaatcctctatggtccttgaactaaatttaattactttctatttaacttc

SEQ ID NO: 330020 - DNA, 275 bp, Homo sapiens
tgcggggaggagccacacactttaaacaaccagatcacagaggaactgtatcacaagaacagcaatagggggtggcactaaaccatcagaaaccacccggatgatccggtcacctccctccaggccccacctccagcactggggatacattcaacatgagattgggtgaggacccagattcaaaccacatcaccttccttgcctcttcctgcttctgatgactcctggtgttccttggcttgtggcctcatctctcccatgtctgcctttctttc

SEQ ID NO: 330021 - DNA, 498 bp, Homo sapiens
tgcctgcacgcttagtttacctttaaagcagggtttaaagctgactcctgatttctgcaataggctcttaaagaattgaaagtcacacctttcccaaggatgagggacctccctatacatgaacaggagaccattcaagagaattcactcaagaaaaagagatccatgtggataagtgtggtgttcccagggttccttgtatagaagtggaatgtcttaagagattgcccagctggtggtgaatatgttgcctgtttgaactccaccaggtcaatgttgaagaggtttctgttccagcaggcactagaggcttcacattgctctgaaaatgtctgaaaccgagatacactcatgctttgcccatcctgtttcctttgcctggaatggccccttcaaagctctctattaaaattcacttcatcctccaaaggcccttttcaaatgctaccttctctacccagtttttcctcatttccccagatggatctccacagaacc

SEQ ID NO: 330022 - DNA, 4490 bp, Homo sapiens
  misc_feature (1)..(2): n is a, c, g, or t
  misc_feature (631)..(631): n is a, c, g, or t
  misc_feature (951)..(951): n is a, c, g, or t
  misc_feature (1094)..(1094): n is a, c, g, or t
  misc_feature (1298)..(1298): n is a, c, g, or t
nngggcttgagctgatgatagtggcaaagaatttcattttttaaaaatgcataccacctgccctttataaaaaaatttaaaccctaatgtatttaattttataattcataaaaatttaaatattggaactaagaacagagcaaagcaaagggaaaaagcactcctttgttttcaaattgcacaaactgtccctggagattctgatagtctctcatctctcttaactatcactgtaaacaacatagaaagcataagactgcaagaagtcagttatacacaaaacaaaatgaagcacagtggaattttctctttctttatctgtatatttctgaagttggtaaagcaactatcttctctattttacagaagagaaagctgagacccaaaaagctattcatagtgatagagctagaactaaaactcagatctcctcatctcagcccagtcttctcagtagctcagactgctttctataatgaacaagaaagaataattagggatttgtattttggcacaaaacagtatcaaatttttattgtaaaaatccacaaatctgacattttatcttttattctagccaggatgtattcttcatttgcatgtgtgtgtttctcttagaaagtggtgctcncaaacctttcaaagcacagaatttattgtaccctctttatttttaccaaattgaaacgtttcaggatttcagaagcaaagtgcaatccaattgtggctggagttttcctgatagaggatccgggtggttccctcccctccaacttctggctactgccctttatttcctttgtgcaatagaattccctgaaacagattatgtcgtaattatactgatttagtcaggataatgggaaaagcgacaaatcggatttatgtattaggtattatggagctttctttagcactctcctccaagtttaatctctgacatgtgtgatntagtaactttctgtctctgagaagcagtttggacccagctgaaaaattttatttatggagacttgtaatcagcctgatatacagagaacactctggactggaaatatagtcaggtaccaaggtctgctaatttggccattgcnagtgattcaaaaccacctccccaccctgagtaaaagatttgatatgaatatgaatgctatgagtctcctggtgatgttttgggtgtatatgttcctgtgtgtgtttggaaatcatagagggtatttaccttgagggctcttttgttgaccttatttatttgaaattcttattttatttgtaatggcatatgtatatttttgtgntgctacatgcaatctctgtgtatactttttgtatatatgtatacatatttgtaaatatattggtatgcagtgatacagtatgtgtatattatgtacccatacccattgtgggctgaatttatttaagttctgtgaggacatcctagtggcattgttcatgctgctgtaattaggttgtggctgtatctcattcataagcctctattttgagaggcttgtgtttggataaaatgggctaatttggagttgaaattaggatatgaagatcttaacagaaagctagatatttattcttagctttaaaatcacctgcaaatttttatttaaactgatgataaattagtgatataacctgaaaaacctaagtatgtgaaactgagacaccagcagattcttaggctgtagtagtcctttattttcttgatccatatttaagtattattactgagtagtaaattatgtatattggggcttaatagagaggctgtggaaaaaaattgctttaatcacatttaaaaacataggaaaatgtccattaaataggggaaatatattcccagttgtcatttttatgcctcatactgaattttgattttggaacaattcttttttcatcagtgttttatgtgtctctatgaggcagaaaagggggcattagctaagggatggcctaacctaagtaggataggatttagtgaggaacgggaggttgttaatttgtatatttgcagcagctatgattaatttagtcctgtcttggcatttccggctacagattttttcttactggacttgcatatcaaaggtgagtaggctcatctgagaaaatgcttccactgaataaaatgccttcactcgtattgctgtgtctctatgagaccacttgtgttctgcaagttgatgatatattcgcacatgaagtagagtttttaatattagatgcatggtgtgctataaaaatctgggccttcaaacctctcccaaggatgatagggttggggaggataagaggatagtaaatacgtgcaatgccaatttgtgaacctatagaatgttgccaagtatcaatgtttggttacttcagttgacatatttatttgcatgaaagagtgtaggagatgtttaatatacacttaaatacattcactgcagaaattaagtagaggttatttttgcatgataaaatataactgcaaagcaactttttacaccgtattctttggaagattaaatctatctgatccaatattatcttaaaatagagaaattatctcaggagtctgttttaccacccaaaaaaatgttacatttgctgattcattatattttaaataaaacagccaactattcataagacttttcaattatagtattaaattcagaaataattataacagcatttttcttgaataaatattaaaatttggtaatttattatttctgaaaaatcagtgaaaacatccataggatctgatggtttgttgtttgaataaccaaatcattgtttttgcactggagagtagtagagcagatattataccatttaaaattcatggaactgactcaggctccttgtggatattaatttgaggacagtagtggtaatcaaaagtacagtagaaaacacttgacattgtgaatgtgacctctgaccccaaccgttgtaaagccaataactttgagggtgaataaggtaacacttgcttagaaaacccagccctttcccccagtctcctgcgctcttatacattgatactttacaactatttttgctgtacctctcagtctttcctggataatgggaccacttaaaaaaaaaagtgattcatcttcctcaaactagaatttcaaagcctaatactacactatgttccagcttcactgagttttgaacaaaaagacttaagcatgccttgtgtttaaggaaaaataattgatgtgtgaatggaatcaatcacctattgacgggaagggtgtcaggatgatgtagggtgatatgcctttaattggataaagagaactgtattaagtataactaatttaataactgattgaagcaccattcttaattttaaaatatttttgttaatttcttttgtggttttaaaaattaataatttttttttttttgagatggagttttgctcgttgcccaggctggaatgcaatggcgcgatctcagctcactgcaacctccgcctcctgggttcaagagattctcctgcctcagcctcccaagtagctgggattacaggcgtgtgccaccacgaccagctaattttgtatttttagtagagatggggtttcaccatgttggccaggttggtctcgaactcctgacctcaagtgatccacccgcctcggcctcccaaagtgctgggattacaggtgtgagccactgtggccggcctaaaaaaaattctttttaatagttatcagactactttaaccagtgccatgtttaaacatacttggacaatagactcagtttttttaatagtttgaagtacattatattaaaactacaaactcacttattcaagcctaaatttcatcatagactataaattgggtatcaatttcctattttggtggacaattccagtctgtctactacgacaatcatctttttaggtgtaatattgtttaagacataggtaattttaggttttatacttttctcctaggcttatggaatgaaagctaataggatatcactttcagaatgaaatagggaattatggctagccttcttatagggctgccgtaaatgatacttaaatgtttgttatatcactgattttcttttctcttctgaagctgttgtgaatgtccactttgccatgattaaaagttgagatttgtaaacattacaatttgaaccataaattttctcaaacatgaaatcagtatgaataagtataaaatttgaaatgatcatacatgagaatcccaaaagtaaatacttccaaaccatagagggataaccactgtatttttaaaaagcttatttccacccttaaagaagcatgctactaattgctttttttctaaattaaaactatgtactgtggtaaattaaaaatctgcaggaaaaattgcttagtgttttagcacaataagaatttttattactcaggagttggagaccagtctgggcaatacagtgaaaccctgtcgctactaaaatac

SEQ ID NO: 330023 - DNA, 580 bp, Homo sapiens
  misc_feature (10)..(10): n is a, c, g, or t
ctagccggtncctctctccacattgtgttctaaattgcttaagccatacgttctcttaaacaggatgtttttttcttcctttccagcagcctttttcttctttgtctgttatggttaatactccatagattttagaaattgagaagttcttgaaacattttattttcttgagttcatcacttttgactcttgtatgagatgtgatttgtcataaaagatagccttccactacttcactaaatgaatttcagagtaaacactgtgattctgcagagcggattcagtaggctttccaatgttttctcctgctatacagtgcctaccaccttgagggcacttcagtactagaggatgaaaactgaaacgttgttttgatgtttattgaataacgagattagagaatatttgatttttgttgtcagtgtattaaagaaattttcacattgataaatgttctctaggaatgtgtctacattcatcaggtgtgaactcttgtacatgaattttgtaccttgaatccacatatatattaagtgtatcatcaatataaaaataaacattatttgcttaaaaaaattgg

SEQ ID NO: 330024 - DNA, 6381 bp, Homo sapiens
  misc_feature (1)..(2): n is a, c, g, or t
  misc_feature (631)..(631): n is a, c, g, or t
  misc_feature (951)..(951): n is a, c, g, or t
  misc_feature (1094)..(1094): n is a, c, g, or t
  misc_feature (1298)..(1298): n is a, c, g, or t
nngggcttgagctgatgatagtggcaaagaatttcattttttaaaaatgcataccacctgccctttataaaaaaatttaaaccctaatgtatttaattttataattcataaaaatttaaatattggaactaagaacagagcaaagcaaagggaaaaagcactcctttgttttcaaattgcacaaactgtccctggagattctgatagtctctcatctctcttaactatcactgtaaacaacatagaaagcataagactgcaagaagtcagttatacacaaaacaaaatgaagcacagtggaattttctctttctttatctgtatatttctgaagttggtaaagcaactatcttctctattttacagaagagaaagctgagacccaaaaagctattcatagtgatagagctagaactaaaactcagatctcctcatctcagcccagtcttctcagtagctcagactgctttctataatgaacaagaaagaataattagggatttgtattttggcacaaaacagtatcaaatttttattgtaaaaatccacaaatctgacattttatcttttattctagccaggatgtattcttcatttgcatgtgtgtgtttctcttagaaagtggtgctcncaaacctttcaaagcacagaatttattgtaccctctttatttttaccaaattgaaacgtttcaggatttcagaagcaaagtgcaatccaattgtggctggagttttcctgatagaggatccgggtggttccctcccctccaacttctggctactgccctttatttcctttgtgcaatagaattccctgaaacagattatgtcgtaattatactgatttagtcaggataatgggaaaagcgacaaatcggatttatgtattaggtattatggagctttctttagcactctcctccaagtttaatctctgacatgtgtgatntagtaactttctgtctctgagaagcagtttggacccagctgaaaaattttatttatggagacttgtaatcagcctgatatacagagaacactctggactggaaatatagtcaggtaccaaggtctgctaatttggccattgcnagtgattcaaaaccacctccccaccctgagtaaaagatttgatatgaatatgaatgctatgagtctcctggtgatgttttgggtgtatatgttcctgtgtgtgtttggaaatcatagagggtatttaccttgagggctcttttgttgaccttatttatttgaaattcttattttatttgtaatggcatatgtatatttttgtgntgctacatgcaatctctgtgtatactttttgtatatatgtatacatatttgtaaatatattggtatgcagtgatacagtatgtgtatattatgtacccatacccattgtgggctgaatttatttaagttctgtgaggacatcctagtggcattgttcatgctgctgtaattaggttgtggctgtatctcattcataagcctctattttgagaggcttgtgtttggataaaatgggctaatttggagttgaaattaggatatgaagatcttaacagaaagctagatatttattcttagctttaaaatcacctgcaaatttttatttaaactgatgataaattagtgatataacctgaaaaacctaagtatgtgaaactgagacaccagcagattcttaggctgtagtagtcctttattttcttgatccatatttaagtattattactgagtagtaaattatgtatattggggcttaatagagaggctgtggaaaaaaattgctttaatcacatttaaaaacataggaaaatgtccattaaataggggaaatatattcccagttgtcatttttatgcctcatactgaattttgattttggaacaattcttttttcatcagtgttttatgtgtctctatgaggcagaaaagggggcattagctaagggatggcctaacctaagtaggataggatttagtgaggaacgggaggttgttaatttgtatatttgcagcagctatgattaatttagtcctgtcttggcatttccggctacagattttttcttactggacttgcatatcaaaggtgagtaggctcatctgagaaaatgcttccactgaataaaatgccttcactcgtattgctgtgtctctatgagaccacttgtgttctgcaagttgatgatatattcgcacatgaagtagagtttttaatattagatgcatggtgtgctataaaaatctgggccttcaaacctctcccaaggatgatagggttggggaggataagaggatagtaaatacgtgcaatgccaatttgtgaacctatagaatgttgccaagtatcaatgtttggttacttcagttgacatatttatttgcatgaaagagtgtaggagatgtttaatatacacttaaatacattcactgcagaaattaagtagaggttatttttgcatgataaaatataactgcaaagcaactttttacaccgtattctttggaagattaaatctatctgatccaatattatcttaaaatagagaaattatctcaggagtctgttttaccacccaaaaaaatgttacatttgctgattcattatattttaaataaaacagccaactattcataagacttttcaattatagtattaaattcagaaataattataacagcatttttcttgaataaatattaaaatttggtaatttattatttctgaaaaatcagtgaaaacatccataggatctgatggtttgttgtttgaataaccaaatcattgtttttgcactggagagtagtagagcagatattataccatttaaaattcatggaactgactcaggctccttgtggatattaatttgaggacagtagtggtaatcaaaagtacagtagaaaacacttgacattgtgaatgtgacctctgaccccaaccgttgtaaagccaataactttgagggtgaataaggtaacacttgcttagaaaacccagccctttcccccagtctcctgcgctcttatacattgatactttacaactatttttgctgtacctctcagtctttcctggataatgggaccacttaaaaaaaaaagtgattcatcttcctcaaactagaatttcaaagcctaatactacactatgttccagcttcactgagttttgaacaaaaagacttaagcatgccttgtgtttaaggaaaaataattgatgtgtgaatggaatcaatcacctattgacgggaagggtgtcaggatgatgtagggtgatatgcctttaattggataaagagaactgtattaagtataactaatttaataactgattgaagcaccattcttaattttaaaatatttttgttaatttcttttgtggttttaaaaattaataatttttttttttttgagatggagttttgctcgttgcccaggctggaatgcaatggcgcgatctcagctcactgcaacctccgcctcctgggttcaagagattctcctgcctcagcctcccaagtagctgggattacaggcgtgtgccaccacgaccagctaattttgtatttttagtagagatggggtttcaccatgttggccaggttggtctcgaactcctgacctcaagtgatccacccgcctcggcctcccaaagtgctgggattacaggtgtgagccactgtggccggcctaaaaaaaattctttttaatagttatcagactactttaaccagtgccatgtttaaacatacttggacaatagactcagtttttttaatagtttgaagtacattatattaaaactacaaactcacttattcaagcctaaatttcatcatagactataaattgggtatcaatttcctattttggtggacaattccagtctgtctactacgacaatcatctttttaggtgtaatattgtttaagacataggtaattttaggttttatacttttctcctaggcttatggaatgaaagctaataggatatcactttcagaatgaaatagggaattatggctagccttcttatagggctgccgtaaatgatacttaaatgtttgttatatcactgattttcttttctcttctgaagctgttgtgaatgtccactttgccatgattaaaagttgagatttgtaaacattacaatttgaaccataaattttctcaaacatgaaatcagtatgaataagtataaaatttgaaatgatcatacatgagaatcccaaaagtaaatacttccaaaccatagagggataaccactgtatttttaaaaagcttatttccacccttaaagaagcatgctactaattgctttttttctaaattaaaactatgtactgtggtaaattaaaaatctgcaggaaaaattgcttagtgttttagcacaataagaatttttattactcaggagttggagaccagtctgggcaatacagtgaaaccctgtcgctactaaaatacaaaaaaaaaaaaaaaaaaaaaaaaattagccaggcatggtggtgtgcgcctgtaatcccagctacttgggaggctgaggcaggagaactgcttgtaacctgggaggcggaggttgcagtgagccgagatcgtgccattgcactccagtctgggtgacagagcaagactcattctcaaaaaaaaaaaaaaaaggaatttttattactatttcctgaagaatggtttttgttaacttgttactgtatcattaaaaagaccttctaatggttcagtacaataatctagaacttgatttatgtggctttttatagttatctgaatgcattccttttgccacatagaccatatggctagttctccaacttttttgcttatttttaataaaccttgctgttcaacaatcagagaaacctttaattttggatgattcttccagttgaggtagaaacatcttagataataggaaaggcaaatacaaagtcctaacattttcatagtagagtttacaagtaaaataacttatccatataggttatcttcgttgtgtagcaccagtataaatagtgatttcattaatcattgaatcagatgaagcagttataaatcactttttactttgtgctaagaattattgtaatttcaggacactttattatttcctctgagcagtttccattggaaggttgagtttcccttttttaagttctaatcatcactaaaggttaagataatcaaataggagttaaaataagttatgtttgatctttttcccttgaaaataatgctgaacttattgtctacattctgattattaggcagaaatgcacttgtttaaatcatagaagtaattcatttggaggatataattactcgattttctagtggtgtgaaatactttttaacaattgtgcttgtctgtaactgaaatgttatagaattttaacactatagggattatagagttatattagctctcctcaagagactgaagcacaatatttttcatgtaacaattcttatccaagtgctgctaatctgtcgtgcaaataatgaagctatttggttgcctatttagctattcacaaatcactgtaatctttgaaacaatcttgtcgttcatttgtattaatatttggatattgtgagttaatactttagaaaaaaatccatcaactcagccccgttagcaaaactgtttggattcatagtttttatatgtgttaacagtagaataaattttgaaggggctatttactaccaatgactaaggggaaaattatactgtcactatcatttgacttgaacatttgtggtattgtaaaagtcttgtcagttgtgttctaaattgcttaagccatacgttctcttaaacaggatgtttttttcttcctttccagcagcctttttcttctttgtctgttatggttaatactccatagattttagaaattgagaagttcttgaaacattttattttcttgagttcatcacttttgactcttgtatgagatgtgatttgtcataaaagatagccttccactacttcactaaatgaatttcagagtaaacactgtgattctgcagagcggattcagtaggctttccaatgttttctcctgctatacagtgcctaccaccttgagggcacttcagtactagaggatgaaaactgaaacgttgttttgatgtttattgaataacgagattagagaatatttgatttttgttgtcagtgtattaaagaaattttcacattgataaatgttctctaggaatgtgtctacattcatcaggtgtgaactcttgtacatgaattttgtaccttgaatccacatatatattaagtgtatcatcaatataaaaataaacattatttgcttaaaaaaattgg

SEQ ID NO: 330025 - DNA, 201 bp, Homo sapiens
attttctttttattgttagctttagacatagctgcttgctgtgcagttatacattagctatatgacctccagggcttttcttcctgtttttgtatatctcaagtcactctctattttaagtagcctgtgtgtgtgtgtgtgtgtgtgtgtatctgaatgaaataattgctagctataggcaaaaatgtatgtgtacacaag

SEQ ID NO: 330026 - DNA, 3306 bp, Homo sapiens
agcggacgcgcagcaccccatttaagtttctcgtctttgcagtggctttgcttagatccggtgccgccttgaaggcggggctgggtcccagccgtatccaatggagccccgggtgagggttgaggggtggaaggtgcctactagccggtgcaggtttcttctagcgcgtgtgctggggtacctggtcgtcatggaggcggtattgaccgaagagcttgatgaggaagagcagctgctgagaaggcatcgcaaagagaagaaggagttgcaagccaaaattcagggcatgaagaatgctgttcccaagaatgacaagaagaggaggaagcagctcaccgaagatgtggccaagttggaaaaagaaatggaacagaaacatagagaggaactggagcaattgaagctgactactaaggagaataagatagattctgttgctgttaacatttcaaacttggtgcttgagaatcagccacctcggatatcaaaagcacaaaagagacgggaaaagaaagctgcattggaaaaggagcgagaagaacggatagctgaagctgaaattgaaaacttaacaggagccagacatatggaaagtgagaaacttgctcaaatattggcagctagacagttagaaattaaacagattccatctgatggccactgtatgtataaagccattgaagatcaactgaaagaaaaggattgtgctctgactgtggttgccttgagaagtcagaccgctgagtatatgcaaagccatgtggaagactttctgccatttttaacaaaccctaatacaggagatatgtatactccagaagaatttcagaagtactgtgaagatattgtaaacacagctgcatggggaggtcagcttgagctaagagctctgtctcacattttacaaacaccaatagagataatacaggcagattctcctcccattatagttggtgaagaatattcaaaaaaaccactaatacttgtatatatgagacatgcatatggcttaggagaacattataattcggttacacggttggtaaacatagttactgaaaattgcagctaatttatacaatgttgtacaattatgttttaatacagtgtgctgaactgagtatttctaccaagtgttgggttgttctaaatgctactgaaaaacacaactaccttatatcagttttatggcaaagctactaacaggtgtttttagaaatatgtcagagataaactttaaccagtgtcttcttagtggaattttaaaaatttgttaagttcattgtagagaacaccattcatagaccaagatggtcccctattagctgatattttcatttatgtaagatcctggacattctgttttgtgttggaacaaattttcaatgtttttaattctcccttttctgcctgttcctaaaaactttcaaaataaccatttcaatgtaatttgtcttgaagaagtttacccaatatctttgtcattgcaataatgtagtatggtgatggtcaatttaattattgcttataaaatgaacttgattgcagtaaccatggtatcgatgagactaatgcagtgaagctttattactaatatatatagccttatcaaagcaagctaagaagcttgctttaataattaataatttaaaaatatttatttagatgggattcagttgtttaaagaagtgagataaattcaaaggtaaataggtattctctgtcaaatttaaatctctaaagaattagagattagttttttatttgtgtataatttaaaaaagacctaataggttactgtctttttaatgcatttgttattctttcgtattttttaagcatcggactggagttagtaccatcatctcttgagtctttcataactacacatttttatatttccttttgtgttttctactttgctttccttgaaggaacaagcattttgtggcctttaccttgtgcaattttagggagtagcagtgtaaaaggtccaagaccacatttacttgaaattcttcctcttttctgatttgtcttaccagatatttcccttcttgcctcattctctaggatttgaataaaacctttgccacttattttattagccttattaatgtcacctttccttcaactcaaatatttgagaaattttatgttacatatatgaatgaagttgaaagctactgtttggaagctaagacttgtatagagtagttttgtatatgaatggttgttctagctcagatttcaggttactcacaacagtattctttctaagaggatatatacaaatgtctctcataatttatgtaaggaaatattatgaaaatgagacttttttagtttgatgtgtgtttcccaaactagagataaaactagtaagatttagtatcgtttataacatttgaatttttgctccatgagtacaactaatttttataagtaaatattgggtttatatgaaaaatggggtgtcagtcttttcacacgcccagcaggtaacaatgtgggaagctggcagggtcattgatagcaagtaagtacttcctgaaggctttccagttcaaaagattacaagccattctgcctgccaaacaaattatattctgaagatgcctgttttgtaacccttgatgtgaattttttggtgtctgaaatttacaaaagaatgaaattgaaattgtaaaacactaaatgctttgggtttattttgaagtaatctgttactttaaaatgtcaacattaggaagccataaaacaagatattatgaaacccagtattataaatgttatctacatctaaagtattttaaaataacttattggcagctttattctttttttccttacaagatttagaatctttttggttatatgtctatttttcaattttgttatatttttaatttaagtggccaatgtggttatgaacaagatttgtatggtcagcttctgttctttcctaaaacttcagataaatatcattttagctataacctaaaaaagtgtttaaataaaatgacagatgttaatttaaaagcagcatatgctaatttactttttcatatgatgatggtctaatggaagttacatatgctttcttttgtcctaactctgaaaagtatatgtcagagttctggaatatgtctttagccaagaattttattcacttaaatttgtttacaacttgtataaagcaaaaaagaatgtgtgtaactatagtgaacgcatagttttgcttatattatgtgatgtttgccaaaaaaagaataaaaaatgaatgaattaaatcaaaaaaaaaat

SEQ ID NO: 330027 - DNA, 3233 bp, Homo sapiens
agcggacgcgcagcaccccatttaagtttctcgtctttgcagtggctttgcttagatccggtgccgccttgaaggcggggctgggtcccagccgtatccaatggagccccgggtgagggttgaggggtggaaggtgcctactagccggtgcaggtttcttctagcgcgtgtgctggggtacctggtcgtcatggaggcggtattgaccgaagagcttgatgaggaagagcagctgctgagaaggcatcgcaaagagaagaaggagttgcaagccaaaattcagggcatgaagaatgctgttcccaagaatgacaagaagaggaggaagcagctcaccgaagatgtggccaagttggaaaaagaaatggaacagaaacatagagaggaactggagcaattgaagctgactactaaggagaataagatagattctgttgctgttaacatttcaaacttggtgcttgagaatcagccacctcggatatcaaaagcacaaaagagacgggaaaagaaagctgcattggaaaaggagcgagaagaacggatagctgaagctgaaattgaaaacttaacaggagccagacatatggaaagtgagaaacttgctcaaatattggcagctagacagttagaaattaaacagattccatctgatggccactgtatgtataaagccattgaagatcaactgaaagaaaaggattgtgctctgactgtggttgccttgagaagtcagaccgctgagtatatgcaaagccatgtggaagactttctgccatttttaacaaaccctaatacaggagatatgtatactccagaagaatttcagaagtactgtgaagatattgtaaacacagctgcatggggaggtcagcttgagctaagagctctgtctcacattttacaaacaccaatagagataatacaggcagattctcctcccattatagttggtgaagaatattcaaaaaaaccactaatacttgtatatatgagacatgcatatggcttaggagaacattataattcggttacacggttggtaaacatagttactgaaaattgcagctaatttatacaatgttgtacaattatgttttaatacagtgtgctgaactgagtatttctaccaagtgttgggttgttctaaatgctactgaaaaacacaactaccttatatcagttttatggcaaagctactaacaggtgtttttagaaatatgtcagagataaactttaaccagtgtcttcttagtggaattttaaaaatttgttaagttcattgtagagaacaccattcatagaccaagatggtcccctattagctgatattttcatttatgtaagatcctggacattctgttttgtgttggaacaaattttcaatgtttttaattctcccttttctgcctgttcctaaaaactttcaaaataaccatttcaatgtaatttgtcttgaagaagtttacccaatatctttgtcattgcaataatgtagtatggtgatggtcaatttaattattgcttataaaatgaacttgattgcagtaaccatggtatcgatgagactaatgcagtgaagctttattactaatatatatagccttatcaaagcaagctaagaagcttgctttaataattaataatttaaaaatatttatttagatgggattcagttgtttaaagaagtgagataaattcaaaggtaaataggtattctctgtcaaatttaaatctctaaagaattagagattagttttttatttgtgtataatttaaaaaagacctaataggttactgtctttttaatgcatttgttattctttcgtattttttaagcatcggactggagttagtaccatcatctcttgagtctttcataactacacatttttatatttccttttgtgttttctactttgctttccttgaaggaacaagcattttgtggcctttaccttgtgcaattttagggagtagcagtgtaaaaggtccaagaccacatttacttgaaattcttcctcttttctgatttgtcttaccagatatttcccttcttgcctcattctctaggatttgaataaaacctttgccacttattttattagccttattaatgtcacctttccttcaactcaaatatttgagaaattttatgttacatatatgaatgaagttgaaagctactgtttggaagctaagacttgtatagagtagttttgtatatgaatggttgttctagctcagatttcaggttactcacaacagtattctttctaagaggatatatacaaatgtctctcataatttatgtaaggaaatattatgaaaatgagacttttttagtttgatgtgtgtttcccaaactagagataaaactagtaagatttagtatcgtttataacatttgaatttttgctccatgagtacaactaatttttataagtaaatattgggtttatatgaaaaatggggtgtcagtcttttcacacgcccagcaggtaacaatgtgggaagctggcagggtcattgatagcaagtaagtacttcctgaaggctttccagttcaaaagattacaagccattctgcctgccaaacaaattatattctgaagatgcctgttttgtaacccttgatgtgaattttttggtgtctgaaatttacaaaagaatgaaattgaaattgtaaaacactaaatgctttgggtttattttgaagtaatctgttactttaaaatgtcaacattaggaagccataaaacaagatattatgaaacccagtattataaatgttatctacatctaaagtattttaaaataacttattggcagctttattctttttttccttacaagatttagaatctttttggttatatgtctatttttcaattttgttatatttttaatttaagtggccaatgtggttatgaacaagatttgtatggtcagcttctgttctttcctaaaacttcagataaatatcatttactttaccttaaaagggttaataaatgccgatgtactaaaacactaacgtactacttttatttaagaggctaaggagtccaaggctccttggcaacttgaaggttttgaaatttgaattgtttgcagaattttcctaaattgtacactgttaacaaagaatgggaccttagacctaattgcttatttgaggttcaaaaaattaacggtggttactaaaaaagaaacggtccactatcctacca

SEQ ID NO: 330028 - DNA, 2761 bp, Homo sapiens
  misc_feature (2098)..(2098): n is a, c, g, or t
cgccggcgcgtagtcggggacgccgggccgaggctttgctagggaacactgttatcgccccgccccctcggagctttttctccagttaactgtcggagtagcgggggctccggcgccgggcgacatgccggtgcgcttcaaggggctgagtgaataccagaggaacttcctgtggaaaaagtcttatttgtcagagtcttgtaattcctccgtggggcgaaagtacccatgggctggacttagatcagatcaattaggaaatcaaggcagatgtagaaccaagatccagcacagtgacatctcatcccttctcatcttggtctgctccacataagagaagctttgtgaaaagttccaaattttgacagtaccagggcccattgttctgttaagtagcacaggaaagtaattagaaacgaggcagcatgtactgcctggcctgccaggtctatcacgttgcaattctagtgacttttgttaggataactggaacattttgtgaccccctgatttttaattttttgttatggtcaaatttttaatgcttttaaaagcaaaattaaatattttatgttgaaaagctgtacttttaaaatcctataatctgaaggatattgtgtgtatatataggtacatatatctgaactaaatttaaaatttcatttctcctccacaagtgttcttaaaagttgtctttgtaactttttgctttagtagctactatttttgtataccgtgttttgtaggcatcacgaaagagccaagttttatttcaaaaagaagagtcccttaccatgacccacagatttcaaaatctctggagtggaatggagctatctcagagagcaatgtggttgcatcaccagaaccagaagccccggaaacaccaaaatcacaagaagcagaacaaaaggatgttattcaagaaagagttcactcactagaagcttccagggttcccaaaagaaccagatctcactctgcagactccagagctgaaggggcttcagatgtggaaaataatgagggtgtaacaaaccatacaccagttaatgaaaatgtggaactggaacattctaccaaggttctttcagaaaatgtagataatggggtaggcatattcactgcatttcttttcaaaagcatagaattcttcattggtttcattgtcatttctgtaatattacattttgtgtttcagaattttccattgttgttttcttgtctaatgtctataagaatagttgataacaggctgttgactttagttattgtgaattagttctattctgactactcgctattttgtagtagttgtactatgataatctgtttattggatggacctcctgcgtctggattttattcatcatatattagcacctgagtcctaagggagagatcaagttgagacagagaagggaagtaggcccttacttctggcagggtgctgagctgacttctacctagccccttttcagtttcttatcgtgtacaagaagacaaacagaaattcaattgatgaaatgcaaaaggaaggagagctctggctgtctctcagagatcttgcatttctgctctcttatgtcacagctggcctgcagcaggtccctgtgagcacataagcagaggctgcaggaacttgtgtggggatctcaatgctttccacatttctttctccattctgttccactgctcttctctggttcatgtccaccactgactgggaccctgaagaggcatttcagagtgttggagaagaatctgtagcttgttgaaaaagctgggggtgaaagggaacaaggaaggtgatgtgtgagtctggcaggcaggagaaggggtgttcatagaagcagtgtgcaggtgaggcaaagtgctgggactttttggtaatagatttaattatgaatgattagtaggaaaggactgagagtattatatttttcctgggatgcctaatagtcctttgatagaaaggaattttaaatagtttgacacttgaaaaaagatactatttataagttgaagaaagtttgctgtaccacaatgcgcatgtagttaacaattttgcactgtagatttaacattttgttaagangatagatttcatgttatgcattttttaccacaatttttaaaaagtttgaatagaaatttttaatgtctttgagtggattttgttttttgaacagttggatagacttctgcgtaagaaagctggattgactgttgttccttcatataatgccttgagaaattctgaatatcaaaggcagtttgtttggaagacttctaaagaaactgctccagcttttgcagccaatcaggtagcttaatggatgtaatacatttctgagtaccattatcttatctagtaatgtagatttacatagaattaagagttgaaagaaattaagtacttaagtagcctggaggtaggttctagaaaaccaaaatgagagttttgctaaaatcatcctattacttatgatttatggtagtaatattatactgtcctaggcttctgatgatcattgttgccagatgcagcacatatactaaatatgagacagggtaatgaaaacttggggaactggtaagtttttgcatgctacaagatttttttacttattaaaaaattattaaattgattttattctaaaatgttgtgttttgttgactaatatattgcgtgtttcctgtattctaagaaaggcgtaactgctttgaatatttaataaatacaaaatatgttgacagt

SEQ ID NO: 330029 - DNA, 889 bp, Homo sapiens
atatattcaagatttcgcccattggaaagcaggatgccattccagttcctccacatgagccttattataagataaggcaaatgtttaaatgaggacagattgtctgagatttctgctcgctctgcagcttctagtctccgggcttttcaaactctggcacgagctaagaaaaggaaggagaatttctggggtaaaacataaacctagctgagttgcctttatctaaggaaacattggcataatttttctttattgcttactgtgttaaaattttttgagtgaagtttttcctaacattttctactttgaaatatttaatttccaatagaacagtttacttggaaattgttaacataggcttatacaaatttaacttttaaagaattctttttacatctatcccagagtacaaagacctagattattgaattcttcacatgtaactttcgtaataggtgtcatggatagattttcacctatccagagagtattctaaaaaaataaacaaagtgaagtaaaagttaagatcccagtgtgaagtatatattcccctaagatttgatatatgtatctttataattgatgatgttgtaaaatgaatttgttgttcctttaacctttgctgtagtgtttctttttattttagttccttctatacatgtttgcagtgttaagataattgtactttgaaaacaccagctgtatatatttttcttatttatgtaacaaagtttgctgaaagatatgtatatttttgatctttgagtgtattctatttgtgtaaggactttggcttacatttgaataatgtctagattttgaaaaattacctgtataatggagaattaaaactttgtagacattttgaaataaaaatggatcaagtgcg

SEQ ID NO: 330030 - DNA, 909 bp, Homo sapiens
  misc_feature (1)..(1): n is a, c, g, or t
  misc_feature (26)..(26): n is a, c, g, or t
  misc_feature (55)..(55): n is a, c, g, or t
  misc_feature (81)..(81): n is a, c, g, or t
  misc_feature (85)..(85): n is a, c, g, or t
  misc_feature (103)..(103): n is a, c, g, or t
ncaccctttcgcggattttgggtttntaaggatccaaagttcagcccattttggnaaagccaggatgaccaatttccagtncctnaacatgagccttttaatnataagatgaggacagattgtctgagatttctgctcgctctgcagcttctagtctccgggcttttcaaactctggcacgagctaagaaaaggaaggagaatttctggggtaaaacataaacctagctgagttgcctttatctaaggaaacattggcataatttttctttattgcttactgtgttaaaattttttgagtgaagtttttcctaacattttctactttgaaatatttaatttccaatagaacagtttacttggaaattgttaacataggcttatacaaatttaacttttaaagaattctttttacatctatcccagagtacaaagacctagattattgaattcttcacatgtaactttcgtaataggtgtcatggatagattttcacctatccagagagtattctaaaaaaataaacaaagtgaagtaaaagttaagatcccagtgtgaagtatatattcccctaagatttgatatatgtatctttataattgatgatgttgtaaaatgaatttgttgttcctttaacctttgctgtagtgtttctttttattttagttccttctatacatgtttgcagtgttaagataattgtactttgaaaacaccagctgtatatatttttcttatttatgtaacaaagtttgctgaaagatatgtatatttttgatctttgagtgtattctatttgtgtaaggactttggcttacatttgaataatgtctagattttgaaaaattacctgtataatggagaattaaaactttgtagacattttgaaataaaaatggatcaagtgcg

SEQ ID NO: 330031 - DNA, 897 bp, Homo sapiens
  misc_feature (2)..(2): n is a, c, g, or t
  misc_feature (11)..(11): n is a, c, g, or t
  misc_feature (19)..(19): n is a, c, g, or t
  misc_feature (22)..(22): n is a, c, g, or t
  misc_feature (24)..(25): n is a, c, g, or t
  misc_feature (41)..(41): n is a, c, g, or t
  misc_feature (57)..(57): n is a, c, g, or t
  misc_feature (86)..(86): n is a, c, g, or t
cnagggctttntaactccnagntnncgcccaattggaaaancaaggatgaccatttncggtccctcaccagaagcctttaataatnaaataaggcaatgaggacagattgtctgagatttctgctcgctctgcagcttctagtctccgggcttttcaaactctggcacgagctaagaaaaggaaggagaatttctggggtaaaacataaacctagctgagttgcctttatctaaggaaacattggcataatttttctttattgcttactgtgttaaaattttttgagtgaagtttttcctaacattttctactttgaaatatttaatttccaatagaacagtttacttggaaattgttaacataggcttatacaaatttaacttttaaagaattctttttacatctatcccagagtacaaagacctagattattgaattcttcacatgtaactttcgtaataggtgtcatggatagattttcacctatccagagagtattctaaaaaaataaacaaagtgaagtaaaagttaagatcccagtgtgaagtatatattcccctaagatttgatatatgtatctttataattgatgatgttgtaaaatgaatttgttgttcctttaacctttgctgtagtgtttctttttattttagttccttctatacatgtttgcagtgttaagataattgtactttgaaaacaccagctgtatatatttttcttatttatgtaacaaagtttgctgaaagatatgtatatttttgatctttgagtgtattctatttgtgtaaggactttggcttacatttgaataatgtctagattttgaaaaattacctgtataatggagaattaaaactttgtagacattttgaaataaaaatggatcaagtgcg

SEQ ID NO: 330032 - DNA, 920 bp, Homo sapiens
aaacccaaaaatcccgggcagttgctttccccccaaggtccatctaatggctccttctgaggaattaggggttttttagagttcaagagttcagcccattttaaggccaaatgttctaaatgaggacagattgtctgagatttctgctcgctctgcagcttctagtctccgggcttttcaaactctggcacgagctaagaaaaggaaggagaatttctggggtaaaacataaacctagctgagttgcctttatctaaggaaacattggcataatttttctttattgcttactgtgttaaaattttttgagtgaagtttttcctaacattttctactttgaaatatttaatttccaatagaacagtttacttggaaattgttaacataggcttatacaaatttaacttttaaagaattctttttacatctatcccagagtacaaagacctagattattgaattcttcacatgtaactttcgtaataggtgtcatggatagattttcacctatccagagagtattctaaaaaaataaacaaagtgaagtaaaagttaagatcccagtgtgaagtatatattcccctaagatttgatatatgtatctttataattgatgatgttgtaaaatgaatttgttgttcctttaacctttgctgtagtgtttctttttattttagttccttctatacatgtttgcagtgttaagataattgtactttgaaaacaccagctgtatatatttttcttatttatgtaacaaagtttgctgaaagatatgtatatttttgatctttgagtgtattctatttgtgtaaggactttggcttacatttgaataatgtctagattttgaaaaattacctgtataatggagaattaaaactttgtagacattttgaaataaaaatggatcaagtgcg

SEQ ID NO: 330033 - DNA, 891 bp, Homo sapiens
aggcctttccccaaatattctactgggcatccctggggaactacggctctgaaagaaccaaagtgcagcctatcaagggccactcttaacatgaggacagattgtctgagatttctgctcgctctgcagcttctagtctccgggcttttcaaactctggcacgagctaagaaaaggaaggagaatttctggggtaaaacataaacctagctgagttgcctttatctaaggaaacattggcataatttttctttattgcttactgtgttaaaattttttgagtgaagtttttcctaacattttctactttgaaatatttaatttccaatagaacagtttacttggaaattgttaacataggcttatacaaatttaacttttaaagaattctttttacatctatcccagagtacaaagacctagattattgaattcttcacatgtaactttcgtaataggtgtcatggatagattttcacctatccagagagtattctaaaaaaataaacaaagtgaagtaaaagttaagatcccagtgtgaagtatatattcccctaagatttgatatatgtatctttataattgatgatgttgtaaaatgaatttgttgttcctttaacctttgctgtagtgtttctttttattttagttccttctatacatgtttgcagtgttaagataattgtactttgaaaacaccagctgtatatatttttcttatttatgtaacaaagtttgctgaaagatatgtatatttttgatctttgagtgtattctatttgtgtaaggactttggcttacatttgaataatgtctagattttgaaaaattacctgtataatggagaattaaaactttgtagacattttgaaataaaaatggatcaagtgcg

SEQ ID NO: 330034 - DNA, 876 bp, Homo sapiens
gccaatgggctaaacaagaaaacaattgcaagtgcctggaaaggagcctttatatgaataaggtcaggatgtataatgaggacagattgtctgagatttctgctcgctctgcagcttctagtctccgggcttttcaaactctggcacgagctaagaaaaggaaggagaatttctggggtaaaacataaacctagctgagttgcctttatctaaggaaacattggcataatttttctttattgcttactgtgttaaaattttttgagtgaagtttttcctaacattttctactttgaaatatttaatttccaatagaacagtttacttggaaattgttaacataggcttatacaaatttaacttttaaagaattctttttacatctatcccagagtacaaagacctagattattgaattcttcacatgtaactttcgtaataggtgtcatggatagattttcacctatccagagagtattctaaaaaaataaacaaagtgaagtaaaagttaagatcccagtgtgaagtatatattcccctaagatttgatatatgtatctttataattgatgatgttgtaaaatgaatttgttgttcctttaacctttgctgtagtgtttctttttattttagttccttctatacatgtttgcagtgttaagataattgtactttgaaaacaccagctgtatatatttttcttatttatgtaacaaagtttgctgaaagatatgtatatttttgatctttgagtgtattctatttgtgtaaggactttggcttacatttgaataatgtctagattttgaaaaattacctgtataatggagaattaaaactttgtagacattttgaaataaaaatggatcaagtgcg

SEQ ID NO: 330035 - DNA, 893 bp, Homo sapiens
gacccttgtacgatttgagtttcttagattcaatattcagcctatggggctaactaggatgaccattttcgtttccccacagaggcctttataatgaaatgaggacgatttctggatttcgtccaatttgacgttttgtctccgggcttttcaaactctggcacgagctaagaaaaggaaggagaatttctggggtaaaacataaacctagctgagttgcctttatctaaggaaacattggcataatttttctttattgcttactgtgttaaaattttttgagtgaagtttttcctaacattttctactttgaaatatttaatttccaatagaacagtttacttggaaattgttaacataggcttatacaaatttaacttttaaagaattctttttacatctatcccagagtacaaagacctagattattgaattcttcacatgtaactttcgtaataggtgtcatggatagattttcacctatccagagagtattctaaaaaaataaacaaagtgaagtaaaagttaagatcccagtgtgaagtatatattcccctaagatttgatatatgtatctttataattgatgatgttgtaaaatgaatttgttgttcctttaacctttgctgtagtgtttctttttattttagttccttctatacatgtttgcagtgttaagataattgtactttgaaaacaccagctgtatatatttttcttatttatgtaacaaagtttgctgaaagatatgtatatttttgatctttgagtgtattctatttgtgtaaggactttggcttacatttgaataatgtctagattttgaaaaattacctgtataatggagaattaaaactttgtagacattttgaaataaaaatggatcaagtgcg

SEQ ID NO: 330036 - DNA, 878 bp, Homo sapiens
ttttaacactccacttttcgccctacggggaaagcaggatggcaatttccagtccctccacaaacacccttaataataaaatgaggccaggtgttttaaatttccgcccgtcccaggcttaagtctccgggcttttcaaactctggcacgagctaagaaaaggaaggagaatttctggggtaaaacataaacctagctgagttgcctttatctaaggaaacattggcataatttttctttattgcttactgtgttaaaattttttgagtgaagtttttcctaacattttctactttgaaatatttaatttccaatagaacagtttacttggaaattgttaacataggcttatacaaatttaacttttaaagaattctttttacatctatcccagagtacaaagacctagattattgaattcttcacatgtaactttcgtaataggtgtcatggatagattttcacctatccagagagtattctaaaaaaataaacaaagtgaagtaaaagttaagatcccagtgtgaagtatatattcccctaagatttgatatatgtatctttataattgatgatgttgtaaaatgaatttgttgttcctttaacctttgctgtagtgtttctttttattttagttccttctatacatgtttgcagtgttaagataattgtactttgaaaacaccagctgtatatatttttcttatttatgtaacaaagtttgctgaaagatatgtatatttttgatctttgagtgtattctatttgtgtaaggactttggcttacatttgaataatgtctagattttgaaaaattacctgtataatggagaattaaaactttgtagacattttgaaataaaaatggatcaagtgcg

SEQ ID NO: 330037 - DNA, 875 bp, Homo sapiens
cggatttttaaaatcgggtataacccaaattgggaagcaaggaagacaatttgcagtcccccccagtaccgttaatatgaaataagcccggttgttcaaattttgttgatcgcaggtgtatctccgggcttttcaaactctggcacgagctaagaaaaggaaggagaatttctggggtaaaacataaacctagctgagttgcctttatctaaggaaacattggcataatttttctttattgcttactgtgttaaaattttttgagtgaagtttttcctaacattttctactttgaaatatttaatttccaatagaacagtttacttggaaattgttaacataggcttatacaaatttaacttttaaagaattctttttacatctatcccagagtacaaagacctagattattgaattcttcacatgtaactttcgtaataggtgtcatggatagattttcacctatccagagagtattctaaaaaaataaacaaagtgaagtaaaagttaagatcccagtgtgaagtatatattcccctaagatttgatatatgtatctttataattgatgatgttgtaaaatgaatttgttgttcctttaacctttgctgtagtgtttctttttattttagttccttctatacatgtttgcagtgttaagataattgtactttgaaaacaccagctgtatatatttttcttatttatgtaacaaagtttgctgaaagatatgtatatttttgatctttgagtgtattctatttgtgtaaggactttggcttacatttgaataatgtctagattttgaaaaattacctgtataatggagaattaaaactttgtagacattttgaaataaaaatggatcaagtgcg

SEQ ID NO: 330038 - DNA, 874 bp, Homo sapiens
  misc_feature (2)..(2): n is a, c, g, or t
  misc_feature (11)..(11): n is a, c, g, or t
  misc_feature (19)..(19): n is a, c, g, or t
  misc_feature (22)..(22): n is a, c, g, or t
  misc_feature (24)..(25): n is a, c, g, or t
  misc_feature (41)..(41): n is a, c, g, or t
  misc_feature (57)..(57): n is a, c, g, or t
  misc_feature (86)..(86): n is a, c, g, or t
cnagggctttntaactccnagntnncgcccaattggaaaancaaggatgaccatttncggtccctcaccagaagcctttaataatnaaataaggcaaaattgttcaaatctccgcccctttccaggttttattttccgggctttttaacttcggcccccattaaaaatttctggggtaaaacataaacctagctgagttgcctttatctaaggaaacattggcataatttttctttattgcttactgtgttaaaattttttgagtgaagtttttcctaacattttctactttgaaatatttaatttccaatagaacagtttacttggaaattgttaacataggcttatacaaatttaacttttaaagaattctttttacatctatcccagagtacaaagacctagattattgaattcttcacatgtaactttcgtaataggtgtcatggatagattttcacctatccagagagtattctaaaaaaataaacaaagtgaagtaaaagttaagatcccagtgtgaagtatatattcccctaagatttgatatatgtatctttataattgatgatgttgtaaaatgaatttgttgttcctttaacctttgctgtagtgtttctttttattttagttccttctatacatgtttgcagtgttaagataattgtactttgaaaacaccagctgtatatatttttcttatttatgtaacaaagtttgctgaaagatatgtatatttttgatctttgagtgtattctatttgtgtaaggactttggcttacatttgaataatgtctagattttgaaaaattacctgtataatggagaattaaaactttgtagacattttgaaataaaaatggatcaagtgcg

SEQ ID NO: 330039 - DNA, 843 bp, Homo sapiens
cacgtgagctcaaaatataaacccttccaattataagaaggagtacgcaagtgttgatgatttgtgctcgcctcaacaaagttttagttctccgggcttttcaaactctggcacgagctaagaaaaggaaggagaatttctggggtaaaacataaacctagctgagttgcctttatctaaggaaacattggcataatttttctttattgcttactgtgttaaaattttttgagtgaagtttttcctaacattttctactttgaaatatttaatttccaatagaacagtttacttggaaattgttaacataggcttatacaaatttaacttttaaagaattctttttacatctatcccagagtacaaagacctagattattgaattcttcacatgtaactttcgtaataggtgtcatggatagattttcacctatccagagagtattctaaaaaaataaacaaagtgaagtaaaagttaagatcccagtgtgaagtatatattcccctaagatttgatatatgtatctttataattgatgatgttgtaaaatgaatttgttgttcctttaacctttgctgtagtgtttctttttattttagttccttctatacatgtttgcagtgttaagataattgtactttgaaaacaccagctgtatatatttttcttatttatgtaacaaagtttgctgaaagatatgtatatttttgatctttgagtgtattctatttgtgtaaggactttggcttacatttgaataatgtctagattttgaaaaattacctgtataatggagaattaaaactttgtagacattttgaaataaaaatggatcaagtgcg

SEQ ID NO: 330040 - DNA, 861 bp, Homo sapiens
ccctcccgacaacgagcctctgaatcaagtgttcgcccagtggaaaaccgaattacatctccgtcctcaccataaccctaatctaaaatggcaaaagtgtcagattttgctccctcccaatttaagttccggctttcaaatttggccgggctaatttctggggtaaaacataaacctagctgagttgcctttatctaaggaaacattggcataatttttctttattgcttactgtgttaaaattttttgagtgaagtttttcctaacattttctactttgaaatatttaatttccaatagaacagtttacttggaaattgttaacataggcttatacaaatttaacttttaaagaattctttttacatctatcccagagtacaaagacctagattattgaattcttcacatgtaactttcgtaataggtgtcatggatagattttcacctatccagagagtattctaaaaaaataaacaaagtgaagtaaaagttaagatcccagtgtgaagtatatattcccctaagatttgatatatgtatctttataattgatgatgttgtaaaatgaatttgttgttcctttaacctttgctgtagtgtttctttttattttagttccttctatacatgtttgcagtgttaagataattgtactttgaaaacaccagctgtatatatttttcttatttatgtaacaaagtttgctgaaagatatgtatatttttgatctttgagtgtattctatttgtgtaaggactttggcttacatttgaataatgtctagattttgaaaaattacctgtataatggagaattaaaactttgtagacattttgaaataaaaatggatcaagtgcg

SEQ ID NO: 330041 - DNA, 853 bp, Homo sapiens
cttatccagtggttataaaagtattatggttctgcgttgcctatctatataccctgaatacgtggatggctagcttggaacgcgtgatgccgatatacatgttaagtttcggggcttatcgtctgtggccggtgttaataaagcaatttctggggtaaaacataaacctagctgagttgcctttatctaaggaaacattggcataatttttctttattgcttactgtgttaaaattttttgagtgaagtttttcctaacattttctactttgaaatatttaatttccaatagaacagtttacttggaaattgttaacataggcttatacaaatttaacttttaaagaattctttttacatctatcccagagtacaaagacctagattattgaattcttcacatgtaactttcgtaataggtgtcatggatagattttcacctatccagagagtattctaaaaaaataaacaaagtgaagtaaaagttaagatcccagtgtgaagtatatattcccctaagatttgatatatgtatctttataattgatgatgttgtaaaatgaatttgttgttcctttaacctttgctgtagtgtttctttttattttagttccttctatacatgtttgcagtgttaagataattgtactttgaaaacaccagctgtatatatttttcttatttatgtaacaaagtttgctgaaagatatgtatatttttgatctttgagtgtattctatttgtgtaaggactttggcttacatttgaataatgtctagattttgaaaaattacctgtataatggagaattaaaactttgtagacattttgaaataaaaatggatcaagtgcg

SEQ ID NO: 330042 - DNA, 834 bp, Homo sapiens
tcagtggcctgaattatggcggcacctatactttctcagatatgcggtggtgctgagaaaacagtgcatgattcatggatgtccgaccggagctcttataagaatgaagagttctggtgactcataatttctggggtaaaacataaacctagctgagttgcctttatctaaggaaacattggcataatttttctttattgcttactgtgttaaaattttttgagtgaagtttttcctaacattttctactttgaaatatttaatttccaatagaacagtttacttggaaattgttaacataggcttatacaaatttaacttttaaagaattctttttacatctatcccagagtacaaagacctagattattgaattcttcacatgtaactttcgtaataggtgtcatggatagattttcacctatccagagagtattctaaaaaaataaacaaagtgaagtaaaagttaagatcccagtgtgaagtatatattcccctaagatttgatatatgtatctttataattgatgatgttgtaaaatgaatttgttgttcctttaacctttgctgtagtgtttctttttattttagttccttctatacatgtttgcagtgttaagataattgtactttgaaaacaccagctgtatatatttttcttatttatgtaacaaagtttgctgaaagatatgtatatttttgatctttgagtgtattctatttgtgtaaggactttggcttacatttgaataatgtctagattttgaaaaattacctgtataatggagaattaaaactttgtagacattttgaaataaaaatggatcaagtgcg

SEQ ID NO: 330043 - DNA, 906 bp, Homo sapiens
  misc_feature (1)..(1): n is a, c, g, or t
  misc_feature (137)..(137): n is a, c, g, or t
ncccccctctaccccctccgcccttttgatctccgccacctagtgccaaaccccgttctttttgttagagttccccccccatgtacgccttgttacgcatagcatttggtcccgctgtttcccactttatgcctccntagtacacttccagtcccccggccttttttacctttgtcccccgccttaatagaagcagccccctcttccgtggtccatcgtgtgccctagatgagtttcctttatctaaagccaacatggccacgtgtgtccttcactccccaacgaaattttttgagtgaagtttttcctaacattttctactttgaaatatttaatttccaatagaacagtttacttggaaattgttaacataggcttatacaaatttaacttttaaagaattctttttacatctatcccagagtacaaagacctagattattgaattcttcacatgtaactttcgtaataggtgtcatggatagattttcacctatccagagagtattctaaaaaaataaacaaagtgaagtaaaagttaagatcccagtgtgaagtatatattcccctaagatttgatatatgtatctttataattgatgatgttgtaaaatgaatttgttgttcctttaacctttgctgtagtgtttctttttattttagttccttctatacatgtttgcagtgttaagataattgtactttgaaaacaccagctgtatatatttttcttatttatgtaacaaagtttgctgaaagatatgtatatttttgatctttgagtgtattctatttgtgtaaggactttggcttacatttgaataatgtctagattttgaaaaattacctgtataatggagaattaaaactttgtagacattttgaaataaaaatggatcaagtgcg

SEQ ID NO: 330044 - DNA, 861 bp, Homo sapiens
  misc_feature (1)..(1): n is a, c, g, or t
nttaatatccaattcacccaattgacaaagaagaagataatttcaataccttgacatgacctttaataacaaggccggccaaccgtccagacttatgtccctccgcggcttatagttcccgactttcaaactaggccaaactaaaaaaagcgcgggtttttgtgggtaaaccttaaccttcgttattctccttatttaaggtccattggcataatttttctttattgcttactgtgttaaaattttttgagtgaagtttttcctaacattttctactttgaaatatttaatttccaatagaacagtttacttggaaattgttaacataggcttatacaaatttaacttttaaagaattctttttacatctatcccagagtacaaagacctagattattgaattcttcacatgtaactttcgtaataggtgtcatggatagattttcacctatccagagagtattctaaaaaaataaacaaagtgaagtaaaagttaagatcccagtgtgaagtatatattcccctaagatttgatatatgtatctttataattgatgatgttgtaaaatgaatttgttgttcctttaacctttgctgtagtgtttctttttattttagttccttctatacatgtttgcagtgttaagataattgtactttgaaaacaccagctgtatatatttttcttatttatgtaacaaagtttgctgaaagatatgtatatttttgatctttgagtgtattctatttgtgtaaggactttggcttacatttgaataatgtctagattttgaaaaattacctgtataatggagaattaaaactttgtagacattttgaaataaaaatggatcaagtgcg

SEQ ID NO: 330045 - DNA, 864 bp, Homo sapiens
cccagtagctacactgaggacccgctgtttgtgtacttttaatctaaccttttataagcagaatctgctaccatttttcgtgtacgtggctcccctcaggatctcagttctcgcccttttcaccacccgcgcagcagtttataaaacgaagccgccacttccgcggtaattcatagtccaattgagtgctccttatttaagccccgcattggcataatttttctttattgcttactgtgttaaaattttttgagtgaagtttttcctaacattttctactttgaaatatttaatttccaatagaacagtttacttggaaattgttaacataggcttatacaaatttaacttttaaagaattctttttacatctatcccagagtacaaagacctagattattgaattcttcacatgtaactttcgtaataggtgtcatggatagattttcacctatccagagagtattctaaaaaaataaacaaagtgaagtaaaagttaagatcccagtgtgaagtatatattcccctaagatttgatatatgtatctttataattgatgatgttgtaaaatgaatttgttgttcctttaacctttgctgtagtgtttctttttattttagttccttctatacatgtttgcagtgttaagataattgtactttgaaaacaccagctgtatatatttttcttatttatgtaacaaagtttgctgaaagatatgtatatttttgatctttgagtgtattctatttgtgtaaggactttggcttacatttgaataatgtctagattttgaaaaattacctgtataatggagaattaaaactttgtagacattttgaaataaaaatggatcaagtgcg

SEQ ID NO: 330046 - DNA, 876 bp, Homo sapiens
ccctactcatgttttccctaggctacaacaacagcacctcaagtttagaaaacactacagattgcgaagggtacacaacacgccattatccactaacatcatgctatatgacaacataaaggatgcggggactttaatacccgctacagataactaaagcaggtattatttttgcgtccaccataccccacacataattggccttttattaaaggttacacaggcaaaatttatctaacgtgcctaagaggtcataatttttgtaaagaagattttacgtcccatttctcctttgaaatatttaatttccaatagaacagtttacttggaaattgttaacataggcttatacaaatttaacttttaaagaattctttttacatctatcccagagtacaaagacctagattattgaattcttcacatgtaactttcgtaataggtgtcatggatagattttcacctatccagagagtattctaaaaaaataaacaaagtgaagtaaaagttaagatcccagtgtgaagtatatattcccctaagatttgatatatgtatctttataattgatgatgttgtaaaatgaatttgttgttcctttaacctttgctgtagtgtttctttttattttagttccttctatacatgtttgcagtgttaagataattgtactttgaaaacaccagctgtatatatttttcttatttatgtaacaaagtttgctgaaagatatgtatatttttgatctttgagtgtattctatttgtgtaaggactttggcttacatttgaataatgtctagattttgaaaaattacctgtataatggagaattaaaactttgtagacattttgaaataaaaatggatcaagtgcg

SEQ ID NO: 330047 - DNA, 828 bp, Homo sapiens
ttacccctattaaaaggtatttaacacctgggtacatccaaaacgcttttatatcatttaataacagtgttacatttcgctacgatggcgttgtgttccgggtttcaaagcttggcctgtctaaataagacgaaatattttggggacaaaaaattacagatattatctttttttagtaaaatggccaaatttactttacgccaacaaaattttttgagtgaagtttttcctaacattttctactttgaaatatttaatttccaatagaacagtttacttggaaattgttaacataggcttatacaaatttaacttttaaagaattctttttacatctatcccagagtacaaagacctagattattgaattcttcacatgtaactttcgtaataggtgtcatggatagattttcacctatccagagagtattctaaaaaaataaacaaagtgaagtaaaagttaagatcccagtgtgaagtatatattcccctaagatttgatatatgtatctttataattgatgatgttgtaaaatgaatttgttgttcctttaacctttgctgtagtgtttctttttattttagttccttctatacatgtttgcagtgttaagataattgtactttgaaaacaccagctgtatatatttttcttatttatgtaacaaagtttgctgaaagatatgtatatttttgatctttgagtgtattctatttgtgtaaggactttggcttacatttgaataatgtctagattttgaaaaattacctgtataatggagaattaaaactttgtagacattttgaaataaaaatggatcaagtgcg

SEQ ID NO: 330048 - DNA, 839 bp, Homo sapiens
agcgcgcgtccggttcctccgtttcccccacgatgcccctttctccataccaagacccgtgttttccccatttttcctccccttaagctccatttttcgcgtttctcccccttcgcccagtttaccaaagcagggggattccggccttatacataccctagttcaccgcttttttctagccaccgtgccaccatcttccctacttccgcactgcgttacaccttctgagggaggttttccctcccatttccacctttgaaatatttaatttccaatagaacagtttacttggaaattgttaacataggcttatacaaatttaacttttaaagaattctttttacatctatcccagagtacaaagacctagattattgaattcttcacatgtaactttcgtaataggtgtcatggatagattttcacctatccagagagtattctaaaaaaataaacaaagtgaagtaaaagttaagatcccagtgtgaagtatatattcccctaagatttgatatatgtatctttataattgatgatgttgtaaaatgaatttgttgttcctttaacctttgctgtagtgtttctttttattttagttccttctatacatgtttgcagtgttaagataattgtactttgaaaacaccagctgtatatatttttcttatttatgtaacaaagtttgctgaaagatatgtatatttttgatctttgagtgtattctatttgtgtaaggactttggcttacatttgaataatgtctagattttgaaaaattacctgtataatggagaattaaaactttgtagacattttgaaataaaaatggatcaagtgcg

SEQ ID NO: 330049 - DNA, 868 bp, Homo sapiens
ataactacatcgcccatacatagcaagccaattaaatcagtcatcgtaattgaaccccaactttattcactaaacagtcctcatgccaatcattcagctgatcagcacggctagattcttaactttaaaaagtgtgcttcctcgtatttaaaaaaacacaattatcggtaataaaatacactacattcgcttgcctaaatctatcgcccccttcgccaacattattctttatagtcccaatggttctaatttgctcagcccagtttttcccaaacacttagacattataaacatttcatttccaatagctcagccccttgcccattgtcgccataggcttatacaaatttaacttttaaagaattctttttacatctatcccagagtacaaagacctagattattgaattcttcacatgtaactttcgtaataggtgtcatggatagattttcacctatccagagagtattctaaaaaaataaacaaagtgaagtaaaagttaagatcccagtgtgaagtatatattcccctaagatttgatatatgtatctttataattgatgatgttgtaaaatgaatttgttgttcctttaacctttgctgtagtgtttctttttattttagttccttctatacatgtttgcagtgttaagataattgtactttgaaaacaccagctgtatatatttttcttatttatgtaacaaagtttgctgaaagatatgtatatttttgatctttgagtgtattctatttgtgtaaggactttggcttacatttgaataatgtctagattttgaaaaattacctgtataatggagaattaaaactttgtagacattttgaaataaaaatggatcaagtgcg

SEQ ID NO: 330050 - DNA, 915 bp, Homo sapiens
ctccaattcagcttttaaagtccaaggtcgcccaaggtgaaagccagattaccatttccattccctcaccataacctttaattataaattgaatgaggacagattgtctgagatttctgctcgctctgcagcttctagtctccgggcttttcaaactctggcacgagctaagaaaaggaaggagaatttctggggtaaaacataaacctagctgagttgcctttatctaaggaaacattggcataatttttctttattgcttactgtgttaaaattttttgagtgaagtttttcctaacattttctactttgaaatatttaatttccaatagaacagtttacttggaaattgttaacataggcttatacaaatttaacttttaaagaattctttttacatctatcccagagtacaaagacctagattattgaattcttcacatgtaactttcgtaataggtgtcatggatagattttcacctatccagagagtattctaaaaaaataaacaaagtgaagtaaaagttaagatcccagtgtgaagtatatattcccctaagatttgatatatgtatctttataattgatgatgttgtaaaatgaatttgttgttcctttaacctttgctgtagtgtttctttttattttagttccttctatacatgtttgcagtgttaagataattgtactttgaaaacaccagctgtatatatttttcttatttatgtaacaaagtttgctgaaagatatgtatatttttgatctttgagtgtattctatttgtgtaaggactttggcttacatttgaataatgtctagattttgaaaaattacctgtataatggagaattaaaactttgtagacattttgaaataaaaatggatcaagtgcgaaatggatcaagctgcagtttg

SEQ ID NO: 330051 - DNA, 953 bp, Homo sapiens
caaaccacaactctgccgcccttcccccagtccccacggaccttttcaatctgtttttgatgtcagagttcgccaatggaatgcacgtgcccattcagtcctcacataaacctcatacttaaatcgccacatttcggattccgctccttcccgctctatttccggcttttcaactctgcccacgtaaaaaagtaggagatttctgtgtaaccatcccccagtaatttctggggtaaaacataaacctagctgagttgcctttatctaaggaaacattggcataatttttctttattgcttactgtgttaaaattttttgagtgaagtttttcctaacattttctactttgaaatatttaatttccaatagaacagtttacttggaaattgttaacataggcttatacaaatttaacttttaaagaattctttttacatctatcccagagtacaaagacctagattattgaattcttcacatgtaactttcgtaataggtgtcatggatagattttcacctatccagagagtattctaaaaaaataaacaaagtgaagtaaaagttaagatcccagtgtgaagtatatattcccctaagatttgatatatgtatctttataattgatgatgttgtaaaatgaatttgttgttcctttaacctttgctgtagtgtttctttttattttagttccttctatacatgtttgcagtgttaagataattgtactttgaaaacaccagctgtatatatttttcttatttatgtaacaaagtttgctgaaagatatgtatatttttgatctttgagtgtattctatttgtgtaaggactttggcttacatttgaataatgtctagattttgaaaaattacctgtataatggagaattaaaactttgtagacattttgaaataaaaatggatcaagtgcgaaatggatcaagctgcagtttg

SEQ ID NO: 330052 - DNA, 892 bp, Homo sapiens
  misc_feature (43)..(43): n is a, c, g, or t
  misc_feature (45)..(47): n is a, c, g, or t
  misc_feature (68)..(68): n is a, c, g, or t
aggttttcaaggattattgattcgagttaagagaaagttaagntnnnctgcaacgactctcttaattntccaccgctacagaaagaaagtcgtgctgtatccctactgacttctccagctgctggtataaaaacagttgatcctctgcctttgcgggaagattctgaagacaatatccacaaatttgctgaggcaactcttccagtttcaaaaattccaaaatacccaacaaatccccctggacagttgccttctccaccacatgttccatcctactggcatccctctcgacgaattcagggctctcttagagatccagagtttcagcacaatgatgaggacagattgtctgagatttctgctcgctctgcagcttctagtctccgggcttttcaaactctggcacgagctaagaaaaggaaggagaatttctggggtaaaacataaacctagctgagttgcctttatctaaggaaacattggcataatttttctttattgcttactgtgttaaaattttttgagtgaagtttttcctaacattttctactttgaaatatttaatttccaatagaacagtttacttggaaattgttaacataggcttatacaaatttaacttttaaagaattctttttacatctatcccagagtacaaagacctagattattgaattcttcacatgtaactttcgtaataggtgtcatggatagattttcacctatccagagagtattaagatggaaaagaaaaacatatgaagtgaatctaaatccgcttcagagcataatgcctcaaaatgggtcataggtcttttacaccaagagggggaacggccaagtggctcctacccccgctcggcgtgtttatccaacggctgcaacccggagg

SEQ ID NO: 330053 - DNA, 891 bp, Homo sapiens
  misc_feature (844)..(844): n is a, c, g, or t
ccgtatctaccctcttaacctataagcttacatgcgcgtactattttttccattttttccccactcatactcgagctctcgagcctttcccattatgcagtacatatcataagaatctcaaattctaatagttatcattttctcttatttagattccttgagttaagccacactgaaaatcaattcgaataatagcttattggtttcaagacttttgaaggcaactattcataaccgtctccccctttcccacatttatttcccaatacaccaatatcctctgtatatttgtaaccataggcttatacaaatttaacttttaaagaattctttttacatctatcccagagtacaaagacctagattattgaattcttcacatgtaactttcgtaataggtgtcatggatagattttcacctatccagagagtattctaaaaaaataaacaaagtgaagtaaaagttaagatcccagtgtgaagtatatattcccctaagatttgatatatgtatctttataattgatgatgttgtaaaatgaatttgttgttcctttaacctttgctgtagtgtttctttttattttagttccttctatacatgtttgcagtgttaagataattgtactttgaaaacaccagctgtatatatttttcttatttatgtaacaaagtttgctgaaagatatgtatatttttgatctttgagtgtattctatttgtgtaaggactttggcttacatttgaataatgtctagattttgaaaaattacctgtataatggagaattaaaactttgtagacattttgaaataaaaatggatcaagtgcgtctgttacgcgncaagcgccgcctttcccctacctgaagtctcccgtccgctggacaat

SEQ ID NO: 330054 - DNA, 868 bp, Homo sapiens
  misc_feature (44)..(44): n is a, c, g, or t
ctcctcatctgtgtcactaacatttggttcaccaggtcggactnagtataagaggagactgacagcattttatgctcaacagcgttctttctttccctatcttactacttgtcccccgatcgttctcgtgactaacatcagataaaagaagtggctatatagaacacacattcttggtagcttcccgtattgagctccgctgcaaaattattatatattgcatctgaataacacggtagacgaaagttcccaaacacattctcgctcgaataattatatttcaaaattccgtagtcatggtaatgttttcataggcttatacaaatttaacttttaaagaattctttttacatctatcccagagtacaaagacctagattattgaattcttcacatgtaactttcgtaataggtgtcatggatagattttcacctatccagagagtattctaaaaaaataaacaaagtgaagtaaaagttaagatcccagtgtgaagtatatattcccctaagatttgatatatgtatctttataattgatgatgttgtaaaatgaatttgttgttcctttaacctttgctgtagtgtttctttttattttagttccttctatacatgtttgcagtgttaagataattgtactttgaaaacaccagctgtatatatttttcttatttatgtaacaaagtttgctgaaagatatgtatatttttgatctttgagtgtattctatttgtgtaaggactttggcttacatttgaataatgtctagattttgaaaaattacctgtataatggagaattaaaactttgtagacattttgaaataaaaatggatcaagtgcgaaatggatcaagctgcagtttg

SEQ ID NO: 330055 - DNA, 3179 bp, Homo sapiens
gtcagtgaaagcgttgtgtagaaacgttacttttataagagaaatcactagcgatatattcagtagttttactgctttctttaataagtgtttcacatactttttttagaaggaaatgctcatggttagttcaaagcatattgaattcagagtctatggattgaagagctttgagacagctttcaatgcttgttgataggaaacctctaaaagggttgttcatttcattttatcagacacctgctttctgaaaggatgtcttatattaatatgtaaaggagtcagaacagtttttggcagtaaagtccttgaggttatactgtactaaaaaagataaactgtttagatctgatctgtatgaagatgtactatccagcattacaaagcagtaatataacttgactgagttccccatcttttccatttgctttccttgtaatcagtggtaatatgccgtgaaatagaaaccatattgtgaagtagtaagtataaaaggaaatatttaacaatagaagtgtagtaattgctcagaacattttctttgccttaataaaatacgctgaaaataagccaagggaagaaaagctaaacaaattgaacatattgggtattcagaaatgtgaagaattttctattaaggcaggaagaaaaaaaatcatgtcagggaggaagaaaaaaacctgtagaactgacaacagagttgccttaaagctaatgtctatgtcatatgaaaatatgccaacgtttattttgattataagctatattttgattacaaaactgttattcaaaacatagtaatgagtacataaagttgacctttggatgttaataatatatgtgaaatgaaattaaaatcatatataactttgctatttttttgtcctgtaattcaactttatgttttgttaagtaattgaagaccaaagttccgcatatttaatcaacaaaactaaactaaaataatttttgttttaaggttttccacaataaaagccagtttgttccaccattcaaaggtaactcagtcatccatgaaactgaatacaaaagaaatttcaagggtttatctccagtgaaagaaccaaaattaagaaatgatttgagagaaaacagaaatcttgaaacagtgtctcctgaaaggaagagtaataaaatagacgatcgtttaaaattggaagcagagatggaattaaaagacttacaccagcctaaaaggaagcttactccttggaaacatcaaaggcttgggaaggtgaattccgaatatagagcaaaatttctgagcccagctcagtatttatataaagctggggcttggacacatgtaaagggaaacatgccaaatcaggttaaagaactccgagaaaaggctgagttttataggaagcgagttcaggggacgcatttttctcgggaccatctgaatcagattttatctgatagcaactgctgttgggatgtctcctcaaccacaagctcagaaggaaccgttagtagcaacatcagagcattagatcttgctggagatcctacaagccataagactttgcagaaatgtccttctacagaaccagaagaaaaaggaaatatcgtggaagaacagccccagaaaaataccacggagaaattgggtgtgtcagctcccaccatacccgttagaaggcggctggcttgggatacagagaacacaagtgaagacgtacagaaacagcccggggagaaagaggaggaggacgacaatgaagaggaaggggacaggaaaacgggcaagcaggcttttatgggagagcaagagaagttggatgtacatgagaaatctaaggcagataagatgaaagaagggtcagattcttctgtatcctcagaaaaaggaggccggcttcctactcccaagctgagagaacttggtggaatccagaggactcatcatgatctcactactccagctgttggtggtgctgttttagtgtctccatctaagatgaagcctccagccccagaacagaggaaaagaatgacctctcaggattgtttagaaacttcaaagaatgattttactaagaaagaaagtcgtgctgtatccctactgacttctccagctgctggtataaaaacagttgatcctctgcctttgcgggaagattctgaagacaatatccacaaatttgctgaggcaactcttccagtttcaaaaattccaaaatacccaacaaatccccctggacagttgccttctccaccacatgttccatcctactggcatccctctcgacgaattcagggctctcttagagatccagagtttcagcacaatgtgggaaaagcaaggatgaacaatttgcagttacctcaacatgaagcctttaatgatgaagatgaggacagattgtctgagatttctgctcgctctgcagcttctagtctccgggcttttcaaactctggcacgagctaagaaaaggaaggagaatttctggggtaaaacataaacctagctgagttgcctttatctaaggaaacattggcataatttttctttattgcttactgtgttaaaattttttgagtgaagtttttcctaacattttctactttgaaatatttaatttccaatagaacagtttacttggaaattgttaacataggcttatacaaatttaacttttaaagaattctttttacatctatcccagagtacaaagacctagattattgaattcttcacatgtaactttcgtaataggtgtcatggatagattttcacctatccagagagtattctaaaaaaataaacaaagtgaagtaaaagttaagatcccagtgtgaagtatatattcccctaagatttgatatatgtatctttataattgatgatgttgtaaaatgaatttgttgttcctttaacctttgctgtagtgtttctttttattttagttccttctatacatgtttgcagtgttaagataattgtactttgaaaacaccagctgtatatatttttcttatttatgtaacaaagtttgctgaaagatatgtatatttttgatctttgagtgtattctatttgtgtaaggactttggcttacatttgaataatgtctagattttgaaaaattacctgtataatggagaattaaaactttgtagacattttgaaataaaaatggatcaagtgcg

SEQ ID NO: 330056 - DNA, 2592 bp, Homo sapiens
cgccggcgcgtagtcggggacgccgggccgaggctttgctagggaacactgttatcgccccgccccctcggagctttttctccagttaactgtcggagtagcgggggctccggcgccgggcgacatgccggtgcgcttcaaggggctgagtgaataccagaggaacttcctgtggaaaaagtcttatttgtcagagtcttgtaattcctccgtggggcgaaagtacccatgggctggacttagatcagatcaattagttggatagacttctgcgtaagaaagctggattgactgttgttccttcatataatgccttgagaaattctgaatatcaaaggcagtttgtttggaagacttctaaagaaactgctccagcttttgcagccaatcaggttttccacaataaaagccagtttgttccaccattcaaaggtaactcagtcatccatgaaactgaatacaaaagaaatttcaagggtttatctccagtgaaagaaccaaaattaagaaatgatttgagagaaaacagaaatcttgaaacagtgtctcctgaaaggaagagtaataaaatagacgatcgtttaaaattggaagcagagatggaattaaaagacttacaccagcctaaaaggaagcttactccttggaaacatcaaaggcttgggaaggtgaattccgaatatagagcaaaatttctgagcccagctcagtatttatataaagctggggcttggacacatgtaaagggaaacatgccaaatcaggttaaagaactccgagaaaaggctgagttttataggaagcgagttcaggggacgcatttttctcgggaccatctgaatcagattttatctgatagcaactgctgttgggatgtctcctcaaccacaagctcagaaggaaccgttagtagcaacatcagagcattagatcttgctggagatcctacaagccataagactttgcagaaatgtccttctacagaaccagaagaaaaaggaaatatcgtggaagaacagccccagaaaaataccacggagaaattgggtgtgtcagctcccaccatacccgttagaaggcggctggcttgggatacagagaacacaagtgaagacgtacagaaacagcccggggagaaagaggaggaggacgacaatgaagaggaaggggacaggaaaacgggcaagcaggcttttatgggagagcaagagaagttggatgtacatgagaaatctaaggcagataagatgaaagaagggtcagattcttctgtatcctcagaaaaaggaggccggcttcctactcccaagctgagagaacttggtggaatccagaggactcatcatgatctcactactccagctgttggtggtgctgttttagtgtctccatctaagatgaagcctccagccccagaacagaggaaaagaatgacctctcaggattgtttagaaacttcaaagaatgattttactaagaaagaaagtcgtgctgtatccctactgacttctccagctgctggtataaaaacagttgatcctctgcctttgcgggaagattctgaagacaatatccacaaatttgctgaggcaactcttccagtttcaaaaattccaaaatacccaacaaatccccctggacagttgccttctccaccacatgttccatcctactggcatccctctcgacgaattcagggctctcttagagatccagagtttcagcacaatgtgggaaaagcaaggatgaacaatttgcagttacctcaacatgaagcctttaatgatgaagatgaggacagattgtctgagatttctgctcgctctgcagcttctagtctccgggcttttcaaactctggcacgagctaagaaaaggaaggagaatttctggggtaaaacataaacctagctgagttgcctttatctaaggaaacattggcataatttttctttattgcttactgtgttaaaattttttgagtgaagtttttcctaacattttctactttgaaatatttaatttccaatagaacagtttacttggaaattgttaacataggcttatacaaatttaacttttaaagaattctttttacatctatcccagagtacaaagacctagattattgaattcttcacatgtaactttcgtaataggtgtcatggatagattttcacctatccagagagtattctaaaaaaataaacaaagtgaagtaaaagttaagatcccagtgtgaagtatatattcccctaagatttgatatatgtatctttataattgatgatgttgtaaaatgaatttgttgttcctttaacctttgctgtagtgtttctttttattttagttccttctatacatgtttgcagtgttaagataattgtactttgaaaacaccagctgtatatatttttcttatttatgtaacaaagtttgctgaaagatatgtatatttttgatctttgagtgtattctatttgtgtaaggactttggcttacatttgaataatgtctagattttgaaaaattacctgtataatggagaattaaaactttgtagacattttgaaataaaaatggatcaagtgcg

SEQ ID NO: 330057 - DNA, 1195 bp, Homo sapiens
  misc_feature (43)..(43): n is a, c, g, or t
  misc_feature (45)..(47): n is a, c, g, or t
  misc_feature (68)..(68): n is a, c, g, or t
aggttttcaaggattattgattcgagttaagagaaagttaagntnnnctgcaacgactctcttaattntccaccgctacagaaagaaagtcgtgctgtatccctactgacttctccagctgctggtataaaaacagttgatcctctgcctttgcgggaagattctgaagacaatatccacaaatttgctgaggcaactcttccagtttcaaaaattccaaaatacccaacaaatccccctggacagttgccttctccaccacatgttccatcctactggcatccctctcgacgaattcagggctctcttagagatccagagtttcagcacaatgtgggaaaagcaaggatgaacaatttgcagttacctcaacatgaagcctttaatgatgaagatgaggacagattgtctgagatttctgctcgctctgcagcttctagtctccgggcttttcaaactctggcacgagctaagaaaaggaaggagaatttctggggtaaaacataaacctagctgagttgcctttatctaaggaaacattggcataatttttctttattgcttactgtgttaaaattttttgagtgaagtttttcctaacattttctactttgaaatatttaatttccaatagaacagtttacttggaaattgttaacataggcttatacaaatttaacttttaaagaattctttttacatctatcccagagtacaaagacctagattattgaattcttcacatgtaactttcgtaataggtgtcatggatagattttcacctatccagagagtattctaaaaaaataaacaaagtgaagtaaaagttaagatcccagtgtgaagtatatattcccctaagatttgatatatgtatctttataattgatgatgttgtaaaatgaatttgttgttcctttaacctttgctgtagtgtttctttttattttagttccttctatacatgtttgcagtgttaagataattgtactttgaaaacaccagctgtatatatttttcttatttatgtaacaaagtttgctgaaagatatgtatatttttgatctttgagtgtattctatttgtgtaaggactttggcttacatttgaataatgtctagattttgaaaaattacctgtataatggagaattaaaactttgtagacattttgaaataaaaatggatcaagtgcg

SEQ ID NO: 330058 - DNA, 2737 bp, Homo sapiens
cgccggcgcgtagtcggggacgccgggccgaggctttgctagggaacactgttatcgccccgccccctcggagctttttctccagttaactgtcggagtagcgggggctccggcgccgggcgacatgccggtgcgcttcaaggggctgagtgaataccagaggaacttcctgtggaaaaagtcttatttgtcagagtcttgtaattcctccgtggggcgaaagtacccatgggctggacttagatcagatcaattaggcatcacgaaagagccaagttttatttcaaaaagaagagtcccttaccatgacccacagatttcaaaatctctggagtggaatggagctatctcagagagcaatgtggttgcatcaccagaaccagaagccccggaaacaccaaaatcacaagaagcagaacaaaaggatgttattcaagaaagagttcactcactagaagcttccagggttcccaaaagaaccagatctcactctgcagactccagagctgaaggggcttcagatgtggaaaataatgagggtgtaacaaaccatacaccagttaatgaaaatgtggaactggaacattctaccaaggttctttcagaaaatgtagataatgggttggatagacttctgcgtaagaaagctggattgactgttgttccttcatataatgccttgagaaattctgaatatcaaaggcagtttgtttggaagacttctaaagaaactgctccagcttttgcagccaatcaggttttccacaataaaagccagtttgttccaccattcaaaggtaactcagtcatccatgaaactgaatacaaaagaaatttcaagggtttatctccagtgaaagaaccaaaattaagaaatgatttgagagaaaacagaaatcttgaaacagtgtctcctgaaaggaagagtaataaaatagacgatcgtttaaaattggaagcagagatggaattaaaagacttacaccagcctaaaaggaagcttactccttggaaacatcaaaggcttgggaaggtgaattccgaatatagagcaaaatttctgagcccagctcagtatttatataaagctggggcttggacacatgtaaagggaaacatgccaaatcaggttaaagaactccgagaaaaggctgagttttataggaagcgagttcaggggacgcatttttctcgggaccatctgaatcagattttatctgatagcaactgctgttgggatgtctcctcaaccacaagctcagaaggaaccgttagtagcaacatcagagcattagatcttgctggagatcctacaagccataagactttgcagaaatgtccttctacagaaccagaagaaaaaggaaatatcgtggaagaacagccccagaaaaataccacggagaaattgggtgtgtcagctcccaccatacccgttagaaggcggctggcttgggatacagagaacacaagtgaagacgtacagaaacagcccggggagaaagaggaggaggacgacaatgaagaggaaggggacaggaaaacgggcaagcaggcttttatgggagagcaagagaagttggatgtacatgagaaatctaaggcagataagatgaaagaagggtcagattcttctgtatcctcagaaaaaggaggccggcttcctactcccaagctgagagaacttggtggaatccagaggactcatcatgatctcactactccagctgttggtggtgctgttttagtgtctccatctaagatgaagcctccagccccagaacagaggaaaagaatgacctctcaggattgtttagaaacttcaaagaatgattttactaagaaagaaagtcgtgctgtatccctactgacttctccagctgctggtataaaaacagttgatcctctgcctttgcgggaagattctgaagacaatatccacaaatttgctgaggcaactcttccagtttcaaaaattccaaaatacccaacaaatccccctggacagttgccttctccaccacatgttccatcctactggcatccctctcgacgaattcagggctctcttagagatccagagtttcagcacaatgtgggaaaagcaaggatgaacaatttgcagttacctcaacatgaagcctttaatgatgaagatgaggacagattgtctgagatttctgctcgctctgcagcttctagtctccgggcttttcaaactctggcacgagctaagaaaaggaaggagaatttctggggtaaaacataaacctagctgagttgcctttatctaaggaaacattggcataatttttctttattgcttactgtgttaaaattttttgagtgaagtttttcctaacattttctactttgaaatatttaatttccaatagaacagtttacttggaaattgttaacataggcttatacaaatttaacttttaaagaattctttttacatctatcccagagtacaaagacctagattattgaattcttcacatgtaactttcgtaataggtgtcatggatagattttcacctatccagagagtattctaaaaaaataaacaaagtgaagtaaaagttaagatcccagtgtgaagtatatattcccctaagatttgatatatgtatctttatattggggaagggagaaggattggtggtccttaaccttgggtgaggggtcttttatttagtcctccataaagtggcggggaagatattgactt

SEQ ID NO: 330059 - DNA, 2897 bp, Homo sapiens
cgccggcgcgtagtcggggacgccgggccgaggctttgctagggaacactgttatcgccccgccccctcggagctttttctccagttaactgtcggagtagcgggggctccggcgccgggcgacatgccggtgcgcttcaaggggctgagtgaataccagaggaacttcctgtggaaaaagtcttatttgtcagagtcttgtaattcctccgtggggcgaaagtacccatgggctggacttagatcagatcaattaggcatcacgaaagagccaagttttatttcaaaaagaagagtcccttaccatgacccacagatttcaaaatctctggagtggaatggagctatctcagagagcaatgtggttgcatcaccagaaccagaagccccggaaacaccaaaatcacaagaagcagaacaaaaggatgttattcaagaaagagttcactcactagaagcttccagggttcccaaaagaaccagatctcactctgcagactccagagctgaaggggcttcagatgtggaaaataatgagggtgtaacaaaccatacaccagttaatgaaaatgtggaactggaacattctaccaaggttctttcagaaaatgtagataatgggttggatagacttctgcgtaagaaagctggattgactgttgttccttcatataatgccttgagaaattctgaatatcaaaggcagtttgtttggaagacttctaaagaaactgctccagcttttgcagccaatcaggttttccacaataaaagccagtttgttccaccattcaaaggtaactcagtcatccatgaaactgaatacaaaagaaatttcaagggtttatctccagtgaaagaaccaaaattaagaaatgatttgagagaaaacagaaatcttgaaacagtgtctcctgaaaggaagagtaataaaatagacgatcgtttaaaattggaagcagagatggaattaaaagacttacaccagcctaaaaggaagcttactccttggaaacatcaaaggcttgggaaggtgaattccgaatatagagcaaaatttctgagcccagctcagtatttatataaagctggggcttggacacatgtaaagggaaacatgccaaatcaggttaaagaactccgagaaaaggctgagttttataggaagcgagttcaggggacgcatttttctcgggaccatctgaatcagattttatctgatagcaactgctgttgggatgtctcctcaaccacaagctcagaaggaaccgttagtagcaacatcagagcattagatcttgctggagatcctacaagccataagactttgcagaaatgtccttctacagaaccagaagaaaaaggaaatatcgtggaagaacagccccagaaaaataccacggagaaattgggtgtgtcagctcccaccatacccgttagaaggcggctggcttgggatacagagaacacaagtgaagacgtacagaaacagcccggggagaaagaggaggaggacgacaatgaagaggaaggggacaggaaaacgggcaagcaggcttttatgggagagcaagagaagttggatgtacatgagaaatctaaggcagataagatgaaagaagggtcagattcttctgtatcctcagaaaaaggaggccggcttcctactcccaagctgagagaacttggtggaatccagaggactcatcatgatctcactactccagctgttggtggtgctgttttagtgtctccatctaagatgaagcctccagccccagaacagaggaaaagaatgacctctcaggattgtttagaaacttcaaagaatgattttactaagaaagaaagtcgtgctgtatccctactgacttctccagctgctggtataaaaacagttgatcctctgcctttgcgggaagattctgaagacaatatccacaaatttgctgaggcaactcttccagtttcaaaaattccaaaatacccaacaaatccccctggacagttgccttctccaccacatgttccatcctactggcatccctctcgacgaattcagggctctcttagagatccagagtttcagcacaatgatgaggacagattgtctgagatttctgctcgctctgcagcttctagtctccgggcttttcaaactctggcacgagctaagaaaaggaaggagaatttctggggtaaaacataaacctagctgagttgcctttatctaaggaaacattggcataatttttctttattgcttactgtgttaaaattttttgagtgaagtttttcctaacattttctactttgaaatatttaatttccaatagaacagtttacttggaaattgttaacataggcttatacaaatttaacttttaaagaattctttttacatctatcccagagtacaaagacctagattattgaattcttcacatgtaactttcgtaataggtgtcatggatagattttcacctatccagagagtattctaaaaaaataaacaaagtgaagtaaaagttaagatcccagtgtgaagtatatattcccctaagatttgatatatgtatctttataattgatgatgttgtaaaatgaatttgttgttcctttaacctttgctgtagtgtttctttttattttagttccttctatacatgtttgcagtgttaagataattgtactttgaaaacaccagctgtatatatttttcttatttatgtaacaaagtttgctgaaagatatgtatatttttgatctttgagtgtattctatttgtgtaaggactttggcttacatttgaataatgtctagattttgaaaaattacctgtataatggagaattaaaactttgtagacattttgaaataaaaatggatcaagtgcg

SEQ ID NO: 330060 - DNA, 2694 bp, Homo sapiens
cgccggcgcgtagtcggggacgccgggccgaggctttgctagggaacactgttatcgccccgccccctcggagctttttctccagttaactgtcggagtagcgggggctccggcgccgggcgacatgccggtgcgcttcaaggggctgagtgaataccagaggaacttcctgtggaaaaagtcttatttgtcagagtcttgtaattcctccgtggggcgaaagtacccatgggctggacttagatcagatcaattaggcatcacgaaagagccaagttttatttcaaaaagaagagtcccttaccatgacccacagatttcaaaatctctggagtggaatggagctatctcagagagcaatgtggttgcatcaccagaaccagaagccccggaaacaccaaaatcacaagaagcagaacaaaaggatgttattcaagaaagagttcactcactagaagcttccagggttcccaaaagaaccagatctcactctgcagactccagagctgaaggggcttcagatgtggaaaataatgagggtgtaacaaaccatacaccagttaatgaaaatgtggaactggaacattctaccaaggttctttcagaaaatgtagataatgggttggatagacttctgcgtaagaaagctggattgactgttgttccttcatataatgccttgagaaattctgaatatcaaaggcagtttgtttggaagacttctaaagaaactgctccagcttttgcagccaatcaggttttccacaataaaagccagtttgttccaccattcaaaggtaactcagtcatccatgaaactgaatacaaaagaaatttcaagggtttatctccagtgaaagaaccaaaattaagaaatgatttgagagaaaacagaaatcttgaaacagtgtctcctgaaaggaagagtaataaaatagacgatcgtttaaaattggaagcagagatggaattaaaagacttacaccagcctaaaaggaagcttactccttggaaacatcaaaggcttgggaaggtgaattccgaatatagagcaaaatttctgagcccagctcagtatttatataaagctggggcttggacacatgtaaagggaaacatgccaaatcaggttaaagaactccgagaaaaggctgagttttataggaagcgagttcaggggacgcatttttctcgggaccatctgaatcagattttatctgatagcaactgctgttgggatgtctcctcaaccacaagctcagaaggaaccgttagtagcaacatcagagcattagatcttgctggagatcctacaagccataagactttgcagaaatgtccttctacagaaccagaagaaaaaggaaatatcgtggaagaacagccccagaaaaataccacggagaaattgggtgtgtcagctcccaccatacccgttagaaggcggctggcttgggatacagagaacacaagtgaagacgtacagaaacagcccggggagaaagaggaggaggacgacaatgaagaggaaggggacaggaaaacgggcaagcaggcttttatgggagagcaagagaagttggatgtacatgagaaatctaaggcagataagatgaaagaagggtcagattcttctgtatcctcagaaaaaggaggccggcttcctactcccaagctgagagaacttggtggaatccagaggactcatcatgatctcactactccagctgttggtggtgctgttttagtgtctccatctaagatgaagcctccagccccagaacagaggaaaagaatgacctctcaggattgtttagaaacttcaaagaatgattttactaagaaagaaagtcgtgctgtatccctactgacttctccagctgctggtataaaaacagttgatcctctgcctttgcgggaagattctgaagacaatatccacaaatttgctgaggcaactcttccagtttcaaaaattccaaaatacccaacaaatccccctggacagttgccttctccaccacatgttccatcctactggcatccctctcgacgaattcagggctctcttagagatccagagtttcagcacaatgtgggaaaagcaaggatgaacaatttgcagttacctcaacatgaagcctttaatgatgaagatgaggacagattgtctgagatttctgctcgctctgcagcttctagtctccgggcttttcaaactctggcacgagctaagaaaaggaaggagaatttctggggtaaaacataaacctagctgagttgcctttatctaaggaaacattggcataatttttctttattgcttactgtgttaaaattttttgagtgaagtttttcctaacattttctactttgaaatatttaatttccaatagaacagtttacttggaaattgttaacataggcttatacaaatttaacttttaaagaattctttttacatctatcccagagtacaaagacctagattattgaattcttcacatgtaactttcgtaataggtgtcatggatagattttcacctatccagagagtatttaacatcgttatttaaccttagaaccacgttgaagatataatcccctagaccgtttatattcctataatgatatgtgccatgatttgtgtcacttccctggtggctgtccttttttaaccctcctaatgcatag

SEQ ID NO: 330061 - DNA, 2674 bp, Homo sapiens
cgccggcgcgtagtcggggacgccgggccgaggctttgctagggaacactgttatcgccccgccccctcggagctttttctccagttaactgtcggagtagcgggggctccggcgccgggcgacatgccggtgcgcttcaaggggctgagtgaataccagaggaacttcctgtggaaaaagtcttatttgtcagagtcttgtaattcctccgtggggcgaaagtacccatgggctggacttagatcagatcaattaggcatcacgaaagagccaagttttatttcaaaaagaagagtcccttaccatgacccacagatttcaaaatctctggagtggaatggagctatctcagagagcaatgtggttgcatcaccagaaccagaagccccggaaacaccaaaatcacaagaagcagaacaaaaggatgttattcaagaaagagttcactcactagaagcttccagggttcccaaaagaaccagatctcactctgcagactccagagctgaaggggcttcagatgtggaaaataatgagggtgtaacaaaccatacaccagttaatgaaaatgtggaactggaacattctaccaaggttctttcagaaaatgtagataatgggttggatagacttctgcgtaagaaagctggattgactgttgttccttcatataatgccttgagaaattctgaatatcaaaggcagtttgtttggaagacttctaaagaaactgctccagcttttgcagccaatcaggttttccacaataaaagccagtttgttccaccattcaaaggtaactcagtcatccatgaaactgaatacaaaagaaatttcaagggtttatctccagtgaaagaaccaaaattaagaaatgatttgagagaaaacagaaatcttgaaacagtgtctcctgaaaggaagagtaataaaatagacgatcgtttaaaattggaagcagagatggaattaaaagacttacaccagcctaaaaggaagcttactccttggaaacatcaaaggcttgggaaggtgaattccgaatatagagcaaaatttctgagcccagctcagtatttatataaagctggggcttggacacatgtaaagggaaacatgccaaatcaggttaaagaactccgagaaaaggctgagttttataggaagcgagttcaggggacgcatttttctcgggaccatctgaatcagattttatctgatagcaactgctgttgggatgtctcctcaaccacaagctcagaaggaaccgttagtagcaacatcagagcattagatcttgctggagatcctacaagccataagactttgcagaaatgtccttctacagaaccagaagaaaaaggaaatatcgtggaagaacagccccagaaaaataccacggagaaattgggtgtgtcagctcccaccatacccgttagaaggcggctggcttgggatacagagaacacaagtgaagacgtacagaaacagcccggggagaaagaggaggaggacgacaatgaagaggaaggggacaggaaaacgggcaagcaggcttttatgggagagcaagagaagttggatgtacatgagaaatctaaggcagataagatgaaagaagggtcagattcttctgtatcctcagaaaaaggaggccggcttcctactcccaagctgagagaacttggtggaatccagaggactcatcatgatctcactactccagctgttggtggtgctgttttagtgtctccatctaagatgaagcctccagccccagaacagaggaaaagaatgacctctcaggattgtttagaaacttcaaagaatgattttactaagaaagaaagtcgtgctgtatccctactgacttctccagctgctggtataaaaacagttgatcctctgcctttgcgggaagattctgaagacaatatccacaaatttgctgaggcaactcttccagtttcaaaaattccaaaatacccaacaaatccccctggacagttgccttctccaccacatgttccatcctactggcatccctctcgacgaattcagggctctcttagagatccagagtttcagcacaatgtgggaaaagcaaggatgaacaatttgcagttacctcaacatgaagcctttaatgatgaagatgaggacagattgtctgagatttctgctcgctctgcagcttctagtctccgggcttttcaaactctggcacgagctaagaaaaggaaggagaatttctggggtaaaacataaacctagctgagttgcctttatctaaggaaacattggcataatttttctttattgcttactgtgttaaaattttttgagtgaagtttttcctaacattttctactttgaaatatttaatttccaatagaacagtttacttggaaattgttaacataggcttatacaaatttaacttttaaagaattcttaacactttattccaaagatcaagggacctatcatgcttgccattctttcaatggcatcttgtgtatattgttgtctccgtataatattttcccctcccctacgggtcatttttacaaaactaaacccccgcgattttaatattatatagtcccttccgcgaagctcatatatgccttattattagcatatgtgcttctaatatcatcgctcatacgt

SEQ ID NO: 330062 - DNA, 1271 bp, Homo sapiens
  misc_feature (1)..(1): n is a, c, g, or t
nttccctcgcgtcccctctcgttttttatacctgcatcgccgtctttctaactccccaaaatgttctttaatagccatgggcaattacacggggccaccccggcattttttccgcgaacaagccttctccaggctctatctgtaaacccgcatgatcgttttccaccaccattttggcacctcaaccgcagggccctctttttactccccccctccccaaagaaagcccggcgtgatgcccctcggcttttcccccgccgggcaaaaaaaagttgatcctctgcctttgcgggaagattctgaagacaatatccacaaatttgctgaggcaactcttccagtttcaaaaattccaaaatacccaacaaatccccctggacagttgccttctccaccacatgttccatcctactggcatccctctcgacgaattcagggctctcttagagatccagagtttcagcacaatgatgaggacagattgtctgagatttctgctcgctctgcagcttctagtctccgggcttttcaaactctggcacgagctaagaaaaggaaggagaatttctggggtaaaacataaacctagctgagttgcctttatctaaggaaacattggcataatttttctttattgcttactgtgttaaaattttttgagtgaagtttttcctaacattttctactttgaaatatttaatttccaatagaacagtttacttggaaattgttaacataggcttatacaaatttaacttttaaagaattctttttacatctatcccagagtacaaagacctagattattgaattcttcacatgtaactttcgtaataggtgtcatggatagattttcacctatccagagagtattctaaaaaaataaacaaagtgaagtaaaagttaagatcccagtgtgaagtatatattcccctaagatttgatatatgtatctttataattgatgatgttgtaaaatgaatttgttgttcctttaacctttgctgtagtgtttctttttattttagttccttctatacatgtttgcagtgttaagataattgtactttgaaaacaccagctgtatatatttttcttatttatgtaacaaagtttgctgaaagatatgtatatttttgatctttgagtgtattctatttgtgtaaggactttggcttacatttgaataatgtctagattttgaaaaattacctgtataatggagaattaaaactttgtagacattttgaaataaaaatggatcaagtgcg

SEQ ID NO: 330063 - DNA, 2595 bp, Homo sapiens
cgccggcgcgtagtcggggacgccgggccgaggctttgctagggaacactgttatcgccccgccccctcggagctttttctccagttaactgtcggagtagcgggggctccggcgccgggcgacatgccggtgcgcttcaaggggctgagtgaataccagaggaacttcctgtggaaaaagtcttatttgtcagagtcttgtaattcctccgtggggcgaaagtacccatgggctggacttagatcagatcaattaggcatcacgaaagagccaagttttatttcaaaaagaagagtcccttaccatgacccacagatttcaaaatctctggagtggaatggagctatctcagagagcaatgtggttgcatcaccagaaccagaagccccggaaacaccaaaatcacaagaagcagaacaaaaggatgttattcaagaaagagttcactcactagaagcttccagggttcccaaaagaaccagatctcactctgcagactccagagctgaaggggcttcagatgtggaaaataatgagggtgtaacaaaccatacaccagttaatgaaaatgtggaactggaacattctaccaaggttctttcagaaaatgtagataatgggttggatagacttctgcgtaagaaagctggattgactgttgttccttcatataatgccttgagaaattctgaatatcaaaggcagtttgtttggaagacttctaaagaaactgctccagcttttgcagccaatcaggttttccacaataaaagccagtttgttccaccattcaaaggtaactcagtcatccatgaaactgaatacaaaagaaatttcaagggtttatctccagtgaaagaaccaaaattaagaaatgatttgagagaaaacagaaatcttgaaacagtgtctcctgaaaggaagagtaataaaatagacgatcgtttaaaattggaagcagagatggaattaaaagacttacaccagcctaaaaggaagcttactccttggaaacatcaaaggcttgggaaggtgaattccgaatatagagcaaaatttctgagcccagctcagtatttatataaagctggggcttggacacatgtaaagggaaacatgccaaatcaggttaaagaactccgagaaaaggctgagttttataggaagcgagttcaggggacgcatttttctcgggaccatctgaatcagattttatctgatagcaactgctgttgggatgtctcctcaaccacaagctcagaaggaaccgttagtagcaacatcagagcattagatcttgctggagatcctacaagccataagactttgcagaaatgtccttctacagaaccagaagaaaaaggaaatatcgtggaagaacagccccagaaaaataccacggagaaattgggtgtgtcagctcccaccatacccgttagaaggcggctggcttgggatacagagaacacaagtgaagacgtacagaaacagcccggggagaaagaggaggaggacgacaatgaagaggaaggggacaggaaaacgggcaagcaggcttttatgggagagcaagagaagttggatgtacatgagaaatctaaggcagataagatgaaagaagggtcagattcttctgtatcctcagaaaaaggaggccggcttcctactcccaagctgagagaacttggtggaatccagaggactcatcatgatctcactactccagctgttggtggtgctgttttagtgtctccatctaagatgaagcctccagccccagaacagaggaaaagaatgacctctcaggattgtttagaaacttcaaagaatgattttactaagaaagaaagtcgtgctgtatccctactgacttctccagctgctggtataaaaacagttgatcctctgcctttgcgggaagattctgaagacaatatccacaaatttgctgaggcaactcttccagtttcaaaaattccaaaatacccaacaaatccccctggacagttgccttctccaccacatgttccatcctactggcatccctctcgacgaattcagggctctcttagagatccagagtttcagcacaatgtgggaaaagcaaggatgaacaatttgcagttacctcaacatgaagcctttaatgatgaagatgaggacagattgtctgagatttctgctcgctctgcagcttctagtctccgggcttttcaaactctggcacgagctaagaaaaggaaggagaatttctggggtaaaacataaacctagctgagttgcctttatctaaggaaacattggcataatttttctttattgcttactgtgttaaaattttttgagtgaagtttttcctaacattttctactttgaaatatttaatttccaatagaacagtttacttggaaattgttaacataggcttatacaaatttaacttttaaagaattctttttacatctatcccagagtacaaagacctagattattgaatgatcaaaaaatctttggaataggtgtaaggtgaacttccccatccggaaggtgctaaaaataacaagtgaacgtcaggtaccacccaatggtaacta

SEQ ID NO: 330064 - DNA, 2578 bp, Homo sapiens
cgccggcgcgtagtcggggacgccgggccgaggctttgctagggaacactgttatcgccccgccccctcggagctttttctccagttaactgtcggagtagcgggggctccggcgccgggcgacatgccggtgcgcttcaaggggctgagtgaataccagaggaacttcctgtggaaaaagtcttatttgtcagagtcttgtaattcctccgtggggcgaaagtacccatgggctggacttagatcagatcaattaggcatcacgaaagagccaagttttatttcaaaaagaagagtcccttaccatgacccacagatttcaaaatctctggagtggaatggagctatctcagagagcaatgtggttgcatcaccagaaccagaagccccggaaacaccaaaatcacaagaagcagaacaaaaggatgttattcaagaaagagttcactcactagaagcttccagggttcccaaaagaaccagatctcactctgcagactccagagctgaaggggcttcagatgtggaaaataatgagggtgtaacaaaccatacaccagttaatgaaaatgtggaactggaacattctaccaaggttctttcagaaaatgtagataatgggttggatagacttctgcgtaagaaagctggattgactgttgttccttcatataatgccttgagaaattctgaatatcaaaggcagtttgtttggaagacttctaaagaaactgctccagcttttgcagccaatcaggttttccacaataaaagccagtttgttccaccattcaaaggtaactcagtcatccatgaaactgaatacaaaagaaatttcaagggtttatctccagtgaaagaaccaaaattaagaaatgatttgagagaaaacagaaatcttgaaacagtgtctcctgaaaggaagagtaataaaatagacgatcgtttaaaattggaagcagagatggaattaaaagacttacaccagcctaaaaggaagcttactccttggaaacatcaaaggcttgggaaggtgaattccgaatatagagcaaaatttctgagcccagctcagtatttatataaagctggggcttggacacatgtaaagggaaacatgccaaatcaggttaaagaactccgagaaaaggctgagttttataggaagcgagttcaggggacgcatttttctcgggaccatctgaatcagattttatctgatagcaactgctgttgggatgtctcctcaaccacaagctcagaaggaaccgttagtagcaacatcagagcattagatcttgctggagatcctacaagccataagactttgcagaaatgtccttctacagaaccagaagaaaaaggaaatatcgtggaagaacagccccagaaaaataccacggagaaattgggtgtgtcagctcccaccatacccgttagaaggcggctggcttgggatacagagaacacaagtgaagacgtacagaaacagcccggggagaaagaggaggaggacgacaatgaagaggaaggggacaggaaaacgggcaagcaggcttttatgggagagcaagagaagttggatgtacatgagaaatctaaggcagataagatgaaagaagggtcagattcttctgtatcctcagaaaaaggaggccggcttcctactcccaagctgagagaacttggtggaatccagaggactcatcatgatctcactactccagctgttggtggtgctgttttagtgtctccatctaagatgaagcctccagccccagaacagaggaaaagaatgacctctcaggattgtttagaaacttcaaagaatgattttactaagaaagaaagtcgtgctgtatccctactgacttctccagctgctggtataaaaacagttgatcctctgcctttgcgggaagattctgaagacaatatccacaaatttgctgaggcaactcttccagtttcaaaaattccaaaatacccaacaaatccccctggacagttgccttctccaccacatgttccatcctactggcatccctctcgacgaattcagggctctcttagagatccagagtttcagcacaatgtgggaaaagcaaggatgaacaatttgcagttacctcaacatgaagcctttaatgatgaagatgaggacagattgtctgagatttctgctcgctctgcagcttctagtctccgggcttttcaaactctggcacgagctaagaaaaggaaggagaatttctggggtaaaacataaacctagctgagttgcctttatctaaggaaacattggcataatttttctttattgcttactgtgttaacccgacccgaagcttttcctacatttcgtactttgcatcctcttaccctccccatcgaacctctacttgccaatcgtaccctagcctcaccacattcactctgaagaaccttttacccttattccgcagaccaaacctagcatttttcaattctcccatgcactcccccccccgggccctcgcaccgtttccccctctcgcaagtcttcccaccactctcagcgtcttgaccttaaaccgcg

SEQ ID NO: 330065 - DNA, 815 bp, Homo sapiens
ctaggtggctaagcaggaataatctttttaccctaaatgagcctttaatataaaattgtcagattattaatttcagtctcttaagcttttgttttcggtcttccaaaatttctggggtaaaacataaacctagctgagttgcctttatctaaggaaacattggcataatttttctttattgcttactgtgttaaaattttttgagtgaagtttttcctaacattttctactttgaaatatttaatttccaatagaacagtttacttggaaattgttaacataggcttatacaaatttaacttttaaagaattctttttacatctatcccagagtacaaagacctagattattgaattcttcacatgtaactttcgtaataggtgtcatggatagattttcacctatccagagagtattctaaaaaaataaacaaagtgaagtaaaagttaagatcccagtgtgaagtatatattcccctaagatttgatatatgtatctttataattgatgatgttgtaaaatgaatttgttgttcctttaacctttgctgtagtgtttctttttattttagttccttctatacatgtttgcagtgttaagataattgtactttgaaaacaccagctgtatatatttttcttatttatgtaacaaagtttgctgaaagatatgtatatttttgatctttgagtgtattctatttgtgtaaggactttggcttacatttgaataatgtctagattttgaaaaattacctgtataatggagaattaaaactttgtagacattttgaaataaaaatggatcaagtgcg

SEQ ID NO: 330066 - DNA, 886 bp, Homo sapiens
agcgggggagacatgccggtgcgcttcaaggggctgagtgaataccagaggaacttcctgtggaaaaagtcttatttgtcagagtcttgtaattcctccgtggggcgaaagtacccatgggctggacttagatcagatcaattaggcatcacgaaagagccaagttttatttcaaaaagaagagtcccttaccatgacccacagatttcaaaatctctggagtggaatggagctatctcagagagcaatgtggttgcatcaccagaaccagaagccccggaaacaccaaaatcacaagaagcagaacaaaaggatgttattcaagaaagagttcactcactagaagcttccagggttcccaaaagaaccagatctcactctgcagactccagagctgaaggggcttcagatgtggaaaataatgagggtgtaacaaaccatacaccagttaatgaaaatgtggaactggaacattctaccaaggttctttcagaaaatgtagataatgggttggatagacttctgcgtaagaaagctggattgactgttgttccttcatataatgccttgagaaattctgaatatcaaaggcagtttgtttggaagacttctaaagaaactgctccagcttttgcagccaatcaggcttctgatgatcattgttgccagatgcagcacatatactaaatatgagacagggtaatgaaaacttggggaactggtaagtttttgcatgctacaagatttttttacttattaaaaaattattaaattgattttattctaaaatgttgtgttttgttgactaatatattgcgtgtttcctgtattctaagaaaggcgtaactgctttgaatatttaataaatacaaaatatgttgacagt

SEQ ID NO: 330067 - DNA, 894 bp, Homo sapiens
ctttctttccgtttagcaggtttaggactttttgttataattcattgagctagaaatcaagttgtatgttttgaaatgcaaatgtctgacaactttgaatccagtccttttttctttctaatggaagaatagtgtctataaataaccttataaaagatttgcttactcagaatgaggaatttcagtattaaggaagggtagcatattaaaatcaaaaattatttctacatttagtgagattattttagaaatgtgatgtaaatgccatgttaaggtatggcattttgtttttaaaaagtttagaaaagctttttgctcagaatagctgtgctttttaaagtaggataaaacagtattatgatgaattattttcaagtaatactgaaatcataggccgtgtgctctgttaatgacgggatttcaagaaggaaaaaaatttaacgataaatgttaagattaaaaggtttgatttctatatatgataaacctggaaaactactgtgaggtatcatgagagtgttagtatcttacatttcagtagattactttttttcctgactaacttgacattgataacacagtttgatgcttttaattttctgttatataaaacacaatgtttatttaatagatatttttggcaatgaatataatctcgggattttttcattgcagatgatgaggacagattgtctgagatttctgctcgctctgcagcttctagtctccgggcttttcaaactctggcacgagctaagaaaaggaaggagaatttctggggtaaaacataaacctagctgagttgcctttatctaaggaaacattggcataatttttctttattgcttactgtgttaaaattttttgagtgaagtttttcctaacattttctac

SEQ ID NO: 330068 - DNA, 2957 bp, Homo sapiens
cgccggcgcgtagtcggggacgccgggccgaggctttgctagggaacactgttatcgccccgccccctcggagctttttctccagttaactgtcggagtagcgggggctccggcgccgggcgacatgccggtgcgcttcaaggggctgagtgaataccagaggaacttcctgtggaaaaagtcttatttgtcagagtcttgtaattcctccgtggggcgaaagtacccatgggctggacttagatcagatcaattaggcatcacgaaagagccaagttttatttcaaaaagaagagtcccttaccatgacccacagatttcaaaatctctggagtggaatggagctatctcagagagcaatgtggttgcatcaccagaaccagaagccccggaaacaccaaaatcacaagaagcagaacaaaaggatgttattcaagaaagagttcactcactagaagcttccagggttcccaaaagaaccagatctcactctgcagactccagagctgaaggggcttcagatgtggaaaataatgagggtgtaacaaaccatacaccagttaatgaaaatgtggaactggaacattctaccaaggttctttcagaaaatgtagataatgggttggatagacttctgcgtaagaaagctggattgactgttgttccttcatataatgccttgagaaattctgaatatcaaaggcagtttgtttggaagacttctaaagaaactgctccagcttttgcagccaatcaggttttccacaataaaagccagtttgttccaccattcaaaggtaactcagtcatccatgaaactgaatacaaaagaaatttcaagggtttatctccagtgaaagaaccaaaattaagaaatgatttgagagaaaacagaaatcttgaaacagtgtctcctgaaaggaagagtaataaaatagacgatcgtttaaaattggaagcagagatggaattaaaagacttacaccagcctaaaaggaagcttactccttggaaacatcaaaggcttgggaaggtgaattccgaatatagagcaaaatttctgagcccagctcagtatttatataaagctggggcttggacacatgtaaagggaaacatgccaaatcaggttaaagaactccgagaaaaggctgagttttataggaagcgagttcaggggacgcatttttctcgggaccatctgaatcagattttatctgatagcaactgctgttgggatgtctcctcaaccacaagctcagaaggaaccgttagtagcaacatcagagcattagatcttgctggagatcctacaagccataagactttgcagaaatgtccttctacagaaccagaagaaaaaggaaatatcgtggaagaacagccccagaaaaataccacggagaaattgggtgtgtcagctcccaccatacccgttagaaggcggctggcttgggatacagagaacacaagtgaagacgtacagaaacagcccggggagaaagaggaggaggacgacaatgaagaggaaggggacaggaaaacgggcaagcaggcttttatgggagagcaagagaagttggatgtacatgagaaatctaaggcagataagatgaaagaagggtcagattcttctgtatcctcagaaaaaggaggccggcttcctactcccaagctgagagaacttggtggaatccagaggactcatcatgatctcactactccagctgttggtggtgctgttttagtgtctccatctaagatgaagcctccagccccagaacagaggaaaagaatgacctctcaggattgtttagaaacttcaaagaatgattttactaagaaagaaagtcgtgctgtatccctactgacttctccagctgctggtataaaaacagttgatcctctgcctttgcgggaagattctgaagacaatatccacaaatttgctgaggcaactcttccagtttcaaaaattccaaaatacccaacaaatccccctggacagttgccttctccaccacatgttccatcctactggcatccctctcgacgaattcagggctctcttagagatccagagtttcagcacaatgtgggaaaagcaaggatgaacaatttgcagttacctcaacatgaagcctttaatgatgaagatgaggacagattgtctgagatttctgctcgctctgcagcttctagtctccgggcttttcaaactctggcacgagctaagaaaaggaaggagaatttctggggtaaaacataaacctagctgagttgcctttatctaaggaaacattggcataatttttctttattgcttactgtgttaaaattttttgagtgaagtttttcctaacattttctactttgaaatatttaatttccaatagaacagtttacttggaaattgttaacataggcttatacaaatttaacttttaaagaattctttttacatctatcccagagtacaaagacctagattattgaattcttcacatgtaactttcgtaataggtgtcatggatagattttcacctatccagagagtattctaaaaaaataaacaaagtgaagtaaaagttaagatcccagtgtgaagtatatattcccctaagatttgatatatgtatctttataattgatgatgttgtaaaatgaatttgttgttcctttaacctttgctgtagtgtttctttttattttagttccttctatacatgtttgcagtgttaagataattgtactttgaaaacaccagctgtatatatttttcttatttatgtaacaaagtttgctgaaagatatgtatatttttgatctttgagtgtattctatttgtgtaaggactttggcttacatttgaataatgtctagattttgaaaaattacctgtataatggagaattaaaactttgtagacattttgaaataaaaatggatcaagtgcg

SEQ ID NO: 330069 - DNA, 3446 bp, Homo sapiens
cgccggcgcgtagtcggggacgccgggccgaggctttgctagggaacactgttatcgccccgccccctcggagctttttctccagttaactgtcggagtagcgggggctccggcgccgggcgacatgccggtgcgcttcaaggggctgagtgaataccagaggaacttcctgtggaaaaagtcttatttgtcagagtcttgtaattcctccgtggggcgaaagtacccatgggctggacttagatcagatcaattaggaaatcaaggcagatgtagaaccaagatccagcacagtgacatctcatcccttctcatcttggtctgctccacataagagaagctttgtgaaaagttccaaattttgacagtaccagggcccattgttctgttaagtagcacaggaaagtaattagaaacgaggcagcatgtactgcctggcctgccaggtctatcacgttgcaattctagtgacttttgttaggataactggaacattttgtgaccccctgatttttaattttttgttatggtcaaatttttaatgcttttaaaagcaaaattaaatattttatgttgaaaagctgtacttttaaaatcctataatctgaaggatattgtgtgtatatataggtacatatatctgaactaaatttaaaatttcatttctcctccacaagtgttcttaaaagttgtctttgtaactttttgctttagtagctactatttttgtataccgtgttttgtaggcatcacgaaagagccaagttttatttcaaaaagaagagtcccttaccatgacccacagatttcaaaatctctggagtggaatggagctatctcagagagcaatgtggttgcatcaccagaaccagaagccccggaaacaccaaaatcacaagaagcagaacaaaaggatgttattcaagaaagagttcactcactagaagcttccagggttcccaaaagaaccagatctcactctgcagactccagagctgaaggggcttcagatgtggaaaataatgagggtgtaacaaaccatacaccagttaatgaaaatgtggaactggaacattctaccaaggttctttcagaaaatgtagataatgggttggatagacttctgcgtaagaaagctggattgactgttgttccttcatataatgccttgagaaattctgaatatcaaaggcagtttgtttggaagacttctaaagaaactgctccagcttttgcagccaatcaggttttccacaataaaagccagtttgttccaccattcaaaggtaactcagtcatccatgaaactgaatacaaaagaaatttcaagggtttatctccagtgaaagaaccaaaattaagaaatgatttgagagaaaacagaaatcttgaaacagtgtctcctgaaaggaagagtaataaaatagacgatcgtttaaaattggaagcagagatggaattaaaagacttacaccagcctaaaaggaagcttactccttggaaacatcaaaggcttgggaaggtgaattccgaatatagagcaaaatttctgagcccagctcagtatttatataaagctggggcttggacacatgtaaagggaaacatgccaaatcaggttaaagaactccgagaaaaggctgagttttataggaagcgagttcaggggacgcatttttctcgggaccatctgaatcagattttatctgatagcaactgctgttgggatgtctcctcaaccacaagctcagaaggaaccgttagtagcaacatcagagcattagatcttgctggagatcctacaagccataagactttgcagaaatgtccttctacagaaccagaagaaaaaggaaatatcgtggaagaacagccccagaaaaataccacggagaaattgggtgtgtcagctcccaccatacccgttagaaggcggctggcttgggatacagagaacacaagtgaagacgtacagaaacagcccggggagaaagaggaggaggacgacaatgaagaggaaggggacaggaaaacgggcaagcaggcttttatgggagagcaagagaagttggatgtacatgagaaatctaaggcagataagatgaaagaagggtcagattcttctgtatcctcagaaaaaggaggccggcttcctactcccaagctgagagaacttggtggaatccagaggactcatcatgatctcactactccagctgttggtggtgctgttttagtgtctccatctaagatgaagcctccagccccagaacagaggaaaagaatgacctctcaggattgtttagaaacttcaaagaatgattttactaagaaagaaagtcgtgctgtatccctactgacttctccagctgctggtataaaaacagttgatcctctgcctttgcgggaagattctgaagacaatatccacaaatttgctgaggcaactcttccagtttcaaaaattccaaaatacccaacaaatccccctggacagttgccttctccaccacatgttccatcctactggcatccctctcgacgaattcagggctctcttagagatccagagtttcagcacaatgtgggaaaagcaaggatgaacaatttgcagttacctcaacatgaagcctttaatgatgaagatgaggacagattgtctgagatttctgctcgctctgcagcttctagtctccgggcttttcaaactctggcacgagctaagaaaaggaaggagaatttctggggtaaaacataaacctagctgagttgcctttatctaaggaaacattggcataatttttctttattgcttactgtgttaaaattttttgagtgaagtttttcctaacattttctactttgaaatatttaatttccaatagaacagtttacttggaaattgttaacataggcttatacaaatttaacttttaaagaattctttttacatctatcccagagtacaaagacctagattattgaattcttcacatgtaactttcgtaataggtgtcatggatagattttcacctatccagagagtattctaaaaaaataaacaaagtgaagtaaaagttaagatcccagtgtgaagtatatattcccctaagatttgatatatgtatctttataattgatgatgttgtaaaatgaatttgttgttcctttaacctttgctgtagtgtttctttttattttagttccttctatacatgtttgcagtgttaagataattgtactttgaaaacaccagctgtatatatttttcttatttatgtaacaaagtttgctgaaagatatgtatatttttgatctttgagtgtattctatttgtgtaaggactttggcttacatttgaataatgtctagattttgaaaaattacctgtataatggagaattaaaactttgtagacattttgaaataaaaatggatcaagtgcg

SEQ ID NO: 330070 - DNA, 1927 bp, Homo sapiens
tctgatgactgtatgtggctaattttgccttcctttgtctttggtccctggctgtatttgtgcaatgtctttgatatgctacttggtgctgtttgtaaagaagcatttacaatagtatatgatgtctgaactctcctgaataggttaaagaactccgagaaaaggctgagttttataggaagcgagttcaggggacgcatttttctcgggaccatctgaatcagattttatctgatagcaactgctgttgggatgtctcctcaaccacaagctcagaaggaaccgttagtagcaacatcagagcattagatcttgctggaaccagaagaaaaaggaaatatcgtggaagaacagccccagaaaaataccacggagaaattgggtgtgtcagctcccaccatacccgttagaaggcggctggcttgggatacagagaacacaagtgaagacgtacagaaacagcccggggagaaagaggaggaggacgacaatgaagaggaaggggacaggaaaacgggcaagcaggcttttatgggagagcaagagaagttggatgtacatgagaaatctaaggcagataagatgaaagaagggtcagattcttctgtatcctcagaaaaaggaggccggcttcctactcccaagctgagagaacttggtggaatccagaggactcatcatgatctcactactccagctgttggtggtgctgttttagtgtctccatctaagatgaagcctccagccccagaacagaggaaaagaatgacctctcaggattgtttagaaacttcaaagaatgattttactaagaaagaaagtcgtgctgtatccctactgacttctccagctgctggtataaaaacagttgatcctctgcctttgcgggaagattctgaagacaatatccacaaatttgctgaggcaactcttccagtttcaaaaattccaaaatacccaacaaatccccctggacagttgccttctccaccacatgttccatcctactggcatccctctcgacgaattcagggctctcttagagatccagagtttcagcacaatgtgggaaaagcaaggatgaacaatttgcagttacctcaacatgaagcctttaatgatgaagatgaggacagattgtctgagatttctgctcgctctgcagcttctagtctccgggcttttcaaactctggcacgagctaagaaaaggaaggagaatttctggggtaaaacataaacctagctgagttgcctttatctaaggaaacattggcataatttttctttattgcttactgtgttaaaattttttgagtgaagtttttcctaacattttctactttgaaatatttaatttccaatagaacagtttacttggaaattgttaacataggcttatacaaatttaacttttaaagaattctttttacatctatcccagagtacaaagacctagattattgaattcttcacatgtaactttcgtaataggtgtcatggatagattttcacctatccagagagtattctaaaaaaataaacaaagtgaagtaaaagttaagatcccagtgtgaagtatatattcccctaagatttgatatatgtatctttataattgatgatgttgtaaaatgaatttgttgttcctttaacctttgctgtagtgtttctttttattttagttccttctatacatgtttgcagtgttaagataattgtactttgaaaacaccagctgtatatatttttcttatttatgtaacaaagtttgctgaaagatatgtatatttttgatctttgagtgtattctatttgtgtaaggactttggcttacatttgaataatgtctagattttgaaaaattacctgtataatggagaattaaaactttgtagacattttgaaataaaaatggatcaagtgcg

SEQ ID NO: 330071 - DNA, 2272 bp, Homo sapiens
  misc_feature (1609)..(1609): n is a, c, g, or t
cgccggcgcgtagtcggggacgccgggccgaggctttgctagggaacactgttatcgccccgccccctcggagctttttctccagttaactgtcggagtagcgggggctccggcgccgggcgacatgccggtgcgcttcaaggggctgagtgaataccagaggaacttcctgtggaaaaagtcttatttgtcagagtcttgtaattcctccgtggggcgaaagtacccatgggctggacttagatcagatcaattaggcatcacgaaagagccaagttttatttcaaaaagaagagtcccttaccatgacccacagatttcaaaatctctggagtggaatggagctatctcagagagcaatgtggttgcatcaccagaaccagaagccccggaaacaccaaaatcacaagaagcagaacaaaaggatgttattcaagaaagagttcactcactagaagcttccagggttcccaaaagaaccagatctcactctgcagactccagagctgaaggggcttcagatgtggaaaataatgagggtgtaacaaaccatacaccagttaatgaaaatgtggaactggaacattctaccaaggttctttcagaaaatgtagataatggggtaggcatattcactgcatttcttttcaaaagcatagaattcttcattggtttcattgtcatttctgtaatattacattttgtgtttcagaattttccattgttgttttcttgtctaatgtctataagaatagttgataacaggctgttgactttagttattgtgaattagttctattctgactactcgctattttgtagtagttgtactatgataatctgtttattggatggacctcctgcgtctggattttattcatcatatattagcacctgagtcctaagggagagatcaagttgagacagagaagggaagtaggcccttacttctggcagggtgctgagctgacttctacctagccccttttcagtttcttatcgtgtacaagaagacaaacagaaattcaattgatgaaatgcaaaaggaaggagagctctggctgtctctcagagatcttgcatttctgctctcttatgtcacagctggcctgcagcaggtccctgtgagcacataagcagaggctgcaggaacttgtgtggggatctcaatgctttccacatttctttctccattctgttccactgctcttctctggttcatgtccaccactgactgggaccctgaagaggcatttcagagtgttggagaagaatctgtagcttgttgaaaaagctgggggtgaaagggaacaaggaaggtgatgtgtgagtctggcaggcaggagaaggggtgttcatagaagcagtgtgcaggtgaggcaaagtgctgggactttttggtaatagatttaattatgaatgattagtaggaaaggactgagagtattatatttttcctgggatgcctaatagtcctttgatagaaaggaattttaaatagtttgacacttgaaaaaagatactatttataagttgaagaaagtttgctgtaccacaatgcgcatgtagttaacaattttgcactgtagatttaacattttgttaagangatagatttcatgttatgcattttttaccacaatttttaaaaagtttgaatagaaatttttaatgtctttgagtggattttgttttttgaacagttggatagacttctgcgtaagaaagctggattgactgttgttccttcatataatgccttgagaaattctgaatatcaaaggcagtttgtttggaagacttctaaagaaactgctccagcttttgcagccaatcaggtagcttaatggatgtaatacatttctgagtaccattatcttatctagtaatgtagatttacatagaattaagagttgaaagaaattaagtacttaagtagcctggaggtaggttctagaaaaccaaaatgagagttttgctaaaatcatcctattacttatgatttatggtagtaatattatactgtcctaggcttctgatgatcattgttgccagatgcagcacatatactaaatatgagacagggtaatgaaaacttggggaactggtaagtttttgcatgctacaagatttttttacttattaaaaaattattaaattgattttattctaaaatgttgtgttttgttgactaatatattgcgtgtttcctgtattctaagaaaggcgtaactgctttgaatatttaataaatacaaaatatgttgacagt

SEQ ID NO: 330072 - DNA, 2656 bp, Homo sapiens
cgccggcgcgtagtcggggacgccgggccgaggctttgctagggaacactgttatcgccccgccccctcggagctttttctccagttaactgtcggagtagcgggggctccggcgccgggcgacatgccggtgcgcttcaaggggctgagtgaataccagaggaacttcctgtggaaaaagtcttatttgtcagagtcttgtaattcctccgtggggcgaaagtacccatgggctggacttagatcagatcaattaggcatcacgaaagagccaagttttatttcaaaaagaagagtcccttaccatgacccacagatttcaaaatctctggagtggaatggagctatctcagagagcaatgtggttgcatcaccagaaccagaagccccggaaacaccaaaatcacaagaagcagaacaaaaggatgttattcaagaaagagttcactcactagaagcttccagggttcccaaaagaaccagatctcactctgcagactccagagctgaaggggcttcagatgtggaaaataatgagggtgtaacaaaccatacaccagttaatgaaaatgtggaactggaacattctaccaaggttctttcagaaaatgtagataatgggttggatagacttctgcgtaagaaagctggattgactgttgttccttcatataatgccttgagaaattctgaatatcaaaggcagtttgtttggaagacttctaaagaaactgctccagcttttgcagccaatcaggttttccacaataaaagccagtttgttccaccattcaaaggtaactcagtcatccatgaaactgaatacaaaagaaatttcaagggtttatctccagtgaaagaaccaaaattaagaaatgatttgagagaaaacagaaatcttgaaacagtgtctcctgaaaggaagagtaataaaatagacgatcgtttaaaattggaagcagagatggaattaaaagacttacaccagcctaaaaggaagcttactccttggaaacatcaaaggcttgggaaggtgaattccgaatatagagcaaaatttctgagcccagctcagtatttatataaagctggggcttggacacatgtaaagggaaacatgccaaatcaggttaaagaactccgagaaaaggctgagttttataggaagcgagttcaggggacgcatttttctcgggaccatctgaatcagattttatctgatagcaactgctgttgggatgtctcctcaaccacaagctcagaaggaaccgttagtagcaacatcagagcattagatcttgctggagatcctacaagccataagactttgcagaaatgtccttctacagaaccagaagaaaaaggaaatatcgtggaagaacagccccagaaaaataccacggagaaattgggtgtgtcagctcccaccatacccgttagaaggcggctggcttgggatacagagaacacaagtgaagacgtacagaaacagcccggggagaaagaggaggaggacgacaatgaagaggaaggggacaggaaaacgggcaagcaggcttttatgggagagcaagagaagttggatgtacatgagaaatctaaggcagataagatgaaagaagggtcagattcttctgtatcctcagaaaaaggaggccggcttcctactcccaagctgagagaacttggtggaatccagaggactcatcatgatctcactactccagctgttggtggtgctgttttagtgtctccatctaagatgaagcctccagccccagaacagaggaaaagaatgacctctcaggattgtttagaaacttcaaagaatgattttactaagaaagaaagtcgtgctgtatccctactgacttctccagctgctggtataaaaacagttgatcctctgcctttgcgggaagattctgaagacaatatccacaaatttgctgaggcaactcttccagtttcaaaaattccaaaatacccaacaaatccccctggacagttgccttctccaccacatgttccatcctactggcatccctctcgacgaattcagggctctcttagagatccagagtttcagcacaatgtgggaaaagcaaggatgaacaatttgcagttacctcaacatgaagcctttaatgatgaagatgaggacagattgtctgagatttctgctcgctctgcagcttctagtctccgggcttttcaaactctggcacgagctaagaaaaggaaggagaatttctggggtaaaacataaacctagctgagttgcctttatctaaggaaacattggcataatttttctttattgcttactgtgttaaaattttttgagtgaagtttttcctaacattttctactttgaaatatttaatttccaatagaacagtttacttggaaattgttaacataggcttatacaaatttaacttttaaagaattctttttacatctatcccagagtacaaagacctagattattgaattcttcacatgtaactttcgtaataggtgtcatggatagattttcacctatccagagagtattctaaaaaaataaacaaagtgaagtaaaagttaagatcccagcggcgagcatctaattcatcctaagatcggaatccggctctttaaaatgaggaag

SEQ ID NO: 330073 - DNA, 2652 bp, Homo sapiens
cgccggcgcgtagtcggggacgccgggccgaggctttgctagggaacactgttatcgccccgccccctcggagctttttctccagttaactgtcggagtagcgggggctccggcgccgggcgacatgccggtgcgcttcaaggggctgagtgaataccagaggaacttcctgtggaaaaagtcttatttgtcagagtcttgtaattcctccgtggggcgaaagtacccatgggctggacttagatcagatcaattaggcatcacgaaagagccaagttttatttcaaaaagaagagtcccttaccatgacccacagatttcaaaatctctggagtggaatggagctatctcagagagcaatgtggttgcatcaccagaaccagaagccccggaaacaccaaaatcacaagaagcagaacaaaaggatgttattcaagaaagagttcactcactagaagcttccagggttcccaaaagaaccagatctcactctgcagactccagagctgaaggggcttcagatgtggaaaataatgagggtgtaacaaaccatacaccagttaatgaaaatgtggaactggaacattctaccaaggttctttcagaaaatgtagataatgggttggatagacttctgcgtaagaaagctggattgactgttgttccttcatataatgccttgagaaattctgaatatcaaaggcagtttgtttggaagacttctaaagaaactgctccagcttttgcagccaatcaggttttccacaataaaagccagtttgttccaccattcaaaggtaactcagtcatccatgaaactgaatacaaaagaaatttcaagggtttatctccagtgaaagaaccaaaattaagaaatgatttgagagaaaacagaaatcttgaaacagtgtctcctgaaaggaagagtaataaaatagacgatcgtttaaaattggaagcagagatggaattaaaagacttacaccagcctaaaaggaagcttactccttggaaacatcaaaggcttgggaaggtgaattccgaatatagagcaaaatttctgagcccagctcagtatttatataaagctggggcttggacacatgtaaagggaaacatgccaaatcaggttaaagaactccgagaaaaggctgagttttataggaagcgagttcaggggacgcatttttctcgggaccatctgaatcagattttatctgatagcaactgctgttgggatgtctcctcaaccacaagctcagaaggaaccgttagtagcaacatcagagcattagatcttgctggagatcctacaagccataagactttgcagaaatgtccttctacagaaccagaagaaaaaggaaatatcgtggaagaacagccccagaaaaataccacggagaaattgggtgtgtcagctcccaccatacccgttagaaggcggctggcttgggatacagagaacacaagtgaagacgtacagaaacagcccggggagaaagaggaggaggacgacaatgaagaggaaggggacaggaaaacgggcaagcaggcttttatgggagagcaagagaagttggatgtacatgagaaatctaaggcagataagatgaaagaagggtcagattcttctgtatcctcagaaaaaggaggccggcttcctactcccaagctgagagaacttggtggaatccagaggactcatcatgatctcactactccagctgttggtggtgctgttttagtgtctccatctaagatgaagcctccagccccagaacagaggaaaagaatgacctctcaggattgtttagaaacttcaaagaatgattttactaagaaagaaagtcgtgctgtatccctactgacttctccagctgctggtataaaaacagttgatcctctgcctttgcgggaagattctgaagacaatatccacaaatttgctgaggcaactcttccagtttcaaaaattccaaaatacccaacaaatccccctggacagttgccttctccaccacatgttccatcctactggcatccctctcgacgaattcagggctctcttagagatccagagtttcagcacaatgtgggaaaagcaaggatgaacaatttgcagttacctcaacatgaagcctttaatgatgaagatgaggacagattgtctgagatttctgctcgctctgcagcttctagtctccgggcttttcaaactctggcacgagctaagaaaaggaaggagaatttctggggtaaaacataaacctagctgagttgcctttatctaaggaaacattggcataatttttctttattgcttactgtgttaaaattttttgagtgaagtttttcctaacattttctactttgaaatatttaatttccaatagaacagtttacttggaaattgttaacataggcttatacaaatttaacttttaaagaattctttttacatctatcccagagtacaaagacctagattattgaattcttcacatgtaactttcggaaaggggtggacgatgaattcaccccccccagagggtttaaaaaaaaacaaagggaaagaagtgaaacccggggagaagattaccccaaattgaaattgactttaagggggaggggaaaagaatgtggtccttg

SEQ ID NO: 330074 - DNA, 2618 bp, Homo sapiens
cgccggcgcgtagtcggggacgccgggccgaggctttgctagggaacactgttatcgccccgccccctcggagctttttctccagttaactgtcggagtagcgggggctccggcgccgggcgacatgccggtgcgcttcaaggggctgagtgaataccagaggaacttcctgtggaaaaagtcttatttgtcagagtcttgtaattcctccgtggggcgaaagtacccatgggctggacttagatcagatcaattaggcatcacgaaagagccaagttttatttcaaaaagaagagtcccttaccatgacccacagatttcaaaatctctggagtggaatggagctatctcagagagcaatgtggttgcatcaccagaaccagaagccccggaaacaccaaaatcacaagaagcagaacaaaaggatgttattcaagaaagagttcactcactagaagcttccagggttcccaaaagaaccagatctcactctgcagactccagagctgaaggggcttcagatgtggaaaataatgagggtgtaacaaaccatacaccagttaatgaaaatgtggaactggaacattctaccaaggttctttcagaaaatgtagataatgggttggatagacttctgcgtaagaaagctggattgactgttgttccttcatataatgccttgagaaattctgaatatcaaaggcagtttgtttggaagacttctaaagaaactgctccagcttttgcagccaatcaggttttccacaataaaagccagtttgttccaccattcaaaggtaactcagtcatccatgaaactgaatacaaaagaaatttcaagggtttatctccagtgaaagaaccaaaattaagaaatgatttgagagaaaacagaaatcttgaaacagtgtctcctgaaaggaagagtaataaaatagacgatcgtttaaaattggaagcagagatggaattaaaagacttacaccagcctaaaaggaagcttactccttggaaacatcaaaggcttgggaaggtgaattccgaatatagagcaaaatttctgagcccagctcagtatttatataaagctggggcttggacacatgtaaagggaaacatgccaaatcaggttaaagaactccgagaaaaggctgagttttataggaagcgagttcaggggacgcatttttctcgggaccatctgaatcagattttatctgatagcaactgctgttgggatgtctcctcaaccacaagctcagaaggaaccgttagtagcaacatcagagcattagatcttgctggagatcctacaagccataagactttgcagaaatgtccttctacagaaccagaagaaaaaggaaatatcgtggaagaacagccccagaaaaataccacggagaaattgggtgtgtcagctcccaccatacccgttagaaggcggctggcttgggatacagagaacacaagtgaagacgtacagaaacagcccggggagaaagaggaggaggacgacaatgaagaggaaggggacaggaaaacgggcaagcaggcttttatgggagagcaagagaagttggatgtacatgagaaatctaaggcagataagatgaaagaagggtcagattcttctgtatcctcagaaaaaggaggccggcttcctactcccaagctgagagaacttggtggaatccagaggactcatcatgatctcactactccagctgttggtggtgctgttttagtgtctccatctaagatgaagcctccagccccagaacagaggaaaagaatgacctctcaggattgtttagaaacttcaaagaatgattttactaagaaagaaagtcgtgctgtatccctactgacttctccagctgctggtataaaaacagttgatcctctgcctttgcgggaagattctgaagacaatatccacaaatttgctgaggcaactcttccagtttcaaaaattccaaaatacccaacaaatccccctggacagttgccttctccaccacatgttccatcctactggcatccctctcgacgaattcagggctctcttagagatccagagtttcagcacaatgtgggaaaagcaaggatgaacaatttgcagttacctcaacatgaagcctttaatgatgaagatgaggacagattgtctgagatttctgctcgctctgcagcttctagtctccgggcttttcaaactctggcacgagctaagaaaaggaaggagaatttctggggtaaaacataaacctagctgagttgcctttatctaaggaaacattggcataatttttctttattgcttactgtgttaaaattttttgagtgaagtttttcctaacattttctactttgaaatatttaatttccaatagaacagtttacttggaaattgttaacataggcttatacaaatttaacttttaaagaattcttctccatctttgcaaagtccaagacctacctcttggagtgctgaaatgtaacttgcgaatacgcgggaggatagattctcactacccgaagaggttcgtaaaaatgaacaagtggatgaacgctacgatccatgtgggagcctatcccctaaacttgaaatg

SEQ ID NO: 330075 - DNA, 2579 bp, Homo sapiens
  misc_feature (2375)..(2375): n is a, c, g, or t
  misc_feature (2488)..(2488): n is a, c, g, or t
  misc_feature (2497)..(2497): n is a, c, g, or t
cgccggcgcgtagtcggggacgccgggccgaggctttgctagggaacactgttatcgccccgccccctcggagctttttctccagttaactgtcggagtagcgggggctccggcgccgggcgacatgccggtgcgcttcaaggggctgagtgaataccagaggaacttcctgtggaaaaagtcttatttgtcagagtcttgtaattcctccgtggggcgaaagtacccatgggctggacttagatcagatcaattaggcatcacgaaagagccaagttttatttcaaaaagaagagtcccttaccatgacccacagatttcaaaatctctggagtggaatggagctatctcagagagcaatgtggttgcatcaccagaaccagaagccccggaaacaccaaaatcacaagaagcagaacaaaaggatgttattcaagaaagagttcactcactagaagcttccagggttcccaaaagaaccagatctcactctgcagactccagagctgaaggggcttcagatgtggaaaataatgagggtgtaacaaaccatacaccagttaatgaaaatgtggaactggaacattctaccaaggttctttcagaaaatgtagataatgggttggatagacttctgcgtaagaaagctggattgactgttgttccttcatataatgccttgagaaattctgaatatcaaaggcagtttgtttggaagacttctaaagaaactgctccagcttttgcagccaatcaggttttccacaataaaagccagtttgttccaccattcaaaggtaactcagtcatccatgaaactgaatacaaaagaaatttcaagggtttatctccagtgaaagaaccaaaattaagaaatgatttgagagaaaacagaaatcttgaaacagtgtctcctgaaaggaagagtaataaaatagacgatcgtttaaaattggaagcagagatggaattaaaagacttacaccagcctaaaaggaagcttactccttggaaacatcaaaggcttgggaaggtgaattccgaatatagagcaaaatttctgagcccagctcagtatttatataaagctggggcttggacacatgtaaagggaaacatgccaaatcaggttaaagaactccgagaaaaggctgagttttataggaagcgagttcaggggacgcatttttctcgggaccatctgaatcagattttatctgatagcaactgctgttgggatgtctcctcaaccacaagctcagaaggaaccgttagtagcaacatcagagcattagatcttgctggagatcctacaagccataagactttgcagaaatgtccttctacagaaccagaagaaaaaggaaatatcgtggaagaacagccccagaaaaataccacggagaaattgggtgtgtcagctcccaccatacccgttagaaggcggctggcttgggatacagagaacacaagtgaagacgtacagaaacagcccggggagaaagaggaggaggacgacaatgaagaggaaggggacaggaaaacgggcaagcaggcttttatgggagagcaagagaagttggatgtacatgagaaatctaaggcagataagatgaaagaagggtcagattcttctgtatcctcagaaaaaggaggccggcttcctactcccaagctgagagaacttggtggaatccagaggactcatcatgatctcactactccagctgttggtggtgctgttttagtgtctccatctaagatgaagcctccagccccagaacagaggaaaagaatgacctctcaggattgtttagaaacttcaaagaatgattttactaagaaagaaagtcgtgctgtatccctactgacttctccagctgctggtataaaaacagttgatcctctgcctttgcgggaagattctgaagacaatatccacaaatttgctgaggcaactcttccagtttcaaaaattccaaaatacccaacaaatccccctggacagttgccttctccaccacatgttccatcctactggcatccctctcgacgaattcagggctctcttagagatccagagtttcagcacaatgtgggaaaagcaaggatgaacaatttgcagttacctcaacatgaagcctttaatgatgaagatgaggacagattgtctgagatttctgctcgctctgcagcttctagtctccgggcttttcaaactctggcacgagctaagaaaaggaaggagaatttctggggtaaaacataaacctagctgagttgcctttatctaaggaaacattggcataatttttctttattgcttactgtgttacagaacattatgctctccctttatacctttacatctagcncttcaatactaccccttctcttcaaaatgcgtaccacatcccctacaaccctcacctcttcaatagcctattttgcatctatcccagaggccgaaatcctagccccccaaatnacccacagntcccattgtccacgctgcccggcctctcccgatctattccaacatgtttataccactaacctccccatatcaacctcactca

SEQ ID NO: 330076 - DNA, 2523 bp, Homo sapiens
cgccggcgcgtagtcggggacgccgggccgaggctttgctagggaacactgttatcgccccgccccctcggagctttttctccagttaactgtcggagtagcgggggctccggcgccgggcgacatgccggtgcgcttcaaggggctgagtgaataccagaggaacttcctgtggaaaaagtcttatttgtcagagtcttgtaattcctccgtggggcgaaagtacccatgggctggacttagatcagatcaattaggcatcacgaaagagccaagttttatttcaaaaagaagagtcccttaccatgacccacagatttcaaaatctctggagtggaatggagctatctcagagagcaatgtggttgcatcaccagaaccagaagccccggaaacaccaaaatcacaagaagcagaacaaaaggatgttattcaagaaagagttcactcactagaagcttccagggttcccaaaagaaccagatctcactctgcagactccagagctgaaggggcttcagatgtggaaaataatgagggtgtaacaaaccatacaccagttaatgaaaatgtggaactggaacattctaccaaggttctttcagaaaatgtagataatgggttggatagacttctgcgtaagaaagctggattgactgttgttccttcatataatgccttgagaaattctgaatatcaaaggcagtttgtttggaagacttctaaagaaactgctccagcttttgcagccaatcaggttttccacaataaaagccagtttgttccaccattcaaaggtaactcagtcatccatgaaactgaatacaaaagaaatttcaagggtttatctccagtgaaagaaccaaaattaagaaatgatttgagagaaaacagaaatcttgaaacagtgtctcctgaaaggaagagtaataaaatagacgatcgtttaaaattggaagcagagatggaattaaaagacttacaccagcctaaaaggaagcttactccttggaaacatcaaaggcttgggaaggtgaattccgaatatagagcaaaatttctgagcccagctcagtatttatataaagctggggcttggacacatgtaaagggaaacatgccaaatcaggttaaagaactccgagaaaaggctgagttttataggaagcgagttcaggggacgcatttttctcgggaccatctgaatcagattttatctgatagcaactgctgttgggatgtctcctcaaccacaagctcagaaggaaccgttagtagcaacatcagagcattagatcttgctggagatcctacaagccataagactttgcagaaatgtccttctacagaaccagaagaaaaaggaaatatcgtggaagaacagccccagaaaaataccacggagaaattgggtgtgtcagctcccaccatacccgttagaaggcggctggcttgggatacagagaacacaagtgaagacgtacagaaacagcccggggagaaagaggaggaggacgacaatgaagaggaaggggacaggaaaacgggcaagcaggcttttatgggagagcaagagaagttggatgtacatgagaaatctaaggcagataagatgaaagaagggtcagattcttctgtatcctcagaaaaaggaggccggcttcctactcccaagctgagagaacttggtggaatccagaggactcatcatgatctcactactccagctgttggtggtgctgttttagtgtctccatctaagatgaagcctccagccccagaacagaggaaaagaatgacctctcaggattgtttagaaacttcaaagaatgattttactaagaaagaaagtcgtgctgtatccctactgacttctccagctgctggtataaaaacagttgatcctctgcctttgcgggaagattctgaagacaatatccacaaatttgctgaggcaactcttccagtttcaaaaattccaaaatacccaacaaatccccctggacagttgccttctccaccacatgttccatcctactggcatccctctcgacgaattcagggctctcttagagatccagagtttcagcacaatgtgggaaaagcaaggatgaacaatttgcagttacctcaacatgaagcctttaatgatgaagatgaggacagattgtctgagatttctgctcgctctgcagcttctagtctccgggcttttcaaactctggcacgagctaagaaaaggaaggagatgaggaaactgaggtttacagaaactgagtaacttcgccaagtccatatccttcataaatggtgtagttggggctgcaagccatgcctaactggccttggagaccagattgctctgatgtttgaaggaagcttccatggctgttccggggtgtggcaggcgacctcacaaaacttgttctacatgttggccaaagatctgctaatttcctacttaggcaacattgtacaatccagttctaacagtaatagaattttctctataaactcttaaag

SEQ ID NO: 330077 - DNA, 373 bp, Homo sapiens
tgactcgttatgcaactttcggcaagtttccttacatcgccacgccccagtgctcttaactgtcagatgaaaatgagagaatgtgtttccggaggctgtttgagaattaaatgaggaggtatataaatatactcccccttggacagtgtcaggtctatgaagctcccagcacagcagctgcttcctcttttctttattctaagttgctgtaaacccatgtatctatggtgcaacgcaatgactcaatccttgcttatttaatgtggctatcctgcccaacctaagtcctgactatcaaggtactgaggtgctgtatgctgaagcagcaaataaacaattcacattggacaagaagatggaaacaagtgtgagg

SEQ ID NO: 330078 - DNA, 2069 bp, Homo sapiens
ggggggacgcgagcgggatccaaacttccggtgcctgcagagctcggagcggcggaggcagagaccgaggctgcaccggcagaggctgcggggcggacgcgcgggccggcgcagccatggtgaagattagcttccagcccgccgtggctggcatcaagggcgacaaggctgacaaggcgtcggcgtcggcccctgcgccggcctcggccaccgagatcctgctgacgccggctagggaggagcagcccccacaacatcgatccaagagggggagctcagtgggcggcgtgtgctacctgtcgatgggcatggtcgtgctgctcatgggcctcgtgttcgcctctgtctacatctacagatacttctttcttgcacagctggcccgagataacttcttccgctgtggtgtgctgtatgaggactccctgtcctcccaggtccggactcagatggagctggaagaggatgtgaaaatctacctcgacgagaactacgagcgcatcaacgtgcctgtgccccagtttggcggcggtgaccctgcagacatcatccatgacttccagcggggtctgactgcgtaccatgatatctccctggacaagtgctatgtcatcgaactcaacaccaccattgtgctgccccctcgcaacttctgggagctcctcatgaacgtgaagagggggacctacctgccgcagacgtacatcatccaggaggagatggtggtcacggagcatgtcagtgacaaggaggccctggggtccttcatctaccacctgtgcaacgggaaagacacctaccggctccggcgccgggcaacgcggaggcggatcaacaagcgtggggccaagaactgcaatgccatccgccacttcgagaacaccttcgtggtggagacgctcatctgcggggtggtgtgaggccctcctcccccagaaccccctgccgtgttcctcttttcttctttccggctgctctctggccctcctccttccccctgcttagcttgtactttggacgcgtttctatagaggtgacatgtctctccattcctctccaaccctgcccacctccctgtaccagagctgtgatctctcggtggggggcccatctctgctgacctgggtgtggcggagggagaggcgatgctgcaaagtgttttctgtgtcccactgtcttgaagctgggcctgccaaagcctgggcccacagctgcaccggcagcccaaggggaaggaccggttgggggagccgggcatgtgaggccctgggcaaggggatggggctgtgggggcggggcggcatgggcttcagaagtatctgcacaattagaaaagtcctcagaagctttttcttggagggtacactttcttcactgtccctattcctagacctggggcttgagctgaggatgggacgatgtgcccagggagggacccaccagagcacaagagaaggtggctacctgggggtgtcccagggactctgtcagtgccttcagcccaccagcaggagcttggagtttggggagtggggatgagtccgtcaagcacaactgttctctgagtggaaccaaagaagcaaggagctaggacccccagtcctgccccccaggagcacaagcagggtcccctcagtcaaggcagtgggatgggcggctgaggaacggggcaggcaaggtcactgctcagtcacgtccacgggggacgagccgtgggttctgctgagtaggtggagctcattgctttctccaagcttggaactgttttgaaagataacacagagggaaagggagagccacctggtacttgtccaccctgcctcctctgttctgaaattccatccccctcagcttaggggaatgcacctttttccctttccttctcacttttgcatgtttttactgatcattcgatatgctaaccgttctcagccctgagccttggagaggagggctgtaacgccttcagtcagtctctggggatgaaactcttaaatgctttgtatattttctcaattagatctcttttcagaagtgtctatagaacaataaaaatcttttacttctga

SEQ ID NO: 330079 - DNA, 242 bp, Homo sapiens
gcggccgcctactactactactactactgctcgaattcaagcttctaacgatgtacggggacttgcatgtttttactgatcattcgatatgctaaccgttctcagccctgagccttggagaggagggctgtaacgccttcagtcagtctctggggatgaaactcttaaatgctttgtatattttctcaattagatctcttttcagaagtgtctatagaacaataaaaatcttttacttctga

SEQ ID NO: 330080 - DNA, 2437 bp, Homo sapiens
ggggggacgcgagcgggatccaaacttccggtgcctgcagagctcggagcggcggaggcagagaccgaggctgcaccggcagaggctgcggggcggacgcgcgggccggcgcagccatggtgaagattagcttccagcccgccgtggctggcatcaagggcgacaaggctgacaaggcgtcggcgtcggcccctgcgccggcctcggccaccgagatcctgctgacgccggctagggaggagcagcccccacaacatcgatccaagagggggagctcagtgggcggcgtgtgctacctgtcgatgggcatggtcgtgctgctcatgggcctcgtgttcgcctctgtctacatctacagatacttctttcttgcacagctggcccgagataacttcttccgctgtggtgtgctgtatgaggactccctgtcctcccaggtccggactcagatggagctggaagaggatgtgaaaatctacctcgacgagaactacgagcgcatcaacgtgcctgtgccccagtttggcggcggtgaccctgcagacatcatccatgacttccagcggggtctgactgcgtaccatgatatctccctggacaagtgctatgtcatcgaactcaacaccaccattgtgctgccccctcgcaacttctgggagctcctcatgaacgtgaagagggggacctacctgccgcagacgtacatcatccaggaggagatggtggtcacggagcatgtcagtgacaaggaggccctggggtccttcatctaccacctgtgcaacgggaaagacacctaccggctccggcgccgggcaacgcggaggcggatcaacaagcgtggggccaagaactgcaatgccatccgccacttcgagaacaccttcgtggtggagacgctcatctgcggggtggtgtgaggccctcctcccccagaaccccctgccgtgttcctcttttcttctttccggctgctctctggccctcctccttccccctgcttagcttgtactttggacgcgtttctatagaggtgacatgtctctccattcctctccaaccctgcccacctccctgtaccagagctgtgatctctcggtggggggcccatctctgctgacctgggtgtggcggagggagaggcgatgctgcaaagtgttttctgtgtcccactgtcttgaagctgggcctgccaaagcctgggcccacagctgcaccggcagcccaaggggaaggaccggttgggggagccgggcatgtgaggccctgggcaaggggatggggctgtgggggcggggcggcatgggcttcagaagtatctgcacaattagaaaagtcctcagaagctttttcttggagggtacactttcttcactgtccctattcctagacctggggcttgagctgaggatgggacgatgtgcccagggagggacccaccagagcacaagagaaggtggctacctgggggtgtcccagggactctgtcagtgccttcagcccaccagcaggagcttggagtttggggagtggggatgagtccgtcaagcacaactgttctctgagtggaaccaaagaagcaaggagctaggacccccagtcctgccccccaggagcacaagcagggtcccctcagtcaaggcagtgggatgggcggctgaggaacggggcaggcaaggtcactgctcagtcacgtccacgggggacgagccgtgggttctgctgagtaggtggagctcattgctttctccaagcttggaactgttttgaaagataacacagagggaaagggagagccacctggtacttgtccaccctgcctcctctgttctgaaattccatccccctcagcttaggggaatgcacctttttccctttccttctcacttttgcatgtttttactgatcattcgatatgctaaccgttctcagccctgagccttggagaggagggctgtaacgccttcagtcagtctctggggatgaaactcttaaatgctttgtatattttctcaattagatctcttttcagaagtgtctatagaacaataaaaatcttttacttctgaaaaaaaagaaaaaccacccacaccaacacacacagaaaaaaccgcgggcggcacacaaaccggggcggcgaaaacgcgggacgaacaggggcacaggccacacacgggtatcgcgacacccacacttctgcacaccagggacaacacacgcggggacaccaataggacgcggcagcaataaaacgcacagaaaaaccggggagtacccccggcatcagagaggccggccacaacagaccacgacacgacgcgcaccgggaggcgagaccaccacaccaccacccagcccgcaggcgacacaaccacccaacccgcacaacaagccggcacgacagccacacgacaacaccagcgcaccaccacaagaa

SEQ ID NO: 330081 - DNA, 1969 bp, Homo sapiens
ggggggacgcgagcgggatccaaacttccggtgcctgcagagctcggagcggcggaggcagagaccgaggctgcaccggcagaggctgcggggcggacgcgcgggccggcgcagccatggtgaagattagcttccagcccgccgtggctggcatcaagggcgacaaggctgacaaggcgtcggcgtcggcccctgcgccggcctcggccaccgagatcctgctgacgccggctagggaggagcagcccccacaacatcgatccaagagggggagctcagtgggcggcgtgtgctacctgtcgatgggcatggtcgtgctgctcatgggcctcgtgttcgcctctgtctacatctacagatacttctttcttgcacagctggcccgagataacttcttccgctgtggtgtgctgtatgaggactccctgtcctcccaggtccggactcagatggagctggaagaggatgtgaaaatctacctcgacgagaactacgagcgcatcaacgtgcctgtgccccagtttggcggcggtgaccctgcagacatcatccatgacttccagcggggtctgactgcgtaccatgatatctccctggacaagtgctatgtcatcgaactcaacaccaccattgtgctgccccctcgcaacttctgggagctcctcatgaacgtgaagagggggacctacctgccgcagacgtacatcatccaggaggagatggtggtcacggagcatgtcagtgacaaggaggccctggggtccttcatctaccacctgtgcaacgggaaagacacctaccggctccggcgccgggcaacgcggaggcggatcaacaagcgtggggccaagaactgcaatgccatccgccacttcgagaacaccttcgtggtggagacgctcatctgcggggtggtgtgaggccctcctcccccagaaccccctgccgtgttcctcttttcttctttccggctgctctctggccctcctccttccccctgcttagcttgtactttggacgcgtttctatagaggtgacatgtctctccattcctctccaaccctgcccacctccctgtaccagagctgtgatctctcggtggggggcccatctctgctgacctgggtgtggcggagggagaggcgatgctgcaaagtgttttctgtgtcccactgtcttgaagctgggcctgccaaagcctgggcccacagctgcaccggcagcccaaggggaaggaccggttgggggagccgggcatgtgaggccctgggcaaggggatggggctgtgggggcggggcggcatgggcttcagaagtatctgcacaattagaaaagtcctcagaagctttttcttggagggtacactttcttcactgtccctattcctagacctggggcttgagctgaggatgggacgatgtgcccagggagggacccaccagagcacaagagaaggtggctacctgggggtgtcccagggactctgtcagtgccttcagcccaccagcaggagcttggagtttggggagtggggatgagtccgtcaagcacaactgttctctgagtggaaccaaagaatcactgctcagtcacgtccacgggggacgagccgtgggttctgctgagtaggtggagctcattgctttctccaagcttggaactgttttgaaagataacacagagggaaagggagagccacctggtacttgtccaccctgcctcctctgttctgaaattccatccccctcagcttaggggaatgcacctttttccctttccttctcacttttgcatgtttttactgatcattcgatatgctaaccgttctcagccctgagccttggagaggagggctgtaacgccttcagtcagtctctggggatgaaactcttaaatgctttgtatattttctcaattagatctcttttcagaagtgtctatagaacaataaaaatcttttacttctga

SEQ ID NO: 330082 - DNA, 1863 bp, Homo sapiens
ggggggacgcgagcgggatccaaacttccggtgcctgcagagctcggagcggcggaggcagagaccgaggctgcaccggcagaggctgcggggcggacgcgcgggccggcgcagccatggtgaagattagcttccagcccgccgtggctggcatcaagggcgacaaggctgacaaggcgtcggcgtcggcccctgcgccggcctcggccaccgagatcctgctgacgccggctagggaggagcagcccccacaacatcgatccaagagggggagctcagtgggcggcgtgtgctacctgtcgatgggcatggtcgtgctgctcatgggcctcgtgttcgcctctgtctacatctacagatacttctttcttgcacagctggcccgagataacttcttccgctgtggtgtgctgtatgaggactccctgtcctcccaggtccggactcagatggagctggaagaggatgtgaaaatctacctcgacgagaactacgagcgcatcaacgtgcctgtgccccagtttggcggcggtgaccctgcagacatcatccatgacttccagcggggtctgactgcgtaccatgatatctccctggacaagtgctatgtcatcgaactcaacaccaccattgtgctgccccctcgcaacttctgggagctcctcatgaacgtgaagagggggacctacctgccgcagacgtacatcatccaggaggagatggtggtcacggagcatgtcagtgacaaggaggccctggggtccttcatctaccacctgtgcaacgggaaagacacctaccggctccggcgccgggcaacgcggaggcggatcaacaagcgtggggccaagaactgcaatgccatccgccacttcgagaacaccttcgtggtggagacgctcatctgcggggtggtgtgaggccctcctcccccagaaccccctgccgtgttcctcttttcttctttccggctgctctctggccctcctccttccccctgcttagcttgtactttggacgcgtttctatagaggtgacatgtctctccattcctctccaaccctgcccacctccctgtaccagagctgtgatctctcggtggggggcccatctctgctgacctgggtgtggcggagggagaggcgatgctgcaaagtgttttctgtgtcccactgtcttgaagctgggcctgccaaagcctgggcccacagctgcaccggcagcccaaggggaaggaccggttgggggagccgggcatgtgaggccctgggcaaggggatggggctgtgggggcggggcggcatgggcttcagaagtatctgcacaattagaaaagtcctcagaagctttttcttggagggtacactttcttcactgtccctattcctagacctggggcttgagctgaggatgggacgatgtgcccagggagggacccaccagagcacaagagaaggtggctacctgggggtgtcccagggactctgtcagtgccttcagcccaccagcaggagcttggagtttggggagtggggatgagtccgtcaacttggaactgttttgaaagataacacagagggaaagggagagccacctggtacttgtccaccctgcctcctctgttctgaaattccatccccctcagcttaggggaatgcacctttttccctttccttctcacttttgcatgtttttactgatcattcgatatgctaaccgttctcagccctgagccttggagaggagggctgtaacgccttcagtcagtctctggggatgaaactcttaaatgctttgtatattttctcaattagatctcttttcagaagtgtctatagaacaataaaaatcttttacttctga

SEQ ID NO: 330083 - DNA, 1901 bp, Homo sapiens
ggctggtacaggtccggagatgttaaggatccggcctcggcaccgagatcctgctgacgccggctagggaggagcagcccccacaacatcgatccaagagggggagctcagtgggcggcgtgtgctacctgtcgatgggcatggtcgtgctgctcatgggcctcgtgttcgcctctgtctacatctacagatacttctttcttgcacagctggcccgagataacttcttccgctgtggtgtgctgtatgaggactccctgtcctcccaggtccggactcagatggagctggaagaggatgtgaaaatctacctcgacgagaactacgagcgcatcaacgtgcctgtgccccagtttggcggcggtgaccctgcagacatcatccatgacttccagcggggtctgactgcgtaccatgatatctccctggacaagtgctatgtcatcgaactcaacaccaccattgtgctgccccctcgcaacttctgggagctcctcatgaacgtgaagagggggacctacctgccgcagacgtacatcatccaggaggagatggtggtcacggagcatgtcagtgacaaggaggccctggggtccttcatctaccacctgtgcaacgggaaagacacctaccggctccggcgccgggcaacgcggaggcggatcaacaagcgtggggccaagaactgcaatgccatccgccacttcgagaacaccttcgtggtggagacgctcatctgcggggtggtgtgaggccctcctcccccagaaccccctgccgtgttcctcttttcttctttccggctgctctctggccctcctccttccccctgcttagcttgtactttggacgcgtttctatagaggtgacatgtctctccattcctctccaaccctgcccacctccctgtaccagagctgtgatctctcggtggggggcccatctctgctgacctgggtgtggcggagggagaggcgatgctgcaaagtgttttctgtgtcccactgtcttgaagctgggcctgccaaagcctgggcccacagctgcaccggcagcccaaggggaaggaccggttgggggagccgggcatgtgaggccctgggcaaggggatggggctgtgggggcggggcggcatgggcttcagaagtatctgcacaattagaaaagtcctcagaagctttttcttggagggtacactttcttcactgtccctattcctagacctggggcttgagctgaggatgggacgatgtgcccagggagggacccaccagagcacaagagaaggtggctacctgggggtgtcccagggactctgtcagtgccttcagcccaccagcaggagcttggagtttggggagtggggatgagtccgtcaagcacaactgttctctgagtggaaccaaagaagcaaggagctaggacccccagtcctgccccccaggagcacaagcagggtcccctcagtcaaggcagtgggatgggcggctgaggaacggggcaggcaaggtcactgctcagtcacgtccacgggggacgagccgtgggttctgctgagtaggtggagctcattgctttctccaagcttggaactgttttgaaagataacacagagggaaagggagagccacctggtacttgtccaccctgcctcctctgttctgaaattccatccccctcagcttaggggaatgcacctttttccctttccttctcacttttgcatgtttttactgatcattcgatatgctaaccgttctcagccctgagccttggagaggagggctgtaacgccttcagtcagtctctggggatgaaactcttaaatgctttgtatattttctcaattagatctcttttcagaagtgtctatagaacaataaaaatcttttacttctga

SEQ ID NO: 330084 - DNA, 1928 bp, Homo sapiens
ggggggacgcgagcgggatccaaacttccggtgcctgcagagctcggagcggcggaggcagagaccgaggctgcaccggcagaggctgcggggcggacgcgcgggccggcgcagccatggtgaagattagcttccagcccgccgtggctggcatcaagggcgacaaggctgacaaggcgtcggcgtcggcccctgcgccggcctcggccaccgagatcctgctgacgccggctaggctggcccgagataacttcttccgctgtggtgtgctgtatgaggactccctgtcctcccaggtccggactcagatggagctggaagaggatgtgaaaatctacctcgacgagaactacgagcgcatcaacgtgcctgtgccccagtttggcggcggtgaccctgcagacatcatccatgacttccagcggggtctgactgcgtaccatgatatctccctggacaagtgctatgtcatcgaactcaacaccaccattgtgctgccccctcgcaacttctgggagctcctcatgaacgtgaagagggggacctacctgccgcagacgtacatcatccaggaggagatggtggtcacggagcatgtcagtgacaaggaggccctggggtccttcatctaccacctgtgcaacgggaaagacacctaccggctccggcgccgggcaacgcggaggcggatcaacaagcgtggggccaagaactgcaatgccatccgccacttcgagaacaccttcgtggtggagacgctcatctgcggggtggtgtgaggccctcctcccccagaaccccctgccgtgttcctcttttcttctttccggctgctctctggccctcctccttccccctgcttagcttgtactttggacgcgtttctatagaggtgacatgtctctccattcctctccaaccctgcccacctccctgtaccagagctgtgatctctcggtggggggcccatctctgctgacctgggtgtggcggagggagaggcgatgctgcaaagtgttttctgtgtcccactgtcttgaagctgggcctgccaaagcctgggcccacagctgcaccggcagcccaaggggaaggaccggttgggggagccgggcatgtgaggccctgggcaaggggatggggctgtgggggcggggcggcatgggcttcagaagtatctgcacaattagaaaagtcctcagaagctttttcttggagggtacactttcttcactgtccctattcctagacctggggcttgagctgaggatgggacgatgtgcccagggagggacccaccagagcacaagagaaggtggctacctgggggtgtcccagggactctgtcagtgccttcagcccaccagcaggagcttggagtttggggagtggggatgagtccgtcaagcacaactgttctctgagtggaaccaaagaagcaaggagctaggacccccagtcctgccccccaggagcacaagcagggtcccctcagtcaaggcagtgggatgggcggctgaggaacggggcaggcaaggtcactgctcagtcacgtccacgggggacgagccgtgggttctgctgagtaggtggagctcattgctttctccaagcttggaactgttttgaaagataacacagagggaaagggagagccacctggtacttgtccaccctgcctcctctgttctgaaattccatccccctcagcttaggggaatgcacctttttccctttccttctcacttttgcatgtttttactgatcattcgatatgctaaccgttctcagccctgagccttggagaggagggctgtaacgccttcagtcagtctctggggatgaaactcttaaatgctttgtatattttctcaattagatctcttttcagaagtgtctatagaacaataaaaatcttttacttctga

SEQ ID NO: 330085 - DNA, 2004 bp, Homo sapiens
  misc_feature (41)..(41): n is a, c, g, or t
  misc_feature (44)..(44): n is a, c, g, or t
  misc_feature (72)..(72): n is a, c, g, or t
  misc_feature (93)..(93): n is a, c, g, or t
  misc_feature (219)..(219): n is a, c, g, or t
acccgcacacgctcccccccgcaccgcccccccccgcacantcnctcaacattaccttccacccccccctcnctcccatcaacccccacaacnctcacaacccctccccctccccccctccccccccctccgccacccacatcctcctcaccccccctacccaccaccaccccccacaacatccatccaacacccccacctcactcccccccctctccnacctctccatccccatcgtcctcctcctcatccccctcctcttcccctctctctacatctacacatacttctttcttccacacctccccccacctggcccgagataacttcttccgctgtggtgtgctgtatgaggactccctgtcctcccaggtccggactcagatggagctggaagaggatgtgaaaatctacctcgacgagaactacgagcgcatcaacgtgcctgtgccccagtttggcggcggtgaccctgcagacatcatccatgacttccagcggggtctgactgcgtaccatgatatctccctggacaagtgctatgtcatcgaactcaacaccaccattgtgctgccccctcgcaacttctgggagctcctcatgaacgtgaagagggggacctacctgccgcagacgtacatcatccaggaggagatggtggtcacggagcatgtcagtgacaaggaggccctggggtccttcatctaccacctgtgcaacgggaaagacacctaccggctccggcgccgggcaacgcggaggcggatcaacaagcgtggggccaagaactgcaatgccatccgccacttcgagaacaccttcgtggtggagacgctcatctgcggggtggtgtgaggccctcctcccccagaaccccctgccgtgttcctcttttcttctttccggctgctctctggccctcctccttccccctgcttagcttgtactttggacgcgtttctatagaggtgacatgtctctccattcctctccaaccctgcccacctccctgtaccagagctgtgatctctcggtggggggcccatctctgctgacctgggtgtggcggagggagaggcgatgctgcaaagtgttttctgtgtcccactgtcttgaagctgggcctgccaaagcctgggcccacagctgcaccggcagcccaaggggaaggaccggttgggggagccgggcatgtgaggccctgggcaaggggatggggctgtgggggcggggcggcatgggcttcagaagtatctgcacaattagaaaagtcctcagaagctttttcttggagggtacactttcttcactgtccctattcctagacctggggcttgagctgaggatgggacgatgtgcccagggagggacccaccagagcacaagagaaggtggctacctgggggtgtcccagggactctgtcagtgccttcagcccaccagcaggagcttggagtttggggagtggggatgagtccgtcaagcacaactgttctctgagtggaaccaaagaagcaaggagctaggacccccagtcctgccccccaggagcacaagcagggtcccctcagtcaaggcagtgggatgggcggctgaggaacggggcaggcaaggtcactgctcagtcacgtccacgggggacgagccgtgggttctgctgagtaggtggagctcattgctttctccaagcttggaactgttttgaaagataacacagagggaaagggagagccacctggtacttgtccaccctgcctcctctgttctgaaattccatccccctcagcttaggggaatgcacctttttccctttccttctcacttttgcatgtttttactgatcattcgatatgctaaccgttctcagccctgagccttggagaggagggctgtaacgccttcagtcagtctctggggatgaaactcttaaatgctttgtatattttctcaattagatctcttttcagaagtgtctatagaacaataaaaatcttttacttctga

SEQ ID NO: 330086 - DNA, 572 bp, Homo sapiens
cagaggaggtggacaagaaggaggtggtggaggctgtgaccattgtagagacaccacccatggtggttgtgggcattgtgggctacgtggaaacccctcgaggcctcctctgtgctgtcccagaggagggtcccctcagtcaaggcagtgggatgggcggctgaggaacggggcaggcaaggtcactgctcagtcacgtccacgggggacgagccgtgggttctgctgagtaggtggagctcattgctttctccaagcttggaactgttttgaaagataacacagagggaaagggagagccacctggtacttgtccaccctgcctcctctgttctgaaattccatccccctcagcttaggggaatgcacctttttccctttccttctcacttttgcatgtttttactgatcattcgatatgctaaccgttctcagccctgagccttggagaggagggctgtaacgccttcagtcagtctctggggatgaaactcttaaatgctttgtatattttctcaattagatctcttttcagaagtgtctatagaacaataaaaatcttttacttctga

SEQ ID NO: 330087 - DNA, 869 bp, Homo sapiens
ggggggacgcgagcgggatccaaacttccggtgcctgcagagctcggagcggcggaggcagagaccgaggctgcaccggcagaggctgcggggcggacgcgcgggccggcgcagccatggtgaagattagcttccagcccgccgtggctggcatcaagggcgacaaggctgacaaggcgtcggcgtcggcccctgcgccggcctcggccaccgagatcctgctgacgccggctagggaggagcagcccccacaacatcgatccaagagggggagctcagtgggcggcgtgtgctacctgtcgatgggcatggtcgtgctgctcatgggcctcgtgttcgcctctgtctacatctacagatacttctttcttgcacagctggcccgagataacttcttccgctgtggtgtgctgtatgaggactccctgtcctcccaggtccggactcagatggagctggaagaggatgtgaaaatctactcactgctcagtcacgtccacgggggacgagccgtgggttctgctgagtaggtggagctcattgctttctccaagcttggaactgttttgaaagataacacagagggaaagggagagccacctggtacttgtccaccctgcctcctctgttctgaaattccatccccctcagcttaggggaatgcacctttttccctttccttctcacttttgcatgtttttactgatcattcgatatgctaaccgttctcagccctgagccttggagaggagggctgtaacgccttcagtcagtctctggggatgaaactcttaaatgctttgtatattttctcaattagatctcttttcagaagtgtctatagaacaataaaaatcttttacttctga

SEQ ID NO: 330088 - DNA, 279 bp, Homo sapiens
acgaaagcctgaggggccgactcactgtggcggccaccttgttttgcagagggggacctacctgccgcagacgtacatcatccaggaggagatggtggtcacggagcatgtcagtgacaaggaggccctggggtccttcatctaccacctgtgcaacgggaaagacacctaccggctccggcgccgggcaacgcggaggcgtgagtggctggcttcacccacagtagcccctgtcccgtgccccagaccacagttatcttcacgcctagcccagctgtc

SEQ ID NO: 330089 - DNA, 2149 bp, Homo sapiens
  misc_feature (2134)..(2134): n is a, c, g, or t
ggggggacgcgagcgggatccaaacttccggtgcctgcagagctcggagcggcggaggcagagaccgaggctgcaccggcagaggctgcggggcggacgcgcgggccggcgcagccatggtgaagattagcttccagcccgccgtggctggcatcaagggcgacaaggctgacaaggcgtcggcgtcggcccctgcgccggcctcggccaccgagatcctgctgacgccggctagggaggagcagcccccacaacatcgatccaagagggggagctcagtgggcggcgtgtgctacctgtcgatgggcatggtcgtgctgctcatgggcctcgtgttcgcctctgtctacatctacagatacttctttcttgcacagctggcccgagataacttcttccgctgtggtgtgctgtatgaggactccctgtcctcccaggtccggactcagatggagctggaagaggatgtgaaaatctacctcgacgagaactacgagcgcatcaacgtgcctgtgccccagtttggcggcggtgaccctgcagacatcatccatgacttccagcggggtctgactgcgtaccatgatatctccctggacaagtgctatgtcatcgaactcaacaccaccattgtgctgccccctcgcaacttctgggagctcctcatgaacgtgaagagggggacctacctgccgcagacgtacatcatccaggaggagatggtggtcacggagcatgtcagtgacaaggaggccctggggtccttcatctaccacctgtgcaacgggaaagacacctaccggctccggcgccgggcaacgcggaggcggatcaacaagcgtggggccaagaactgcaatgccatccgccacttcgagaacaccttcgtggtggagacgctcatctgcggggtggtgtgaggccctcctcccccagaaccccctgccgtgttcctcttttcttctttccggctgctctctggccctcctccttccccctgcttagcttgtactttggacgcgtttctatagaggtgacatgtctctccattcctctccaaccctgcccacctccctgtaccagagctgtgatctctcggtggggggcccatctctgctgacctgggtgtggcggagggagaggcgatgctgcaaagtgttttctgtgtcccactgtcttgaagctgggcctgccaaagcctgggcccacagctgcaccggcagcccaaggggaaggaccggttgggggagccgggcatgtgaggccctgggcaaggggatggggctgtgggggcggggcggcatgggcttcagaagtatctgcacaattagaaaagtcctcagaagctttttcttggagggtacactttcttcactgtccctattcctagacctggggcttgagctgaggatgggacgatgtgcccagggagggacccaccagagcacaagagaaggtggctacctgggggtgtcccagggactctgtcagtgccttcagcccaccagcaggagcttggagtttggggagtggggatgagtccgtcaagcacaactgttctctgagtggaaccaaagaagcaaggagctaggacccccagtcctgccccccaggagcacaagcagggtcccctcagtcaaggcagtgggatgggcggctgaggaacggggcaggcaaggtcactgctcagtcacgtccacgggggacgagccgtgggttctgctgagtaggtggagctcattgctttctccaagcttggaactgttttgaaagataacacagagggaaagggagagccacctggtacttgtccaccctgcctcctctgttctgaaattccatccccctcagcttaggggaatgcacctttttccctttccttctcacttttgcatgtttttactgatcattcgatatgctaaccgttctcagccctgagccttggagaggagggctgtaacgccttcagtcagtctctggggatgaaactcttaaatgctttgtatattttctcaattagatctcttttcagaagtgtctatagaacaataaaaatcttttacttctgaaaaaaaaaaaaaaaaaaaaaaaaaaaaaaaaaaaaaaaaaaaaaaaaaaaaaaaaaaaaaaaaanagaggggggggggcc

SEQ ID NO: 330090 - DNA, 2269 bp, Homo sapiens
ggggggacgcgagcgggatccaaacttccggtgcctgcagagctcggagcggcggaggcagagaccgaggctgcaccggcagaggctgcggggcggacgcgcgggccggcgcagccatggtgaagattagcttccagcccgccgtggctggcatcaagggcgacaaggctgacaaggcgtcggcgtcggcccctgcgccggcctcggccaccgagatcctgctgacgccggctagggaggagcagcccccacaacatcgatccaagagggggagctcagtgggcggcgtgtgctacctgtcgatgggcatggtcgtgctgctcatgggcctcgtgttcgcctctgtctacatctacagatacttctttcttgcacagctggcccgagataacttcttccgctgtggtgtgctgtatgaggactccctgtcctcccaggtccggactcagatggagctggaagaggatgtgaaaatctacctcgacgagaactacgagcgcatcaacgtgcctgtgccccagtttggcggcggtgaccctgcagacatcatccatgacttccagcggggtctgactgcgtaccatgatatctccctggacaagtgctatgtcatcgaactcaacaccaccattgtgctgccccctcgcaacttctgggagctcctcatgaacgtgaagagggggacctacctgccgcagacgtacatcatccaggaggagatggtggtcacggagcatgtcagtgacaaggaggccctggggtccttcatctaccacctgtgcaacgggaaagacacctaccggctccggcgccgggcaacgcggaggcggatcaacaagcgtggggccaagaactgcaatgccatccgccacttcgagaacaccttcgtggtggagacgctcatctgcggggtggtgtgaggccctcctcccccagaaccccctgccgtgttcctcttttcttctttccggctgctctctggccctcctccttccccctgcttagcttgtactttggacgcgtttctatagaggtgacatgtctctccattcctctccaaccctgcccacctccctgtaccagagctgtgatctctcggtggggggcccatctctgctgacctgggtgtggcggagggagaggcgatgctgcaaagtgttttctgtgtcccactgtcttgaagctgggcctgccaaagcctgggcccacagctgcaccggcagcccaaggggaaggaccggttgggggagccgggcatgtgaggccctgggcaaggggatggggctgtgggggcggggcggcatgggcttcagaagtatctgcacaattagaaaagtcctcagaagctttttcttggagggtacactttcttcactgtccctattcctagacctggggcttgagctgaggatgggacgatgtgcccagggagggacccaccagagcacaagagaaggtggctacctgggggtgtcccagggactctgtcagtgccttcagcccaccagcaggagcttggagtttggggagtggggatgagtccgtcaagcacaactgttctctgagtggaaccaaagaagcaaggagctaggacccccagtcctgccccccaggagcacaagcagggtcccctcagtcaaggcagtgggatgggcggctgaggaacggggcaggcaaggtcactgctcagtcacgtccacgggggacgagccgtgggttctgctgagtaggtggagctcattgctttctccaagcttggaactgttttgaaagataacacagagggaaagggagagccacctggtacttgtccaccctgcctcctctgttctgaaattccatccccctcagcttaggggaatgcacctttttccctttccttctcacttttgcatgtttttactgatcattcgatatgctaaccgttctcagccctgagccttggagaggagggctgtaacgccttcagtcagtctctggggatgaaactcttaaatgctttgtatattttctcaattagatctcttttcagaagtgtctatagaacaataaaaatcttttacttctgaaaaccagacccgacacagagactcacaaaaacaacgaccaaaacaacaacaacaaagacaaggaacgacgaaaccgggggcggaccatgcctaaggagcgatccggcgcgtaacgcgcggaaccgggtcaaggacgtggaacccgtggagggtagaagccgcgtccaagggccagtagggcgatgcacgctgacctacgg

SEQ ID NO: 330091 - DNA, 1961 bp, Homo sapiens
gtctcgaatggttgcttatcccagaatgaggagggggcttaagtcccgtactaaagcggcagccaaaagctgaagtccgaagagtgggaggcgtctggttctggtcttcaggtggagaagtgctcgaggaggagcagcccccacaacatcgatccaagagggggagctcagtgggcggcgtgtgctacctgtcgatgggcatggtcgtgctgctcatgggcctcgtgttcgcctctgtctacatctacagatacttctttcttgcacagctggcccgagataacttcttccgctgtggtgtgctgtatgaggactccctgtcctcccaggtccggactcagatggagctggaagaggatgtgaaaatctacctcgacgagaactacgagcgcatcaacgtgcctgtgccccagtttggcggcggtgaccctgcagacatcatccatgacttccagcggggtctgactgcgtaccatgatatctccctggacaagtgctatgtcatcgaactcaacaccaccattgtgctgccccctcgcaacttctgggagctcctcatgaacgtgaagagggggacctacctgccgcagacgtacatcatccaggaggagatggtggtcacggagcatgtcagtgacaaggaggccctggggtccttcatctaccacctgtgcaacgggaaagacacctaccggctccggcgccgggcaacgcggaggcggatcaacaagcgtggggccaagaactgcaatgccatccgccacttcgagaacaccttcgtggtggagacgctcatctgcggggtggtgtgaggccctcctcccccagaaccccctgccgtgttcctcttttcttctttccggctgctctctggccctcctccttccccctgcttagcttgtactttggacgcgtttctatagaggtgacatgtctctccattcctctccaaccctgcccacctccctgtaccagagctgtgatctctcggtggggggcccatctctgctgacctgggtgtggcggagggagaggcgatgctgcaaagtgttttctgtgtcccactgtcttgaagctgggcctgccaaagcctgggcccacagctgcaccggcagcccaaggggaaggaccggttgggggagccgggcatgtgaggccctgggcaaggggatggggctgtgggggcggggcggcatgggcttcagaagtatctgcacaattagaaaagtcctcagaagctttttcttggagggtacactttcttcactgtccctattcctagacctggggcttgagctgaggatgggacgatgtgcccagggagggacccaccagagcacaagagaaggtggctacctgggggtgtcccagggactctgtcagtgccttcagcccaccagcaggagcttggagtttggggagtggggatgagtccgtcaagcacaactgttctctgagtggaaccaaagaagcaaggagctaggacccccagtcctgccccccaggagcacaagcagggtcccctcagtcaaggcagtgggatgggcggctgaggaacggggcaggcaaggtcactgctcagtcacgtccacgggggacgagccgtgggttctgctgagtaggtggagctcattgctttctccaagcttggaactgttttgaaagataacacagagggaaagggagagccacctggtacttgtccaccctgcctcctctgttctgaaattccatccccctcagcttaggggaatgcacctttttccctttccttctcacttttgcatgtttttactgatcattcgatatgctaaccgttctcagccctgagccttggagaggagggctgtaacgccttcagtcagtctctggggatgaaactcttaaatgctttgtatattttctcaattagatctcttttcagaagtgtctatagaacaataaaaatcttttacttctga

SEQ ID NO: 330092 - DNA, 1958 bp, Homo sapiens
ggggggacgcgagcgggatccaaacttccggtgcctgcagagctcggagcggcggaggcagagaccgaggctgcaccggcagaggctgcggggcggacgcgcgggccggcgcagccatggtgaagattagcttccagcccgccgtggctggcatcaagggcgacaaggctgacaaggcgtcggcgtcggcccctgcgccggcctcggccaccgagatcctgctgacgccggctagggaggagcagcccccacaacatcgatccaagagggggagctcagtgggcggcgtgtgctacctgtcgatgggcatggtcgtgctgctcatgggcctcgtgttcgcctctgtctacatctacagatacttctttcttgcacagctggcccgagataacttcttccgctgtggtgtgctgtatgaggactccctgtcctcccaggtccggactcagatggagctggaagaggatgtgaaaatctacctcgacgagaactacgagcgcatcaacgtgcctgtgccccagtttggcggcggtgaccctgcagacatcatccatgacttccagcggagggggacctacctgccgcagacgtacatcatccaggaggagatggtggtcacggagcatgtcagtgacaaggaggccctggggtccttcatctaccacctgtgcaacgggaaagacacctaccggctccggcgccgggcaacgcggaggcggatcaacaagcgtggggccaagaactgcaatgccatccgccacttcgagaacaccttcgtggtggagacgctcatctgcggggtggtgtgaggccctcctcccccagaaccccctgccgtgttcctcttttcttctttccggctgctctctggccctcctccttccccctgcttagcttgtactttggacgcgtttctatagaggtgacatgtctctccattcctctccaaccctgcccacctccctgtaccagagctgtgatctctcggtggggggcccatctctgctgacctgggtgtggcggagggagaggcgatgctgcaaagtgttttctgtgtcccactgtcttgaagctgggcctgccaaagcctgggcccacagctgcaccggcagcccaaggggaaggaccggttgggggagccgggcatgtgaggccctgggcaaggggatggggctgtgggggcggggcggcatgggcttcagaagtatctgcacaattagaaaagtcctcagaagctttttcttggagggtacactttcttcactgtccctattcctagacctggggcttgagctgaggatgggacgatgtgcccagggagggacccaccagagcacaagagaaggtggctacctgggggtgtcccagggactctgtcagtgccttcagcccaccagcaggagcttggagtttggggagtggggatgagtccgtcaagcacaactgttctctgagtggaaccaaagaagcaaggagctaggacccccagtcctgccccccaggagcacaagcagggtcccctcagtcaaggcagtgggatgggcggctgaggaacggggcaggcaaggtcactgctcagtcacgtccacgggggacgagccgtgggttctgctgagtaggtggagctcattgctttctccaagcttggaactgttttgaaagataacacagagggaaagggagagccacctggtacttgtccaccctgcctcctctgttctgaaattccatccccctcagcttaggggaatgcacctttttccctttccttctcacttttgcatgtttttactgatcattcgatatgctaaccgttctcagccctgagccttggagaggagggctgtaacgccttcagtcagtctctggggatgaaactcttaaatgctttgtatattttctcaattagatctcttttcagaagtgtctatagaacaataaaaatcttttacttctga

SEQ ID NO: 330093 - DNA, 1316 bp, Homo sapiens
ggggggacgcgagcgggatccaaacttccggtgcctgcagagctcggagcggcggaggcagagaccgaggctgcaccggcagaggctgcggggcggacgcgcgggccggcgcagccatggtgaagattagcttccagcccgccgtggctggcatcaagggcgacaaggctgacaaggcgtcggcgtcggcccctgcgccggcctcggccaccgagatcctgctgacgccggctagggaggagcagcccccacaacatcgatccaagagggggagctcagtgggcggcgtgtgctacctgtcgatgggcatggtcgtgctgctcatgggcctcgtgttcgcctctgtctacatctacagatacttctttcttgcacagctggcccgagataacttcttccgctgtggtgtgctgtatgaggactccctgtcctcccaggtccggactcagatggagctggaagaggatgtgaaaatctacctcgacgagaactacgagcgcatcaacgtgcctgtgccccagtttggcggcggtgaccctgcagacatcatccatgacttccagcggggtctgactgcgtaccatgatatctccctggacaagtgctatgtcatcgaactcaacaccaccattgtgctgccccctcgcaacttctgggagctcctcatgaacgtgaagagggggacctacctgccgcagacgtacatcatccaggaggagatggtggtcacggagcatgtcagtgacaaggaggccctggggtccttcatctaccacctgtgcaacgggaaagacacctaccggctccggcgccgggcaacgcggaggcggatcaacaagcgtggggccaagaactgcaatgccatccgccacttcgagaacaccttcgtggtggagacgctcatctgcggggtggtgtgaggccctcctcccccagaaccccctgccgtgttcctcttttcttctttccggctgctctctggccctcctccttccccctgcttagcttgtactttggacgcgtttctatagaggtgacatgtctctccattcctctccaacccctgcctcctctgttctgaaattccatccccctcagcttaggggaatgcacctttttccctttccttctcacttttgcatgtttttactgatcattcgatatgctaaccgttctcagccctgagccttggagaggagggctgtaacgccttcagtcagtctctggggatgaaactcttaaatgctttgtatattttctcaattagatctcttttcagaagtgtctatagaacaataaaaatcttttacttctga

SEQ ID NO: 330094 - DNA, 1287 bp, Homo sapiens
  misc_feature (24)..(24): n is a, c, g, or t
  misc_feature (33)..(33): n is a, c, g, or t
gggcaatcagcaggtaggcgcggngaatctaanctacaagcgtcggagcgccgagacgaacatgctaactgaccgagttccatccgccacttcgagaacaccttcgtggtggagacgctcatctgcggggtggtgtgaggccctcctcccccagaaccccctgccgtgttcctcttttcttctttccggctgctctctggccctcctccttccccctgcttagcttgtactttggacgcgtttctatagaggtgacatgtctctccattcctctccaaccctgcccacctccctgtaccagagctgtgatctctcggtggggggcccatctctgctgacctgggtgtggcggagggagaggcgatgctgcaaagtgttttctgtgtcccactgtcttgaagctgggcctgccaaagcctgggcccacagctgcaccggcagcccaaggggaaggaccggttgggggagccgggcatgtgaggccctgggcaaggggatggggctgtgggggcggggcggcatgggcttcagaagtatctgcacaattagaaaagtcctcagaagctttttcttggagggtacactttcttcactgtccctattcctagacctggggcttgagctgaggatgggacgatgtgcccagggagggacccaccagagcacaagagaaggtggctacctgggggtgtcccagggactctgtcagtgccttcagcccaccagcaggagcttggagtttggggagtggggatgagtccgtcaagcacaactgttctctgagtggaaccaaagaagcaaggagctaggacccccagtcctgccccccaggagcacaagcagggtcccctcagtcaaggcagtgggatgggcggctgaggaacggggcaggcaaggtcactgctcagtcacgtccacgggggacgagccgtgggttctgctgagtaggtggagctcattgctttctccaagcttggaactgttttgaaagataacacagagggaaagggagagccacctggtacttgtccaccctgcctcctctgttctgaaattccatccccctcagcttaggggaatgcacctttttccctttccttctcacttttgcatgtttttactgatcattcgatatgctaaccgttctcagccctgagccttggagaggagggctgtaacgccttcagtcagtctctggggatgaaactcttaaatgctttgtatattttctcaattagatctcttttcagaagtgtctatagaacaataaaaatcttttacttctga

SEQ ID NO: 330095 - DNA, 633 bp, Homo sapiens
ggggggacgcgagcgggatccaaacttccggtgcctgcagagctcggagcggcggaggcagagaccgaggctgcaccggcagaggctgcggggcggacgcgcgggccggcgcagccatggtgaagattagcttccagcccgccgtggctggcatcaagggcgacaaggctgacaaggcgtcggcgtcggcccctgcgccggcctcggccaccgagatcctgctgacgccggctagggaggagcagcccccacaacatcgatccaagagggggagctcagtgggcggcgtgtgctacctgtcgatgggcatggtcgtgctgctcatgggcctcgtgttcgcctctgtctacatctacagatacttctttcttgcacagctggcccgagataacttcttccgctgtggtgtgctgtatgaggactccctgtcctcccaggtccggactcagatggagctggaagaggatgtgaaaatctacctcgacgagaactacgagcgcatcaacgtgcctgtgccccagtttggcggcggtgaccctgcagacatcatccatgacttccagcggcggggtctgactgcgtaccatgatatggcactttcctttcctagtctacccaaactcccccacgtct

SEQ ID NO: 330096 - DNA, 465 bp, Homo sapiens
ccttccctctctttactggatcatcatatggaaatgtagtatgctttctggttattgtttaaaaaactttcattttgatcatagtaatattattaaagatacgtttttcagggctgggcacagtggctcacacctgtaatcctagcactttgggaggcagaggtgggtagatcacttgaggtcaggagttcgaggccagcctggccaacatggtgaaaccccgtctctactaaaaacacaaaaattagctgggcgtggtggcaggtgcctgtaatcccatctactcaggaggctgaggcaggagaatcgcttgaacccaggaggcggaggttgcagtgagccgagatcacaccagtgcactgcagcttgagtgacaagagcaaaactgtctcaaaagaaaaaaaaattttgagcagctgttgcttacccctgtgcacaattaagattatttaaccataccaccaa

SEQ ID NO: 330097 - DNA, 230 bp, Homo sapiens
tttccaagtaacatcacaccatcccagaacaaggctcaagaagatttatagaaatacaaaacatccagcagccaacaaggtaaaacttacaatgtgattaccaggtagtaaaacatatccaaaattaaaataatcgatcatgtgaaactgacttagaaccatcacagatgttagaattagacaaggacaataaatggttattatagttgtattccatatgttcaaaaaat

SEQ ID NO: 330098 - DNA, 744 bp, Homo sapiens
tcatgtcgtaaagtgtagttctgaaaaacagagcaaatgaaatgcaaagcaggtacttgggtttacatcccagtgccactgatgattctgttttctcatctgtggaagtttcactgttcttgtttcatggagaaattaactaagtgtcagctgtcaggcacactgaactcaggtgatgttcattaatagctgttgtacaatatgtttgtatttggattgctgcttattacttaacaacaggataaacctgaacaatggaaaagaccaacattagagagtattatctttccaaatacacacacctgtaagagaactggaaatgtgagaactacaacttcttcttatttaaacatttgaacaattgccggccctttcaccgaatttacctgtggaatgccttttgagagttagagaactgagaactggtattacttttcaggtcttttgctttccctaatccttgtgatactggagatttatcatctattaaaatggacctagtatttttaaatctgcatatcaaaagcaaattgaatgtctcttgcttccttttaatttcttttaacatataaatttctcttttagcatgtaaatttgttgaattaacagccctttgataatataattccttgcatataatatgtacaatgagagaatcaattaatttagaattacatactcctaatttaaaaaagaaactggtgtacttattgctgataactaggaagtcgaccggccgcgaat

SEQ ID NO: 330099 - DNA, 307 bp, Homo sapiens
gctactcagtagactgagggtgaaggattgtttgagcccagctgtataaaatttgccatttttaccatctttgagtgtactgttctctggtattatattcacattgtgtgaggccatcaccaacatccctctccagaacgtcttcatcttcccaggtgactctgtgtacctatcaaacacttaactcttcattgccttctccccataatccttggcaaccaccactctacttcctgtctcttaagaatttcactactccaggtacctctcctataagtggagtcataaaatagttgttctttgtgac

SEQ ID NO: 330100 - DNA, 719 bp, Homo sapiens
ttattcagcaatacaaagcaacaaactattgatacacacaacttaggtgaattttaaagttatccagaaggaaggaagccaaatccaaaaggtagtatactttatgattccattgatacataacattctttttatatttttattttgtggtttttctttgagacagggtcttgctctgtcacccaggctggagtgcagtagcatgatcatggctcattgcagcctcaaccttctgggctcaagcaatcctcccacctcagcctcccaagtggctggtaccataagcacatgccaccacgcccagcttttttttacttttgtaaagacaaggtctccctatgttgcccaggctggtctcgaacttctaggctcaaagtagaaagaagtagtctcccacctcagcctctcaaagtgctgacattacaggcatgagtcaccatgcccagcctatataatattatttttttatttttagatggagtgtcgctctgtcacccaggctggagtgcagtggcgcgatctgggctcactacaacctccgcctcctgggttcaagcaattctcctgccttagcctcccgagtaactgggattacaggtgtatgccaccacatccagctaatttttgtatttttagtagagatgaggtttcactatgtcagccaggctggtcttgaactcctgacctcgtgatcctcccgccttggcctcccaaagtgc

SEQ ID NO: 330101 - DNA, 615 bp, Homo sapiens
gcggccgcgtcgacgcggcggcggcagcggcgtcggctcggggttctccgggagagggggagtgcgcggcggccgcagctgccacaaaccaggtgaagctttgttctaagaatatttgtttcatctagtttatgagtccaaatgatatagactgtaaatgtcacagcagtggtgaaagactgctcggtcatgagcaccgacagtaactcactggcacgtgaatttctgaccgatgtcaaccggctttgcaatgcagtggtccagagggtggaggccagggaggaagaagaggaggagacgcacatggcaacccttggacagtaccttgtccatggtcgaggatttctattacttaccaagctaaattctataattgatcagtagagatggggtttcaccgtgttgaccagctgatcttaaactcctgacctcaagcagtctacccccgttggcctcccaaagtgctgggattacaggtgtgagccactgcacccagccaagtttatgtatttttattctttttcatgaatgtgatttgttaaatgagtgattaaatataatttttatatatttgtatgacttttctgtaaataaaatttaaaatcagaaaaaatc

SEQ ID NO: 330102 - DNA, 5288 bp, Homo sapiens
  misc_feature (2724)..(2724): n is a, c, g, or t
  misc_feature (5268)..(5268): n is a, c, g, or t
  misc_feature (5280)..(5282): n is a, c, g, or t
  misc_feature (5284)..(5284): n is a, c, g, or t
gagagagggccactcgccttcctggtgacacagagatttcctagccccgttaccaaacgaaaaagcaacgcaagggcttctaagaagccatcccaatgaccttttggctttgagaagagcagtcctcataccagagtgtttggggttttggcctctttcagtgtttattcattcttacgtgggaaagttgtattccgaggtttctgtggtgcatgaagcttttgccttcaccatctgttcccgtgtcttcctcgggtgacatcagagtacagcagtattttcccttgccatctaatggggtttgggctgtttgactcaaccgtgtgtgttcctcaatgccaggggaataatcctaccctaagtcagctgaacagaagccaggatctaactgcaaacaagagacccagcttgcttaacagcatggaagagaccagtttcgttgcagctacctgggaagacggttgctaattagcctgcaacaaagagttccttgctcatctaaaagaggcaatcaccgttcaggtgaagctttgttctaagaatatttgtttcatctagtttatgagtccaaatgatatagactgtaaatgtcacagcagtggtgaaagactgctcggtcatgagcaccgacagtaactcactggcacgtgaatttctgaccgatgtcaaccggctttgcaatgcagtggtccagagggtggaggccagggaggaagaagaggaggagacgcacatggcaacccttggacagtaccttgtccatggtcgaggatttctattacttaccaagctaaattctataattgatcaggcattgacatgtagagaagaactcctgactcttcttctgtctctccttccactggtatggaagatacctgtccaagaagaaaaggcaacagattttaacctaccgctctcagcagatataatcctgaccaaagaaaagaactcaagttcacaaagatccactcaggaaaaattacatttagaaggaagtgccctgtctagtcaggtttctgcaaaagtaaatgtttttcgaaaaagcagacgacagcgtaaaattacccatcgctattctgtaagagatgcaagaaagacacagctctccacctcagattcagaagccaattcagatgaaaaaggcatagcaatgaataagcatagaaggccccatctgctgcatcattttttaacatcgtttcctaaacaagaccaccccaaagctaaacttgaccgcttagcaaccaaagaacagactcctccagatgctatggctttggaaaattccagagagattattccaagacaggggtcaaacactgacattttaagtgagccagctgccttgtctgttatcagtaacatgaacaattctccatttgacttatgtcatgttttgttatctttattagaaaaagtttgtaagtttgacgttaccttgaatcataattctcctttagcagccagtgtagtgcccacactaactgaattcctagcaggctttggggactgctgcagtctgagcgacaacttggagagtcgagtagtttctgcaggttggaccgaagaaccggtggctttgattcaaaggatgctctttcgaacagtgttgcatcttctgtcagtagatgttagtactgcagagatgatgccagaaaatcttaggaaaaatttaactgaattgcttagagcagctttaaaaattagaatatgcctagaaaagcagcctgacccttttgcaccaagacaaaagaaaacactgcaggaggttcaggaagattttgtgttttcaaagtatcgtcatagagcccttcttttacctgagcttttggaaggagttcttcagattctgatctgttgtcttcaaagtgcagcttcaaatcccttctacttcagtcaagccatggatttggttcaagaattcattcagcatcatggatttaatttatttgaaacagcagttcttcaaatggaatggctggttttaagagatggagttcctcccgaggcctcagagcatttgaaagccctaataaatagtgtgatgaaaataatgagcactgtcaaaaaagtgaaatcagagcaacttcatcattcgatgtgtacaagaaaaaggcacagacgatgtgaatattctcattttatgcatcatcaccgagatctctcaggtcttctggtttcggcttttaaaaaccaggtttccaaaaacccatttgaagagactgcagatggagatgtttattatcctgagcggtgctgttgcattgcagtgtgtgcccatcagtgcttgcgcttactacagcaggcttccttgagcagcacttgtgtccagatcctatcgggtgttcataacattggaatatgctgttgtatggatcccaaatctgtaatcattcctttgctccatgcttttaaattgccagcactgaaaaattttcagcagcatatattgaatatccttaacaaacttattttggatcagttaggaggagcagagatatcaccaaaaattaaaaaagcagcttgtaatatttgtactgttgactctgaccaactagcccaattagaagagacactgcagggaaacttatgtgatgctgaactctcctcaagtttatccagtccttcttacagatttcaagggatcctgcccagcagtggatctgaagatttgttgtggaaatgggatgctttaaaggcttatcagaactttgtttttgnagaagacagattacatagtatacagattgcaaatcacatttgcaatttaatccagaaaggcaatatagttgttcagtggaaattatataattacatatttaatcctgtgctccaaagaggagttgaattagcacatcattgtcaacacctaagcgttacttcagctcaaagtcatgtatgtagccatcataaccagtgcttgcctcaggacgtgcttcagatttatgtaaaaactctgcctatcctgcttaaatccagggtaataagagatttgtttttgagttgtaatggagtaagtcaaataatcgaattaaattgcttaaatggtattcgaagtcattctctaaaagcatttgaaactctgataatcagcctaggggagcaacagaaagatgcctcagttccagatattgatgggatagacattgaacagaaggagttgtcctctgtacatgtgggtacttcttttcatcatcagcaagcttattcagattctcctcagagtctcagcaaattttatgctggcctcaaagaagcttatccaaagagacggaagactgttaaccaagatgttcatatcaacacaataaacctattcctctgtgtggcttttttatgcgtaagtaaagaagcagagtctgacagggagtcggccaatgactcagaagatacttctggctatgacagcacagccagcgagcctttaagtcatatgctgccatgtatatctctcgagagccttgtcttgccttctcctgaacatatgcaccaagcagcagacatttggtctatgtgtcgttggatctacatgttgagttcagtgttccagaaacagttttataggcttggtggtttccgagtatgccataagttaatatttatgataatacagaaactgttcagaagtcacaaagaggagcaaggaaaaaaggagggagatacaagtgtaaatgaaaaccaggatttaaacagaatttctcaacctaagagaactatgaaggaagatttattatctttggctataaaaagtgaccccataccatcagaactaggtagtctaaaaaagagtgctgacagtttaggtaaattagagttacagcatatttcttccataaatgtggaagaagtttcagctactgaagccgctcccgaggaagcaaagctatttacaagtcaagaaagtgagacctcacttcaaagtatacgacttttggaagcccttctggccatttgtcttcatggtgccagaactagtcaacagaagatggaattggagttacctaatcagaacttgtctgtggaaagtatattatttgaaatgagggaccatctttcccagtcaaaggtgattgaaacacaactagcaaagcctttatttgatgccctgcttcgagttgccctcgggaattattcagcagattttgaacataatgatgctatgactgagaagagtcatcaatctgcagaagaattgtcatcccagcctggtgatttttcagaagaagctgaggattctcagtgttgtagttttaaacttttagttgaagaagaaggttacgaagcagatagtgaaagcaatcctgaagatggcgaaacccaggatgatggggtagacttaaagtctgaaacagaaggtttcagtgcatcaagcagtccaaatgacttactcgaaaacctcactcaaggggaaataatttatcctgagatttgtatgctggaattaaatttgctttctgctagtaaagccaaacttgatgtgcttgcccatgtatttgagagttttttgaaaattattaggcagaaagaaaagaatgtttttctgctcatgcaacagggaactgtgaaaaatcttttaggagggttcttgagtattttaacacaggatgattctgattttcaagcatgccagagagtattggtggatcttttggtatctttgatgagttcaagaacatgttcagaagagctaacccttcttttgagaatatttctggagaaatctccttgtacaaaaattcttcttctgggtattctgaaaattattgaaagtgatactactatgagcccttcacagtatctaaccttccctttactgcacgctccaaatttaagcaacggtgtttcatcacaaaagtatcctgggattttaaacagtaaggccatgggtttattgagaagagcacgagtttcacggagcaagaaagaggctgatagagagagttttccccatcggctgctttcatcttggcacatagccccagtccacctgccgttgctggggcaaaactgctggccacacctatcagaaggtttcagtgtttccctgtggtttaatgtggagtgtatccatgaagctgagagtactacagaaaaaggaaagaagataaagaaaagaaacaaatcattaattttaccagatagcagttttgatggtacaggtatgatgacaggattatctgatttgtacacaaagattgttttcagactataattttccttgagccgtaaaaatgtggtagtgttcttaacactcttaacatgttnttcaccttaaannncntact

SEQ ID NO: 330103 - DNA, 931 bp, Homo sapiens
  misc_feature (795)..(796): n is a, c, g, or t
  misc_feature (798)..(798): n is a, c, g, or t
gagagagggccactcgccttcctggtgacacagagatttcctagccccgttaccaaacgaaaaagcaacgcaagggcttctaagaagccatcccaatgaccttttggctttgagaagagcagtcctcataccagagtgtttggggttttggcctctttcagtgtttattcattcttacgtgggaaagttgtattccgaggtttctgtggtgcatgaagcttttgccttcaccatctgttcccgtgtcttcctcgggtgacatcagagtacagcagtattttcccttgccatctaatggggtttgggctgtttgactcaaccgtgtgtgttcctcaatgccaggggaataatcctaccctaagtcagctgaacagaagccaggatctaactgcaaacaagagacccagcttgcttaacagcatggaagagaccagtttcgttgcagctacctgggaagacggttgctaattagcctgcaacaaagagttccttgctcatctaaaagaggcaatcaccgttcagtagagatggggtttcaccatgtttggccaggctggtctcgaactcctgaactcaagtgaactgtccacctctcaaagagctgggattacaggtcataagaccttcattccagaggcatcctgccctgtatccgggaagaaggaatgctgcacacagatgccgagaagaatcggaacagacaggcattgctggatcccccctcggtctattaccacgagatcaaactctttgtccaatcacatgtctacagtgctgtccattcttcatgattanngnaaaggggtgccgggtccggacatcgaagtcacggagaaaacaatttttggaaaaaacaccccgcggggaggggagagaacacaagaaaactctcccgcgaaaaccgcgcttttttctcgtgcgtcgctcccgc

SEQ ID NO: 330104 - DNA, 1045 bp, Homo sapiens
gagagagggccactcgccttcctggtgacacagagatttcctagccccgttaccaaacgaaaaagcaacgcaagggcttctaagaagccatcccaatgaccttttggctttgagaagagcagtcctcataccagagtgtttggggttttggcctctttcagtgtttattcattcttacgtgggaaagttgtattccgaggtttctgtggtgcatgaagcttttgccttcaccatctgttcccgtgtcttcctcgggtgacatcagagtacagcagtattttcccttgccatctaatggggtttgggctgtttgactcaaccgtgtgtgttcctcaatgccaggggaataatcctaccctaagtcagctgaacagaagccaggatctaactgcaaacaagagacccagcttgcttaacagcatggaagagaccagtttcgttgcagctacctgggaagacggttgctaattagcctgcaacaaagagttccttgctcatctaaaagaggcaatcaccgttcaggtgaagctttgttctaagaatatttgtttcatctagtttatgagtccaaatgatatagactgtaaatgtcacagcagtggtgaaagactgctcggtcatgagcaccgacagtaactcactggcacgtgaatttctgaccgatgtcaaccggctttgcaatgcagtggtccagagggtggaggccagggaggaagaagaggaggagacgcacatggcaacccttggacagtaccttgtccatggtcgaggatttctattacttaccaagctaaattctataattgatcagtagagatggggtttcaccgtgttgaccagctgatcttaaactcctgacctcaagcagtctacccccgttggcctcccaaagtgctgggattacaggtgtgagccactgcacccagccaagtttatgtatttttattctttttcatgaatgtgatttgttaaatgagtgattaaatataatttttatatatttgtatgacttttctgtaaataaaatttaaaatcagaaaaaatc

SEQ ID NO: 330105 - DNA, 794 bp, Homo sapiens
gagagagggccactcgccttcctggtgacacagagatttcctagccccgttaccaaacgaaaaagcaacgcaagggcttctaagaagccatcccaatgaccttttggctttgagaagagcagtcctcataccagagtgtttggggttttggcctctttcagtgtttattcattcttacgtgggaaagttgtattccgaggtttctgtggtgcatgaagcttttgccttcaccatctgttcccgtgtcttcctcgggtgacatcagagtacagcagtattttcccttgccatctaatggggtttgggctgtttgactcaaccgtgtgtgttcctcaatgccaggggaataatcctaccctaagtcagctgaacagaagccaggatctaactgcaaacaagagacccagcttgcttaacagcatggaagagaccagtttcgttgcagctacctgggaagacggttgctaattagcctgcaacaaagagttccttgctcatctaaaagaggcaatcaccgttcaggtcataagaccttcattccagaggcatcctgccctgtatccgggaagaaggaatgctgcacacagatgccgagaagaatcggaacagacaggcattgctggatcccccctcggtctattaccacgagatcaaactctttgtccaatcacatgtctacagtgctgtccattcttcattgaatctaagcagaaaaatgggcagttttccctgggtcttccggtcttcatttctgaagtcttccatgttacataaaacttttttttttttttttt

SEQ ID NO: 330106 - DNA, 794 bp, Homo sapiens
  misc_feature (332)..(332): n is a, c, g, or t
aaaaatagtaataaatgggggcgaggtgactatagctattatttataattttgaatttaaaaccgccgcaaagagataattacgattaagcacctaactgaaaagtgacaaaccgacggaaatataaaatgatgaatttgcggcattattatttacgttgatactattaagccaactctaaaataataaaataacgatataaatatctgttctatgctagaaagataataaatacgaaattgaatatgaagatgaataatgatatgggaatcttggtgtagtatgttctctcacgtgattttatttgtatttttttccgatgcggtatattntttttttttatgccttactctcagttttgtttattcacaagccttacataggtagagtatgagcattaaaaaaatactttgtagaaactaatggattgatgttacagaatggaagattatacatgttaaatttttactctcagcaaattgggagaaaactatatccacccatttttttttttaggttgttgaactcagtagctgtgaagaaactcaagcattagcactgcgagttatactctcattaattaaatacaaccaacaaagagtacatgaattagaaaattgtaatggactttctatgattcatcaggtgttgatcaaacaaaaatgcattgttgggttttacattttgaaggtatgtcttcataaaatttattcttatagtttcatatgcagtgatactcatctcgtcatcaaagtcttccaataatagtttgtatttcagttattcctgaagaa

SEQ ID NO: 330107 - DNA, 569 bp, Homo sapiens
gagagagggccactcgccttcctggtgacacagagatttcctagccccgttaccaaacgaaaaagcaacgcaagggcttctaagaagccatcccaatgaccttttggctttgagaagagcagtcctcataccagagtgtttggggttttggcctctttcagtgtttattcattcttacgtgggaaagttgtattccgaggtttctgtggtgcatgaagcttttgccttcaccatctgttcccgtgtcttcctcgggtgacatcagagtacagcagtattttcccttgccatctaatggggtttgggctgtttgactcaaccgtgtgtgttcctcaatgccaggggaataatcctaccctaagtcagctgaacagaagccaggatctaactgcaaacaagagacccagcttgcttaacagcatggaagagaccagtttcgttgcagctacctgggaagacggttgctaattagcctgcaacaaagagttccttgctcatctaaaagaggcaatcaccgttcagcttctggcgaccaccattctgtttcctgtctgtgcgaatttggctat

SEQ ID NO: 330108 - DNA, 711 bp, Homo sapiens
gcggccgcgtcgacgcggcggcggcagcggcgtcggctcggggttctccgggagagggggagtgcgcggcggccgcagctgccacaaaccaggtgaagctttgttctaagaatatttgtttcatctagtttatgagtccaaatgatatagactgtaaatgtcacagcagtggtgaaagactgctcggtcatgagcaccgacagtaactcactggcacgtgaatttctgaccgatgtcaaccggctttgcaatgcagtggtccagagggtggaggccagggaggaagaagaggaggagacgcacatggcaacccttggacagtaccttgtccatggtcgaggatttctattacttaccaagctaaattctataattgatcaggtaacatttttatatcaaatacttactttcatcaatatatgatagttaactgtagctacatggttttggattacatagtttctgaagcctccttgagataaagtccagtctttcacattattccactaaaaaaaaagtggacctatttataaccatattgtttatttgaatactttcaaaacgtctgaaatatcttagaattatgaattgcctaagaactaaatggtttcatatatactatgctttttatcgtaatatcagtgagataactatggttcttagtagaaatataagacataatcttatatccctgtatcttatgtcagaaac

SEQ ID NO: 330109 - DNA, 365 bp, Homo sapiens
gtgcagtggtgcaatctcggctgactgcaacctccacctccgggttcaagtgattcttgtgtctcagccacctaagtagccgggactacaagtgtgcatcaccacacccagtgaatttttgtattttcagttagagatggggtttcaccgtgttgaccagctgatcttaaactcctgacctcaagcagtctacccccgttggcctcccaaagtgctgggattacaggtgtgagccactgcacccagccaagtttatgtatttttattctttttcatgaatgtgatttgttaaatgagtgattaaatataatttttatatatttgtatgacttttctgtaaataaaatttaaaatcagaaaaaatc

SEQ ID NO: 330110 - DNA, 14402 bp, Homo sapiens
  misc_feature (2724)..(2724): n is a, c, g, or t
gagagagggccactcgccttcctggtgacacagagatttcctagccccgttaccaaacgaaaaagcaacgcaagggcttctaagaagccatcccaatgaccttttggctttgagaagagcagtcctcataccagagtgtttggggttttggcctctttcagtgtttattcattcttacgtgggaaagttgtattccgaggtttctgtggtgcatgaagcttttgccttcaccatctgttcccgtgtcttcctcgggtgacatcagagtacagcagtattttcccttgccatctaatggggtttgggctgtttgactcaaccgtgtgtgttcctcaatgccaggggaataatcctaccctaagtcagctgaacagaagccaggatctaactgcaaacaagagacccagcttgcttaacagcatggaagagaccagtttcgttgcagctacctgggaagacggttgctaattagcctgcaacaaagagttccttgctcatctaaaagaggcaatcaccgttcaggtgaagctttgttctaagaatatttgtttcatctagtttatgagtccaaatgatatagactgtaaatgtcacagcagtggtgaaagactgctcggtcatgagcaccgacagtaactcactggcacgtgaatttctgaccgatgtcaaccggctttgcaatgcagtggtccagagggtggaggccagggaggaagaagaggaggagacgcacatggcaacccttggacagtaccttgtccatggtcgaggatttctattacttaccaagctaaattctataattgatcaggcattgacatgtagagaagaactcctgactcttcttctgtctctccttccactggtatggaagatacctgtccaagaagaaaaggcaacagattttaacctaccgctctcagcagatataatcctgaccaaagaaaagaactcaagttcacaaagatccactcaggaaaaattacatttagaaggaagtgccctgtctagtcaggtttctgcaaaagtaaatgtttttcgaaaaagcagacgacagcgtaaaattacccatcgctattctgtaagagatgcaagaaagacacagctctccacctcagattcagaagccaattcagatgaaaaaggcatagcaatgaataagcatagaaggccccatctgctgcatcattttttaacatcgtttcctaaacaagaccaccccaaagctaaacttgaccgcttagcaaccaaagaacagactcctccagatgctatggctttggaaaattccagagagattattccaagacaggggtcaaacactgacattttaagtgagccagctgccttgtctgttatcagtaacatgaacaattctccatttgacttatgtcatgttttgttatctttattagaaaaagtttgtaagtttgacgttaccttgaatcataattctcctttagcagccagtgtagtgcccacactaactgaattcctagcaggctttggggactgctgcagtctgagcgacaacttggagagtcgagtagtttctgcaggttggaccgaagaaccggtggctttgattcaaaggatgctctttcgaacagtgttgcatcttctgtcagtagatgttagtactgcagagatgatgccagaaaatcttaggaaaaatttaactgaattgcttagagcagctttaaaaattagaatatgcctagaaaagcagcctgacccttttgcaccaagacaaaagaaaacactgcaggaggttcaggaagattttgtgttttcaaagtatcgtcatagagcccttcttttacctgagcttttggaaggagttcttcagattctgatctgttgtcttcaaagtgcagcttcaaatcccttctacttcagtcaagccatggatttggttcaagaattcattcagcatcatggatttaatttatttgaaacagcagttcttcaaatggaatggctggttttaagagatggagttcctcccgaggcctcagagcatttgaaagccctaataaatagtgtgatgaaaataatgagcactgtcaaaaaagtgaaatcagagcaacttcatcattcgatgtgtacaagaaaaaggcacagacgatgtgaatattctcattttatgcatcatcaccgagatctctcaggtcttctggtttcggcttttaaaaaccaggtttccaaaaacccatttgaagagactgcagatggagatgtttattatcctgagcggtgctgttgcattgcagtgtgtgcccatcagtgcttgcgcttactacagcaggcttccttgagcagcacttgtgtccagatcctatcgggtgttcataacattggaatatgctgttgtatggatcccaaatctgtaatcattcctttgctccatgcttttaaattgccagcactgaaaaattttcagcagcatatattgaatatccttaacaaacttattttggatcagttaggaggagcagagatatcaccaaaaattaaaaaagcagcttgtaatatttgtactgttgactctgaccaactagcccaattagaagagacactgcagggaaacttatgtgatgctgaactctcctcaagtttatccagtccttcttacagatttcaagggatcctgcccagcagtggatctgaagatttgttgtggaaatgggatgctttaaaggcttatcagaactttgtttttgnagaagacagattacatagtatacagattgcaaatcacatttgcaatttaatccagaaaggcaatatagttgttcagtggaaattatataattacatatttaatcctgtgctccaaagaggagttgaattagcacatcattgtcaacacctaagcgttacttcagctcaaagtcatgtatgtagccatcataaccagtgcttgcctcaggacgtgcttcagatttatgtaaaaactctgcctatcctgcttaaatccagggtaataagagatttgtttttgagttgtaatggagtaagtcaaataatcgaattaaattgcttaaatggtattcgaagtcattctctaaaagcatttgaaactctgataatcagcctaggggagcaacagaaagatgcctcagttccagatattgatgggatagacattgaacagaaggagttgtcctctgtacatgtgggtacttcttttcatcatcagcaagcttattcagattctcctcagagtctcagcaaattttatgctggcctcaaagaagcttatccaaagagacggaagactgttaaccaagatgttcatatcaacacaataaacctattcctctgtgtggcttttttatgcgtaagtaaagaagcagagtctgacagggagtcggccaatgactcagaagatacttctggctatgacagcacagccagcgagcctttaagtcatatgctgccatgtatatctctcgagagccttgtcttgccttctcctgaacatatgcaccaagcagcagacatttggtctatgtgtcgttggatctacatgttgagttcagtgttccagaaacagttttataggcttggtggtttccgagtatgccataagttaatatttatgataatacagaaactgttcagaagtcacaaagaggagcaaggaaaaaaggagggagatacaagtgtaaatgaaaaccaggatttaaacagaatttctcaacctaagagaactatgaaggaagatttattatctttggctataaaaagtgaccccataccatcagaactaggtagtctaaaaaagagtgctgacagtttaggtaaattagagttacagcatatttcttccataaatgtggaagaagtttcagctactgaagccgctcccgaggaagcaaagctatttacaagtcaagaaagtgagacctcacttcaaagtatacgacttttggaagcccttctggccatttgtcttcatggtgccagaactagtcaacagaagatggaattggagttacctaatcagaacttgtctgtggaaagtatattatttgaaatgagggaccatctttcccagtcaaaggtgattgaaacacaactagcaaagcctttatttgatgccctgcttcgagttgccctcgggaattattcagcagattttgaacataatgatgctatgactgagaagagtcatcaatctgcagaagaattgtcatcccagcctggtgatttttcagaagaagctgaggattctcagtgttgtagttttaaacttttagttgaagaagaaggttacgaagcagatagtgaaagcaatcctgaagatggcgaaacccaggatgatggggtagacttaaagtctgaaacagaaggtttcagtgcatcaagcagtccaaatgacttactcgaaaacctcactcaaggggaaataatttatcctgagatttgtatgctggaattaaatttgctttctgctagtaaagccaaacttgatgtgcttgcccatgtatttgagagttttttgaaaattattaggcagaaagaaaagaatgtttttctgctcatgcaacagggaactgtgaaaaatcttttaggagggttcttgagtattttaacacaggatgattctgattttcaagcatgccagagagtattggtggatcttttggtatctttgatgagttcaagaacatgttcagaagagctaacccttcttttgagaatatttctggagaaatctccttgtacaaaaattcttcttctgggtattctgaaaattattgaaagtgatactactatgagcccttcacagtatctaaccttccctttactgcacgctccaaatttaagcaacggtgtttcatcacaaaagtatcctgggattttaaacagtaaggccatgggtttattgagaagagcacgagtttcacggagcaagaaagaggctgatagagagagttttccccatcggctgctttcatcttggcacatagccccagtccacctgccgttgctggggcaaaactgctggccacacctatcagaaggtttcagtgtttccctgtggtttaatgtggagtgtatccatgaagctgagagtactacagaaaaaggaaagaagataaagaaaagaaacaaatcattaattttaccagatagcagttttgatggtacagagagcgacagaccagaaggtgcagagtacataaatcctggtgaaagactcatagaagaaggatgtattcatataatttcactgggatccaaagcgttgatgatccaagtgtgggctgatccccacaatgccactcttatctttcgtgtgtgcatggattcaaatgatgacatgaaagctgttttactagcacaggttgaatcacaggagaatattttcctcccaagcaaatggcaacatttagtactcacctacttacagcagccccaagggaaaaggaggattcatgggaaaatctccatatgggtctctggacagaggaagcctgatgttactttggattttatgcttccaagaaaaacaagtttgtcatctgatagcaataaaacattttgcatgattggccattgtttatcatcccaagaagagtttttgcagttggctggaaaatgggacctgggaaatttgcttctcttcaacggagctaaggttggttcacaagaggccttttatctgtatgcttgtggacccaaccatacatctgtaatgccatgtaagtatggcaagccagtcaatgactactccaaatatattaataaagaaattttgcgatgtgaacaaatcagagaactttttatgaccaagaaagatgtggatattggtctcttaattgaaagtctttcagttgtttatacaacttactgtcctgctcagtataccatctatgaaccagtgattagacttaaaggtcaaatgaaaacccaactctctcaaagacccttcagctcaaaagaagttcagagcatcttattagaacctcatcatctaaagaatctccaacctactgaatataaaactattcaaggcattctgcacgaaattggtggaactggcatatttgtttttctctttgccagggttgttgaactcagtagctgtgaagaaactcaagcattagcactgcgagttatactctcattaattaaatacaaccaacaaagagtacatgaattagaaaattgtaatggactttctatgattcatcaggtgttgatcaaacaaaaatgcattgttgggttttacattttgaagacccttcttgaaggatgctgtggtgaagatattatttatatgaatgagaatggagagtttaagttggatgtagactctaatgctataatccaagatgttaagctgttagaggaactattgcttgactggaagatatggagtaaagcagagcaaggtgtttgggaaactttgctagcagctctagaagtcctcatcagagcagatcaccaccagcagatgtttaatattaagcagttattgaaagctcaagtggttcatcactttctactgacttgtcaggttttgcaggaatacaaagaggggcaactcacacccatgccccgagagatggcaagatctttcaggagaaagtgcggtcaatcatgtacctgaggcattccagcagtggaggaaggtcccttatgagccctggatttatggtaataagcccatctggttttactgcttcaccatatgaaggagagaattcctctaatattattccacaacagatggccgcccatatgctgcgttctagaagcctaccagcattccctacttcttcactactaacgcaatcacaaaaactgactggaagtttgggttgtagtatcgacaggttacaaaatattgcagatacttatgttgccacccaatcaaagaaacaaaattctttggggagttccgacacactgaaaaaaggcaaagaggacgcattcatcagtagctgtgagtctgcaaaaactgtttgtgaaatggaagctgtcctctcagcccaggtctctgtcagtgatgtcccaaagggagtgctgggatttccagtggtcaaagcagatcataaacagttgggagcagaacccaggtcagaagatgacagtcctggggatgagtcctgcccacgccgacctgattacctaaagggattggcctccttccagcgaagccacagcactattgcaagccttgggctagcttttccttcacagaacggatctgcagctgttggccgttggccaagtcttgttgatagaaacactgatgattgggaaaatgtaactgaagactgtttggtacctatatgctgtggattatatgaactcctaagtggggttcttcttatcctgcctgatgttttgcttgaagatgtgatggacaagcttattcaagcagatacacttttggtcctcgttaaccacccatcaccagctatacaacaaggtgttattaaactattagatgcatattttgctagagcatctaaggaacaaaaagataaatttctgaagaatcgtggattttccttgctagccaaccagttgtatcttcatcgaggaactcaagaattgttagaatgcttcatcgaaatgttctttggtcgacatattggccttgatgaagaatttgatctggaagatgtgagaaacatgggattgtttcagaagtggtctgtcattcctattctgggactaatagagacctctctatatgacaacatactcttgcataatgctcttttacttcttctccaaattttaaattcttgttctaaggtagcagatatgttgctggataatggtctactctatgtgttatgtaatacagtagcagccctgaatggattagaaaagaacattcccatgagtgaatataaattgcttgcttgtgatatacagcaacttttcatagcagttacaattcatgcttgcagttcctcaggctcacaatattttagggttattgaagaccttattgtaatgcttggatatcttcaaaatagcaaaaacaagaggacacaaaatatggctgttgcactacagcttagagttctccaggctgctatggaatttataaggaccaccgcaaatcatgactctgaaaacctcacagattcactccagtcaccttctgctccccatcatgcagtagttcaaaagcggaaaagcattgctggtcctcgaaaatttccccttgctcaaactgaatcgcttctgatgaaaatgcgttcagtggcaaatgatgagcttcatgtgatgatgcaacggagaatgagccaagagaaccctagccaagcaactgaaacggaacttgcgcagagactacagaggctcactgttttagcagtcaacaggattatttatcaagaatttaattcagacattattgacattttgagaactccagaaaatgtaactcaaagcaagacctcagttttccagaccgaaatttctgaggaaaatattcatcatgaacagtcttctgttttcaatccatttcagaaagaaatttttacatatctggtagaaggattcaaagtatctattggttcaagtaaagccagtggttccaagcagcaatggactaaaattctgtggtcttgtaaggagaccttccgaatgcagcttgggagactactagtgcatattttgtcgccagcccacgctgcacaagagagaaagcaaatttttgaaatagttcatgaaccaaatcatcaggaaatactacgagactgtctcagcccatccctacaacatggagccaagttagttttgtatttgtcagagttgatacataatcaccaaggtgaattgactgaagaagagctaggcacagcagaactgcttatgaatgctttgaagttatgtggtcacaagtgcatccctcccagtgcatcaacaaaagcagaccttattaaaatgatcaaagaggaacaaaagaaatatgaaactgaagaaggagtgaataaagctgcttggcagaaaacagttaacaataatcaacaaagtctctttcagcgtctggattcaaaatcaaaggatatatctaaaatagctgcagatatcacccaggcagtgtctctctcccaaggaaatgagagaaaaaaggtgatccagcatattagaggaatgtataaagtagatttgagtgccagcagacattggcaggaacttattcagcagctgacacatgatagagcagtatggtatgaccccatctactatccaacctcatggcagttggatccaacagaagggccaaatcgagagaggagacgtttacagagatgttatttaactattccaaataagtatctccttagggatagacagaaatcagaagatgttgtcaaaccaccactctcttacctgtttgaagacaaaactcattcttctttctcttctactgtcaaagacaaagctgcaagtgaatctataagagtgaatcgaagatgcatcagtgttgcaccatctagagagacagctggtgaattgttactaggtaaatgtggaatgtattttgtggaagataatgcttctgatacagttgaaagttcgagccttcagggagagttggaaccagcatcattttcctggacatatgaagaaattaaagaagttcacaagcgttggtggcaattgagagataatgctgtagaaatctttctaacaaatggcagaacactcctgttggcatttgataacaccaaggttcgtgatgatgtataccacaatatactcacaaataacctccctaatcttctggaatatggtaacatcaccgctctgacaaatttatggtatactgggcaaattactaattttgaatatttgactcacttaaacaaacatgctggccgatccttcaatgatctcatgcagtatcctgtgttcccatttatacttgctgactacgttagtgagacacttgacctcaatgatctgttgatatacagaaatctctctaaacctatagctgttcagtataaagaaaaagaagatcgttatgtggacacatacaagtacttggaggaagagtaccgcaaaggagccagagaagatgaccccatgcctcccgtgcagccctatcactatggctcccactattccaatagcggcactgtgcttcacttcctggtcaggatgcctcctttcactaaaatgtttttagcctatcaagatcaaagttttgacattccagacagaacttttcattctacaaatacaacttggcgactctcatcttttgaatctatgactgatgtgaaagaacttatcccagagtttttctatcttccagagttcctagttaaccgtgaaggttttgattttggtgtgcgtcagaatggtgaacgggttaatcacgtcaaccttcccccttgggcgcgtaatgatcctcgtctttttatcctcatccatcggcaggctctagagtctgactacgtgtcgcagaacatctgtcagtggattgacttggtgtttgggtataagcaaaaggggaaggcttctgttcaagcgatcaatgtttttcatcctgctacatattttggaatggatgtctctgcagttgaagatccagttcagagacgagcgctagaaaccatgataaaaacctacgggcagactccccgtcagctgttccacatggcccatgtgagcagacctggagccaagctcaatattgaaggagagcttccagctgctgtggggttgctagtgcagtttgctttcagggagacccgagaacaggtcaaagaaatcacctatccgagtcctttgtcatggataaaaggcttgaaatggggggaatacgtgggttcccccagtgctccagtacctgtggtctgcttcagccagccccacggagaaagatttggctctctccaggctctgcccaccagagcaatctgtggtttgtcacggaatttctgtcttctgatgacatatagcaaggaacaaggtgtgagaagcatgaacagtacggacattcagtggtcagccatcctgagctggggatatgctgataatattttaaggttgaagagtaaacaaagtgagcctccagtaaactttattcaaagttcacaacagtaccaggtgactagttgtgcttgggtgcctgacagttgccagctgtttactggaagcaaatgcggtgtcatcacagcctacacaaacagatttacaagcagcacgccatcagaaatagaaatggagactcaaatacatctctatggtcacacagaagagataaccagcttatttgtttgcaaaccatacagtatactgataagtgtgagcagagacggaacctgcatcatatgggatttaaacaggttatgctatgtacaaagtctggcgggacacaaaagccctgtcacagctgtctctgccagtgaaacctcaggtgatattgctactgtgtgtgattcagctggcggaggcagtgacctcagactctggacggtgaacggggatctcgttggacatgtccactgcagggagatcatctgttccgtggctttctccaaccagcctgagggagtatctatcaatgtaatcgctgggggattagaaaatggaattgtaaggttatggagcacatgggacttaaagcctgtgagagaaattacatttcccaaatcaaataagcccatcatcagccttacattttcttgtgatggccaccatttgtacacagcaaacagtgatgggaccgtgattgcctggtgtcggaaggaccagcagcgcttgaaacagccaatgttctattccttccttagcagctatgcagccgggtgaatgcgaatgaacttcacgttctccaaagcactttaactccaaactagatttgttgacttcaccagttttaggaggttgaacctaaagaaatggatgactggacaaaccatccaaataatgataaagtctattcatctgcacaaaattctgaagagtcacatgatcctaagaggaaagttctgttctattttagtgataatctggaagattgtgtcaatatgcactagccaacaagttttaagcctcgcatggtacattaaaatgatattcttaaaattttttcccaccaaggtattccaaagaaaatattaaggtctcccctttttctatgattccaaaaggaccagtagaatttaaattggttggttgattgtttatataaaacacactaaaattatattttaaaagtttactgccatgaaatactcctcccaccacacacacatgctccaaaagaggaaagaaaaaaagataatttttaggacttgataattgctttctttgagaagcaaattattcagtaggtgcctctgtaccaaatattttatggaatatctaaatactaaaataaactatgaatgaatctcaaaattaggcagtttttgccagttgctttcttagctcaaaggagaaccagaatttttttgacagccacaaacaagaatacaggtatcttggatttcagacacattctgtttcttcataaaaattttacttaaaatctgtaacgctagatattgactatccttagttgagtcactgaggtttaaacacaatggtaagtcttaaagtctgctatttacagagcattgaatctgtaccaatttgcaatagaaagccttcagtatgcaagaagtttgcatgggtattaagaacacagcctaaataaggcatttgatctaatctgcaggaagaattttcttccccaaaacagaattataaaagcttactttaaacaggaggcagaataattcttttaggaaaccatttcattctgtttctactaacctataccatctgagaattctaggaagaataataaaatctcgtgtattccacagcaaacttacataccataaagacagaattcctaaacatcttggagccgtctgtctctcccatatgatggctgtctgtatatttttacttggggtgctgctttattggctttgaaaacactgtcagataagctcagtaatatgttaccatgggataaaaatatgtatccctgcctaagaataacttgtgcatttgttatggaaatttaattcatatggtgtttacagtactacttttgtaacttccagactttctaaaacattctgcttaaaaaccatataaaatataattccaaagtctctgctgtcaagatagattcgagagaaagcacgtggccatgtatgctttaaccttaaactgcatacacatgtagtgatacctaggctgcatttagatcaccgtgtgctcaggccaggtgtgaatcctgaggtccatggaggtgcagagatgagattactcctattcacgttgaagtgatttgctttgttaacaaaaaattgcagctattgtctagctttcatttttttactgagaactttaaattagtcccctattagaatagggttgctactcatctttttttaaaaaccgaatttcatcatttatctaaagagaaaatatgcagaataactggtcttgttaagagtgcaatattatatttttatgtaaaaataaaaattaatttggggggattatttattcagcatgaaacctaatatgtatatgtttgaaatacttcataatgtgcatgttgtagcaaacatttctgtaaattatcacaagctctgttacctttatatacactgcctcttcaatttggaaataaatttcataaaaatagaaaaaaaaaaaaacaaaaaacaaaaaaaaaaaatgtgtgcgcggcgcgcgccctgggcccccgcgagaagaggccttcttaagcaccctggggtgggggcgcgcggaggagccccacagataggtgaaaaagggacacaaatgggccacaaacgcgcggcaccccgaaggcgaaactcgcgcgacacgacaaccagagggcagcggacatcatccaccaataaaaaacacagccccgggggggaaacacggagacgcgtctgcacacaaaacactcacgacaggagagtcacgaagagagggcaacacaagcgcgggaactaactacacaacaggggaagcacaaaaagaagaaagccgagaaattcaacaaattaaacgcccgtaagcactcgtggataacaagaaaagacacagaagaagagaaaagaaaaaccagaagaacaaacaagacaacacacaagccaaaaacacgcagcaacaagaaagcgaaaggcagacggagcggagagcagcagaggacagagagtgaacggaagagacgaggagcgaagagagggggagggaggacggcgggagccgacagcaaggcccgcggagcgagagggggggacagacaagaagaaaggaagcagagagaagggacgagagacgagaggcaagagcgcgcggaggagcaggagcagacggggagc

SEQ ID NO: 330111 - DNA, 14348 bp, Homo sapiens
  misc_feature (2724)..(2724): n is a, c, g, or t
gagagagggccactcgccttcctggtgacacagagatttcctagccccgttaccaaacgaaaaagcaacgcaagggcttctaagaagccatcccaatgaccttttggctttgagaagagcagtcctcataccagagtgtttggggttttggcctctttcagtgtttattcattcttacgtgggaaagttgtattccgaggtttctgtggtgcatgaagcttttgccttcaccatctgttcccgtgtcttcctcgggtgacatcagagtacagcagtattttcccttgccatctaatggggtttgggctgtttgactcaaccgtgtgtgttcctcaatgccaggggaataatcctaccctaagtcagctgaacagaagccaggatctaactgcaaacaagagacccagcttgcttaacagcatggaagagaccagtttcgttgcagctacctgggaagacggttgctaattagcctgcaacaaagagttccttgctcatctaaaagaggcaatcaccgttcaggtgaagctttgttctaagaatatttgtttcatctagtttatgagtccaaatgatatagactgtaaatgtcacagcagtggtgaaagactgctcggtcatgagcaccgacagtaactcactggcacgtgaatttctgaccgatgtcaaccggctttgcaatgcagtggtccagagggtggaggccagggaggaagaagaggaggagacgcacatggcaacccttggacagtaccttgtccatggtcgaggatttctattacttaccaagctaaattctataattgatcaggcattgacatgtagagaagaactcctgactcttcttctgtctctccttccactggtatggaagatacctgtccaagaagaaaaggcaacagattttaacctaccgctctcagcagatataatcctgaccaaagaaaagaactcaagttcacaaagatccactcaggaaaaattacatttagaaggaagtgccctgtctagtcaggtttctgcaaaagtaaatgtttttcgaaaaagcagacgacagcgtaaaattacccatcgctattctgtaagagatgcaagaaagacacagctctccacctcagattcagaagccaattcagatgaaaaaggcatagcaatgaataagcatagaaggccccatctgctgcatcattttttaacatcgtttcctaaacaagaccaccccaaagctaaacttgaccgcttagcaaccaaagaacagactcctccagatgctatggctttggaaaattccagagagattattccaagacaggggtcaaacactgacattttaagtgagccagctgccttgtctgttatcagtaacatgaacaattctccatttgacttatgtcatgttttgttatctttattagaaaaagtttgtaagtttgacgttaccttgaatcataattctcctttagcagccagtgtagtgcccacactaactgaattcctagcaggctttggggactgctgcagtctgagcgacaacttggagagtcgagtagtttctgcaggttggaccgaagaaccggtggctttgattcaaaggatgctctttcgaacagtgttgcatcttctgtcagtagatgttagtactgcagagatgatgccagaaaatcttaggaaaaatttaactgaattgcttagagcagctttaaaaattagaatatgcctagaaaagcagcctgacccttttgcaccaagacaaaagaaaacactgcaggaggttcaggaagattttgtgttttcaaagtatcgtcatagagcccttcttttacctgagcttttggaaggagttcttcagattctgatctgttgtcttcaaagtgcagcttcaaatcccttctacttcagtcaagccatggatttggttcaagaattcattcagcatcatggatttaatttatttgaaacagcagttcttcaaatggaatggctggttttaagagatggagttcctcccgaggcctcagagcatttgaaagccctaataaatagtgtgatgaaaataatgagcactgtcaaaaaagtgaaatcagagcaacttcatcattcgatgtgtacaagaaaaaggcacagacgatgtgaatattctcattttatgcatcatcaccgagatctctcaggtcttctggtttcggcttttaaaaaccaggtttccaaaaacccatttgaagagactgcagatggagatgtttattatcctgagcggtgctgttgcattgcagtgtgtgcccatcagtgcttgcgcttactacagcaggcttccttgagcagcacttgtgtccagatcctatcgggtgttcataacattggaatatgctgttgtatggatcccaaatctgtaatcattcctttgctccatgcttttaaattgccagcactgaaaaattttcagcagcatatattgaatatccttaacaaacttattttggatcagttaggaggagcagagatatcaccaaaaattaaaaaagcagcttgtaatatttgtactgttgactctgaccaactagcccaattagaagagacactgcagggaaacttatgtgatgctgaactctcctcaagtttatccagtccttcttacagatttcaagggatcctgcccagcagtggatctgaagatttgttgtggaaatgggatgctttaaaggcttatcagaactttgtttttgnagaagacagattacatagtatacagattgcaaatcacatttgcaatttaatccagaaaggcaatatagttgttcagtggaaattatataattacatatttaatcctgtgctccaaagaggagttgaattagcacatcattgtcaacacctaagcgttacttcagctcaaagtcatgtatgtagccatcataaccagtgcttgcctcaggacgtgcttcagatttatgtaaaaactctgcctatcctgcttaaatccagggtaataagagatttgtttttgagttgtaatggagtaagtcaaataatcgaattaaattgcttaaatggtattcgaagtcattctctaaaagcatttgaaactctgataatcagcctaggggagcaacagaaagatgcctcagttccagatattgatgggatagacattgaacagaaggagttgtcctctgtacatgtgggtacttcttttcatcatcagcaagcttattcagattctcctcagagtctcagcaaattttatgctggcctcaaagaagcttatccaaagagacggaagactgttaaccaagatgttcatatcaacacaataaacctattcctctgtgtggcttttttatgcgtaagtaaagaagcagagtctgacagggagtcggccaatgactcagaagatacttctggctatgacagcacagccagcgagcctttaagtcatatgctgccatgtatatctctcgagagccttgtcttgccttctcctgaacatatgcaccaagcagcagacatttggtctatgtgtcgttggatctacatgttgagttcagtgttccagaaacagttttataggcttggtggtttccgagtatgccataagttaatatttatgataatacagaaactgttcagaagtcacaaagaggagcaaggaaaaaaggagggagatacaagtgtaaatgaaaaccaggatttaaacagaatttctcaacctaagagaactatgaaggaagatttattatctttggctataaaaagtgaccccataccatcagaactaggtagtctaaaaaagagtgctgacagtttaggtaaattagagttacagcatatttcttccataaatgtggaagaagtttcagctactgaagccgctcccgaggaagcaaagctatttacaagtcaagaaagtgagacctcacttcaaagtatacgacttttggaagcccttctggccatttgtcttcatggtgccagaactagtcaacagaagatggaattggagttacctaatcagaacttgtctgtggaaagtatattatttgaaatgagggaccatctttcccagtcaaaggtgattgaaacacaactagcaaagcctttatttgatgccctgcttcgagttgccctcgggaattattcagcagattttgaacataatgatgctatgactgagaagagtcatcaatctgcagaagaattgtcatcccagcctggtgatttttcagaagaagctgaggattctcagtgttgtagttttaaacttttagttgaagaagaaggttacgaagcagatagtgaaagcaatcctgaagatggcgaaacccaggatgatggggtagacttaaagtctgaaacagaaggtttcagtgcatcaagcagtccaaatgacttactcgaaaacctcactcaaggggaaataatttatcctgagatttgtatgctggaattaaatttgctttctgctagtaaagccaaacttgatgtgcttgcccatgtatttgagagttttttgaaaattattaggcagaaagaaaagaatgtttttctgctcatgcaacagggaactgtgaaaaatcttttaggagggttcttgagtattttaacacaggatgattctgattttcaagcatgccagagagtattggtggatcttttggtatctttgatgagttcaagaacatgttcagaagagctaacccttcttttgagaatatttctggagaaatctccttgtacaaaaattcttcttctgggtattctgaaaattattgaaagtgatactactatgagcccttcacagtatctaaccttccctttactgcacgctccaaatttaagcaacggtgtttcatcacaaaagtatcctgggattttaaacagtaaggccatgggtttattgagaagagcacgagtttcacggagcaagaaagaggctgatagagagagttttccccatcggctgctttcatcttggcacatagccccagtccacctgccgttgctggggcaaaactgctggccacacctatcagaaggtttcagtgtttccctgtggtttaatgtggagtgtatccatgaagctgagagtactacagaaaaaggaaagaagataaagaaaagaaacaaatcattaattttaccagatagcagttttgatggtacagagagcgacagaccagaaggtgcagagtacataaatcctggtgaaagactcatagaagaaggatgtattcatataatttcactgggatccaaagcgttgatgatccaagtgtgggctgatccccacaatgccactcttatctttcgtgtgtgcatggattcaaatgatgacatgaaagctgttttactagcacaggttgaatcacaggagaatattttcctcccaagcaaatggcaacatttagtactcacctacttacagcagccccaagggaaaaggaggattcatgggaaaatctccatatgggtctctggacagaggaagcctgatgttactttggattttatgcttccaagaaaaacaagtttgtcatctgatagcaataaaacattttgcatgattggccattgtttatcatcccaagaagagtttttgcagttggctggaaaatgggacctgggaaatttgcttctcttcaacggagctaaggttggttcacaagaggccttttatctgtatgcttgtggacccaaccatacatctgtaatgccatgtaagtatggcaagccagtcaatgactactccaaatatattaataaagaaattttgcgatgtgaacaaatcagagaactttttatgaccaagaaagatgtggatattggtctcttaattgaaagtctttcagttgtttatacaacttactgtcctgctcagtataccatctatgaaccagtgattagacttaaaggtcaaatgaaaacccaactctctcaaagacccttcagctcaaaagaagttcagagcatcttattagaacctcatcatctaaagaatctccaacctactgaatataaaactattcaaggcattctgcacgaaattggtggaactggcatatttgtttttctctttgccagggttgttgaactcagtagctgtgaagaaactcaagcattagcactgcgagttatactctcattaattaaatacaaccaacaaagagtacatgaattagaaaattgtaatggactttctatgattcatcaggtgttgatcaaacaaaaatgcattgttgggttttacattttgaagacccttcttgaaggatgctgtggtgaagatattatttatatgaatgagaatggagagtttaagttggatgtagactctaatgctataatccaagatgttaagctgttagaggaactattgcttgactggaagatatggagtaaagcagagcaaggtgtttgggaaactttgctagcagctctagaagtcctcatcagagcagatcaccaccagcagatgtttaatattaagcagttattgaaagctcaagtggttcatcactttctactgacttgtcaggttttgcaggaatacaaagaggggcaactcacacccatgccccgagagatggcaagatctttcaggagaaagtgcggtcaatcatgtacctgaggcattccagcagtggaggaaggtcccttatgagccctggatttatggtaataagcccatctggttttactgcttcaccatatgaaggagagaattcctctaatattattccacaacagatggccgcccatatgctgcgttctagaagcctaccagcattccctacttcttcactactaacgcaatcacaaaaactgactggaagtttgggttgtagtatcgacaggttacaaaatattgcagatacttatgttgccacccaatcaaagaaacaaaattctttggggagttccgacacactgaaaaaaggcaaagaggacgcattcatcagtagctgtgagtctgcaaaaactgtttgtgaaatggaagctgtcctctcagcccaggtctctgtcagtgatgtcccaaagggagtgctgggatttccagtggtcaaagcagatcataaacagttgggagcagaacccaggtcagaagatgacagtcctggggatgagtcctgcccacgccgacctgattacctaaagggattggcctccttccagcgaagccacagcactattgcaagccttgggctagcttttccttcacagaacggatctgcagctgttggccgttggccaagtcttgttgatagaaacactgatgattgggaaaatgtaactgaagactgtttggtacctatatgctgtggattatatgaactcctaagtggggttcttcttatcctgcctgatgttttgcttgaagatgtgatggacaagcttattcaagcagatacacttttggtcctcgttaaccacccatcaccagctatacaacaaggtgttattaaactattagatgcatattttgctagagcatctaaggaacaaaaagataaatttctgaagaatcgtggattttccttgctagccaaccagttgtatcttcatcgaggaactcaagaattgttagaatgcttcatcgaaatgttctttggtcgacatattggccttgatgaagaatttgatctggaagatgtgagaaacatgggattgtttcagaagtggtctgtcattcctattctgggactaatagagacctctctatatgacaacatactcttgcataatgctcttttacttcttctccaaattttaaattcttgttctaaggtagcagatatgttgctggataatggtctactctatgtgttatgtaatacagtagcagccctgaatggattagaaaagaacattcccatgagtgaatataaattgcttgcttgtgatatacagcaacttttcatagcagttacaattcatgcttgcagttcctcaggctcacaatattttagggttattgaagaccttattgtaatgcttggatatcttcaaaatagcaaaaacaagaggacacaaaatatggctgttgcactacagcttagagttctccaggctgctatggaatttataaggaccaccgcaaatcatgactctgaaaacctcacagattcactccagtcaccttctgctccccatcatgcagtagttcaaaagcggaaaagcattgctggtcctcgaaaatttccccttgctcaaactgaatcgcttctgatgaaaatgcgttcagtggcaaatgatgagcttcatgtgatgatgcaacggagaatgagccaagagaaccctagccaagcaactgaaacggaacttgcgcagagactacagaggctcactgttttagcagtcaacaggattatttatcaagaatttaattcagacattattgacattttgagaactccagaaaatgtaactcaaagcaagacctcagttttccagaccgaaatttctgaggaaaatattcatcatgaacagtcttctgttttcaatccatttcagaaagaaatttttacatatctggtagaaggattcaaagtatctattggttcaagtaaagccagtggttccaagcagcaatggactaaaattctgtggtcttgtaaggagaccttccgaatgcagcttgggagactactagtgcatattttgtcgccagcccacgctgcacaagagagaaagcaaatttttgaaatagttcatgaaccaaatcatcaggaaatactacgagactgtctcagcccatccctacaacatggagccaagttagttttgtatttgtcagagttgatacataatcaccaaggtgaattgactgaagaagagctaggcacagcagaactgcttatgaatgctttgaagttatgtggtcacaagtgcatccctcccagtgcatcaacaaaagcagaccttattaaaatgatcaaagaggaacaaaagaaatatgaaactgaagaaggagtgaataaagctgcttggcagaaaacagttaacaataatcaacaaagtctctttcagcgtctggattcaaaatcaaaggatatatctaaaatagctgcagatatcacccaggcagtgtctctctcccaaggaaatgagagaaaaaaggtgatccagcatattagaggaatgtataaagtagatttgagtgccagcagacattggcaggaacttattcagcagctgacacatgatagagcagtatggtatgaccccatctactatccaacctcatggcagttggatccaacagaagggccaaatcgagagaggagacgtttacagagatgttatttaactattccaaataagtatctccttagggatagacagaaatcagaagatgttgtcaaaccaccactctcttacctgtttgaagacaaaactcattcttctttctcttctactgtcaaagacaaagctgcaagtgaatctataagagtgaatcgaagatgcatcagtgttgcaccatctagagagacagctggtgaattgttactaggtaaatgtggaatgtattttgtggaagataatgcttctgatacagttgaaagttcgagccttcagggagagttggaaccagcatcattttcctggacatatgaagaaattaaagaagttcacaagcgttggtggcaattgagagataatgctgtagaaatctttctaacaaatggcagaacactcctgttggcatttgataacaccaaggttcgtgatgatgtataccacaatatactcacaaataacctccctaatcttctggaatatggtaacatcaccgctctgacaaatttatggtatactgggcaaattactaattttgaatatttgactcacttaaacaaacatgctggccgatccttcaatgatctcatgcagtatcctgtgttcccatttatacttgctgactacgttagtgagacacttgacctcaatgatctgttgatatacagaaatctctctaaacctatagctgttcagtataaagaaaaagaagatcgttatgtggacacatacaagtacttggaggaagagtaccgcaaaggagccagagaagatgaccccatgcctcccgtgcagccctatcactatggctcccactattccaatagcggcactgtgcttcacttcctggtcaggatgcctcctttcactaaaatgtttttagcctatcaagatcaaagttttgacattccagacagaacttttcattctacaaatacaacttggcgactctcatcttttgaatctatgactgatgtgaaagaacttatcccagagtttttctatcttccagagttcctagttaaccgtgaaggttttgattttggtgtgcgtcagaatggtgaacgggttaatcacgtcaaccttcccccttgggcgcgtaatgatcctcgtctttttatcctcatccatcggcaggctctagagtctgactacgtgtcgcagaacatctgtcagtggattgacttggtgtttgggtataagcaaaaggggaaggcttctgttcaagcgatcaatgtttttcatcctgctacatattttggaatggatgtctctgcagttgaagatccagttcagagacgagcgctagaaaccatgataaaaacctacgggcagactccccgtcagctgttccacatggcccatgtgagcagacctggagccaagctcaatattgaaggagagcttccagctgctgtggggttgctagtgcagtttgctttcagggagacccgagaacaggtcaaagaaatcacctatccgagtcctttgtcatggataaaaggcttgaaatggggggaatacgtgggttcccccagtgctccagtacctgtggtctgcttcagccagccccacggagaaagatttggctctctccaggctctgcccaccagagcaatctgtggtttgtcacggaatttctgtcttctgatgacatatagcaaggaacaaggtgtgagaagcatgaacagtacggacattcagtggtcagccatcctgagctggggatatgctgataatattttaaggttgaagagtaaacaaagtgagcctccagtaaactttattcaaagttcacaacagtaccaggtgactagttgtgcttgggtgcctgacagttgccagctgtttactggaagcaaatgcggtgtcatcacagcctacacaaacagatttacaagcagcacgccatcagaaatagaaatggagactcaaatacatctctatggtcacacagaagagataaccagcttatttgtttgcaaaccatacagtatactgataagtgtgagcagagacggaacctgcatcatatgggatttaaacaggttatgctatgtacaaagtctggcgggacacaaaagccctgtcacagctgtctctgccagtgaaacctcaggtgatattgctactgtgtgtgattcagctggcggaggcagtgacctcagactctggacggtgaacggggatctcgttggacatgtccactgcagggagatcatctgttccgtggctttctccaaccagcctgagggagtatctatcaatgtaatcgctgggggattagaaaatggaattgtaaggttatggagcacatgggacttaaagcctgtgagagaaattacatttcccaaatcaaataagcccatcatcagccttacattttcttgtgatggccaccatttgtacacagcaaacagtgatgggaccgtgattgcctggtgtcggaaggaccagcagcgcttgaaacagccaatgttctattccttccttagcagctatgcagccgggtgaatgcgaatgaacttcacgttctccaaagcactttaactccaaactagatttgttgacttcaccagttttaggaggttgaacctaaagaaatggatgactggacaaaccatccaaataatgataaagtctattcatctgcacaaaattctgaagagtcacatgatcctaagaggaaagttctgttctattttagtgataatctggaagattgtgtcaatatgcactagccaacaagttttaagcctcgcatggtacattaaaatgatattcttaaaattttttcccaccaaggtattccaaagaaaatattaaggtctcccctttttctatgattccaaaaggaccagtagaatttaaattggttggttgattgtttatataaaacacactaaaattatattttaaaagtttactgccatgaaatactcctcccaccacacacacatgctccaaaagaggaaagaaaaaaagataatttttaggacttgataattgctttctttgagaagcaaattattcagtaggtgcctctgtaccaaatattttatggaatatctaaatactaaaataaactatgaatgaatctcaaaattaggcagtttttgccagttgctttcttagctcaaaggagaaccagaatttttttgacagccacaaacaagaatacaggtatcttggatttcagacacattctgtttcttcataaaaattttacttaaaatctgtaacgctagatattgactatccttagttgagtcactgaggtttaaacacaatggtaagtcttaaagtctgctatttacagagcattgaatctgtaccaatttgcaatagaaagccttcagtatgcaagaagtttgcatgggtattaagaacacagcctaaataaggcatttgatctaatctgcaggaagaattttcttccccaaaacagaattataaaagcttactttaaacaggaggcagaataattcttttaggaaaccatttcattctgtttctactaacctataccatctgagaattctaggaagaataataaaatctcgtgtattccacagcaaacttacataccataaagacagaattcctaaacatcttggagccgtctgtctctcccatatgatggctgtctgtatatttttacttggggtgctgctttattggctttgaaaacactgtcagataagctcagtaatatgttaccatgggataaaaatatgtatccctgcctaagaataacttgtgcatttgttatggaaatttaattcatatggtgtttacagtactacttttgtaacttccagactttctaaaacattctgcttaaaaaccatatgccatgtatgctttaaccttaaactgcatacacatgtagtgatacctaggctgcatttagatcaccgtgtgctcaggccaggtgtgaatcctgaggtccatggaggtgcagagatgagattactcctattcacgttgaagtgatttgctttgttaacaaaaaattgcagctattgtctagctttcatttttttactgagaactttaaattagtcccctattagaatagggttgctactcatctttttttaaaaaccgaatttcatcatttatctaaagagaaaatatgcagaataactggtcttgttaagagtgcaatattatatttttatgtaaaaataaaaattaatttggggggattatttattcagcatgaaacctaatatgtatatgtttgaaatacttcataatgtgcatgttgtagcaaacatttctgtaaattatcacaagctctgttacctttatatacactgcctcttcaatttggaaataaatttcataaaaatagaaaaaaaaaaaaacaaaaaacaaaaaaaaaaaatgtgtgcgcggcgcgcgccctgggcccccgcgagaagaggccttcttaagcaccctggggtgggggcgcgcggaggagccccacagataggtgaaaaagggacacaaatgggccacaaacgcgcggcaccccgaaggcgaaactcgcgcgacacgacaaccagagggcagcggacatcatccaccaataaaaaacacagccccgggggggaaacacggagacgcgtctgcacacaaaacactcacgacaggagagtcacgaagagagggcaacacaagcgcgggaactaactacacaacaggggaagcacaaaaagaagaaagccgagaaattcaacaaattaaacgcccgtaagcactcgtggataacaagaaaagacacagaagaagagaaaagaaaaaccagaagaacaaacaagacaacacacaagccaaaaacacgcagcaacaagaaagcgaaaggcagacggagcggagagcagcagaggacagagagtgaacggaagagacgaggagcgaagagagggggagggaggacggcgggagccgacagcaaggcccgcggagcgagagggggggacagacaagaagaaaggaagcagagagaagggacgagagacgagaggcaagagcgcgcggaggagcaggagcagacggggagc

SEQ ID NO: 330112 - DNA, 10834 bp, Homo sapiens
  misc_feature (2724)..(2724): n is a, c, g, or t
gagagagggccactcgccttcctggtgacacagagatttcctagccccgttaccaaacgaaaaagcaacgcaagggcttctaagaagccatcccaatgaccttttggctttgagaagagcagtcctcataccagagtgtttggggttttggcctctttcagtgtttattcattcttacgtgggaaagttgtattccgaggtttctgtggtgcatgaagcttttgccttcaccatctgttcccgtgtcttcctcgggtgacatcagagtacagcagtattttcccttgccatctaatggggtttgggctgtttgactcaaccgtgtgtgttcctcaatgccaggggaataatcctaccctaagtcagctgaacagaagccaggatctaactgcaaacaagagacccagcttgcttaacagcatggaagagaccagtttcgttgcagctacctgggaagacggttgctaattagcctgcaacaaagagttccttgctcatctaaaagaggcaatcaccgttcaggtgaagctttgttctaagaatatttgtttcatctagtttatgagtccaaatgatatagactgtaaatgtcacagcagtggtgaaagactgctcggtcatgagcaccgacagtaactcactggcacgtgaatttctgaccgatgtcaaccggctttgcaatgcagtggtccagagggtggaggccagggaggaagaagaggaggagacgcacatggcaacccttggacagtaccttgtccatggtcgaggatttctattacttaccaagctaaattctataattgatcaggcattgacatgtagagaagaactcctgactcttcttctgtctctccttccactggtatggaagatacctgtccaagaagaaaaggcaacagattttaacctaccgctctcagcagatataatcctgaccaaagaaaagaactcaagttcacaaagatccactcaggaaaaattacatttagaaggaagtgccctgtctagtcaggtttctgcaaaagtaaatgtttttcgaaaaagcagacgacagcgtaaaattacccatcgctattctgtaagagatgcaagaaagacacagctctccacctcagattcagaagccaattcagatgaaaaaggcatagcaatgaataagcatagaaggccccatctgctgcatcattttttaacatcgtttcctaaacaagaccaccccaaagctaaacttgaccgcttagcaaccaaagaacagactcctccagatgctatggctttggaaaattccagagagattattccaagacaggggtcaaacactgacattttaagtgagccagctgccttgtctgttatcagtaacatgaacaattctccatttgacttatgtcatgttttgttatctttattagaaaaagtttgtaagtttgacgttaccttgaatcataattctcctttagcagccagtgtagtgcccacactaactgaattcctagcaggctttggggactgctgcagtctgagcgacaacttggagagtcgagtagtttctgcaggttggaccgaagaaccggtggctttgattcaaaggatgctctttcgaacagtgttgcatcttctgtcagtagatgttagtactgcagagatgatgccagaaaatcttaggaaaaatttaactgaattgcttagagcagctttaaaaattagaatatgcctagaaaagcagcctgacccttttgcaccaagacaaaagaaaacactgcaggaggttcaggaagattttgtgttttcaaagtatcgtcatagagcccttcttttacctgagcttttggaaggagttcttcagattctgatctgttgtcttcaaagtgcagcttcaaatcccttctacttcagtcaagccatggatttggttcaagaattcattcagcatcatggatttaatttatttgaaacagcagttcttcaaatggaatggctggttttaagagatggagttcctcccgaggcctcagagcatttgaaagccctaataaatagtgtgatgaaaataatgagcactgtcaaaaaagtgaaatcagagcaacttcatcattcgatgtgtacaagaaaaaggcacagacgatgtgaatattctcattttatgcatcatcaccgagatctctcaggtcttctggtttcggcttttaaaaaccaggtttccaaaaacccatttgaagagactgcagatggagatgtttattatcctgagcggtgctgttgcattgcagtgtgtgcccatcagtgcttgcgcttactacagcaggcttccttgagcagcacttgtgtccagatcctatcgggtgttcataacattggaatatgctgttgtatggatcccaaatctgtaatcattcctttgctccatgcttttaaattgccagcactgaaaaattttcagcagcatatattgaatatccttaacaaacttattttggatcagttaggaggagcagagatatcaccaaaaattaaaaaagcagcttgtaatatttgtactgttgactctgaccaactagcccaattagaagagacactgcagggaaacttatgtgatgctgaactctcctcaagtttatccagtccttcttacagatttcaagggatcctgcccagcagtggatctgaagatttgttgtggaaatgggatgctttaaaggcttatcagaactttgtttttgnagaagacagattacatagtatacagattgcaaatcacatttgcaatttaatccagaaaggcaatatagttgttcagtggaaattatataattacatatttaatcctgtgctccaaagaggagttgaattagcacatcattgtcaacacctaagcgttacttcagctcaaagtcatgtatgtagccatcataaccagtgcttgcctcaggacgtgcttcagatttatgtaaaaactctgcctatcctgcttaaatccagggtaataagagatttgtttttgagttgtaatggagtaagtcaaataatcgaattaaattgcttaaatggtattcgaagtcattctctaaaagcatttgaaactctgataatcagcctaggggagcaacagaaagatgcctcagttccagatattgatgggatagacattgaacagaaggagttgtcctctgtacatgtgggtacttcttttcatcatcagcaagcttattcagattctcctcagagtctcagcaaattttatgctggcctcaaagaagcttatccaaagagacggaagactgttaaccaagatgttcatatcaacacaataaacctattcctctgtgtggcttttttatgcgtaagtaaagaagcagagtctgacagggagtcggccaatgactcagaagatacttctggctatgacagcacagccagcgagcctttaagtcatatgctgccatgtatatctctcgagagccttgtcttgccttctcctgaacatatgcaccaagcagcagacatttggtctatgtgtcgttggatctacatgttgagttcagtgttccagaaacagttttataggcttggtggtttccgagtatgccataagttaatatttatgataatacagaaactgttcagaagtcacaaagaggagcaaggaaaaaaggagggagatacaagtgtaaatgaaaaccaggatttaaacagaatttctcaacctaagagaactatgaaggaagatttattatctttggctataaaaagtgaccccataccatcagaactaggtagtctaaaaaagagtgctgacagtttaggtaaattagagttacagcatatttcttccataaatgtggaagaagtttcagctactgaagccgctcccgaggaagcaaagctatttacaagtcaagaaagtgagacctcacttcaaagtatacgacttttggaagcccttctggccatttgtcttcatggtgccagaactagtcaacagaagatggaattggagttacctaatcagaacttgtctgtggaaagtatattatttgaaatgagggaccatctttcccagtcaaaggtgattgaaacacaactagcaaagcctttatttgatgccctgcttcgagttgccctcgggaattattcagcagattttgaacataatgatgctatgactgagaagagtcatcaatctgcagaagaattgtcatcccagcctggtgatttttcagaagaagctgaggattctcagtgttgtagttttaaacttttagttgaagaagaaggttacgaagcagatagtgaaagcaatcctgaagatggcgaaacccaggatgatggggtagacttaaagtctgaaacagaaggtttcagtgcatcaagcagtccaaatgacttactcgaaaacctcactcaaggggaaataatttatcctgagatttgtatgctggaattaaatttgctttctgctagtaaagccaaacttgatgtgcttgcccatgtatttgagagttttttgaaaattattaggcagaaagaaaagaatgtttttctgctcatgcaacagggaactgtgaaaaatcttttaggagggttcttgagtattttaacacaggatgattctgattttcaagcatgccagagagtattggtggatcttttggtatctttgatgagttcaagaacatgttcagaagagctaacccttcttttgagaatatttctggagaaatctccttgtacaaaaattcttcttctgggtattctgaaaattattgaaagtgatactactatgagcccttcacagtatctaaccttccctttactgcacgctccaaatttaagcaacggtgtttcatcacaaaagtatcctgggattttaaacagtaaggccatgggtttattgagaagagcacgagtttcacggagcaagaaagaggctgatagagagagttttccccatcggctgctttcatcttggcacatagccccagtccacctgccgttgctggggcaaaactgctggccacacctatcagaaggtttcagtgtttccctgtggtttaatgtggagtgtatccatgaagctgagagtactacagaaaaaggaaagaagataaagaaaagaaacaaatcattaattttaccagatagcagttttgatggtacagagagcgacagaccagaaggtgcagagtacataaatcctggtgaaagactcatagaagaaggatgtattcatataatttcactgggatccaaagcgttgatgatccaagtgtgggctgatccccacaatgccactcttatctttcgtgtgtgcatggattcaaatgatgacatgaaagctgttttactagcacaggttgaatcacaggagaatattttcctcccaagcaaatggcaacatttagtactcacctacttacagcagccccaagggaaaaggaggattcatgggaaaatctccatatgggtctctggacagaggaagcctgatgttactttggattttatgcttccaagaaaaacaagtttgtcatctgatagcaataaaacattttgcatgattggccattgtttatcatcccaagaagagtttttgcagttggctggaaaatgggacctgggaaatttgcttctcttcaacggagctaaggttggttcacaagaggccttttatctgtatgcttgtggacccaaccatacatctgtaatgccatgtaagtatggcaagccagtcaatgactactccaaatatattaataaagaaattttgcgatgtgaacaaatcagagaactttttatgaccaagaaagatgtggatattggtctcttaattgaaagtctttcagttgtttatacaacttactgtcctgctcagtataccatctatgaaccagtgattagacttaaaggtcaaatgaaaacccaactctctcaaagacccttcagctcaaaagaagttcagagcatcttattagaacctcatcatctaaagaatctccaacctactgaatataaaactattcaaggcattctgcacgaaattggtggaactggcatatttgtttttctctttgccagggttgttgaactcagtagctgtgaagaaactcaagcattagcactgcgagttatactctcattaattaaatacaaccaacaaagagtacatgaattagaaaattgtaatggactttctatgattcatcaggtgttgatcaaacaaaaatgcattgttgggttttacattttgaagacccttcttgaaggatgctgtggtgaagatattatttatatgaatgagaatggagagtttaagttggatgtagactctaatgctataatccaagatgttaagctgttagaggaactattgcttgactggaagatatggagtaaagcagagcaaggtgtttgggaaactttgctagcagctctagaagtcctcatcagagcagatcaccaccagcagatgtttaatattaagcagttattgaaagctcaagtggttcatcactttctactgacttgtcaggttttgcaggaatacaaagaggggcaactcacacccatgccccgagagatggcaagatctttcaggagaaagtgcggtcaatcatgtacctgaggcattccagcagtggaggaaggtcccttatgagccctggatttatggtaataagcccatctggttttactgcttcaccatatgaaggagagaattcctctaatattattccacaacagatggccgcccatatgctgcgttctagaagcctaccagcattccctacttcttcactactaacgcaatcacaaaaactgactggaagtttgggttgtagtatcgacaggttacaaaatattgcagatacttatgttgccacccaatcaaagaaacaaaattctttggggagttccgacacactgaaaaaaggcaaagaggacgcattcatcagtagctgtgagtctgcaaaaactgtttgtgaaatggaagctgtcctctcagcccaggtctctgtcagtgatgtcccaaagggagtgctgggatttccagtggtcaaagcagatcataaacagttgggagcagaacccaggtcagaagatgacagtcctggggatgagtcctgcccacgccgacctgattacctaaagggattggcctccttccagcgaagccacagcactattgcaagccttgggctagcttttccttcacagaacggatctgcagctgttggccgttggccaagtcttgttgatagaaacactgatgattgggaaaatgtaactgaagactgtttggtacctatatgctgtggattatatgaactcctaagtggggttcttcttatcctgcctgatgttttgcttgaagatgtgatggacaagcttattcaagcagatacacttttggtcctcgttaaccacccatcaccagctatacaacaaggtgttattaaactattagatgcatattttgctagagcatctaaggaacaaaaagataaatttctgaagaatcgtggattttccttgctagccaaccagttgtatcttcatcgaggaactcaagaattgttagaatgcttcatcgaaatgttctttggtcgacatattggccttgatgaagaatttgatctggaagatgtgagaaacatgggattgtttcagaagtggtctgtcattcctattctgggactaatagagacctctctatatgacaacatactcttgcataatgctcttttacttcttctccaaattttaaattcttgttctaaggtagcagatatgttgctggataatggtctactctatgtgttatgtaatacagtagcagccctgaatggattagaaaagaacattcccatgagtgaatataaattgcttgcttgtgatatacagcaacttttcatagcagttacaattcatgcttgcagttcctcaggctcacaatattttagggttattgaagaccttattgtaatgcttggatatcttcaaaatagcaaaaacaagaggacacaaaatatggctgttgcactacagcttagagttctccaggctgctatggaatttataaggaccaccgcaaatcatgactctgaaaacctcacagattcactccagtcaccttctgctccccatcatgcagtagttcaaaagcggaaaagcattgctggtcctcgaaaatttccccttgctcaaactgaatcgcttctgatgaaaatgcgttcagtggcaaatgatgagcttcatgtgatgatgcaacggagaatgagccaagagaaccctagccaagcaactgaaacggaacttgcgcagagactacagaggctcactgttttagcagtcaacaggattatttatcaagaatttaattcagacattattgacattttgagaactccagaaaatgtaactcaaagcaagacctcagttttccagaccgaaatttctgaggaaaatattcatcatgaacagtcttctgttttcaatccatttcagaaagaaatttttacatatctggtagaaggattcaaagtatctattggttcaagtaaagccagtggttccaagcagcaatggactaaaattctgtggtcttgtaaggagaccttccgaatgcagcttgggagactactagtgcatattttgtcgccagcccacgctgcacaagagagaaagcaaatttttgaaatagttcatgaaccaaatcatcaggaaatactacgagactgtctcagcccatccctacaacatggagccaagttagttttgtatttgtcagagttgatacataatcaccaaggtgaattgactgaagaagagctaggcacagcagaactgcttatgaatgctttgaagttatgtggtcacaagtgcatccctcccagtgcatcaacaaaagcagaccttattaaaatgatcaaagaggaacaaaagaaatatgaaactgaagaaggagtgaataaagctgcttggcagaaaacagttaacaataatcaacaaagtctctttcagcgtctggattcaaaatcaaaggatatatctaaaatagctgcagatatcacccaggcagtgtctctctcccaaggaaatgagagaaaaaaggtgatccagcatattagaggaatgtataaagtagatttgagtgccagcagacattggcaggaacttattcagcagctgacacatgatagagcagtatggtatgaccccatctactatccaacctcatggcagttggatccaacagaagggccaaatcgagagaggagacgtttacagagatgttatttaactattccaaataagtatctccttagggatagacagaaatcagaagatgttgtcaaaccaccactctcttacctgtttgaagacaaaactcattcttctttctcttctactgtcaaagacaaagctgcaagtgaatctataagagtgaatcgaagatgcatcagtgttgcaccatctagagagacagctggtgaattgttactaggtaaatgtggaatgtattttgtggaagataatgcttctgatacagttgaaagttcgagccttcagggagagttggaaccagcatcattttcctggacatatgaagaaattaaagaagttcacaagcgttggtggcaattgagagataatgctgtagaaatctttctaacaaatggcagaacactcctgttggcatttgataacaccaaggttcgtgatgatgtataccacaatatactcacaaataacctccctaatcttctggaatatggtaacatcaccgctctgacaaatttatggtatactgggcaaattactaattttgaatatttgactcacttaaacaaacatgctggccgatccttcaatgatctcatgcagtatcctgtgttcccatttatacttgctgactacgttagtgagacacttgacctcaatgatctgttgatatacagaaatctctctaaacctatagctgttcagtataaagaaaaagaagatcgttatgtggacacatacaagtacttggaggaagagtaccgcaaaggagccagagaagatgaccccatgcctcccgtgcagccctatcactatggctcccactattccaatagcggcactgtgcttcacttcctggtcaggatgcctcctttcactaaaatgtttttagcctatcaagattttttttagtggccagccaatgccaattgactcaacagaatagatgagaaagtaatacaagtgacagaagatgttgctcagcagagcaactaaggctgggagaagaaacctgatgctgcgatgtgtttgtggcagtctccaaatgaaaagatgtgttcaaatttcaacaagttcagaggagttttagatgatgcaatatggttcctaagaaacatgtaaactgctactgttttcagaggctagcttttggatatcatttaatattctaggcctttccctatggctagaaagtctgatcattgttggcagaaaagagagtccaaacttaattctttattattaatagtctaccctggaaaaaaaatgaacgaaagagtgactatgcttatttttattttcattcacaggaaattttactcaattctttagctcagagttagaacaccaaaaaacaatgcaccgtaacctacgcacccccccgaaaaaaaagaaagaaagaaaagaaaggagaaaaagtagtcttaacaattcaaagtgaaggaatcatgcttcctgatggggaaaaaactgtttgcctacttgaacttaaatcttccttcttcattattcattcattcaataaataaaccatgattgaatacccaaa

SEQ ID NO: 330113 - DNA, 9679 bp, Homo sapiens
  misc_feature (2724)..(2724): n is a, c, g, or t
gagagagggccactcgccttcctggtgacacagagatttcctagccccgttaccaaacgaaaaagcaacgcaagggcttctaagaagccatcccaatgaccttttggctttgagaagagcagtcctcataccagagtgtttggggttttggcctctttcagtgtttattcattcttacgtgggaaagttgtattccgaggtttctgtggtgcatgaagcttttgccttcaccatctgttcccgtgtcttcctcgggtgacatcagagtacagcagtattttcccttgccatctaatggggtttgggctgtttgactcaaccgtgtgtgttcctcaatgccaggggaataatcctaccctaagtcagctgaacagaagccaggatctaactgcaaacaagagacccagcttgcttaacagcatggaagagaccagtttcgttgcagctacctgggaagacggttgctaattagcctgcaacaaagagttccttgctcatctaaaagaggcaatcaccgttcaggtgaagctttgttctaagaatatttgtttcatctagtttatgagtccaaatgatatagactgtaaatgtcacagcagtggtgaaagactgctcggtcatgagcaccgacagtaactcactggcacgtgaatttctgaccgatgtcaaccggctttgcaatgcagtggtccagagggtggaggccagggaggaagaagaggaggagacgcacatggcaacccttggacagtaccttgtccatggtcgaggatttctattacttaccaagctaaattctataattgatcaggcattgacatgtagagaagaactcctgactcttcttctgtctctccttccactggtatggaagatacctgtccaagaagaaaaggcaacagattttaacctaccgctctcagcagatataatcctgaccaaagaaaagaactcaagttcacaaagatccactcaggaaaaattacatttagaaggaagtgccctgtctagtcaggtttctgcaaaagtaaatgtttttcgaaaaagcagacgacagcgtaaaattacccatcgctattctgtaagagatgcaagaaagacacagctctccacctcagattcagaagccaattcagatgaaaaaggcatagcaatgaataagcatagaaggccccatctgctgcatcattttttaacatcgtttcctaaacaagaccaccccaaagctaaacttgaccgcttagcaaccaaagaacagactcctccagatgctatggctttggaaaattccagagagattattccaagacaggggtcaaacactgacattttaagtgagccagctgccttgtctgttatcagtaacatgaacaattctccatttgacttatgtcatgttttgttatctttattagaaaaagtttgtaagtttgacgttaccttgaatcataattctcctttagcagccagtgtagtgcccacactaactgaattcctagcaggctttggggactgctgcagtctgagcgacaacttggagagtcgagtagtttctgcaggttggaccgaagaaccggtggctttgattcaaaggatgctctttcgaacagtgttgcatcttctgtcagtagatgttagtactgcagagatgatgccagaaaatcttaggaaaaatttaactgaattgcttagagcagctttaaaaattagaatatgcctagaaaagcagcctgacccttttgcaccaagacaaaagaaaacactgcaggaggttcaggaagattttgtgttttcaaagtatcgtcatagagcccttcttttacctgagcttttggaaggagttcttcagattctgatctgttgtcttcaaagtgcagcttcaaatcccttctacttcagtcaagccatggatttggttcaagaattcattcagcatcatggatttaatttatttgaaacagcagttcttcaaatggaatggctggttttaagagatggagttcctcccgaggcctcagagcatttgaaagccctaataaatagtgtgatgaaaataatgagcactgtcaaaaaagtgaaatcagagcaacttcatcattcgatgtgtacaagaaaaaggcacagacgatgtgaatattctcattttatgcatcatcaccgagatctctcaggtcttctggtttcggcttttaaaaaccaggtttccaaaaacccatttgaagagactgcagatggagatgtttattatcctgagcggtgctgttgcattgcagtgtgtgcccatcagtgcttgcgcttactacagcaggcttccttgagcagcacttgtgtccagatcctatcgggtgttcataacattggaatatgctgttgtatggatcccaaatctgtaatcattcctttgctccatgcttttaaattgccagcactgaaaaattttcagcagcatatattgaatatccttaacaaacttattttggatcagttaggaggagcagagatatcaccaaaaattaaaaaagcagcttgtaatatttgtactgttgactctgaccaactagcccaattagaagagacactgcagggaaacttatgtgatgctgaactctcctcaagtttatccagtccttcttacagatttcaagggatcctgcccagcagtggatctgaagatttgttgtggaaatgggatgctttaaaggcttatcagaactttgtttttgnagaagacagattacatagtatacagattgcaaatcacatttgcaatttaatccagaaaggcaatatagttgttcagtggaaattatataattacatatttaatcctgtgctccaaagaggagttgaattagcacatcattgtcaacacctaagcgttacttcagctcaaagtcatgtatgtagccatcataaccagtgcttgcctcaggacgtgcttcagatttatgtaaaaactctgcctatcctgcttaaatccagggtaataagagatttgtttttgagttgtaatggagtaagtcaaataatcgaattaaattgcttaaatggtattcgaagtcattctctaaaagcatttgaaactctgataatcagcctaggggagcaacagaaagatgcctcagttccagatattgatgggatagacattgaacagaaggagttgtcctctgtacatgtgggtacttcttttcatcatcagcaagcttattcagattctcctcagagtctcagcaaattttatgctggcctcaaagaagcttatccaaagagacggaagactgttaaccaagatgttcatatcaacacaataaacctattcctctgtgtggcttttttatgcgtaagtaaagaagcagagtctgacagggagtcggccaatgactcagaagatacttctggctatgacagcacagccagcgagcctttaagtcatatgctgccatgtatatctctcgagagccttgtcttgccttctcctgaacatatgcaccaagcagcagacatttggtctatgtgtcgttggatctacatgttgagttcagtgttccagaaacagttttataggcttggtggtttccgagtatgccataagttaatatttatgataatacagaaactgttcagaagtcacaaagaggagcaaggaaaaaaggagggagatacaagtgtaaatgaaaaccaggatttaaacagaatttctcaacctaagagaactatgaaggaagatttattatctttggctataaaaagtgaccccataccatcagaactaggtagtctaaaaaagagtgctgacagtttaggtaaattagagttacagcatatttcttccataaatgtggaagaagtttcagctactgaagccgctcccgaggaagcaaagctatttacaagtcaagaaagtgagacctcacttcaaagtatacgacttttggaagcccttctggccatttgtcttcatggtgccagaactagtcaacagaagatggaattggagttacctaatcagaacttgtctgtggaaagtatattatttgaaatgagggaccatctttcccagtcaaaggtgattgaaacacaactagcaaagcctttatttgatgccctgcttcgagttgccctcgggaattattcagcagattttgaacataatgatgctatgactgagaagagtcatcaatctgcagaagaattgtcatcccagcctggtgatttttcagaagaagctgaggattctcagtgttgtagttttaaacttttagttgaagaagaaggttacgaagcagatagtgaaagcaatcctgaagatggcgaaacccaggatgatggggtagacttaaagtctgaaacagaaggtttcagtgcatcaagcagtccaaatgacttactcgaaaacctcactcaaggggaaataatttatcctgagatttgtatgctggaattaaatttgctttctgctagtaaagccaaacttgatgtgcttgcccatgtatttgagagttttttgaaaattattaggcagaaagaaaagaatgtttttctgctcatgcaacagggaactgtgaaaaatcttttaggagggttcttgagtattttaacacaggatgattctgattttcaagcatgccagagagtattggtggatcttttggtatctttgatgagttcaagaacatgttcagaagagctaacccttcttttgagaatatttctggagaaatctccttgtacaaaaattcttcttctgggtattctgaaaattattgaaagtgatactactatgagcccttcacagtatctaaccttccctttactgcacgctccaaatttaagcaacggtgtttcatcacaaaagtatcctgggattttaaacagtaaggccatgggtttattgagaagagcacgagtttcacggagcaagaaagaggctgatagagagagttttccccatcggctgctttcatcttggcacatagccccagtccacctgccgttgctggggcaaaactgctggccacacctatcagaaggtttcagtgtttccctgtggtttaatgtggagtgtatccatgaagctgagagtactacagaaaaaggaaagaagataaagaaaagaaacaaatcattaattttaccagatagcagttttgatggtacagagagcgacagaccagaaggtgcagagtacataaatcctggtgaaagactcatagaagaaggatgtattcatataatttcactgggatccaaagcgttgatgatccaagtgtgggctgatccccacaatgccactcttatctttcgtgtgtgcatggattcaaatgatgacatgaaagctgttttactagcacaggttgaatcacaggagaatattttcctcccaagcaaatggcaacatttagtactcacctacttacagcagccccaagggaaaaggaggattcatgggaaaatctccatatgggtctctggacagaggaagcctgatgttactttggattttatgcttccaagaaaaacaagtttgtcatctgatagcaataaaacattttgcatgattggccattgtttatcatcccaagaagagtttttgcagttggctggaaaatgggacctgggaaatttgcttctcttcaacggagctaaggttggttcacaagaggccttttatctgtatgcttgtggacccaaccatacatctgtaatgccatgtaagtatggcaagccagtcaatgactactccaaatatattaataaagaaattttgcgatgtgaacaaatcagagaactttttatgaccaagaaagatgtggatattggtctcttaattgaaagtctttcagttgtttatacaacttactgtcctgctcagtataccatctatgaaccagtgattagacttaaaggtcaaatgaaaacccaactctctcaaagacccttcagctcaaaagaagttcagagcatcttattagaacctcatcatctaaagaatctccaacctactgaatataaaactattcaaggcattctgcacgaaattggtggaactggcatatttgtttttctctttgccagggttgttgaactcagtagctgtgaagaaactcaagcattagcactgcgagttatactctcattaattaaatacaaccaacaaagagtacatgaattagaaaattgtaatggactttctatgattcatcaggtgttgatcaaacaaaaatgcattgttgggttttacattttgaagacccttcttgaaggatgctgtggtgaagatattatttatatgaatgagaatggagagtttaagttggatgtagactctaatgctataatccaagatgttaagctgttagaggaactattgcttgactggaagatatggagtaaagcagagcaaggtgtttgggaaactttgctagcagctctagaagtcctcatcagagcagatcaccaccagcagatgtttaatattaagcagttattgaaagctcaagtggttcatcactttctactgacttgtcaggttttgcaggaatacaaagaggggcaactcacacccatgccccgagagatggcaagatctttcaggagaaagtgcggtcaatcatgtacctgaggcattccagcagtggaggaaggtcccttatgagccctggatttatggtaataagcccatctggttttactgcttcaccatatgaaggagagaattcctctaatattattccacaacagatggccgcccatatgctgcgttctagaagcctaccagcattccctacttcttcactactaacgcaatcacaaaaactgactggaagtttgggttgtagtatcgacaggttacaaaatattgcagatacttatgttgccacccaatcaaagaaacaaaattctttggggagttccgacacactgaaaaaaggcaaagaggacgcattcatcagtagctgtgagtctgcaaaaactgtttgtgaaatggaagctgtcctctcagcccaggtctctgtcagtgatgtcccaaagggagtgctgggatttccagtggtcaaagcagatcataaacagttgggagcagaacccaggtcagaagatgacagtcctggggatgagtcctgcccacgccgacctgattacctaaagggattggcctccttccagcgaagccacagcactattgcaagccttgggctagcttttccttcacagaacggatctgcagctgttggccgttggccaagtcttgttgatagaaacactgatgattgggaaaatgtaactgaagactgtttggtacctatatgctgtggattatatgaactcctaagtggggttcttcttatcctgcctgatgttttgcttgaagatgtgatggacaagcttattcaagcagatacacttttggtcctcgttaaccacccatcaccagctatacaacaaggtgttattaaactattagatgcatattttgctagagcatctaaggaacaaaaagataaatttctgaagaatcgtggattttccttgctagccaaccagttgtatcttcatcgaggaactcaagaattgttagaatgcttcatcgaaatgttctttggtcgacatattggccttgatgaagaatttgatctggaagatgtgagaaacatgggattgtttcagaagtggtctgtcattcctattctgggactaatagagacctctctatatgacaacatactcttgcataatgctcttttacttcttctccaaattttaaattcttgttctaaggtagcagatatgttgctggataatggtctactctatgtgttatgtaatacagtagcagccctgaatggattagaaaagaacattcccatgagtgaatataaattgcttgcttgtgatatacagcaacttttcatagcagttacaattcatgcttgcagttcctcaggctcacaatattttagggttattgaagaccttattgtaatgcttggatatcttcaaaatagcaaaaacaagaggacacaaaatatggctgttgcactacagcttagagttctccaggctgctatggaatttataaggaccaccgcaaatcatgactctgaaaacctcacagattcactccagtcaccttctgctccccatcatgcagtagttcaaaagcggaaaagcattgctggtcctcgaaaatttccccttgctcaaactgaatcgcttctgatgaaaatgcgttcagtggcaaatgatgagcttcatgtgatgatgcaacggagaatgagccaagagaaccctagccaagcaactgaaacggaacttgcgcagagactacagaggctcactgttttagcagtcaacaggattatttatcaagaatttaattcagacattattgacattttgagaactccagaaaatgtaactcaaagcaagacctcagttttccagaccgaaatttctgaggaaaatattcatcatgaacagtcttctgttttcaatccatttcagaaagaaatttttacatatctggtagaaggattcaaagtatctattggttcaagtaaagccagtggttccaagcagcaatggactaaaattctgtggtcttgtaaggagaccttccgaatgcagcttgggagactactagtgcatattttgtcgccagcccacgctgcacaagagagaaagcaaatttttgaaatagttcatgaaccaaatcatcaggaaatactacgagactgtctcagcccatccctacaagcacactagaatctccatgttccccaaggactcacccatgacagcttaatgtgtgaactcccagcctttcccccattgggtaacggaattgggctgagtccagattgcaaccacttccaataacatggtttttgggaaagccattatcttccaagccactataggtcaaagatatccactggatttgaaacaataagcaacttgcagttcgggctgtattttacaacattaggaatgatgaatttaaagatgttcacattacactggaccaaattaagatggctttctccctcttgcgatgtgcctcagccgtgatagtgaccagcttggagtttacagttacagtatagtctttgccagagacaatctttggtgttctaaggaaaaggctgccatggtggagatccatcatctcgcccttcaatttgtcttccatgacatcaacaagagcaagttcgcctgccaagtccttcattaagataccgatggcacaggccatgccaagagcaccaaccccaacaactgtaatcttattctggaggatctgttcttcctttagaagactgtgaataagctgatccttgagcgtatacttgagagtatattggacttggaaacaaaaggaatcgagaatgcacgtccggcgggtgttggggcacgcggcagtgagatccagactcgtcggcagcggctccagcaccttcgctacctttaaatacagtcagtcaaggaaaagcaggataaatgctgtttccttccctgtttattaatttttggaatgatgaattcatgcccctagtagcctctaattcttgtatttgtttttatttttggagtgtcattaggagctcaggtattttaaaataaatgttatgtgttttagtctattgcagtcattattcagtttgatattaaaatt

SEQ ID NO: 330114 - DNA, 8606 bp, Homo sapiens
  misc_feature (2724)..(2724): n is a, c, g, or t
gagagagggccactcgccttcctggtgacacagagatttcctagccccgttaccaaacgaaaaagcaacgcaagggcttctaagaagccatcccaatgaccttttggctttgagaagagcagtcctcataccagagtgtttggggttttggcctctttcagtgtttattcattcttacgtgggaaagttgtattccgaggtttctgtggtgcatgaagcttttgccttcaccatctgttcccgtgtcttcctcgggtgacatcagagtacagcagtattttcccttgccatctaatggggtttgggctgtttgactcaaccgtgtgtgttcctcaatgccaggggaataatcctaccctaagtcagctgaacagaagccaggatctaactgcaaacaagagacccagcttgcttaacagcatggaagagaccagtttcgttgcagctacctgggaagacggttgctaattagcctgcaacaaagagttccttgctcatctaaaagaggcaatcaccgttcaggtgaagctttgttctaagaatatttgtttcatctagtttatgagtccaaatgatatagactgtaaatgtcacagcagtggtgaaagactgctcggtcatgagcaccgacagtaactcactggcacgtgaatttctgaccgatgtcaaccggctttgcaatgcagtggtccagagggtggaggccagggaggaagaagaggaggagacgcacatggcaacccttggacagtaccttgtccatggtcgaggatttctattacttaccaagctaaattctataattgatcaggcattgacatgtagagaagaactcctgactcttcttctgtctctccttccactggtatggaagatacctgtccaagaagaaaaggcaacagattttaacctaccgctctcagcagatataatcctgaccaaagaaaagaactcaagttcacaaagatccactcaggaaaaattacatttagaaggaagtgccctgtctagtcaggtttctgcaaaagtaaatgtttttcgaaaaagcagacgacagcgtaaaattacccatcgctattctgtaagagatgcaagaaagacacagctctccacctcagattcagaagccaattcagatgaaaaaggcatagcaatgaataagcatagaaggccccatctgctgcatcattttttaacatcgtttcctaaacaagaccaccccaaagctaaacttgaccgcttagcaaccaaagaacagactcctccagatgctatggctttggaaaattccagagagattattccaagacaggggtcaaacactgacattttaagtgagccagctgccttgtctgttatcagtaacatgaacaattctccatttgacttatgtcatgttttgttatctttattagaaaaagtttgtaagtttgacgttaccttgaatcataattctcctttagcagccagtgtagtgcccacactaactgaattcctagcaggctttggggactgctgcagtctgagcgacaacttggagagtcgagtagtttctgcaggttggaccgaagaaccggtggctttgattcaaaggatgctctttcgaacagtgttgcatcttctgtcagtagatgttagtactgcagagatgatgccagaaaatcttaggaaaaatttaactgaattgcttagagcagctttaaaaattagaatatgcctagaaaagcagcctgacccttttgcaccaagacaaaagaaaacactgcaggaggttcaggaagattttgtgttttcaaagtatcgtcatagagcccttcttttacctgagcttttggaaggagttcttcagattctgatctgttgtcttcaaagtgcagcttcaaatcccttctacttcagtcaagccatggatttggttcaagaattcattcagcatcatggatttaatttatttgaaacagcagttcttcaaatggaatggctggttttaagagatggagttcctcccgaggcctcagagcatttgaaagccctaataaatagtgtgatgaaaataatgagcactgtcaaaaaagtgaaatcagagcaacttcatcattcgatgtgtacaagaaaaaggcacagacgatgtgaatattctcattttatgcatcatcaccgagatctctcaggtcttctggtttcggcttttaaaaaccaggtttccaaaaacccatttgaagagactgcagatggagatgtttattatcctgagcggtgctgttgcattgcagtgtgtgcccatcagtgcttgcgcttactacagcaggcttccttgagcagcacttgtgtccagatcctatcgggtgttcataacattggaatatgctgttgtatggatcccaaatctgtaatcattcctttgctccatgcttttaaattgccagcactgaaaaattttcagcagcatatattgaatatccttaacaaacttattttggatcagttaggaggagcagagatatcaccaaaaattaaaaaagcagcttgtaatatttgtactgttgactctgaccaactagcccaattagaagagacactgcagggaaacttatgtgatgctgaactctcctcaagtttatccagtccttcttacagatttcaagggatcctgcccagcagtggatctgaagatttgttgtggaaatgggatgctttaaaggcttatcagaactttgtttttgnagaagacagattacatagtatacagattgcaaatcacatttgcaatttaatccagaaaggcaatatagttgttcagtggaaattatataattacatatttaatcctgtgctccaaagaggagttgaattagcacatcattgtcaacacctaagcgttacttcagctcaaagtcatgtatgtagccatcataaccagtgcttgcctcaggacgtgcttcagatttatgtaaaaactctgcctatcctgcttaaatccagggtaataagagatttgtttttgagttgtaatggagtaagtcaaataatcgaattaaattgcttaaatggtattcgaagtcattctctaaaagcatttgaaactctgataatcagcctaggggagcaacagaaagatgcctcagttccagatattgatgggatagacattgaacagaaggagttgtcctctgtacatgtgggtacttcttttcatcatcagcaagcttattcagattctcctcagagtctcagcaaattttatgctggcctcaaagaagcttatccaaagagacggaagactgttaaccaagatgttcatatcaacacaataaacctattcctctgtgtggcttttttatgcgtaagtaaagaagcagagtctgacagggagtcggccaatgactcagaagatacttctggctatgacagcacagccagcgagcctttaagtcatatgctgccatgtatatctctcgagagccttgtcttgccttctcctgaacatatgcaccaagcagcagacatttggtctatgtgtcgttggatctacatgttgagttcagtgttccagaaacagttttataggcttggtggtttccgagtatgccataagttaatatttatgataatacagaaactgttcagaagtcacaaagaggagcaaggaaaaaaggagggagatacaagtgtaaatgaaaaccaggatttaaacagaatttctcaacctaagagaactatgaaggaagatttattatctttggctataaaaagtgaccccataccatcagaactaggtagtctaaaaaagagtgctgacagtttaggtaaattagagttacagcatatttcttccataaatgtggaagaagtttcagctactgaagccgctcccgaggaagcaaagctatttacaagtcaagaaagtgagacctcacttcaaagtatacgacttttggaagcccttctggccatttgtcttcatggtgccagaactagtcaacagaagatggaattggagttacctaatcagaacttgtctgtggaaagtatattatttgaaatgagggaccatctttcccagtcaaaggtgattgaaacacaactagcaaagcctttatttgatgccctgcttcgagttgccctcgggaattattcagcagattttgaacataatgatgctatgactgagaagagtcatcaatctgcagaagaattgtcatcccagcctggtgatttttcagaagaagctgaggattctcagtgttgtagttttaaacttttagttgaagaagaaggttacgaagcagatagtgaaagcaatcctgaagatggcgaaacccaggatgatggggtagacttaaagtctgaaacagaaggtttcagtgcatcaagcagtccaaatgacttactcgaaaacctcactcaaggggaaataatttatcctgagatttgtatgctggaattaaatttgctttctgctagtaaagccaaacttgatgtgcttgcccatgtatttgagagttttttgaaaattattaggcagaaagaaaagaatgtttttctgctcatgcaacagggaactgtgaaaaatcttttaggagggttcttgagtattttaacacaggatgattctgattttcaagcatgccagagagtattggtggatcttttggtatctttgatgagttcaagaacatgttcagaagagctaacccttcttttgagaatatttctggagaaatctccttgtacaaaaattcttcttctgggtattctgaaaattattgaaagtgatactactatgagcccttcacagtatctaaccttccctttactgcacgctccaaatttaagcaacggtgtttcatcacaaaagtatcctgggattttaaacagtaaggccatgggtttattgagaagagcacgagtttcacggagcaagaaagaggctgatagagagagttttccccatcggctgctttcatcttggcacatagccccagtccacctgccgttgctggggcaaaactgctggccacacctatcagaaggtttcagtgtttccctgtggtttaatgtggagtgtatccatgaagctgagagtactacagaaaaaggaaagaagataaagaaaagaaacaaatcattaattttaccagatagcagttttgatggtacagagagcgacagaccagaaggtgcagagtacataaatcctggtgaaagactcatagaagaaggatgtattcatataatttcactgggatccaaagcgttgatgatccaagtgtgggctgatccccacaatgccactcttatctttcgtgtgtgcatggattcaaatgatgacatgaaagctgttttactagcacaggttgaatcacaggagaatattttcctcccaagcaaatggcaacatttagtactcacctacttacagcagccccaagggaaaaggaggattcatgggaaaatctccatatgggtctctggacagaggaagcctgatgttactttggattttatgcttccaagaaaaacaagtttgtcatctgatagcaataaaacattttgcatgattggccattgtttatcatcccaagaagagtttttgcagttggctggaaaatgggacctgggaaatttgcttctcttcaacggagctaaggttggttcacaagaggccttttatctgtatgcttgtggacccaaccatacatctgtaatgccatgtaagtatggcaagccagtcaatgactactccaaatatattaataaagaaattttgcgatgtgaacaaatcagagaactttttatgaccaagaaagatgtggatattggtctcttaattgaaagtctttcagttgtttatacaacttactgtcctgctcagtataccatctatgaaccagtgattagacttaaaggtcaaatgaaaacccaactctctcaaagacccttcagctcaaaagaagttcagagcatcttattagaacctcatcatctaaagaatctccaacctactgaatataaaactattcaaggcattctgcacgaaattggtggaactggcatatttgtttttctctttgccagggttgttgaactcagtagctgtgaagaaactcaagcattagcactgcgagttatactctcattaattaaatacaaccaacaaagagtacatgaattagaaaattgtaatggactttctatgattcatcaggtgttgatcaaacaaaaatgcattgttgggttttacattttgaagacccttcttgaaggatgctgtggtgaagatattatttatatgaatgagaatggagagtttaagttggatgtagactctaatgctataatccaagatgttaagctgttagaggaactattgcttgactggaagatatggagtaaagcagagcaaggtgtttgggaaactttgctagcagctctagaagtcctcatcagagcagatcaccaccagcagatgtttaatattaagcagttattgaaagctcaagtggttcatcactttctactgacttgtcaggttttgcaggaatacaaagaggggcaactcacacccatgccccgagagatggcaagatctttcaggagaaagtgcggtcaatcatgtacctgaggcattccagcagtggaggaaggtcccttatgagccctggatttatggtaataagcccatctggttttactgcttcaccatatgaaggagagaattcctctaatattattccacaacagatggccgcccatatgctgcgttctagaagcctaccagcattccctacttcttcactactaacgcaatcacaaaaactgactggaagtttgggttgtagtatcgacaggttacaaaatattgcagatacttatgttgccacccaatcaaagaaacaaaattctttggggagttccgacacactgaaaaaaggcaaagaggacgcattcatcagtagctgtgagtctgcaaaaactgtttgtgaaatggaagctgtcctctcagcccaggtctctgtcagtgatgtcccaaagggagtgctgggatttccagtggtcaaagcagatcataaacagttgggagcagaacccaggtcagaagatgacagtcctggggatgagtcctgcccacgccgacctgattacctaaagggattggcctccttccagcgaagccacagcactattgcaagccttgggctagcttttccttcacagaacggatctgcagctgttggccgttggccaagtcttgttgatagaaacactgatgattgggaaaatgtaactgaagactgtttggtacctatatgctgtggattatatgaactcctaagtggggttcttcttatcctgcctgatgttttgcttgaagatgtgatggacaagcttattcaagcagatacacttttggtcctcgttaaccacccatcaccagctatacaacaaggtgttattaaactattagatgcatattttgctagagcatctaaggaacaaaaagataaatttctgaagaatcgtggattttccttgctagccaaccagttgtatcttcatcgaggaactcaagaattgttagaatgcttcatcgaaatgttctttggtcgacatattggccttgatgaagaatttgatctggaagatgtgagaaacatgggattgtttcagaagtggtctgtcattcctattctgggactaatagagacctctctatatgacaacatactcttgcataatgctcttttacttcttctccaaattttaaattcttgttctaaggtagcagatatgttgctggataatggtctactctatgtgttatgtaatacagtagcagccctgaatggattagaaaagaacattcccatgagtgaatataaattgcttgcttgtgatatacagcaacttttcatagcagttacaattcatgcttgcagttcctcaggctcacaatattttagggttattgaagaccttattgtaatgcttggatatcttcaaaatagcaaaaacaagaggacacaaaatatggctgttgcactacagcttagagttctccaggctgctatggaatttataaggaccaccgcaaatcatgactctgaaaacctcacagattcactccagtcaccttctgctccccatcatgcagtagttcaaaagcggaaaagcattgctggtcctcgaaaatttccccttgctcaaactgaatcgcttctgatgaaaatgcgttcagtggcaaatgatgagcttcatgtgatgatgcaacggagaatgagccaagagaaccctagccaagcaactgaaacggaacttgcgcagagactacagaggctcactgttttagcagtcaacaggattatttatcaagaatttaattcagacattattgacattttgagaactccagaaaatgtaactcaaagcaagacctcagttttccagaccgaaatttctgaggaaaatattcatcatgaacagtcttctgttttcaatccatttcagaaagaaatttttacatatctggtagaaggattcaaagtatctattggttcaagtgccagtggttccaagcagctggactgtgcatattttgtcgccgc

SEQ ID NO: 330115 - DNA, 7538 bp, Homo sapiens
  misc_feature (2724)..(2724): n is a, c, g, or t
gagagagggccactcgccttcctggtgacacagagatttcctagccccgttaccaaacgaaaaagcaacgcaagggcttctaagaagccatcccaatgaccttttggctttgagaagagcagtcctcataccagagtgtttggggttttggcctctttcagtgtttattcattcttacgtgggaaagttgtattccgaggtttctgtggtgcatgaagcttttgccttcaccatctgttcccgtgtcttcctcgggtgacatcagagtacagcagtattttcccttgccatctaatggggtttgggctgtttgactcaaccgtgtgtgttcctcaatgccaggggaataatcctaccctaagtcagctgaacagaagccaggatctaactgcaaacaagagacccagcttgcttaacagcatggaagagaccagtttcgttgcagctacctgggaagacggttgctaattagcctgcaacaaagagttccttgctcatctaaaagaggcaatcaccgttcaggtgaagctttgttctaagaatatttgtttcatctagtttatgagtccaaatgatatagactgtaaatgtcacagcagtggtgaaagactgctcggtcatgagcaccgacagtaactcactggcacgtgaatttctgaccgatgtcaaccggctttgcaatgcagtggtccagagggtggaggccagggaggaagaagaggaggagacgcacatggcaacccttggacagtaccttgtccatggtcgaggatttctattacttaccaagctaaattctataattgatcaggcattgacatgtagagaagaactcctgactcttcttctgtctctccttccactggtatggaagatacctgtccaagaagaaaaggcaacagattttaacctaccgctctcagcagatataatcctgaccaaagaaaagaactcaagttcacaaagatccactcaggaaaaattacatttagaaggaagtgccctgtctagtcaggtttctgcaaaagtaaatgtttttcgaaaaagcagacgacagcgtaaaattacccatcgctattctgtaagagatgcaagaaagacacagctctccacctcagattcagaagccaattcagatgaaaaaggcatagcaatgaataagcatagaaggccccatctgctgcatcattttttaacatcgtttcctaaacaagaccaccccaaagctaaacttgaccgcttagcaaccaaagaacagactcctccagatgctatggctttggaaaattccagagagattattccaagacaggggtcaaacactgacattttaagtgagccagctgccttgtctgttatcagtaacatgaacaattctccatttgacttatgtcatgttttgttatctttattagaaaaagtttgtaagtttgacgttaccttgaatcataattctcctttagcagccagtgtagtgcccacactaactgaattcctagcaggctttggggactgctgcagtctgagcgacaacttggagagtcgagtagtttctgcaggttggaccgaagaaccggtggctttgattcaaaggatgctctttcgaacagtgttgcatcttctgtcagtagatgttagtactgcagagatgatgccagaaaatcttaggaaaaatttaactgaattgcttagagcagctttaaaaattagaatatgcctagaaaagcagcctgacccttttgcaccaagacaaaagaaaacactgcaggaggttcaggaagattttgtgttttcaaagtatcgtcatagagcccttcttttacctgagcttttggaaggagttcttcagattctgatctgttgtcttcaaagtgcagcttcaaatcccttctacttcagtcaagccatggatttggttcaagaattcattcagcatcatggatttaatttatttgaaacagcagttcttcaaatggaatggctggttttaagagatggagttcctcccgaggcctcagagcatttgaaagccctaataaatagtgtgatgaaaataatgagcactgtcaaaaaagtgaaatcagagcaacttcatcattcgatgtgtacaagaaaaaggcacagacgatgtgaatattctcattttatgcatcatcaccgagatctctcaggtcttctggtttcggcttttaaaaaccaggtttccaaaaacccatttgaagagactgcagatggagatgtttattatcctgagcggtgctgttgcattgcagtgtgtgcccatcagtgcttgcgcttactacagcaggcttccttgagcagcacttgtgtccagatcctatcgggtgttcataacattggaatatgctgttgtatggatcccaaatctgtaatcattcctttgctccatgcttttaaattgccagcactgaaaaattttcagcagcatatattgaatatccttaacaaacttattttggatcagttaggaggagcagagatatcaccaaaaattaaaaaagcagcttgtaatatttgtactgttgactctgaccaactagcccaattagaagagacactgcagggaaacttatgtgatgctgaactctcctcaagtttatccagtccttcttacagatttcaagggatcctgcccagcagtggatctgaagatttgttgtggaaatgggatgctttaaaggcttatcagaactttgtttttgnagaagacagattacatagtatacagattgcaaatcacatttgcaatttaatccagaaaggcaatatagttgttcagtggaaattatataattacatatttaatcctgtgctccaaagaggagttgaattagcacatcattgtcaacacctaagcgttacttcagctcaaagtcatgtatgtagccatcataaccagtgcttgcctcaggacgtgcttcagatttatgtaaaaactctgcctatcctgcttaaatccagggtaataagagatttgtttttgagttgtaatggagtaagtcaaataatcgaattaaattgcttaaatggtattcgaagtcattctctaaaagcatttgaaactctgataatcagcctaggggagcaacagaaagatgcctcagttccagatattgatgggatagacattgaacagaaggagttgtcctctgtacatgtgggtacttcttttcatcatcagcaagcttattcagattctcctcagagtctcagcaaattttatgctggcctcaaagaagcttatccaaagagacggaagactgttaaccaagatgttcatatcaacacaataaacctattcctctgtgtggcttttttatgcgtaagtaaagaagcagagtctgacagggagtcggccaatgactcagaagatacttctggctatgacagcacagccagcgagcctttaagtcatatgctgccatgtatatctctcgagagccttgtcttgccttctcctgaacatatgcaccaagcagcagacatttggtctatgtgtcgttggatctacatgttgagttcagtgttccagaaacagttttataggcttggtggtttccgagtatgccataagttaatatttatgataatacagaaactgttcagaagtcacaaagaggagcaaggaaaaaaggagggagatacaagtgtaaatgaaaaccaggatttaaacagaatttctcaacctaagagaactatgaaggaagatttattatctttggctataaaaagtgaccccataccatcagaactaggtagtctaaaaaagagtgctgacagtttaggtaaattagagttacagcatatttcttccataaatgtggaagaagtttcagctactgaagccgctcccgaggaagcaaagctatttacaagtcaagaaagtgagacctcacttcaaagtatacgacttttggaagcccttctggccatttgtcttcatggtgccagaactagtcaacagaagatggaattggagttacctaatcagaacttgtctgtggaaagtatattatttgaaatgagggaccatctttcccagtcaaaggtgattgaaacacaactagcaaagcctttatttgatgccctgcttcgagttgccctcgggaattattcagcagattttgaacataatgatgctatgactgagaagagtcatcaatctgcagaagaattgtcatcccagcctggtgatttttcagaagaagctgaggattctcagtgttgtagttttaaacttttagttgaagaagaaggttacgaagcagatagtgaaagcaatcctgaagatggcgaaacccaggatgatggggtagacttaaagtctgaaacagaaggtttcagtgcatcaagcagtccaaatgacttactcgaaaacctcactcaaggggaaataatttatcctgagatttgtatgctggaattaaatttgctttctgctagtaaagccaaacttgatgtgcttgcccatgtatttgagagttttttgaaaattattaggcagaaagaaaagaatgtttttctgctcatgcaacagggaactgtgaaaaatcttttaggagggttcttgagtattttaacacaggatgattctgattttcaagcatgccagagagtattggtggatcttttggtatctttgatgagttcaagaacatgttcagaagagctaacccttcttttgagaatatttctggagaaatctccttgtacaaaaattcttcttctgggtattctgaaaattattgaaagtgatactactatgagcccttcacagtatctaaccttccctttactgcacgctccaaatttaagcaacggtgtttcatcacaaaagtatcctgggattttaaacagtaaggccatgggtttattgagaagagcacgagtttcacggagcaagaaagaggctgatagagagagttttccccatcggctgctttcatcttggcacatagccccagtccacctgccgttgctggggcaaaactgctggccacacctatcagaaggtttcagtgtttccctgtggtttaatgtggagtgtatccatgaagctgagagtactacagaaaaaggaaagaagataaagaaaagaaacaaatcattaattttaccagatagcagttttgatggtacagagagcgacagaccagaaggtgcagagtacataaatcctggtgaaagactcatagaagaaggatgtattcatataatttcactgggatccaaagcgttgatgatccaagtgtgggctgatccccacaatgccactcttatctttcgtgtgtgcatggattcaaatgatgacatgaaagctgttttactagcacaggttgaatcacaggagaatattttcctcccaagcaaatggcaacatttagtactcacctacttacagcagccccaagggaaaaggaggattcatgggaaaatctccatatgggtctctggacagaggaagcctgatgttactttggattttatgcttccaagaaaaacaagtttgtcatctgatagcaataaaacattttgcatgattggccattgtttatcatcccaagaagagtttttgcagttggctggaaaatgggacctgggaaatttgcttctcttcaacggagctaaggttggttcacaagaggccttttatctgtatgcttgtggacccaaccatacatctgtaatgccatgtaagtatggcaagccagtcaatgactactccaaatatattaataaagaaattttgcgatgtgaacaaatcagagaactttttatgaccaagaaagatgtggatattggtctcttaattgaaagtctttcagttgtttatacaacttactgtcctgctcagtataccatctatgaaccagtgattagacttaaaggtcaaatgaaaacccaactctctcaaagacccttcagctcaaaagaagttcagagcatcttattagaacctcatcatctaaagaatctccaacctactgaatataaaactattcaaggcattctgcacgaaattggtggaactggcatatttgtttttctctttgccagggttgttgaactcagtagctgtgaagaaactcaagcattagcactgcgagttatactctcattaattaaatacaaccaacaaagagtacatgaattagaaaattgtaatggactttctatgattcatcaggtgttgatcaaacaaaaatgcattgttgggttttacattttgaagacccttcttgaaggatgctgtggtgaagatattatttatatgaatgagaatggagagtttaagttggatgtagactctaatgctataatccaagatgttaagctgttagaggaactattgcttgactggaagatatggagtaaagcagagcaaggtgtttgggaaactttgctagcagctctagaagtcctcatcagagcagatcaccaccagcagatgtttaatattaagcagttattgaaagctcaagtggttcatcactttctactgacttgtcaggttttgcaggaatacaaagaggggcaactcacacccatgccccgagagatggcaagatctttcaggagaaagtgcggtcaatcatgtacctgaggcattccagcagtggaggaaggtcccttatgagccctggatttatggtaataagcccatctggttttactgcttcaccatatgaaggagagaattcctctaatattattccacaacagatggccgcccatatgctgcgttctagaagcctaccagcattccctacttcttcactactaacgcaatcacaaaaactgactggaagtttgggttgtagtatcgacaggttacaaaatattgcagatacttatgttgccacccaatcaaagaaacaaaattctttggggagttccgacacactgaaaaaaggcaaagaggacgcattcatcagtagctgtgagtctgcaaaaactgtttgtgaaatggaagctgtcctctcagcccaggtctctgtcagtgatgtcccaaagggagtgctgggatttccagtggtcaaagcagatcataaacagttgggagcagaacccaggtcagaagatgacagtcctggggatgagtcctgcccacgccgacctgattacctaaagggattggcctccttccagcgaagccacagcactattgcaagccttgggctagcttttccttcacagaacggatctgcagctgttggccgttggccaagtcttgttgatagaaacactgatgattgggaaaactttgcctattctcttggttatgagccaaattacaaccgaactgcaagtgctcacagtgtaactgaagactgtttggtacctatatgctgtggattatatgaactcctaagtggggttcttcttatcctgcctgatgttttgcttgaagatgtgatggacaagcttattcaagcagatacacttttggtcctcgttaaccacccatcaccagctatacaacaaggtgttattaaagtaagggcaaatactagata

SEQ ID NO: 330116 - DNA, 5611 bp, Homo sapiens
  misc_feature (2724)..(2724): n is a, c, g, or t
gagagagggccactcgccttcctggtgacacagagatttcctagccccgttaccaaacgaaaaagcaacgcaagggcttctaagaagccatcccaatgaccttttggctttgagaagagcagtcctcataccagagtgtttggggttttggcctctttcagtgtttattcattcttacgtgggaaagttgtattccgaggtttctgtggtgcatgaagcttttgccttcaccatctgttcccgtgtcttcctcgggtgacatcagagtacagcagtattttcccttgccatctaatggggtttgggctgtttgactcaaccgtgtgtgttcctcaatgccaggggaataatcctaccctaagtcagctgaacagaagccaggatctaactgcaaacaagagacccagcttgcttaacagcatggaagagaccagtttcgttgcagctacctgggaagacggttgctaattagcctgcaacaaagagttccttgctcatctaaaagaggcaatcaccgttcaggtgaagctttgttctaagaatatttgtttcatctagtttatgagtccaaatgatatagactgtaaatgtcacagcagtggtgaaagactgctcggtcatgagcaccgacagtaactcactggcacgtgaatttctgaccgatgtcaaccggctttgcaatgcagtggtccagagggtggaggccagggaggaagaagaggaggagacgcacatggcaacccttggacagtaccttgtccatggtcgaggatttctattacttaccaagctaaattctataattgatcaggcattgacatgtagagaagaactcctgactcttcttctgtctctccttccactggtatggaagatacctgtccaagaagaaaaggcaacagattttaacctaccgctctcagcagatataatcctgaccaaagaaaagaactcaagttcacaaagatccactcaggaaaaattacatttagaaggaagtgccctgtctagtcaggtttctgcaaaagtaaatgtttttcgaaaaagcagacgacagcgtaaaattacccatcgctattctgtaagagatgcaagaaagacacagctctccacctcagattcagaagccaattcagatgaaaaaggcatagcaatgaataagcatagaaggccccatctgctgcatcattttttaacatcgtttcctaaacaagaccaccccaaagctaaacttgaccgcttagcaaccaaagaacagactcctccagatgctatggctttggaaaattccagagagattattccaagacaggggtcaaacactgacattttaagtgagccagctgccttgtctgttatcagtaacatgaacaattctccatttgacttatgtcatgttttgttatctttattagaaaaagtttgtaagtttgacgttaccttgaatcataattctcctttagcagccagtgtagtgcccacactaactgaattcctagcaggctttggggactgctgcagtctgagcgacaacttggagagtcgagtagtttctgcaggttggaccgaagaaccggtggctttgattcaaaggatgctctttcgaacagtgttgcatcttctgtcagtagatgttagtactgcagagatgatgccagaaaatcttaggaaaaatttaactgaattgcttagagcagctttaaaaattagaatatgcctagaaaagcagcctgacccttttgcaccaagacaaaagaaaacactgcaggaggttcaggaagattttgtgttttcaaagtatcgtcatagagcccttcttttacctgagcttttggaaggagttcttcagattctgatctgttgtcttcaaagtgcagcttcaaatcccttctacttcagtcaagccatggatttggttcaagaattcattcagcatcatggatttaatttatttgaaacagcagttcttcaaatggaatggctggttttaagagatggagttcctcccgaggcctcagagcatttgaaagccctaataaatagtgtgatgaaaataatgagcactgtcaaaaaagtgaaatcagagcaacttcatcattcgatgtgtacaagaaaaaggcacagacgatgtgaatattctcattttatgcatcatcaccgagatctctcaggtcttctggtttcggcttttaaaaaccaggtttccaaaaacccatttgaagagactgcagatggagatgtttattatcctgagcggtgctgttgcattgcagtgtgtgcccatcagtgcttgcgcttactacagcaggcttccttgagcagcacttgtgtccagatcctatcgggtgttcataacattggaatatgctgttgtatggatcccaaatctgtaatcattcctttgctccatgcttttaaattgccagcactgaaaaattttcagcagcatatattgaatatccttaacaaacttattttggatcagttaggaggagcagagatatcaccaaaaattaaaaaagcagcttgtaatatttgtactgttgactctgaccaactagcccaattagaagagacactgcagggaaacttatgtgatgctgaactctcctcaagtttatccagtccttcttacagatttcaagggatcctgcccagcagtggatctgaagatttgttgtggaaatgggatgctttaaaggcttatcagaactttgtttttgnagaagacagattacatagtatacagattgcaaatcacatttgcaatttaatccagaaaggcaatatagttgttcagtggaaattatataattacatatttaatcctgtgctccaaagaggagttgaattagcacatcattgtcaacacctaagcgttacttcagctcaaagtcatgtatgtagccatcataaccagtgcttgcctcaggacgtgcttcagatttatgtaaaaactctgcctatcctgcttaaatccagggtaataagagatttgtttttgagttgtaatggagtaagtcaaataatcgaattaaattgcttaaatggtattcgaagtcattctctaaaagcatttgaaactctgataatcagcctaggggagcaacagaaagatgcctcagttccagatattgatgggatagacattgaacagaaggagttgtcctctgtacatgtgggtacttcttttcatcatcagcaagcttattcagattctcctcagagtctcagcaaattttatgctggcctcaaagaagcttatccaaagagacggaagactgttaaccaagatgttcatatcaacacaataaacctattcctctgtgtggcttttttatgcgtaagtaaagaagcagagtctgacagggagtcggccaatgactcagaagatacttctggctatgacagcacagccagcgagcctttaagtcatatgctgccatgtatatctctcgagagccttgtcttgccttctcctgaacatatgcaccaagcagcagacatttggtctatgtgtcgttggatctacatgttgagttcagtgttccagaaacagttttataggcttggtggtttccgagtatgccataagttaatatttatgataatacagaaactgttcagaagtcacaaagaggagcaaggaaaaaaggagggagatacaagtgtaaatgaaaaccaggatttaaacagaatttctcaacctaagagaactatgaaggaagatttattatctttggctataaaaagtgaccccataccatcagaactaggtagtctaaaaaagagtgctgacagtttaggtaaattagagttacagcatatttcttccataaatgtggaagaagtttcagctactgaagccgctcccgaggaagcaaagctatttacaagtcaagaaagtgagacctcacttcaaagtatacgacttttggaagcccttctggccatttgtcttcatggtgccagaactagtcaacagaagatggaattggagttacctaatcagaacttgtctgtggaaagtatattatttgaaatgagggaccatctttcccagtcaaaggtgattgaaacacaactagcaaagcctttatttgatgccctgcttcgagttgccctcgggaattattcagcagattttgaacataatgatgctatgactgagaagagtcatcaatctgcagaagaattgtcatcccagcctggtgatttttcagaagaagctgaggattctcagtgttgtagttttaaacttttagttgaagaagaaggttacgaagcagatagtgaaagcaatcctgaagatggcgaaacccaggatgatggggtagacttaaagtctgaaacagaaggtttcagtgcatcaagcagtccaaatgacttactcgaaaacctcactcaaggggaaataatttatcctgagatttgtatgctggaattaaatttgctttctgctagtaaagccaaacttgatgtgcttgcccatgtatttgagagttttttgaaaattattaggcagaaagaaaagaatgtttttctgctcatgcaacagggaactgtgaaaaatcttttaggagggttcttgagtattttaacacaggatgattctgattttcaagcatgccagagagtattggtggatcttttggtatctttgatgagttcaagaacatgttcagaagagctaacccttcttttgagaatatttctggagaaatctccttgtacaaaaattcttcttctgggtattctgaaaattattgaaagtgatactactatgagcccttcacagtatctaaccttccctttactgcacgctccaaatttaagcaacggtgtttcatcacaaaagtatcctgggattttaaacagtaaggccatgggtttattgagaagagcacgagtttcacggagcaagaaagaggctgatagagagagttttccccatcggctgctttcatcttggcacatagccccagtccacctgccgttgctggggcaaaactgctggccacacctatcagaaggtttcagtgtttccctgtggtttaatgtggagtgtatccatgaagctgagagtactacagaaaaaggaaagaagataaagaaaagaaacaaatcattaattttaccagatagcagttttgatggtacagagagcgacagaccagaaggtgcagagtacataaatcctggtgaaagactcatagaagaaggatgtattcatataatttcactgggatccaaagcgttgatgatccaagtgtgggctgatccccacaatgccactcttatctttcgtgtgtgcatggattcaaatgatgacatgaaagctgttttactagcacaggttgaatcacaggagaatattttcctcccaagcaaatggcaacatttagtactcacctacttacagcagccccaagggaaaaggaggattcatgggaaaatctccatatgggtctctggacagaggtaggaagcattttgagaaaatgcatctcaatctcagttacaatgttatgtttcattagtcaattatagcttctgaaacagaatacagaaacttctaggtttttactataataaaatttactatattttt

SEQ ID NO: 330117 - DNA, 6357 bp, Homo sapiens
  misc_feature (2724)..(2724): n is a, c, g, or t
gagagagggccactcgccttcctggtgacacagagatttcctagccccgttaccaaacgaaaaagcaacgcaagggcttctaagaagccatcccaatgaccttttggctttgagaagagcagtcctcataccagagtgtttggggttttggcctctttcagtgtttattcattcttacgtgggaaagttgtattccgaggtttctgtggtgcatgaagcttttgccttcaccatctgttcccgtgtcttcctcgggtgacatcagagtacagcagtattttcccttgccatctaatggggtttgggctgtttgactcaaccgtgtgtgttcctcaatgccaggggaataatcctaccctaagtcagctgaacagaagccaggatctaactgcaaacaagagacccagcttgcttaacagcatggaagagaccagtttcgttgcagctacctgggaagacggttgctaattagcctgcaacaaagagttccttgctcatctaaaagaggcaatcaccgttcaggtgaagctttgttctaagaatatttgtttcatctagtttatgagtccaaatgatatagactgtaaatgtcacagcagtggtgaaagactgctcggtcatgagcaccgacagtaactcactggcacgtgaatttctgaccgatgtcaaccggctttgcaatgcagtggtccagagggtggaggccagggaggaagaagaggaggagacgcacatggcaacccttggacagtaccttgtccatggtcgaggatttctattacttaccaagctaaattctataattgatcaggcattgacatgtagagaagaactcctgactcttcttctgtctctccttccactggtatggaagatacctgtccaagaagaaaaggcaacagattttaacctaccgctctcagcagatataatcctgaccaaagaaaagaactcaagttcacaaagatccactcaggaaaaattacatttagaaggaagtgccctgtctagtcaggtttctgcaaaagtaaatgtttttcgaaaaagcagacgacagcgtaaaattacccatcgctattctgtaagagatgcaagaaagacacagctctccacctcagattcagaagccaattcagatgaaaaaggcatagcaatgaataagcatagaaggccccatctgctgcatcattttttaacatcgtttcctaaacaagaccaccccaaagctaaacttgaccgcttagcaaccaaagaacagactcctccagatgctatggctttggaaaattccagagagattattccaagacaggggtcaaacactgacattttaagtgagccagctgccttgtctgttatcagtaacatgaacaattctccatttgacttatgtcatgttttgttatctttattagaaaaagtttgtaagtttgacgttaccttgaatcataattctcctttagcagccagtgtagtgcccacactaactgaattcctagcaggctttggggactgctgcagtctgagcgacaacttggagagtcgagtagtttctgcaggttggaccgaagaaccggtggctttgattcaaaggatgctctttcgaacagtgttgcatcttctgtcagtagatgttagtactgcagagatgatgccagaaaatcttaggaaaaatttaactgaattgcttagagcagctttaaaaattagaatatgcctagaaaagcagcctgacccttttgcaccaagacaaaagaaaacactgcaggaggttcaggaagattttgtgttttcaaagtatcgtcatagagcccttcttttacctgagcttttggaaggagttcttcagattctgatctgttgtcttcaaagtgcagcttcaaatcccttctacttcagtcaagccatggatttggttcaagaattcattcagcatcatggatttaatttatttgaaacagcagttcttcaaatggaatggctggttttaagagatggagttcctcccgaggcctcagagcatttgaaagccctaataaatagtgtgatgaaaataatgagcactgtcaaaaaagtgaaatcagagcaacttcatcattcgatgtgtacaagaaaaaggcacagacgatgtgaatattctcattttatgcatcatcaccgagatctctcaggtcttctggtttcggcttttaaaaaccaggtttccaaaaacccatttgaagagactgcagatggagatgtttattatcctgagcggtgctgttgcattgcagtgtgtgcccatcagtgcttgcgcttactacagcaggcttccttgagcagcacttgtgtccagatcctatcgggtgttcataacattggaatatgctgttgtatggatcccaaatctgtaatcattcctttgctccatgcttttaaattgccagcactgaaaaattttcagcagcatatattgaatatccttaacaaacttattttggatcagttaggaggagcagagatatcaccaaaaattaaaaaagcagcttgtaatatttgtactgttgactctgaccaactagcccaattagaagagacactgcagggaaacttatgtgatgctgaactctcctcaagtttatccagtccttcttacagatttcaagggatcctgcccagcagtggatctgaagatttgttgtggaaatgggatgctttaaaggcttatcagaactttgtttttgnagaagacagattacatagtatacagattgcaaatcacatttgcaatttaatccagaaaggcaatatagttgttcagtggaaattatataattacatatttaatcctgtgctccaaagaggagttgaattagcacatcattgtcaacacctaagcgttacttcagctcaaagtcatgtatgtagccatcataaccagtgcttgcctcaggacgtgcttcagatttatgtaaaaactctgcctatcctgcttaaatccagggtaataagagatttgtttttgagttgtaatggagtaagtcaaataatcgaattaaattgcttaaatggtattcgaagtcattctctaaaagcatttgaaactctgataatcagcctaggggagcaacagaaagatgcctcagttccagatattgatgggatagacattgaacagaaggagttgtcctctgtacatgtgggtacttcttttcatcatcagcaagcttattcagattctcctcagagtctcagcaaattttatgctggcctcaaagaagcttatccaaagagacggaagactgttaaccaagatgttcatatcaacacaataaacctattcctctgtgtggcttttttatgcgtaagtaaagaagcagagtctgacagggagtcggccaatgactcagaagatacttctggctatgacagcacagccagcgagcctttaagtcatatgctgccatgtatatctctcgagagccttgtcttgccttctcctgaacatatgcaccaagcagcagacatttggtctatgtgtcgttggatctacatgttgagttcagtgttccagaaacagttttataggcttggtggtttccgagtatgccataagttaatatttatgataatacagaaactgttcagaagtcacaaagaggagcaaggaaaaaaggagggagatacaagtgtaaatgaaaaccaggatttaaacagaatttctcaacctaagagaactatgaaggaagatttattatctttggctataaaaagtgaccccataccatcagaactaggtagtctaaaaaagagtgctgacagtttaggtaaattagagttacagcatatttcttccataaatgtggaagaagtttcagctactgaagccgctcccgaggaagcaaagctatttacaagtcaagaaagtgagacctcacttcaaagtatacgacttttggaagcccttctggccatttgtcttcatggtgccagaactagtcaacagaagatggaattggagttacctaatcagaacttgtctgtggaaagtatattatttgaaatgagggaccatctttcccagtcaaaggtgattgaaacacaactagcaaagcctttatttgatgccctgcttcgagttgccctcgggaattattcagcagattttgaacataatgatgctatgactgagaagagtcatcaatctgcagaagaattgtcatcccagcctggtgatttttcagaagaagctgaggattctcagtgttgtagttttaaacttttagttgaagaagaaggttacgaagcagatagtgaaagcaatcctgaagatggcgaaacccaggatgatggggtagacttaaagtctgaaacagaaggtttcagtgcatcaagcagtccaaatgacttactcgaaaacctcactcaaggggaaataatttatcctgagatttgtatgctggaattaaatttgctttctgctagtaaagccaaacttgatgtgcttgcccatgtatttgagagttttttgaaaattattaggcagaaagaaaagaatgtttttctgctcatgcaacagggaactgtgaaaaatcttttaggagggttcttgagtattttaacacaggatgattctgattttcaagcatgccagagagtattggtggatcttttggtatctttgatgagttcaagaacatgttcagaagagctaacccttcttttgagaatatttctggagaaatctccttgtacaaaaattcttcttctgggtattctgaaaattattgaaagtgatactactatgagcccttcacagtatctaaccttccctttactgcacgctccaaatttaagcaacggtgtttcatcacaaaagtatcctgggattttaaacagtaaggccatgggtttattgagaagagcacgagtttcacggagcaagaaagaggctgatagagagagttttccccatcggctgctttcatcttggcacatagccccagtccacctgccgttgctggggcaaaactgctggccacacctatcagaaggtttcagtgtttccctgtggtttaatgtggagtgtatccatgaagctgagagtactacagaaaaaggaaagaagataaagaaaagaaacaaatcattaattttaccagatagcagttttgatggtacagagagcgacagaccagaaggtgcagagtacataaatcctggtgaaagactcatagaagaaggatgtattcatataatttcactgggatccaaagcgttgatgatccaagtgtgggctgatccccacaatgccactcttatctttcgtgtgtgcatggattcaaatgatgacatgaaagctgttttactagcacaggttgaatcacaggagaatattttcctcccaagcaaatggcaacatttagtactcacctacttacagcagccccaagggaaaaggaggattcatgggaaaatctccatatgggtctctggacagaggaagcctgatgttactttggattttatgcttccaagaaaaacaagtttgtcatctgatagcaataaaacattttgcatgattggccattgtttatcatcccaagaagagtttttgcagttggctggaaaatgggacctgggaaatttgcttctcttcaacggagctaaggttggttcacaagaggccttttatctgtatgcttgtggacccaaccatacatctgtaatgccatgtaagtatggcaagccagtcaatgactactccaaatatattaataaagaaattttgcgatgtgaacaaatcagagaactttttatgaccaagaaagatgtggatattggtctcttaattgaaagtctttcagttgtttatacaacttactgtcctgctcagtataccatctatgaaccagtgattagacttaaaggtcaaatgaaaacccaactctctcaaagacccttcagctcaaaagaagttcagagcatcttattagaacctcatcatctaaagaatctccaacctactgaatataaaactattcaaggcattctgcacgaaattggtggaactggcatatttgtttttctctttgccagggttgttgaactcagtagctgtgaagaaactcaagcattagcactgcgagttatactctcattaattaaatacaaccaacaaagagtacatgaattagaaaattgtaatggactttctatgattcatcaggtgttgatcaaacaaaaatgcattgttgggttttacattttgaaggtatgtcttcataaaatttattcttatagtttcatatgcagtgatactcatctcgtcatcaaagtcttccaataatagtttgtatttcagttattcctgaagaa

SEQ ID NO: 330118 - DNA, 828 bp, Homo sapiens
gagagagggccactcgccttcctggtgacacagagatttcctagccccgttaccaaacgaaaaagcaacgcaagggcttctaagaagccatcccaatgaccttttggctttgagaagagcagtcctcataccagagtgtttggggttttggcctctttcagtgtttattcattcttacgtgggaaagttgtattccgaggtttctgtggtgcatgaagcttttgccttcaccatctgttcccgtgtcttcctcgggtgacatcagagtacagcagtattttcccttgccatctaatggggtttgggctgtttgactcaaccgtgtgtgttcctcaatgccaggggaataatcctaccctaagtcagctgaacagaagccaggatctaactgcaaacaagagacccagcttgcttaacagcatggaagagaccagtttcgttgcagctacctgggaagacggttgctaattagcctgcaacaaagagttccttgctcatctaaaagaggcaatcaccgttcaggtgaagctttgttctaagaatatttgtttcatctagtttatgagtccaaatgatatagactgtaaatgtcacagcagtggtgaaagactgctcggtcatgagcaccgacagtaactcactggcacgtgaatttctgaccgatgtcaaccggctttgcaatgcagtggtccagagggtggaggccagggaggaagaagaggaggtttgagaccagctgggccaacatggtgaaacccatctctactgaatatacaaaaattagctgggcatggtggcatgtgcctgtggtcccagctgctcatgagg

SEQ ID NO: 330119 - DNA, 584 bp, Homo sapiens
taaattgagtttcacttaattcacttaaattcagcacagtagaaccattaatcctaatgactttgaatcattcagtcaatactgtattttgttaagaagacaggaaaaaacatatgttttgggaagatattaataaaaagtggttaaaataaaaatagttttggcatttaagaattttaagcattaagccaggtgtggggtgcatgcctatagtcccagctgcttggagtctgaggtgggaggctgtcttgagtccaggagttagaggctgcagtaagctgtgattgtgtcactgcacttcagtaggtaagagagcaagaccctgtctcttaagaaaaagtaaaggaattttaagcattagttacttgtaaaattaacctatatggattttaacagtgctagataaatgggcttttgctgtggttgtgatttataatgcaaaagagaggtggttccacttaatagatttttaagtagtatttttgtatctactcttaccaggagagaattcctctaatattattccacaacagatggccgcccatatgctgcgttctagaagcctaccagcattccctacttct

SEQ ID NO: 330120 - DNA, 434 bp, Homo sapiens
cagcctctcttttgttgttttaaaaatcagtttgtatcctttgaagtaatgtcagctagtgtttagagtaagtataggtgtgcctctgttttgttgttttaaaaatcaatttgtatcctttgaactaatgtcagctagtgtttagagtaaggataagtgtgagaggaggtaacccagagatatgacataaatgaaggaaatcagccctgcagcaaaatacattgaggataaactcctttagtgggtttaagataaataagagggctgtcaccttaaaattgagttttaaaacatattgaggtattctaagccttcttttttcattccattagattttaacctaccgctctcagcagatataatcctgaccaaagaaaagaactcaagttcacaaagatccactcaggaaaaattacatttagaaggaagtgccc

SEQ ID NO: 330121 - DNA, 259 bp, Homo sapiens
ggtggcaattgagagataatgctgtagaaatctttctaacaaatggcagaacactcctgttggcatttgataacaccaaggtaaattcacccttattaattgatatatattgtttaagtgctcatgggccactgtaactatactcatactgattacatgaaggtttactgaaatcgaataaaattgccatgtttcttagtcctgattaaagtgaagcctttgttatatgaggattgtctttgacctccacagtgaggta

SEQ ID NO: 330122 - DNA, 268 bp, Homo sapiens
agttaagttgacaattctttaaatctaaagagatttttttttattttttcaggaatacaaagaggggcaactcacacccatgccccgagaggtttgtagatcatttgtgaaaattatagcagaagtccttggatctcctccagatttggaattattgacaattatcttcaatttccttttagcagttcaccctcctactaatacttacgtttgtcacaatcccacgaacttctacttttctttgcacataggtaggtataatcatttt

SEQ ID NO: 330123 - DNA, 509 bp, Homo sapiens
gcagattaattcaatttaaaacataaaaattgagtgctgtttgttttcaccccttgtttgaacctgagtactcacttaaaaatatttgtaagtttgggattttctacttatctgaattgttttacaaaacaagttaaagatactttgtgaagtgttaaattatttactagctttcctttgaatttaatgattgctaaaattgaaagcttaatgtttctgttgaacttcctgattaaccaattactaatgcatcttatattaatgctaattttctatagacccttcttgaaggatgctgtggtgaagatattatttatatgaatgagaatggagagtttaagttggatgtagactctaatgctataatccaagatgttaagctgttagaggaactattgcttgactggaagatatggagtaaagcagaggcatgtaatatgtactttttttccattttttattgtggtaaaatgcatataacacaaaatttaccatcttaagcattttta

SEQ ID NO: 330124 - DNA, 615 bp, Homo sapiens
atataaacatttggagtttttaaattaacagatcagttgtgacttacttactcaatctctataatgattttttttatagctacaagtcctggatggtcacttaaaacaccctttaatctttttacttgcagagcagtatggtatgaccccatctactatccaacctcatggcagttggatccaacagaagggccaaatcgagagaggagacgtttacagagatgttatttaactattccaaataagtatctccttagggatagacagaaatcagaaggtaatagtggcttcttgactcaacatataaatatagcagagaactatggtcattagataaagataatatttacttttctcctcaacagatgttgtcaaaccaccactctcttacctgtttgaagacaaaactcattcttctttctcttctactgtcaaagacaaagctgcaagtgaatctataaggtaactttgaatcaatagaccttcactctttcatgaatatacaacagcttattgtagtgtttatgtaatatttattttatataatgccatcattttcagaaaaatcctaaacaggaaaggctcaagggaggacaaggttatatggccaaaatc

SEQ ID NO: 330125 - DNA, 14126 bp, Homo sapiens
  misc_feature (2294)..(2294): n is a, c, g, or t
gcggccgcgtcgacgcggcggcggcagcggcgtcggctcggggttctccgggagagggggagtgcgcggcggccgcagctgccacaaaccaggtgaagctttgttctaagaatatttgtttcatctagtttatgagtccaaatgatatagactgtaaatgtcacagcagtggtgaaagactgctcggtcatgagcaccgacagtaactcactggcacgtgaatttctgaccgatgtcaaccggctttgcaatgcagtggtccagagggtggaggccagggaggaagaagaggaggagacgcacatggcaacccttggacagtaccttgtccatggtcgaggatttctattacttaccaagctaaattctataattgatcaggcattgacatgtagagaagaactcctgactcttcttctgtctctccttccactggtatggaagatacctgtccaagaagaaaaggcaacagattttaacctaccgctctcagcagatataatcctgaccaaagaaaagaactcaagttcacaaagatccactcaggaaaaattacatttagaaggaagtgccctgtctagtcaggtttctgcaaaagtaaatgtttttcgaaaaagcagacgacagcgtaaaattacccatcgctattctgtaagagatgcaagaaagacacagctctccacctcagattcagaagccaattcagatgaaaaaggcatagcaatgaataagcatagaaggccccatctgctgcatcattttttaacatcgtttcctaaacaagaccaccccaaagctaaacttgaccgcttagcaaccaaagaacagactcctccagatgctatggctttggaaaattccagagagattattccaagacaggggtcaaacactgacattttaagtgagccagctgccttgtctgttatcagtaacatgaacaattctccatttgacttatgtcatgttttgttatctttattagaaaaagtttgtaagtttgacgttaccttgaatcataattctcctttagcagccagtgtagtgcccacactaactgaattcctagcaggctttggggactgctgcagtctgagcgacaacttggagagtcgagtagtttctgcaggttggaccgaagaaccggtggctttgattcaaaggatgctctttcgaacagtgttgcatcttctgtcagtagatgttagtactgcagagatgatgccagaaaatcttaggaaaaatttaactgaattgcttagagcagctttaaaaattagaatatgcctagaaaagcagcctgacccttttgcaccaagacaaaagaaaacactgcaggaggttcaggaagattttgtgttttcaaagtatcgtcatagagcccttcttttacctgagcttttggaaggagttcttcagattctgatctgttgtcttcaaagtgcagcttcaaatcccttctacttcagtcaagccatggatttggttcaagaattcattcagcatcatggatttaatttatttgaaacagcagttcttcaaatggaatggctggttttaagagatggagttcctcccgaggcctcagagcatttgaaagccctaataaatagtgtgatgaaaataatgagcactgtcaaaaaagtgaaatcagagcaacttcatcattcgatgtgtacaagaaaaaggcacagacgatgtgaatattctcattttatgcatcatcaccgagatctctcaggtcttctggtttcggcttttaaaaaccaggtttccaaaaacccatttgaagagactgcagatggagatgtttattatcctgagcggtgctgttgcattgcagtgtgtgcccatcagtgcttgcgcttactacagcaggcttccttgagcagcacttgtgtccagatcctatcgggtgttcataacattggaatatgctgttgtatggatcccaaatctgtaatcattcctttgctccatgcttttaaattgccagcactgaaaaattttcagcagcatatattgaatatccttaacaaacttattttggatcagttaggaggagcagagatatcaccaaaaattaaaaaagcagcttgtaatatttgtactgttgactctgaccaactagcccaattagaagagacactgcagggaaacttatgtgatgctgaactctcctcaagtttatccagtccttcttacagatttcaagggatcctgcccagcagtggatctgaagatttgttgtggaaatgggatgctttaaaggcttatcagaactttgtttttgnagaagacagattacatagtatacagattgcaaatcacatttgcaatttaatccagaaaggcaatatagttgttcagtggaaattatataattacatatttaatcctgtgctccaaagaggagttgaattagcacatcattgtcaacacctaagcgttacttcagctcaaagtcatgtatgtagccatcataaccagtgcttgcctcaggacgtgcttcagatttatgtaaaaactctgcctatcctgcttaaatccagggtaataagagatttgtttttgagttgtaatggagtaagtcaaataatcgaattaaattgcttaaatggtattcgaagtcattctctaaaagcatttgaaactctgataatcagcctaggggagcaacagaaagatgcctcagttccagatattgatgggatagacattgaacagaaggagttgtcctctgtacatgtgggtacttcttttcatcatcagcaagcttattcagattctcctcagagtctcagcaaattttatgctggcctcaaagaagcttatccaaagagacggaagactgttaaccaagatgttcatatcaacacaataaacctattcctctgtgtggcttttttatgcgtaagtaaagaagcagagtctgacagggagtcggccaatgactcagaagatacttctggctatgacagcacagccagcgagcctttaagtcatatgctgccatgtatatctctcgagagccttgtcttgccttctcctgaacatatgcaccaagcagcagacatttggtctatgtgtcgttggatctacatgttgagttcagtgttccagaaacagttttataggcttggtggtttccgagtatgccataagttaatatttatgataatacagaaactgttcagaagtcacaaagaggagcaaggaaaaaaggagggagatacaagtgtaaatgaaaaccaggatttaaacagaatttctcaacctaagagaactatgaaggaagatttattatctttggctataaaaagtgaccccataccatcagaactaggtagtctaaaaaagagtgctgacagtttaggtaaattagagttacagcatatttcttccataaatgtggaagaagtttcagctactgaagccgctcccgaggaagcaaagctatttacaagtcaagaaagtgagacctcacttcaaagtatacgacttttggaagcccttctggccatttgtcttcatggtgccagaactagtcaacagaagatggaattggagttacctaatcagaacttgtctgtggaaagtatattatttgaaatgagggaccatctttcccagtcaaaggtgattgaaacacaactagcaaagcctttatttgatgccctgcttcgagttgccctcgggaattattcagcagattttgaacataatgatgctatgactgagaagagtcatcaatctgcagaagaattgtcatcccagcctggtgatttttcagaagaagctgaggattctcagtgttgtagttttaaacttttagttgaagaagaaggttacgaagcagatagtgaaagcaatcctgaagatggcgaaacccaggatgatggggtagacttaaagtctgaaacagaaggtttcagtgcatcaagcagtccaaatgacttactcgaaaacctcactcaaggggaaataatttatcctgagatttgtatgctggaattaaatttgctttctgctagtaaagccaaacttgatgtgcttgcccatgtatttgagagttttttgaaaattattaggcagaaagaaaagaatgtttttctgctcatgcaacagggaactgtgaaaaatcttttaggagggttcttgagtattttaacacaggatgattctgattttcaagcatgccagagagtattggtggatcttttggtatctttgatgagttcaagaacatgttcagaagagctaacccttcttttgagaatatttctggagaaatctccttgtacaaaaattcttcttctgggtattctgaaaattattgaaagtgatactactatgagcccttcacagtatctaaccttccctttactgcacgctccaaatttaagcaacggtgtttcatcacaaaagtatcctgggattttaaacagtaaggccatgggtttattgagaagagcacgagtttcacggagcaagaaagaggctgatagagagagttttccccatcggctgctttcatcttggcacatagccccagtccacctgccgttgctggggcaaaactgctggccacacctatcagaaggtttcagtgtttccctgtggtttaatgtggagtgtatccatgaagctgagagtactacagaaaaaggaaagaagataaagaaaagaaacaaatcattaattttaccagatagcagttttgatggtacagagagcgacagaccagaaggtgcagagtacataaatcctggtgaaagactcatagaagaaggatgtattcatataatttcactgggatccaaagcgttgatgatccaagtgtgggctgatccccacaatgccactcttatctttcgtgtgtgcatggattcaaatgatgacatgaaagctgttttactagcacaggttgaatcacaggagaatattttcctcccaagcaaatggcaacatttagtactcacctacttacagcagccccaagggaaaaggaggattcatgggaaaatctccatatgggtctctggacagaggaagcctgatgttactttggattttatgcttccaagaaaaacaagtttgtcatctgatagcaataaaacattttgcatgattggccattgtttatcatcccaagaagagtttttgcagttggctggaaaatgggacctgggaaatttgcttctcttcaacggagctaaggttggttcacaagaggccttttatctgtatgcttgtggacccaaccatacatctgtaatgccatgtaagtatggcaagccagtcaatgactactccaaatatattaataaagaaattttgcgatgtgaacaaatcagagaactttttatgaccaagaaagatgtggatattggtctcttaattgaaagtctttcagttgtttatacaacttactgtcctgctcagtataccatctatgaaccagtgattagacttaaaggtcaaatgaaaacccaactctctcaaagacccttcagctcaaaagaagttcagagcatcttattagaacctcatcatctaaagaatctccaacctactgaatataaaactattcaaggcattctgcacgaaattggtggaactggcatatttgtttttctctttgccagggttgttgaactcagtagctgtgaagaaactcaagcattagcactgcgagttatactctcattaattaaatacaaccaacaaagagtacatgaattagaaaattgtaatggactttctatgattcatcaggtgttgatcaaacaaaaatgcattgttgggttttacattttgaagacccttcttgaaggatgctgtggtgaagatattatttatatgaatgagaatggagagtttaagttggatgtagactctaatgctataatccaagatgttaagctgttagaggaactattgcttgactggaagatatggagtaaagcagagcaaggtgtttgggaaactttgctagcagctctagaagtcctcatcagagcagatcaccaccagcagatgtttaatattaagcagttattgaaagctcaagtggttcatcactttctactgacttgtcaggttttgcaggaatacaaagaggggcaactcacacccatgccccgagaggtttgtagatcatttgtgaaaattatagcagaagtccttggatctcctccagatttggaattattgacaattatcttcaatttccttttagcagttcaccctcctactaatacttacgtttgtcacaatcccacgaacttctacttttctttgcacatagatggcaagatctttcaggagaaagtgcggtcaatcatgtacctgaggcattccagcagtggaggaaggtcccttatgagccctggatttatggtaataagcccatctggttttactgcttcaccatatgaaggagagaattcctctaatattattccacaacagatggccgcccatatgctgcgttctagaagcctaccagcattccctacttcttcactactaacgcaatcacaaaaactgactggaagtttgggttgtagtatcgacaggttacaaaatattgcagatacttatgttgccacccaatcaaagaaacaaaattctttggggagttccgacacactgaaaaaaggcaaagaggacgcattcatcagtagctgtgagtctgcaaaaactgtttgtgaaatggaagctgtcctctcagcccaggtctctgtcagtgatgtcccaaagggagtgctgggatttccagtggtcaaagcagatcataaacagttgggagcagaacccaggtcagaagatgacagtcctggggatgagtcctgcccacgccgacctgattacctaaagggattggcctccttccagcgaagccacagcactattgcaagccttgggctagcttttccttcacagaacggatctgcagctgttggccgttggccaagtcttgttgatagaaacactgatgattgggaaaactttgcctattctcttggttatgagccaaattacaaccgaactgcaagtgctcacagtgtaactgaagactgtttggtacctatatgctgtggattatatgaactcctaagtggggttcttcttatcctgcctgatgttttgcttgaagatgtgatggacaagcttattcaagcagatacacttttggtcctcgttaaccacccatcaccagctatacaacaaggtgttattaaactattagatgcatattttgctagagcatctaaggaacaaaaagataaatttctgaagaatcgtggattttccttgctagccaaccagttgtatcttcatcgaggaactcaagaattgttagaatgcttcatcgaaatgttctttggtcgacatattggccttgatgaagaatttgatctggaagatgtgagaaacatgggattgtttcagaagtggtctgtcattcctattctgggactaatagagacctctctatatgacaacatactcttgcataatgctcttttacttcttctccaaattttaaattcttgttctaaggtagcagatatgttgctggataatggtctactctatgtgttatgtaatacagtagcagccctgaatggattagaaaagaacattcccatgagtgaatataaattgcttgcttgtgatatacagcaacttttcatagcagttacaattcatgcttgcagttcctcaggctcacaatattttagggttattgaagaccttattgtaatgcttggatatcttcaaaatagcaaaaacaagaggacacaaaatatggctgttgcactacagcttagagttctccaggctgctatggaatttataaggaccaccgcaaatcatgactctgaaaacctcacagattcactccagtcaccttctgctccccatcatgcagtagttcaaaagcggaaaagcattgctggtcctcgaaaatttccccttgctcaaactgaatcgcttctgatgaaaatgcgttcagtggcaaatgatgagcttcatgtgatgatgcaacggagaatgagccaagagaaccctagccaagcaactgaaacggaacttgcgcagagactacagaggctcactgttttagcagtcaacaggattatttatcaagaatttaattcagacattattgacattttgagaactccagaaaatgtaactcaaagcaagacctcagttttccagaccgaaatttctgaggaaaatattcatcatgaacagtcttctgttttcaatccatttcagaaagaaatttttacatatctggtagaaggattcaaagtatctattggttcaagtaaagccagtggttccaagcagcaatggactaaaattctgtggtcttgtaaggagaccttccgaatgcagcttgggagactactagtgcatattttgtcgccagcccacgctgcacaagagagaaagcaaatttttgaaatagttcatgaaccaaatcatcaggaaatactacgagactgtctcagcccatccctacaacatggagccaagttagttttgtatttgtcagagttgatacataatcaccaaggtgaattgactgaagaagagctaggcacagcagaactgcttatgaatgctttgaagttatgtggtcacaagtgcatccctcccagtgcatcaacaaaagcagaccttattaaaatgatcaaagaggaacaaaagaaatatgaaactgaagaaggagtgaataaagctgcttggcagaaaacagttaacaataatcaacaaagtctctttcagcgtctggattcaaaatcaaaggatatatctaaaatagctgcagatatcacccaggcagtgtctctctcccaaggaaatgagagaaaaaaggtgatccagcatattagaggaatgtataaagtagatttgagtgccagcagacattggcaggaacttattcagcagctgacacatgatagagcagtatggtatgaccccatctactatccaacctcatggcagttggatccaacagaagggccaaatcgagagaggagacgtttacagagatgttatttaactattccaaataagtatctccttagggatagacagaaatcagaagatgttgtcaaaccaccactctcttacctgtttgaagacaaaactcattcttctttctcttctactgtcaaagacaaagctgcaagtgaatctataagagtgaatcgaagatgcatcagtgttgcaccatctagagagacagctggtgaattgttactaggtaaatgtggaatgtattttgtggaagataatgcttctgatacagttgaaagttcgagccttcagggagagttggaaccagcatcattttcctggacatatgaagaaattaaagaagttcacaagcgttggtggcaattgagagataatgctgtagaaatctttctaacaaatggcagaacactcctgttggcatttgataacaccaaggttcgtgatgatgtataccacaatatactcacaaataacctccctaatcttctggaatatggtaacatcaccgctctgacaaatttatggtatactgggcaaattactaattttgaatatttgactcacttaaacaaacatgctggccgatccttcaatgatctcatgcagtatcctgtgttcccatttatacttgctgactacgttagtgagacacttgacctcaatgatctgttgatatacagaaatctctctaaacctatagctgttcagtataaagaaaaagaagatcgttatgtggacacatacaagtacttggaggaagagtaccgcaaaggagccagagaagatgaccccatgcctcccgtgcagccctatcactatggctcccactattccaatagcggcactgtgcttcacttcctggtcaggatgcctcctttcactaaaatgtttttagcctatcaagatcaaagttttgacattccagacagaacttttcattctacaaatacaacttggcgactctcatcttttgaatctatgactgatgtgaaagaacttatcccagagtttttctatcttccagagttcctagttaaccgtgaaggttttgattttggtgtgcgtcagaatggtgaacgggttaatcacgtcaaccttcccccttgggcgcgtaatgatcctcgtctttttatcctcatccatcggcaggctctagagtctgactacgtgtcgcagaacatctgtcagtggattgacttggtgtttgggtataagcaaaaggggaaggcttctgttcaagcgatcaatgtttttcatcctgctacatattttggaatggatgtctctgcagttgaagatccagttcagagacgagcgctagaaaccatgataaaaacctacgggcagactccccgtcagctgttccacatggcccatgtgagcagacctggagccaagctcaatattgaaggagagcttccagctgctgtggggttgctagtgcagtttgctttcagggagacccgagaacaggtcaaagaaatcacctatccgagtcctttgtcatggataaaaggcttgaaatggggggaatacgtgggttcccccagtgctccagtacctgtggtctgcttcagccagccccacggagaaagatttggctctctccaggctctgcccaccagagcaatctgtggtttgtcacggaatttctgtcttctgatgacatatagcaaggaacaaggtgtgagaagcatgaacagtacggacattcagtggtcagccatcctgagctggggatatgctgataatattttaaggttgaagagtaaacaaagtgagcctccagtaaactttattcaaagttcacaacagtaccaggtgactagttgtgcttgggtgcctgacagttgccagctgtttactggaagcaaatgcggtgtcatcacagcctacacaaacagatttacaagcagcacgccatcagaaatagaaatggagactcaaatacatctctatggtcacacagaagagataaccagcttatttgtttgcaaaccatacagtatactgataagtgtgagcagagacggaacctgcatcatatgggatttaaacaggttatgctatgtacaaagtctggcgggacacaaaagccctgtcacagctgtctctgccagtgaaacctcaggtgatattgctactgtgtgtgattcagctggcggaggcagtgacctcagactctggacggtgaacggggatctcgttggacatgtccactgcagggagatcatctgttccgtggctttctccaaccagcctgagggagtatctatcaatgtaatcgctgggggattagaaaatggaattgtaaggttatggagcacatgggacttaaagcctgtgagagaaattacatttcccaaatcaaataagcccatcatcagccttacattttcttgtgatggccaccatttgtacacagcaaacagtgatgggaccgtgattgcctggtgtcggaaggaccagcagcgcttgaaacagccaatgttctattccttccttagcagctatgcagccgggtgaatgcgaatgaacttcacgttctccaaagcactttaactccaaactagatttgttgacttcaccagttttaggaggttgaacctaaagaaatggatgactggacaaaccatccaaataatgataaagtctattcatctgcacaaaattctgaagagtcacatgatcctaagaggaaagttctgttctattttagtgataatctggaagattgtgtcaatatgcactagccaacaagttttaagcctcgcatggtacattaaaatgatattcttaaaattttttcccaccaaggtattccaaagaaaatattaaggtctcccctttttctatgattccaaaaggaccagtagaatttaaattggttggttgattgtttatataaaacacactaaaattatattttaaaagtttactgccatgaaatactcctcccaccacacacacatgctccaaaagaggaaagaaaaaaagataatttttaggacttgataattgctttctttgagaagcaaattattcagtaggtgcctctgtaccaaatattttatggaatatctaaatactaaaataaactatgaatgaatctcaaaattaggcagtttttgccagttgctttcttagctcaaaggagaaccagaatttttttgacagccacaaacaagaatacaggtatcttggatttcagacacattctgtttcttcataaaaattttacttaaaatctgtaacgctagatattgactatccttagttgagtcactgaggtttaaacacaatggtaagtcttaaagtctgctatttacagagcattgaatctgtaccaatttgcaatagaaagccttcagtatgcaagaagtttgcatgggtattaagaacacagcctaaataaggcatttgatctaatctgcaggaagaattttcttccccaaaacagaattataaaagcttactttaaacaggaggcagaataattcttttaggaaaccatttcattctgtttctactaacctataccatctgagaattcctaaacatcttggagccgtctgtctctcccatatgatggctgtctgtatatttttacttggggtgctgctttattggctttgaaaacactgtcagataagctcagtaatatgttaccatgggataaaaatatgtatccctgcctaagaataacttgtgcatttgttatggaaatttaattcatatggtgtttacagtactacttttgtaacttccagactttctaaaacattctgcttaaaaaccatataaaatataattccaaagtctctgctgtcaagatagattcgagagaaagcacgtggccatgtatgctttaaccttaaactgcatacacatgtagtgatacctaggctgcatttagatcaccgtgtgctcaggccaggtgtgaatcctgaggtccatggaggtgcagagatgagattactcctattcacgttgaagtgatttgctttgttaacaaaaaattgcagctattgtctagctttcatttttttactgagaactttaaattagtcccctattagaatagggttgctactcatctttttttaaaaaccgaatttcatcatttatctaaagagaaaatatgcagaataactggtcttgttaagagtgcaatattatatttttatgtaaaaataaaaattaatttggggggattatttattcagcatgaaacctaatatgtatatgtttgaaatacttcataatgtgcatgttgtagcaaacatttctgtaaattatcacaagctctgttacctttatatacactgcctcttcaatttggaaataaatttcataaaaatagaaaaaaaaaaaaacaaaaaacaaaaaaaaaaaatgtgtgcgcggcgcgcgccctgggcccccgcgagaagaggccttcttaagcaccctggggtgggggcgcgcggaggagccccacagataggtgaaaaagggacacaaatgggccacaaacgcgcggcaccccgaaggcgaaactcgcgcgacacgacaaccagagggcagcggacatcatccaccaataaaaaacacagccccgggggggaaacacggagacgcgtctgcacacaaaacactcacgacaggagagtcacgaagagagggcaacacaagcgcgggaactaactacacaacaggggaagcacaaaaagaagaaagccgagaaattcaacaaattaaacgcccgtaagcactcgtggataacaagaaaagacacagaagaagagaaaagaaaaaccagaagaacaaacaagacaacacacaagccaaaaacacgcagcaacaagaaagcgaaaggcagacggagcggagagcagcagaggacagagagtgaacggaagagacgaggagcgaagagagggggagggaggacggcgggagccgacagcaaggcccgcggagcgagagggggggacagacaagaagaaaggaagcagagagaagggacgagagacgagaggcaagagcgcgcggaggagcaggagcagacggggagc

SEQ ID NO: 330126 - DNA, 12284 bp, Homo sapiens
  misc_feature (2724)..(2724): n is a, c, g, or t
gagagagggccactcgccttcctggtgacacagagatttcctagccccgttaccaaacgaaaaagcaacgcaagggcttctaagaagccatcccaatgaccttttggctttgagaagagcagtcctcataccagagtgtttggggttttggcctctttcagtgtttattcattcttacgtgggaaagttgtattccgaggtttctgtggtgcatgaagcttttgccttcaccatctgttcccgtgtcttcctcgggtgacatcagagtacagcagtattttcccttgccatctaatggggtttgggctgtttgactcaaccgtgtgtgttcctcaatgccaggggaataatcctaccctaagtcagctgaacagaagccaggatctaactgcaaacaagagacccagcttgcttaacagcatggaagagaccagtttcgttgcagctacctgggaagacggttgctaattagcctgcaacaaagagttccttgctcatctaaaagaggcaatcaccgttcaggtgaagctttgttctaagaatatttgtttcatctagtttatgagtccaaatgatatagactgtaaatgtcacagcagtggtgaaagactgctcggtcatgagcaccgacagtaactcactggcacgtgaatttctgaccgatgtcaaccggctttgcaatgcagtggtccagagggtggaggccagggaggaagaagaggaggagacgcacatggcaacccttggacagtaccttgtccatggtcgaggatttctattacttaccaagctaaattctataattgatcaggcattgacatgtagagaagaactcctgactcttcttctgtctctccttccactggtatggaagatacctgtccaagaagaaaaggcaacagattttaacctaccgctctcagcagatataatcctgaccaaagaaaagaactcaagttcacaaagatccactcaggaaaaattacatttagaaggaagtgccctgtctagtcaggtttctgcaaaagtaaatgtttttcgaaaaagcagacgacagcgtaaaattacccatcgctattctgtaagagatgcaagaaagacacagctctccacctcagattcagaagccaattcagatgaaaaaggcatagcaatgaataagcatagaaggccccatctgctgcatcattttttaacatcgtttcctaaacaagaccaccccaaagctaaacttgaccgcttagcaaccaaagaacagactcctccagatgctatggctttggaaaattccagagagattattccaagacaggggtcaaacactgacattttaagtgagccagctgccttgtctgttatcagtaacatgaacaattctccatttgacttatgtcatgttttgttatctttattagaaaaagtttgtaagtttgacgttaccttgaatcataattctcctttagcagccagtgtagtgcccacactaactgaattcctagcaggctttggggactgctgcagtctgagcgacaacttggagagtcgagtagtttctgcaggttggaccgaagaaccggtggctttgattcaaaggatgctctttcgaacagtgttgcatcttctgtcagtagatgttagtactgcagagatgatgccagaaaatcttaggaaaaatttaactgaattgcttagagcagctttaaaaattagaatatgcctagaaaagcagcctgacccttttgcaccaagacaaaagaaaacactgcaggaggttcaggaagattttgtgttttcaaagtatcgtcatagagcccttcttttacctgagcttttggaaggagttcttcagattctgatctgttgtcttcaaagtgcagcttcaaatcccttctacttcagtcaagccatggatttggttcaagaattcattcagcatcatggatttaatttatttgaaacagcagttcttcaaatggaatggctggttttaagagatggagttcctcccgaggcctcagagcatttgaaagccctaataaatagtgtgatgaaaataatgagcactgtcaaaaaagtgaaatcagagcaacttcatcattcgatgtgtacaagaaaaaggcacagacgatgtgaatattctcattttatgcatcatcaccgagatctctcaggtcttctggtttcggcttttaaaaaccaggtttccaaaaacccatttgaagagactgcagatggagatgtttattatcctgagcggtgctgttgcattgcagtgtgtgcccatcagtgcttgcgcttactacagcaggcttccttgagcagcacttgtgtccagatcctatcgggtgttcataacattggaatatgctgttgtatggatcccaaatctgtaatcattcctttgctccatgcttttaaattgccagcactgaaaaattttcagcagcatatattgaatatccttaacaaacttattttggatcagttaggaggagcagagatatcaccaaaaattaaaaaagcagcttgtaatatttgtactgttgactctgaccaactagcccaattagaagagacactgcagggaaacttatgtgatgctgaactctcctcaagtttatccagtccttcttacagatttcaagggatcctgcccagcagtggatctgaagatttgttgtggaaatgggatgctttaaaggcttatcagaactttgtttttgnagaagacagattacatagtatacagattgcaaatcacatttgcaatttaatccagaaaggcaatatagttgttcagtggaaattatataattacatatttaatcctgtgctccaaagaggagttgaattagcacatcattgtcaacacctaagcgttacttcagctcaaagtcatgtatgtagccatcataaccagtgcttgcctcaggacgtgcttcagatttatgtaaaaactctgcctatcctgcttaaatccagggtaataagagatttgtttttgagttgtaatggagtaagtcaaataatcgaattaaattgcttaaatggtattcgaagtcattctctaaaagcatttgaaactctgataatcagcctaggggagcaacagaaagatgcctcagttccagatattgatgggatagacattgaacagaaggagttgtcctctgtacatgtgggtacttcttttcatcatcagcaagcttattcagattctcctcagagtctcagcaaattttatgctggcctcaaagaagcttatccaaagagacggaagactgttaaccaagatgttcatatcaacacaataaacctattcctctgtgtggcttttttatgcgtaagtaaagaagcagagtctgacagggagtcggccaatgactcagaagatacttctggctatgacagcacagccagcgagcctttaagtcatatgctgccatgtatatctctcgagagccttgtcttgccttctcctgaacatatgcaccaagcagcagacatttggtctatgtgtcgttggatctacatgttgagttcagtgttccagaaacagttttataggcttggtggtttccgagtatgccataagttaatatttatgataatacagaaactgttcagaagtcacaaagaggagcaaggaaaaaaggagggagatacaagtgtaaatgaaaaccaggatttaaacagaatttctcaacctaagagaactatgaaggaagatttattatctttggctataaaaagtgaccccataccatcagaactaggtagtctaaaaaagagtgctgacagtttaggtaaattagagttacagcatatttcttccataaatgtggaagaagtttcagctactgaagccgctcccgaggaagcaaagctatttacaagtcaagaaagtgagacctcacttcaaagtatacgacttttggaagcccttctggccatttgtcttcatggtgccagaactagtcaacagaagatggaattggagttacctaatcagaacttgtctgtggaaagtatattatttgaaatgagggaccatctttcccagtcaaaggtgattgaaacacaactagcaaagcctttatttgatgccctgcttcgagttgccctcgggaattattcagcagattttgaacataatgatgctatgactgagaagagtcatcaatctgcagaagaattgtcatcccagcctggtgatttttcagaagaagctgaggattctcagtgttgtagttttaaacttttagttgaagaagaaggttacgaagcagatagtgaaagcaatcctgaagatggcgaaacccaggatgatggggtagacttaaagtctgaaacagaaggtttcagtgcatcaagcagtccaaatgacttactcgaaaacctcactcaaggggaaataatttatcctgagatttgtatgctggaattaaatttgctttctgctagtaaagccaaacttgatgtgcttgcccatgtatttgagagttttttgaaaattattaggcagaaagaaaagaatgtttttctgctcatgcaacagggaactgtgaaaaatcttttaggagggttcttgagtattttaacacaggatgattctgattttcaagcatgccagagagtattggtggatcttttggtatctttgatgagttcaagaacatgttcagaagagctaacccttcttttgagaatatttctggagaaatctccttgtacaaaaattcttcttctgggtattctgaaaattattgaaagtgatactactatgagcccttcacagtatctaaccttccctttactgcacgctccaaatttaagcaacggtgtttcatcacaaaagtatcctgggattttaaacagtaaggccatgggtttattgagaagagcacgagtttcacggagcaagaaagaggctgatagagagagttttccccatcggctgctttcatcttggcacatagccccagtccacctgccgttgctggggcaaaactgctggccacacctatcagaaggtttcagtgtttccctgtggtttaatgtggagtgtatccatgaagctgagagtactacagaaaaaggaaagaagataaagaaaagaaacaaatcattaattttaccagatagcagttttgatggtacagagagcgacagaccagaaggtgcagagtacataaatcctggtgaaagactcatagaagaaggatgtattcatataatttcactgggatccaaagcgttgatgatccaagtgtgggctgatccccacaatgccactcttatctttcgtgtgtgcatggattcaaatgatgacatgaaagctgttttactagcacaggttgaatcacaggagaatattttcctcccaagcaaatggcaacatttagtactcacctacttacagcagccccaagggaaaaggaggattcatgggaaaatctccatatgggtctctggacagaggaagcctgatgttactttggattttatgcttccaagaaaaacaagtttgtcatctgatagcaataaaacattttgcatgattggccattgtttatcatcccaagaagagtttttgcagttggctggaaaatgggacctgggaaatttgcttctcttcaacggagctaaggttggttcacaagaggccttttatctgtatgcttgtggacccaaccatacatctgtaatgccatgtaagtatggcaagccagtcaatgactactccaaatatattaataaagaaattttgcgatgtgaacaaatcagagaactttttatgaccaagaaagatgtggatattggtctcttaattgaaagtctttcagttgtttatacaacttactgtcctgctcagtataccatctatgaaccagtgattagacttaaaggtcaaatgaaaacccaactctctcaaagacccttcagctcaaaagaagttcagagcatcttattagaacctcatcatctaaagaatctccaacctactgaatataaaactattcaaggcattctgcacgaaattggtggaactggcatatttgtttttctctttgccagggttgttgaactcagtagctgtgaagaaactcaagcattagcactgcgagttatactctcattaattaaatacaaccaacaaagagtacatgaattagaaaattgtaatggactttctatgattcatcaggtgttgatcaaacaaaaatgcattgttgggttttacattttgaagacccttcttgaaggatgctgtggtgaagatattatttatatgaatgagaatggagagtttaagttggatgtagactctaatgctataatccaagatgttaagctgttagaggaactattgcttgactggaagatatggagtaaagcagagcaaggtgtttgggaaactttgctagcagctctagaagtcctcatcagagcagatcaccaccagcagatgtttaatattaagcagttattgaaagctcaagtggttcatcactttctactgacttgtcaggttttgcaggaatacaaagaggggcaactcacacccatgccccgagagatggcaagatctttcaggagaaagtgcggtcaatcatgtacctgaggcattccagcagtggaggaaggtcccttatgagccctggatttatggtaataagcccatctggttttactgcttcaccatatgaaggagagaattcctctaatattattccacaacagatggccgcccatatgctgcgttctagaagcctaccagcattccctacttcttcactactaacgcaatcacaaaaactgactggaagtttgggttgtagtatcgacaggttacaaaatattgcagatacttatgttgccacccaatcaaagaaacaaaattctttggggagttccgacacactgaaaaaaggcaaagaggacgcattcatcagtagctgtgagtctgcaaaaactgtttgtgaaatggaagctgtcctctcagcccaggtctctgtcagtgatgtcccaaagggagtgctgggatttccagtggtcaaagcagatcataaacagttgggagcagaacccaggtcagaagatgacagtcctggggatgagtcctgcccacgccgacctgattacctaaagggattggcctccttccagcgaagccacagcactattgcaagccttgggctagcttttccttcacagaacggatctgcagctgttggccgttggccaagtcttgttgatagaaacactgatgattgggaaaatgtaactgaagactgtttggtacctatatgctgtggattatatgaactcctaagtggggttcttcttatcctgcctgatgttttgcttgaagatgtgatggacaagcttattcaagcagatacacttttggtcctcgttaaccacccatcaccagctatacaacaaggtgttattaaactattagatgcatattttgctagagcatctaaggaacaaaaagataaatttctgaagaatcgtggattttccttgctagccaaccagttgtatcttcatcgaggaactcaagaattgttagaatgcttcatcgaaatgttctttggtcgacatattggccttgatgaagaatttgatctggaagatgtgagaaacatgggattgtttcagaagtggtctgtcattcctattctgggactaatagagacctctctatatgacaacatactcttgcataatgctcttttacttcttctccaaattttaaattcttgttctaaggtagcagatatgttgctggataatggtctactctatgtgttatgtaatacagtagcagccctgaatggattagaaaagaacattcccatgagtgaatataaattgcttgcttgtgatatacagcaacttttcatagcagttacaattcatgcttgcagttcctcaggctcacaatattttagggttattgaagaccttattgtaatgcttggatatcttcaaaatagcaaaaacaagaggacacaaaatatggctgttgcactacagcttagagttctccaggctgctatggaatttataaggaccaccgcaaatcatgactctgaaaacctcacagattcactccagtcaccttctgctccccatcatgcagtagttcaaaagcggaaaagcattgctggtcctcgaaaatttccccttgctcaaactgaatcgcttctgatgaaaatgcgttcagtggcaaatgatgagcttcatgtgatgatgcaacggagaatgagccaagagaaccctagccaagcaactgaaacggaacttgcgcagagactacagaggctcactgttttagcagtcaacaggattatttatcaagaatttaattcagacattattgacattttgagaactccagaaaatgtaactcaaagcaagacctcagttttccagaccgaaatttctgaggaaaatattcatcatgaacagtcttctgttttcaatccatttcagaaagaaatttttacatatctggtagaaggattcaaagtatctattggttcaagtaaagccagtggttccaagcagcaatggactaaaattctgtggtcttgtaaggagaccttccgaatgcagcttgggagactactagtgcatattttgtcgccagcccacgctgcacaagagagaaagcaaatttttgaaatagttcatgaaccaaatcatcaggaaatactacgagactgtctcagcccatccctacaacatggagccaagttagttttgtatttgtcagagttgatacataatcaccaaggtgaattgactgaagaagagctaggcacagcagaactgcttatgaatgctttgaagttatgtggtcacaagtgcatccctcccagtgcatcaacaaaagcagaccttattaaaatgatcaaagaggaacaaaagaaatatgaaactgaagaaggagtgaataaagctgcttggcagaaaacagttaacaataatcaacaaagtctctttcagcgtctggattcaaaatcaaaggatatatctaaaatagctgcagatatcacccaggcagtgtctctctcccaaggaaatgagagaaaaaaggtgatccagcatattagaggaatgtataaagtagatttgagtgccagcagacattggcaggaacttattcagcagctgacacatgatagagcagtatggtatgaccccatctactatccaacctcatggcagttggatccaacagaagggccaaatcgagagaggagacgtttacagagatgttatttaactattccaaataagtatctccttagggatagacagaaatcagaagatgttgtcaaaccaccactctcttacctgtttgaagacaaaactcattcttctttctcttctactgtcaaagacaaagctgcaagtgaatctataagagtgaatcgaagatgcatcagtgttgcaccatctagagagacagctggtgaattgttactaggtaaatgtggaatgtattttgtggaagataatgcttctgatacagttgaaagttcgagccttcagggagagttggaaccagcatcattttcctggacatatgaagaaattaaagaagttcacaagcgttggtggcaattgagagataatgctgtagaaatctttctaacaaatggcagaacactcctgttggcatttgataacaccaaggttcgtgatgatgtataccacaatatactcacaaataacctccctaatcttctggaatatggtaacatcaccgctctgacaaatttatggtatactgggcaaattactaattttgaatatttgactcacttaaacaaacatgctggccgatccttcaatgatctcatgcagtatcctgtgttcccatttatacttgctgactacgttagtgagacacttgacctcaatgatctgttgatatacagaaatctctctaaacctatagctgttcagtataaagaaaaagaagatcgttatgtggacacatacaagtacttggaggaagagtaccgcaaaggagccagagaagatgaccccatgcctcccgtgcagccctatcactatggctcccactattccaatagcggcactgtgcttcacttcctggtcaggatgcctcctttcactaaaatgtttttagcctatcaagatcaaagttttgacattccagacagaacttttcattctacaaatacaacttggcgactctcatcttttgaatctatgactgatgtgaaagaacttatcccagagtttttctatcttccagagttcctagttaaccgtgaaggttttgattttggtgtgcgtcagaatggtgaacgggttaatcacgtcaaccttcccccttgggcgcgtaatgatcctcgtctttttatcctcatccatcggcaggctctagagtctgactacgtgtcgcagaacatctgtcagtggattgacttggtgtttgggtataagcaaaaggggaaggcttctgttcaagcgatcaatgtttttcatcctgctacatattttggaatggatgtctctgcagttgaagatccagttcagagacgagcgctagaaaccatgataaaaacctacgggcagactccccgtcagctgttccacatggcccatgtgagcagacctggagccaagctcaatattgaaggagagcttccagctgctgtggggttgctagtgcagtttgctttcagggagacccgagaacaggtcaaagaaatcacctatccgagtcctttgtcatggataaaaggcttgaaatggggggaatacgtgggttcccccagtgctccagtacctgtggtctgcttcagccagccccacggagaaagatttggctctctccaggctctgcccaccagagcaatctgtggtttgtcacggaatttctgtcttctgatgacatatagcaaggaacaaggtgtgagaagcatgaacagtacggacattcagtggtcagccatcctgagctggggatatgctgataatattttaaggttgaagagtaaacaaagtgagcctccagtaaactttattcaaagttcacaacagtaccaggtgactagttgtgcttgggtgcctgacagttgccagctgtttactggaagcaaatgcggtgtcatcacagcctacacaaacagatttacaagcagcacgccatcagaaatagaaatggagactcaaatacatctctatggtcacacagaagagataaccagcttatttgtttgcaaaccatacagtatactgataagtgtgagcagagacggaacctgcatcatatgggatttaaacaggttatgctatgtacaaagtctggcgggacacaaaagccctgtcacagctgtctctgccagtgaaacctcaggtgatattgctactgtgtgtgattcagctggcggaggcagtgacctcagactctggacggtgaacggggatctcgttggacatgtccactgcagggagatcatctgttccgtggctttctccaaccagcctgagggagtatctatcaatgtaatcgctgggggattagaaaatggaattgtaaggttatggagcacatgggacttaaagcctgtgagagaaattacatttcccaaatcaaataagcccatcatcagccttacattttcttgtgatggccaccatttgtacacagcaaacagtgatgggaccgtgattgcctggtgtcggaaggaccagcagcgcttgaaacagccaatgttctattccttccttagcagctatgcagccgggtgaatgcgaatgaacttcacgttctccaaagcactttaactccaaactagatttgttgacttcaccagttttaggaggttgaacctaaagaaatggatgactggacaaaccatccaaataatgataaagtctattcatctgcacaaaattctgaagagtcacatgatcctaagaggaaagttctgttctattttagtgataatctggaagattgtgtcaatatgcactagccaacaagttttaagcctcgcatggtacattaaaatgatattcttaaaattttttcccaccaaggtattccaaagaaaatattaaggtctcccctttttctatgattccaaaaggaccagtagaatttaaattggttggttgattgtttatataaaacacactaaaattatattttaaaagtttactgccatgaaatactcctcccaccacacacacatgctccgaagcctgttagggtaccgagctcc

SEQ ID NO: 330127 - DNA, 6819 bp, Homo sapiens
  misc_feature (2724)..(2724): n is a, c, g, or t
gagagagggccactcgccttcctggtgacacagagatttcctagccccgttaccaaacgaaaaagcaacgcaagggcttctaagaagccatcccaatgaccttttggctttgagaagagcagtcctcataccagagtgtttggggttttggcctctttcagtgtttattcattcttacgtgggaaagttgtattccgaggtttctgtggtgcatgaagcttttgccttcaccatctgttcccgtgtcttcctcgggtgacatcagagtacagcagtattttcccttgccatctaatggggtttgggctgtttgactcaaccgtgtgtgttcctcaatgccaggggaataatcctaccctaagtcagctgaacagaagccaggatctaactgcaaacaagagacccagcttgcttaacagcatggaagagaccagtttcgttgcagctacctgggaagacggttgctaattagcctgcaacaaagagttccttgctcatctaaaagaggcaatcaccgttcaggtgaagctttgttctaagaatatttgtttcatctagtttatgagtccaaatgatatagactgtaaatgtcacagcagtggtgaaagactgctcggtcatgagcaccgacagtaactcactggcacgtgaatttctgaccgatgtcaaccggctttgcaatgcagtggtccagagggtggaggccagggaggaagaagaggaggagacgcacatggcaacccttggacagtaccttgtccatggtcgaggatttctattacttaccaagctaaattctataattgatcaggcattgacatgtagagaagaactcctgactcttcttctgtctctccttccactggtatggaagatacctgtccaagaagaaaaggcaacagattttaacctaccgctctcagcagatataatcctgaccaaagaaaagaactcaagttcacaaagatccactcaggaaaaattacatttagaaggaagtgccctgtctagtcaggtttctgcaaaagtaaatgtttttcgaaaaagcagacgacagcgtaaaattacccatcgctattctgtaagagatgcaagaaagacacagctctccacctcagattcagaagccaattcagatgaaaaaggcatagcaatgaataagcatagaaggccccatctgctgcatcattttttaacatcgtttcctaaacaagaccaccccaaagctaaacttgaccgcttagcaaccaaagaacagactcctccagatgctatggctttggaaaattccagagagattattccaagacaggggtcaaacactgacattttaagtgagccagctgccttgtctgttatcagtaacatgaacaattctccatttgacttatgtcatgttttgttatctttattagaaaaagtttgtaagtttgacgttaccttgaatcataattctcctttagcagccagtgtagtgcccacactaactgaattcctagcaggctttggggactgctgcagtctgagcgacaacttggagagtcgagtagtttctgcaggttggaccgaagaaccggtggctttgattcaaaggatgctctttcgaacagtgttgcatcttctgtcagtagatgttagtactgcagagatgatgccagaaaatcttaggaaaaatttaactgaattgcttagagcagctttaaaaattagaatatgcctagaaaagcagcctgacccttttgcaccaagacaaaagaaaacactgcaggaggttcaggaagattttgtgttttcaaagtatcgtcatagagcccttcttttacctgagcttttggaaggagttcttcagattctgatctgttgtcttcaaagtgcagcttcaaatcccttctacttcagtcaagccatggatttggttcaagaattcattcagcatcatggatttaatttatttgaaacagcagttcttcaaatggaatggctggttttaagagatggagttcctcccgaggcctcagagcatttgaaagccctaataaatagtgtgatgaaaataatgagcactgtcaaaaaagtgaaatcagagcaacttcatcattcgatgtgtacaagaaaaaggcacagacgatgtgaatattctcattttatgcatcatcaccgagatctctcaggtcttctggtttcggcttttaaaaaccaggtttccaaaaacccatttgaagagactgcagatggagatgtttattatcctgagcggtgctgttgcattgcagtgtgtgcccatcagtgcttgcgcttactacagcaggcttccttgagcagcacttgtgtccagatcctatcgggtgttcataacattggaatatgctgttgtatggatcccaaatctgtaatcattcctttgctccatgcttttaaattgccagcactgaaaaattttcagcagcatatattgaatatccttaacaaacttattttggatcagttaggaggagcagagatatcaccaaaaattaaaaaagcagcttgtaatatttgtactgttgactctgaccaactagcccaattagaagagacactgcagggaaacttatgtgatgctgaactctcctcaagtttatccagtccttcttacagatttcaagggatcctgcccagcagtggatctgaagatttgttgtggaaatgggatgctttaaaggcttatcagaactttgtttttgnagaagacagattacatagtatacagattgcaaatcacatttgcaatttaatccagaaaggcaatatagttgttcagtggaaattatataattacatatttaatcctgtgctccaaagaggagttgaattagcacatcattgtcaacacctaagcgttacttcagctcaaagtcatgtatgtagccatcataaccagtgcttgcctcaggacgtgcttcagatttatgtaaaaactctgcctatcctgcttaaatccagggtaataagagatttgtttttgagttgtaatggagtaagtcaaataatcgaattaaattgcttaaatggtattcgaagtcattctctaaaagcatttgaaactctgataatcagcctaggggagcaacagaaagatgcctcagttccagatattgatgggatagacattgaacagaaggagttgtcctctgtacatgtgggtacttcttttcatcatcagcaagcttattcagattctcctcagagtctcagcaaattttatgctggcctcaaagaagcttatccaaagagacggaagactgttaaccaagatgttcatatcaacacaataaacctattcctctgtgtggcttttttatgcgtaagtaaagaagcagagtctgacagggagtcggccaatgactcagaagatacttctggctatgacagcacagccagcgagcctttaagtcatatgctgccatgtatatctctcgagagccttgtcttgccttctcctgaacatatgcaccaagcagcagacatttggtctatgtgtcgttggatctacatgttgagttcagtgttccagaaacagttttataggcttggtggtttccgagtatgccataagttaatatttatgataatacagaaactgttcagaagtcacaaagaggagcaaggaaaaaaggagggagatacaagtgtaaatgaaaaccaggatttaaacagaatttctcaacctaagagaactatgaaggaagatttattatctttggctataaaaagtgaccccataccatcagaactaggtagtctaaaaaagagtgctgacagtttaggtaaattagagttacagcatatttcttccataaatgtggaagaagtttcagctactgaagccgctcccgaggaagcaaagctatttacaagtcaagaaagtgagacctcacttcaaagtatacgacttttggaagcccttctggccatttgtcttcatggtgccagaactagtcaacagaagatggaattggagttacctaatcagaacttgtctgtggaaagtatattatttgaaatgagggaccatctttcccagtcaaaggtgattgaaacacaactagcaaagcctttatttgatgccctgcttcgagttgccctcgggaattattcagcagattttgaacataatgatgctatgactgagaagagtcatcaatctgcagaagaattgtcatcccagcctggtgatttttcagaagaagctgaggattctcagtgttgtagttttaaacttttagttgaagaagaaggttacgaagcagatagtgaaagcaatcctgaagatggcgaaacccaggatgatggggtagacttaaagtctgaaacagaaggtttcagtgcatcaagcagtccaaatgacttactcgaaaacctcactcaaggggaaataatttatcctgagatttgtatgctggaattaaatttgctttctgctagtaaagccaaacttgatgtgcttgcccatgtatttgagagttttttgaaaattattaggcagaaagaaaagaatgtttttctgctcatgcaacagggaactgtgaaaaatcttttaggagggttcttgagtattttaacacaggatgattctgattttcaagcatgccagagagtattggtggatcttttggtatctttgatgagttcaagaacatgttcagaagagctaacccttcttttgagaatatttctggagaaatctccttgtacaaaaattcttcttctgggtattctgaaaattattgaaagtgatactactatgagcccttcacagtatctaaccttccctttactgcacgctccaaatttaagcaacggtgtttcatcacaaaagtatcctgggattttaaacagtaaggccatgggtttattgagaagagcacgagtttcacggagcaagaaagaggctgatagagagagttttccccatcggctgctttcatcttggcacatagccccagtccacctgccgttgctggggcaaaactgctggccacacctatcagaaggtttcagtgtttccctgtggtttaatgtggagtgtatccatgaagctgagagtactacagaaaaaggaaagaagataaagaaaagaaacaaatcattaattttaccagatagcagttttgatggtacagagagcgacagaccagaaggtgcagagtacataaatcctggtgaaagactcatagaagaaggatgtattcatataatttcactgggatccaaagcgttgatgatccaagtgtgggctgatccccacaatgccactcttatctttcgtgtgtgcatggattcaaatgatgacatgaaagctgttttactagcacaggttgaatcacaggagaatattttcctcccaagcaaatggcaacatttagtactcacctacttacagcagccccaagggaaaaggaggattcatgggaaaatctccatatgggtctctggacagaggaagcctgatgttactttggattttatgcttccaagaaaaacaagtttgtcatctgatagcaataaaacattttgcatgattggccattgtttatcatcccaagaagagtttttgcagttggctggaaaatgggacctgggaaatttgcttctcttcaacggagctaaggttggttcacaagaggccttttatctgtatgcttgtggacccaaccatacatctgtaatgccatgtaagtatggcaagccagtcaatgactactccaaatatattaataaagaaattttgcgatgtgaacaaatcagagaactttttatgaccaagaaagatgtggatattggtctcttaattgaaagtctttcagttgtttatacaacttactgtcctgctcagtataccatctatgaaccagtgattagacttaaaggtcaaatgaaaacccaactctctcaaagacccttcagctcaaaagaagttcagagcatcttattagaacctcatcatctaaagaatctccaacctactgaatataaaactattcaaggcattctgcacgaaattggtggaactggcatatttgtttttctctttgccagggttgttgaactcagtagctgtgaagaaactcaagcattagcactgcgagttatactctcattaattaaatacaaccaacaaagagtacatgaattagaaaattgtaatggactttctatgattcatcaggtgttgatcaaacaaaaatgcattgttgggttttacattttgaagacccttcttgaaggatgctgtggtgaagatattatttatatgaatgagaatggagagtttaagttggatgtagactctaatgctataatccaagatgttaagctgttagaggaactattgcttgactggaagatatggagtaaagcagagcaaggtgtttgggaaactttgctagcagctctagaagtcctcatcagagcagatcaccaccagcagatgtttaatattaagcagttattgaaagctcaagtggttcatcactttctactgacttgtcaggttttgcaggaatacaaagaggggcaactcacacccatgccccgagaggtttgtagatcatttgtgaaaattatagcagaagtccttggatctcctccagatttggaattattgacaattatcttcaatttccttttagcagttcaccctcctactaatacttacgtttgtcacaatcccacgaacttctacttttctttgcacataggtaggtataatcatttttgttagatcatggctatttccacttttgttttattcttcccacttgattcacatttgtttga

SEQ ID NO: 330128 - DNA, 5158 bp, Homo sapiens
  misc_feature (2724)..(2724): n is a, c, g, or t
  misc_feature (5143)..(5143): n is a, c, g, or t
gagagagggccactcgccttcctggtgacacagagatttcctagccccgttaccaaacgaaaaagcaacgcaagggcttctaagaagccatcccaatgaccttttggctttgagaagagcagtcctcataccagagtgtttggggttttggcctctttcagtgtttattcattcttacgtgggaaagttgtattccgaggtttctgtggtgcatgaagcttttgccttcaccatctgttcccgtgtcttcctcgggtgacatcagagtacagcagtattttcccttgccatctaatggggtttgggctgtttgactcaaccgtgtgtgttcctcaatgccaggggaataatcctaccctaagtcagctgaacagaagccaggatctaactgcaaacaagagacccagcttgcttaacagcatggaagagaccagtttcgttgcagctacctgggaagacggttgctaattagcctgcaacaaagagttccttgctcatctaaaagaggcaatcaccgttcaggtgaagctttgttctaagaatatttgtttcatctagtttatgagtccaaatgatatagactgtaaatgtcacagcagtggtgaaagactgctcggtcatgagcaccgacagtaactcactggcacgtgaatttctgaccgatgtcaaccggctttgcaatgcagtggtccagagggtggaggccagggaggaagaagaggaggagacgcacatggcaacccttggacagtaccttgtccatggtcgaggatttctattacttaccaagctaaattctataattgatcaggcattgacatgtagagaagaactcctgactcttcttctgtctctccttccactggtatggaagatacctgtccaagaagaaaaggcaacagattttaacctaccgctctcagcagatataatcctgaccaaagaaaagaactcaagttcacaaagatccactcaggaaaaattacatttagaaggaagtgccctgtctagtcaggtttctgcaaaagtaaatgtttttcgaaaaagcagacgacagcgtaaaattacccatcgctattctgtaagagatgcaagaaagacacagctctccacctcagattcagaagccaattcagatgaaaaaggcatagcaatgaataagcatagaaggccccatctgctgcatcattttttaacatcgtttcctaaacaagaccaccccaaagctaaacttgaccgcttagcaaccaaagaacagactcctccagatgctatggctttggaaaattccagagagattattccaagacaggggtcaaacactgacattttaagtgagccagctgccttgtctgttatcagtaacatgaacaattctccatttgacttatgtcatgttttgttatctttattagaaaaagtttgtaagtttgacgttaccttgaatcataattctcctttagcagccagtgtagtgcccacactaactgaattcctagcaggctttggggactgctgcagtctgagcgacaacttggagagtcgagtagtttctgcaggttggaccgaagaaccggtggctttgattcaaaggatgctctttcgaacagtgttgcatcttctgtcagtagatgttagtactgcagagatgatgccagaaaatcttaggaaaaatttaactgaattgcttagagcagctttaaaaattagaatatgcctagaaaagcagcctgacccttttgcaccaagacaaaagaaaacactgcaggaggttcaggaagattttgtgttttcaaagtatcgtcatagagcccttcttttacctgagcttttggaaggagttcttcagattctgatctgttgtcttcaaagtgcagcttcaaatcccttctacttcagtcaagccatggatttggttcaagaattcattcagcatcatggatttaatttatttgaaacagcagttcttcaaatggaatggctggttttaagagatggagttcctcccgaggcctcagagcatttgaaagccctaataaatagtgtgatgaaaataatgagcactgtcaaaaaagtgaaatcagagcaacttcatcattcgatgtgtacaagaaaaaggcacagacgatgtgaatattctcattttatgcatcatcaccgagatctctcaggtcttctggtttcggcttttaaaaaccaggtttccaaaaacccatttgaagagactgcagatggagatgtttattatcctgagcggtgctgttgcattgcagtgtgtgcccatcagtgcttgcgcttactacagcaggcttccttgagcagcacttgtgtccagatcctatcgggtgttcataacattggaatatgctgttgtatggatcccaaatctgtaatcattcctttgctccatgcttttaaattgccagcactgaaaaattttcagcagcatatattgaatatccttaacaaacttattttggatcagttaggaggagcagagatatcaccaaaaattaaaaaagcagcttgtaatatttgtactgttgactctgaccaactagcccaattagaagagacactgcagggaaacttatgtgatgctgaactctcctcaagtttatccagtccttcttacagatttcaagggatcctgcccagcagtggatctgaagatttgttgtggaaatgggatgctttaaaggcttatcagaactttgtttttgnagaagacagattacatagtatacagattgcaaatcacatttgcaatttaatccagaaaggcaatatagttgttcagtggaaattatataattacatatttaatcctgtgctccaaagaggagttgaattagcacatcattgtcaacacctaagcgttacttcagctcaaagtcatgtatgtagccatcataaccagtgcttgcctcaggacgtgcttcagatttatgtaaaaactctgcctatcctgcttaaatccagggtaataagagatttgtttttgagttgtaatggagtaagtcaaataatcgaattaaattgcttaaatggtattcgaagtcattctctaaaagcatttgaaactctgataatcagcctaggggagcaacagaaagatgcctcagttccagatattgatgggatagacattgaacagaaggagttgtcctctgtacatgtgggtacttcttttcatcatcagcaagcttattcagattctcctcagagtctcagcaaattttatgctggcctcaaagaagcttatccaaagagacggaagactgttaaccaagatgttcatatcaacacaataaacctattcctctgtgtggcttttttatgcgtaagtaaagaagcagagtctgacagggagtcggccaatgactcagaagatacttctggctatgacagcacagccagcgagcctttaagtcatatgctgccatgtatatctctcgagagccttgtcttgccttctcctgaacatatgcaccaagcagcagacatttggtctatgtgtcgttggatctacatgttgagttcagtgttccagaaacagttttataggcttggtggtttccgagtatgccataagttaatatttatgataatacagaaactgttcagaagtcacaaagaggagcaaggaaaaaaggagggagatacaagtgtaaatgaaaaccaggatttaaacagaatttctcaacctaagagaactatgaaggaagatttattatctttggctataaaaagtgaccccataccatcagaactaggtagtctaaaaaagagtgctgacagtttaggtaaattagagttacagcatatttcttccataaatgtggaagaagtttcagctactgaagccgctcccgaggaagcaaagctatttacaagtcaagaaagtgagacctcacttcaaagtatacgacttttggaagcccttctggccatttgtcttcatggtgccagaactagtcaacagaagatggaattggagttacctaatcagaacttgtctgtggaaagtatattatttgaaatgagggaccatctttcccagtcaaaggtgattgaaacacaactagcaaagcctttatttgatgccctgcttcgagttgccctcgggaattattcagcagattttgaacataatgatgctatgactgagaagagtcatcaatctgcagaagaattgtcatcccagcctggtgatttttcagaagaagctgaggattctcagtgttgtagttttaaacttttagttgaagaagaaggttacgaagcagatagtgaaagcaatcctgaagatggcgaaacccaggatgatggggtagacttaaagtctgaaacagaaggtttcagtgcatcaagcagtccaaatgacttactcgaaaacctcactcaaggggaaataatttatcctgagatttgtatgctggaattaaatttgctttctgctagtaaagccaaacttgatgtgcttgcccatgtatttgagagttttttgaaaattattaggcagaaagaaaagaatgtttttctgctcatgcaacagggaactgtgaaaaatcttttaggagggttcttgagtattttaacacaggatgattctgattttcaagcatgccagagagtattggtggatcttttggtatctttgatgagttcaagaacatgttcagaagagctaacccttcttttgagaatatttctggagaaatctccttgtacaaaaattcttcttctgggtattctgaaaattattgaaagtgatactactatgagcccttcacagtatctaaccttccctttactgcacgctccaaatttaagcaacggtgtttcatcacaaaagtatcctgggattttaaacagtaaggccatgggtttattgagaagagcacgagtttcacggagcaagaaagaggctgatagagagagttttccccatcggctgctttcatcttggcacatagccccagtccacctgccgttgctggggcaaaactgctggccacacctatcagaaggtttcagtgtttccctgtggtttaatgtggagtgtatccatgaagctgagagtactacttacagcagccccaagggaaaaggaggattacagggaaatatgcctgaggtntcatggggtgcccgc

SEQ ID NO: 330129 - DNA, 8044 bp, Homo sapiens
gagatttttttttattttttcaggaatacaaagaggggcaactcacacccatgccccgagaggtttgtagatcatttgtgaaaattatagcagaagtccttggatctcctccagatttggaattattgacaattatcttcaatttccttttagcagttcaccctcctactaatacttacgtttgtcacaatcccacgaacttctacttttctttgcacatagatggcaagatctttcaggagaaagtgcggtcaatcatgtacctgaggcattccagcagtggaggaaggtcccttatgagccctggatttatggtaataagcccatctggttttactgcttcaccatatgaaggagagaattcctctaatattattccacaacagatggccgcccatatgctgcgttctagaagcctaccagcattccctacttcttcactactaacgcaatcacaaaaactgactggaagtttgggttgtagtatcgacaggttacaaaatattgcagatacttatgttgccacccaatcaaagaaacaaaattctttggggagttccgacacactgaaaaaaggcaaagaggacgcattcatcagtagctgtgagtctgcaaaaactgtttgtgaaatggaagctgtcctctcagcccaggtctctgtcagtgatgtcccaaagggagtgctgggatttccagtggtcaaagcagatcataaacagttgggagcagaacccaggtcagaagatgacagtcctggggatgagtcctgcccacgccgacctgattacctaaagggattggcctccttccagcgaagccacagcactattgcaagccttgggctagcttttccttcacagaacggatctgcagctgttggccgttggccaagtcttgttgatagaaacactgatgattgggaaaatgtaactgaagactgtttggtacctatatgctgtggattatatgaactcctaagtggggttcttcttatcctgcctgatgttttgcttgaagatgtgatggacaagcttattcaagcagatacacttttggtcctcgttaaccacccatcaccagctatacaacaaggtgttattaaactattagatgcatattttgctagagcatctaaggaacaaaaagataaatttctgaagaatcgtggattttccttgctagccaaccagttgtatcttcatcgaggaactcaagaattgttagaatgcttcatcgaaatgttctttggtcgacatattggccttgatgaagaatttgatctggaagatgtgagaaacatgggattgtttcagaagtggtctgtcattcctattctgggactaatagagacctctctatatgacaacatactcttgcataatgctcttttacttcttctccaaattttaaattcttgttctaaggtagcagatatgttgctggataatggtctactctatgtgttatgtaatacagtagcagccctgaatggattagaaaagaacattcccatgagtgaatataaattgcttgcttgtgatatacagcaacttttcatagcagttacaattcatgcttgcagttcctcaggctcacaatattttagggttattgaagaccttattgtaatgcttggatatcttcaaaatagcaaaaacaagaggacacaaaatatggctgttgcactacagcttagagttctccaggctgctatggaatttataaggaccaccgcaaatcatgactctgaaaacctcacagattcactccagtcaccttctgctccccatcatgcagtagttcaaaagcggaaaagcattgctggtcctcgaaaatttccccttgctcaaactgaatcgcttctgatgaaaatgcgttcagtggcaaatgatgagcttcatgtgatgatgcaacggagaatgagccaagagaaccctagccaagcaactgaaacggaacttgcgcagagactacagaggctcactgttttagcagtcaacaggattatttatcaagaatttaattcagacattattgacattttgagaactccagaaaatgtaactcaaagcaagacctcagttttccagaccgaaatttctgaggaaaatattcatcatgaacagtcttctgttttcaatccatttcagaaagaaatttttacatatctggtagaaggattcaaagtatctattggttcaagtaaagccagtggttccaagcagcaatggactaaaattctgtggtcttgtaaggagaccttccgaatgcagcttgggagactactagtgcatattttgtcgccagcccacgctgcacaagagagaaagcaaatttttgaaatagttcatgaaccaaatcatcaggaaatactacgagactgtctcagcccatccctacaacatggagccaagttagttttgtatttgtcagagttgatacataatcaccaaggtgaattgactgaagaagagctaggcacagcagaactgcttatgaatgctttgaagttatgtggtcacaagtgcatccctcccagtgcatcaacaaaagcagaccttattaaaatgatcaaagaggaacaaaagaaatatgaaactgaagaaggagtgaataaagctgcttggcagaaaacagttaacaataatcaacaaagtctctttcagcgtctggattcaaaatcaaaggatatatctaaaatagctgcagatatcacccaggcagtgtctctctcccaaggaaatgagagaaaaaaggtgatccagcatattagaggaatgtataaagtagatttgagtgccagcagacattggcaggaacttattcagcagctgacacatgatagagcagtatggtatgaccccatctactatccaacctcatggcagttggatccaacagaagggccaaatcgagagaggagacgtttacagagatgttatttaactattccaaataagtatctccttagggatagacagaaatcagaagatgttgtcaaaccaccactctcttacctgtttgaagacaaaactcattcttctttctcttctactgtcaaagacaaagctgcaagtgaatctataagagtgaatcgaagatgcatcagtgttgcaccatctagagagacagctggtgaattgttactaggtaaatgtggaatgtattttgtggaagataatgcttctgatacagttgaaagttcgagccttcagggagagttggaaccagcatcattttcctggacatatgaagaaattaaagaagttcacaagcgttggtggcaattgagagataatgctgtagaaatctttctaacaaatggcagaacactcctgttggcatttgataacaccaaggttcgtgatgatgtataccacaatatactcacaaataacctccctaatcttctggaatatggtaacatcaccgctctgacaaatttatggtatactgggcaaattactaattttgaatatttgactcacttaaacaaacatgctggccgatccttcaatgatctcatgcagtatcctgtgttcccatttatacttgctgactacgttagtgagacacttgacctcaatgatctgttgatatacagaaatctctctaaacctatagctgttcagtataaagaaaaagaagatcgttatgtggacacatacaagtacttggaggaagagtaccgcaaaggagccagagaagatgaccccatgcctcccgtgcagccctatcactatggctcccactattccaatagcggcactgtgcttcacttcctggtcaggatgcctcctttcactaaaatgtttttagcctatcaagatcaaagttttgacattccagacagaacttttcattctacaaatacaacttggcgactctcatcttttgaatctatgactgatgtgaaagaacttatcccagagtttttctatcttccagagttcctagttaaccgtgaaggttttgattttggtgtgcgtcagaatggtgaacgggttaatcacgtcaaccttcccccttgggcgcgtaatgatcctcgtctttttatcctcatccatcggcaggctctagagtctgactacgtgtcgcagaacatctgtcagtggattgacttggtgtttgggtataagcaaaaggggaaggcttctgttcaagcgatcaatgtttttcatcctgctacatattttggaatggatgtctctgcagttgaagatccagttcagagacgagcgctagaaaccatgataaaaacctacgggcagactccccgtcagctgttccacatggcccatgtgagcagacctggagccaagctcaatattgaaggagagcttccagctgctgtggggttgctagtgcagtttgctttcagggagacccgagaacaggtcaaagaaatcacctatccgagtcctttgtcatggataaaaggcttgaaatggggggaatacgtgggttcccccagtgctccagtacctgtggtctgcttcagccagccccacggagaaagatttggctctctccaggctctgcccaccagagcaatctgtggtttgtcacggaatttctgtcttctgatgacatatagcaaggaacaaggtgtgagaagcatgaacagtacggacattcagtggtcagccatcctgagctggggatatgctgataatattttaaggttgaagagtaaacaaagtgagcctccagtaaactttattcaaagttcacaacagtaccaggtgactagttgtgcttgggtgcctgacagttgccagctgtttactggaagcaaatgcggtgtcatcacagcctacacaaacagatttacaagcagcacgccatcagaaatagaaatggagactcaaatacatctctatggtcacacagaagagataaccagcttatttgtttgcaaaccatacagtatactgataagtgtgagcagagacggaacctgcatcatatgggatttaaacaggttatgctatgtacaaagtctggcgggacacaaaagccctgtcacagctgtctctgccagtgaaacctcaggtgatattgctactgtgtgtgattcagctggcggaggcagtgacctcagactctggacggtgaacggggatctcgttggacatgtccactgcagggagatcatctgttccgtggctttctccaaccagcctgagggagtatctatcaatgtaatcgctgggggattagaaaatggaattgtaaggttatggagcacatgggacttaaagcctgtgagagaaattacatttcccaaatcaaataagcccatcatcagccttacattttcttgtgatggccaccatttgtacacagcaaacagtgatgggaccgtgattgcctggtgtcggaaggaccagcagcgcttgaaacagccaatgttctattccttccttagcagctatgcagccgggtgaatgcgaatgaacttcacgttctccaaagcactttaactccaaactagatttgttgacttcaccagttttaggaggttgaacctaaagaaatggatgactggacaaaccatccaaataatgataaagtctattcatctgcacaaaattctgaagagtcacatgatcctaagaggaaagttctgttctattttagtgataatctggaagattgtgtcaatatgcactagccaacaagttttaagcctcgcatggtacattaaaatgatattcttaaaattttttcccaccaaggtattccaaagaaaatattaaggtctcccctttttctatgattccaaaaggaccagtagaatttaaattggttggttgattgtttatataaaacacactaaaattatattttaaaagtttactgccatgaaatactcctcccaccacacacacatgctccaaaagaggaaagaaaaaaagataatttttaggacttgataattgctttctttgagaagcaaattattcagtaggtgcctctgtaccaaatattttatggaatatctaaatactaaaataaactatgaatgaatctcaaaattaggcagtttttgccagttgctttcttagctcaaaggagaaccagaatttttttgacagccacaaacaagaatacaggtatcttggatttcagacacattctgtttcttcataaaaattttacttaaaatctgtaacgctagatattgactatccttagttgagtcactgaggtttaaacacaatggtaagtcttaaagtctgctatttacagagcattgaatctgtaccaatttgcaatagaaagccttcagtatgcaagaagtttgcatgggtattaagaacacagcctaaataaggcatttgatctaatctgcaggaagaattttcttccccaaaacagaattataaaagcttactttaaacaggaggcagaataattcttttaggaaaccatttcattctgtttctactaacctataccatctgagaattctaggaagaataataaaatctcgtgtattccacagcaaacttacataccataaagacagaattcctaaacatcttggagccgtctgtctctcccatatgatggctgtctgtatatttttacttggggtgctgctttattggctttgaaaacactgtcagataagctcagtaatatgttaccatgggataaaaatatgtatccctgcctaagaataacttgtgcatttgttatggaaatttaattcatatggtgtttacagtactacttttgtaacttccagactttctaaaacattctgcttaaaaaccatataaaatataattccaaagtctctgctgtcaagatagattcgagagaaagcacgtggccatgtatgctttaaccttaaactgcatacacatgtagtgatacctaggctgcatttagatcaccgtgtgctcaggccaggtgtgaatcctgaggtccatggaggtgcagagatgagattactcctattcacgttgaagtgatttgctttgttaacaaaaaattgcagctattgtctagctttcatttttttactgagaactttaaattagtcccctattagaatagggttgctactcatctttttttaaaaaccgaatttcatcatttatctaaagagaaaatatgcagaataactggtcttgttaagagtgcaatattatatttttatgtaaaaataaaaattaatttggggggattatttattcagcatgaaacctaatatgtatatgtttgaaatacttcataatgtgcatgttgtagcaaacatttctgtaaattatcacaagctctgttacctttatatacactgcctcttcaatttggaaataaatttcataaaaatagaaaaaaaaaaaaacaaaaaacaaaaaaaaaaaatgtgtgcgcggcgcgcgccctgggcccccgcgagaagaggccttcttaagcaccctggggtgggggcgcgcggaggagccccacagataggtgaaaaagggacacaaatgggccacaaacgcgcggcaccccgaaggcgaaactcgcgcgacacgacaaccagagggcagcggacatcatccaccaataaaaaacacagccccgggggggaaacacggagacgcgtctgcacacaaaacactcacgacaggagagtcacgaagagagggcaacacaagcgcgggaactaactacacaacaggggaagcacaaaaagaagaaagccgagaaattcaacaaattaaacgcccgtaagcactcgtggataacaagaaaagacacagaagaagagaaaagaaaaaccagaagaacaaacaagacaacacacaagccaaaaacacgcagcaacaagaaagcgaaaggcagacggagcggagagcagcagaggacagagagtgaacggaagagacgaggagcgaagagagggggagggaggacggcgggagccgacagcaaggcccgcggagcgagagggggggacagacaagaagaaaggaagcagagagaagggacgagagacgagaggcaagagcgcgcggaggagcaggagcagacggggagc

SEQ ID NO: 330130 - DNA, 2249 bp, Homo sapiens
aggaagagtccccaccctctcatgtaggtgagaggcggctgaagagttgctgtattctgggaatgggcagggtcactcgtccgaacagagtcctatcctacgcggcggaagagtgtgccctttgacttgcatcgtctacctacctctgccatcctctaccagccgcaactgcgagggctggagccaacttcaggactgattgatcatgacttctataaaggagcaggcagcaattagcaggctcttaagttttttacaggagtgggacaacgctggcaaagtcgcaaggagtcacatcctcgacaagttcattgaaaccaaccaaggcaagactgcccctgaactggagcaggagttttcccagggagccagtttgttcctggtacgcttgaccacctcgcttagaatcacctatatgactgactcatgtttagaaaagcttctcaggtccattggcatcttcttatcagctgtaagcagtaatcggtaccttatagaatttcttgaggttggaggtgtcctaaccctcttggaaatacttgggctagagaagatcaaggaggaggccaagaaggaatctgtcaaactacttcaggttattgcgaactctggcaggacatacaaggaactcatttgtgaaagctatggtgtacgatccatagcagaatttttggcaaagtctaagtcagaagagacccaggaggaagtgcaggttctgttggattctttggtccacggcaatcccaagtaccaaaatcaagtgtataaaggtctaatagctttgctgccctgcgagtccccaaaagcccagcagctgtccctgcagactctcaggactgcccagccaatcattgggaccacacaccccagcatcgtggactgcgtgctgaaggtgctgggcacgatgcacctggaagtccagtatgaagccatcgagttgatcaaagacctggtcggttacgatgtgcgccaggcgctgctcaagggcctcgtggcgctgctgataccgtcggtcaaggagatctccaaactgcaggccaagatcctcagtgacccctcggttctccagctcacccccagcctgccgatgtttttgcagcaggccgcggccgccaaggccatcgggtaagcgggcaggggttagtgggtagctgcagcaagcctggcttggcgctgccggcgggccccgggagcgctccgtgcgccgggtgggcgggggtgtgcgccgggtgagccccagggcgtcgccccagcccgaacccccggcccagggtcctggcgcgcaacgacatgagcatcgccgaggagctgctgtacctgcgcgtggtgcgtggcctaatggccgccatgggcaacacggaccacagcaacagccagcggctggccagcctcacgctggaggtgcgcgcggcggctggttagggggcgggaagggcggcggcacccgcagccccgtcgcccccgcagtcacgccgcctcgcccgcgcggcgcagtgcttcgtgcagatgttccccttggtggcggagcacgtgcgcaagtgcatgggggaggaactctaccagctcttcctggtaagtgcgcccttcctgccccgccgcaatgagcagatggcggctcggacagtgtgatgccccttcagacagtccccatcctggagcgcgccacatgcagagtggacctggccaccagctgcaggagggactgctctggcgtaggctcctccacccgccaccttcctgttccctttcctgccctttcggtcaggctgccgacccgccccccacctgcaacatccctctgccaagcccaactccaagtccagactgccctggcaccccagccgggtcccccttgctcctgtcctcagagcaacgctgaggacttgtacatgaaaatagacagcattcaggcggacatcttggcggccaacacagtcaatgttaccaaagccctgtgcctccatggcagctcctacagcatgaacactctctatggctcgcgcgattcggctcagatggcctacctcacacacttcgaggaggatgtagaatcaaaggagtaacagcccctgtggcaaaccaggaaggccaaggctgcggggcagggaagcctggcaagaggaaggcgcctggggtcaagctcagagccactccacttggctccaggggggagacggggattaggcatcccagaggggcagaggaagagccgctggctgcgaagagtcaataaacagccttgatacctg

SEQ ID NO: 330131 - DNA, 2151 bp, Homo sapiens
aggaagagtccccaccctctcatgtaggtgagaggcggctgaagagttgctgtattctgggaatgggcagggtcactcgtccgaacagagtcctatcctacgcggcggaagagtgtgccctttgacttgcatcgtctacctacctctgccatcctctaccagccgcaactgcgagggctggagccaacttcaggactgattgatcatgacttctataaaggagcaggcagcaattagcaggctcttaagttttttacaggagtgggacaacgctggcaaagtcgcaaggagtcacatcctcgacaagttcattgaaaccaaccaaggcaagactgcccctgaactggagcaggagttttcccagggagccagtttgttcctgtaatcggtaccttatagaatttcttgaggttggaggtgtcctaaccctcttggaaatacttgggctagagaagatcaaggaggaggccaagaaggaatctgtcaaactacttcaggttattgcgaactctggcaggacatacaaggaactcatttgtgaaagctatggtgtacgatccatagcagaatttttggcaaagtctaagtcagaagagacccaggaggaagtgcaggttctgttggattctttggtccacggcaatcccaagtaccaaaatcaagtgtataaaggtctaatagctttgctgccctgcgagtccccaaaagcccagcagctgtccctgcagactctcaggactgcccagccaatcattgggaccacacaccccagcatcgtggactgcgtgctgaaggtgctgggcacgatgcacctggaagtccagtatgaagccatcgagttgatcaaagacctggtcggttacgatgtgcgccaggcgctgctcaagggcctcgtggcgctgctgataccgtcggtcaaggagatctccaaactgcaggccaagatcctcagtgacccctcggttctccagctcacccccagcctgccgatgtttttgcagcaggccgcggccgccaaggccatcgggtaagcgggcaggggttagtgggtagctgcagcaagcctggcttggcgctgccggcgggccccgggagcgctccgtgcgccgggtgggcgggggtgtgcgccgggtgagccccagggcgtcgccccagcccgaacccccggcccagggtcctggcgcgcaacgacatgagcatcgccgaggagctgctgtacctgcgcgtggtgcgtggcctaatggccgccatgggcaacacggaccacagcaacagccagcggctggccagcctcacgctggaggtgcgcgcggcggctggttagggggcgggaagggcggcggcacccgcagccccgtcgcccccgcagtcacgccgcctcgcccgcgcggcgcagtgcttcgtgcagatgttccccttggtggcggagcacgtgcgcaagtgcatgggggaggaactctaccagctcttcctggtaagtgcgcccttcctgccccgccgcaatgagcagatggcggctcggacagtgtgatgccccttcagacagtccccatcctggagcgcgccacatgcagagtggacctggccaccagctgcaggagggactgctctggcgtaggctcctccacccgccaccttcctgttccctttcctgccctttcggtcaggctgccgacccgccccccacctgcaacatccctctgccaagcccaactccaagtccagactgccctggcaccccagccgggtcccccttgctcctgtcctcagagcaacgctgaggacttgtacatgaaaatagacagcattcaggcggacatcttggcggccaacacagtcaatgttaccaaagccctgtgcctccatggcagctcctacagcatgaacactctctatggctcgcgcgattcggctcagatggcctacctcacacacttcgaggaggatgtagaatcaaaggagtaacagcccctgtggcaaaccaggaaggccaaggctgcggggcagggaagcctggcaagaggaaggcgcctggggtcaagctcagagccactccacttggctccaggggggagacggggattaggcatcccagaggggcagaggaagagccgctggctgcgaagagtcaataaacagccttgatacctg

SEQ ID NO: 330132 - DNA, 2056 bp, Homo sapiens
aggaagagtccccaccctctcatgtaggtgagaggcggctgaagagttgctgtattctgggaatgggcagggtcactcgtccgaacagagtcctatcctacgcggcggaagagtgtgccctttgacttgcatcgtctacctacctctgccatcctctaccagccgcaactgcgagggctggagccaacttcaggactgattgatcatgacttctataaaggagcaggcagcaattagcaggctcttaagttttttacaggagtgggacaacgctggcaaagtcgcaaggagtcacatcctcgacaagttcattgaaaccaaccaaggcaagactgcccctgaactggagcaggagttttcccagggagccagtttgttcctggtacgcttgaccacctcgcttagaatcacctatatgactgactcatgtttagaaaagcttctcaggtccattggcatcttcttatcagctgtaagcagtaatcggtaccttatagaatttcttgaggttggaggtgtcctaaccctcttggaaatacttgggctagagaagatcaaggaggaggccaagaaggaatctgtcaaactacttcaggttattgcgaactctggcaggacatacaaggaactcatttgtgaaagctatggtgtacgatccatagcagaatttttggcaaagtctaagtcagaagagacccaggaggaagtgcaggttctgttggattctttggtccacggcaatcccaagtaccaaaatcaagtgtataaaggtctaatagctttgctgccctgcgagtccccaaaagcccagcagctgtccctgcagactctcaggactgcccagccaatcattgggaccacacaccccagcatcgtggactgcgtgctgaaggtgctgggcacgatgcacctggaagtccagtatgaagccatcgagttgatcaaagacctggtcggttacgatgtgcgccaggcgctgctcaagggcctcgtggcgctgctgataccgtcggtcaaggagatctccaaactgcaggccaagatcctcagtgacccctcggttctccagctcacccccagcctgccgatgtttttgcagcaggccgcggccgccaaggccatcgggtaagcgggcaggggttagtgggtagctgcagcaagcctggcttggcgctgccggcgggccccgggagcgctccgtgcgccgggtgggcgggggtgtgcgccgggtgagccccagggcgtcgccccagcccgaacccccggcccagggtcctggcgcgcaacgacatgagcatcgccgaggagctgctgtacctgcgcgtggtgcgtggcctaatggccgccatgggcaacacggaccacagcaacagccagcggctggccagcctcacgctggaggtgcgcgcggcggctggttagggggcgggaagggcggcggcacccgcagccccgtcgcccccgcagtcacgccgcctcgcccgcgcggcgcagtgcttcgtgcagatgttccccttggtggcggagcacgtgcgcaagtgcatgggggaggaactctaccagctcttcctggctgccgacccgccccccacctgcaacatccctctgccaagcccaactccaagtccagactgccctggcaccccagccgggtcccccttgctcctgtcctcagagcaacgctgaggacttgtacatgaaaatagacagcattcaggcggacatcttggcggccaacacagtcaatgttaccaaagccctgtgcctccatggcagctcctacagcatgaacactctctatggctcgcgcgattcggctcagatggcctacctcacacacttcgaggaggatgtagaatcaaaggagtaacagcccctgtggcaaaccaggaaggccaaggctgcggggcagggaagcctggcaagaggaaggcgcctggggtcaagctcagagccactccacttggctccaggggggagacggggattaggcatcccagaggggcagaggaagagccgctggctgcgaagagtcaataaacagccttgatacctg

SEQ ID NO: 330133 - DNA, 2156 bp, Homo sapiens
aggaagagtccccaccctctcatgtaggtgagaggcggctgaagagttgctgtattctgggaatgggcagggtcactcgtccgaacagagtcctatcctacgcggcggaagagtgtgccctttgacttgcatcgtctacctacctctgccatcctctaccagccgcaactgcgagggctggagccaacttcaggactgattgatcatgacttctataaaggagcaggcagcaattagcaggctcttaagttttttacaggagtgggacaacgctggcaaagtcgcaaggagtcacatcctcgacaagttcattgaaaccaaccaaggcaagactgcccctgaactggagcaggagttttcccagggagccagtttgttcctggtacgcttgaccacctcgcttagaatcacctatatgactgactcatgtttagaaaagcttctcaggtccattggcatcttcttatcagctgtaagcagtaatcggtaccttatagaatttcttgaggttggaggtgtcctaaccctcttggaaatacttgggctagagaagatcaaggaggaggccaagaaggaatctgtcaaactacttcaggttattgcgaactctggcaggacatacaaggaactcatttgtgaaagctatggtgtacgatccatagcagaatttttggcaaagtctaagtcagaagagacccaggaggaagtgcaggttctgttggattctttggtccacggcaatcccaagtaccaaaatcaagtgtataaaggtctaatagctttgctgccctgcgagtccccaaaagcccagcagctgtccctgcagactctcaggactgcccagccaatcattgggaccacacaccccagcatcgtggactgcgtgctgaaggtgctgggcacgatgcacctggaagtccagtatgaagccatcgagttgatcaaagacctggtcggttacgatgtgcgccaggcgctgctcaagggcctcgtggcgctgctgataccgtcggtcaaggagatctccaaactgcaggccaagatcctcagtgacccctcggttctccagctcacccccagcctgccgatgtttttgcagcaggccgcggccgccaaggccatcgggtaagcgggcaggggttagtgggtagctgcagcaagcctggcttggcgctgccggcgggccccgggagcgctccgtgcgccgggtgggcgggggtgtgcgccgggtgagccccagggcgtcgccccagcccgaacccccggcccagggtcctggcgcgcaacgacatgagcatcgccgaggagctgctgtacctgcgcgtggtgcgtggcctaatggccgccatgggcaacacggaccacagcaacagccagcggctggccagcctcacgctggagtgcttcgtgcagatgttccccttggtggcggagcacgtgcgcaagtgcatgggggaggaactctaccagctcttcctggtaagtgcgcccttcctgccccgccgcaatgagcagatggcggctcggacagtgtgatgccccttcagacagtccccatcctggagcgcgccacatgcagagtggacctggccaccagctgcaggagggactgctctggcgtaggctcctccacccgccaccttcctgttccctttcctgccctttcggtcaggctgccgacccgccccccacctgcaacatccctctgccaagcccaactccaagtccagactgccctggcaccccagccgggtcccccttgctcctgtcctcagagcaacgctgaggacttgtacatgaaaatagacagcattcaggcggacatcttggcggccaacacagtcaatgttaccaaagccctgtgcctccatggcagctcctacagcatgaacactctctatggctcgcgcgattcggctcagatggcctacctcacacacttcgaggaggatgtagaatcaaaggagtaacagcccctgtggcaaaccaggaaggccaaggctgcggggcagggaagcctggcaagaggaaggcgcctggggtcaagctcagagccactccacttggctccaggggggagacggggattaggcatcccagaggggcagaggaagagccgctggctgcgaagagtcaataaacagccttgatacctg

SEQ ID NO: 330134 - DNA, 1880 bp, Homo sapiens
aggaagagtccccaccctctcatgtaggtgagaggcggctgaagagttgctgtattctgggaatgggcagggtcactcgtccgaacagagtcctatcctacgcggcggaagagtgtgccctttgacttgcatcgtctacctacctctgccatcctctaccagccgcaactgcgagggctggagccaacttcaggactgattgatcatgacttctataaaggagcaggcagcaattagcaggctcttaagttttttacaggagtgggacaacgctggcaaagtcgcaaggagtcacatcctcgacaagttcattgaaaccaaccaaggcaagactgcccctgaactggagcaggagttttcccagggagccagtttgttcctgacacggggtcttgctatgttgcccaagctggtctcaaactcctggcctcatgcgatcttcccaccttagcctcccaaagtgctgggactacagccaatcattgggaccacacaccccagcatcgtggactgcgtgctgaaggtgctgggcacgatgcacctggaagtccagtatgaagccatcgagttgatcaaagacctggtcggttacgatgtgcgccaggcgctgctcaagggcctcgtggcgctgctgataccgtcggtcaaggagatctccaaactgcaggccaagatcctcagtgacccctcggttctccagctcacccccagcctgccgatgtttttgcagcaggccgcggccgccaaggccatcgggtaagcgggcaggggttagtgggtagctgcagcaagcctggcttggcgctgccggcgggccccgggagcgctccgtgcgccgggtgggcgggggtgtgcgccgggtgagccccagggcgtcgccccagcccgaacccccggcccagggtcctggcgcgcaacgacatgagcatcgccgaggagctgctgtacctgcgcgtggtgcgtggcctaatggccgccatgggcaacacggaccacagcaacagccagcggctggccagcctcacgctggaggtgcgcgcggcggctggttagggggcgggaagggcggcggcacccgcagccccgtcgcccccgcagtcacgccgcctcgcccgcgcggcgcagtgcttcgtgcagatgttccccttggtggcggagcacgtgcgcaagtgcatgggggaggaactctaccagctcttcctggtaagtgcgcccttcctgccccgccgcaatgagcagatggcggctcggacagtgtgatgccccttcagacagtccccatcctggagcgcgccacatgcagagtggacctggccaccagctgcaggagggactgctctggcgtaggctcctccacccgccaccttcctgttccctttcctgccctttcggtcaggctgccgacccgccccccacctgcaacatccctctgccaagcccaactccaagtccagactgccctggcaccccagccgggtcccccttgctcctgtcctcagagcaacgctgaggacttgtacatgaaaatagacagcattcaggcggacatcttggcggccaacacagtcaatgttaccaaagccctgtgcctccatggcagctcctacagcatgaacactctctatggctcgcgcgattcggctcagatggcctacctcacacacttcgaggaggatgtagaatcaaaggagtaacagcccctgtggcaaaccaggaaggccaaggctgcggggcagggaagcctggcaagaggaaggcgcctggggtcaagctcagagccactccacttggctccaggggggagacggggattaggcatcccagaggggcagaggaagagccgctggctgcgaagagtcaataaacagccttgatacctg

SEQ ID NO: 330135 - DNA, 1734 bp, Homo sapiens
atcttgtcttcccgtaaagacccagcccttccctcctccatgaaacctggattcctccaaggcgaaggcccccctctctggggtctcagcctccagcgctgacatcctaggccgcctcgacaggtgggctcaccatcaacccttcctcctcccccttcagccccctcctcctgctcttcaactgaggttcgccttcccagctcccccacgccctgcacagtgctgatcagtaaaagaggaggacactgacgagtggcgacttggttcacggggttctttgcttcctcggtggcggaggggcctggggcctctctccagcacctctgcccttccgcagccatcgagttgatcaaagacctggtcggttacgatgtgcgccaggcgctgctcaagggcctcgtggcgctgctgataccgtcggtcaaggagatctccaaactgcaggccaagatcctcagtggtaaggacctgctcaaatggggctgcctgggccacgggagggcggtctcttgcctcacggctgccccctcctcagacacccctcggttctccagctcacccccagcctgccgatgtttttgcagcaggccgcggccgccaaggccatcgggtaagcgggcaggggttagtgggtagctgcagcaagcctggcttggcgctgccggcgggccccgggagcgctccgtgcgccgggtgggcgggggtgtgcgccgggtgagccccagggcgtcgccccagcccgaacccccggcccagggtcctggcgcgcaacgacatgagcatcgccgaggagctgctgtacctgcgcgtggtgcgtggcctaatggccgccatgggcaacacggaccacagcaacagccagcggctggccagcctcacgctggaggtgcgcgcggcggctggttagggggcgggaagggcggcggcacccgcagccccgtcgcccccgcagtcacgccgcctcgcccgcgcggcgcagtgcttcgtgcagatgttccccttggtggcggagcacgtgcgcaagtgcatgggggaggaactctaccagctcttcctggtaagtgcgcccttcctgccccgccgcaatgagcagatggcggctcggacagtgtgatgccccttcagacagtccccatcctggagcgcgccacatgcagagtggacctggccaccagctgcaggagggactgctctggcgtaggctcctccacccgccaccttcctgttccctttcctgccctttcggtcaggctgccgacccgccccccacctgcaacatccctctgccaagcccaactccaagtccagactgccctggcaccccagccgggtcccccttgctcctgtcctcagagcaacgctgaggacttgtacatgaaaatagacagcattcaggcggacatcttggcggccaacacagtcaatgttaccaaagccctgtgcctccatggcagctcctacagcatgaacactctctatggctcgcgcgattcggctcagatggcctacctcacacacttcgaggaggatgtagaatcaaaggagtaacagcccctgtggcaaaccaggaaggccaaggctgcggggcagggaagcctggcaagaggaaggcgcctggggtcaagctcagagccactccacttggctccaggggggagacggggattaggcatcccagaggggcagaggaagagccgctggctgcgaagagtcaataaacagccttgatacctg

SEQ ID NO: 330136 - DNA, 1657 bp, Homo sapiens
atcttgtcttcccgtaaagacccagcccttccctcctccatgaaacctggattcctccaaggcgaaggcccccctctctggggtctcagcctccagcgctgacatcctaggccgcctcgacagctcccccacgccctgcacagtgctgatcagtaaaagaggaggacactgacgagtggcgacttggttcacggggttctttgcttcctcggtggcggaggggcctggggcctctctccagcacctctgcccttccgcagccatcgagttgatcaaagacctggtcggttacgatgtgcgccaggcgctgctcaagggcctcgtggcgctgctgataccgtcggtcaaggagatctccaaactgcaggccaagatcctcagtggtaaggacctgctcaaatggggctgcctgggccacgggagggcggtctcttgcctcacggctgccccctcctcagacacccctcggttctccagctcacccccagcctgccgatgtttttgcagcaggccgcggccgccaaggccatcgggtaagcgggcaggggttagtgggtagctgcagcaagcctggcttggcgctgccggcgggccccgggagcgctccgtgcgccgggtgggcgggggtgtgcgccgggtgagccccagggcgtcgccccagcccgaacccccggcccagggtcctggcgcgcaacgacatgagcatcgccgaggagctgctgtacctgcgcgtggtgcgtggcctaatggccgccatgggcaacacggaccacagcaacagccagcggctggccagcctcacgctggaggtgcgcgcggcggctggttagggggcgggaagggcggcggcacccgcagccccgtcgcccccgcagtcacgccgcctcgcccgcgcggcgcagtgcttcgtgcagatgttccccttggtggcggagcacgtgcgcaagtgcatgggggaggaactctaccagctcttcctggtaagtgcgcccttcctgccccgccgcaatgagcagatggcggctcggacagtgtgatgccccttcagacagtccccatcctggagcgcgccacatgcagagtggacctggccaccagctgcaggagggactgctctggcgtaggctcctccacccgccaccttcctgttccctttcctgccctttcggtcaggctgccgacccgccccccacctgcaacatccctctgccaagcccaactccaagtccagactgccctggcaccccagccgggtcccccttgctcctgtcctcagagcaacgctgaggacttgtacatgaaaatagacagcattcaggcggacatcttggcggccaacacagtcaatgttaccaaagccctgtgcctccatggcagctcctacagcatgaacactctctatggctcgcgcgattcggctcagatggcctacctcacacacttcgaggaggatgtagaatcaaaggagtaacagcccctgtggcaaaccaggaaggccaaggctgcggggcagggaagcctggcaagaggaaggcgcctggggtcaagctcagagccactccacttggctccaggggggagacggggattaggcatcccagaggggcagaggaagagccgctggctgcgaagagtcaataaacagccttgatacctg

SEQ ID NO: 330137 - DNA, 1580 bp, Homo sapiens
atcttgtcttcccgtaaagacccagcccttccctcctccatgaaacctggattcctccaaggcgaaggcccccctctctggggtctcagcctccagcgctgacatcctaggccgcctcgacagctcccccacgccctgcacagtgctgatcagtaaaagaggaggacactgacgagtggcgacttggttcacggggttctttgcttcctcggtggcggaggggcctggggcctctctccagcacctctgcccttccgcagccatcgagttgatcaaagacctggtcggttacgatgtgcgccaggcgctgctcaagggcctcgtggcgctgctgataccgtcggtcaaggagatctccaaactgcaggccaagatcctcagtgacccctcggttctccagctcacccccagcctgccgatgtttttgcagcaggccgcggccgccaaggccatcgggtaagcgggcaggggttagtgggtagctgcagcaagcctggcttggcgctgccggcgggccccgggagcgctccgtgcgccgggtgggcgggggtgtgcgccgggtgagccccagggcgtcgccccagcccgaacccccggcccagggtcctggcgcgcaacgacatgagcatcgccgaggagctgctgtacctgcgcgtggtgcgtggcctaatggccgccatgggcaacacggaccacagcaacagccagcggctggccagcctcacgctggaggtgcgcgcggcggctggttagggggcgggaagggcggcggcacccgcagccccgtcgcccccgcagtcacgccgcctcgcccgcgcggcgcagtgcttcgtgcagatgttccccttggtggcggagcacgtgcgcaagtgcatgggggaggaactctaccagctcttcctggtaagtgcgcccttcctgccccgccgcaatgagcagatggcggctcggacagtgtgatgccccttcagacagtccccatcctggagcgcgccacatgcagagtggacctggccaccagctgcaggagggactgctctggcgtaggctcctccacccgccaccttcctgttccctttcctgccctttcggtcaggctgccgacccgccccccacctgcaacatccctctgccaagcccaactccaagtccagactgccctggcaccccagccgggtcccccttgctcctgtcctcagagcaacgctgaggacttgtacatgaaaatagacagcattcaggcggacatcttggcggccaacacagtcaatgttaccaaagccctgtgcctccatggcagctcctacagcatgaacactctctatggctcgcgcgattcggctcagatggcctacctcacacacttcgaggaggatgtagaatcaaaggagtaacagcccctgtggcaaaccaggaaggccaaggctgcggggcagggaagcctggcaagaggaaggcgcctggggtcaagctcagagccactccacttggctccaggggggagacggggattaggcatcccagaggggcagaggaagagccgctggctgcgaagagtcaataaacagccttgatacctg

SEQ ID NO: 330138 - DNA, 1520 bp, Homo sapiens
atcttgtcttcccgtaaagacccagcccttccctcctccatgaaacctggattcctccaaggcgaaggcccccctctctggggtctcagcctccagcgctgacatcctaggccgcctcgacagccatcgagttgatcaaagacctggtcggttacgatgtgcgccaggcgctgctcaagggcctcgtggcgctgctgataccgtcggtcaaggagatctccaaactgcaggccaagatcctcagtggtaaggacctgctcaaatggggctgcctgggccacgggagggcggtctcttgcctcacggctgccccctcctcagacacccctcggttctccagctcacccccagcctgccgatgtttttgcagcaggccgcggccgccaaggccatcgggtaagcgggcaggggttagtgggtagctgcagcaagcctggcttggcgctgccggcgggccccgggagcgctccgtgcgccgggtgggcgggggtgtgcgccgggtgagccccagggcgtcgccccagcccgaacccccggcccagggtcctggcgcgcaacgacatgagcatcgccgaggagctgctgtacctgcgcgtggtgcgtggcctaatggccgccatgggcaacacggaccacagcaacagccagcggctggccagcctcacgctggaggtgcgcgcggcggctggttagggggcgggaagggcggcggcacccgcagccccgtcgcccccgcagtcacgccgcctcgcccgcgcggcgcagtgcttcgtgcagatgttccccttggtggcggagcacgtgcgcaagtgcatgggggaggaactctaccagctcttcctggtaagtgcgcccttcctgccccgccgcaatgagcagatggcggctcggacagtgtgatgccccttcagacagtccccatcctggagcgcgccacatgcagagtggacctggccaccagctgcaggagggactgctctggcgtaggctcctccacccgccaccttcctgttccctttcctgccctttcggtcaggctgccgacccgccccccacctgcaacatccctctgccaagcccaactccaagtccagactgccctggcaccccagccgggtcccccttgctcctgtcctcagagcaacgctgaggacttgtacatgaaaatagacagcattcaggcggacatcttggcggccaacacagtcaatgttaccaaagccctgtgcctccatggcagctcctacagcatgaacactctctatggctcgcgcgattcggctcagatggcctacctcacacacttcgaggaggatgtagaatcaaaggagtaacagcccctgtggcaaaccaggaaggccaaggctgcggggcagggaagcctggcaagaggaaggcgcctggggtcaagctcagagccactccacttggctccaggggggagacggggattaggcatcccagaggggcagaggaagagccgctggctgcgaagagtcaataaacagccttgatacctg

SEQ ID NO: 330139 - DNA, 350 bp, Homo sapiens
tcatatagcaataaaaaaatgcatgttttatttgtaaattgtgcagagccattttaaactttaaaacagattttgacatgcctatgctgaaataaaatcctccagccacataactctaaggtaaacaagacagtgatgcaacatgagaaccaggcctcaattttgctttggttgaacaggcttggttgaagagcttttaatcctattcatattatataatcttgagtggggattttttcataaatcccttccaatttagcatttcctctcttctttgctcaggtgtacgatccatagcagaatttttggcaaagtctaagtcagaagagacccaggaggaagtgcaggtt

SEQ ID NO: 330140 - DNA, 450 bp, Homo sapiens
gtccgcagtcattcacctggttcttaaggccagctagatttcgtggttatctccatcctggaggctgcgtggacgcccttctggaagcacgcatcccatgtcctctggggagtagtagaggttggtgtgtatgtatgtctgtctccgcatgcctcagattattgcttcctaataaaattctgatagctgggccccatcaatatctcaaatacatgtgaggaaatgttaatttagaatcaattttaggatgtttcagactgtaaagtccttttaactagatctctggcgaagatgtagaagcactttatgggactgtaaatttcatgttgaacagtcttcgtgaaatacacatctctcctacacacaagctgttctctccatatcaatcatggcccctgcaagtaatgtttcacaaatattctgtaaatcacagaaaactccatgataatg

SEQ ID NO: 330141 - DNA, 2637 bp, Homo sapiens
aggaagagtccccaccctctcatgtaggtgagaggcggctgaagagttgctgtattctgggaatgggcagggtcactcgtccgaacagagtcctatcctacgcggcggaagagtgtgccctttgacttgcatcgtctacctacctctgccatcctctaccagccgcaactgcgagggctggagtgacataaccccgctgaagaaatataaaaaagcattcagtcacaaaagttcatggaaggaggcaacaggagatgaaagaattcaacaaatatttggaaggcagaaggcaggtgcagggaggctaaccggcttgaagcagaggaaattgcaagcaactgccaacaaggggagcttaccaacaagaaaccagtcaattcagccagtttgacctctaagaggcttaatgcttgaaagcacaaattaccactgaaggtcagaaatgaggttggtccgcagtcattcacctggttcttaaggccagctagatttcgtggttatctccatcctggaggctgcgtggacgcccttctggaagcacgcatcccatgtcctctggggagtagtagagccaacttcaggactgattgatcatgacttctataaaggagcaggcagcaattagcaggctcttaagttttttacaggagtgggacaacgctggcaaagtcgcaaggagtcacatcctcgacaagttcattgaaaccaaccaaggcaagactgcccctgaactggagcaggagttttcccagggagccagtttgttcctggtacgcttgaccacctcgcttagaatcacctatatgactgactcatgtttagaaaagcttctcaggtccattggcatcttcttatcagctgtaagcagtaatcggtaccttatagaatttcttgaggttggaggtgtcctaaccctcttggaaatacttgggctagagaagatcaaggaggaggccaagaaggaatctgtcaaactacttcaggttattgcgaactctggcaggacatacaaggaactcatttgtgaaagctatggtgtacgatccatagcagaatttttggcaaagtctaagtcagaagagacccaggaggaagtgcaggttctgttggattctttggtccacggcaatcccaagtaccaaaatcaagtgtataaaggtctaatagctttgctgccctgcgagtccccaaaagcccagcagctgtccctgcagactctcaggactgcccagccaatcattgggaccacacaccccagcatcgtggactgcgtgctgaaggtgctgggcacgatgcacctggaagtccagtatgaagccatcgagttgatcaaagacctggtcggttacgatgtgcgccaggcgctgctcaagggcctcgtggcgctgctgataccgtcggtcaaggagatctccaaactgcaggccaagatcctcagtgacccctcggttctccagctcacccccagcctgccgatgtttttgcagcaggccgcggccgccaaggccatcgggtaagcgggcaggggttagtgggtagctgcagcaagcctggcttggcgctgccggcgggccccgggagcgctccgtgcgccgggtgggcgggggtgtgcgccgggtgagccccagggcgtcgccccagcccgaacccccggcccagggtcctggcgcgcaacgacatgagcatcgccgaggagctgctgtacctgcgcgtggtgcgtggcctaatggccgccatgggcaacacggaccacagcaacagccagcggctggccagcctcacgctggaggtgcgcgcggcggctggttagggggcgggaagggcggcggcacccgcagccccgtcgcccccgcagtcacgccgcctcgcccgcgcggcgcagtgcttcgtgcagatgttccccttggtggcggagcacgtgcgcaagtgcatgggggaggaactctaccagctcttcctggtaagtgcgcccttcctgccccgccgcaatgagcagatggcggctcggacagtgtgatgccccttcagacagtccccatcctggagcgcgccacatgcagagtggacctggccaccagctgcaggagggactgctctggcgtaggctcctccacccgccaccttcctgttccctttcctgccctttcggtcaggctgccgacccgccccccacctgcaacatccctctgccaagcccaactccaagtccagactgccctggcaccccagccgggtcccccttgctcctgtcctcagagcaacgctgaggacttgtacatgaaaatagacagcattcaggcggacatcttggcggccaacacagtcaatgttaccaaagccctgtgcctccatggcagctcctacagcatgaacactctctatggctcgcgcgattcggctcagatggcctacctcacacacttcgaggaggatgtagaatcaaaggagtaacagcccctgtggcaaaccaggaaggccaaggctgcggggcagggaagcctggcaagaggaaggcgcctggggtcaagctcagagccactccacttggctccaggggggagacggggattaggcatcccagaggggcagaggaagagccgctggctgcgaagagtcaataaacagccttgatacctg

SEQ ID NO: 330142 - DNA, 2365 bp, Homo sapiens
aggaagagtccccaccctctcatgtaggtgagaggcggctgaagagttgctgtattctgggaatgggcagggtcactcgtccgaacagagtcctatcctacgcggcggaagagtgtgccctttgacttgcatcgtctacctacctctgccatcctctaccagccgcaactgcgagggctggaggctagagtgcagtggcgcgatctcggctcactgcaacccgcctcccgggttcaagggatttctcctgcctcagcctcccaagagctgggattacaggtgcctgccaccacgcccagccaacttcaggactgattgatcatgacttctataaaggagcaggcagcaattagcaggctcttaagttttttacaggagtgggacaacgctggcaaagtcgcaaggagtcacatcctcgacaagttcattgaaaccaaccaaggcaagactgcccctgaactggagcaggagttttcccagggagccagtttgttcctggtacgcttgaccacctcgcttagaatcacctatatgactgactcatgtttagaaaagcttctcaggtccattggcatcttcttatcagctgtaagcagtaatcggtaccttatagaatttcttgaggttggaggtgtcctaaccctcttggaaatacttgggctagagaagatcaaggaggaggccaagaaggaatctgtcaaactacttcaggttattgcgaactctggcaggacatacaaggaactcatttgtgaaagctatggtgtacgatccatagcagaatttttggcaaagtctaagtcagaagagacccaggaggaagtgcaggttctgttggattctttggtccacggcaatcccaagtaccaaaatcaagtgtataaaggtctaatagctttgctgccctgcgagtccccaaaagcccagcagctgtccctgcagactctcaggactgcccagccaatcattgggaccacacaccccagcatcgtggactgcgtgctgaaggtgctgggcacgatgcacctggaagtccagtatgaagccatcgagttgatcaaagacctggtcggttacgatgtgcgccaggcgctgctcaagggcctcgtggcgctgctgataccgtcggtcaaggagatctccaaactgcaggccaagatcctcagtgacccctcggttctccagctcacccccagcctgccgatgtttttgcagcaggccgcggccgccaaggccatcgggtaagcgggcaggggttagtgggtagctgcagcaagcctggcttggcgctgccggcgggccccgggagcgctccgtgcgccgggtgggcgggggtgtgcgccgggtgagccccagggcgtcgccccagcccgaacccccggcccagggtcctggcgcgcaacgacatgagcatcgccgaggagctgctgtacctgcgcgtggtgcgtggcctaatggccgccatgggcaacacggaccacagcaacagccagcggctggccagcctcacgctggaggtgcgcgcggcggctggttagggggcgggaagggcggcggcacccgcagccccgtcgcccccgcagtcacgccgcctcgcccgcgcggcgcagtgcttcgtgcagatgttccccttggtggcggagcacgtgcgcaagtgcatgggggaggaactctaccagctcttcctggtaagtgcgcccttcctgccccgccgcaatgagcagatggcggctcggacagtgtgatgccccttcagacagtccccatcctggagcgcgccacatgcagagtggacctggccaccagctgcaggagggactgctctggcgtaggctcctccacccgccaccttcctgttccctttcctgccctttcggtcaggctgccgacccgccccccacctgcaacatccctctgccaagcccaactccaagtccagactgccctggcaccccagccgggtcccccttgctcctgtcctcagagcaacgctgaggacttgtacatgaaaatagacagcattcaggcggacatcttggcggccaacacagtcaatgttaccaaagccctgtgcctccatggcagctcctacagcatgaacactctctatggctcgcgcgattcggctcagatggcctacctcacacacttcgaggaggatgtagaatcaaaggagtaacagcccctgtggcaaaccaggaaggccaaggctgcggggcagggaagcctggcaagaggaaggcgcctggggtcaagctcagagccactccacttggctccaggggggagacggggattaggcatcccagaggggcagaggaagagccgctggctgcgaagagtcaataaacagccttgatacctg

SEQ ID NO: 330143 - DNA, 2552 bp, Homo sapiens
aggaagagtccccaccctctcatgtaggtgagaggcggctgaagagttgctgtattctgggaatgggcagggtcactcgtccgaacagagtcctatcctacgcggcggaagagtgtgccctttgacttgcatcgtctacctacctctgccatcctctaccagccgcaactgcgagggctggagtgacataaccccgctgaagaaatataaaaaagcattcagtcacaaaagttcatggaaggaggcaacaggagatgaaagaattcaacaaatatttggaaggcagaaggcaggtgcagggaggctaaccggcttgaagcagaggaaattgcaagcaactgccaacaaggggagcttaccaacaagaaaccagtcaattcagccagtttgacctctaagaggcttaatgcttgaaagcacaaattaccactgaaggtcagaaatgaggttggtccgcagtcattcacctggttcttaaggccagctagatttcgtggttatctccatcctggaggctgcgtggacgcccttctggaagcacgcatcccatgtcctctggggagtagtagagccaacttcaggactgattgatcatgacttctataaaggagcaggcagcaattagcaggctcttaagttttttacaggagtgggacaacgctggcaaagtcgcaaggagtcacatcctcgacaagttcattgaaaccaaccaaggcaagactgcccctgaactggagcaggagttttcccagggagccagtttgttcctggtacgcttgaccacctcgcttagaatcacctatatgactgactcatgtttagaaaagcttctcaggtccattggcatcttcttatcagctgtaagcagtaatcggtaccttatagaatttcttgaggttggaggtgtcctaaccctcttggaaatacttgggctagagaagatcaaggaggaggccaagaaggaatctgtcaaactacttcaggttattgcgaactctggcaggacatacaaggaactcatttgtgaaagctatggtgtacgatccatagcagaatttttggcaaagtctaagtcagaagagacccaggaggaagtgcaggttctgttggattctttggtccacggcaatcccaagtaccaaaatcaagtgtataaaggtctaatagctttgctgccctgcgagtccccaaaagcccagcagctgtccctgcagactctcaggactgcccagccatcgagttgatcaaagacctggtcggttacgatgtgcgccaggcgctgctcaagggcctcgtggcgctgctgataccgtcggtcaaggagatctccaaactgcaggccaagatcctcagtgacccctcggttctccagctcacccccagcctgccgatgtttttgcagcaggccgcggccgccaaggccatcgggtaagcgggcaggggttagtgggtagctgcagcaagcctggcttggcgctgccggcgggccccgggagcgctccgtgcgccgggtgggcgggggtgtgcgccgggtgagccccagggcgtcgccccagcccgaacccccggcccagggtcctggcgcgcaacgacatgagcatcgccgaggagctgctgtacctgcgcgtggtgcgtggcctaatggccgccatgggcaacacggaccacagcaacagccagcggctggccagcctcacgctggaggtgcgcgcggcggctggttagggggcgggaagggcggcggcacccgcagccccgtcgcccccgcagtcacgccgcctcgcccgcgcggcgcagtgcttcgtgcagatgttccccttggtggcggagcacgtgcgcaagtgcatgggggaggaactctaccagctcttcctggtaagtgcgcccttcctgccccgccgcaatgagcagatggcggctcggacagtgtgatgccccttcagacagtccccatcctggagcgcgccacatgcagagtggacctggccaccagctgcaggagggactgctctggcgtaggctcctccacccgccaccttcctgttccctttcctgccctttcggtcaggctgccgacccgccccccacctgcaacatccctctgccaagcccaactccaagtccagactgccctggcaccccagccgggtcccccttgctcctgtcctcagagcaacgctgaggacttgtacatgaaaatagacagcattcaggcggacatcttggcggccaacacagtcaatgttaccaaagccctgtgcctccatggcagctcctacagcatgaacactctctatggctcgcgcgattcggctcagatggcctacctcacacacttcgaggaggatgtagaatcaaaggagtaacagcccctgtggcaaaccaggaaggccaaggctgcggggcagggaagcctggcaagaggaaggcgcctggggtcaagctcagagccactccacttggctccaggggggagacggggattaggcatcccagaggggcagaggaagagccgctggctgcgaagagtcaataaacagccttgatacctg

SEQ ID NO: 330144 - DNA, 1785 bp, Homo sapiens
aggaagagtccccaccctctcatgtaggtgagaggcggctgaagagttgctgtattctgggaatgggcagggtcactcgtccgaacagagtcctatcctacgcggcggaagagtgtgccctttgacttgcatcgtctacctacctctgccatcctctaccagccgcaactgcgagggctggaggtgtacgatccatagcagaatttttggcaaagtctaagtcagaagagacccaggaggaagtgcaggttctgttggattctttggtccacggcaatcccaagtaccaaaatcaagtgtataaaggtctaatagctttgctgccctgcgagtccccaaaagcccagcagctgtccctgcagactctcaggactgcccagccaatcattgggaccacacaccccagcatcgtggactgcgtgctgaaggtgctgggcacgatgcacctggaagtccagtatgaagccatcgagttgatcaaagacctggtcggttacgatgtgcgccaggcgctgctcaagggcctcgtggcgctgctgataccgtcggtcaaggagatctccaaactgcaggccaagatcctcagtgacccctcggttctccagctcacccccagcctgccgatgtttttgcagcaggccgcggccgccaaggccatcgggtaagcgggcaggggttagtgggtagctgcagcaagcctggcttggcgctgccggcgggccccgggagcgctccgtgcgccgggtgggcgggggtgtgcgccgggtgagccccagggcgtcgccccagcccgaacccccggcccagggtcctggcgcgcaacgacatgagcatcgccgaggagctgctgtacctgcgcgtggtgcgtggcctaatggccgccatgggcaacacggaccacagcaacagccagcggctggccagcctcacgctggaggtgcgcgcggcggctggttagggggcgggaagggcggcggcacccgcagccccgtcgcccccgcagtcacgccgcctcgcccgcgcggcgcagtgcttcgtgcagatgttccccttggtggcggagcacgtgcgcaagtgcatgggggaggaactctaccagctcttcctggtaagtgcgcccttcctgccccgccgcaatgagcagatggcggctcggacagtgtgatgccccttcagacagtccccatcctggagcgcgccacatgcagagtggacctggccaccagctgcaggagggactgctctggcgtaggctcctccacccgccaccttcctgttccctttcctgccctttcggtcaggctgccgacccgccccccacctgcaacatccctctgccaagcccaactccaagtccagactgccctggcaccccagccgggtcccccttgctcctgtcctcagagcaacgctgaggacttgtacatgaaaatagacagcattcaggcggacatcttggcggccaacacagtcaatgttaccaaagccctgtgcctccatggcagctcctacagcatgaacactctctatggctcgcgcgattcggctcagatggcctacctcacacacttcgaggaggatgtagaatcaaaggagtaacagcccctgtggcaaaccaggaaggccaaggctgcggggcagggaagcctggcaagaggaaggcgcctggggtcaagctcagagccactccacttggctccaggggggagacggggattaggcatcccagaggggcagaggaagagccgctggctgcgaagagtcaataaacagccttgatacctg

SEQ ID NO: 330145 - DNA, 1657 bp, Homo sapiens
atcttgtcttcccgtaaagacccagcccttccctcctccatgaaacctggattcctccaaggcgaaggcccccctctctggggtctcagcctccagcgctgacatcctaggccgcctcgacaggtgggctcaccatcaacccttcctcctcccccttcagccccctcctcctgctcttcaactgaggttcgccttcccagctcccccacgccctgcacagtgctgatcagtaaaagaggaggacactgacgagtggcgacttggttcacggggttctttgcttcctcggtggcggaggggcctggggcctctctccagcacctctgcccttccgcagccatcgagttgatcaaagacctggtcggttacgatgtgcgccaggcgctgctcaagggcctcgtggcgctgctgataccgtcggtcaaggagatctccaaactgcaggccaagatcctcagtgacccctcggttctccagctcacccccagcctgccgatgtttttgcagcaggccgcggccgccaaggccatcgggtaagcgggcaggggttagtgggtagctgcagcaagcctggcttggcgctgccggcgggccccgggagcgctccgtgcgccgggtgggcgggggtgtgcgccgggtgagccccagggcgtcgccccagcccgaacccccggcccagggtcctggcgcgcaacgacatgagcatcgccgaggagctgctgtacctgcgcgtggtgcgtggcctaatggccgccatgggcaacacggaccacagcaacagccagcggctggccagcctcacgctggaggtgcgcgcggcggctggttagggggcgggaagggcggcggcacccgcagccccgtcgcccccgcagtcacgccgcctcgcccgcgcggcgcagtgcttcgtgcagatgttccccttggtggcggagcacgtgcgcaagtgcatgggggaggaactctaccagctcttcctggtaagtgcgcccttcctgccccgccgcaatgagcagatggcggctcggacagtgtgatgccccttcagacagtccccatcctggagcgcgccacatgcagagtggacctggccaccagctgcaggagggactgctctggcgtaggctcctccacccgccaccttcctgttccctttcctgccctttcggtcaggctgccgacccgccccccacctgcaacatccctctgccaagcccaactccaagtccagactgccctggcaccccagccgggtcccccttgctcctgtcctcagagcaacgctgaggacttgtacatgaaaatagacagcattcaggcggacatcttggcggccaacacagtcaatgttaccaaagccctgtgcctccatggcagctcctacagcatgaacactctctatggctcgcgcgattcggctcagatggcctacctcacacacttcgaggaggatgtagaatcaaaggagtaacagcccctgtggcaaaccaggaaggccaaggctgcggggcagggaagcctggcaagaggaaggcgcctggggtcaagctcagagccactccacttggctccaggggggagacggggattaggcatcccagaggggcagaggaagagccgctggctgcgaagagtcaataaacagccttgatacctg

SEQ ID NO: 330146 - DNA, 1443 bp, Homo sapiens
atcttgtcttcccgtaaagacccagcccttccctcctccatgaaacctggattcctccaaggcgaaggcccccctctctggggtctcagcctccagcgctgacatcctaggccgcctcgacagccatcgagttgatcaaagacctggtcggttacgatgtgcgccaggcgctgctcaagggcctcgtggcgctgctgataccgtcggtcaaggagatctccaaactgcaggccaagatcctcagtgacccctcggttctccagctcacccccagcctgccgatgtttttgcagcaggccgcggccgccaaggccatcgggtaagcgggcaggggttagtgggtagctgcagcaagcctggcttggcgctgccggcgggccccgggagcgctccgtgcgccgggtgggcgggggtgtgcgccgggtgagccccagggcgtcgccccagcccgaacccccggcccagggtcctggcgcgcaacgacatgagcatcgccgaggagctgctgtacctgcgcgtggtgcgtggcctaatggccgccatgggcaacacggaccacagcaacagccagcggctggccagcctcacgctggaggtgcgcgcggcggctggttagggggcgggaagggcggcggcacccgcagccccgtcgcccccgcagtcacgccgcctcgcccgcgcggcgcagtgcttcgtgcagatgttccccttggtggcggagcacgtgcgcaagtgcatgggggaggaactctaccagctcttcctggtaagtgcgcccttcctgccccgccgcaatgagcagatggcggctcggacagtgtgatgccccttcagacagtccccatcctggagcgcgccacatgcagagtggacctggccaccagctgcaggagggactgctctggcgtaggctcctccacccgccaccttcctgttccctttcctgccctttcggtcaggctgccgacccgccccccacctgcaacatccctctgccaagcccaactccaagtccagactgccctggcaccccagccgggtcccccttgctcctgtcctcagagcaacgctgaggacttgtacatgaaaatagacagcattcaggcggacatcttggcggccaacacagtcaatgttaccaaagccctgtgcctccatggcagctcctacagcatgaacactctctatggctcgcgcgattcggctcagatggcctacctcacacacttcgaggaggatgtagaatcaaaggagtaacagcccctgtggcaaaccaggaaggccaaggctgcggggcagggaagcctggcaagaggaaggcgcctggggtcaagctcagagccactccacttggctccaggggggagacggggattaggcatcccagaggggcagaggaagagccgctggctgcgaagagtcaataaacagccttgatacctg

SEQ ID NO: 330147 - DNA, 1860 bp, Homo sapiens
aggaagagtccccaccctctcatgtaggtgagaggcggctgaagagttgctgtattctgggaatgggcagggtcactcgtccgaacagagtcctatcctacgcggcggaagagtgtgccctttgacttgcatcgtctacctacctctgccatcctctaccagccgcaactgcgagggctggagccaacttcaggactgattgatcatgacttctataaaggagcaggcagcaattagcaggctcttaagttttttacaggagtgggacaacgctggcaaagtcgcaaggagtcacatcctcgacaagttcattgaaaccaaccaaggcaagactgcccctgaactggagcaggagttttcccagggagccagtttgttcctggtacgcttgaccacctcgcttagaatcacctatatgactgactcatgtttagaaaagcttctcaggtccattggcatcttcttatcagctgtaagcagtaatcggtaccttatagaatttcttgaggttggaggtgtcctaaccctcttggaaatacttgggctagagaagatcaaggaggaggccaagaaggaatctgtcaaactacttcaggttattgcgaactctggcaggacatacaaggaactcatttgtgaaagctatggtgtacgatccatagcagaatttttggcaaagtctaagtcagaagagacccaggaggaagtgcaggttctgttggattctttggtccacggcaatcccaagtaccaaaatcaagtgtataaaggtctaatagctttgctgccctgcgagtccccaaaagcccagcagctgtccctgcagactctcaggactgcccagccaatcattgggaccacacaccccagcatcgtggactgcgtgctgaaggtgctgggcacgatgcacctggaagtccagtatgaagccatcgagttgatcaaagacctggtcggttacgatgtgcgccaggcgctgctcaagggcctcgtggcgctgctgataccgtcggtcaaggagatctccaaactgcaggccaagatcctcagtgacccctcggttctccagctcacccccagcctgccgatgtttttgcagcaggccgcggccgccaaggccatcgggtaagcgggcaggggttagtgggtagctgcagcaagcctggcttggcgctgccggcgggccccgggagcgctccgtgcgccgggtgggcgggggtgtgcgccgggtgagccccagggcgtcgccccagcccgaacccccggcccagggtcctggcgcgcaacgacatgagcatcgccgaggagctgctgtacctgcgcgtggtgcgtggcctaatggccgccatgggcaacacggaccacagcaacagccagcggctggccagcctcacgctggagtgcttcgtgcagatgttccccttggtggcggagcacgtgcgcaagtgcatgggggaggaactctaccagctcttcctgagcaacgctgaggacttgtacatgaaaatagacagcattcaggcggacatcttggcggccaacacagtcaatgttaccaaagccctgtgcctccatggcagctcctacagcatgaacactctctatggctcgcgcgattcggctcagatggcctacctcacacacttcgaggaggatgtagaatcaaaggagtaacagcccctgtggcaaaccaggaaggccaaggctgcggggcagggaagcctggcaagaggaaggcgcctggggtcaagctcagagccactccacttggctccaggggggagacggggattaggcatcccagaggggcagaggaagagccgctggctgcgaagagtcaataaacagccttgatacctg

SEQ ID NO: 330148 - DNA, 363 bp, Homo sapiens
ttttttttagatggaatctcaccctgttgcccaggctggagtgtaatggcatgatctcggctcactgcaacctctgtctcccgggcctcagcctcccaagtagctggaaccacaggcatccaccactacgcccggctaattttttgtatttttagtagagacggggtttcaccttggccaggctgttctcgaactcctgatctcaagtgattcgccccacttcagcttcccaaagctaggattacaggcatgagccaccacgcctggcctgaagtttcttaagattccccatcttataagaaaaagacaaaccttgttggtaatgttaataccaataagtacaaattgcacgctccatatctc

SEQ ID NO: 330149 - DNA, 376 bp, Homo sapiens
ttccccctccgccggaacccgcgtctgcctccccggaacccacttccccgtcccccggaacatgcgtctgcctccccggaacccgcttccgtctccccggaacccacttccgcctccccaagacccgcttctgcctccccgggacccacttccgcctccccaagacccgcttccgcctccccaagacccgcttccgcctccccggaacctacttccgcctccccaagaccctcttctgcctccccgggaccggcttccgcctccccaggacccgcttccgcctccccgggacccacttccgcctcccccgggtctgtgcggatgccaggcctggttgggtctgttttccctggtggcatcgggccgccctcgccgt

SEQ ID NO: 330150 - DNA, 450 bp, Homo sapiens
cctcctctagctgggacaacaggtgttcacccttcctggctaagttttttgatttttagtagagatggagaatttcccaggatggtctcaaacttctaagcttaagcaatcctcctgcctcagcctcccaaggtgctgggattacaggcatgagccactatgcccggccactgtataactttgattctccaaaaatttaactactaatagtctactgttgaccagaagccttaccaataaaataagttgattaacacatttttaaaatatgtattattactgtgttcttacaatcaagtaagctagagaaaggaaaatgttatgatgaaaatcataaaaaaaaaaaaaagcccggcatggtggtgtgtgcccgtagtcttctgttactcaggaggctgaggtgagaggattgcttgagtccagaaattcaggctgtagtgagctatgatc

SEQ ID NO: 330151 - DNA, 389 bp, Homo sapiens
cctcctctagctgggacaacaggtgttcacccttcctggctaagttttttgatttttagtagagatggagaatttcccaggatggtctcaaacttctaagcttaagcaatcctcctacccaacacaaccaaacaaccactctacctacacacaacaccaatcaacacactcacaaacacacacaccacccacacccccccaacaccacaccatctacccactctcacaacacaaccccacccacacaaaccacccaacaccactaccacctcctacaaccacatacaaaccactccactcacacatcatcgcacttcttaacctgtgtctcttactaatcacagtacagctcagagcaaacggaaaatccttatgatgaaaatcataaa

SEQ ID NO: 330152 - DNA, 2783 bp, Homo sapiens
  misc_feature (1941)..(1941): n is a, c, g, or t
gcacgagggatgctgccagcgtgcgtgtccctacggaagctgagactgcacttcctgcgaggcccctgcagcagcagcggcgtggtcagagcgagcttcggagaagcagtggtgggttccatgtgatggtggagtaggaggcaggtctccgcggttcatctgtgttgctctaaatgacactgtttcattattttgatggctggagaatatttcctagtgtatgtatatgagagtttcttgatctctttatctgtggatgaacagctactttgaaacatatgatacatttgtgttaaggctagtcaccctgctgtggaatagaaggccagaattgatcagtctcatctgagagtaactttgtacccatcactgattccttctgagactgcctccacttccccagcagcctctggtttcttcatgtggctgcagatggcaggatttcccaaaggtttctggctgaaacatattccgtggtgtatctgtacagcagtttcctcatccctgcagctgtgtttgaacaggtcatttaccatgctgtcctccaggttcaacagtatggctccaaaggatgaaatttcattctgattttctggctgaagactattctctttgtgtatgtccaccacagttactttatcccttcatctgtggatgggcagtctcgctgtattgcccaggctggagtgcagtggcatgatctcagctcactgcaagctctgcttcctgggttcacgccattctcctgcctcagcctcctgagtagctgggattacaggcacccgccaccacgcccaggaaagaaaaaagaagaaaacaaacctccatacgagaatgggtctaaaggaacttcccaaacctccatgattttgcaggaaacaagataaaggtggtttccacaagaaaaatggcacaatgtttctcagaagacaattacataagaatcagcatacttcaaattcacagcaaataatcagacaattgatgaaaatacttacccaaacactaattgtagactatgccttctgaatatgtttgtcataaacttggagtaaggaatcctcacaggcactggacaattcaaaaaacgtaaagttgtttgttagaatactggtgcttttgggtagaaaccctcatccatatcctggtaaggcttgaagttgcacaggagttttcatttgtcaaaacccagaaaaccataagctttagatttgtgaattttatattgtattatatgtgacctttctttttaaaaaatgagctgtaagcagtctcccagacagtagctcagcctccagaactctctttctgcatagttgaagacccctcttcacacaagatggtagcaacaaatcataggtgcaattgcaccaaattcacagaagatcaattgaaaatcctcatcaataccttcactcaaaaaccttacccaggttatgctaccaaacaaaaacttgctttagcaatcaatgcagaagagtccagaatccaaatttggtttcagaatcaaagacctaggcatggattccagaaaacaccagaacctgactttagatttaagccacagccatggacaagattaacctggtgtggagtttcaaaatagagaagccagatggtgttgtaccacctatagcacctttcaattacacacagtcatccatgcatttatgaaaaacccataccctgggattgattccagagaacaacttgctgaagaaattggtgcttcagagtcaagagtccaaatttggttccaaaatcgaagatctagatttcatctccagagaaaaagagaacctgttatgtccttagaatgagaagaccagagaagaccaggggcaaggtttctgagggacttcaaggtacagaagatacacaaagtggcaccagcctcactagcactctcatttctcaagagccagaacatggtgaatacantcaagttcagtgtatttgataatatcaatttgggccccaaatctctctcacagtcttcctgggagtctattcttcttccaaaagtgcaagctaagccttctgaagatggtaaagaacttggccgggtgtggtggctcatgcctgtaatcccagcactttaggaggctgaggctggaagattgcttgagcctaggagtttgaaaccagtctgagcaacatagtaagaccctgtctctattctaaaaaacaaaataagtaaaaaggactgtaggaggccaagacaggtacaggaggcaccacactaccctgttgacacagcctggatccagagttcagcagaccttgagacaatgaaaacaaacttagtaataatcatttttcaatcattgcagtaattattgatttggacaaaaatcaattgacgtcaaaaccttaaagtgacgtttctctgcctatggagtggtcattcttttattcctttagtttcataataaattttcttttacttaaaaaaacttatagtttgatgaagagtgagatatatacctcatctcaaagaatcttcacacacacacttattaattacaacaaggaaaatcagtaattttgcagtggcagacatatggccaactccaaccttacccaagtggctgaaagtcactgcaccagtaatggcacaaaccaatgtgagatgattcctgatatgatacactaacaaagggcactgtctcttctgcatgttgcagacaaaaagtgggtaagctgaaactgaaactaataattaggcaatgtcaagcaaatacaaattcaggttgacagtctgcgaagtaacatccatgtac

SEQ ID NO: 330153 - DNA, 1485 bp, Homo sapiens
gttagagtggggcattttggttaatgcagacacagaggaatgttaaaatcaggatatttagagtctctgttatcacaaacagttgttaatttatttgtggtgaaaacatttggaatcttcttttccagattttgtgaaaaagctgtgatgttttgttaacctctggtcacagtgctgtggaacagagaggaacgattcattcctctcatctaagtgtaattttgtacctatttctgatccctgcccatgcccctgcttccttccaatctctggaaaccactgttgtgctctctagatctattgcaataaagccttttattttgggttctacatgagtgagatgtggcaatgtttttctttctctacctggttcaggtcatttaccatgctgtcctccaggttcaacagtatggctccaaaggatgaaatttcattctgattttctggctgaagactattctctttgtgtatgtccaccacagttactttatcccttcatctgtggatgggcaggaaactccaaactgtccaaggagatagttctgttgtgattacttcattgagaaatttaacttatgagcagttgaaaggaatgcaagttgctgcaaaatcagaatgaagagtgcaaaacgaccaagctacaatgttttgtcattattcactctgatgtgaaaaaggcagtgaatttaatagaaaataacttcgtagagtaaaatctcaggtgtgtttttttagtgccgcagtcttggatgatgggttcctagaagctctcaacatctcttcttaattggagaaagtgttaagccccacagtagctggagcagtacatcttcaatttttgacaagaaagcaggaacttgattactttgagtgctattcattagtttctgctttcattgagaatgcaacaaaagccaactaggctgctgctaactccttgctggacttcttctgccactgtcacaggaactgtaatctcactggacaattaactagggagtctttcatcttgagtgactgctgcacaaatgatcttcaaagcattttagccaccagaggaattctcttcaaatacccaaaatccatcagtatcttgaatcatgctggattttgaagaattcttaagaagccatgtaaagggggctctctggccttgaaatagtgatgttttttatacagaaaggagaatgcagaatggtcagactatcatgcactgttaaatttgatttcaagaaattacaggaaaactttccaaagttccatctcacagaaattatttttacaaagaattccaagataagtttagttttatggaagacttttatgtggtttttactcactcttcatctcagacatcgacagatgattacatcacttatttagctagtaaatttattaatataaaaactcagagacattccaatatccacattgcttacaccattaggcatagattcagtgtcagctatgacaattgaaaataag

SEQ ID NO: 330154 - DNA, 722 bp, Homo sapiens
ttcattttaacaatcaatccacccacctcctctctactcggaactggtggcacctggttggtggagaatttgaactggagatgaactctattatccaggatgctgagagtataatacgcatgacagagcttttagagcactgtgatgtaacatgtcaagcagaaatagggagcatgtttacagccattctatgaaaaagtgtttggaatgtacagactagcacagaagttgggctaattaaacaagtattgctgaaaatgagtgctgtagatgacatgagagcaggtatggggttgattgttagggaagtataacttaaaagtttataaagtttcacatacttctctttatattctataggtaatgtagatttgttgacactactttgatttaaaataaatggaaatgtatggaaattttactttttatattaatggaaaacctgaagagtgaaagaagaaaaatatacttactatagtagacaaatataattactaatgttgttttctaaattttagaaaatctcagtaccacggagtgctatgaaatctatcagaaaaataaacagtatctttttatgtagtatttcattaagcttttacataattaaaatgccacaataggtattacagttctgtataatgagcattttatcaaattcccctagttctgtgcccctcaatctggcatatatgcaactatgacaggaggtactaaaagcc

SEQ ID NO: 330155 - DNA, 666 bp, Homo sapiens
gctgaactcaggagtccctgatgccagcctttctgatgcggtccccctcccctcccccatgtgtctcgctccatagctccaggccaggagccccaactggctggtggaggatgtcttgctcctcagcagctgggatttgtaagtatttgtaggaacatggaacagatcagtggctgacaggcccaggaagcagacagtccccttcccataggtcaccagcttcacttccccttcctgcaccccatcctgatttgagggagcccaggatgacaaagagggagtagttgagcaaggtatggagtggcagcctctacaggagctcaaaggatgcatttgtccatctgccctgggctcagcttccacactcagagtcactcacatccctccaccgtcgccacagctcacctgtgtgcccacacggccaaggtcacactgaccccaaacgcacactgtttcaactctcagcacttcactgtcacactcgcgtgtgtacacacatgctttctgttctatgagtgtgatggtgtttgagaaaatgtggggctatggttcaggcgcacttcacatgtgcaaagatggagaaagcactcacctacacgtttaggctcagaatattgattgaaacattttgaatgatcaaaaataaaatgttatttttaaagtttc

SEQ ID NO: 330156 - DNA, 2648 bp, Homo sapiens
  misc_feature (1806)..(1806): n is a, c, g, or t
gcacgagggatgctgccagcgtgcgtgtccctacggaagctgagactgcacttcctgcgaggcccctgcagcagcagcggcgtggtcagagcgagcttcggagaagcagtggtgggttccatgtgatggtggagtaggaggcaggtctccgcgctactttgaaacatatgatacatttgtgttaaggctagtcaccctgctgtggaatagaaggccagaattgatcagtctcatctgagagtaactttgtacccatcactgattccttctgagactgcctccacttccccagcagcctctggtttcttcatgtggctgcagatggcaggatttcccaaaggtttctggctgaaacatattccgtggtgtatctgtacagcagtttcctcatccctgcagctgtgtttgaacaggttcaacagtatggctccaaaggatgaaatttcattctgattttctggctgaagactattctctttgtgtatgtccaccacagttactttatcccttcatctgtggatgggcagtctcgctgtattgcccaggctggagtgcagtggcatgatctcagctcactgcaagctctgcttcctgggttcacgccattctcctgcctcagcctcctgagtagctgggattacaggcacccgccaccacgcccaggaaagaaaaaagaagaaaacaaacctccatacgagaatgggtctaaaggaacttcccaaacctccatgattttgcaggaaacaagataaaggtggtttccacaagaaaaatggcacaatgtttctcagaagacaattacataagaatcagcatacttcaaattcacagcaaataatcagacaattgatgaaaatacttacccaaacactaattgtagactatgccttctgaatatgtttgtcataaacttggagtaaggaatcctcacaggcactggacaattcaaaaaacgtaaagttgtttgttagaatactggtgcttttgggtagaaaccctcatccatatcctggtaaggcttgaagttgcacaggagttttcatttgtcaaaacccagaaaaccataagctttagatttgtgaattttatattgtattatatgtgacctttctttttaaaaaatgagctgtaagcagtctcccagacagtagctcagcctccagaactctctttctgcatagttgaagacccctcttcacacaagatggtagcaacaaatcataggtgcaattgcaccaaattcacagaagatcaattgaaaatcctcatcaataccttcactcaaaaaccttacccaggttatgctaccaaacaaaaacttgctttagcaatcaatgcagaagagtccagaatccaaatttggtttcagaatcaaagacctaggcatggattccagaaaacaccagaacctgactttagatttaagccacagccatggacaagattaacctggtgtggagtttcaaaatagagaagccagatggtgttgtaccacctatagcacctttcaattacacacagtcatccatgcatttatgaaaaacccataccctgggattgattccagagaacaacttgctgaagaaattggtgcttcagagtcaagagtccaaatttggttccaaaatcgaagatctagatttcatctccagagaaaaagagaacctgttatgtccttagaatgagaagaccagagaagaccaggggcaaggtttctgagggacttcaaggtacagaagatacacaaagtggcaccagcctcactagcactctcatttctcaagagccagaacatggtgaatacantcaagttcagtgtatttgataatatcaatttgggccccaaatctctctcacagtcttcctgggagtctattcttcttccaaaagtgcaagctaagccttctgaagatggtaaagaacttggccgggtgtggtggctcatgcctgtaatcccagcactttaggaggctgaggctggaagattgcttgagcctaggagtttgaaaccagtctgagcaacatagtaagaccctgtctctattctaaaaaacaaaataagtaaaaaggactgtaggaggccaagacaggtacaggaggcaccacactaccctgttgacacagcctggatccagagttcagcagaccttgagacaatgaaaacaaacttagtaataatcatttttcaatcattgcagtaattattgatttggacaaaaatcaattgacgtcaaaaccttaaagtgacgtttctctgcctatggagtggtcattcttttattcctttagtttcataataaattttcttttacttaaaaaaacttatagtttgatgaagagtgagatatatacctcatctcaaagaatcttcacacacacacttattaattacaacaaggaaaatcagtaattttgcagtggcagacatatggccaactccaaccttacccaagtggctgaaagtcactgcaccagtaatggcacaaaccaatgtgagatgattcctgatatgatacactaacaaagggcactgtctcttctgcatgttgcagacaaaaagtgggtaagctgaaactgaaactaataattaggcaatgtcaagcaaatacaaattcaggttgacagtctgcgaagtaacatccatgtac

SEQ ID NO: 330157 - DNA, 2274 bp, Homo sapiens
  misc_feature (1432)..(1432): n is a, c, g, or t
gcacgagggatgctgccagcgtgcgtgtccctacggaagctgagactgcacttcctgcgaggcccctgcagcagcagcggcgtggtcagagcgagcttcggagaagcagtggtgggttccatgtgatggtggagtaggaggcaggtctccgcgtctcgctgtattgcccaggctggagtgcagtggcatgatctcagctcactgcaagctctgcttcctgggttcacgccattctcctgcctcagcctcctgagtagctgggattacaggcacccgccaccacgcccaggaaagaaaaaagaagaaaacaaacctccatacgagaatgggtctaaaggaacttcccaaacctccatgattttgcaggaaacaagataaaggtggtttccacaagaaaaatggcacaatgtttctcagaagacaattacataagaatcagcatacttcaaattcacagcaaataatcagacaattgatgaaaatacttacccaaacactaattgtagactatgccttctgaatatgtttgtcataaacttggagtaaggaatcctcacaggcactggacaattcaaaaaacgtaaagttgtttgttagaatactggtgcttttgggtagaaaccctcatccatatcctggtaaggcttgaagttgcacaggagttttcatttgtcaaaacccagaaaaccataagctttagatttgtgaattttatattgtattatatgtgacctttctttttaaaaaatgagctgtaagcagtctcccagacagtagctcagcctccagaactctctttctgcatagttgaagacccctcttcacacaagatggtagcaacaaatcataggtgcaattgcaccaaattcacagaagatcaattgaaaatcctcatcaataccttcactcaaaaaccttacccaggttatgctaccaaacaaaaacttgctttagcaatcaatgcagaagagtccagaatccaaatttggtttcagaatcaaagacctaggcatggattccagaaaacaccagaacctgactttagatttaagccacagccatggacaagattaacctggtgtggagtttcaaaatagagaagccagatggtgttgtaccacctatagcacctttcaattacacacagtcatccatgcatttatgaaaaacccataccctgggattgattccagagaacaacttgctgaagaaattggtgcttcagagtcaagagtccaaatttggttccaaaatcgaagatctagatttcatctccagagaaaaagagaacctgttatgtccttagaatgagaagaccagagaagaccaggggcaaggtttctgagggacttcaaggtacagaagatacacaaagtggcaccagcctcactagcactctcatttctcaagagccagaacatggtgaatacantcaagttcagtgtatttgataatatcaatttgggccccaaatctctctcacagtcttcctgggagtctattcttcttccaaaagtgcaagctaagccttctgaagatggtaaagaacttggccgggtgtggtggctcatgcctgtaatcccagcactttaggaggctgaggctggaagattgcttgagcctaggagtttgaaaccagtctgagcaacatagtaagaccctgtctctattctaaaaaacaaaataagtaaaaaggactgtaggaggccaagacaggtacaggaggcaccacactaccctgttgacacagcctggatccagagttcagcagaccttgagacaatgaaaacaaacttagtaataatcatttttcaatcattgcagtaattattgatttggacaaaaatcaattgacgtcaaaaccttaaagtgacgtttctctgcctatggagtggtcattcttttattcctttagtttcataataaattttcttttacttaaaaaaacttatagtttgatgaagagtgagatatatacctcatctcaaagaatcttcacacacacacttattaattacaacaaggaaaatcagtaattttgcagtggcagacatatggccaactccaaccttacccaagtggctgaaagtcactgcaccagtaatggcacaaaccaatgtgagatgattcctgatatgatacactaacaaagggcactgtctcttctgcatgttgcagacaaaaagtgggtaagctgaaactgaaactaataattaggcaatgtcaagcaaatacaaattcaggttgacagtctgcgaagtaacatccatgtac

SEQ ID NO: 330158 - DNA, 2750 bp, Homo sapiens
  misc_feature (1908)..(1908): n is a, c, g, or t
gcacgagggatgctgccagcgtgcgtgtccctacggaagctgagactgcacttcctgcgaggcccctgcagcagcagcggcgtggtcagagcgagcttcggagaagcagtggtgggttccatgtgatggtggagtaggaggcaggtctccgcggttcatctgtgttgctctaaatgacactgtttcattattttgatggctggagaatatttcctagtgtatgtatatgagagtttcttgatctctttatctgtggatgaacaggctagtcaccctgctgtggaatagaaggccagaattgatcagtctcatctgagagtaactttgtacccatcactgattccttctgagactgcctccacttccccagcagcctctggtttcttcatgtggctgcagatggcaggatttcccaaaggtttctggctgaaacatattccgtggtgtatctgtacagcagtttcctcatccctgcagctgtgtttgaacaggtcatttaccatgctgtcctccaggttcaacagtatggctccaaaggatgaaatttcattctgattttctggctgaagactattctctttgtgtatgtccaccacagttactttatcccttcatctgtggatgggcagtctcgctgtattgcccaggctggagtgcagtggcatgatctcagctcactgcaagctctgcttcctgggttcacgccattctcctgcctcagcctcctgagtagctgggattacaggcacccgccaccacgcccaggaaagaaaaaagaagaaaacaaacctccatacgagaatgggtctaaaggaacttcccaaacctccatgattttgcaggaaacaagataaaggtggtttccacaagaaaaatggcacaatgtttctcagaagacaattacataagaatcagcatacttcaaattcacagcaaataatcagacaattgatgaaaatacttacccaaacactaattgtagactatgccttctgaatatgtttgtcataaacttggagtaaggaatcctcacaggcactggacaattcaaaaaacgtaaagttgtttgttagaatactggtgcttttgggtagaaaccctcatccatatcctggtaaggcttgaagttgcacaggagttttcatttgtcaaaacccagaaaaccataagctttagatttgtgaattttatattgtattatatgtgacctttctttttaaaaaatgagctgtaagcagtctcccagacagtagctcagcctccagaactctctttctgcatagttgaagacccctcttcacacaagatggtagcaacaaatcataggtgcaattgcaccaaattcacagaagatcaattgaaaatcctcatcaataccttcactcaaaaaccttacccaggttatgctaccaaacaaaaacttgctttagcaatcaatgcagaagagtccagaatccaaatttggtttcagaatcaaagacctaggcatggattccagaaaacaccagaacctgactttagatttaagccacagccatggacaagattaacctggtgtggagtttcaaaatagagaagccagatggtgttgtaccacctatagcacctttcaattacacacagtcatccatgcatttatgaaaaacccataccctgggattgattccagagaacaacttgctgaagaaattggtgcttcagagtcaagagtccaaatttggttccaaaatcgaagatctagatttcatctccagagaaaaagagaacctgttatgtccttagaatgagaagaccagagaagaccaggggcaaggtttctgagggacttcaaggtacagaagatacacaaagtggcaccagcctcactagcactctcatttctcaagagccagaacatggtgaatacantcaagttcagtgtatttgataatatcaatttgggccccaaatctctctcacagtcttcctgggagtctattcttcttccaaaagtgcaagctaagccttctgaagatggtaaagaacttggccgggtgtggtggctcatgcctgtaatcccagcactttaggaggctgaggctggaagattgcttgagcctaggagtttgaaaccagtctgagcaacatagtaagaccctgtctctattctaaaaaacaaaataagtaaaaaggactgtaggaggccaagacaggtacaggaggcaccacactaccctgttgacacagcctggatccagagttcagcagaccttgagacaatgaaaacaaacttagtaataatcatttttcaatcattgcagtaattattgatttggacaaaaatcaattgacgtcaaaaccttaaagtgacgtttctctgcctatggagtggtcattcttttattcctttagtttcataataaattttcttttacttaaaaaaacttatagtttgatgaagagtgagatatatacctcatctcaaagaatcttcacacacacacttattaattacaacaaggaaaatcagtaattttgcagtggcagacatatggccaactccaaccttacccaagtggctgaaagtcactgcaccagtaatggcacaaaccaatgtgagatgattcctgatatgatacactaacaaagggcactgtctcttctgcatgttgcagacaaaaagtgggtaagctgaaactgaaactaataattaggcaatgtcaagcaaatacaaattcaggttgacagtctgcgaagtaacatccatgtac

SEQ ID NO: 330159 - DNA, 2500 bp, Homo sapiens
  misc_feature (1658)..(1658): n is a, c, g, or t
gcacgagggatgctgccagcgtgcgtgtccctacggaagctgagactgcacttcctgcgaggcccctgcagcagcagcggcgtggtcagagcgagcttcggagaagcagtggtgggttccatgtgatggtggagtaggaggcaggtctccgcggtttcttcatgtggctgcagatggcaggatttcccaaaggtttctggctgaaacatattccgtggtgtatctgtacagcagtttcctcatccctgcagctgtgtttgaacaggttcaacagtatggctccaaaggatgaaatttcattctgattttctggctgaagactattctctttgtgtatgtccaccacagttactttatcccttcatctgtggatgggcagtctcgctgtattgcccaggctggagtgcagtggcatgatctcagctcactgcaagctctgcttcctgggttcacgccattctcctgcctcagcctcctgagtagctgggattacaggcacccgccaccacgcccaggaaagaaaaaagaagaaaacaaacctccatacgagaatgggtctaaaggaacttcccaaacctccatgattttgcaggaaacaagataaaggtggtttccacaagaaaaatggcacaatgtttctcagaagacaattacataagaatcagcatacttcaaattcacagcaaataatcagacaattgatgaaaatacttacccaaacactaattgtagactatgccttctgaatatgtttgtcataaacttggagtaaggaatcctcacaggcactggacaattcaaaaaacgtaaagttgtttgttagaatactggtgcttttgggtagaaaccctcatccatatcctggtaaggcttgaagttgcacaggagttttcatttgtcaaaacccagaaaaccataagctttagatttgtgaattttatattgtattatatgtgacctttctttttaaaaaatgagctgtaagcagtctcccagacagtagctcagcctccagaactctctttctgcatagttgaagacccctcttcacacaagatggtagcaacaaatcataggtgcaattgcaccaaattcacagaagatcaattgaaaatcctcatcaataccttcactcaaaaaccttacccaggttatgctaccaaacaaaaacttgctttagcaatcaatgcagaagagtccagaatccaaatttggtttcagaatcaaagacctaggcatggattccagaaaacaccagaacctgactttagatttaagccacagccatggacaagattaacctggtgtggagtttcaaaatagagaagccagatggtgttgtaccacctatagcacctttcaattacacacagtcatccatgcatttatgaaaaacccataccctgggattgattccagagaacaacttgctgaagaaattggtgcttcagagtcaagagtccaaatttggttccaaaatcgaagatctagatttcatctccagagaaaaagagaacctgttatgtccttagaatgagaagaccagagaagaccaggggcaaggtttctgagggacttcaaggtacagaagatacacaaagtggcaccagcctcactagcactctcatttctcaagagccagaacatggtgaatacantcaagttcagtgtatttgataatatcaatttgggccccaaatctctctcacagtcttcctgggagtctattcttcttccaaaagtgcaagctaagccttctgaagatggtaaagaacttggccgggtgtggtggctcatgcctgtaatcccagcactttaggaggctgaggctggaagattgcttgagcctaggagtttgaaaccagtctgagcaacatagtaagaccctgtctctattctaaaaaacaaaataagtaaaaaggactgtaggaggccaagacaggtacaggaggcaccacactaccctgttgacacagcctggatccagagttcagcagaccttgagacaatgaaaacaaacttagtaataatcatttttcaatcattgcagtaattattgatttggacaaaaatcaattgacgtcaaaaccttaaagtgacgtttctctgcctatggagtggtcattcttttattcctttagtttcataataaattttcttttacttaaaaaaacttatagtttgatgaagagtgagatatatacctcatctcaaagaatcttcacacacacacttattaattacaacaaggaaaatcagtaattttgcagtggcagacatatggccaactccaaccttacccaagtggctgaaagtcactgcaccagtaatggcacaaaccaatgtgagatgattcctgatatgatacactaacaaagggcactgtctcttctgcatgttgcagacaaaaagtgggtaagctgaaactgaaactaataattaggcaatgtcaagcaaatacaaattcaggttgacagtctgcgaagtaacatccatgtac

SEQ ID NO: 330160 - DNA, 2634 bp, Homo sapiens
  misc_feature (1792)..(1792): n is a, c, g, or t
gttagagtggggcattttggttaatgcagacacagaggaatgttaaaatcaggatatttagagtctctgttatcacaaacagttgttaatttatttgtggtgaaaacatttggaatcttcttttccagattttgtgaaaaagctgtgatgttttgttaacctctggtcacagtgctgtggaacagagaggaacgattcattcctctcatctaagtgtaattttgtacctatttctgatccctgcccatgcccctgcttccttccaatctctggaaaccactgttgtgctctctagatctattgcaataaagccttttattttgggttctacatgagtgagatgtggcaatgtttttctttctctacctggttcaggtcatttaccatgctgtcctccaggttcaacagtatggctccaaaggatgaaatttcattctgattttctggctgaagactattctctttgtgtatgtccaccacagttactttatcccttcatctgtggatgggcagtctcgctgtattgcccaggctggagtgcagtggcatgatctcagctcactgcaagctctgcttcctgggttcacgccattctcctgcctcagcctcctgagtagctgggattacaggcacccgccaccacgcccaggaaagaaaaaagaagaaaacaaacctccatacgagaatgggtctaaaggaacttcccaaacctccatgattttgcaggaaacaagataaaggtggtttccacaagaaaaatggcacaatgtttctcagaagacaattacataagaatcagcatacttcaaattcacagcaaataatcagacaattgatgaaaatacttacccaaacactaattgtagactatgccttctgaatatgtttgtcataaacttggagtaaggaatcctcacaggcactggacaattcaaaaaacgtaaagttgtttgttagaatactggtgcttttgggtagaaaccctcatccatatcctggtaaggcttgaagttgcacaggagttttcatttgtcaaaacccagaaaaccataagctttagatttgtgaattttatattgtattatatgtgacctttctttttaaaaaatgagctgtaagcagtctcccagacagtagctcagcctccagaactctctttctgcatagttgaagacccctcttcacacaagatggtagcaacaaatcataggtgcaattgcaccaaattcacagaagatcaattgaaaatcctcatcaataccttcactcaaaaaccttacccaggttatgctaccaaacaaaaacttgctttagcaatcaatgcagaagagtccagaatccaaatttggtttcagaatcaaagacctaggcatggattccagaaaacaccagaacctgactttagatttaagccacagccatggacaagattaacctggtgtggagtttcaaaatagagaagccagatggtgttgtaccacctatagcacctttcaattacacacagtcatccatgcatttatgaaaaacccataccctgggattgattccagagaacaacttgctgaagaaattggtgcttcagagtcaagagtccaaatttggttccaaaatcgaagatctagatttcatctccagagaaaaagagaacctgttatgtccttagaatgagaagaccagagaagaccaggggcaaggtttctgagggacttcaaggtacagaagatacacaaagtggcaccagcctcactagcactctcatttctcaagagccagaacatggtgaatacantcaagttcagtgtatttgataatatcaatttgggccccaaatctctctcacagtcttcctgggagtctattcttcttccaaaagtgcaagctaagccttctgaagatggtaaagaacttggccgggtgtggtggctcatgcctgtaatcccagcactttaggaggctgaggctggaagattgcttgagcctaggagtttgaaaccagtctgagcaacatagtaagaccctgtctctattctaaaaaacaaaataagtaaaaaggactgtaggaggccaagacaggtacaggaggcaccacactaccctgttgacacagcctggatccagagttcagcagaccttgagacaatgaaaacaaacttagtaataatcatttttcaatcattgcagtaattattgatttggacaaaaatcaattgacgtcaaaaccttaaagtgacgtttctctgcctatggagtggtcattcttttattcctttagtttcataataaattttcttttacttaaaaaaacttatagtttgatgaagagtgagatatatacctcatctcaaagaatcttcacacacacacttattaattacaacaaggaaaatcagtaattttgcagtggcagacatatggccaactccaaccttacccaagtggctgaaagtcactgcaccagtaatggcacaaaccaatgtgagatgattcctgatatgatacactaacaaagggcactgtctcttctgcatgttgcagacaaaaagtgggtaagctgaaactgaaactaataattaggcaatgtcaagcaaatacaaattcaggttgacagtctgcgaagtaacatccatgtac

SEQ ID NO: 330161 - DNA, 2672 bp, Homo sapiens
  misc_feature (1830)..(1830): n is a, c, g, or t
gcacgagggatgctgccagcgtgcgtgtccctacggaagctgagactgcacttcctgcgaggcccctgcagcagcagcggcgtggtcagagcgagcttcggagaagcagtggtgggttccatgtgatggtggagtaggaggcaggtctccgcgctactttgaaacatatgatacatttgtgttaaggctagtcaccctgctgtggaatagaaggccagaattgatcagtctcatctgagagtaactttgtacccatcactgattccttctgagactgcctccacttccccagcagcctctggtttcttcatgtggctgcagatggcaggatttcccaaaggtttctggctgaaacatattccgtggtgtatctgtacagcagtttcctcatccctgcagctgtgtttgaacaggtcatttaccatgctgtcctccaggttcaacagtatggctccaaaggatgaaatttcattctgattttctggctgaagactattctctttgtgtatgtccaccacagttactttatcccttcatctgtggatgggcagtctcgctgtattgcccaggctggagtgcagtggcatgatctcagctcactgcaagctctgcttcctgggttcacgccattctcctgcctcagcctcctgagtagctgggattacaggcacccgccaccacgcccaggaaagaaaaaagaagaaaacaaacctccatacgagaatgggtctaaaggaacttcccaaacctccatgattttgcaggaaacaagataaaggtggtttccacaagaaaaatggcacaatgtttctcagaagacaattacataagaatcagcatacttcaaattcacagcaaataatcagacaattgatgaaaatacttacccaaacactaattgtagactatgccttctgaatatgtttgtcataaacttggagtaaggaatcctcacaggcactggacaattcaaaaaacgtaaagttgtttgttagaatactggtgcttttgggtagaaaccctcatccatatcctggtaaggcttgaagttgcacaggagttttcatttgtcaaaacccagaaaaccataagctttagatttgtgaattttatattgtattatatgtgacctttctttttaaaaaatgagctgtaagcagtctcccagacagtagctcagcctccagaactctctttctgcatagttgaagacccctcttcacacaagatggtagcaacaaatcataggtgcaattgcaccaaattcacagaagatcaattgaaaatcctcatcaataccttcactcaaaaaccttacccaggttatgctaccaaacaaaaacttgctttagcaatcaatgcagaagagtccagaatccaaatttggtttcagaatcaaagacctaggcatggattccagaaaacaccagaacctgactttagatttaagccacagccatggacaagattaacctggtgtggagtttcaaaatagagaagccagatggtgttgtaccacctatagcacctttcaattacacacagtcatccatgcatttatgaaaaacccataccctgggattgattccagagaacaacttgctgaagaaattggtgcttcagagtcaagagtccaaatttggttccaaaatcgaagatctagatttcatctccagagaaaaagagaacctgttatgtccttagaatgagaagaccagagaagaccaggggcaaggtttctgagggacttcaaggtacagaagatacacaaagtggcaccagcctcactagcactctcatttctcaagagccagaacatggtgaatacantcaagttcagtgtatttgataatatcaatttgggccccaaatctctctcacagtcttcctgggagtctattcttcttccaaaagtgcaagctaagccttctgaagatggtaaagaacttggccgggtgtggtggctcatgcctgtaatcccagcactttaggaggctgaggctggaagattgcttgagcctaggagtttgaaaccagtctgagcaacatagtaagaccctgtctctattctaaaaaacaaaataagtaaaaaggactgtaggaggccaagacaggtacaggaggcaccacactaccctgttgacacagcctggatccagagttcagcagaccttgagacaatgaaaacaaacttagtaataatcatttttcaatcattgcagtaattattgatttggacaaaaatcaattgacgtcaaaaccttaaagtgacgtttctctgcctatggagtggtcattcttttattcctttagtttcataataaattttcttttacttaaaaaaacttatagtttgatgaagagtgagatatatacctcatctcaaagaatcttcacacacacacttattaattacaacaaggaaaatcagtaattttgcagtggcagacatatggccaactccaaccttacccaagtggctgaaagtcactgcaccagtaatggcacaaaccaatgtgagatgattcctgatatgatacactaacaaagggcactgtctcttctgcatgttgcagacaaaaagtgggtaagctgaaactgaaactaataattaggcaatgtcaagcaaatacaaattcaggttgacagtctgcgaagtaacatccatgtac

SEQ ID NO: 330162 - DNA, 2094 bp, Homo sapiens
  misc_feature (1252)..(1252): n is a, c, g, or t
agaaagttttattttattaaaaaatgtagtctacaaacgagcctcaatttttggcaataaactcaaaaatgctacacaaaccatcacagaattcggtttgtccttgcaggaaagaaaaaagaagaaaacaaacctccatacgagaatgggtctaaaggaacttcccaaacctccatgattttgcaggaaacaagataaaggtggtttccacaagaaaaatggcacaatgtttctcagaagacaattacataagaatcagcatacttcaaattcacagcaaataatcagacaattgatgaaaatacttacccaaacactaattgtagactatgccttctgaatatgtttgtcataaacttggagtaaggaatcctcacaggcactggacaattcaaaaaacgtaaagttgtttgttagaatactggtgcttttgggtagaaaccctcatccatatcctggtaaggcttgaagttgcacaggagttttcatttgtcaaaacccagaaaaccataagctttagatttgtgaattttatattgtattatatgtgacctttctttttaaaaaatgagctgtaagcagtctcccagacagtagctcagcctccagaactctctttctgcatagttgaagacccctcttcacacaagatggtagcaacaaatcataggtgcaattgcaccaaattcacagaagatcaattgaaaatcctcatcaataccttcactcaaaaaccttacccaggttatgctaccaaacaaaaacttgctttagcaatcaatgcagaagagtccagaatccaaatttggtttcagaatcaaagacctaggcatggattccagaaaacaccagaacctgactttagatttaagccacagccatggacaagattaacctggtgtggagtttcaaaatagagaagccagatggtgttgtaccacctatagcacctttcaattacacacagtcatccatgcatttatgaaaaacccataccctgggattgattccagagaacaacttgctgaagaaattggtgcttcagagtcaagagtccaaatttggttccaaaatcgaagatctagatttcatctccagagaaaaagagaacctgttatgtccttagaatgagaagaccagagaagaccaggggcaaggtttctgagggacttcaaggtacagaagatacacaaagtggcaccagcctcactagcactctcatttctcaagagccagaacatggtgaatacantcaagttcagtgtatttgataatatcaatttgggccccaaatctctctcacagtcttcctgggagtctattcttcttccaaaagtgcaagctaagccttctgaagatggtaaagaacttggccgggtgtggtggctcatgcctgtaatcccagcactttaggaggctgaggctggaagattgcttgagcctaggagtttgaaaccagtctgagcaacatagtaagaccctgtctctattctaaaaaacaaaataagtaaaaaggactgtaggaggccaagacaggtacaggaggcaccacactaccctgttgacacagcctggatccagagttcagcagaccttgagacaatgaaaacaaacttagtaataatcatttttcaatcattgcagtaattattgatttggacaaaaatcaattgacgtcaaaaccttaaagtgacgtttctctgcctatggagtggtcattcttttattcctttagtttcataataaattttcttttacttaaaaaaacttatagtttgatgaagagtgagatatatacctcatctcaaagaatcttcacacacacacttattaattacaacaaggaaaatcagtaattttgcagtggcagacatatggccaactccaaccttacccaagtggctgaaagtcactgcaccagtaatggcacaaaccaatgtgagatgattcctgatatgatacactaacaaagggcactgtctcttctgcatgttgcagacaaaaagtgggtaagctgaaactgaaactaataattaggcaatgtcaagcaaatacaaattcaggttgacagtctgcgaagtaacatccatgtac

SEQ ID NO: 330163 - DNA, 1473 bp, Homo sapiens
gcacgagggatgctgccagcgtgcgtgtccctacggaagctgagactgcacttcctgcgaggcccctgcagcagcagcggcgtggtcagagcgagcttcggagaagcagtggtgggttccatgtgatggtggagtaggaggcaggtctccgcggttcatctgtgttgctctaaatgacactgtttcattattttgatggctggagaatatttcctagtgtatgtatatgagagtttcttgatctctttatctgtggatgaacaggctagtcaccctgctgtggaatagaaggccagaattgatcagtctcatctgagagtaactttgtacccatcactgattccttctgagactgcctccacttccccagcagcctctggtttcttcatgtggctgcagatggcaggatttcccaaaggtttctggctgaaacatattccgtggtgtatctgtacagcagtttcctcatccctgcagctgtgtttgaacaggtcatttaccatgctgtcctccaggttcaacagtatggctccaaaggatgaaatttcattctgattttctggctgaagactattctctttgtgtatgtccaccacagttactttatcccttcatctgtggatgggcagtctcgctgcactccagcctgggtgacaagagcaactccgtctcccaaaataaaaagaagaattgtcaacaagagggagtggcaattcagaagcatatttaagccaagtcctcaagactagaaagcatgaagcaggggaggcgttttgaaagcataagaacaatagaccatgggcatggatggccgagtctggggatcagcatcgtaatttgttgagaaggaggccgtggtgtgctgccagttattaattggtttaatcggttgatacacagccctactggcctaaccagtagcccagggccctggaggatttgcagttcgtgtcagaatttgattgcagttccttccacttggcataaggagacactatcagcctgattgggagggtgatggtgggatggagcctgccgaggtggcggcgctgagctgaccacaccaccggccatagagtgggagcctttcctgcccgcttaactgcagctaatatcaaaagcactggtatgggctgtctatctgtgctggaacctgagtttatctttgtctgcaattacgattcttctgggtttattttgccagctcattatccagccccctggaatcaggcctcccaaatttatcaggtgctggggaggaccctagggagtggtgtatgggggctagctggtgaaactgccctttcctttctgttctatgagtgtgatggtgtttgagaaaatgtggggctatggttcaggcgcacttcacatgtgcaaagatggagaaagcactcacctacacgtttaggctcagaatattgattgaaacattttgaatgatcaaaaataaaatgttatttttaaagtttc

SEQ ID NO: 330164 - DNA, 1715 bp, Homo sapiens
gcacgagggatgctgccagcgtgcgtgtccctacggaagctgagactgcacttcctgcgaggcccctgcagcagcagcggcgtggtcagagcgagcttcggagaagcagtggtgggttccatgtgatggtggagtaggaggcaggtctccgcggttcatctgtgttgctctaaatgacactgtttcattattttgatggctggagaatatttcctagtgtatgtatatgagagtttcttgatctctttatctgtggatgaacaggctagtcaccctgctgtggaatagaaggccagaattgatcagtctcatctgagagtaactttgtacccatcactgattccttctgagactgcctccacttccccagcagcctctggtttcttcatgtggctgcagatggcaggatttcccaaaggtttctggctgaaacatattccgtggtgtatctgtacagcagtttcctcatccctgcagctgtgtttgaacaggtcatttaccatgctgtcctccaggttcaacagtatggctccaaaggatgaaatttcattctgattttctggctgaagactattctctttgtgtatgtccaccacagttactttatcccttcatctgtggatgggcagtctcgctgcactccagcctgggtgacaagagcaactccgtctcccaaaataaaaagaagaattgtcaacaagagggagtggcaattcagaagcatatttaagccaagtcctcaagactagaaagcatgaagcaggggaggcgttttgaaagcataagaacaatagaccatgggcatggatggccgagtctggggatcagcatcgtaatttgttgagaaggaggccgtggtgtgctgccagttattaattggtttaatcggttgatacacagccctactggcctaaccagtagcccagggccctggaggatttgcagttcgtgtcagaatttgattgcagttccttccacttggcataaggagacactatcagcctgattgggagggtgatggtgggatggagcctgccgaggtggcggcgctgagctgaccacaccaccggccatagagtgggagcctttcctgcccgcttaactgcagctaatatcaaaagcactggtatgggctgtctatctgtgctggaacctgagtttatctttgtctgcaattacgattcttctgggtttattttgccagctcattatccagccccctggaatcaggcctcccaaatttatcaggtgctggggaggaccctagggagtggtgtatgggggctagctggtgaaactgccctttcctttctgttctatgagtgtgatggtgtttgagaaaatgtggggctatggttcaggcgcacttcacatgtgcaaagatggagaaagcactcacctacacgtttaggctcagaatattgattgaaacattttgaatgatcaaaaataaaatgttatttttaaagtttctctctgagattttgcttaagttttggtagatattcttaagttttagtgacctcagtttgggaattaagtaagctaaacattgtgtccttattattagttatataaaactatgctttagactttgttagaaacttctgccccaccttgactgactccttttccatttctggttgtacaaaatgaattcacactttaatgctatggccacctttaaataaagtacagcgtgactaaaaaaaaaa

SEQ ID NO: 330165 - DNA, 1588 bp, Homo sapiens
gctgaactcaggagtccctgatgccagcctttctgatgcggtccccctcccctcccccatgtgtctcgctccatagctccaggccaggagccccaactggctggtggaggatgtcttgctcctcagcagctgggatttgtaagtatttgtaggaacatggaacagatcagtggctgacaggcccaggaagcagacagtccccttcccataggtcaccagcttcacttccccttcctgcaccccatcctgatttgagggagcccaggatgacaaagagggagtagttgagcaaggtatggagtggcagcctctacaggagctcaaaggatgcatttgtccatctgccctgggctcagcttccacactcagagtcactcacatccctccaccgtcgccacagctcacctgtgtgcccacacggccaaggtcacactgaccccaaacgcacactgtttcaactctcagcacttcactgtcacactcgcgtgtgtacacacatgctttctaatttccacagccacatggatgctcacacactcacacctttgcacacacacacaagctggctcacagacacactgggggcccagatcctggtcattccccacaggtcttaataaaggttcatggaaggaaacctgtttcctaaggtagggtgggagtgtgtgtgagtgtgtgggggggagagggtgagagtgagtgtgtgcgtgtgttagtgtgtgtgtgtgtatgtaaggagcaggagtgactgggtcctgagtttagggagttgggaagaggaaggagagatggagacaagcctggaccaagagccactcagagctgcctggaagggaagccaggctgagataaaggcaaggcaaagaaataagacactgacaaggatcaagccagggttgggtagggactgggaacagagtctgcctccatgagaagctgtcacattgctgctctggtgccctgtgacagcggcaccatctccagctggagactcccctctctggatcttgtcattgtgactttgctttgttggacaaccaggagtggtgacaggcagggaatatggtgcccagggcagctagccatgccacgccagtccagctgccaacccacccgtcactggccatctcatcacctgcagagggagtggggtggtgcagatgaaaccagcgatcagcttggctgcccttgcttcgtagtgccacagtagaggctaggggagcaactggctttcctccccaaaaggcgggcagggttatccacactttgcccaggtccctgaagcctgcggctgagctcggggataacaggggccaagtcaccggtcccagacacctaggaactattagagacaggaaccagcatatgagacaggggctgttaagtaggaggttggagaacacacgtttttggtctaaaccgggggcccctctctttgcccactgagcccgcggcctgcgtggtgctgagactgcctctggccgcgtccgcttgggacaaggcctgagcggtggctgatcccacctggatgtcccgggccggctcccacccgaagcccgccatcccgggacgcggtggggagaagctg

SEQ ID NO: 330166 - DNA, 1423 bp, Homo sapiens
gcacgagggatgctgccagcgtgcgtgtccctacggaagctgagactgcacttcctgcgaggcccctgcagcagcagcggcgtggtcagagcgagcttcggagaagcagtggtgggttccatgtgatggtggagtaggaggcaggtctccgcgctactttgaaacatatgatacatttgtgttaaggctagtcaccctgctgtggaatagaaggccagaattgatcagtctcatctgagagtaactttgtacccatcactgattccttctgagactgcctccacttccccagcagcctctggtttcttcatgtggctgcagatggcaggatttcccaaaggtttctggctgaaacatattccgtggtgtatctgtacagcagtttcctcatccctgcagctgtgtttgaacaggttcaacagtatggctccaaaggatgaaatttcattctgattttctggctgaagactattctctttgtgtatgtccaccacagttactttatcccttcatctgtggatgggcagtctcgctgtattgcccaggctggagtgcagtggcatgatctcagctcactgcaagctctgcttcctgggttcacgccattctcctgcctcagcctcctgagtagctgggattacaggcacccgccaccacgcccaggaaagaaaaaagaagaaaacaaacctccatacgagaatgggtctaaaggaacttcccaaacctccatgattttgcaggaaacaagataaagctggttggtggagaatttgaactggagatgaactctattatccaggatgctgagagtataatacgcatgacagagcttttagagcactgtgatgtaacatgtcaagcagaaatagggagcatgtttacagccattctatgaaaaagtgtttggaatgtacagactagcacagaagttgggctaattaaacaagtattgctgaaaatgagtgctgtagatgacatgagagcaggtatggggttgattgttagggaagtataacttaaaagtttataaagtttcacatacttctctttatattctataggtaatgtagatttgttgacactactttgatttaaaataaatggaaatgtatggaaattttactttttatattaatggaaaacctgaagagtgaaagaagaaaaatatacttactatagtagacaaatataattactaatgttgttttctaaattttagaaaatctcagtaccacggagtgctatgaaatctatcagaaaaataaacagtatctttttatgtagtatttcattaagcttttacataattaaaatgccacaataggtattacagttctgtataatgagcattttatcaaattcccctagttctgtgcccctcaatctggcatatatgcaactatgacaggaggtactaaaagcc

SEQ ID NO: 330167 - DNA, 1383 bp, Homo sapiens
gcacgagggatgctgccagcgtgcgtgtccctacggaagctgagactgcacttcctgcgaggcccctgcagcagcagcggcgtggtcagagcgagcttcggagaagcagtggtgggttccatgtgatggtggagtaggaggcaggtctccgcggttcatctgtgttgctctaaatgacactgtttcattattttgatggctggagaatatttcctagtgtatgtatatgagagtttcttgatctctttatctgtggatgaacaggctagtcaccctgctgtggaatagaaggccagaattgatcagtctcatctgagagtaactttgtacccatcactgattccttctgagactgcctccacttccccagcagcctctggtttcttcatgtggctgcagatggcaggatttcccaaaggtttctggctgaaacatattccgtggtgtatctgtacagcagtttcctcatccctgcagctgtgtttgaacaggtcatttaccatgctgtcctccaggttcaacagtatggctccaaaggatgaaatttcattctgattttctggctgaagactattctctttgtgtatgtccaccacagttactttatcccttcatctgtggatgggcagtctcgctgcactccagcctgggtgacaagagcaactccgtctcccaaaataaaaagaagaattgtcaacaagagggagtggcaattcagaagcatatttaagccaagtcctcaagactagaaagcatgaagcaggggaggcgttttgaaagcataagaacaatagaccatgggcatggatggccgagtctggggatcagcatcgtaatttgttgagaaggaggccgtggtgtgctgccagttattaattggtttaatcggttgatacacagccctactggcctaaccagtagcccagggccctggaggatttgcagttcgtgtcagaatttgattgcagttccttccacttggcataaggagacactatcagcctgattgggagggtgatggtgggatggagcctgccgaggtggcggcgctgagctgaccacaccaccggccatagagtgggagcctttcctgcccgcttaactgcagctaatatcaaaagcactggtatgggctgtctatctgtgctggaacctgagtttatctttgtctgcaattacgattcttctgggtttattttgccagctcattatccagccccctggaatcaggcctcccaaatttatcaggtgctggggaggaccctagggagtggtgtatgggggctagctggtgaaactgccctttcgaatcgtaattgcagacaaagataaactcaggttccagcacagatagacagcccataccagtgcttttggtcgacg

SEQ ID NO: 330168 - DNA, 1167 bp, Homo sapiens
gctgaactcaggagtccctgatgccagcctttctgatgcggtccccctcccctcccccatgtgtctcgctccatagctccaggccaggagccccaactggctggtggaggatgtcttgctcctcagcagctgggatttgtaagtatttgtaggaacatggaacagatcagtggctgacaggcccaggaagcagacagtccccttcccataggtcaccagcttcacttccccttcctgcaccccatcctgatttgagggagcccaggatgacaaagagggagtagttgagcaaggtatggagtggcagcctctacaggagctcaaaggatgcatttgtccatctgccctgggctcagcttccacactcagagtcactcacatccctccaccgtcgccacagctcacctgtgtgcccacacggccaaggtcacactgaccccaaacgcacactgtttcaactctcagcacttcactgtcacactcgcgtgtgtacacacatgctttctaatttccacagccacatggatgctcacacactcacacctttgcacacacacacaagctggctcacagacacactgggggcccagatcctggtcattccccacaggtcttaataaaggttcatggaaggaaacctgtttcctaaggtagggtgggagtgtgtgtgagtgtgtgggggggagagggtgagagtgagtgtgtgcgtgtgttagtgtgtgtgtgtgtatgtaaggagcaggagtgactgggtcctgagtttagggagttgggaagaggaaggagagatggagacaagcctggaccaagagccactcagagctgcctggaagggaagccaggctgagataaaggcaaggcaaagaaataagacactgacaaggatcaagccagggttgggtagggactgggaacagatcagtggctgacaggcccaggaagcagacagtccccttcccataggtcaccagcttcacttccccttcctgcaccccatcctgatttgagggagcccaggatgacaaagagggagtagttgagcaaggtatggagtagcagcctctacaggagctcaaaggatgcatttgtccatctgccctgggctcagcttccacactcagagtcactcacatccctccaccgtcgccacagctcacctgtgtgccc

SEQ ID NO: 330169 - DNA, 1434 bp, Homo sapiens
gcacgagggatgctgccagcgtgcgtgtccctacggaagctgagactgcacttcctgcgaggcccctgcagcagcagcggcgtggtcagagcgagcttcggagaagcagtggtgggttccatgtgatggtggagtaggaggcaggtctccgcggttcatctgtgttgctctaaatgacactgtttcattattttgatggctggagaatatttcctagtgtatgtatatgagagtttcttgatctctttatctgtggatgaacaggctagtcaccctgctgtggaatagaaggccagaattgatcagtctcatctgagagtaactttgtacccatcactgattccttctgagactgcctccacttccccagcagcctctggtttcttcatgtggctgcagatggcaggatttcccaaaggtttctggctgaaacatattccgtggtgtatctgtacagcagtttcctcatccctgcagctgtgtttgaacaggtcatttaccatgctgtcctccaggttcaacagtatggctccaaaggatgaaatttcattctgattttctggctgaagactattctctttgtgtatgtccaccacagttactttatcccttcatctgtggatgggcagtctcgctgtattgcccaggctggagtgcagtggcatgatctcagctcactgcaagctctgcttcctgggttcacgccattctcctgcctcagcctcctgagtagctgggattacaggcacccgccaccacgcccagctggttggtggagaatttgaactggagatgaactctattatccaggatgctgagagtataatacgcatgacagagcttttagagcactgtgatgtaacatgtcaagcagaaatagggagcatgtttacagccattctatgaaaaagtgtttggaatgtacagactagcacagaagttgggctaattaaacaagtattgctgaaaatgagtgctgtagatgacatgagagcaggtatggggttgattgttagggaagtataacttaaaagtttataaagtttcacatacttctctttatattctataggtaatgtagatttgttgacactactttgatttaaaataaatggaaatgtatggaaattttactttttatattaatggaaaacctgaagagtgaaagaagaaaaatatacttactatagtagacaaatataattactaatgttgttttctaaattttagaaaatctcagtaccacggagtgctatgaaatctatcagaaaaataaacagtatctttttatgtagtatttcattaagcttttacataattaaaatgccacaataggtattacagttctgtataatgagcattttatcaaattcccctagttctgtgcccctcaatctggcatatatgcaactatgacaggaggtactaaaagcc

SEQ ID NO: 330170 - DNA, 952 bp, Homo sapiens
gcacgagggatgctgccagcgtgcgtgtccctacggaagctgagactgcacttcctgcgaggcccctgcagcagcagcggcgtggtcagagcgagcttcggagaagcagtggtgggttccatgtgatggtggagtaggaggcaggtctccgcggttcatctgtgttgctctaaatgacactgtttcattattttgatggctggagaatatttcctagtgtatgtatatgagagtttcttgatctctttatctgtggatgaacaggctagtcaccctgctgtggaatagaaggccagaattgatcagtctcatctgagagtaactttgtacccatcactgattccttctgagactgcctccacttccccagcagcctctggtttcttcatgtggctgcagatggcaggatttcccaaaggtttctggctgaaacatattccgtggtgtatctgtacagcagtttcctcatccctgcagctgtgtttgaacaggtcatttaccatgctgtcctccaggttcaacagtatggctccaaaggatgaaatttcattctgattttctggctgaagactattctctttgtgtatgtccaccacagttactttatcccttcatctgtggatgggcagtctcgctgtattgcccaggctggagtgcagtggcatgatctcagctcactgcaagctctgcttcctgggttcacgccattctcctgcctcagcctcctgagtagctgggattacaggcacccgccaccacgcccagaatgaaacatatatggaaatgttctgtgcaatcaaaacagcagtggtaacagaggagatgtaggctctgagtgtctcactggagactgaagtccacagatatgcaacaaagcctttgtctccctgatgtttttgcctcctgctggtcatgtgctttcacacatcaagagaggacatttaacatttga

SEQ ID NO: 330171 - DNA, 580 bp, Homo sapiens
gcacgagggatgctgccagcgtgcgtgtccctacggaagctgagactgcacttcctgcgaggcccctgcagcagcagcggcgtggtcagagcgagcttcggagaagcagtggtgggttccatgtgatggtggagtaggaggcaggtctccgcggtttcttcatgtggctgcagatggcaggatttcccaaaggtttctggctgaaacatattccgtggtgtatctgtacagcagtttcctcatccctgcagctgtgtttgaacaggaaagaaaaaagaagaaaacaaacctccatacgagaatgggtctaaaggaacttcccaaacctccatgattttgcaggaaacaagataaaggttatcacaaccagcccagctccagaagtgaaagagctggctgcagctgggcatgaggccaaatgaaaatgctttcactcccctcaagggctgcagagggggcccttgcaaagggagggtcaccgagctgcaatttcttctgcctccaatccagaaagagcctgaaggattgctcaaggtgtcctgggaaagattttgatttcaaagagacaatctcccccagg

SEQ ID NO: 330172 - DNA, 667 bp, Homo sapiens
tttggttaatgcagacacagaggaatgttaaaatcaggatatttagagtctctgttatcacaaacagttgttaatttatttgtggtgaaaacatttggaatcttcttttccagattttgtgaaaaagctgtgatgttttgttaacctctggtcacagtgctgtggaacagagaggaacgattcattcctctcatctaagtgtaattttgtacctatttctgatccctgcccatgcccctgcttccttccaatctctggaaaccactgttgtgctctctagatctattgcaataaagccttttattttgggttctacatgagtgagatgtggcaatgtttttctttctctacctggttcaggtcatttaccatgctgtcctccaggttcaacagtatggctccaaaggatgaaatttcattctgattttctggctgaagactattctctttgtgtatgtccaccacagttactttatcccttcatctgtggatgggcaggtaagtttattccttatcttggcgattgtgaatagtgctgcagtccacataggatggctgatacctcttgcataaactgatttctttggcactgaaagtatacttagtagtagaattgttagatgaagtggtagttgtaggtttaatttttggaggaacctcccactgg

SEQ ID NO: 330173 - DNA, 967 bp, Homo sapiens
gcacgagggatgctgccagcgtgcgtgtccctacggaagctgagactgcacttcctgcgaggcccctgcagcagcagcggcgtggtcagagcgagcttcggagaagcagtggtgggttccatgtgatggtggagtaggaggcaggtctccgcggttcatctgtgttgctctaaatgacactgtttcattattttgatggctggagaatatttcctagtgtatgtatatgagagtttcttgatctctttatctgtggatgaacagctactttgaaacatatgatacatttgtgttaaggctagtcaccctgctgtggaatagaaggccagaattgatcagtctcatctgagagtaactttgtacccatcactgattccttctgagactgcctccacttccccagcagcctctggtttcttcatgtggctgcagatggcaggatttcccaaaggtttctggctgaaacatattccgtggtgtatctgtacagcagtttcctcatccctgcagctgtgtttgaacaggtcatttaccatgctgtcctccaggttcaacagtatggctccaaaggatgaaatttcattctgattttctggctgaagactattctctttgtgtatgtccaccacagttactttatcccttcatctgtggatgggcagtccagcctgggtgacaagagcaactccgtctcccaaaaaagaactaagcgcaaaaccgaggtatttgcccccaaggggggggggcatctcggaggtttttttaggcccaggtcctaagagacctagaaaggcgcgtgaacgcaggggaaggggttttggacaacggtgtagacaccgtattaacaccgtggcccatggaaatgcgccagaatcgggggacccaggatccgaacatcggcggacaaaggaggcccggacgtggcgcgcgccgacaaacaaggggggaaaaccggcgtgataccagg

SEQ ID NO: 330174 - DNA, 1173 bp, Homo sapiens
gtcttgtcttctggttcactgccatataactatctagagtagtgatatacaggagttattcagtaaaataatttatatttgtgtggattgctcattaatactctacgtacattttactgtcttctaaggatctcttctggattaaggccattaactcatcgttataaattttctagtttatcatttgtcttcaaaccttgttcatagtgttttcttacgtagactatttacgtgaacaaataaacaggcaataggagtcatcagtctttgctttcttctgagttttgttgcattttgaaaatgtctgatttataccttttttctggtctgtataaatcgtttttcactgtacctgctgtttctctgttagaattgtttaaaaaatgatttttactttattttacttaaggcataagaagttctccgtggttaaaatattagtacgtgaactttgtcatctatgaacaagttcctttagaagctgagctctgatagtgatgtcaaatagccacctgttacttgaagacgatgtttgcatacctggcccctcctttatcactgctgttgctgccattgttgatgacatgatgtggaagggcagtgagaaatttgatacttgttcatctatctgttggactcaactagtagtgttgctttagtttttaatctttttatctgaaacggagagtctattataatttgtcattttattcattgcagcggttgtggaacaggaaatgaaaaaggactggctttttgcccctcattatcgatactatgtaagagaaatgagaattcatgcatacagtcagctgctggaatcatataggtcattaacccttggctatatggcagaagcgtttggtgttggtgtggaattcattgatcaggaactgtccaggtttattgctgccgggagactacactgcaaaatagataaagtgaatgaaatagtagaaaccaacagacctgatagcaagaactggcagtaccaagaaactatcaagaaaggagatctgctactaaacagagttcaaaaactttccagagtaattaatatgtaaagccatgtaactaacaaaggatttgctttagagataattatttggaatttttatagcttacttcacaatgtgcccaggtcagctgtataaaataaatactgcattgttg

SEQ ID NO: 330175 - DNA, 1577 bp, Homo sapiens
gtcttgtcttctggttcactgccatataactatctagagtagtgatatacaggagttattcagtaaaataatttatatttgtgtggattgctcattaatactctacgtacattttactgtcttctaaggatctcttctggattaaggccattaactcatcgttataaattttctagtttatcatttgtcttcaaaccttgttcatagtgttttcttacgtagactatttacgtgaacaaataaacaggcaataggagtcatcagtctttgctttcttctgagttttgttgcattttgaaaatgtctgatttataccttttttctggtctgtataaatcgtttttcactgtacctgctgtttctctgttagaattgtttaaaaaatgatttttactttattttacttaaggcataagaagttctccgtggttaaaatattagtacgtgaactttgtcatctatgaacaagttcctttagaagctgagctctgatagtgatgtcaaatagccacctgttacttgaagacgatgtttgcatacctggcccctcctttatcactgctgttgctgccattgttgatgacatgatgtggaagggcagtgagaaatttgatacttgttcatctatctgttggactcaactagtagtgttgctttagtttttaatctttttatctgaaacggagagtctattataatttgtcattttattcattgcagcggttgtggaacaggaaatgaaaaaggactggctttttgcccctcattatcgatactatgtaagagaaatgagaattcatgcatacagtcagctgctggaatcatataggtcattaacccttggctatatggcagaagcgtttggtgttggtgtggaattcattgatcagtaagtttgaataatgccatgttaattgaagttttaaagttgccttttaaaatatgtgaacttgtacaattttttacttgtttacattggttccctcaatcttaacggggaggggagaggtttttttcctcagtattatcaaaacattcgtatcctgttgcctctgccttcctcatgtcatgtctgccccttgcattaacagatgggaagatgagttgtagtgaggctaagtgatttgttaaaggtcattagaccagttgttatcaaaagttgtcttctgttacttctttgtagaccacactgcagctacggtaatgactcttagatctgatatttacagttggtcatattccctctgataattccttccagtttttaggttgctgctgcaattctggtcagattggttgttaaatgtgggacttttagtacttgcatcagtgattaaacaaataaatacttaatgagccattcattactatatgtttggtattgttttacagctcccttttcacactttcattgtagtagtagggaagagatggcaaggaagcaaataaatataaaacgtaatttcacatatagaaatgaacctatggagatgagaaaatgctatccttacgtacggcatgcttaaggaggtgaggtttgctctgagatttgaattgagaggagtcagccatatgga

SEQ ID NO: 330176 - DNA, 816 bp, Homo sapiens
ttttagatgaaatccccttttttaaaatgggcaaagcaataattctacatcatttctccccttcccttccacttgtttagactaagatatgttagagagggaaagggtcgttgttttagtaaatactattgctgttgacatgttaatactattgctgttgacatgtttactgatgggctgtgttccataattttgttttaggtcttttgtttgaaacagtttactgtttttatcagttttggtccctaatttttcctaacctacagtttttctctgagtacatatggtttcattgtttgatctactttctatctatctgaatatgaacttctaggatcatgtttattctagtagatgatgacttaaagcctgcagtataggagggacaacgtcaactactgcatgtgcaataacaagcttgaagggaagctaaatgtttgttacaaatttaagacagtattttaatgccgtttgcatttttctaagaattttctataaagctaattctgttattttttgtctctaaattaggggaactgtccaggtttattgctgccgggagactacactgcaaaatagataaagtgaatgaaatagtagaaaccaacagacctgatagcaagaactggcagtaccaagaaactatcaagaaaggagatctgctactaaacagagttcaaaaactttccagagtaattaatatgtaaagccatgtaactaacaaaggatttgctttagagataattatttggaatttttatagcttacttcacaatgtgcccaggtcagctgtataaaataaatactgcattgttg

SEQ ID NO: 330177 - DNA, 995 bp, Homo sapiens
gtcgtttccagttttgccctattataagcaaccctgttttgaacactccaacaatttatctttcccacttgttatttccttggggaaaaagtctaaaaaattgaactttccaaaggttaaatatattgtgtcttgaccactgttgccctccagagatatgtcagtttacatttacacaatttatacttctctcaatctatagcatttgagagaacctgtcccaccctctccatactctttgccagtctgagaggacagaaataattttattgatgttttatgcatttctcttattagtgagaatacgcaccatctcatggttagtggccattgatctccatgttgctaaatcatgtgttcccttgcttatctttatctgccttgatgttgaccatcctttgcttctcaccacagctttctcttggttctgcagtaacgtgctcttgttttctctggacctacctcctcatccactgttagacctctcagtgtctgactgccttagactgggttattgcccttgtttcttatcttcactttgtgccatcagatacatttggatggcagtgatggacaaattcatgtcgccagccccaaactggagcaccagactcatgcctcaatgcctccttagtgtcctcacttggctgtttaataggcatatccacttgaacactgccaaagtatgcttgaatcccaccctcacccccaacactaaaaacaaatattctccttctccagggatttccatcttgttgaaaccacaaacataagtatactctagagtctcttttcttgctcaccttctatataccaagaaactatcaagaaaggagatctgctactaaacagagttcaaaaactttccagagtaattaatatgtaaagccatgtaactaacaaaggatttgctttagagataattatttggaatttttatagcttacttcacaatgtgcccaggtcagctgtataaaataaatactgcattgttg

SEQ ID NO: 330178 - DNA, 336 bp, Homo sapiens
tatagggtcgcgccccaaggaggataagaaagaaaagttcaggaacacaccgggaactgtccaggtttattgctgccgggagactacactgcaaaatagataaagtgaatgaaatagtagaaaccaacagacctgatagcaagaactggcagtaccaagaaactatcaagaaaggagatctgctactaaacagagttcaaaaactttccagagtaattaatatgtaaagccatgtaactaacaaaggatttgctttagagataattatttggaatttttatagcttacttcacaatgtgcccaggtcagctgtataaaataaatactgcattgttg

SEQ ID NO: 330179 - DNA, 929 bp, Homo sapiens
ttttagatgaaatccccttttttaaaatgggcaaagcaataattctacatcatttctccccttcccttccacttgtttagactaagatatgttagagagggaaagggtcgttgttttagtaaatactattgctgttgacatgttaatactattgctgttgacatgtttactgatgggctgtgttccataattttgttttaggtcttttgtttgaaacagtttactgtttttatcagttttggtccctaatttttcctaacctacagtttttctctgagtacatatggtttcattgtttgatctactttctatctatctgaatatgaacttctaggatcatgtttattctagtagatgatgacttaaagcctgcagtataggagggacaacgtcaactactgcatgtgcaataacaagcttgaagggaagctaaatgtttgttacaaatttaagacagtattttaatgccgtttgcatttttctaagaattttctataaagctaattctgttattttttgtctctaaattaggggaactgtccaggtttattgctgccgggagactacactgcaaaatagataaagtgaatgaaatagtagaaaccaacaggtactctcatttctcagaataaggggcattcctaaattttaaaagtaggtcaactattgtcatggaataatgtgactggtaaataattcattttttcttgaatttatttatagacctgatagcaagaactggcagtaccaagaaactatcaagaaaggagatctgctactaaacagagttcaaaaactttccagagtaattaatatgtaaagccatgtaactaacaaaggatttgctttagagataattatttggaatttttatagcttacttcacaatgtgcccaggtcagctgtataaaataaatactgcattgttg

SEQ ID NO: 330180 - DNA, 1898 bp, Homo sapiens
accgcagaaagaatgtggattttagagttctagataggggttttcatttaggccttgcgacatggctgttacatgaccttggttggtctgtttccctaacctctttgtgcctcatttgtcttacctactaaataggctaatagtactacctcgcagcatgaagatgattttaataagatgaatgagagtaacgactcgacaaactatggtgattgtttttattaatgctgttattacattttcagttttcaaaaaattttaagctcccatcagttacaaacggaaagtaaaatagctaaaaagggagtgagaaagagattcaagaaattgggcttttgagttgggctgcacccactctgggactccgcagggggccttgagggtggaaaagcccccgtgaccacacaggggcgcaggcgcccaggccgggtgaggcgttcccggaggtgtccagcagaggacgctgccggcggagacgggaccggaagccgggccgcaggcggccgggcgtattcgccgactcctcccgcttccgctgccgcagccggtcgtaaccaagttgtgtcctgtcagccgctgtccccttcgccgcgatgccgctggagaacctggaggaggagggtctgcccaagaaccccgacttgcgtatcgcgcagctgcgcttcctgctcagcctgcccgagcaccgcggagacgctgccgtgcgcgacgagctgatggcggccgtccgcgataacaacatggctccttactatgaagccttgtgcaaatccctcgactggcagatagacgtggacctactcaataaaatgaagaaggcaaatgaagatgagttgaagcgtttggatgaggagctggaagatgcagagaagaatctaggagagagcgaaattcgcgatgcaatgatggcaaaggccgagtacctctgccggataggtgacaaagagggagctctgacagcctttcgcaagacatatgacaaaactgtggccctgggtcaccgattggatattgtattctatctccttaggattggcttattttatatggataatgatctcatcacacgaaacacagaaaaggccaaaagcttaatagaagaaggaggagactgggacaggagaaaccgcctaaaagtgtatcagggtctttattgtgtggctattcgtgatttcaaacaggcagctgaactcttccttgacactgtttcaacatttacatcctatgaactcatggattataaaacatttgtgacttatactgtctatgtcagtatgattgccttagaaagaccagatctcagggaaaaggtcattaaaggagcagagattcttgaagtgttgcacagtcttccagcagttcggcagtatctgttttcactctatgaatgccgttactctgttttcttccaatcattagcggttgtggaacaggaaatgaaaaaggactggctttttgcccctcattatcgatactatgtaagagaaatgagaattcatgcatacagtcagctgctggaatcatataggtcattaacccttggctatatggcagaagcgtttggtgttggtgtggaattcattgatcaggaactgtccaggtttattgctgccgggagactacactgcaaaatagataaagtgaatgaaatagtagaaaccaacagacctgatagcaagaactggcagtaccaagaaactatcaagaaaggagatctgctactaaacagagttcaaaaactttccagagtaattaatatgtaaagccatgtaactaacaaaggatttgctttagagataattatttggaatttttatagcttacttcacaatgtgcccaggtcagctgtataaaataaatactgcattgttgtttctttccaaaaatttttttcttaa

SEQ ID NO: 330181 - DNA, 1351 bp, Homo sapiens
  misc_feature (19)..(19): n is a, c, g, or t
taaggctaggtagcgaggnctgggtgtcgctgtccccttcgccgcgatgccgctggagaacctggaggaggagggtctgcccaagaaccccgacttgcgtatcgcgcagctgcgcttcctgctcagcctgcccgagcaccgcggagacgctgccgtgcgcgacgagctgatggcggccgtccgcgataacaacatggctccttactatgaagccttgtgcaaatccctcgactggcagatagacgtggacctactcaataaaatgaagaaggcaaatgaagatgagttgaagcgtttggatgaggagctggaagatgcagagaagaatctaggagagagcgaaattcgcgatgcaatgatggcaaaggccgagtacctctgccggataggtgacaaagagggagctctgacagcctttcgcaagacatatgacaaaactgtggccctgggtcaccgattggatattgtattctatctccttaggattggcttattttatatggataatgatctcatcacacgaaacacagaaaaggccaaaagcttaatagaagaaggaggagactgggacaggagaaaccgcctaaaagtgtatcagggtctttattgtgtggctattcgtgatttcaaacaggcagctgaactcttccttgacactgtttcaacatttacatcctatgaactcatggattataaaacatttgtgacttatactgtctatgtcagtatgattgccttagaaagaccagatctcagggaaaaggtcattaaaggagcagagattcttgaagtgttgcacagtcttccagcagttcggcagtatctgttttcactctatgaatgccgttactctgttttcttccaatcattagcggttgtggaacaggaaatgaaaaaggactggctttttgcccctcattatcgatactatgtaagagaaatgagaattcatgcatacagtcagctgctggaatcatataggtcattaacccttggctatatggcagaagcgtttggtgttggtgtggaattcattgatcaggaactgtccaggtttattgctgccgggagactacactgcaaaatagataaagtgaatgaaatagtagaaaccaacagacctgatagcaagaactggcagtaccaagaaactatcaagaaaggagatctgctactaaacagagttcaaaaactttccagagtaattaatatgtaaagccatgtaactaacaaaggatttgctttagagataattatttggaatttttatagcttacttcacaatgtgcccaggtcagctgtataaaataaatactgcattgttgtttctttccaaaaatttttttcttaa

SEQ ID NO: 330182 - DNA, 2276 bp, Homo sapiens
accgcagaaagaatgtggattttagagttctagataggggttttcatttaggccttgcgacatggctgttacatgaccttggttggtctgtttccctaacctctttgtgcctcatttgtcttacctactaaataggctaatagtactacctcgcagcatgaagatgattttaataagatgaatgagagtaacgactcgacaaactatggtgattgtttttattaatgctgttattacattttcagttttcaaaaaattttaagctcccatcagttacaaacggaaagtaaaatagctaaaaagggagtgagaaagagattcaagaaattgggcttttgagttgggctgcacccactctgggactccgcagggggccttgagggtggaaaagcccccgtgaccacacaggggcgcaggcgcccaggccgggtgaggcgttcccggaggtgtccagcagaggacgctgccggcggagacgggaccggaagccgggccgcaggcggccgggcgtattcgccgactcctcccgcttccgctgccgcagccggtcgtaaccaagttgtgtcctgtcagccgctgtccccttcgccgcgatgccgctggagaacctggaggaggagggtctgcccaagaaccccgacttgcgtatcgcgcagctgcgcttcctgctcagcctgcccgagcaccgcggagacgctgccgtgcgcgacgagctgatggcggccgtccgcgataacaacatggctccttactatgaagccttgtgcaaatccctcgactggcagatagacgtggacctactcaataaaatgaagaaggcaaatgaagatgagttgaagcgtttggatgaggagctggaagatgcagagaagaatctaggagagagcgaaattcgcgatgcaatgatggcaaaggccgagtacctctgccggataggtgacaaagagggagctctgacagcctttcgcaagacatatgacaaaactgtggccctgggtcaccgattggatattgtattctatctccttaggattggcttattttatatggataatgatctcatcacacgaaacacagaaaaggccaaaagcttaatagaagaaggaggagactgggacaggagaaaccgcctaaaagtgtatcagggtctttattgtgtggctattcgtgatttcaaacaggcagctgaactcttccttgacactgtttcaacatttacatcctatgaactcatggattataaaacatttgtgacttatactgtctatgtcagtatgattgccttagaaagaccagatctcagggaaaaggtcattaaaggagcagagattcttgaagtgttgcacagtcttccagcagttcggcagtatctgttttcactctatgaatgccgttactctgttttcttccaatcattagcggttgtggaacaggaaatgaaaaaggactggctttttgcccctcattatcgatactatgtaagagaaatgagaattcatgcatacagtcagctgctggaatcatataggtcattaacccttggctatatggcagaagcgtttggtgttggtgtggaattcattgatcagtaagtttgaataatgccatgttaattgaagttttaaagttgccttttaaaatatgtgaacttgtacaattttttacttgtttacattggttccctcaatcttaacggggaggggagaggtttttttcctcagtattatcaaaacattcgtatcctgttgcctctgccttcctcatgtcatgtctgccccttgcattaacagatgggaagatgagttgtagtgaggctaagtgatttgttaaaggtcattagaccagttgttatcaaaagttgtcttctgttacttctttgtagaccacactgcagctacggtaatgactcttagatctgatatttacagttggtcatattccctctgataattccttccagtttttaggttgctgctgcaattctggtcagattggttgttaaatgtgggacttttagtacttgcatcagtgattaaacaaataaatacttaatgagccattcattactatatgtttggtattgttttacagctcccttttcacactttcattgtagtagtagggaagagatggcaaggaagcaaataaatataaaacgtaatttcacatatagaaatgaacctatggagatgagaaaatgctatccttacgtacggcatgcttaaggaggtgaggtttgctctgagatttgaattgagaggagtcagccatatgga

SEQ ID NO: 330183 - DNA, 2057 bp, Homo sapiens
accgcagaaagaatgtggattttagagttctagataggggttttcatttaggccttgcgacatggctgttacatgaccttggttggtctgtttccctaacctctttgtgcctcatttgtcttacctactaaataggctaatagtactacctcgcagcatgaagatgattttaataagatgaatgagagtaacgactcgacaaactatggtgattgtttttattaatgctgttattacattttcagttttcaaaaaattttaagctcccatcagttacaaacggaaagtaaaatagctaaaaagggagtgagaaagagattcaagaaattgggcttttgagttgggctgcacccactctgggactccgcagggggccttgagggtggaaaagcccccgtgaccacacaggggcgcaggcgcccaggccgggtgaggcgttcccggaggtgtccagcagaggacgctgccggcggagacgggaccggaagccgggccgcaggcggccgggcgtattcgccgactcctcccgcttccgctgccgcagccggtcgtaaccaagttgtgtcctgtcagccgctgtccccttcgccgcgatgccgctggagaacctggaggaggagggtctgcccaagaaccccgacttgcgtatcgcgcagctgcgcttcctgctcagcctgcccgagcaccgcggagacgctgccgtgcgcgacgagctgatggcggccgtccgcgataacaacttttggaacagaatccggcaagagcaaaccgaggattgccctccctccagccctagtagaggttggcattgccaggattggccgtcacgcaaacctcccaccagcatacgtttatgttttgccaagccgattattaagcgccatcgcatgccttcctacatggctccttactatgaagccttgtgcaaatccctcgactggcagatagacgtggacctactcaataaaatgaagaaggcaaatgaagatgagttgaagcgtttggatgaggagctggaagatgcagagaagaatctaggagagagcgaaattcgcgatgcaatgatggcaaaggccgagtacctctgccggataggtgacaaagagggagctctgacagcctttcgcaagacatatgacaaaactgtggccctgggtcaccgattggatattgtattctatctccttaggattggcttattttatatggataatgatctcatcacacgaaacacagaaaaggccaaaagcttaatagaagaaggaggagactgggacaggagaaaccgcctaaaagtgtatcagggtctttattgtgtggctattcgtgatttcaaacaggcagctgaactcttccttgacactgtttcaacatttacatcctatgaactcatggattataaaacatttgtgacttatactgtctatgtcagtatgattgccttagaaagaccagatctcagggaaaaggtcattaaaggagcagagattcttgaagtgttgcacagtcttccagcagttcggcagtatctgttttcactctatgaatgccgttactctgttttcttccaatcattagcggttgtggaacaggaaatgaaaaaggactggctttttgcccctcattatcgatactatgtaagagaaatgagaattcatgcatacagtcagctgctggaatcatataggtcattaacccttggctatatggcagaagcgtttggtgttggtgtggaattcattgatcaggaactgtccaggtttattgctgccgggagactacactgcaaaatagataaagtgaatgaaatagtagaaaccaacagacctgatagcaagaactggcagtaccaagaaactatcaagaaaggagatctgctactaaacagagttcaaaaactttccagagtaattaatatgtaaagccatgtaactaacaaaggatttgctttagagataattatttggaatttttatagcttacttcacaatgtgcccaggtcagctgtataaaataaatactgcattgttgtttctttccaaaaatttttttcttaa

SEQ ID NO: 330184 - DNA, 2122 bp, Homo sapiens
accgcagaaagaatgtggattttagagttctagataggggttttcatttaggccttgcgacatggctgttacatgaccttggttggtctgtttccctaacctctttgtgcctcatttgtcttacctactaaataggctaatagtactacctcgcagcatgaagatgattttaataagatgaatgagagtaacgactcgacaaactatggtgattgtttttattaatgctgttattacattttcagttttcaaaaaattttaagctcccatcagttacaaacggaaagtaaaatagctaaaaagggagtgagaaagagattcaagaaattgggcttttgagttgggctgcacccactctgggactccgcagggggccttgagggtggaaaagcccccgtgaccacacaggggcgcaggcgcccaggccgggtgaggcgttcccggaggtgtccagcagaggacgctgccggcggagacgggaccggaagccgggccgcaggcggccgggcgtattcgccgactcctcccgcttccgctgccgcagccggtcgtaaccaagttgtgtcctgtcagccgctgtccccttcgccgcgatgccgctggagaacctggaggaggagggtctgcccaagaaccccgacttgcgtatcgcgcagctgcgcttcctgctcagcctgcccgagcaccgcggagacgctgccgtgcgcgacgagctgatggcggccgtccgcgataacagtgaggcccgcacgagcgccgagtcagcggcctaggcctgggccgtccccgcgttccggagcctgcggggactttttttgatggagctccagacccctctgacggggtctcagagaccaggcctggcttctccggcccttagggttttgctttggtttggggataccctgggggacctcgacttgcctcagcggggtctgcatctctctgtgccgccttcccctacatggctccttactatgaagccttgtgcaaatccctcgactggcagatagacgtggacctactcaataaaatgaagaaggcaaatgaagatgagttgaagcgtttggatgaggagctggaagatgcagagaagaatctaggagagagcgaaattcgcgatgcaatgatggcaaaggccgagtacctctgccggataggtgacaaagagggagctctgacagcctttcgcaagacatatgacaaaactgtggccctgggtcaccgattggatattgtattctatctccttaggattggcttattttatatggataatgatctcatcacacgaaacacagaaaaggccaaaagcttaatagaagaaggaggagactgggacaggagaaaccgcctaaaagtgtatcagggtctttattgtgtggctattcgtgatttcaaacaggcagctgaactcttccttgacactgtttcaacatttacatcctatgaactcatggattataaaacatttgtgacttatactgtctatgtcagtatgattgccttagaaagaccagatctcagggaaaaggtcattaaaggagcagagattcttgaagtgttgcacagtcttccagcagttcggcagtatctgttttcactctatgaatgccgttactctgttttcttccaatcattagcggttgtggaacaggaaatgaaaaaggactggctttttgcccctcattatcgatactatgtaagagaaatgagaattcatgcatacagtcagctgctggaatcatataggtcattaacccttggctatatggcagaagcgtttggtgttggtgtggaattcattgatcaggaactgtccaggtttattgctgccgggagactacactgcaaaatagataaagtgaatgaaatagtagaaaccaacagacctgatagcaagaactggcagtaccaagaaactatcaagaaaggagatctgctactaaacagagttcaaaaactttccagagtaattaatatgtaaagccatgtaactaacaaaggatttgctttagagataattatttggaatttttatagcttacttcacaatgtgcccaggtcagctgtataaaataaatactgcattgttgtttctttccaaaaatttttttcttaa

SEQ ID NO: 330185 - DNA, 1234 bp, Homo sapiens
  misc_feature (19)..(19): n is a, c, g, or t
taaggctaggtagcgaggnctgggtgtcgctgtccccttcgccgcgatgccgctggagaacctggaggaggaggacatggctccttactatgaagccttgtgcaaatccctcgactggcagatagacgtggacctactcaataaaatgaagaaggcaaatgaagatgagttgaagcgtttggatgaggagctggaagatgcagagaagaatctaggagagagcgaaattcgcgatgcaatgatggcaaaggccgagtacctctgccggataggtgacaaagagggagctctgacagcctttcgcaagacatatgacaaaactgtggccctgggtcaccgattggatattgtattctatctccttaggattggcttattttatatggataatgatctcatcacacgaaacacagaaaaggccaaaagcttaatagaagaaggaggagactgggacaggagaaaccgcctaaaagtgtatcagggtctttattgtgtggctattcgtgatttcaaacaggcagctgaactcttccttgacactgtttcaacatttacatcctatgaactcatggattataaaacatttgtgacttatactgtctatgtcagtatgattgccttagaaagaccagatctcagggaaaaggtcattaaaggagcagagattcttgaagtgttgcacagtcttccagcagttcggcagtatctgttttcactctatgaatgccgttactctgttttcttccaatcattagcggttgtggaacaggaaatgaaaaaggactggctttttgcccctcattatcgatactatgtaagagaaatgagaattcatgcatacagtcagctgctggaatcatataggtcattaacccttggctatatggcagaagcgtttggtgttggtgtggaattcattgatcaggaactgtccaggtttattgctgccgggagactacactgcaaaatagataaagtgaatgaaatagtagaaaccaacagacctgatagcaagaactggcagtaccaagaaactatcaagaaaggagatctgctactaaacagagttcaaaaactttccagagtaattaatatgtaaagccatgtaactaacaaaggatttgctttagagataattatttggaatttttatagcttacttcacaatgtgcccaggtcagctgtataaaataaatactgcattgttgtttctttccaaaaatttttttcttaa

SEQ ID NO: 330186 - DNA, 1703 bp, Homo sapiens
accgcagaaagaatgtggattttagagttctagataggggttttcatttaggccttgcgacatggctgttacatgaccttggttggtctgtttccctaacctctttgtgcctcatttgtcttacctactaaataggctaatagtactacctcgcagcatgaagatgattttaataagatgaatgagagtaacgactcgacaaactatggtgattgtttttattaatgctgttattacattttcagttttcaaaaaattttaagctcccatcagttacaaacggaaagtaaaatagctaaaaagggagtgagaaagagattcaagaaattgggcttttgagttgggctgcacccactctgggactccgcagggggccttgagggtggaaaagcccccgtgaccacacaggggcgcaggcgcccaggccgggtgaggcgttcccggaggtgtccagcagaggacgctgccggcggagacgggaccggaagccgggccgcaggcggccgggcgtattcgccgactcctcccgcttccgctgccgcagccggtcgtaaccaagttgtgtcctgtcagccgctgtccccttcgccgcgatgccgctggagaacctggaggaggagggtctgcccaagaaccccgacttgcgtatcgcgcagctgcgcttcctgctcagcctgcccgagcaccgcggagacgctgccgtgcgcgacgagctgatggcggccgtccgcgataacaacatggctccttactatgaagccttgtgcaaatccctcgactggcagatagacgtggacctactcaataaaatgaagaaggcaaatgaagatgagttgaagcgtttggatgaggagctggaagatgcagagaagaatctaggagagagcgaaattcgcgatgcaatgatggcaaaggccgagtacctctgccggataggtgacaaagagggagctctgacagcctttcgcaagacatatgacaaaactgtggccctgggtcaccgattggatattgtattctatctccttaggattggcttattttatatggataatgatctcatcacacgaaacacagaaaaggccaaaagcttaatagaagaaggaggagactgggacaggagaaaccgcctaaaagtgtatcagggtctttattgtgtggctattcgtgatttcaaacaggcagctgaactcttccttgacactgtttcaacatttacatcctatgaactcatggattataaaacatttgtgacttatactgtctatgtcagtatgattgccttagaaagaccagatctcagggaaaaggtcattaaaggagcagagattcttgaagtgttgcacagtcttccagcagttcggcagtatctgttttcactctatgaatgccgttactctgttttcttccaatcattagggaactgtccaggtttattgctgccgggagactacactgcaaaatagataaagtgaatgaaatagtagaaaccaacagacctgatagcaagaactggcagtaccaagaaactatcaagaaaggagatctgctactaaacagagttcaaaaactttccagagtaattaatatgtaaagccatgtaactaacaaaggatttgctttagagataattatttggaatttttatagcttacttcacaatgtgcccaggtcagctgtataaaataaatactgcattgttg

SEQ ID NO: 330187 - DNA, 1199 bp, Homo sapiens
gtcttgtcttctggttcactgccatataactatctagagtagtgatatacaggagttattcagtaaaataatttatatttgtgtggattgctcattaatactctacgtacattttactgtcttctaaggatctcttctggattaaggccattaactcatcgttataaattttctagtttatcatttgtcttcaaaccttgttcatagtgttttcttacgtagactatttacgtgaacaaataaacaggcaataggagtcatcagtctttgctttcttctgagttttgttgcattttgaaaatgtctgatttataccttttttctggtctgtataaatcgtttttcactgtacctgctgtttctctgttagaattgtttaaaaaatgatttttactttattttacttaaggcataagaagttctccgtggttaaaatattagtacgtgaactttgtcatctatgaacaagttcctttagaagctgagctctgatagtgatgtcaaatagccacctgttacttgaagacgatgtttgcatacctggcccctcctttatcactgctgttgctgccattgttgatgacatgatgtggaagggcagtgagaaatttgatacttgttcatctatctgttggactcaactagtagtgttgctttagtttttaatctttttatctgaaacggagagtctattataatttgtcattttattcattgcagcggttgtggaacaggaaatgaaaaaggactggctttttgcccctcattatcgatactatgtaagagaaatgagaattcatgcatacagtcagctgctggaatcatataggtcattaacccttggctatatggcagaagcgtttggtgttggtgtggaattcattgatcaggaactgtccaggtttattgctgccgggagactacactgcaaaatagataaagtgaatgaaatagtagaaaccaacagacctgatagcaagaactggcagtaccaagaaactatcaagaaaggagatctgctactaaacagagttcaaaaactttccagagtaattaatatgtaaagccatgtaactaacaaaggatttgctttagagataattatttggaatttttatagcttacttcacaatgtgcccaggtcagctgtataaaataaatactgcattgttgtttctttccaaaaatttttttcttaa

SEQ ID NO: 330188 - DNA, 715 bp, Homo sapiens
gcttccgctgccgcagccggtcgtaaccaagttgtgtcctgtcagccgctgtccccttcgccgcgatgccgctggagaacctggaggaggagggtctgcccaagaaccccgacttgcgtatcgcgcagctgcgcttcctgctcagcctgcccgagcaccgcggagacgctgccgtgcgcgacgagctgatggcggccgtccgcgataacagtgaggcccgcacgagcgccgagtcagcggcctaggcctgggccgtccccgcgttccggagcctgcggggactttttttgatggagctccagacccctctgacggggtctcagagaccaggcctggcttctccggcccttagggttttgctttggtttggggataccctgggggacctcgacttgcctcagcggggtctgcatctctctgtgccgccttcccctgtaagggcagcttgggggagaatcgtgaggcattaatatttacccctgtgctaggcacagagtaaaggccccgtgactttctgtcagtggggactgctcccgggcgcggggtattcctgtgggagagttcagcttgcctgtggaagggaaatttgggttcggttctttctggcccttctgtagtgaatgtgtatgtttgaacatatgtatgtgagtatgtgtgtataaaaagtctttccctgtttgaagacttttggaacagaatccggcaagagcaaacc

SEQ ID NO: 330189 - DNA, 1872 bp, Homo sapiens
accgcagaaagaatgtggattttagagttctagataggggttttcatttaggccttgcgacatggctgttacatgaccttggttggtctgtttccctaacctctttgtgcctcatttgtcttacctactaaataggctaatagtactacctcgcagcatgaagatgattttaataagatgaatgagagtaacgactcgacaaactatggtgattgtttttattaatgctgttattacattttcagttttcaaaaaattttaagctcccatcagttacaaacggaaagtaaaatagctaaaaagggagtgagaaagagattcaagaaattgggcttttgagttgggctgcacccactctgggactccgcagggggccttgagggtggaaaagcccccgtgaccacacaggggcgcaggcgcccaggccgggtgaggcgttcccggaggtgtccagcagaggacgctgccggcggagacgggaccggaagccgggccgcaggcggccgggcgtattcgccgactcctcccgcttccgctgccgcagccggtcgtaaccaagttgtgtcctgtcagccgctgtccccttcgccgcgatgccgctggagaacctggaggaggagggtctgcccaagaaccccgacttgcgtatcgcgcagctgcgcttcctgctcagcctgcccgagcaccgcggagacgctgccgtgcgcgacgagctgatggcggccgtccgcgataacaacatggctccttactatgaagccttgtgcaaatccctcgactggcagatagacgtggacctactcaataaaatgaagaaggcaaatgaagatgagttgaagcgtttggatgaggagctggaagatgcagagaagaatctaggagagagcgaaattcgcgatgcaatgatggcaaaggccgagtacctctgccggataggtgacaaagagggagctctgacagcctttcgcaagacatatgacaaaactgtggccctgggtcaccgattggatattgtattctatctccttaggattggcttattttatatggataatgatctcatcacacgaaacacagaaaaggccaaaagcttaatagaagaaggaggagactgggacaggagaaaccgcctaaaagtgtatcagggtctttattgtgtggctattcgtgatttcaaacaggcagctgaactcttccttgacactgtttcaacatttacatcctatgaactcatggattataaaacatttgtgacttatactgtctatgtcagtatgattgccttagaaagaccagatctcagggaaaaggtcattaaaggagcagagattcttgaagtgttgcacagtcttccagcagttcggcagtatctgttttcactctatgaatgccgttactctgttttcttccaatcattagcggttgtggaacaggaaatgaaaaaggactggctttttgcccctcattatcgatactatgtaagagaaatgagaattcatgcatacagtcagctgctggaatcatataggtcattaacccttggctatatggcagaagcgtttggtgttggtgtggaattcattgatcaggaactgtccaggtttattgctgccgggagactacactgcaaaatagataaagtgaatgaaatagtagaaaccaacagacctgatagcaagaactggcagtaccaagaaactatcaagaaaggagatctgctactaaacagagttcaaaaactttccagagtaattaatatgtaaagccatgtaactaacaaaggatttgctttagagataattatttggaatttttatagcttacttcacaatgtgcccaggtcagctgtataaaataaatactgcattgttg

SEQ ID NO: 330190 - DNA, 1905 bp, Homo sapiens
accgcagaaagaatgtggattttagagttctagataggggttttcatttaggccttgcgacatggctgttacatgaccttggttggtctgtttccctaacctctttgtgcctcatttgtcttacctactaaataggctaatagtactacctcgcagcatgaagatgattttaataagatgaatgagagtaacgactcgacaaactatggtgattgtttttattaatgctgttattacattttcagttttcaaaaaattttaagctcccatcagttacaaacggaaagtaaaatagctaaaaagggagtgagaaagagattcaagaaattgggcttttgagttgggctgcacccactctgggactccgcagggggccttgagggtggaaaagcccccgtgaccacacaggggcgcaggcgcccaggccgggtgaggcgttcccggaggtgtccagcagaggacgctgccggcggagacgggaccggaagccgggccgcaggcggccgggcgtattcgccgactcctcccgcttccgctgccgcagccggtcgtaaccaagttgtgtcctgtcagccgctgtccccttcgccgcgatgccgctggagaacctggaggaggagggtctgcccaagaaccccgacttgcgtatcgcgcagctgcgcttcctgctcagcctgcccgagcaccgcggagacgctgccgtgcgcgacgagctgatggcggccgtccgcgataacaacatggctccttactatgaagccttgtgcaaatccctcgactggcagatagacgtggacctactcaataaaatgaagaaggcaaatgaagatgagttgaagcgtttggatgaggagctggaagatgcagagaagaatctaggagagagcgaaattcgcgatgcaatgatggcaaaggccgagtacctctgccggataggtgacaaagagggagctctgacagcctttcgcaagacatatgacaaaactgtggccctgggtcaccgattggatattgtattctatctccttaggattggcttattttatatggataatgatctcatcacacgaaacacagaaaaggccaaaagcttaatagaagaaggaggagactgggacaggagaaaccgcctaaaagtgtatcagggtctttattgtgtggctattcgtgatttcaaacaggcagctgaactcttccttgacactgtttcaacatttacatcctatgaactcatggattataaaacatttgtgacttatactgtctatgtcagtatgattgccttagaaagaccagatctcagggaaaaggtcattaaaggagcagagattcttgaagtgttgcacagtcttccagcagttcggcagtatctgttttcactctatgaatgccgttactctgttttcttccaatcattagcggttgtggaacaggaaatgaaaaaggactggctttttgcccctcattatcgatactatgtaagagaaatgagaattcatgcatacagtcagctgctggaatcatataggtcattaacccttggctatatggcagaagcgtttggtgttggtgtggaattcattgatcaggaactgtccaggtttattgctgccgggagactacactgcaaaatagataaagtgaatgaaatagtagaaaccaacagacctgatagcaagaactggcagtaccaagaaactatcaagaaaggagatctgctactaaacagagttcaaaaactttccagagtaattaatatgtaaagccatgtaactaacaaaggatttgctttagagataattatttggaatttttatagcttacttcacaatgtgcccaggtcagctgtataaaataaatactgcattgttgaaaaaaaaaaaatttttggcctcgttggcctca

SEQ ID NO: 330191 - DNA, 1593 bp, Homo sapiens
accgcagaaagaatgtggattttagagttctagataggggttttcatttaggccttgcgacatggctgttacatgaccttggttggtctgtttccctaacctctttgtgcctcatttgtcttacctactaaataggctaatagtactacctcgcagcatgaagatgattttaataagatgaatgagagtaacgactcgacaaactatggtgattgtttttattaatgctgttattacattttcagttttcaaaaaattttaagctcccatcagttacaaacggaaagtaaaatagctaaaaagggagtgagaaagagattcaagaaattgggcttttgagttgggctgcacccactctgggactccgcagggggccttgagggtggaaaagcccccgtgaccacacaggggcgcaggcgcccaggccgggtgaggcgttcccggaggtgtccagcagaggacgctgccggcggagacgggaccggaagccgggccgcaggcggccgggcgtattcgccgactcctcccgcttccgctgccgcagccggtcgtaaccaagttgtgtcctgtcagccgctgtccccttcgccgcgatgccgctggagaacctggaggaggagggtctgcccaagaaccccgacttgcgtatcgcgcagctgcgcttcctgctcagcctgcccgagcaccgcggagacgctgccgtgcgcgacgagctgatggcggccgtccgcgataacaacatggctccttactatgaagccttgtgcaaatccctcgactggcagatagacgtggacctactcaataaaatgaagaaggcaaatgaagatgagttgaagcgtttggatgaggagctggaagatgcagagaagaatctaggagagagcgaaattcgcgatgcaatgatggcaaaggccgagtacctctgccggataggtgacaaagagggagctctgacagcctttcgcaagacatatgacaaaactgtggccctgggtcaccgattggatattgtattctatctccttaggattggcttattttatatggataatgatctcatcacacgaaacacagaaaaggccaaaagcttaatagaagaaggaggagactgggacaggagaaaccgcctaaaagtgtatcagggtctttattgtgtggctattcgtgatttcaaacaggcagctgaactcttccttgacactgtttcaacatttacatcctatgaactcatggattataaaacatttgtgacttatactgtctatgtcagtatgattgccttagaaagaccagatctcagggaaaaggtcattaaaggagcagagattcttgaagtgttgcacagtcttccagcagttcggcagtatctgttttcactctatgaatgccgttactctgttttcttccaatcattagcggttgtggaacaggaaatgaaaaaggactggctttttgcccctcattatcgatactatgtaagagaaatgagaattcatgcatacagtcagctgctggaatcatataggtcattaacccttggctatatggcagaagcgtttggtgtttactagcgagggacgggatcctcta

SEQ ID NO: 330192 - DNA, 1368 bp, Homo sapiens
accgcagaaagaatgtggattttagagttctagataggggttttcatttaggccttgcgacatggctgttacatgaccttggttggtctgtttccctaacctctttgtgcctcatttgtcttacctactaaataggctaatagtactacctcgcagcatgaagatgattttaataagatgaatgagagtaacgactcgacaaactatgacatggctccttactatgaagccttgtgcaaatccctcgactggcagatagacgtggacctactcaataaaatgaagaaggcaaatgaagatgagttgaagcgtttggatgaggagctggaagatgcagagaagaatctaggagagagcgaaattcgcgatgcaatgatggcaaaggccgagtacctctgccggataggtgacaaagagggagctctgacagcctttcgcaagacatatgacaaaactgtggccctgggtcaccgattggatattgtattctatctccttaggattggcttattttatatggataatgatctcatcacacgaaacacagaaaaggccaaaagcttaatagaagaaggaggagactgggacaggagaaaccgcctaaaagtgtatcagggtctttattgtgtggctattcgtgatttcaaacaggcagctgaactcttccttgacactgtttcaacatttacatcctatgaactcatggattataaaacatttgtgacttatactgtctatgtcagtatgattgccttagaaagaccagatctcagggaaaaggtcattaaaggagcagagattcttgaagtgttgcacagtcttccagcagttcggcagtatctgttttcactctatgaatgccgttactctgttttcttccaatcattagcggttgtggaacaggaaatgaaaaaggactggctttttgcccctcattatcgatactatgtaagagaaatgagaattcatgcatacagtcagctgctggaatcatataggtcattaacccttggctatatggcagaagcgtttggtgttggtgtggaattcattgatcaggaactgtccaggtttattgctgccgggagactacactgcaaaatagataaagtgaatgaaatagtagaaaccaacagacctgatagcaagaactggcagtaccaagaaactatcaagaaaggagatctgctactaaacagagttcaaaaactttccagagtaattaatatgtaaagccatgtaactaacaaaggatttgctttagagataattatttggaatttttatagcttacttcacaatgtgcccaggtcagctgtataaaataaatactgcattgttgtttctttccaaaaatttttttcttaa

SEQ ID NO: 330193 - DNA, 1940 bp, Homo sapiens
accgcagaaagaatgtggattttagagttctagataggggttttcatttaggccttgcgacatggctgttacatgaccttggttggtctgtttccctaacctctttgtgcctcatttgtcttacctactaaataggctaatagtactacctcgcagcatgaagatgattttaataagatgaatgagagtaacgactcgacaaactatggtgattgtttttattaatgctgttattacattttcagttttcaaaaaattttaagctcccatcagttacaaacggaaagtaaaatagctaaaaagggagtgagaaagagattcaagaaattgggcttttgagttgggctgcacccactctgggactccgcagggggccttgagggtggaaaagcccccgtgaccacacaggggcgcaggcgcccaggccgggtgaggcgttcccggaggtgtccagcagaggacgctgccggcggagacgggaccggaagccgggccgcaggcggccgggcgtattcgccgactcctcccgcttccgctgccgcagccggtcgtaaccaagttgtgtcctgtcagccgctgtccccttcgccgcgatgccgctggagaacctggaggaggaggacttttggaacagaatccggcaagagcaaaccgaggattgccctccctccagccctagtagaggttggcattgccaggattggccgtcacgcaaacctcccaccagcatacgtttatgttttgccaagccgattattaagcgccatcgcatgccttcctacatggctccttactatgaagccttgtgcaaatccctcgactggcagatagacgtggacctactcaataaaatgaagaaggcaaatgaagatgagttgaagcgtttggatgaggagctggaagatgcagagaagaatctaggagagagcgaaattcgcgatgcaatgatggcaaaggccgagtacctctgccggataggtgacaaagagggagctctgacagcctttcgcaagacatatgacaaaactgtggccctgggtcaccgattggatattgtattctatctccttaggattggcttattttatatggataatgatctcatcacacgaaacacagaaaaggccaaaagcttaatagaagaaggaggagactgggacaggagaaaccgcctaaaagtgtatcagggtctttattgtgtggctattcgtgatttcaaacaggcagctgaactcttccttgacactgtttcaacatttacatcctatgaactcatggattataaaacatttgtgacttatactgtctatgtcagtatgattgccttagaaagaccagatctcagggaaaaggtcattaaaggagcagagattcttgaagtgttgcacagtcttccagcagttcggcagtatctgttttcactctatgaatgccgttactctgttttcttccaatcattagcggttgtggaacaggaaatgaaaaaggactggctttttgcccctcattatcgatactatgtaagagaaatgagaattcatgcatacagtcagctgctggaatcatataggtcattaacccttggctatatggcagaagcgtttggtgttggtgtggaattcattgatcaggaactgtccaggtttattgctgccgggagactacactgcaaaatagataaagtgaatgaaatagtagaaaccaacagacctgatagcaagaactggcagtaccaagaaactatcaagaaaggagatctgctactaaacagagttcaaaaactttccagagtaattaatatgtaaagccatgtaactaacaaaggatttgctttagagataattatttggaatttttatagcttacttcacaatgtgcccaggtcagctgtataaaataaatactgcattgttgtttctttccaaaaatttttttcttaa

SEQ ID NO: 330194 - DNA, 2156 bp, Homo sapiens
accgcagaaagaatgtggattttagagttctagataggggttttcatttaggccttgcgacatggctgttacatgaccttggttggtctgtttccctaacctctttgtgcctcatttgtcttacctactaaataggctaatagtactacctcgcagcatgaagatgattttaataagatgaatgagagtaacgactcgacaaactatggtgattgtttttattaatgctgttattacattttcagttttcaaaaaattttaagctcccatcagttacaaacggaaagtaaaatagctaaaaagggagtgagaaagagattcaagaaattgggcttttgagttgggctgcacccactctgggactccgcagggggccttgagggtggaaaagcccccgtgaccacacaggggcgcaggcgcccaggccgggtgaggcgttcccggaggtgtccagcagaggacgctgccggcggagacgggaccggaagccgggccgcaggcggccgggcgtattcgccgactcctcccgcttccgctgccgcagccggtcgtaaccaagttgtgtcctgtcagccgctgtccccttcgccgcgatgccgctggagaacctggaggaggagggtctgcccaagaaccccgacttgcgtatcgcgcagctgcgcttcctgctcagcctgcccgagcaccgcggagacgctgccgtgcgcgacgagctgatggcggccgtccgcgataacaacatggctccttactatgaagccttgtgcaaatccctcgactggcagatagacgtggacctactcaataaaatgaagaaggcaaatgaagatgagttgaagcgtttggatgaggagctggaagatgcagagaagaatctaggagagagcgaaattcgcgatgcaatgatggcaaaggccgagtacctctgccggataggtgacaaagagggagctctgacagcctttcgcaagacatatgacaaaactgtggccctgggtcaccgattggatattgtattctatctccttaggattggcttattttatatggataatgatctcatcacacgaaacacagaaaaggccaaaaggtactttctaagggtgggattatattttctctaaattatgatgctacaaatgagaagctgatataagaaactgcctgttttgtttacagctagtaagtttggtcaaataattgatgtacttatttagtaaaataatttaaatatctcctttcggttcaagttgttaaaagttgttttctcatttcaaataacagacaagtttttaaaacgtggccttgtctgtttccagactatgatcttactgtttttatttcatagcttaatagaagaaggaggagactgggacaggagaaaccgcctaaaagtgtatcagggtctttattgtgtggctattcgtgatttcaaacaggcagctgaactcttccttgacactgtttcaacatttacatcctatgaactcatggattataaaacatttgtgacttatactgtctatgtcagtatgattgccttagaaagaccagatctcagggaaaaggtcattaaaggagcagagattcttgaagtgttgcacagtcttccagcagttcggcagtatctgttttcactctatgaatgccgttactctgttttcttccaatcattagcggttgtggaacaggaaatgaaaaaggactggctttttgcccctcattatcgatactatgtaagagaaatgagaattcatgcatacagtcagctgctggaatcatataggtcattaacccttggctatatggcagaagcgtttggtgttggtgtggaattcattgatcaggaactgtccaggtttattgctgccgggagactacactgcaaaatagataaagtgaatgaaatagtagaaaccaacagacctgatagcaagaactggcagtaccaagaaactatcaagaaaggagatctgctactaaacagagttcaaaaactttccagagtaattaatatgtaaagccatgtaactaacaaaggatttgctttagagataattatttggaatttttatagcttacttcacaatgtgcccaggtcagctgtataaaataaatactgcattgttgtttctttccaaaaatttttttcttaa

SEQ ID NO: 330195 - DNA, 1157 bp, Homo sapiens
tttttttacttataagtatttgacatttggctatatttttcttcttgttaggctgagggtgtattttgtatagatttatttattcttcttgttctgtatcgtttatgacggacatatgtagctgccattttattttattaccgcgaagtcctcacctattcactcttaaatctacctcattgaagccttcaataactatttgttgttggaagccataatgaaactgttgatcaaattacccaatccaaatcaaattaaccaaaaagactttcttcagtcttcatattaattaccttccctgcagaacagaacatggttgcccattatgtgaaattccttttacttctttggtggtcctgtctgttttcttatgcctaattgttgcttacggtatacttgctgtttgtttgtttgtttgtttgtttcttttatacactcattaagtgagttctccatctaaatatcccataaggcacttcagaatcaacatatccaaaaggaaacatattttactcatctccaaatcttttgtttctccagcaattcaagttttggtgaatgaagctatgaacaatccagtaatccaaaccagaaacttgagagtcatcttttttacacctcccactttgcatctctcacattgaataagcaatcatgccctgagccatatactttcttagcatctctgccatcctccctatcctctttggtatggcctctcttcagactgcctccttagctctcttctggatcactataacagcctaacaattgtatcaccttcacttttgctctttcttccatatgactatcagaattatttctctggaagatcatgtcaatcactccttctcagtggttcttcattgcctataggaagaaatccaaactccgtagcatgagagaaatgtttttcataacgactttatcctgcctttctattgtttctttcatatcatgcccagctcagccccccattcaatgaaaatcatactaaactactttaattccactaacatgttgtgctagttaagcctctttacctttgttcatgctgtttttactcagaccactccattccacaacatacacttgggggatacctactaattttgaagacccccttcagccctgatgttaaccttctttgtggaatc

SEQ ID NO: 330196 - DNA, 547 bp, Homo sapiens
tctgagaatgactggaggaaatggtcatgattaccccgcggtcccctccactcaccttggacatgactatcatctggctctgggctctgtctggccctgctgggactccccgagctcagttgccaccagcctgctgggacagttcgagctcttccattttcctaccctgaagcaagcctcagtcacagggtcgtgaaacatgaaccaaccagggcgacaaacagatgtcaacaagtcatcattcccctttccaatgggcagacctgcccctgtaacctgccagctgagaccccactgcacttcccccactgcagacaagaggcagagtgccactcctgcgtcgcctacaaggtgcccaactgtgtccctggccctgaggtccagcctgatgggatcaccttcgagacagcacaggcctaggcagggccttcccaccaggcctccctgaagggaaggttcaagaaaggggtcctgtgagccacagctcaggcctgggatttggagtagcaggggtctctagtggaaagcccaccaggagctcaccagg

SEQ ID NO: 330197 - DNA, 579 bp, Homo sapiens
catgtatcatatgattttttaaaacagggattttttaatttttaaaactttctgagcatgaaacatccttcccatacacacatttattttttgtacattcaactttaagaatgtatttggtacaaaagtagcagagtgcctatatatacatccctgaaaaattggcttaacatgaattggacatgtgaaactatttctctggggatggcagttaacaaaaagaaagggaacacatcgtgaaaaagtaagaggaaacagaattggaagacataaagaaggcaacaaatagtgtatcaccactgggacagcaactttccccacctatgtgaccaaccaataaaccaaatttcatgacagggcaattccaaattagctaattaaagtaataaaaactctgggattcgtttcaaaatatttaaggggttgaagggggagtgacagaagcacagatgaaagaagactggccatgaatggatcgttgttgaagctgaataagaagaacacccatctctctactttgatatatatttgaaattttccataacacaacatttaaataataacaatgataacaagttt

SEQ ID NO: 330198 - DNA, 449 bp, Homo sapiens
gataagtggcacacccaccataacagagtagacttcaaaacatacttaagaaaaaagaaatgtggtgtttactgagcaccttctctgtataaaggacagtgccaaatgtggcacaggagataaacaacgaatccacagtctgatcacagggataagcacctcaaatgcaaggcagggccaagtccagtcagtgacataaaagacgtactactgagttgggcacagtggctcacgcttgtgatcctaacactttgggaggccgaggcgggtggatcacgaggtcaggagatggagaccattctggctaacacagtgaaacccatctctactaaaaatacaaaaaattagccaggcgctttggcacatgcctatagtcccagctactcgggaggctgaggcaggagaatcgcttgaacccaggaggcggaagttgcagtgagccgggattg

SEQ ID NO: 330199 - DNA, 214 bp, Homo sapiens
ggaaatgggagctgagtgaacttgggagccaatgttggagttgggaaagcagtaggaatgcatggccagagcccagggatcgccagggagacagtgaatccaagaggatgtcaagtgtagaggtggaggaaggcacatgggtagaggaaaatgcataaatgagatgatacacagttaaaaattgacagggaggccaggtgcggtggctcacgcc

SEQ ID NO: 330200 - DNA, 3492 bp, Homo sapiens
aggagggagccagcgcgcccagcccagccaggctcggacagagggggcggggagagggtggagcgcggggagccaggcgaggggccgcgacgacgggactccattagccgctccggccacaggcagcgcttcgccagccgaggaaccggacgcggacaccgccgccccgcgagcctccagcccctcgcctgttgccgcgcgagtcccgggcccggagcgctaggagcgcgcggtgagggagcgggaccccgccgggacccgagggggcgcggcggggaggggaacggggagtcagcccgcgctgtgtctcggggccggccggcaggaaggagccatggctctggacgggataaggatgccagatggctgctacgcggacgggacgtgggaactgagtgtccatgtgacggacctgaaccgcgatgtcaccctgagagtgaccggcgaggtgcacattggaggcgtgatgcttaagctggtggagaaactcgatgtaaaaaaagattggtctgaccatgctctctggtgggaaaagaagagaacttggcttctgaagacacattggaccttagataagtatggtattcaggcagatgctaagcttcagttcacccctcagcacaaactgctccgcctgcagcttcccaacatgaagtatgtgaaggtgaaagtgaatttctctgatagagtcttcaaagctgtttctgacatctgtaagacttttaatatcagacaccccgaagaactttctctcttaaagaaacccagagatccaacaaagaaaaaaaagaagaagctagatgaccagtctgaagatgaggcacttgaattagaggggcctcttatcactcctggatcaggaagtatatattcaagcccaggactgtatagtaaaacaatgacccccacttatgatgctcatgatggaagccccttgtcaccaacttctgcttggtttggtgacagtgctttgtcagaaggcaatcctggtatacttgctgtcagtcaaccaatcacgtcaccagaaatcttggcaaaaatgttcaagcctcaagctcttcttgataaagcaaaaatcaaccaaggatggcttgattcctcaagatctctcatggaacaagatgtgaaggaaaatgaggccttgctgctccgattcaagtattacagcttttttgatttgaatccaaagtatgatgcaatcagaatcaatcagctttacgagcaggccaaatgggccattctcctggaagagattgaatgcacagaagaagaaatgatgatgtttgcagccctgcagtatcatatcaataagctgtcaatcatgacatcagagaatcatttgaacaacagtgacaaagaagttgatgaagttgatgctgccctttcagacctggagattactctggaagggggtaaaacgtcaacaattttgggtgacattacttccattcctgaacttgctgactacattaaagttttcaagccaaaaaagctgactctgaaaggttacaaacaatattggtgcaccttcaaagacacatccatttcttgttataagagcaaagaagaatccagtggcacaccagctcatcagatgaacctcaggggatgtgaagttaccccagatgtaaacatttcaggccaaaaatttaacattaaactcctgattccagttgcagaaggcatgaatgaaatctggcttcgttgtgacaatgaaaaacagtatgcacactggatggcagcctgcagattagcctccaaaggcaagaccatggcggacagttcttacaacttagaagttcagaatattctttcctttctgaagatgcagcatttaaacccagatcctcagttaataccagagcagatcacgactgatataactcctgaatgtttggtgtctccccgctatctaaaaaagtataagaacaagcagataacagcgagaatcttggaggcccatcagaatgtagctcagatgagtctaattgaagccaagatgagatttattcaagcttggcagtcactacctgaatttggcatcactcacttcattgcaaggttccaagggggcaaaaaagaagaacttattggaattgcatacaacagactgattcggatggatgccagcactggagatgcaattaaaacatggcgtttcagcaacatgaaacagtggaatgtcaactgggaaatcaaaatggtcaccgtagagtttgcagatgaagtacgattgtccttcatttgtactgaagtagattgcaaagtggttcatgaattcattggtggctacatatttctctcaacacgtgcaaaagaccaaaacgagagtttagatgaagagatgttctacaaacttaccagtggttgggtgtgaatagaaatactgtttaatgaaactccacggccataacaatatttaactttaaaagctgtttgttatatgctgcttaataaagtaagcttgaaatttatcattttatcatgaaaacttctttgccttaccagaccagttaatatgtgcactaaacaagcacgactattaatctatcatgttatgatataataaacttgaatttggcacacattccttagggccatgaattgaaaactgaaatagtgggcaaatcaggaacaaaccatcactgatttactgatttaagctagccaaactgtaagaaacaagccatctattttaaagctatccagggcttaacctatatgaactctatttatcatgtctaatgcatgtgatttaatgtatgtttaatttgatatcatgttttaaaatatcctacttctggtagccatttaattcctccccctacccccaaataaatcaggcatgcaggaggcctgatatttagtaatgtcattgtgtttgaccttgaaggaaaatgctattagtccgtcgtgcttgatttgtttttgtccttgaataagcatgttatgtatattgtctcgtgtttttatttttacaccatattgtattacacttttagtattcaccagcataatcactgtctgcctaaaatatgcaactctttgcattacaatatgaagtaaagttctatgaagtatgcattttgtgtaactaatgtaaaaacacaaattttataaaattgtacagttttttaaaaactactcacaactagcagatggcttaaatgtagcaatctctgcgttaattaaatgcctttaagagatataattaacgtgcagttttaatatctactaaattaagaatgacttcattatgatcatgatttgccacaatgtccttaactctaatgcctggactggccatgttctagtctgttgcgctgttacaatctgtattggtgctagtcagaaaattcctagctcacatagcccaaaagggtgcgagggagaggtggattaccagtattgttcaataatccatggttcaaagactgtataaatgcattttattttaaataaaagcaaaacttttatttaataaatattttt

SEQ ID NO: 330201 - DNA, 669 bp, Homo sapiens
ttgcaggtgaccgcaactttttctttgcttcgttgccattttttctgattgcctttttttttctttctgcttcctttttctttcctcgcattgccatctacagccaggctatataagagatttggtaagttctccatatttaccacaaaagaaaaagaataaataaaaattcatagccacaaccttccctcatggaatttaccccagtagtgaaatttaaatttaaaatagaaatgattatggtgatttcaagtaccttaaagctgctaacaaatattcctgctagaaacatgtattccaggtattcattctgattatagacatagtgctaaatttaattaaaactcgtgtatatgtggattagaatgtgctgttctgtaatagtagtaccgttaggtgtatgcatttggaatatgtctcaagtgtggcaactatgtactcctaatagtactttttgttgatatgaaaactgaaattaagacttattttgaaaaatccttatacattacattattacagtgtccaaatgtagcttcagatattttgatttcaactcttacaatatgattttggggtacggggtgcgtaattcaatcttttgatcttttgtctcagttctcccatgagagaataatgttcaatggtaaaggtgatgtttactcatgttta

SEQ ID NO: 330202 - DNA, 470 bp, Homo sapiens
ggctgcttgtattgacttgagatttcttaaaagtaaatttagccattttaataaaaattttttgttacaggatgtgaagttaccccagatgtaaacatttcaggccaaaaatttaacattaaactcctgattccagttgcagaaggcatgaatgaaatctggcttcgttgtgacaatgaaaaacagtatgcacactggatggcagcctgcagattagcctccaaaggcaagaccatggcggacagttcttacaacttagaagttcagaatattctttcctttctgaagatgcagcatttaaacccagatcctcagttaataccagagcagatcacgactgatataactcctgaatgtttggtgtctccccgctatctaaaaaagtataagaacaagcaggtacttacttcattttacttcatctactgtgctggtttgtttttataattttgtacataactttgtttttc

SEQ ID NO: 330203 - DNA, 3408 bp, Homo sapiens
agtgttctttacctccagtcaactcttgattatggtaatagttatatctcatttggggctcaagaggatcctaaaacaaaagtaaatggtacagagaattacaatattagcagagtacaaaagtatatatttatcagaaataagtcacgtgcccagaaaagttatctgtgcttataagtcacaatgacatgttgccttagcaaagattatctaatgtaaactttgcttctagtttatggacgtgtgagaatactaaacaaattttgcatttctttcctgaattagtactttaaaaatatgcaactagaaatttatcctccctaaaagtaatattttaacctcctcttcattccaaactctaagttgcttacttatttttaagatgtggttacttaaggtaagaaaaaatgtaaaaaaagattggtctgaccatgctctctggtgggaaaagaagagaacttggcttctgaagacacattggaccttagataagtatggtattcaggcagatgctaagcttcagttcacccctcagcacaaactgctccgcctgcagcttcccaacatgaagtatgtgaaggtgaaagtgaatttctctgatagagtcttcaaagctgtttctgacatctgtaagacttttaatatcagacaccccgaagaactttctctcttaaagaaacccagagatccaacaaagaaaaaaaagaagaagctagatgaccagtctgaagatgaggcacttgaattagaggggcctcttatcactcctggatcaggaagtatatattcaagcccaggactgtatagtaaaacaatgacccccacttatgatgctcatgatggaagccccttgtcaccaacttctgcttggtttggtgacagtgctttgtcagaaggcaatcctggtatacttgctgtcagtcaaccaatcacgtcaccagaaatcttggcaaaaatgttcaagcctcaagctcttcttgataaagcaaaaatcaaccaaggatggcttgattcctcaagatctctcatggaacaagatgtgaaggaaaatgaggccttgctgctccgattcaagtattacagcttttttgatttgaatccaaagtatgatgcaatcagaatcaatcagctttacgagcaggccaaatgggccattctcctggaagagattgaatgcacagaagaagaaatgatgatgtttgcagccctgcagtatcatatcaataagctgtcaatcatgacatcagagaatcatttgaacaacagtgacaaagaagttgatgaagttgatgctgccctttcagacctggagattactctggaagggggtaaaacgtcaacaattttgggtgacattacttccattcctgaacttgctgactacattaaagttttcaagccaaaaaagctgactctgaaaggttacaaacaatattggtgcaccttcaaagacacatccatttcttgttataagagcaaagaagaatccagtggcacaccagctcatcagatgaacctcaggggatgtgaagttaccccagatgtaaacatttcaggccaaaaatttaacattaaactcctgattccagttgcagaaggcatgaatgaaatctggcttcgttgtgacaatgaaaaacagtatgcacactggatggcagcctgcagattagcctccaaaggcaagaccatggcggacagttcttacaacttagaagttcagaatattctttcctttctgaagatgcagcatttaaacccagatcctcagttaataccagagcagatcacgactgatataactcctgaatgtttggtgtctccccgctatctaaaaaagtataagaacaagcagataacagcgagaatcttggaggcccatcagaatgtagctcagatgagtctaattgaagccaagatgagatttattcaagcttggcagtcactacctgaatttggcatcactcacttcattgcaaggttccaagggggcaaaaaagaagaacttattggaattgcatacaacagactgattcggatggatgccagcactggagatgcaattaaaacatggcgtttcagcaacatgaaacagtggaatgtcaactgggaaatcaaaatggtcaccgtagagtttgcagatgaagtacgattgtccttcatttgtactgaagtagattgcaaagtggttcatgaattcattggtggctacatatttctctcaacacgtgcaaaagaccaaaacgagagtttagatgaagagatgttctacaaacttaccagtggttgggtgtgaatagaaatactgtttaatgaaactccacggccataacaatatttaactttaaaagctgtttgttatatgctgcttaataaagtaagcttgaaatttatcattttatcatgaaaacttctttgccttaccagaccagttaatatgtgcactaaacaagcacgactattaatctatcatgttatgatataataaacttgaatttggcacacattccttagggccatgaattgaaaactgaaatagtgggcaaatcaggaacaaaccatcactgatttactgatttaagctagccaaactgtaagaaacaagccatctattttaaagctatccagggcttaacctatatgaactctatttatcatgtctaatgcatgtgatttaatgtatgtttaatttgatatcatgttttaaaatatcctacttctggtagccatttaattcctccccctacccccaaataaatcaggcatgcaggaggcctgatatttagtaatgtcattgtgtttgaccttgaaggaaaatgctattagtccgtcgtgcttgatttgtttttgtccttgaataagcatgttatgtatattgtctcgtgtttttatttttacaccatattgtattacacttttagtattcaccagcataatcactgtctgcctaaaatatgcaactctttgcattacaatatgaagtaaagttctatgaagtatgcattttgtgtaactaatgtaaaaacacaaattttataaaattgtacagttttttaaaaactactcacaactagcagatggcttaaatgtagcaatctctgcgttaattaaatgcctttaagagatataattaacgtgcagttttaatatctactaaattaagaatgacttcattatgatcatgatttgccacaatgtccttaactctaatgcctggactggccatgttctagtctgttgcgctgttacaatctgtattggtgctagtcagaaaattcctagctcacatagcccaaaagggtgcgagggagaggtggattaccagtattgttcaataatccatggttcaaagactgtataaatgcattttattttaaataaaagcaaaacttttatttaataaatattttt

SEQ ID NO: 330204 - DNA, 3512 bp, Homo sapiens
aggagggagccagcgcgcccagcccagccaggctcggacagagggggcggggagagggtggagcgcggggagccaggcgaggggccgcgacgacgggactccattagccgctccggccacaggcagcgcttcgccagccgaggaaccggacgcggacaccgccgccccgcgagcctccagcccctcgcctgttgccgcgcgagtcccgggcccggagcgctaggagcgcgcggtgagggagcgggaccccgccgggacccgagggggcgcggcggggaggggaacggggagtcagcccgcgctgtgtctcggggccggccggcaggaaggagccatggctctggacgggataaggatgccagatggctgctacgcggacgggacgtgggaactgagtgtccatgtgacggacctgaaccgcgatgtcaccctgagagtgaccggcgaggtgcacattggaggcgtgatgcttaagctggtggagaaactcggtgagtagcatcccagccgcatgtaaaaaaagattggtctgaccatgctctctggtgggaaaagaagagaacttggcttctgaagacacattggaccttagataagtatggtattcaggcagatgctaagcttcagttcacccctcagcacaaactgctccgcctgcagcttcccaacatgaagtatgtgaaggtgaaagtgaatttctctgatagagtcttcaaagctgtttctgacatctgtaagacttttaatatcagacaccccgaagaactttctctcttaaagaaacccagagatccaacaaagaaaaaaaagaagaagctagatgaccagtctgaagatgaggcacttgaattagaggggcctcttatcactcctggatcaggaagtatatattcaagcccaggactgtatagtaaaacaatgacccccacttatgatgctcatgatggaagccccttgtcaccaacttctgcttggtttggtgacagtgctttgtcagaaggcaatcctggtatacttgctgtcagtcaaccaatcacgtcaccagaaatcttggcaaaaatgttcaagcctcaagctcttcttgataaagcaaaaatcaaccaaggatggcttgattcctcaagatctctcatggaacaagatgtgaaggaaaatgaggccttgctgctccgattcaagtattacagcttttttgatttgaatccaaagtatgatgcaatcagaatcaatcagctttacgagcaggccaaatgggccattctcctggaagagattgaatgcacagaagaagaaatgatgatgtttgcagccctgcagtatcatatcaataagctgtcaatcatgacatcagagaatcatttgaacaacagtgacaaagaagttgatgaagttgatgctgccctttcagacctggagattactctggaagggggtaaaacgtcaacaattttgggtgacattacttccattcctgaacttgctgactacattaaagttttcaagccaaaaaagctgactctgaaaggttacaaacaatattggtgcaccttcaaagacacatccatttcttgttataagagcaaagaagaatccagtggcacaccagctcatcagatgaacctcaggggatgtgaagttaccccagatgtaaacatttcaggccaaaaatttaacattaaactcctgattccagttgcagaaggcatgaatgaaatctggcttcgttgtgacaatgaaaaacagtatgcacactggatggcagcctgcagattagcctccaaaggcaagaccatggcggacagttcttacaacttagaagttcagaatattctttcctttctgaagatgcagcatttaaacccagatcctcagttaataccagagcagatcacgactgatataactcctgaatgtttggtgtctccccgctatctaaaaaagtataagaacaagcagataacagcgagaatcttggaggcccatcagaatgtagctcagatgagtctaattgaagccaagatgagatttattcaagcttggcagtcactacctgaatttggcatcactcacttcattgcaaggttccaagggggcaaaaaagaagaacttattggaattgcatacaacagactgattcggatggatgccagcactggagatgcaattaaaacatggcgtttcagcaacatgaaacagtggaatgtcaactgggaaatcaaaatggtcaccgtagagtttgcagatgaagtacgattgtccttcatttgtactgaagtagattgcaaagtggttcatgaattcattggtggctacatatttctctcaacacgtgcaaaagaccaaaacgagagtttagatgaagagatgttctacaaacttaccagtggttgggtgtgaatagaaatactgtttaatgaaactccacggccataacaatatttaactttaaaagctgtttgttatatgctgcttaataaagtaagcttgaaatttatcattttatcatgaaaacttctttgccttaccagaccagttaatatgtgcactaaacaagcacgactattaatctatcatgttatgatataataaacttgaatttggcacacattccttagggccatgaattgaaaactgaaatagtgggcaaatcaggaacaaaccatcactgatttactgatttaagctagccaaactgtaagaaacaagccatctattttaaagctatccagggcttaacctatatgaactctatttatcatgtctaatgcatgtgatttaatgtatgtttaatttgatatcatgttttaaaatatcctacttctggtagccatttaattcctccccctacccccaaataaatcaggcatgcaggaggcctgatatttagtaatgtcattgtgtttgaccttgaaggaaaatgctattagtccgtcgtgcttgatttgtttttgtccttgaataagcatgttatgtatattgtctcgtgtttttatttttacaccatattgtattacacttttagtattcaccagcataatcactgtctgcctaaaatatgcaactctttgcattacaatatgaagtaaagttctatgaagtatgcattttgtgtaactaatgtaaaaacacaaattttataaaattgtacagttttttaaaaactactcacaactagcagatggcttaaatgtagcaatctctgcgttaattaaatgcctttaagagatataattaacgtgcagttttaatatctactaaattaagaatgacttcattatgatcatgatttgccacaatgtccttaactctaatgcctggactggccatgttctagtctgttgcgctgttacaatctgtattggtgctagtcagaaaattcctagctcacatagcccaaaagggtgcgagggagaggtggattaccagtattgttcaataatccatggttcaaagactgtataaatgcattttattttaaataaaagcaaaacttttatttaataaatattttt

SEQ ID NO: 330205 - DNA, 3345 bp, Homo sapiens
aggagggagccagcgcgcccagcccagccaggctcggacagagggggcggggagagggtggagcgcggggagccaggcgaggggccgcgacgacgggactccattagccgctccggccacaggcagcgcttcgccagccgaggaaccggacgcggacaccgccgccccgcgagcctccagcccctcgcctgttgccgcgcgagtcccgggcccggagcgctaggagcgcgcggaaggagccatggctctggacgggataaggatgccagatggctgctacgcggacgggacgtgggaactgagtgtccatgtgacggacctgaaccgcgatgtcaccctgagagtgaccggcgaggtgcacattggaggcgtgatgcttaagctggtggagaaactcgatgtaaaaaaagattggtctgaccatgctctctggtgggaaaagaagagaacttggcttctgaagacacattggaccttagataagtatggtattcaggcagatgctaagcttcagttcacccctcagcacaaactgctccgcctgcagcttcccaacatgaagtatgtgaaggtgaaagtgaatttctctgatagagtcttcaaagctgtttctgacatctgtaagacttttaatatcagacaccccgaagaactttctctcttaaagaaacccagagatccaacaaagaaaaaaaagaagaagctagatgaccagtctgaagatgaggcacttgaattagaggggcctcttatcactcctggatcaggaagtatatattcaagcccaggactgtatagtaaaacaatgacccccacttatgatgctcatgatggaagccccttgtcaccaacttctgcttggtttggtgacagtgctttgtcagaaggcaatcctggtatacttgctgtcagtcaaccaatcacgtcaccagaaatcttggcaaaaatgttcaagcctcaagctcttcttgataaagcaaaaatcaaccaaggatggcttgattcctcaagatctctcatggaacaagatgtgaaggaaaatgaggccttgctgctccgattcaagtattacagcttttttgatttgaatccaaagtatgatgcaatcagaatcaatcagctttacgagcaggccaaatgggccattctcctggaagagattgaatgcacagaagaagaaatgatgatgtttgcagccctgcagtatcatatcaataagctgtcaatcatgacatcagagaatcatttgaacaacagtgacaaagaagttgatgaagttgatgctgccctttcagacctggagattactctggaagggggtaaaacgtcaacaattttgggtgacattacttccattcctgaacttgctgactacattaaagttttcaagccaaaaaagctgactctgaaaggttacaaacaatattggtgcaccttcaaagacacatccatttcttgttataagagcaaagaagaatccagtggcacaccagctcatcagatgaacctcaggggatgtgaagttaccccagatgtaaacatttcaggccaaaaatttaacattaaactcctgattccagttgcagaaggcatgaatgaaatctggcttcgttgtgacaatgaaaaacagtatgcacactggatggcagcctgcagattagcctccaaaggcaagaccatggcggacagttcttacaacttagaagttcagaatattctttcctttctgaagatgcagcatttaaacccagatcctcagttaataccagagcagatcacgactgatataactcctgaatgtttggtgtctccccgctatctaaaaaagtataagaacaagcagataacagcgagaatcttggaggcccatcagaatgtagctcagatgagtctaattgaagccaagatgagatttattcaagcttggcagtcactacctgaatttggcatcactcacttcattgcaaggttccaagggggcaaaaaagaagaacttattggaattgcatacaacagactgattcggatggatgccagcactggagatgcaattaaaacatggcgtttcagcaacatgaaacagtggaatgtcaactgggaaatcaaaatggtcaccgtagagtttgcagatgaagtacgattgtccttcatttgtactgaagtagattgcaaagtggttcatgaattcattggtggctacatatttctctcaacacgtgcaaaagaccaaaacgagagtttagatgaagagatgttctacaaacttaccagtggttgggtgtgaatagaaatactgtttaatgaaactccacggccataacaatatttaactttaaaagctgtttgttatatgctgcttaataaagtaagcttgaaatttatcattttatcatgaaaacttctttgccttaccagaccagttaatatgtgcactaaacaagcacgactattaatctatcatgttatgatataataaacttgaatttggcacacattccttagggccatgaattgaactagccaaactgtaagaaacaagccatctattttaaagctatccagggcttaacctatatgaactctatttatcatgtctaatgcatgtgatttaatgtatgtttaatttgatatcatgttttaaaatatcctacttctggtagccatttaattcctccccctacccccaaataaatcaggcatgcaggaggcctgatatttagtaatgtcattgtgtttgaccttgaaggaaaatgctattagtccgtcgtgcttgatttgtttttgtccttgaataagcatgttatgtatattgtctcgtgtttttatttttacaccatattgtattacacttttagtattcaccagcataatcactgtctgcctaaaatatgcaactctttgcattacaatatgaagtaaagttctatgaagtatgcattttgtgtaactaatgtaaaaacacaaattttataaaattgtacagttttttaaaaactactcacaactagcagatggcttaaatgtagcaatctctgcgttaattaaatgcctttaagagatataattaacgtgcagttttaatatctactaaattaagaatgacttcattatgatcatgatttgccacaatgtccttaactctaatgcctggactggccatgttctagtctgttgcgctgttacaatctgtattggtgctagtcagaaaattcctagctcacatagcccaaaagggtgcgagggagaggtggattaccagtattgttcaataatccatggttcaaagactgtataaatgcattttattttaaataaaagcaaaacttttatttaataaatattttt

SEQ ID NO: 330206 - DNA, 2084 bp, Homo sapiens
acagaatcaagagagctcggcattaaggcagagaggagaaaaaggaaaaggaggccaaaaaagctgactctgaaaggttacaaacaatattggtgcaccttcaaagacacatccatttcttgttataagagcaaagaagaatccagtggcacaccagctcatcagatgaacctcaggggatgtgaagttaccccagatgtaaacatttcaggccaaaaatttaacattaaactcctgattccagttgcagaaggcatgaatgaaatctggcttcgttgtgacaatgaaaaacagtatgcacactggatggcagcctgcagattagcctccaaaggcaagaccatggcggacagttcttacaacttagaagttcagaatattctttcctttctgaagatgcagcatttaaacccagatcctcagttaataccagagcagatcacgactgatataactcctgaatgtttggtgtctccccgctatctaaaaaagtataagaacaagcagccaggctatataagagatttgataacagcgagaatcttggaggcccatcagaatgtagctcagatgagtctaattgaagccaagatgagatttattcaagcttggcagtcactacctgaatttggcatcactcacttcattgcaaggttccaagggggcaaaaaagaagaacttattggaattgcatacaacagactgattcggatggatgccagcactggagatgcaattaaaacatggcgtttcagcaacatgaaacagtggaatgtcaactgggaaatcaaaatggtcaccgtagagtttgcagatgaagtacgattgtccttcatttgtactgaagtagattgcaaagtggttcatgaattcattggtggctacatatttctctcaacacgtgcaaaagaccaaaacgagagtttagatgaagagatgttctacaaacttaccagtggttgggtgtgaatagaaatactgtttaatgaaactccacggccataacaatatttaactttaaaagctgtttgttatatgctgcttaataaagtaagcttgaaatttatcattttatcatgaaaacttctttgccttaccagaccagttaatatgtgcactaaacaagcacgactattaatctatcatgttatgatataataaacttgaatttggcacacattccttagggccatgaattgaaaactgaaatagtgggcaaatcaggaacaaaccatcactgatttactgatttaagctagccaaactgtaagaaacaagccatctattttaaagctatccagggcttaacctatatgaactctatttatcatgtctaatgcatgtgatttaatgtatgtttaatttgatatcatgttttaaaatatcctacttctggtagccatttaattcctccccctacccccaaataaatcaggcatgcaggaggcctgatatttagtaatgtcattgtgtttgaccttgaaggaaaatgctattagtccgtcgtgcttgatttgtttttgtccttgaataagcatgttatgtatattgtctcgtgtttttatttttacaccatattgtattacacttttagtattcaccagcataatcactgtctgcctaaaatatgcaactctttgcattacaatatgaagtaaagttctatgaagtatgcattttgtgtaactaatgtaaaaacacaaattttataaaattgtacagttttttaaaaactactcacaactagcagatggcttaaatgtagcaatctctgcgttaattaaatgcctttaagagatataattaacgtgcagttttaatatctactaaattaagaatgacttcattatgatcatgatttgccacaatgtccttaactctaatgcctggactggccatgttctagtctgttgcgctgttacaatctgtattggtgctagtcagaaaattcctagctcacatagcccaaaagggtgcgagggagaggtggattaccagtattgttcaataatccatggttcaaagactgtataaatgcattttattttaaataaaagcaaaacttttatttaataaatattttt

SEQ ID NO: 330207 - DNA, 2355 bp, Homo sapiens
aggagggagccagcgcgcccagcccagccaggctcggacagagggggcggggagagggtggagcgcggggagccaggcgaggggccgcgacgacgggactccattagccgctccggccacaggcagcgcttcgccagccgaggaaccggacgcggacaccgccgccccgcgagcctccagcccctcgcctgttgccgcgcgagtcccgggcccggagcgctaggagcgcgcggaaggagccatggctctggacgggataaggatgccagatggctgctacgcggacgggacgtgggaactgagtgtccatgtgacggacctgaaccgcgatgtcaccctgagagtgaccggcgaggtgcacattggaggcgtgatgcttaagctggtggagaaactcgatgtaaaaaaagattggtctgaccatgctctctggtgggaaaagaagagaacttggcttctgaagacacattggaccttagataagtatggtattcaggcagatgctaagcttcagttcacccctcagcacaaactgctccgcctgcagcttcccaacatgaagtatgtgaaggtgaaagtgaatttctctgatagagtcttcaaagctgtttctgacatctgtaagacttttaatatcagacaccccgaagaactttctctcttaaagaaacccagagatccaacaaagaaaaaaaagaagaagctagatgaccagtctgaagatgaggcacttgaattagaggggcctcttatcactcctggatcaggaagtatatattcaagcccaggactgtatagtaaaacaatgacccccacttatgatgctcatgatggaagccccttgtcaccaacttctgcttggtttggtgacagtgctttgtcagaaggcaatcctggtatacttgctgtcagtcaaccaatcacgtcaccagaaatcttggcaaaaatgttcaagcctcaagctcttcttgataaagcaaaaatcaaccaaggatggcttgattcctcaagatctctcatggaacaagatgtgaaggaaaatgaggccttgctgctccgattcaagtattacagcttttttgatttgaatccaaagtatgatgcaatcagaatcaatcagctttacgagcaggccaaatgggccattctcctggaagagattgaatgcacagaagaagaaatgatgatgtttgcagccctgcagtatcatatcaataagctgtcaatcatgacatcagagaatcatttgaacaacagtgacaaagaagttgatgaagttgatgctgccctttcagacctggagattactctggaagggggtaaaacgtcaacaattttgggtgacattacttccattcctgaacttgctgactacattaaagttttcaagccaaaaaagctgactctgaaaggttacaaacaatattggtgcaccttcaaagacacatccatttcttgttataagagcaaagaagaatccagtggcacaccagctcatcagatgaacctcaggggatgtgaagttaccccagatgtaaacatttcaggccaaaaatttaacattaaactcctgattccagttgcagaaggcatgaatgaaatctggcttcgttgtgacaatgaaaaacagtatgcacactggatggcagcctgcagattagcctccaaaggcaagaccatggcggacagttcttacaacttagaagttcagaatattctttcctttctgaagatgcagcatttaaacccagatcctcagttaataccagagcagatcacgactgatataactcctgaatgtttggtgtctccccgctatctaaaaaagtataagaacaagcagccaggctatataagagatttggtaagttctccatatttaccacaaaagaaaaagaataaataaaaattcatagccacaaccttccctcatggaatttaccccagtagtgaaatttaaatttaaaatagaaatgattatggtgatttcaagtaccttaaagctgctaacaaatattcctgctagaaacatgtattccaggtattcattctgattatagacatagtgctaaatttaattaaaactcgtgtatatgtggattagaatgtgctgttctgtaatagtagtaccgttaggtgtatgcatttggaatatgtctcaagtgtggcaactatgtactcctaatagtactttttgttgatatgaaaactgaaattaagacttattttgagatttcaactcttacaatatgattttggggtacggggtgcgtaattcaatcttttgatcttttgtctcagttctcccatgagagaataatgttcaatggtaaaggtgatgtttactcatgttta

SEQ ID NO: 330208 - DNA, 1897 bp, Homo sapiens
aggagggagccagcgcgcccagcccagccaggctcggacagagggggcggggagagggtggagcgcggggagccaggcgaggggccgcgacgacgggactccattagccgctccggccacaggcagcgcttcgccagccgaggaaccggacgcggacaccgccgccccgcgagcctccagcccctcgcctgttgccgcgcgagtcccgggcccggagcgctaggagcgcgcggaaggagccatggctctggacgggataaggatgccagatggctgctacgcggacgggacgtgggaactgagtgtccatgtgacggacctgaaccgcgatgtcaccctgagagtgaccggcgaggtgcacattggaggcgtgatgcttaagctggtggagaaactcgatgtaaaaaaagattggtctgaccatgctctctggtgggaaaagaagagaacttggcttctgaagacacattggaccttagataagtatggtattcaggcagatgctaagcttcagttcacccctcagcacaaactgctccgcctgcagcttcccaacatgaagtatgtgaaggtgaaagtgaatttctctgatagagtcttcaaagctgtttctgacatctgtaagacttttaatatcagacaccccgaagaactttctctcttaaagaaacccagagatccaacaaagaaaaaaaagaagaagctagatgaccagtctgaagatgaggcacttgaattagaggggcctcttatcactcctggatcaggaagtatatattcaagcccaggactgtatagtaaaacaatgacccccacttatgatgctcatgatggaagccccttgtcaccaacttctgcttggtttggtgacagtgctttgtcagaaggcaatcctggtatacttgctgtcagtcaaccaatcacgtcaccagaaatcttggcaaaaatgttcaagcctcaagctcttcttgataaagcaaaaatcaaccaaggatggcttgattcctcaagatctctcatggaacaagatgtgaaggaaaatgaggccttgctgctccgattcaagtattacagcttttttgatttgaatccaaagtatgatgcaatcagaatcaatcagctttacgagcaggccaaatgggccattctcctggaagagattgaatgcacagaagaagaaatgatgatgtttgcagccctgcagtatcatatcaataagctgtcaatcatgacatcagagaatcatttgaacaacagtgacaaagaagttgatgaagttgatgctgccctttcagacctggagattactctggaagggggtaaaacgtcaacaattttgggtgacattacttccattcctgaacttgctgactacattaaagttttcaagccaaaaaagctgactctgaaaggttacaaacaatattggtgcaccttcaaagacacatccatttcttgttataagagcaaagaagaatccagtggcacaccagctcatcagatgaacctcaggggatgtgaagttaccccagatgtaaacatttcaggccaaaaatttaacattaaactcctgattccagttgcagaaggcatgaatgaaatctggcttcgttgtgacaatgaaaaacagtatgcacactggatggcagcctgcagattagcctccaaaggcaagaccatggcggacagttcttacaacttagaagttcagaatattctttcctttctgaagatgcagcatttaaacccagatcctcagttaataccagagcagatcacgactgatataactcctgaatgtttggtgtctccaccctttgcttggtttaagtatttatggattgttattataggacatagtagtagcggtggtcagacatggaaatggttgggagac

SEQ ID NO: 330209 - DNA, 483 bp, Homo sapiens
tagcaattattttaataaaataattctggtttcagtatcatatcaataagctgtcaatcatgacatcagagaatcatttgaacaacagtgacaaagaagttgatgaagttgatgctgccctttcagacctggagattactctggaagggggtaaaacgtcaacaattttggtagggtgaatctttttttttacctactaatttagcttgaattgatgcattccattttgtggatttaggttcaaagtatttgggggtggtggagagaaatatttaatgctttagagagagaaatcagatgttaatttttcaggaactttgagcaaagtggtttattttgagacagggtctcgttctgttgcccaggctggagtgcagtggcacacgtcataggtcactgcattctcaaactccagggctcaagccatttcctacctcagcctcctgagtagctgagactacaaccatgcaccaccacacctgg

SEQ ID NO: 330210 - DNA, 3399 bp, Homo sapiens
aggagggagccagcgcgcccagcccagccaggctcggacagagggggcggggagagggtggagcgcggggagccaggcgaggggccgcgacgacgggactccattagccgctccggccacaggcagcgcttcgccagccgaggaaccggacgcggacaccgccgccccgcgagcctccagcccctcgcctgttgccgcgcgagtcccgggcccggagcgctaggagcgcgcggaaggagccatggctctggacgggataaggatgccagatggctgctacgcggacgggacgtgggaactgagtgtccatgtgacggacctgaaccgcgatgtcaccctgagagtgaccggcgaggtgcacattggaggcgtgatgcttaagctggtggagaaactcgatgtaaaaaaagattggtctgaccatgctctctggtgggaaaagaagagaacttggcttctgaagacacattggaccttagataagtatggtattcaggcagatgctaagcttcagttcacccctcagcacaaactgctccgcctgcagcttcccaacatgaagtatgtgaaggtgaaagtgaatttctctgatagagtcttcaaagctgtttctgacatctgtaagacttttaatatcagacaccccgaagaactttctctcttaaagaaacccagagatccaacaaagaaaaaaaagaagaagctagatgaccagtctgaagatgaggcacttgaattagaggggcctcttatcactcctggatcaggaagtatatattcaagcccaggactgtatagtaaaacaatgacccccacttatgatgctcatgatggaagccccttgtcaccaacttctgcttggtttggtgacagtgctttgtcagaaggcaatcctggtatacttgctgtcagtcaaccaatcacgtcaccagaaatcttggcaaaaatgttcaagcctcaagctcttcttgataaagcaaaaatcaaccaaggatggcttgattcctcaagatctctcatggaacaagatgtgaaggaaaatgaggccttgctgctccgattcaagtattacagcttttttgatttgaatccaaagtatgatgcaatcagaatcaatcagctttacgagcaggccaaatgggccattctcctggaagagattgaatgcacagaagaagaaatgatgatgtttgcagccctgcagtatcatatcaataagctgtcaatcatgacatcagagaatcatttgaacaacagtgacaaagaagttgatgaagttgatgctgccctttcagacctggagattactctggaagggggtaaaacgtcaacaattttgggtgacattacttccattcctgaacttgctgactacattaaagttttcaagccaaaaaagctgactctgaaaggttacaaacaatattggtgcaccttcaaagacacatccatttcttgttataagagcaaagaagaatccagtggcacaccagctcatcagatgaacctcaggggatgtgaagttaccccagatgtaaacatttcaggccaaaaatttaacattaaactcctgattccagttgcagaaggcatgaatgaaatctggcttcgttgtgacaatgaaaaacagtatgcacactggatggcagcctgcagattagcctccaaaggcaagaccatggcggacagttcttacaacttagaagttcagaatattctttcctttctgaagatgcagcatttaaacccagatcctcagttaataccagagcagatcacgactgatataactcctgaatgtttggtgtctccccgctatctaaaaaagtataagaacaagcagataacagcgagaatcttggaggcccatcagaatgtagctcagatgagtctaattgaagccaagatgagatttattcaagcttggcagtcactacctgaatttggcatcactcacttcattgcaaggttccaagggggcaaaaaagaagaacttattggaattgcatacaacagactgattcggatggatgccagcactggagatgcaattaaaacatggcgtttcagcaacatgaaacagtggaatgtcaactgggaaatcaaaatggtcaccgtagagtttgcagatgaagtacgattgtccttcatttgtactgaagtagattgcaaagtggttcatgaattcattggtggctacatatttctctcaacacgtgcaaaagaccaaaacgagagtttagatgaagagatgttctacaaacttaccagtggttgggtgtgaatagaaatactgtttaatgaaactccacggccataacaatatttaactttaaaagctgtttgttatatgctgcttaataaagtaagcttgaaatttatcattttatcatgaaaacttctttgccttaccagaccagttaatatgtgcactaaacaagcacgactattaatctatcatgttatgatataataaacttgaatttggcacacattccttagggccatgaattgaaaactgaaatagtgggcaaatcaggaacaaaccatcactgatttactgatttaagctagccaaactgtaagaaacaagccatctattttaaagctatccagggcttaacctatatgaactctatttatcatgtctaatgcatgtgatttaatgtatgtttaatttgatatcatgttttaaaatatcctacttctggtagccatttaattcctccccctacccccaaataaatcaggcatgcaggaggcctgatatttagtaatgtcattgtgtttgaccttgaaggaaaatgctattagtccgtcgtgcttgatttgtttttgtccttgaataagcatgttatgtatattgtctcgtgtttttatttttacaccatattgtattacacttttagtattcaccagcataatcactgtctgcctaaaatatgcaactctttgcattacaatatgaagtaaagttctatgaagtatgcattttgtgtaactaatgtaaaaacacaaattttataaaattgtacagttttttaaaaactactcacaactagcagatggcttaaatgtagcaatctctgcgttaattaaatgcctttaagagatataattaacgtgcagttttaatatctactaaattaagaatgacttcattatgatcatgatttgccacaatgtccttaactctaatgcctggactggccatgttctagtctgttgcgctgttacaatctgtattggtgctagtcagaaaattcctagctcacatagcccaaaagggtgcgagggagaggtggattaccagtattgttcaataatccatggttcaaagactgtataaatgcattttattttaaataaaagcaaaacttttatttaataaatattttt

SEQ ID NO: 330211 - DNA, 3082 bp, Homo sapiens
agtgttctttacctccagtcaactcttgattatggtaatagttatatctcatttggggctcaagaggatcctaaaacaaaaatgtaaaaaaagattggtctgaccatgctctctggtgggaaaagaagagaacttggcttctgaagacacattggaccttagataagtatggtattcaggcagatgctaagcttcagttcacccctcagcacaaactgctccgcctgcagcttcccaacatgaagtatgtgaaggtgaaagtgaatttctctgatagagtcttcaaagctgtttctgacatctgtaagacttttaatatcagacaccccgaagaactttctctcttaaagaaacccagagatccaacaaagaaaaaaaagaagaagctagatgaccagtctgaagatgaggcacttgaattagaggggcctcttatcactcctggatcaggaagtatatattcaagcccaggactgtatagtaaaacaatgacccccacttatgatgctcatgatggaagccccttgtcaccaacttctgcttggtttggtgacagtgctttgtcagaaggcaatcctggtatacttgctgtcagtcaaccaatcacgtcaccagaaatcttggcaaaaatgttcaagcctcaagctcttcttgataaagcaaaaatcaaccaaggatggcttgattcctcaagatctctcatggaacaagatgtgaaggaaaatgaggccttgctgctccgattcaagtattacagcttttttgatttgaatccaaagtatgatgcaatcagaatcaatcagctttacgagcaggccaaatgggccattctcctggaagagattgaatgcacagaagaagaaatgatgatgtttgcagccctgcagtatcatatcaataagctgtcaatcatgacatcagagaatcatttgaacaacagtgacaaagaagttgatgaagttgatgctgccctttcagacctggagattactctggaagggggtaaaacgtcaacaattttgggtgacattacttccattcctgaacttgctgactacattaaagttttcaagccaaaaaagctgactctgaaaggttacaaacaatattggtgcaccttcaaagacacatccatttcttgttataagagcaaagaagaatccagtggcacaccagctcatcagatgaacctcaggggatgtgaagttaccccagatgtaaacatttcaggccaaaaatttaacattaaactcctgattccagttgcagaaggcatgaatgaaatctggcttcgttgtgacaatgaaaaacagtatgcacactggatggcagcctgcagattagcctccaaaggcaagaccatggcggacagttcttacaacttagaagttcagaatattctttcctttctgaagatgcagcatttaaacccagatcctcagttaataccagagcagatcacgactgatataactcctgaatgtttggtgtctccccgctatctaaaaaagtataagaacaagcagataacagcgagaatcttggaggcccatcagaatgtagctcagatgagtctaattgaagccaagatgagatttattcaagcttggcagtcactacctgaatttggcatcactcacttcattgcaaggttccaagggggcaaaaaagaagaacttattggaattgcatacaacagactgattcggatggatgccagcactggagatgcaattaaaacatggcgtttcagcaacatgaaacagtggaatgtcaactgggaaatcaaaatggtcaccgtagagtttgcagatgaagtacgattgtccttcatttgtactgaagtagattgcaaagtggttcatgaattcattggtggctacatatttctctcaacacgtgcaaaagaccaaaacgagagtttagatgaagagatgttctacaaacttaccagtggttgggtgtgaatagaaatactgtttaatgaaactccacggccataacaatatttaactttaaaagctgtttgttatatgctgcttaataaagtaagcttgaaatttatcattttatcatgaaaacttctttgccttaccagaccagttaatatgtgcactaaacaagcacgactattaatctatcatgttatgatataataaacttgaatttggcacacattccttagggccatgaattgaaaactgaaatagtgggcaaatcaggaacaaaccatcactgatttactgatttaagctagccaaactgtaagaaacaagccatctattttaaagctatccagggcttaacctatatgaactctatttatcatgtctaatgcatgtgatttaatgtatgtttaatttgatatcatgttttaaaatatcctacttctggtagccatttaattcctccccctacccccaaataaatcaggcatgcaggaggcctgatatttagtaatgtcattgtgtttgaccttgaaggaaaatgctattagtccgtcgtgcttgatttgtttttgtccttgaataagcatgttatgtatattgtctcgtgtttttatttttacaccatattgtattacacttttagtattcaccagcataatcactgtctgcctaaaatatgcaactctttgcattacaatatgaagtaaagttctatgaagtatgcattttgtgtaactaatgtaaaaacacaaattttataaaattgtacagttttttaaaaactactcacaactagcagatggcttaaatgtagcaatctctgcgttaattaaatgcctttaagagatataattaacgtgcagttttaatatctactaaattaagaatgacttcattatgatcatgatttgccacaatgtccttaactctaatgcctggactggccatgttctagtctgttgcgctgttacaatctgtattggtgctagtcagaaaattcctagctcacatagcccaaaagggtgcgagggagaggtggattaccagtattgttcaataatccatggttcaaagactgtataaatgcattttattttaaataaaagcaaaacttttatttaataaatattttt

SEQ ID NO: 330212 - DNA, 3420 bp, Homo sapiens
aggagggagccagcgcgcccagcccagccaggctcggacagagggggcggggagagggtggagcgcggggagccaggcgaggggccgcgacgacgggactccattagccgctccggccacaggcagcgcttcgccagccgaggaaccggacgcggacaccgccgccccgcgagcctccagcccctcgcctgttgccgcgcgagtcccgggcccggagcgctaggagcgcgcggaaggagccatggctctggacgggataaggatgccagatggctgctacgcggacgggacgtgggaactgagtgtccatgtgacggacctgaaccgcgatgtcaccctgagagtgaccggcgaggtgcacattggaggcgtgatgcttaagctggtggagaaactcgatgtaaaaaaagattggtctgaccatgctctctggtgggaaaagaagagaacttggcttctgaagacacattggaccttagataagtatggtattcaggcagatgctaagcttcagttcacccctcagcacaaactgctccgcctgcagcttcccaacatgaagtatgtgaaggtgaaagtgaatttctctgatagagtcttcaaagctgtttctgacatctgtaagacttttaatatcagacaccccgaagaactttctctcttaaagaaacccagagatccaacaaagaaaaaaaagaagaagctagatgaccagtctgaagatgaggcacttgaattagaggggcctcttatcactcctggatcaggaagtatatattcaagcccaggactgtatagtaaaacaatgacccccacttatgatgctcatgatggaagccccttgtcaccaacttctgcttggtttggtgacagtgctttgtcagaaggcaatcctggtatacttgctgtcagtcaaccaatcacgtcaccagaaatcttggcaaaaatgttcaagcctcaagctcttcttgataaagcaaaaatcaaccaaggatggcttgattcctcaagatctctcatggaacaagatgtgaaggaaaatgaggccttgctgctccgattcaagtattacagcttttttgatttgaatccaaagtatgatgcaatcagaatcaatcagctttacgagcaggccaaatgggccattctcctggaagagattgaatgcacagaagaagaaatgatgatgtttgcagccctgcagtatcatatcaataagctgtcaatcatgacatcagagaatcatttgaacaacagtgacaaagaagttgatgaagttgatgctgccctttcagacctggagattactctggaagggggtaaaacgtcaacaattttgggtgacattacttccattcctgaacttgctgactacattaaagttttcaagccaaaaaagctgactctgaaaggttacaaacaatattggtgcaccttcaaagacacatccatttcttgttataagagcaaagaagaatccagtggcacaccagctcatcagatgaacctcaggggatgtgaagttaccccagatgtaaacatttcaggccaaaaatttaacattaaactcctgattccagttgcagaaggcatgaatgaaatctggcttcgttgtgacaatgaaaaacagtatgcacactggatggcagcctgcagattagcctccaaaggcaagaccatggcggacagttcttacaacttagaagttcagaatattctttcctttctgaagatgcagcatttaaacccagatcctcagttaataccagagcagatcacgactgatataactcctgaatgtttggtgtctccccgctatctaaaaaagtataagaacaagcagccaggctatataagagatttgataacagcgagaatcttggaggcccatcagaatgtagctcagatgagtctaattgaagccaagatgagatttattcaagcttggcagtcactacctgaatttggcatcactcacttcattgcaaggttccaagggggcaaaaaagaagaacttattggaattgcatacaacagactgattcggatggatgccagcactggagatgcaattaaaacatggcgtttcagcaacatgaaacagtggaatgtcaactgggaaatcaaaatggtcaccgtagagtttgcagatgaagtacgattgtccttcatttgtactgaagtagattgcaaagtggttcatgaattcattggtggctacatatttctctcaacacgtgcaaaagaccaaaacgagagtttagatgaagagatgttctacaaacttaccagtggttgggtgtgaatagaaatactgtttaatgaaactccacggccataacaatatttaactttaaaagctgtttgttatatgctgcttaataaagtaagcttgaaatttatcattttatcatgaaaacttctttgccttaccagaccagttaatatgtgcactaaacaagcacgactattaatctatcatgttatgatataataaacttgaatttggcacacattccttagggccatgaattgaaaactgaaatagtgggcaaatcaggaacaaaccatcactgatttactgatttaagctagccaaactgtaagaaacaagccatctattttaaagctatccagggcttaacctatatgaactctatttatcatgtctaatgcatgtgatttaatgtatgtttaatttgatatcatgttttaaaatatcctacttctggtagccatttaattcctccccctacccccaaataaatcaggcatgcaggaggcctgatatttagtaatgtcattgtgtttgaccttgaaggaaaatgctattagtccgtcgtgcttgatttgtttttgtccttgaataagcatgttatgtatattgtctcgtgtttttatttttacaccatattgtattacacttttagtattcaccagcataatcactgtctgcctaaaatatgcaactctttgcattacaatatgaagtaaagttctatgaagtatgcattttgtgtaactaatgtaaaaacacaaattttataaaattgtacagttttttaaaaactactcacaactagcagatggcttaaatgtagcaatctctgcgttaattaaatgcctttaagagatataattaacgtgcagttttaatatctactaaattaagaatgacttcattatgatcatgatttgccacaatgtccttaactctaatgcctggactggccatgttctagtctgttgcgctgttacaatctgtattggtgctagtcagaaaattcctagctcacatagcccaaaagggtgcgagggagaggtggattaccagtattgttcaataatccatggttcaaagactgtataaatgcattttattttaaataaaagcaaaacttttatttaataaatattttt

SEQ ID NO: 330213 - DNA, 1616 bp, Homo sapiens
tcgaggctgacctagaggatccccaaacaccgcaatctaaaaaagtataagaacaagcagataacagcgagaatcttggaggcccatcagaatgtagctcagatgagtctaattgaagccaagatgagatttattcaagcttggcagtcactacctgaatttggcatcactcacttcattgcaaggttccaagggggcaaaaaagaagaacttattggaattgcatacaacagactgattcggatggatgccagcactggagatgcaattaaaacatggcgtttcagcaacatgaaacagtggaatgtcaactgggaaatcaaaatggtcaccgtagagtttgcagatgaagtacgattgtccttcatttgtactgaagtagattgcaaagtggttcatgaattcattggtggctacatatttctctcaacacgtgcaaaagaccaaaacgagagtttagatgaagagatgttctacaaacttaccagtggttgggtgtgaatagaaatactgtttaatgaaactccacggccataacaatatttaactttaaaagctgtttgttatatgctgcttaataaagtaagcttgaaatttatcattttatcatgaaaacttctttgccttaccagaccagttaatatgtgcactaaacaagcacgactattaatctatcatgttatgatataataaacttgaatttggcacacattccttagggccatgaattgaaaactgaaatagtgggcaaatcaggaacaaaccatcactgatttactgatttaagctagccaaactgtaagaaacaagccatctattttaaagctatccagggcttaacctatatgaactctatttatcatgtctaatgcatgtgatttaatgtatgtttaatttgatatcatgttttaaaatatcctacttctggtagccatttaattcctccccctacccccaaataaatcaggcatgcaggaggcctgatatttagtaatgtcattgtgtttgaccttgaaggaaaatgctattagtccgtcgtgcttgatttgtttttgtccttgaataagcatgttatgtatattgtctcgtgtttttatttttacaccatattgtattacacttttagtattcaccagcataatcactgtctgcctaaaatatgcaactctttgcattacaatatgaagtaaagttctatgaagtatgcattttgtgtaactaatgtaaaaacacaaattttataaaattgtacagttttttaaaaactactcacaactagcagatggcttaaatgtagcaatctctgcgttaattaaatgcctttaagagatataattaacgtgcagttttaatatctactaaattaagaatgacttcattatgatcatgatttgccacaatgtccttaactctaatgcctggactggccatgttctagtctgttgcgctgttacaatctgtattggtgctagtcagaaaattcctagctcacatagcccaaaagggtgcgagggagaggtggattaccagtattgttcaataatccatggttcaaagactgtataaatgcattttattttaaataaaagcaaaacttttatttaataaatattttt

SEQ ID NO: 330214 - DNA, 2409 bp, Homo sapiens
aggagggagccagcgcgcccagcccagccaggctcggacagagggggcggggagagggtggagcgcggggagccaggcgaggggccgcgacgacgggactccattagccgctccggccacaggcagcgcttcgccagccgaggaaccggacgcggacaccgccgccccgcgagcctccagcccctcgcctgttgccgcgcgagtcccgggcccggagcgctaggagcgcgcggaaggagccatggctctggacgggataaggatgccagatggctgctacgcggacgggacgtgggaactgagtgtccatgtgacggacctgaaccgcgatgtcaccctgagagtgaccggcgaggtgcacattggaggcgtgatgcttaagctggtggagaaactcgatgtaaaaaaagattggtctgaccatgctctctggtgggaaaagaagagaacttggcttctgaagacacattggaccttagataagtatggtattcaggcagatgctaagcttcagttcacccctcagcacaaactgctccgcctgcagcttcccaacatgaagtatgtgaaggtgaaagtgaatttctctgatagagtcttcaaagctgtttctgacatctgtaagacttttaatatcagacaccccgaagaactttctctcttaaagaaacccagagatccaacaaagaaaaaaaagaagaagctagatgaccagtctgaagatgaggcacttgaattagaggggcctcttatcactcctggatcaggaagtatatattcaagcccaggactgtatagtaaaacaatgacccccacttatgatgctcatgatggaagccccttgtcaccaacttctgcttggtttggtgacagtgctttgtcagaaggcaatcctggtatacttgctgtcagtcaaccaatcacgtcaccagaaatcttggcaaaaatgttcaagcctcaagctcttcttgataaagcaaaaatcaaccaaggatggcttgattcctcaagatctctcatggaacaagatgtgaaggaaaatgaggccttgctgctccgattcaagtattacagcttttttgatttgaatccaaagtatgatgcaatcagaatcaatcagctttacgagcaggccaaatgggccattctcctggaagagattgaatgcacagaagaagaaatgatgatgtttgcagccctgcagtatcatatcaataagctgtcaatcatgacatcagagaatcatttgaacaacagtgacaaagaagttgatgaagttgatgctgccctttcagacctggagattactctggaagggggtaaaacgtcaacaattttgggtgacattacttccattcctgaacttgctgactacattaaagttttcaagccaaaaaagctgactctgaaaggttacaaacaatattggtgcaccttcaaagacacatccatttcttgttataagagcaaagaagaatccagtggcacaccagctcatcagatgaacctcaggggatgtgaagttaccccagatgtaaacatttcaggccaaaaatttaacattaaactcctgattccagttgcagaaggcatgaatgaaatctggcttcgttgtgacaatgaaaaacagtatgcacactggatggcagcctgcagattagcctccaaaggcaagaccatggcggacagttcttacaacttagaagttcagaatattctttcctttctgaagatgcagcatttaaacccagatcctcagttaataccagagcagatcacgactgatataactcctgaatgtttggtgtctccccgctatctaaaaaagtataagaacaagcagccaggctatataagagatttggtaagttctccatatttaccacaaaagaaaaagaataaataaaaattcatagccacaaccttccctcatggaatttaccccagtagtgaaatttaaatttaaaatagaaatgattatggtgatttcaagtaccttaaagctgctaacaaatattcctgctagaaacatgtattccaggtattcattctgattatagacatagtgctaaatttaattaaaactcgtgtatatgtggattagaatgtgctgttctgtaatagtagtaccgttaggtgtatgcatttggaatatgtctcaagtgtggcaactatgtactcctaatagtactttttgttgatatgaaaactgaaattaagacttattttgaaaaatccttatacattacattattacagtgtccaaatgtagcttcagatattttgatttcaactcttacaatatgattttggggtacggggtgcgtaattcaatcttttgatcttttgtctcagttctcccatgagagaataatgttcaatggtaaaggtgatgtttactcatgttta

SEQ ID NO: 330215 - DNA, 839 bp, Homo sapiens
aggagggagccagcgcgcccagcccagccaggctcggacagagggggcggggagagggtggagcgcggggagccaggcgaggggccgcgacgacgggactccattagccgctccggccacaggcagcgcttcgccagccgaggaaccggacgcggacaccgccgccccgcgagcctccagcccctcgcctgttgccgcgcgagtcccgggcccggagcgctaggagcgcgcggaaggagccatggctctggacgggataaggatgccagatggctgctacgcggacgggacgtgggaactgagtgtccatgtgacggacctgaaccgcgatgtcaccctgagagtgaccggcgaggtgcacattggaggcgtgatgcttaagctggtggagaaactcgatgtaaaaaaagattggtctgaccatgctctctggtgggaaaagaagagaacttggcttctgaagacacattggaccttagataagtatggtattcaggcagatgctaagcttcagttcacccctcagcacaaactgctccgcctgcagcttcccaacatgaagtatgtgaaggtgaaagtgaatttctctgatagagtcttcaaagctgtttctgacatctgtaagacttttaatatcagacaccccgaagaactttctctcttaaagaaacccagagatccaacaaagaaaaaaaagaagaagctagatgaccagtctgaagatgaggcacttgaattagaggggcctcttatcactcctggatcaggaagtatatattcagccccggactgtatgtaaccatgacccccaccgagagagctcggatcctcagatcgac

SEQ ID NO: 330216 - DNA, 793 bp, Homo sapiens
acagcacataccattataaacgccacacgtaacccattcatctcctgaaatttatgtcagaaagattggaaataaaatctatattaacagcaagtgcttaatatcaagatgcggtattaaaaataacaaaaattttcattcctgtaatactaagaggctctcttaactccatttaacagacacacagtgccacctatcagccatcctctgtaactgcaggtgcaaggtaaagaaccgctcatagacatgccttcccctctccctgctatttacatgccaaagaccaccacaggttaagaggacagccctattagaagcccctgctgtttctatattgtgttcttgaaaagttttacttccttaggaactggagctttttactgctgaactgaacccagagattgcaatcccagcgaagtctgaacaaatctatgtctaaaatacgggctgttatgatacccaacagtgtcctaggagaaatccaagccaatctccaggtccagccctcaacagccgcctgatgggaagagacataacaattaatggcaaatttcttacaaggattacccacacgtcttctttcctctaactacctcctcttcggcctgcaactgctgtgatttggcctctgcccagcttctctcacaaggctgctcacccctgtgtggtgaacccaagggctacctcttgaccctcatcctgtgtgacctctcagtgccacttaacagggccccctggcttctagagttttctttctcttctcaggcgactccttcttgacttccgtgacagt

SEQ ID NO: 330217 - DNA, 382 bp, Homo sapiens
ccctccaacaaacatgccttttcccttaccttgctttttttaaattgtattcatcactgtctagcatattatttattgtttgtcgtccctgcctgtagtaaccccactccatcctgcagccccaagaatgtaacctccatgaggccagagattatttttcttttattcactgctgtattccaagaacctggaacagtgtctgtagcaggtgctcaaatatgtttaccagaaggaatgataggtcatgtgggaccctcaagtttggggttcattttttagtcactcagaatagtactgatctgtctgcccatgttgtcatacacacagtcacagcatggcagcaatggggtactaactagaaagagccatgaatttaggtttt

SEQ ID NO: 330218 - DNA, 1917 bp, Homo sapiens
tccccgtgcgcacgcgcgaacgcggggtgggccgggcctcgcgtagcccatctcctcttcctcctcgcggtcgcggccggacggagggtggagggccctgcgcctgcgcggagctggagtccggctgggccgcagccgctgggagaccggcggttgccgtggggaccggtcgggcccctccctcctccggtcccccgccccaggtccttccccaccgagacgcgccggcggaccgcgggcgagtgcagccggtgacccggcgagaggcggcgccgctcccaagatgtcgcagacggccatgtccgaaacctacgattttttgtttaagttcttggttattggaaatgcaggaactggcaaatcttgcttacttcatcagtttattgaaaaaaaattcaaagatgactcaaatcatacaataggagtggaatttggttcaaagataataaatgttggtggtaaatatgtaaagttacaaatatgggatacagcaggacaagaacgattcaggtccgtgacgagaagttattaccgaggcgcggccggggctctcctcgtctatgatatcaccagccgagaaacctacaatgcgcttactaattggttaacagatgcccgaatgctagcgagccagaacattgtgatcatcctttgtggaaacaagaaggacctggatgcagatcgtgaagttaccttcttagaagcctccagatttgctcaagaaaatgagctgatgtttttggaaacaagtgcgctcacaggggagaatgtagaagaggcttttgtacagtgtgcaagaaaaatacttaacaaaatcgaatcaggtgagctggacccagaaagaatgggctcaggtattcagtacggagatgctgccttgagacagctgaggtcaccgcggcgcgcacaggccccgaacgctcaggagtgtggttgttaggagagcacacaggtgttcatacagtggcatttgggacacaatcgttggaacctgaagaatctgaagttttttttaccaccatctttttctactctgtatggaagtagatctttatggggaaaagagaatttggggtgttctgcaagccagtcaaagtggcacagcaaatcatataaatcgaattaaatggacaacaccgttagatgtgtatgtaaaaattttctgtttcatatttttcctttcactttcggtttaaaacatgctatatgtactgtatgtcctgtagcccagtgcggctccacagcatggaatctgatgtatgatatgatagaatgtggcactaaatgcagtttcagattttattttttttaatcatatgaactaaaattgtcaattgtgaggtgtgcttttctcatcatgttggttatattgcacaattggttatatttatgacctgatattcaaagactctggcattgatagccagtgtgttttcttatttaactccgtttactacattctacatggtgtttacgtgatccacacttgaaatactagatcagtagacattcactaatataccaaaataaaatgaaaaattgagtttttccgtgaactttatactgtccagctctgttgattttaaagcctcttcatccaggtcagttcaggaagtatatctggagtacctgctctgtttttggctgtgagactagcactaaggattctggtacctttacccaaacctactgggctactaatacttctctcagcagttgatcaaatacaatagaccatgtaagctggggccgctcatccacttccagtttgctggtctccctgctagaaaacacattgtactgtgctttttctggaattcagtataatggcatcactgcctgtttttcacatcttttgtttcctgttcattttaaggaaacctactaaatccagttaatattaaatggacaccactc

SEQ ID NO: 330219 - DNA, 2658 bp, Homo sapiens
tccccgtgcgcacgcgcgaacgcggggtgggccgggcctcgcgtagcccatctcctcttcctcctcgcggtcgcggccggacggagggtggagggccctgcgcctgcgcggagctggagtccggctgggccgcagccgctgggagaccggcggttgccgtggggaccggtcgggcccctccctcctccggtcccccgccccaggtccttccccaccgagacgcgccggcggaccgcgggcgagtgcagccggtgacccggcgagaggcggcgccgctcccaagatgtcgcagacggccatgtccgaaacctacgattttttgtttaagttcttggttattggaaatgcaggaactggcaaatcttgcttacttcatcagtttattgaaaaaaaattcaaagatgactcaaatcatacaataggagtggaatttggttcaaagataataaatgttggtggtaaatatgtaaagttacaaatatgggatacagcaggacaagaacgattcaggtccgtgacgagaagttattaccgaggcgcggccggggctctcctcgtctatgatatcaccagccgagaaacctacaatgcgcttactaattggttaacagatgcccgaatgctagcgagccagaacattgtgatcatcctttgtggaaacaagaaggacctggatgcagatcgtgaagttaccttcttagaagcctccagatttgctcaagaaaatgagctgatgtttttggaaacaagtgcgctcacaggggagaatgtagaagaggcttttgtacagtgtgcaagaaaaatacttaacaaaatcgaatcaggtgagctggacccagaaagaatgggctcaggtattcagtacggagatgctgccttgagacagctgaggtcaccgcggcgcgcacaggccccgaacgctcaggagtgtggttgttaggagagcacacaggtgttcatacagtggcatttgggacacaatcgttggaacctgaagaatctgaagttttttttaccaccatctttttctactctgtatggaagtagatctttatggggaaaagagaatttggggtgttctgcaagccagtcaaagtggcacagcaaatcatataaatcgaattaaatggacaacaccgttagatgtgtatgtaaaaattttctgtttcatatttttcctttcactttcggtttaaaacatgctatatgtactgtatgtcctgtagcccagtgcggctccacagcatggaatctgatgtatgatatgatagaatgtggcactaaatgcagtttcagattttattttttttaatcatatgaactaaaattgtcaattgtgaggtgtgcttttctcatcatgttggttatattgcacaattggttatatttatgacctgatattcaaagactctggcattgatagccagtgtgttttcttatttaactccgtttactacattctacatggtgtttacgtgatccacacttgaaatactagatcagtagacattcactaatataccaaaataaaatgaaaaattgagtttttccgtgaactttatactgtccagctctgttgattttaaagcctcttcatccaggtcagttcaggaagtatatctggagtacctgctctgtttttggctgtgagactagcactaaggattctggtacctttacccaaacctactgggctactaatacttctctcagcagttgatcaaatacaatagaccatgtaagctggggccgctcatccacttccagtttgctggtctccctgctagaaaacacattgtactgtgctttttctggaattcagtataatggcatcactgcctgtttttcacatcttttgtttcctgttcattttaaggaaacctactaaatccagttaatattaaatggacaccactcattaagaaatttctttatggcttctgctgaatacttaaatgccttactacagttatccagttgacatgtttttaattcatataaggtatattgggtatattgaagtatatattgtattacaaagacttgttcttgtattttaaaatgtcagtgcaaaaaatatatggtggaacctttctttaaagttgaaatgcagtattatttaaatctgaaaggttaaaaagctttcttcaccttatatatgttcttccactgtgactttttagttgaagactagtaaattaacttttagttagaagatgcctactgcttttgttgtttattttaatcagcagagcacagagacacataaaaactctgggaaatgactaggataaaaatatcagtatgtatctgttttagatattttgagttttgctttttttatgccttgaatattttatttcaaaaagtatctgaagcaaattctcagactgaactacttcttagacctcactgtaagaatattttattcaatgtctcatttatgatagatttgcaagctgctcatttttgaacagctttttgcatgggataggagcatgtctattctaacacatcagcttattcaaaagcaagaattttaaaaataagataaatgtaaagttgttttataaacgatcctgttaattaaaccacagacaccatatatccttctgcatcctttggccaataaaagttgctggagaaccaaaaaaaaat

SEQ ID NO: 330220 - DNA, 2734 bp, Homo sapiens
tccccgtgcgcacgcgcgaacgcggggtgggccgggcctcgcgtagcccatctcctcttcctcctcgcggtcgcggccggacggagggtggagggccctgcgcctgcgcggagctggagtccggctgggccgcagccgctgggagaccggcggttgccgtggggaccggtcgggcccctccctcctccggtcccccgccccaggtccttccccaccgagacgcgccggcggaccgcgggcgagtgcagccggtgacccggcgagaggcggcgccgctcccaagatgtcgcagacggccatgtccgaaacctacgagaactcctaccgattcttttgtttaacgttctttgcgcttactctgcgcaactgcacggaacctggcccaacactcttttggcctttacctttccctccacgctttttaccttttcgaaccacacaacaccttttcccacacggactgaccttccaaagttcactaccaacctagcgacgctgcgcactttggcttcaaaagcataataaatgttggtggtaaatatgtaaagttacaaatatgggatacagcaggacaagaacgattcaggtccgtgacgagaagttattaccgaggcgcggccggggctctcctcgtctatgatatcaccagccgagaaacctacaatgcgcttactaattggttaacagatgcccgaatgctagcgagccagaacattgtgatcatcctttgtggaaacaagaaggacctggatgcagatcgtgaagttaccttcttagaagcctccagatttgctcaagaaaatgagctgatgtttttggaaacaagtgcgctcacaggggagaatgtagaagaggcttttgtacagtgtgcaagaaaaatacttaacaaaatcgaatcaggtgagctggacccagaaagaatgggctcaggtattcagtacggagatgctgccttgagacagctgaggtcaccgcggcgcgcacaggccccgaacgctcaggagtgtggttgttaggagagcacacaggtgttcatacagtggcatttgggacacaatcgttggaacctgaagaatctgaagttttttttaccaccatctttttctactctgtatggaagtagatctttatggggaaaagagaatttggggtgttctgcaagccagtcaaagtggcacagcaaatcatataaatcgaattaaatggacaacaccgttagatgtgtatgtaaaaattttctgtttcatatttttcctttcactttcggtttaaaacatgctatatgtactgtatgtcctgtagcccagtgcggctccacagcatggaatctgatgtatgatatgatagaatgtggcactaaatgcagtttcagattttattttttttaatcatatgaactaaaattgtcaattgtgaggtgtgcttttctcatcatgttggttatattgcacaattggttatatttatgacctgatattcaaagactctggcattgatagccagtgtgttttcttatttaactccgtttactacattctacatggtgtttacgtgatccacacttgaaatactagatcagtagacattcactaatataccaaaataaaatgaaaaattgagtttttccgtgaactttatactgtccagctctgttgattttaaagcctcttcatccaggtcagttcaggaagtatatctggagtacctgctctgtttttggctgtgagactagcactaaggattctggtacctttacccaaacctactgggctactaatacttctctcagcagttgatcaaatacaatagaccatgtaagctggggccgctcatccacttccagtttgctggtctccctgctagaaaacacattgtactgtgctttttctggaattcagtataatggcatcactgcctgtttttcacatcttttgtttcctgttcattttaaggaaacctactaaatccagttaatattaaatggacaccactcattaagaaatttctttatggcttctgctgaatacttaaatgccttactacagttatccagttgacatgtttttaattcatataaggtatattgggtatattgaagtatatattgtattacaaagacttgttcttgtattttaaaatgtcagtgcaaaaaatatatggtggaacctttctttaaagttgaaatgcagtattatttaaatctgaaaggttaaaaagctttcttcaccttatatatgttcttccactgtgactttttagttgaagactagtaaattaacttttagttagaagatgcctactgcttttgttgtttattttaatcagcagagcacagagacacataaaaactctgggaaatgactaggataaaaatatcagtatgtatctgttttagatattttgagttttgctttttttatgccttgaatattttatttcaaaaagtatctgaagcaaattctcagactgaactacttcttagacctcactgtaagaatattttattcaatgtctcatttatgatagatttgcaagctgctcatttttgaacagctttttgcatgggataggagcatgtctattctaacacatcagcttattcaaaagcaagaattttaaaaataagataaatgtaaagttgttttataaacgatcctgttaattaaaccacagacaccatatatccttctgcatcctttggccaataaaagttgctggagaaccaaaaaaaaat

SEQ ID NO: 330221 - DNA, 2424 bp, Homo sapiens
tccccgtgcgcacgcgcgaacgcggggtgggccgggcctcgcgtagcccatctcctcttcctcctcgcggtcgcggccggacggagggtggagggccctgcgcctgcgcggagctggagtccggctgggccgcagccgctgggagaccggcggttgccgtggggaccggtcgggcccctccctcctccggtcccccgccccaggtccttccccaccgagacgcgccggcggaccgcgggcgagtgcagccggtgacccggcgagaggcggcgccgctcccaagatgtcgcagacggccatgtccgaaacctacggtccgtgacgagaagttattaccgaggcgcggccggggctctcctcgtctatgatatcaccagatgcccgaatgctagcgagccagaacattgtgatcatcctttgtggaaacaagaaggacctggatgcagatcgtgaagttaccttcttagaagcctccagatttgctcaagaaaatgagctgatgtttttggaaacaagtgcgctcacaggggagaatgtagaagaggcttttgtacagtgtgcaagaaaaatacttaacaaaatcgaatcaggtgagctggacccagaaagaatgggctcaggtattcagtacggagatgctgccttgagacagctgaggtcaccgcggcgcgcacaggccccgaacgctcaggagtgtggttgttaggagagcacacaggtgttcatacagtggcatttgggacacaatcgttggaacctgaagaatctgaagttttttttaccaccatctttttctactctgtatggaagtagatctttatggggaaaagagaatttggggtgttctgcaagccagtcaaagtggcacagcaaatcatataaatcgaattaaatggacaacaccgttagatgtgtatgtaaaaattttctgtttcatatttttcctttcactttcggtttaaaacatgctatatgtactgtatgtcctgtagcccagtgcggctccacagcatggaatctgatgtatgatatgatagaatgtggcactaaatgcagtttcagattttattttttttaatcatatgaactaaaattgtcaattgtgaggtgtgcttttctcatcatgttggttatattgcacaattggttatatttatgacctgatattcaaagactctggcattgatagccagtgtgttttcttatttaactccgtttactacattctacatggtgtttacgtgatccacacttgaaatactagatcagtagacattcactaatataccaaaataaaatgaaaaattgagtttttccgtgaactttatactgtccagctctgttgattttaaagcctcttcatccaggtcagttcaggaagtatatctggagtacctgctctgtttttggctgtgagactagcactaaggattctggtacctttacccaaacctactgggctactaatacttctctcagcagttgatcaaatacaatagaccatgtaagctggggccgctcatccacttccagtttgctggtctccctgctagaaaacacattgtactgtgctttttctggaattcagtataatggcatcactgcctgtttttcacatcttttgtttcctgttcattttaaggaaacctactaaatccagttaatattaaatggacaccactcattaagaaatttctttatggcttctgctgaatacttaaatgccttactacagttatccagttgacatgtttttaattcatataaggtatattgggtatattgaagtatatattgtattacaaagacttgttcttgtattttaaaatgtcagtgcaaaaaatatatggtggaacctttctttaaagttgaaatgcagtattatttaaatctgaaaggttaaaaagctttcttcaccttatatatgttcttccactgtgactttttagttgaagactagtaaattaacttttagttagaagatgcctactgcttttgttgtttattttaatcagcagagcacagagacacataaaaactctgggaaatgactaggataaaaatatcagtatgtatctgttttagatattttgagttttgctttttttatgccttgaatattttatttcaaaaagtatctgaagcaaattctcagactgaactacttcttagacctcactgtaagaatattttattcaatgtctcatttatgatagatttgcaagctgctcatttttgaacagctttttgcatgggataggagcatgtctattctaacacatcagcttattcaaaagcaagaattttaaaaataagataaatgtaaagttgttttataaacgatcctgttaattaaaccacagacaccatatatccttctgcatcctttggccaataaaagttgctggagaaccaaaaaaaaat

SEQ ID NO: 330222 - DNA, 1911 bp, Homo sapiens
caaatgtctccctttaactttttaaagcttcttcttttttcccatttaccacagtggacgttttatttatagtcgacatcatgtagtaggcacaggcaagtgttaaaagacaagatattcacgaattctcttttaggctttaagctgtatttacttttgcatttatagttatgcagattttgaaattgttcttaatattttttaggtgttcatacagtggcatttgggacacaatcgttggaacctgaagaatctgaagttttttttaccaccatctttttctactctgtatggaagtagatctttatggggaaaagagaatttggggtgttctgcaagccagtcaaagtggcacagcaaatcatataaatcgaattaaatggacaacaccgttagatgtgtatgtaaaaattttctgtttcatatttttcctttcactttcggtttaaaacatgctatatgtactgtatgtcctgtagcccagtgcggctccacagcatggaatctgatgtatgatatgatagaatgtggcactaaatgcagtttcagattttattttttttaatcatatgaactaaaattgtcaattgtgaggtgtgcttttctcatcatgttggttatattgcacaattggttatatttatgacctgatattcaaagactctggcattgatagccagtgtgttttcttatttaactccgtttactacattctacatggtgtttacgtgatccacacttgaaatactagatcagtagacattcactaatataccaaaataaaatgaaaaattgagtttttccgtgaactttatactgtccagctctgttgattttaaagcctcttcatccaggtcagttcaggaagtatatctggagtacctgctctgtttttggctgtgagactagcactaaggattctggtacctttacccaaacctactgggctactaatacttctctcagcagttgatcaaatacaatagaccatgtaagctggggccgctcatccacttccagtttgctggtctccctgctagaaaacacattgtactgtgctttttctggaattcagtataatggcatcactgcctgtttttcacatcttttgtttcctgttcattttaaggaaacctactaaatccagttaatattaaatggacaccactcattaagaaatttctttatggcttctgctgaatacttaaatgccttactacagttatccagttgacatgtttttaattcatataaggtatattgggtatattgaagtatatattgtattacaaagacttgttcttgtattttaaaatgtcagtgcaaaaaatatatggtggaacctttctttaaagttgaaatgcagtattatttaaatctgaaaggttaaaaagctttcttcaccttatatatgttcttccactgtgactttttagttgaagactagtaaattaacttttagttagaagatgcctactgcttttgttgtttattttaatcagcagagcacagagacacataaaaactctgggaaatgactaggataaaaatatcagtatgtatctgttttagatattttgagttttgctttttttatgccttgaatattttatttcaaaaagtatctgaagcaaattctcagactgaactacttcttagacctcactgtaagaatattttattcaatgtctcatttatgatagatttgcaagctgctcatttttgaacagctttttgcatgggataggagcatgtctattctaacacatcagcttattcaaaagcaagaattttaaaaataagataaatgtaaagttgttttataaacgatcctgttaattaaaccacagacaccatatatccttctgcatcctttggccaataaaagttgctggagaaccaaaaaaaaat

SEQ ID NO: 330223 - DNA, 973 bp, Homo sapiens
tccccgtgcgcacgcgcgaacgcggggtgggccgggcctcgcgtagcccatctcctcttcctcctcgcggtcgcggccggacggagggtggagggccctgcgcctgcgcggagctggagtccggctgggccgcagccgctgggagaccggcggttgccgtggggaccggtcgggcccctccctcctccggtcccccgccccaggtccttccccaccgagacgcgccggcggaccgcgggcgagtgcagccggtgacccggcgagaggcggcgccgctcccaagatgtcgcagacggccatgtccgaaacctacgattttttgtttaagttcttggttattggaaatgcaggaactggcaaatcttgcttacttcatcagtttattgaaaaaaaattcaaagatgactcaaatcatacaataggagtggaatttggttcaaagataataaatgttggtggtaaatatgtaaagttacaaatatgggatacagcaggacaagaacgattcaggtccgtgacgagaagttattaccgaggcgcggccggggctctcctcgtctatgatatcaccagccgagaaacctacaatgcgcttactaattggttaacagatgcccgaatgctagcgagccagaacattgtgatcatcctttgtggaaacaagaaggacctggatgcagatcgtgaagttaccttcttagaagcctccagatttgctcaagaaaatgagctgatgtttttggaaacaagtgcgctcacaggggagaatgtagaagaggcttttgtacagtgtgcaagaaaaatacttaacaaaatcgaatcaggtgagctggacccagaaagaatgggctcaggtattcagtacggagatgctgccttgagacagctgaggtcaccgcggcgcgcacaggccccgaacgctcaggagtgtggttgttaggagagcacacaggtgggtttggacacctccctg

SEQ ID NO: 330224 - DNA, 1204 bp, Homo sapiens
tccccgtgcgcacgcgcgaacgcggggtgggccgggcctcgcgtagcccatctcctcttcctcctcgcggtcgcggccggacggagggtggagggccctgcgcctgcgcggagctggagtccggctgggccgcagccgctgggagaccggcggttgccgtggggaccggtcgggcccctccctcctccggtcccccgccccaggtccttccccaccgagacgcgccggcggaccgcgggcgagtgcagccggtgacccggcgagaggcggcgccgctcccaagatgtcgcagacggccatgtccgaaacctacgattttttgtttaagttcttggttattggaaatgcaggaactggcaaatcttgcttacttcatcagtttattgaaaaaaaattcaaagatgactcaaatcatacaataggagtggaatttggttcaaagataataaatgttggtggtaaatatgtaaagttacaaatatgggatacagcaggacaagaacgattcagccgcgcctcggtaataacttctcgtgacggacctgcattcgattgtggttacgtagatgggaaagtcagtattgcgcaggactggcgtactggaggcctctacatacttgctgaattgcatactctatccggggcagaagaaaagacatagaactggcgactgactatctgggatatgattacgcattgctccaggaaatgccttaccagaagtcctgcataccatgagtgatgcaagtccgtattggttgtgatagagcaaagcacagggtagccgtgtgccatggaggagacggatagtagatgatgaacgcatgtgcctgtatgagatgaccatctcgatgactattggacatcaaatgaaattatgagactgtactgaattcatgggtgaagcataggatgcgatcaacaagaggtgagaattggtgtatgcaggctacggggtaactgcgtgccgctatagcaagaacaaagctacgagagacaaaacaagtggaagctcgacacgtgaggacccggacaccgcggcaaggaaagtgtgggtcagggcaagtgacaagcaacggaagagttgtatgacattagaggagcgacagttggggggatcaccaggtcggtggggcaacccgggaacgaagatcttgatcaggcggaatgtagccaggaaacgggagatcaacaccacaggtgt

SEQ ID NO: 330225 - DNA, 1555 bp, Homo sapiens
tccccgtgcgcacgcgcgaacgcggggtgggccgggcctcgcgtagcccatctcctcttcctcctcgcggtcgcggccggacggagggtggagggccctgcgcctgcgcggagctggagtccggctgggccgcagccgctgggagaccggcggttgccgtggggaccggtcgggcccctccctcctccggtcccccgccccaggtccttccccaccgagacgcgccggcggaccgcgggcgagtgcagccggtgacccggcgagaggcggcgccgctcccaagatgtcgcagacggccatgtccgaaacctacgattttttgtttaagttcttggttattggaaatgcaggaactggcaaatcttgcttacttcatcagtttattgaaaaaaaattcaaagatgactcaaatcatacaataggagtggaatttggttcaaagataataaatgttggtggtaaatatgtaaagttacaaatatgggatacagcaggacaagaacgattcaggtccgtgacgagaagttattaccgaggcgcggccggggctctcctcgtctatgatatcaccagccgagaaacctacaatgcgcttactaattggttaacagatgcccgaatgctagcgagccagaacattgtgatcatcctttgtggaaacaagaaggacctggatgcagatcgtgaagttaccttcttagaagcctccagatttgctcaagaaaatgagctgatgtttttggaaacaagtgcgctcacaggggagaatgtagaagaggcttttgtacagtgtgcaagaaaaatacttaacaaaatcgaatcaggtgagctggacccagaaagaatgggctcaggtattcagtacggagatgctgccttgagacagctgaggtcaccgcggcgcgcacaggccccgaacgctcaggagtgtggttgttaggagagcacacaggtgttcatacagtggcatttgggacacaatcgttggaacctgaagaatctgaagttttttttaccaccatctttttctactctgtatggaagtagatctttatggggaaaagagaatttggggtgttctgcaagccagtcaaagtggcacagcaaatcatataaatcgaattaaatggacaacaccgttagatgtgtatgtaaaaattttctgtttcatatttttcctttcactttcggtttaaaacatgctatatgtactgtatgtcctgtagcccagtgcggctccacagcatggaatctgatgtatgatatgatagaatgtggcactaaatgcagtttcagattttattttttttaatcatatgaactaaaattgtcaattgtgaggtgtgcttttctcatcatgttggttatattgcacaattggttatatttatgacctgatattcaaagactctggcattgatagccagtgtgttttcttatttaactccgtttactacattctacatggtgtttacgtgatccacacttgaaatactagatcagtagacattcactaatataccaaaataaaatgaaaaattgagtttttccgtga

SEQ ID NO: 330226 - DNA, 2602 bp, Homo sapiens
tccccgtgcgcacgcgcgaacgcggggtgggccgggcctcgcgtagcccatctcctcttcctcctcgcggtcgcggccggacggagggtggagggccctgcgcctgcgcggagctggagtccggctgggccgcagccgctgggagaccggcggttgccgtggggaccggtcgggcccctccctcctccggtcccccgccccaggtccttccccaccgagacgcgccggcggaccgcgggcgagtgcagccggtgacccggcgagaggcggcgccgctcccaagatgtcgcagacggccatgtccgaaacctacgattttttgtttaagttcttggttattggaaatgcaggaactggcaaatcttgcttacttcatcagtttattgaaaaaaaattcaaagatgactcaaatcatacaataggagtggaatttggttcaaagataataaatgttggtggtaaatatgtaaagttacaaatatgggatacagcaggacaagaacgattcaggtccgtgacgagaagttattaccgaggcgcggccggggctctcctcgtctatgatatcaccagccgagaaacctacaatgcgcttactaattggttaacagatgcccgaatgctagcgagccagaacattgtgatcatcctttgtggaaacaagaaggacctggatgcagatcgtgaagttaccttcttagaagcctccagatttgctcaagaaaatgagctgatgtttttggaaacaagtgcgctcacaggggagaatgtagaagaggcttttgtacagtgtgcaagaaaaatacttaacaaaatcgaatcaggtgagctggacccagaaagaatgggctcaggtattcagtacggagatgctgccttgagacagctgaggtcaccgcggcgcgcacaggccccgaacgctcaggagtgtggttgttaggagagcacacaggtgttcatacagtggcatttgggacacaatcgttggaacctgaagaatctgaagttttttttaccaccatctttttctactctgtatggaagtagatctttatggggaaaagagaatttggggtgttctgcaagccagtcaaagtggcacagcaaatcatataaatcgaattaaatggacaacaccgttagatgtgtatgtaaaaattttctgtttcatatttttcctttcactttcggtttaaaacatgctatatgtactgtatgtcctgtagcccagtgcggctccacagcatggaatctgatgtatgatatgatagaatgtggcactaaatgcagtttcagattttattttttttaatcatatgaattggttatatttatgacctgatattcaaagactctggcattgatagccagtgtgttttcttatttaactccgtttactacattctacatggtgtttacgtgatccacacttgaaatactagatcagtagacattcactaatataccaaaataaaatgaaaaattgagtttttccgtgaactttatactgtccagctctgttgattttaaagcctcttcatccaggtcagttcaggaagtatatctggagtacctgctctgtttttggctgtgagactagcactaaggattctggtacctttacccaaacctactgggctactaatacttctctcagcagttgatcaaatacaatagaccatgtaagctggggccgctcatccacttccagtttgctggtctccctgctagaaaacacattgtactgtgctttttctggaattcagtataatggcatcactgcctgtttttcacatcttttgtttcctgttcattttaaggaaacctactaaatccagttaatattaaatggacaccactcattaagaaatttctttatggcttctgctgaatacttaaatgccttactacagttatccagttgacatgtttttaattcatataaggtatattgggtatattgaagtatatattgtattacaaagacttgttcttgtattttaaaatgtcagtgcaaaaaatatatggtggaacctttctttaaagttgaaatgcagtattatttaaatctgaaaggttaaaaagctttcttcaccttatatatgttcttccactgtgactttttagttgaagactagtaaattaacttttagttagaagatgcctactgcttttgttgtttattttaatcagcagagcacagagacacataaaaactctgggaaatgactaggataaaaatatcagtatgtatctgttttagatattttgagttttgctttttttatgccttgaatattttatttcaaaaagtatctgaagcaaattctcagactgaactacttcttagacctcactgtaagaatattttattcaatgtctcatttatgatagatttgcaagctgctcatttttgaacagctttttgcatgggataggagcatgtctattctaacacatcagcttattcaaaagcaagaattttaaaaataagataaatgtaaagttgttttataaacgatcctgttaattaaaccacagacaccatatatccttctgcatcctttggccaataaaagttgctggagaaccaaaaaaaaat

SEQ ID NO: 330227 - DNA, 2620 bp, Homo sapiens
tccccgtgcgcacgcgcgaacgcggggtgggccgggcctcgcgtagcccatctcctcttcctcctcgcggtcgcggccggacggagggtggagggccctgcgcctgcgcggagctggagtccggctgggccgcagccgctgggagaccggcggttgccgtggggaccggtcgggcccctccctcctccggtcccccgccccaggtccttccccaccgagacgcgccggcggaccgcgggcgagtgcagccggtgacccggcgagaggcggcgccgctcccaagatgtcgcagacggccatgtccgaaacctacgattttttgtttaagttcttggttattggaaatgcaggaactggcaaatcttgcttacttcatcagtttattgaaaaaaaattcaaagatgactcaaatcatacaataggagtggaatttggttcaaagataataaatgttggtggtaaatatgtaaagttacaaatatgggatacagcaggacaagaacgattcaggtccgtgacgagaagttattaccgaggcgcggccggggctctcctcgtctatgatatcaccagatgcccgaatgctagcgagccagaacattgtgatcatcctttgtggaaacaagaaggacctggatgcagatcgtgaagttaccttcttagaagcctccagatttgctcaagaaaatgagctgatgtttttggaaacaagtgcgctcacaggggagaatgtagaagaggcttttgtacagtgtgcaagaaaaatacttaacaaaatcgaatcaggtgagctggacccagaaagaatgggctcaggtattcagtacggagatgctgccttgagacagctgaggtcaccgcggcgcgcacaggccccgaacgctcaggagtgtggttgttaggagagcacacaggtgttcatacagtggcatttgggacacaatcgttggaacctgaagaatctgaagttttttttaccaccatctttttctactctgtatggaagtagatctttatggggaaaagagaatttggggtgttctgcaagccagtcaaagtggcacagcaaatcatataaatcgaattaaatggacaacaccgttagatgtgtatgtaaaaattttctgtttcatatttttcctttcactttcggtttaaaacatgctatatgtactgtatgtcctgtagcccagtgcggctccacagcatggaatctgatgtatgatatgatagaatgtggcactaaatgcagtttcagattttattttttttaatcatatgaactaaaattgtcaattgtgaggtgtgcttttctcatcatgttggttatattgcacaattggttatatttatgacctgatattcaaagactctggcattgatagccagtgtgttttcttatttaactccgtttactacattctacatggtgtttacgtgatccacacttgaaatactagatcagtagacattcactaatataccaaaataaaatgaaaaattgagtttttccgtgaactttatactgtccagctctgttgattttaaagcctcttcatccaggtcagttcaggaagtatatctggagtacctgctctgtttttggctgtgagactagcactaaggattctggtacctttacccaaacctactgggctactaatacttctctcagcagttgatcaaatacaatagaccatgtaagctggggccgctcatccacttccagtttgctggtctccctgctagaaaacacattgtactgtgctttttctggaattcagtataatggcatcactgcctgtttttcacatcttttgtttcctgttcattttaaggaaacctactaaatccagttaatattaaatggacaccactcattaagaaatttctttatggcttctgctgaatacttaaatgccttactacagttatccagttgacatgtttttaattcatataaggtatattgggtatattgaagtatatattgtattacaaagacttgttcttgtattttaaaatgtcagtgcaaaaaatatatggtggaacctttctttaaagttgaaatgcagtattatttaaatctgaaaggttaaaaagctttcttcaccttatatatgttcttccactgtgactttttagttgaagactagtaaattaacttttagttagaagatgcctactgcttttgttgtttattttaatcagcagagcacagagacacataaaaactctgggaaatgactaggataaaaatatcagtatgtatctgttttagatattttgagttttgctttttttatgccttgaatattttatttcaaaaagtatctgaagcaaattctcagactgaactacttcttagacctcactgtaagaatattttattcaatgtctcatttatgatagatttgcaagctgctcatttttgaacagctttttgcatgggataggagcatgtctattctaacacatcagcttattcaaaagcaagaattttaaaaataagataaatgtaaagttgttttataaacgatcctgttaattaaaccacagacaccatatatccttctgcatcctttggccaataaaagttgctggagaaccaaaaaaaaat

SEQ ID NO: 330228 - DNA, 2530 bp, Homo sapiens
tccccgtgcgcacgcgcgaacgcggggtgggccgggcctcgcgtagcccatctcctcttcctcctcgcggtcgcggccggacggagggtggagggccctgcgcctgcgcggagctggagtccggctgggccgcagccgctgggagaccggcggttgccgtggggaccggtcgggcccctccctcctccggtcccccgccccaggtccttccccaccgagacgcgccggcggaccgcgggcgagtgcagccggtgacccggcgagaggcggcgccgctcccaagatgtcgcagacggccatgtccgaaacctacgattttttgtttaagttcttggttattggaaatgcaggaactggcaaatcttgcttacttcatcagtttattgaaaaaaaattcaaagatgactcaaatcatacaataggagtggaatttggttcaaagataataaatgttggtggtaaatatgtaaagttacaaatatgggatacagcaggacaagaacgattcaggtccgtgacgagaagttattaccgaggcgcggccggggctctcctcgtctatgatatcaccagccgagaaacctacaatgcgcttactaattggttaacagatgcccgaatgctagcgagccagaacattgtgatcatcctttgtggaaacaagaaggacctggatgcagatcgtgaagttaccttcttagaagcctccagatttgctcaagaaaatgagctgatgtttttggaaacaagtgcgctcacaggggagaatgtagaagaggcttttgtacagtgtgcaagaaaaatacttaacaaaatcgaatcaggtgttcatacagtggcatttgggacacaatcgttggaacctgaagaatctgaagttttttttaccaccatctttttctactctgtatggaagtagatctttatggggaaaagagaatttggggtgttctgcaagccagtcaaagtggcacagcaaatcatataaatcgaattaaatggacaacaccgttagatgtgtatgtaaaaattttctgtttcatatttttcctttcactttcggtttaaaacatgctatatgtactgtatgtcctgtagcccagtgcggctccacagcatggaatctgatgtatgatatgatagaatgtggcactaaatgcagtttcagattttattttttttaatcatatgaactaaaattgtcaattgtgaggtgtgcttttctcatcatgttggttatattgcacaattggttatatttatgacctgatattcaaagactctggcattgatagccagtgtgttttcttatttaactccgtttactacattctacatggtgtttacgtgatccacacttgaaatactagatcagtagacattcactaatataccaaaataaaatgaaaaattgagtttttccgtgaactttatactgtccagctctgttgattttaaagcctcttcatccaggtcagttcaggaagtatatctggagtacctgctctgtttttggctgtgagactagcactaaggattctggtacctttacccaaacctactgggctactaatacttctctcagcagttgatcaaatacaatagaccatgtaagctggggccgctcatccacttccagtttgctggtctccctgctagaaaacacattgtactgtgctttttctggaattcagtataatggcatcactgcctgtttttcacatcttttgtttcctgttcattttaaggaaacctactaaatccagttaatattaaatggacaccactcattaagaaatttctttatggcttctgctgaatacttaaatgccttactacagttatccagttgacatgtttttaattcatataaggtatattgggtatattgaagtatatattgtattacaaagacttgttcttgtattttaaaatgtcagtgcaaaaaatatatggtggaacctttctttaaagttgaaatgcagtattatttaaatctgaaaggttaaaaagctttcttcaccttatatatgttcttccactgtgactttttagttgaagactagtaaattaacttttagttagaagatgcctactgcttttgttgtttattttaatcagcagagcacagagacacataaaaactctgggaaatgactaggataaaaatatcagtatgtatctgttttagatattttgagttttgctttttttatgccttgaatattttatttcaaaaagtatctgaagcaaattctcagactgaactacttcttagacctcactgtaagaatattttattcaatgtctcatttatgatagatttgcaagctgctcatttttgaacagctttttgcatgggataggagcatgtctattctaacacatcagcttattcaaaagcaagaattttaaaaataagataaatgtaaagttgttttataaacgatcctgttaattaaaccacagacaccatatatccttctgcatcctttggccaataaaagttgctggagaaccaaaaaaaaat

SEQ ID NO: 330229 - DNA, 778 bp, Homo sapiens
tccccgtgcgcacgcgcgaacgcggggtgggccgggcctcgcgtagcccatctcctcttcctcctcgcggtcgcggccggacggagggtggagggccctgcgcctgcgcggagctggagtccggctgggccgcagccgctgggagaccggcggttgccgtggggaccggtcgggcccctccctcctccggtcccccgccccaggtccttccccaccgagacgcgccggcggaccgcgggcgagtgcagccggtgacccggcgagaggcggcgccgctcccaagatgtcgcagacggccatgtccgaaacctacgattttttgtttaagttcttggttattggaaatgcaggaactggcaaatcttgcttacttcatcagtttattgaaaaaaaattcaaagatgactcaaatcatacaataggagtggaatttggttcaaagataataaatgttggtggtaaatatgtaaagttacaaatatgggatacagcaggacaagaacgattcagaaacttcatttttggaaactttgattgacaagacagctaaaatttaggttagctctctgcagcatggattactaaagaatacaggaggatctccgcgcaactgcattataattcggaggctgacccattctcaggaggatgtggcactgtgtattgtacagtatgtttctagattcaaatcaaagcacaagcttgtttttctgtgttccttttttaaagaagaactttttaaaaccttgtgagggtttgttttgttttacattaacta

SEQ ID NO: 330230 - DNA, 525 bp, Homo sapiens
gtagcagccagcctaggattctttgttctgtccaaatagtccatgccaggatcatctatagccagcctcaactctgcctggcatctcagcgccagacggatcctggcctgtctagagtttccttaggtgccttcttctttaccttatgcctccaggcagccttccctggcttggtagccacttcactgcccaatgtatgagcccaaaaggaggagggcagaggccactcccaacttcagccagccaaggtaggattcctttgccatcttcagggcctcatagtgctgtgagaggtgcttctctcctggtcctgaaagtgagtcccacactactccatgctgtgcagcctctggacttgcctactgtttggattgctcatggctggccttagatttctctcctattggtccttaagaaacaagattgattgtgttttacacattttttcagtgaatcagaagacatcaaagaaggcataacatggtgtggcactgtgatgaagagcacaggttctaggatcacacc

SEQ ID NO: 330231 - DNA, 457 bp, Homo sapiens
cctcccaaagtgctgggattacaggtgtgagccatcgcacccagtctcagtgtagatttctaagttcaaattcacattctcagaacttttgcagttattattccattgtctctagtatccagtgttgctagtgagaagtctggtgccagtttgagtttgattccaattcttttatagatgacttgtattttcctttctgaaagcattgaggaatattctgtttatcttttgattacttgaaatttcaaaggatgtgtctgttgtgggacgtttgtcattcatcctttcaggactctaggacttttttaacctggagatttgagtacttctttagcttggggaaattttcctttgatatttctttgataatatcttccttttaattttttctattatctctggatttctgttcatcagatggtagacctcatagattggtcatctttttctcctatat

SEQ ID NO: 330232 - DNA, 370 bp, Homo sapiens
gctgtttcaaatccacatgctttgtgtatagattttgtctcctcctcctgtttaaaaaatattgaatcctttgtaaaatttatctctggagacaaaggctaatgagccattgtctaaaagagctgagcagaatcttgttatctgctcattcaaccccttcatgtcacaaatgggacagggggagaaatggcatatctgaaatttacaaagaaaaaaatggcacatctgaactttacataagaaatggcatatctgaaatttacaaacttacatttacatgagtggtgccacaaccaagatacattgactcacagcatcttttatgaatgaaggagaaaagagtgtctgctgtattctgtcacttccaccc

SEQ ID NO: 330233 - DNA, 2576 bp, Homo sapiens
  misc_feature (27)..(27): n is a, c, g, or t
  misc_feature (29)..(29): n is a, c, g, or t
  misc_feature (262)..(262): n is a, c, g, or t
  misc_feature (2570)..(2571): n is a, c, g, or t
aaagcttgctagattaactattgatananaagcttaaataggtagtaaaccactaaatatgcaaggaagtgattatcagggttgtgaaggagaagaacaggtaagttaaatgggcattctgaggagtagaaatttcctttacttcataattatttgttaattcatctttatatgtttaatgggcttttctctattattttatatttttcaataaaagaaaaaagaatttaaaaaatcttggagctcactgggagcaatgggnttgcagctgaagtccaatagtacaaatgatgtggtaagaggccggcagggctgtgaattacagcaacaaaggagaaaaggaagtgattggagaattaagcaacatgaatggtattattcaaagacagctcattataggacacggaactccctgggtaggagtttgaagctttcttaactcagaaagaaacttccaacacagtttcccaaagaaaaatgggcaccaagggcaaagttattaaatgcaaagcagccatcgcctgggaagcaggcaagcccctttgcattgaagaggttgaagtagctccccccaaggctcatgaagttcgcattcagatcattgctacctccctgtgccatactgatgccactgttatcgattctaaatttgagggcctagctttcccagtgatcgttggccatgaggctgcaggtattgtggaaagtattgggccaggagtgaccaacgtcaaaccaggtgacaaagtaattccactttatgcacctctatgtagaaaatgcaagttttgtctgagtccactcacaaatttgtgtgggaaaatcagtaatctcaaaagtcctgctagtgatcaacaactaatggaagacaaaaccagcaggtttacctgcaaaggaaaaccagtttaccatttctttggaaccagtacattctctcagtacactgtggtgtcagatatcaatcttgccaaaatagatgatgatgcaaatttagagagagtttgtctgcttggatgtgggttttcaactggctatggggctgcaatcaacaatgccaaggtcacccctggttcgacttgtgctgtctttggcctaggaggtgtgggtctttctgctgtaatgggttgtaaagcagcaggagcttccagaatcataggtattgacatcaacagtgagaagtttgtgaaggctaaagccctgggagccactgactgcctcaatcctagagacttacataaacctatccaggaagttatcattgaattgaccaagggaggtgtggattttgcccttgactgtgcaggtggatctgaaaccatgaaagcagccctggactgtacaaccgcaggctggggatcatgtactttcattggagtagctgctggtagcaaaggattgactgtttttccagaggagctaataatcggccgtactataaatggaacattctttggtggttggaaaagtgtagattctatcccaaagctggtcactgactataagaataagaaattcaatctggatgcactggtgacccataccctgccttttgacaaaatcagtgaggcatttgacctaatgaaccaaggaaaaagcatccgaacaatcctcatcttttgaagatgccaggagcaattcggaatactatctgattgaatgtgaacctgcctggttaatttattacctgatttgatgaaccaaggaaagccatgcgtttaaacaaatatttacatttaatatgggaacataaaagagctttaaatattatagactttgtacctgttatatatatgaatattccctatgttaaataataataataactagtgtttatgaatagaatcatatcatctttagaaattgtttaaaattagttctgggaagttgaaagtggggaatgaagagataataaataaaactagattggccatatgtttataatttttttagattgggtaatgaatacatggagtttcattatacttttctctccacttttgtctatgttgaaaattttctgggagctaaatgatgagaacacatggacacatgatggggaacaacacacactagggcctgttgagggcagggagtcggcagagagagagcatcaggaagaatagctaatggatgctgggcttcatacctgggtgatgagatgatctgtgcagcaaagcaccatggtacatgtttacctatgtaacaaacctgcacatcctgcacatgtaccctggaacttaataaaagttggaaatttttaaaaagaatgaataagacctggtatttgatagcacaacagggagactatagtcaacagcaatttaattgtatattttaatatgactaaaagagtataatggattgtttgtaacacaaataaatgcttgaggggatggacaccccatattacatgatgtgattattacacattgcatgcctatatcaaaacatctcatgtaccccataaatatatacacctaatacccacaaaacttaaaatataaaatgttttaaataaaaataaagaaaagatttccacaataaaaagatttttactggaaaaaatcacnntattt

SEQ ID NO: 330234 - DNA, 794 bp, Homo sapiens
  misc_feature (27)..(27): n is a, c, g, or t
  misc_feature (29)..(29): n is a, c, g, or t
  misc_feature (262)..(262): n is a, c, g, or t
aaagcttgctagattaactattgatananaagcttaaataggtagtaaaccactaaatatgcaaggaagtgattatcagggttgtgaaggagaagaacaggtaagttaaatgggcattctgaggagtagaaatttcctttacttcataattatttgttaattcatctttatatgtttaatgggcttttctctattattttatatttttcaataaaagaaaaaagaatttaaaaaatcttggagctcactgggagcaatgggnttgcagctgaagtccaatagtacaaatgatgtggtaagaggccggcagggctgtgaattacagcaacaaaggagaaaaggaagtgattggagaattaagcaacatgaatggtattattcaaagacagctcattataggacacggaactccctgggtaggagtttgaagctttcttaactcagaaagaaacttccaacacagtttcccaaagaacaggcaagcccctttgcattgaagaggttgaagtagctccccccaaggctcatgaagttcgcattcagatcattgctacctccctgtgccatactgatgccactgttatcgattctaaatttgagggcctagctttcccagtgatcgttggccatgaggctgcaggtattgcgcatcgaatcctcccaggagagagcatcgccataccagccgacacagtagttccactctacccgactctgtctagcacatgccccataaccccctatcagctcccctcatcatgctcgtaccccacgtgtattcttcacctcgccgc

SEQ ID NO: 330235 - DNA, 2522 bp, Homo sapiens
  misc_feature (27)..(27): n is a, c, g, or t
  misc_feature (29)..(29): n is a, c, g, or t
  misc_feature (262)..(262): n is a, c, g, or t
  misc_feature (2516)..(2517): n is a, c, g, or t
aaagcttgctagattaactattgatananaagcttaaataggtagtaaaccactaaatatgcaaggaagtgattatcagggttgtgaaggagaagaacaggtaagttaaatgggcattctgaggagtagaaatttcctttacttcataattatttgttaattcatctttatatgtttaatgggcttttctctattattttatatttttcaataaaagaaaaaagaatttaaaaaatcttggagctcactgggagcaatgggnttgcagctgaagtccaatagtacaaatgatgtggtaagaggccggcagggctgtgaattacagcaacaaaggagaaaaggaagtgattggagaattaagcaacatgaatggtattattcaaagacagctcattataggacacggaactccctgggtaggagtttgaagctttcttaactcagaaagaaacttccaacacagtttcccaaagaaaaatgggcaccaagggcaaagttattaaatgcaaagcagccatcgcctgggaagcaggcaagcccctttgcattgaagaggttgaagtagctccccccaaggctcatgaagttcgcattcagatcattgctacctccctgtgccatactgatgccactgttatcgattctaaatttgagggcctagctttcccagtgatcgttggccatgaggctgcaggtattgtggaaagtattgggccaggagtgaccaacgtcaaaccaggtgacaaagtaattccactttatgcacctctatgtagaaaatgcaagttttgtctgagtccactcacaaatttgtgtgggaaaatcagtaatctcaaaagtcctgctagtgatcaacaactaatggaagacaaaaccagcaggtttacctgcaaaggaaaaccagtttaccatttctttggaaccagtacattctctcagtacactgtggtgtcagatatcaatcttgcctcaactggctatggggctgcaatcaacaatgccaaggtcacccctggttcgacttgtgctgtctttggcctaggaggtgtgggtctttctgctgtaatgggttgtaaagcagcaggagcttccagaatcataggtattgacatcaacagtgagaagtttgtgaaggctaaagccctgggagccactgactgcctcaatcctagagacttacataaacctatccaggaagttatcattgaattgaccaagggaggtgtggattttgcccttgactgtgcaggtggatctgaaaccatgaaagcagccctggactgtacaaccgcaggctggggatcatgtactttcattggagtagctgctggtagcaaaggattgactgtttttccagaggagctaataatcggccgtactataaatggaacattctttggtggttggaaaagtgtagattctatcccaaagctggtcactgactataagaataagaaattcaatctggatgcactggtgacccataccctgccttttgacaaaatcagtgaggcatttgacctaatgaaccaaggaaaaagcatccgaacaatcctcatcttttgaagatgccaggagcaattcggaatactatctgattgaatgtgaacctgcctggttaatttattacctgatttgatgaaccaaggaaagccatgcgtttaaacaaatatttacatttaatatgggaacataaaagagctttaaatattatagactttgtacctgttatatatatgaatattccctatgttaaataataataataactagtgtttatgaatagaatcatatcatctttagaaattgtttaaaattagttctgggaagttgaaagtggggaatgaagagataataaataaaactagattggccatatgtttataatttttttagattgggtaatgaatacatggagtttcattatacttttctctccacttttgtctatgttgaaaattttctgggagctaaatgatgagaacacatggacacatgatggggaacaacacacactagggcctgttgagggcagggagtcggcagagagagagcatcaggaagaatagctaatggatgctgggcttcatacctgggtgatgagatgatctgtgcagcaaagcaccatggtacatgtttacctatgtaacaaacctgcacatcctgcacatgtaccctggaacttaataaaagttggaaatttttaaaaagaatgaataagacctggtatttgatagcacaacagggagactatagtcaacagcaatttaattgtatattttaatatgactaaaagagtataatggattgtttgtaacacaaataaatgcttgaggggatggacaccccatattacatgatgtgattattacacattgcatgcctatatcaaaacatctcatgtaccccataaatatatacacctaatacccacaaaacttaaaatataaaatgttttaaataaaaataaagaaaagatttccacaataaaaagatttttactggaaaaaatcacnntattt

SEQ ID NO: 330236 - DNA, 2472 bp, Homo sapiens
  misc_feature (27)..(27): n is a, c, g, or t
  misc_feature (29)..(29): n is a, c, g, or t
  misc_feature (262)..(262): n is a, c, g, or t
  misc_feature (2466)..(2467): n is a, c, g, or t
aaagcttgctagattaactattgatananaagcttaaataggtagtaaaccactaaatatgcaaggaagtgattatcagggttgtgaaggagaagaacaggtaagttaaatgggcattctgaggagtagaaatttcctttacttcataattatttgttaattcatctttatatgtttaatgggcttttctctattattttatatttttcaataaaagaaaaaagaatttaaaaaatcttggagctcactgggagcaatgggnttgcagctgaagtccaatagtacaaatgatgtggtaagaggccggcagggctgtgaattacagcaacaaaggagaaaaggaagtgattggagaattaagcaacatgaatggtattattcaaagacagctcattataggacacggaactccctgggtaggagtttgaagctttcttaactcagaaagaaacttccaacacagtttcccaaagaaaaatgggcaccaagggcaaagttattaaatgcaaagcagccatcgcctgggaagcaggcaagcccctttgcattgaagaggttgaagtagctccccccaaggctcatgaagttcgcattcagatcattgctacctccctgtgccatactgatgccactgttatcgattctaaatttgagggcctagctttcccagtgatcgttggccatgaggctgcaggtattgtggaaagtattgggccaggagtgaccaacgtcaaaccaggtgacaaagtaattccactttatgcacctctatgtagaaaatgcaagttttgtctgagtccactcacaaatttgtgtgggaaaatcagtaatctcaaaagtcctgctagtgatcaacaactaatggaagacaaaaccagcaggtttacctgcaaaggaaaaccagtttaccatttctttggaaccagtacattctctcagtacactgtggtgtcagatatcaatcttgcctcaactggctatggggctgcaatcaacaatgccaaggtcacccctggttcgacttgtgctgtctttggcctaggaggtgtgggtctttctgctgtaatgggttgtaaagcagcaggagcttccagaatcataggtattgacatcaacagtgagaagtttgtgaaggctaaagccctgggagccactgactgcctcaatcctagagacttacataaacctatccaggaagttatcattgaattgaccaagggaggtgtggattttgcccttgactgtgcaggtggatctgaaaccatgaaagcagccctggactgtacaaccgcaggctggggatcatgtactttcattggagtagctgctggtagcaaaggattgactgtttttccagaggagctaataatcggccgtactataaatggaacattctttggtggttggaaaagtgtagattctatcccaaagctggtcactgactataagaataagaaattcaatctggatgcactggtgacccataccctgccttttgacaaaatcagtgaggcatttgacctaatgaaccaaggaaaaagtatctgattgaatgtgaacctgcctggttaatttattacctgatttgatgaaccaaggaaagccatgcgtttaaacaaatatttacatttaatatgggaacataaaagagctttaaatattatagactttgtacctgttatatatatgaatattccctatgttaaataataataataactagtgtttatgaatagaatcatatcatctttagaaattgtttaaaattagttctgggaagttgaaagtggggaatgaagagataataaataaaactagattggccatatgtttataatttttttagattgggtaatgaatacatggagtttcattatacttttctctccacttttgtctatgttgaaaattttctgggagctaaatgatgagaacacatggacacatgatggggaacaacacacactagggcctgttgagggcagggagtcggcagagagagagcatcaggaagaatagctaatggatgctgggcttcatacctgggtgatgagatgatctgtgcagcaaagcaccatggtacatgtttacctatgtaacaaacctgcacatcctgcacatgtaccctggaacttaataaaagttggaaatttttaaaaagaatgaataagacctggtatttgatagcacaacagggagactatagtcaacagcaatttaattgtatattttaatatgactaaaagagtataatggattgtttgtaacacaaataaatgcttgaggggatggacaccccatattacatgatgtgattattacacattgcatgcctatatcaaaacatctcatgtaccccataaatatatacacctaatacccacaaaacttaaaatataaaatgttttaaataaaaataaagaaaagatttccacaataaaaagatttttactggaaaaaatcacnntattt

SEQ ID NO: 330237 - DNA, 2468 bp, Homo sapiens
  misc_feature (27)..(27): n is a, c, g, or t
  misc_feature (29)..(29): n is a, c, g, or t
  misc_feature (262)..(262): n is a, c, g, or t
  misc_feature (2462)..(2463): n is a, c, g, or t
aaagcttgctagattaactattgatananaagcttaaataggtagtaaaccactaaatatgcaaggaagtgattatcagggttgtgaaggagaagaacaggtaagttaaatgggcattctgaggagtagaaatttcctttacttcataattatttgttaattcatctttatatgtttaatgggcttttctctattattttatatttttcaataaaagaaaaaagaatttaaaaaatcttggagctcactgggagcaatgggnttgcagctgaagtccaatagtacaaatgatgtggtaagaggccggcagggctgtgaattacagcaacaaaggagaaaaggaagtgattggagaattaagcaacatgaatggtattattcaaagacagctcattataggacacggaactccctgggtaggagtttgaagctttcttaactcagaaagaaacttccaacacagtttcccaaagaaaaatgggcaccaagggcaaagttattaaatgcaaagcagccatcgcctgggaagcaggcaagcccctttgcattgaagaggttgaagtagctccccccaaggctcatgaagttcgcattcagatcattgctacctccctgtgccatactgatgccactgttatcgattctaaatttgagggcctagctttcccagtgatcgttggccatgaggctgcaggtattgtggaaagtattgggccaggagtgaccaacgtcaaaccaggtgacaaagtaattccactttatgcacctctatgtagaaaatgcaagttttgtctgagtccactcacaaatttgtgtgggaaaatcagtaatctcaaaagtcctgctagtgatcaacaactaatggaagacaaaaccagcaggtttacctgcaaaggaaaaccagtttaccatttctttggaaccagtacattctctcagtacactgtggtgtcagatatcaatcttgcctcaactggctatggggctgcaatcaacaatgccaaggtcacccctggttcgacttgtgctgtctttggcctaggaggtgtgggtctttctgctgtaatgggttgtaaagcagcaggagcttccagaatcataggtattgacatcaacagtgagaagtttgtgaaggctaaagccctgggagccactgactgcctcaatcctagagacttacataaacctatccaggaagttatcattgaattgaccaagggaggtgtggattttgcccttgactgtgcaggtggatctgaaaccatgaaagcagccctggactgtacaaccgcaggctggggatcatgtactttcattggagtagctgctggtagcaaaggattgactgtttttccagaggagctaataatcggccgtactataaatggaacattctttggtggttggaaaagtgtagattctatcccaaagctggtcactgactataagaataagaaattcaatctggatgcactggtgacccataccctgccttttgacaaaatcagtgaggcatttgacctaatgaaccaaggaaaaagcatccgaacaatcctcatcttttgaagatgccaggagcaattcggaatactatctgattgaatgtgaacctgcctggttaatttattacctgatttgatgaaccaaggaaagccatgcgtttaaacaaatatttacatttaatatgggaacattatgttaaataataataataactagtgtttatgaatagaatcatatcatctttagaaattgtttaaaattagttctgggaagttgaaagtggggaatgaagagataataaataaaactagattggccatatgtttataatttttttagattgggtaatgaatacatggagtttcattatacttttctctccacttttgtctatgttgaaaattttctgggagctaaatgatgagaacacatggacacatgatggggaacaacacacactagggcctgttgagggcagggagtcggcagagagagagcatcaggaagaatagctaatggatgctgggcttcatacctgggtgatgagatgatctgtgcagcaaagcaccatggtacatgtttacctatgtaacaaacctgcacatcctgcacatgtaccctggaacttaataaaagttggaaatttttaaaaagaatgaataagacctggtatttgatagcacaacagggagactatagtcaacagcaatttaattgtatattttaatatgactaaaagagtataatggattgtttgtaacacaaataaatgcttgaggggatggacaccccatattacatgatgtgattattacacattgcatgcctatatcaaaacatctcatgtaccccataaatatatacacctaatacccacaaaacttaaaatataaaatgttttaaataaaaataaagaaaagatttccacaataaaaagatttttactggaaaaaatcacnntattt

SEQ ID NO: 330238 - DNA, 2526 bp, Homo sapiens
  misc_feature (27)..(27): n is a, c, g, or t
  misc_feature (29)..(29): n is a, c, g, or t
  misc_feature (262)..(262): n is a, c, g, or t
  misc_feature (2520)..(2521): n is a, c, g, or t
aaagcttgctagattaactattgatananaagcttaaataggtagtaaaccactaaatatgcaaggaagtgattatcagggttgtgaaggagaagaacaggtaagttaaatgggcattctgaggagtagaaatttcctttacttcataattatttgttaattcatctttatatgtttaatgggcttttctctattattttatatttttcaataaaagaaaaaagaatttaaaaaatcttggagctcactgggagcaatgggnttgcagctgaagtccaatagtacaaatgatgtggtaagaggccggcagggctgtgaattacagcaacaaaggagaaaaggaagtgattggagaattaagcaacatgaatggtattattcaaagacagctcattataggacacggaactccctgggtaggagtttgaagctttcttaactcagaaagaaacttccaacacagtttcccaaagaaaaatgggcaccaagggcaaagttattaaatgcaaagcagccatcgcctgggaagcaggcaagcccctttgcattgaagaggttgaagtagctccccccaaggctcatgaagttcgcattcagatcattgctacctccctgtgccatactgatgccactgttatcgattctaaatttgagggcctagctttcccagtgatcgttggccatgaggctgcaggtattgtggaaagtattgggccaggagtgaccaacgtcaaaccaggtgacaaagtaattccactttatgcacctctatgtagaaaatgcaagttttgtctgagtccactcacaaatttgtgtgggaaaatcagtaatctcaaaagtcctgctagtgatcaacaactaatggaagacaaaaccagcaggtttacctgcaaaggaaaaccagtttaccatttctttggaaccagtacattctctcagtacactgtggtgtcagatatcaatcttgccaaaatagatgatgatgcaaatttagagagagtttgtctgcttggatgtgggttttcaactggctatggggctgcaatcaacaatgccaaggtcacccctggttcgacttgtgctgtctttggcctaggaggtgtgggtctttctgctgtaatgggttgtaaagcagcaggagcttccagaatcataggtattgacatcaacagtgagaagtttgtgaaggctaaagccctgggagccactgactgcctcaatcctagagacttacataaacctatccaggaagttatcattgaattgaccaagggaggtgtggattttgcccttgactgtgcaggtggatctgaaaccatgaaagcagccctggactgtacaaccgcaggctggggatcatgtactttcattggagtagctgctggtagcaaaggattgactgtttttccagaggagctaataatcggccgtactataaatggaacattctttggtggttggaaaagtgtagattctatcccaaagctggtcactgactataagaataagaaattcaatctggatgcactggtgacccataccctgccttttgacaaaatcagtgaggcatttgacctaatgaaccaaggaaaaagtatctgattgaatgtgaacctgcctggttaatttattacctgatttgatgaaccaaggaaagccatgcgtttaaacaaatatttacatttaatatgggaacataaaagagctttaaatattatagactttgtacctgttatatatatgaatattccctatgttaaataataataataactagtgtttatgaatagaatcatatcatctttagaaattgtttaaaattagttctgggaagttgaaagtggggaatgaagagataataaataaaactagattggccatatgtttataatttttttagattgggtaatgaatacatggagtttcattatacttttctctccacttttgtctatgttgaaaattttctgggagctaaatgatgagaacacatggacacatgatggggaacaacacacactagggcctgttgagggcagggagtcggcagagagagagcatcaggaagaatagctaatggatgctgggcttcatacctgggtgatgagatgatctgtgcagcaaagcaccatggtacatgtttacctatgtaacaaacctgcacatcctgcacatgtaccctggaacttaataaaagttggaaatttttaaaaagaatgaataagacctggtatttgatagcacaacagggagactatagtcaacagcaatttaattgtatattttaatatgactaaaagagtataatggattgtttgtaacacaaataaatgcttgaggggatggacaccccatattacatgatgtgattattacacattgcatgcctatatcaaaacatctcatgtaccccataaatatatacacctaatacccacaaaacttaaaatataaaatgttttaaataaaaataaagaaaagatttccacaataaaaagatttttactggaaaaaatcacnntattt

SEQ ID NO: 330239 - DNA, 2440 bp, Homo sapiens
  misc_feature (27)..(27): n is a, c, g, or t
  misc_feature (29)..(29): n is a, c, g, or t
  misc_feature (262)..(262): n is a, c, g, or t
  misc_feature (2434)..(2435): n is a, c, g, or t
aaagcttgctagattaactattgatananaagcttaaataggtagtaaaccactaaatatgcaaggaagtgattatcagggttgtgaaggagaagaacaggtaagttaaatgggcattctgaggagtagaaatttcctttacttcataattatttgttaattcatctttatatgtttaatgggcttttctctattattttatatttttcaataaaagaaaaaagaatttaaaaaatcttggagctcactgggagcaatgggnttgcagctgaagtccaatagtacaaatgatgtggtaagaggccggcagggctgtgaattacagcaacaaaggagaaaaggaagtgattggagaattaagcaacatgaatggtattattcaaagacagctcattataggacacggaactccctgggtaggagtttgaagctttcttaactcagaaagaaacttccaacacagtttcccaaagaaaaatgggcaccaagggcaaagttattaaatgcaaagcagccatcgcctgggaagcaggcaagcccctttgcattgaagaggttgaagtagctccccccaaggctcatgaagttcgcattcagatcattgctacctccctgtgccatactgatgccactgttatcgattctaaatttgagggcctagctttcccagtgatcgttggccatgaggctgcaggtattgtggaaagtattgggccaggagtgaccaacgtcaaaccaggtgacaaagtaattccactttatgcacctctatgtagaaaatgcaagttttgtctgagtccactcacaaatttgtgtgggaaaatcagtaatctcaaaagtcctgctagtgatcaacaactaatggaagacaaaaccagcaggtttacctgcaaaggaaaaccagtttaccatttctttggaaccagtacattctctcagtacactgtggtgtcagatatcaatcttgccaaaatagatgatgatgcaaatttagagagagtttgtctgcttggatgtgggttttcaactggctatggggctgcaatcaacaatgccaaggtcacccctggttcgacttgtgctgtctttggcctaggaggtgtgggtctttctgctgtaatgggttgtaaagcagcaggagcttccagaatcataggtattgacatcaacagtgagaagtttgtgaaggctaaagccctgggagccactgactgcctcaatcctagagacttacataaacctatccaggaagttatcattgaattgaccaagggaggtgtggattttgcccttgactgtgcaggtggatctgaaaccatggttggaaaagtgtagattctatcccaaagctggtcactgactataagaataagaaattcaatctggatgcactggtgacccataccctgccttttgacaaaatcagtgaggcatttgacctaatgaaccaaggaaaaagcatccgaacaatcctcatcttttgaagatgccaggagcaattcggaatactatctgattgaatgtgaacctgcctggttaatttattacctgatttgatgaaccaaggaaagccatgcgtttaaacaaatatttacatttaatatgggaacataaaagagctttaaatattatagactttgtacctgttatatatatgaatattccctatgttaaataataataataactagtgtttatgaatagaatcatatcatctttagaaattgtttaaaattagttctgggaagttgaaagtggggaatgaagagataataaataaaactagattggccatatgtttataatttttttagattgggtaatgaatacatggagtttcattatacttttctctccacttttgtctatgttgaaaattttctgggagctaaatgatgagaacacatggacacatgatggggaacaacacacactagggcctgttgagggcagggagtcggcagagagagagcatcaggaagaatagctaatggatgctgggcttcatacctgggtgatgagatgatctgtgcagcaaagcaccatggtacatgtttacctatgtaacaaacctgcacatcctgcacatgtaccctggaacttaataaaagttggaaatttttaaaaagaatgaataagacctggtatttgatagcacaacagggagactatagtcaacagcaatttaattgtatattttaatatgactaaaagagtataatggattgtttgtaacacaaataaatgcttgaggggatggacaccccatattacatgatgtgattattacacattgcatgcctatatcaaaacatctcatgtaccccataaatatatacacctaatacccacaaaacttaaaatataaaatgttttaaataaaaataaagaaaagatttccacaataaaaagatttttactggaaaaaatcacnntattt

SEQ ID NO: 330240 - DNA, 2056 bp, Homo sapiens
  misc_feature (2050)..(2051): n is a, c, g, or t
tctccctcttccttttctttctctctttcgttattaaatgcaaagcagccatcgcctgggaagcaggcaagcccctttgcattgaagaggttgaagtagctccccccaaggctcatgaagttcgcattcagatcattgctacctccctgtgccatactgatgccactgttatcgattctaaatttgagggcctagctttcccagtgatcgttggccatgaggctgcaggtattgtggaaagtattgggccaggagtgaccaacgtcaaaccaggtgacaaagtaattccactttatgcacctctatgtagaaaatgcaagttttgtctgagtccactcacaaatttgtgtgggaaaatcagtaatctcaaaagtcctgctagtgatcaacaactaatggaagacaaaaccagcaggtttacctgcaaaggaaaaccagtttaccatttctttggaaccagtacattctctcagtacactgtggtgtcagatatcaatcttgcctcaactggctatggggctgcaatcaacaatgccaaggtcacccctggttcgacttgtgctgtctttggcctaggaggtgtgggtctttctgctgtaatgggttgtaaagcagcaggagcttccagaatcataggtattgacatcaacagtgagaagtttgtgaaggctaaagccctgggagccactgactgcctcaatcctagagacttacataaacctatccaggaagttatcattgaattgaccaagggaggtgtggattttgcccttgactgtgcaggtggatctgaaaccatgaaagcagccctggactgtacaaccgcaggctggggatcatgtactttcattggagtagctgctggtagcaaaggattgactgtttttccagaggagctaataatcggccgtactataaatggaacattctttggtggttggaaaagtgtagattctatcccaaagctggtcactgactataagaataagaaattcaatctggatgcactggtgacccataccctgccttttgacaaaatcagtgaggcatttgacctaatgaaccaaggaaaaagcatccgaacaatcctcatcttttgaagatgccaggagcaattcggaatactatctgattgaatgtgaacctgcctggttaatttattacctgatttgatgaaccaaggaaagccatgcgtttaaacaaatatttacatttaatatgggaacataaaagagctttaaatattatagactttgtacctgttatatatatgaatattccctatgttaaataataataataactagtgtttatgaatagaatcatatcatctttagaaattgtttaaaattagttctgggaagttgaaagtggggaatgaagagataataaataaaactagattggccatatgtttataatttttttagattgggtaatgaatacatggagtttcattatacttttctctccacttttgtctatgttgaaaattttctgggagctaaatgatgagaacacatggacacatgatggggaacaacacacactagggcctgttgagggcagggagtcggcagagagagagcatcaggaagaatagctaatggatgctgggcttcatacctgggtgatgagatgatctgtgcagcaaagcaccatggtacatgtttacctatgtaacaaacctgcacatcctgcacatgtaccctggaacttaataaaagttggaaatttttaaaaagaatgaataagacctggtatttgatagcacaacagggagactatagtcaacagcaatttaattgtatattttaatatgactaaaagagtataatggattgtttgtaacacaaataaatgcttgaggggatggacaccccatattacatgatgtgattattacacattgcatgcctatatcaaaacatctcatgtaccccataaatatatacacctaatacccacaaaacttaaaatataaaatgttttaaataaaaataaagaaaagatttccacaataaaaagatttttactggaaaaaatcacnntattt

SEQ ID NO: 330241 - DNA, 2662 bp, Homo sapiens
  misc_feature (27)..(27): n is a, c, g, or t
  misc_feature (29)..(29): n is a, c, g, or t
  misc_feature (262)..(262): n is a, c, g, or t
  misc_feature (2656)..(2657): n is a, c, g, or t
aaagcttgctagattaactattgatananaagcttaaataggtagtaaaccactaaatatgcaaggaagtgattatcagggttgtgaaggagaagaacaggtaagttaaatgggcattctgaggagtagaaatttcctttacttcataattatttgttaattcatctttatatgtttaatgggcttttctctattattttatatttttcaataaaagaaaaaagaatttaaaaaatcttggagctcactgggagcaatgggnttgcagctgaagtccaatagtacaaatgatgtggtaagaggccggcagggctgtgaattacagcaacaaaggagaaaaggaagtgattggagaattaagcaacatgaatggtattattcaaagacagctcattataggacacggaactccctgggtaggagtttgaagctttcttaactcagaaagaaacttccaacacagtttcccaaagaaaaatgggcaccaagggcaaaattttgatttagtggatttgaggcagggctttcatctctaacaaattcccaagtgatgtgaataaatgcttgtccgaggaccacacttcgagttgcagagatgtaaaacacatctattctccagcaattatctgactcaggttattaaatgcaaagcagccatcgcctgggaagcaggcaagcccctttgcattgaagaggttgaagtagctccccccaaggctcatgaagttcgcattcagatcattgctacctccctgtgccatactgatgccactgttatcgattctaaatttgagggcctagctttcccagtgatcgttggccatgaggctgcaggtattgtggaaagtattgggccaggagtgaccaacgtcaaaccaggtgacaaagtaattccactttatgcacctctatgtagaaaatgcaagttttgtctgagtccactcacaaatttgtgtgggaaaatcagtaatctcaaaagtcctgctagtgatcaacaactaatggaagacaaaaccagcaggtttacctgcaaaggaaaaccagtttaccatttctttggaaccagtacattctctcagtacactgtggtgtcagatatcaatcttgcctcaactggctatggggctgcaatcaacaatgccaaggtcacccctggttcgacttgtgctgtctttggcctaggaggtgtgggtctttctgctgtaatgggttgtaaagcagcaggagcttccagaatcataggtattgacatcaacagtgagaagtttgtgaaggctaaagccctgggagccactgactgcctcaatcctagagacttacataaacctatccaggaagttatcattgaattgaccaagggaggtgtggattttgcccttgactgtgcaggtggatctgaaaccatgaaagcagccctggactgtacaaccgcaggctggggatcatgtactttcattggagtagctgctggtagcaaaggattgactgtttttccagaggagctaataatcggccgtactataaatggaacattctttggtggttggaaaagtgtagattctatcccaaagctggtcactgactataagaataagaaattcaatctggatgcactggtgacccataccctgccttttgacaaaatcagtgaggcatttgacctaatgaaccaaggaaaaagcatccgaacaatcctcatcttttgaagatgccaggagcaattcggaatactatctgattgaatgtgaacctgcctggttaatttattacctgatttgatgaaccaaggaaagccatgcgtttaaacaaatatttacatttaatatgggaacataaaagagctttaaatattatagactttgtacctgttatatatatgaatattccctatgttaaataataataataactagtgtttatgaatagaatcatatcatctttagaaattgtttaaaattagttctgggaagttgaaagtggggaatgaagagataataaataaaactagattggccatatgtttataatttttttagattgggtaatgaatacatggagtttcattatacttttctctccacttttgtctatgttgaaaattttctgggagctaaatgatgagaacacatggacacatgatggggaacaacacacactagggcctgttgagggcagggagtcggcagagagagagcatcaggaagaatagctaatggatgctgggcttcatacctgggtgatgagatgatctgtgcagcaaagcaccatggtacatgtttacctatgtaacaaacctgcacatcctgcacatgtaccctggaacttaataaaagttggaaatttttaaaaagaatgaataagacctggtatttgatagcacaacagggagactatagtcaacagcaatttaattgtatattttaatatgactaaaagagtataatggattgtttgtaacacaaataaatgcttgaggggatggacaccccatattacatgatgtgattattacacattgcatgcctatatcaaaacatctcatgtaccccataaatatatacacctaatacccacaaaacttaaaatataaaatgttttaaataaaaataaagaaaagatttccacaataaaaagatttttactggaaaaaatcacnntattt

SEQ ID NO: 330242 - DNA, 2243 bp, Homo sapiens
  misc_feature (2237)..(2238): n is a, c, g, or t
gatagtttcatggtgtgaggacccagactacttcttggggaagaaacctgaggaaatatccccactgacatgaactccccaatttgcaaacgtgtcagtcacaacatatcagaaggaagttcaataaaaagaaaatacaagcattattttttaagctacaccatgtaaacttagtatataagccctgcaatgtattatacaacttcaatatccccataaggaatactcctcaagttaggagatagaggttgaagtggggtttgagcctcacacccttctattcatatcctcgaacacaaaccttttctcctagaattctcaattatggaatacattcataaggaatgctaagtggcagccaggtggctggtaatcagcctaggggtagacaccagagtgaggcctcctgctccttctctggcccactgagaataccacctgactgcccacacagatggaaaggtggcaatgaggaaggcagaagttgggcctcatcaggtgtgtccaccatatgggcacaggaagcacaagagagggcaggcccttctaccacccaactgcaaagaagcaaggaagtggggggaaggggatgggatacaatgactgactagcctgttgaggtgtagtgatcctgccccagagtgaggaaaggacacagagattctccttccacaggtaggggtgtcttccagtcctgggtgaagaaaacatttatgcatagcaccctgctcatagcaggggttccacagttccagcagtaatgtttgagataaggactgctctgtcgttgaggcttatccccctctttgtgtctacatgtggagttacccagaaataagaacatctgggttcttaaaaagtagcatcccaacacaccaactttgatgcccactccctccttcgatgctcaactttgccctcagctataggagatccgagaacagtgactattccaagactaaaacctgactccctccttggtacattctaattctcctcaacagcaccactgagtaacaaggacgctgcctaaggtaagtaagggtcctcaattccccccaagtttactagcacatgcataaaatattattaacaccatgaatggaagaggatgacgggataaaagaaattaggcttaataaagtgaatgtctataaaggaagaccagatcctgaaatgaaaaggcaaaacttatttgtgagctttggttaaatttatcatgaaaattacacttattaatgttttattgttattaacagcatcatccgaacaatcctcatcttttgaagatgccaggagcaattcggaatactatctgattgaatgtgaacctgcctggttaatttattacctgatttgatgaaccaaggaaagccatgcgtttaaacaaatatttacatttaatatgggaacataaaagagctttaaatattatagactttgtacctgttatatatatgaatattccctatgttaaataataataataactagtgtttatgaatagaatcatatcatctttagaaattgtttaaaattagttctgggaagttgaaagtggggaatgaagagataataaataaaactagattggccatatgtttataatttttttagattgggtaatgaatacatggagtttcattatacttttctctccacttttgtctatgttgaaaattttctgggagctaaatgatgagaacacatggacacatgatggggaacaacacacactagggcctgttgagggcagggagtcggcagagagagagcatcaggaagaatagctaatggatgctgggcttcatacctgggtgatgagatgatctgtgcagcaaagcaccatggtacatgtttacctatgtaacaaacctgcacatcctgcacatgtaccctggaacttaataaaagttggaaatttttaaaaagaatgaataagacctggtatttgatagcacaacagggagactatagtcaacagcaatttaattgtatattttaatatgactaaaagagtataatggattgtttgtaacacaaataaatgcttgaggggatggacaccccatattacatgatgtgattattacacattgcatgcctatatcaaaacatctcatgtaccccataaatatatacacctaatacccacaaaacttaaaatataaaatgttttaaataaaaataaagaaaagatttccacaataaaaagatttttactggaaaaaatcacnntattt

SEQ ID NO: 330243 - DNA, 2189 bp, Homo sapiens
  misc_feature (2183)..(2184): n is a, c, g, or t
gatagtttcatggtgtgaggacccagactacttcttggggaagaaacctgaggaaatatccccactgacatgaactccccaatttgcaaacgtgtcagtcacaacatatcagaaggaagttcaataaaaagaaaatacaagcattattttttaagctacaccatgtaaacttagtatataagccctgcaatgtattatacaacttcaatatccccataaggaatactcctcaagttaggagatagaggttgaagtggggtttgagcctcacacccttctattcatatcctcgaacacaaaccttttctcctagaattctcaattatggaatacattcataaggaatgctaagtggcagccaggtggctggtaatcagcctaggggtagacaccagagtgaggcctcctgctccttctctggcccactgagaataccacctgactgcccacacagatggaaaggtggcaatgaggaaggcagaagttgggcctcatcaggtgtgtccaccatatgggcacaggaagcacaagagagggcaggcccttctaccacccaactgcaaagaagcaaggaagtggggggaaggggatgggatacaatgactgactagcctgttgaggtgtagtgatcctgccccagagtgaggaaaggacacagagattctccttccacaggtaggggtgtcttccagtcctgggtgaagtaatgtttgagataaggactgctctgtcgttgaggcttatccccctctttgtgtctacatgtggagttacccagaaataagaacatctgggttcttaaaaagtagcatcccaacacaccaactttgatgcccactccctccttcgatgctcaactttgccctcagctataggagatccgagaacagtgactattccaagactaaaacctgactccctccttggtacattctaattctcctcaacagcaccactgagtaacaaggacgctgcctaaggtaagtaagggtcctcaattccccccaagtttactagcacatgcataaaatattattaacaccatgaatggaagaggatgacgggataaaagaaattaggcttaataaagtgaatgtctataaaggaagaccagatcctgaaatgaaaaggcaaaacttatttgtgagctttggttaaatttatcatgaaaattacacttattaatgttttattgttattaacagcatcatccgaacaatcctcatcttttgaagatgccaggagcaattcggaatactatctgattgaatgtgaacctgcctggttaatttattacctgatttgatgaaccaaggaaagccatgcgtttaaacaaatatttacatttaatatgggaacataaaagagctttaaatattatagactttgtacctgttatatatatgaatattccctatgttaaataataataataactagtgtttatgaatagaatcatatcatctttagaaattgtttaaaattagttctgggaagttgaaagtggggaatgaagagataataaataaaactagattggccatatgtttataatttttttagattgggtaatgaatacatggagtttcattatacttttctctccacttttgtctatgttgaaaattttctgggagctaaatgatgagaacacatggacacatgatggggaacaacacacactagggcctgttgagggcagggagtcggcagagagagagcatcaggaagaatagctaatggatgctgggcttcatacctgggtgatgagatgatctgtgcagcaaagcaccatggtacatgtttacctatgtaacaaacctgcacatcctgcacatgtaccctggaacttaataaaagttggaaatttttaaaaagaatgaataagacctggtatttgatagcacaacagggagactatagtcaacagcaatttaattgtatattttaatatgactaaaagagtataatggattgtttgtaacacaaataaatgcttgaggggatggacaccccatattacatgatgtgattattacacattgcatgcctatatcaaaacatctcatgtaccccataaatatatacacctaatacccacaaaacttaaaatataaaatgttttaaataaaaataaagaaaagatttccacaataaaaagatttttactggaaaaaatcacnntattt

SEQ ID NO: 330244 - DNA, 2203 bp, Homo sapiens
  misc_feature (2197)..(2198): n is a, c, g, or t
gatagtttcatggtgtgaggacccagactacttcttggggaagaaacctgaggaaatatccccactgacatgaactccccaatttgcaaacgtgtcagtcacaacatatcagaaggaagttcaataaaaagaaaatacaagcattattttttaagctacaccatgtaaacttagtatataagccctgcaatgtattatacaacttcaatatccccataaggaatactcctcaagttaggagatagaggttgaagtggggtttgagcctcacacccttctattcatatcctcgaacacaaaccttttctcctagaattctcaattatggaatacattcataaggaatgctaagtggcagccaggtggctggtaatcagcctaggggtagacaccagagtgaggcctcctgctccttctctggcccactgagaataccacctgactgcccacacagatggaaaggtggcaatgaggaaggcagaagttgggcctcatcaggtgtgtccaccatatgggcacaggaagcacaagagagggcaggcccttctaccacccaactgcaaagaagcaaggaagtggggggaaggggatgggatacaatgactgactagcctgttgaggtgtagtgatcctgccccagagtgaggaaaggacacagagattctccttccacaggtaggggtgtcttccagtcctgggtgaagaaaacatttatgcatagcaccctgctcatagcaggggttccacagttccagcagtaatgtttgagataaggactgctctgtcgttgaggcttatccccctctttgtgtctacatgtggagttacccagaaataagaacatctgggttcttaaaaagtagcatcccaacacaccaactttgatgcccactccctccttcgatgctcaactttgccctcagctataggagatccgagaacagtgactattccaagactaaaacctgactccctccttggtacattctaattctcctcaacagcaccactgagtaacaaggacgctgcctaaggtaagtaagggtcctcaattccccccaagtttactagcacatgcataaaatattattaacaccatgaatggaagaggatgacgggataaaagaaattaggcttaataaagtgaatgtctataaaggaagaccagatcctgaaatgaaaaggcaaaacttatttgtgagctttggttaaatttatcatgcatccgaacaatcctcatcttttgaagatgccaggagcaattcggaatactatctgattgaatgtgaacctgcctggttaatttattacctgatttgatgaaccaaggaaagccatgcgtttaaacaaatatttacatttaatatgggaacataaaagagctttaaatattatagactttgtacctgttatatatatgaatattccctatgttaaataataataataactagtgtttatgaatagaatcatatcatctttagaaattgtttaaaattagttctgggaagttgaaagtggggaatgaagagataataaataaaactagattggccatatgtttataatttttttagattgggtaatgaatacatggagtttcattatacttttctctccacttttgtctatgttgaaaattttctgggagctaaatgatgagaacacatggacacatgatggggaacaacacacactagggcctgttgagggcagggagtcggcagagagagagcatcaggaagaatagctaatggatgctgggcttcatacctgggtgatgagatgatctgtgcagcaaagcaccatggtacatgtttacctatgtaacaaacctgcacatcctgcacatgtaccctggaacttaataaaagttggaaatttttaaaaagaatgaataagacctggtatttgatagcacaacagggagactatagtcaacagcaatttaattgtatattttaatatgactaaaagagtataatggattgtttgtaacacaaataaatgcttgaggggatggacaccccatattacatgatgtgattattacacattgcatgcctatatcaaaacatctcatgtaccccataaatatatacacctaatacccacaaaacttaaaatataaaatgttttaaataaaaataaagaaaagatttccacaataaaaagatttttactggaaaaaatcacnntattt

SEQ ID NO: 330245 - DNA, 1277 bp, Homo sapiens
  misc_feature (46)..(46): n is a, c, g, or t
  misc_feature (1271)..(1272): n is a, c, g, or t
gtagggcgggaatggggggggggggggctggtaggtagtgggtcgntctggcaggtggatctgaaaccatgaaagcagccctggactgtacaaccgcaggctggggatcatgtactttcattggagtagctgctggtagcaaaggattgactgtttttccagaggagctaataatcggccgtactataaatggaacattctttggtggttggaaaagtgtagattctatcccaaagctggtcactgactataagaataagaaattcaatctggatgcactggtgacccataccctgccttttgacaaaatcagtgaggcatttgacctaatgaaccaaggaaaaagtatctgattgaatgtgaacctgcctggttaatttattacctgatttgatgaaccaaggaaagccatgcgtttaaacaaatatttacatttaatatgggaacataaaagagctttaaatattatagactttgtacctgttatatatatgaatattccctatgttaaataataataataactagtgtttatgaatagaatcatatcatctttagaaattgtttaaaattagttctgggaagttgaaagtggggaatgaagagataataaataaaactagattggccatatgtttataatttttttagattgggtaatgaatacatggagtttcattatacttttctctccacttttgtctatgttgaaaattttctgggagctaaatgatgagaacacatggacacatgatggggaacaacacacactagggcctgttgagggcagggagtcggcagagagagagcatcaggaagaatagctaatggatgctgggcttcatacctgggtgatgagatgatctgtgcagcaaagcaccatggtacatgtttacctatgtaacaaacctgcacatcctgcacatgtaccctggaacttaataaaagttggaaatttttaaaaagaatgaataagacctggtatttgatagcacaacagggagactatagtcaacagcaatttaattgtatattttaatatgactaaaagagtataatggattgtttgtaacacaaataaatgcttgaggggatggacaccccatattacatgatgtgattattacacattgcatgcctatatcaaaacatctcatgtaccccataaatatatacacctaatacccacaaaacttaaaatataaaatgttttaaataaaaataaagaaaagatttccacaataaaaagatttttactggaaaaaatcacnntattt

SEQ ID NO: 330246 - DNA, 944 bp, Homo sapiens
  misc_feature (27)..(27): n is a, c, g, or t
  misc_feature (29)..(29): n is a, c, g, or t
  misc_feature (262)..(262): n is a, c, g, or t
aaagcttgctagattaactattgatananaagcttaaataggtagtaaaccactaaatatgcaaggaagtgattatcagggttgtgaaggagaagaacaggtaagttaaatgggcattctgaggagtagaaatttcctttacttcataattatttgttaattcatctttatatgtttaatgggcttttctctattattttatatttttcaataaaagaaaaaagaatttaaaaaatcttggagctcactgggagcaatgggnttgcagctgaagtccaatagtacaaatgatgtggtaagaggccggcagggctgtgaattacagcaacaaaggagaaaaggaagtgattggagaattaagcaacatgaatggtattattcaaagacagctcattataggacacggaactccctgggtaggagtttgaagctttcttaactcagaaagaaacttccaacacagtttcccaaagaaaaatgggcaccaagggcaaaattttgatttagtggatttgaggcagggctttcatctctaacaaattcccaagtgatgtgaataaatgcttgtccgaggaccacacttcgagttgcagagatgtaaaacacatctattctccagcaattatctgactcaggttattaaatgcaaagcagccatcgcctgggaagcaggcaagcccctttgcattgaagaggttgaagtagctccccccaaggctcatgaagttcgcattcagtaatctcaaaagtcctgctagtgatcaacaactaatggaagacaaaaccagcaggtttacctgcaaaggaaaaccagtttaccatttctttggaaccagtacattctctcagtacactgtggtgtcagatatcaatcttgcctcaactggctatggggctgcaatcaacaatgccggtcacccctggttcgcttgtgctgtctttgg

SEQ ID NO: 330247 - DNA, 2469 bp, Homo sapiens
  misc_feature (27)..(27): n is a, c, g, or t
  misc_feature (29)..(29): n is a, c, g, or t
  misc_feature (262)..(262): n is a, c, g, or t
  misc_feature (2463)..(2464): n is a, c, g, or t
aaagcttgctagattaactattgatananaagcttaaataggtagtaaaccactaaatatgcaaggaagtgattatcagggttgtgaaggagaagaacaggtaagttaaatgggcattctgaggagtagaaatttcctttacttcataattatttgttaattcatctttatatgtttaatgggcttttctctattattttatatttttcaataaaagaaaaaagaatttaaaaaatcttggagctcactgggagcaatgggnttgcagctgaagtccaatagtacaaatgatgtggtaagaggccggcagggctgtgaattacagcaacaaaggagaaaaggaagtgattggagaattaagcaacatgaatggtattattcaaagacagctcattataggacacggaactccctgggtaggagtttgaagctttcttaactcagaaagaaacttccaacacagtttcccaaagaaaaatgggcaccaagggcaaagttattaaatgcaaagcagccatcgcctgggaagcaggcaagcccctttgcattgaagaggttgaagtagctccccccaaggctcatgaagttcgcattcagatcattgctacctccctgtgccatactgatgccactgttatcgattctaaatttgagggcctagctttcccagtgatcgttggccatgaggctgcaggtattgtggaaagtattgggccaggagtgaccaacgtcaaaccaggtgacaaagtaattccactttatgcacctctatgtagaaaatgcaagttttgtctgagtccactcacaaatttgtgtgggaaaatcagtaatctcaaaagtcctgctagtgatcaacaactaatggaagacaaaaccagcaggtttacctgcaaaggaaaaccagtttaccatttctttggaaccagtacattctctcagtacactgtggtgtcagatatcaatcttgcctcaactggctatggggctgcaatcaacaatgccaaggtcacccctggttcgacttgtgctgtctttggcctaggaggtgtgggtctttctgctgtaatgggttgtaaagcagcaggagcttccagaatcataggtattgacatcaacagtgagaagtttgtgaaggctaaagccctgggagccactgactgcctcaatcctagagacttacataaacctatccaggaagttatcattgaattgaccaagggaggtgtggattttgcccttgactgtgcaggtggatctgaaaccatgaaagcagccctggactgtacaaccgcaggctggggatcatgtactttcattggagtagctgctggtagcaaaggattgactgtttttccagaggagctaataatcggccgtactataaatggaacattctttggtggttggaaaagtgtagattctatcccaaagctggtcactgactataagaataagaaattcaatctggatgcactggtgacccataccctgccttttgacaaaatcagtgaggcatttgacctaatgaaccaaggaaaaagcatccgaacaatcctcatcttttgaagatgccaggagcaattcggaatactatctgattgaatgtgaacctgcctggttaatttattacctgatttgatgaaccaaggaaagccatgcgtttaaacaaatatttacatttaatatgggaacataaaagagctttaaatattatagactttgtacctgttatatatatgaatattccctatgttaaataataataataactagtgtttatgaatagaatcatatcatctttagaaattgtttaaaattagttctgggaagttgaaagtggggaatgaagagataataaataaaactagattggccatatgtttataatttttttagattgggtaatgaatacatggagtttcattatacttttctctccacttttgtctatgttgaaaattttctgggagctaaatgatgagaacacatggacacatgatggggaacaacacacactagggcctgttgagggcagggagtcggcagagagagagcatcaggaagaatagctaatggatgctgggcttcatacctgggtgatgagatgatctgtgcagcaaagcaccatggtacatgtttacctatgtaacaaacctgcacatcctgcacatgtaccctggaacttaataaaaggagactatagtcaacagcaatttaattgtatattttaatatgactaaaagagtataatggattgtttgtaacacaaataaatgcttgaggggatggacaccccatattacatgatgtgattattacacattgcatgcctatatcaaaacatctcatgtaccccataaatatatacacctaatacccacaaaacttaaaatataaaatgttttaaataaaaataaagaaaagatttccacaataaaaagatttttactggaaaaaatcacnntattt

SEQ ID NO: 330248 - DNA, 2386 bp, Homo sapiens
  misc_feature (27)..(27): n is a, c, g, or t
  misc_feature (29)..(29): n is a, c, g, or t
  misc_feature (262)..(262): n is a, c, g, or t
  misc_feature (2380)..(2381): n is a, c, g, or t
aaagcttgctagattaactattgatananaagcttaaataggtagtaaaccactaaatatgcaaggaagtgattatcagggttgtgaaggagaagaacaggtaagttaaatgggcattctgaggagtagaaatttcctttacttcataattatttgttaattcatctttatatgtttaatgggcttttctctattattttatatttttcaataaaagaaaaaagaatttaaaaaatcttggagctcactgggagcaatgggnttgcagctgaagtccaatagtacaaatgatgtggtaagaggccggcagggctgtgaattacagcaacaaaggagaaaaggaagtgattggagaattaagcaacatgaatggtattattcaaagacagctcattataggacacggaactccctgggtaggagtttgaagctttcttaactcagaaagaaacttccaacacagtttcccaaagaaaaatgggcaccaagggcaaagttattaaatgcaaagcagccatcgcctgggaagcaggcaagcccctttgcattgaagaggttgaagtagctccccccaaggctcatgaagttcgcattcagatcattgctacctccctgtgccatactgatgccactgttatcgattctaaatttgagggcctagctttcccagtgatcgttggccatgaggctgcaggtattgtggaaagtattgggccaggagtgaccaacgtcaaaccaggtgacaaagtaattccactttatgcacctctatgtagaaaatgcaagttttgtctgagtccactcacaaatttgtgtgggaaaatcagtaatctcaaaagtcctgctagtgatcaacaactaatggaagacaaaaccagcaggtttacctgcaaaggaaaaccagtttaccatttctttggaaccagtacattctctcagtacactgtggtgtcagatatcaatcttgcctcaactggctatggggctgcaatcaacaatgccaaggtcacccctggttcgacttgtgctgtctttggcctaggaggtgtgggtctttctgctgtaatgggttgtaaagcagcaggagcttccagaatcataggtattgacatcaacagtgagaagtttgtgaaggctaaagccctgggagccactgactgcctcaatcctagagacttacataaacctatccaggaagttatcattgaattgaccaagggaggtgtggattttgcccttgactgtgcaggtggatctgaaaccatggttggaaaagtgtagattctatcccaaagctggtcactgactataagaataagaaattcaatctggatgcactggtgacccataccctgccttttgacaaaatcagtgaggcatttgacctaatgaaccaaggaaaaagcatccgaacaatcctcatcttttgaagatgccaggagcaattcggaatactatctgattgaatgtgaacctgcctggttaatttattacctgatttgatgaaccaaggaaagccatgcgtttaaacaaatatttacatttaatatgggaacataaaagagctttaaatattatagactttgtacctgttatatatatgaatattccctatgttaaataataataataactagtgtttatgaatagaatcatatcatctttagaaattgtttaaaattagttctgggaagttgaaagtggggaatgaagagataataaataaaactagattggccatatgtttataatttttttagattgggtaatgaatacatggagtttcattatacttttctctccacttttgtctatgttgaaaattttctgggagctaaatgatgagaacacatggacacatgatggggaacaacacacactagggcctgttgagggcagggagtcggcagagagagagcatcaggaagaatagctaatggatgctgggcttcatacctgggtgatgagatgatctgtgcagcaaagcaccatggtacatgtttacctatgtaacaaacctgcacatcctgcacatgtaccctggaacttaataaaagttggaaatttttaaaaagaatgaataagacctggtatttgatagcacaacagggagactatagtcaacagcaatttaattgtatattttaatatgactaaaagagtataatggattgtttgtaacacaaataaatgcttgaggggatggacaccccatattacatgatgtgattattacacattgcatgcctatatcaaaacatctcatgtaccccataaatatatacacctaatacccacaaaacttaaaatataaaatgttttaaataaaaataaagaaaagatttccacaataaaaagatttttactggaaaaaatcacnntattt

SEQ ID NO: 330249 - DNA, 2514 bp, Homo sapiens
  misc_feature (27)..(27): n is a, c, g, or t
  misc_feature (29)..(29): n is a, c, g, or t
  misc_feature (262)..(262): n is a, c, g, or t
  misc_feature (2508)..(2509): n is a, c, g, or t
aaagcttgctagattaactattgatananaagcttaaataggtagtaaaccactaaatatgcaaggaagtgattatcagggttgtgaaggagaagaacaggtaagttaaatgggcattctgaggagtagaaatttcctttacttcataattatttgttaattcatctttatatgtttaatgggcttttctctattattttatatttttcaataaaagaaaaaagaatttaaaaaatcttggagctcactgggagcaatgggnttgcagctgaagtccaatagtacaaatgatgtggtaagaggccggcagggctgtgaattacagcaacaaaggagaaaaggaagtgattggagaattaagcaacatgaatggtattattcaaagacagctcattataggacacggaactccctgggtaggagtttgaagctttcttaactcagaaagaaacttccaacacagtttcccaaagaaaaatgggcaccaagggcaaagttattaaatgcaaagcagccatcgcctgggaagcaggcaagcccctttgcattgaagaggttgaagtagctccccccaaggctcatgaagttcgcattcagatcattgctacctccctgtgccatactgatgccactgttatcgattctaaatttgagggcctagctttcccagtgatcgttggccatgaggctgcaggtattgtggaaagtattgggccaggagtgaccaacgtcaaaccaggtgacaaagtaattccactttatgcacctctatgtagaaaatgcaagttttgtctgagtccactcacaaatttgtgtgggaaaatcagtaatctcaaaagtcctgctagtgatcaacaactaatggaagacaaaaccatacactgtggtgtcagatatcaatcttgccaaaatagatgatgatgcaaatttagagagagtttgtctgcttggatgtgggttttcaactggctatggggctgcaatcaacaatgccaaggtcacccctggttcgacttgtgctgtctttggcctaggaggtgtgggtctttctgctgtaatgggttgtaaagcagcaggagcttccagaatcataggtattgacatcaacagtgagaagtttgtgaaggctaaagccctgggagccactgactgcctcaatcctagagacttacataaacctatccaggaagttatcattgaattgaccaagggaggtgtggattttgcccttgactgtgcaggtggatctgaaaccatgaaagcagccctggactgtacaaccgcaggctggggatcatgtactttcattggagtagctgctggtagcaaaggattgactgtttttccagaggagctaataatcggccgtactataaatggaacattctttggtggttggaaaagtgtagattctatcccaaagctggtcactgactataagaataagaaattcaatctggatgcactggtgacccataccctgccttttgacaaaatcagtgaggcatttgacctaatgaaccaaggaaaaagcatccgaacaatcctcatcttttgaagatgccaggagcaattcggaatactatctgattgaatgtgaacctgcctggttaatttattacctgatttgatgaaccaaggaaagccatgcgtttaaacaaatatttacatttaatatgggaacataaaagagctttaaatattatagactttgtacctgttatatatatgaatattccctatgttaaataataataataactagtgtttatgaatagaatcatatcatctttagaaattgtttaaaattagttctgggaagttgaaagtggggaatgaagagataataaataaaactagattggccatatgtttataatttttttagattgggtaatgaatacatggagtttcattatacttttctctccacttttgtctatgttgaaaattttctgggagctaaatgatgagaacacatggacacatgatggggaacaacacacactagggcctgttgagggcagggagtcggcagagagagagcatcaggaagaatagctaatggatgctgggcttcatacctgggtgatgagatgatctgtgcagcaaagcaccatggtacatgtttacctatgtaacaaacctgcacatcctgcacatgtaccctggaacttaataaaagttggaaatttttaaaaagaatgaataagacctggtatttgatagcacaacagggagactatagtcaacagcaatttaattgtatattttaatatgactaaaagagtataatggattgtttgtaacacaaataaatgcttgaggggatggacaccccatattacatgatgtgattattacacattgcatgcctatatcaaaacatctcatgtaccccataaatatatacacctaatacccacaaaacttaaaatataaaatgttttaaataaaaataaagaaaagatttccacaataaaaagatttttactggaaaaaatcacnntattt

SEQ ID NO: 330250 - DNA, 2133 bp, Homo sapiens
  misc_feature (27)..(27): n is a, c, g, or t
  misc_feature (29)..(29): n is a, c, g, or t
  misc_feature (262)..(262): n is a, c, g, or t
  misc_feature (2127)..(2128): n is a, c, g, or t
aaagcttgctagattaactattgatananaagcttaaataggtagtaaaccactaaatatgcaaggaagtgattatcagggttgtgaaggagaagaacaggtaagttaaatgggcattctgaggagtagaaatttcctttacttcataattatttgttaattcatctttatatgtttaatgggcttttctctattattttatatttttcaataaaagaaaaaagaatttaaaaaatcttggagctcactgggagcaatgggnttgcagctgaagtccaatagtacaaatgatgtggtaagaggccggcagggctgtgaattacagcaacaaaggagaaaaggaagtgattggagaattaagcaacatgaatggtattattcaaagacagctcattataggacacggaactccctgggtaggagtttgaagctttcttaactcagaaagaaacttccaacacagtttcccaaagaaaaatgggcaccaagggcaaagttattaaatgcaaagcagccatcgcctgggaagcaggcaagcccctttgcattgaagaggttgaagtagctccccccaaggctcatgaagttcgcattcagatcattgctacctccctgtgccatactgatgccactgttatcgattctaaatttgagggcctagctttcccagtgatcgttggccatgaggctgcaggtattgtggaaagtattgggccaggagtgaccaacgtcaaaccaggtgacaaagtaattccactttatgcacctctatgtagaaaatgcaagttttgtctgagtccactcacaaatttgtgtgggaaaatcagtaatctcaaaagtcctgctagtgatcaacaactaatggaagacaaaaccaaaagcagccctggactgtacaaccgcaggctggggatcatgtactttcattggagtagctgctggtagcaaaggattgactgtttttccagaggagctaataatcggccgtactataaatggaacattctttggtggttggaaaagtgtagattctatcccaaagctggtcactgactataagaataagaaattcaatctggatgcactggtgacccataccctgccttttgacaaaatcagtgaggcatttgacctaatgaaccaaggaaaaagcatccgaacaatcctcatcttttgaagatgccaggagcaattcggaatactatctgattgaatgtgaacctgcctggttaatttattacctgatttgatgaaccaaggaaagccatgcgtttaaacaaatatttacatttaatatgggaacataaaagagctttaaatattatagactttgtacctgttatatatatgaatattccctatgttaaataataataataactagtgtttatgaatagaatcatatcatctttagaaattgtttaaaattagttctgggaagttgaaagtggggaatgaagagataataaataaaactagattggccatatgtttataatttttttagattgggtaatgaatacatggagtttcattatacttttctctccacttttgtctatgttgaaaattttctgggagctaaatgatgagaacacatggacacatgatggggaacaacacacactagggcctgttgagggcagggagtcggcagagagagagcatcaggaagaatagctaatggatgctgggcttcatacctgggtgatgagatgatctgtgcagcaaagcaccatggtacatgtttacctatgtaacaaacctgcacatcctgcacatgtaccctggaacttaataaaagttggaaatttttaaaaagaatgaataagacctggtatttgatagcacaacagggagactatagtcaacagcaatttaattgtatattttaatatgactaaaagagtataatggattgtttgtaacacaaataaatgcttgaggggatggacaccccatattacatgatgtgattattacacattgcatgcctatatcaaaacatctcatgtaccccataaatatatacacctaatacccacaaaacttaaaatataaaatgttttaaataaaaataaagaaaagatttccacaataaaaagatttttactggaaaaaatcacnntattt

SEQ ID NO: 330251 - DNA, 2526 bp, Homo sapiens
  misc_feature (27)..(27): n is a, c, g, or t
  misc_feature (29)..(29): n is a, c, g, or t
  misc_feature (262)..(262): n is a, c, g, or t
  misc_feature (2520)..(2521): n is a, c, g, or t
aaagcttgctagattaactattgatananaagcttaaataggtagtaaaccactaaatatgcaaggaagtgattatcagggttgtgaaggagaagaacaggtaagttaaatgggcattctgaggagtagaaatttcctttacttcataattatttgttaattcatctttatatgtttaatgggcttttctctattattttatatttttcaataaaagaaaaaagaatttaaaaaatcttggagctcactgggagcaatgggnttgcagctgaagtccaatagtacaaatgatgtggtaagaggccggcagggctgtgaattacagcaacaaaggagaaaaggaagtgattggagaattaagcaacatgaatggtattattcaaagacagctcattataggacacggaactccctgggtaggagtttgaagctttcttaactcagaaagaaacttccaacacagtttcccaaagaaaaatgggcaccaagggcaaagttattaaatgcaaagcagccatcgcctgggaagcaggcaagcccctttgcattgaagaggttgaagtagctccccccaaggctcatgaagttcgcattcagatcattgctacctccctgtgccatactgatgccactgttatcgattctaaatttgagggcctagctttcccagtgatcgttggccatgaggctgcaggtattgtggaaagtattgggccaggagtgaccaacgtcaaaccaggtgacaaagtaattccactttatgcacctctatgtagaaaatgcaagttttgtctgagtccactcacaaatttgtgtgggaaaatcaggcaggtttacctgcaaaggaaaaccagtttaccatttctttggaaccagtacattctctcagtacactgtggtgtcagatatcaatcttgccaaaatagatgatgatgcaaatttagagagagtttgtctgcttggatgtgggttttcaactggctatggggctgcaatcaacaatgccaaggtcacccctggttcgacttgtgctgtctttggcctaggaggtgtgggtctttctgctgtaatgggttgtaaagcagcaggagcttccagaatcataggtattgacatcaacagtgagaagtttgtgaaggctaaagccctgggagccactgactgcctcaatcctagagacttacataaacctatccaggaagttatcattgaattgaccaagggaggtgtggattttgcccttgactgtgcaggtggatctgaaaccatgaaagcagccctggactgtacaaccgcaggctggggatcatgtactttcattggagtagctgctggtagcaaaggattgactgtttttccagaggagctaataatcggccgtactataaatggaacattctttggtggttggaaaagtgtagattctatcccaaagctggtcactgactataagaataagaaattcaatctggatgcactggtgacccataccctgccttttgacaaaatcagtgaggcatttgacctaatgaaccaaggaaaaagcatccgaacaatcctcatcttttgaagatgccaggagcaattcggaatactatctgattgaatgtgaacctgcctggttaatttattacctgatttgatgaaccaaggaaagccatgcgtttaaacaaatatttacatttaatatgggaacataaaagagctttaaatattatagactttgtacctgttatatatatgaatattccctatgttaaataataataataactagtgtttatgaatagaatcatatcatctttagaaattgtttaaaattagttctgggaagttgaaagtggggaatgaagagataataaataaaactagattggccatatgtttataatttttttagattgggtaatgaatacatggagtttcattatacttttctctccacttttgtctatgttgaaaattttctgggagctaaatgatgagaacacatggacacatgatggggaacaacacacactagggcctgttgagggcagggagtcggcagagagagagcatcaggaagaatagctaatggatgctgggcttcatacctgggtgatgagatgatctgtgcagcaaagcaccatggtacatgtttacctatgtaacaaacctgcacatcctgcacatgtaccctggaacttaataaaagttggaaatttttaaaaagaatgaataagacctggtatttgatagcacaacagggagactatagtcaacagcaatttaattgtatattttaatatgactaaaagagtataatggattgtttgtaacacaaataaatgcttgaggggatggacaccccatattacatgatgtgattattacacattgcatgcctatatcaaaacatctcatgtaccccataaatatatacacctaatacccacaaaacttaaaatataaaatgttttaaataaaaataaagaaaagatttccacaataaaaagatttttactggaaaaaatcacnntattt

SEQ ID NO: 330252 - DNA, 2092 bp, Homo sapiens
  misc_feature (27)..(27): n is a, c, g, or t
  misc_feature (29)..(29): n is a, c, g, or t
  misc_feature (262)..(262): n is a, c, g, or t
  misc_feature (2086)..(2087): n is a, c, g, or t
aaagcttgctagattaactattgatananaagcttaaataggtagtaaaccactaaatatgcaaggaagtgattatcagggttgtgaaggagaagaacaggtaagttaaatgggcattctgaggagtagaaatttcctttacttcataattatttgttaattcatctttatatgtttaatgggcttttctctattattttatatttttcaataaaagaaaaaagaatttaaaaaatcttggagctcactgggagcaatgggnttgcagctgaagtccaatagtacaaatgatgtggtaagaggccggcagggctgtgaattacagcaacaaaggagaaaaggaagtgattggagaattaagcaacatgaatggtattattcaaagacagctcattataggacacggaactccctgggtaggagtttgaagctttcttaactcagaaagaaacttccaacacagtttcccaaagaaaaatgggcaccaagggcaaagttattaaatgcaaagcagccatcgcctgggaagcaggcaagcccctttgcattgaagaggttgaagtagctccccccaaggctcatgaagttcgcattcagatcattgctacctccctgtgccatactgatgccactgttatcgattctaaatttgagggcctagctttcccagtgatcgttggccatgaggctgcaggtattgtggaaagtattgggccaggagtgaccaacgtcaaaccaggtgacaaagtaattccactttatgcacctctatgtagaaaatgcaagttttgtctgagtccactcacaaatttgtgtgggaaaatcagtaatctcaaaagtcctgctagtgatcaacaactaatggaagacaaaaccaaaagcagccctggactgtacaaccgcaggctggggatcatgtactttcattggagtagctgctggtagcaaaggattgactgtttttccagaggagctaataatcggccgtactataaatggaacattctttggtggttggaaaagtgtagattctatcccaaagctggtcactgactataagaataagaaattcaatctggatgcactggtgacccataccctgccttttgacaaaatcagtgaggcatttgacctaatgaaccaaggaaaaagcatccgaacaatcctcatcttttgaagatgccaggagcaattcggaatactatctgattgaatgtgaacctgcctggttaatttattacctgatttgatgaaccaaggaaagccatgcgtttaaacaaatatttacatttaatatgggaacataaaagagctttaaatattatagactttgtacctgttatatatatgaatattccctatgttaaataataataataactagtgtttatgaatagaatcatatcatctttagaaattagataataaataaaactagattggccatatgtttataatttttttagattgggtaatgaatacatggagtttcattatacttttctctccacttttgtctatgttgaaaattttctgggagctaaatgatgagaacacatggacacatgatggggaacaacacacactagggcctgttgagggcagggagtcggcagagagagagcatcaggaagaatagctaatggatgctgggcttcatacctgggtgatgagatgatctgtgcagcaaagcaccatggtacatgtttacctatgtaacaaacctgcacatcctgcacatgtaccctggaacttaataaaagttggaaatttttaaaaagaatgaataagacctggtatttgatagcacaacagggagactatagtcaacagcaatttaattgtatattttaatatgactaaaagagtataatggattgtttgtaacacaaataaatgcttgaggggatggacaccccatattacatgatgtgattattacacattgcatgcctatatcaaaacatctcatgtaccccataaatatatacacctaatacccacaaaacttaaaatataaaatgttttaaataaaaataaagaaaagatttccacaataaaaagatttttactggaaaaaatcacnntattt

SEQ ID NO: 330253 - DNA, 281 bp, Homo sapiens
caagtacttaaacttttgtgagggattctctaagtgttatcttttaagtgtagcatctctcgttcttaattggaggtaaagacatccactggggcaaaatgaattttgtagaaccagatgttttcattaggaggagattgtgtcagctgatctgccactgagaggcatgttcaggcttgttctgagacatagatttccttcatgtggaagattctggacttggacaaggtgggaggaagccagccctgttgagcaagccctgctctcaaagagtttcaacc

SEQ ID NO: 330254 - DNA, 1609 bp, Homo sapiens
  misc_feature (1)..(1): n is a, c, g, or t
ngagcctccaagtgtccacaccctgtgtgtcctctgtcctgccagcaccgagggctcatccatccacagagcagtgcagtgggaggagacgccatgacccccatcctcacggtcctgatctgtctcgggctgagcctggaccccaggacccacgtgcaggcagggcccctccccaagcccaccctctgggctgagccaggctctgtgatcacccaagggagtcctgtgaccctcaggtgtcaggggagcctggagacgcaggagtaccatctatatagagaaaagaaaacagcactctggattacacggatcccacaggagcttgtgaagaagggccagttccccatcctatccatcacctgggaacatgcagggcggtattgctgtatctatggcagccacactgcaggcctctcagagagcagtgaccccctggagctggtggtgacaggagcctacagcaaacccaccctctcagctctgcccagccctgtggtgacctcaggagggaatgtgaccatccagtgtgactcacaggtggcatttgatggcttcattctgtgtaaggaaggagaagatgaacacccacaatgcctgaactcccattcccatgcccgtgggtcatcccgggccatcttctccgtgggccccgtgagcccaagtcgcaggtggtcgtacaggtgctatggttatgactcgcgcgctccctatgtgtggtctctacccagtgatctcctggggctcctggtcccaggtgtttctaagaagccatcactctcagtgcagccgggtcctgtcgtggcccctggggagaagctgaccttccagtgtggctctgatgccggctacgacagatttgttctgtacaaggagtggggacgtgacttcctccagcgccctggccggcagccccaggctgggctctcccaggccaacttcaccctgggccctgtgagccgctcctacgggggccagtacacatgctccggtgcatacaacctctcctccgagtggtcggcccccagcgaccccctggacatcctgatcacaggacagatccgtgccagacccttcctctccgtgcggccgggccccacagtggcctcaggagagaacgtgaccctgctgtgtcagtcacagggagggatgcacactttccttttgaccaaggagggggcagctgattccccgctgcgtctaaaatcaaagcgccaatctcataagtaccaggctgaattccccatgagtcctgtgacctcggcccacgcggggacctacaggtgctacggctcactcagctccaacccctacctgctgactcaccccagtgaccccctggagctcgtggtctcaggagcagctgagaccctcagcccaccacaaaacaagtccgactccaaggctggtgagtgaggagatgcttgccgtgatgacgctgggcacagagggtcaggtcctgtcaagaggagctgggtgtcctgggtggacatttgaagaattatattcattccaacttgaagaattattcaacacctttaacaatgtatatgtgaagtactttattctttcatattttaaaaataaaagataattatccatgagaaaacta

SEQ ID NO: 330255 - DNA, 1417 bp, Homo sapiens
  misc_feature (1)..(1): n is a, c, g, or t
ngagcctccaagtgtccacaccctgtgtgtcctctgtcctgccagcaccgagggctcatccatccacagagcagtgcagtgggaggagacgccatgacccccatcctcacggtcctgatctgtctcgggctgagcctggaccccaggacccacgtgcaggcagggcccctccccaagcccaccctctgggctgagccaggctctgtgatcacccaagggagtcctgtgaccctcaggtgtcaggggagcctggagacgcaggagtaccatctatatagagaaaagaaaacagcactctggattacacggatcccacaggagcttgtgaagaagggccagttccccatcctatccatcacctgggaacatgcagggcggtattgctgtatctatggcagccacactgcaggcctctcagagagcagtgaccccctggagctggtggtgacaggagcctacagcaaacccaccctctcagctctgcccagccctgtggtgacctcaggagggaatgtgaccatccagtgtgactcacaggtggcatttgatggcttcattctgtgtgtttctaagaagccatcactctcagtgcagccgggtcctgtcgtggcccctggggagaagctgaccttccagtgtggctctgatgccggctacgacagatttgttctgtacaaggagtggggacgtgacttcctccagcgccctggccggcagccccaggctgggctctcccaggccaacttcaccctgggccctgtgagccgctcctacgggggccagtacacatgctccggtgcatacaacctctcctccgagtggtcggcccccagcgaccccctggacatcctgatcacaggacagatccgtgccagacccttcctctccgtgcggccgggccccacagtggcctcaggagagaacgtgaccctgctgtgtcagtcacagggagggatgcacactttccttttgaccaaggagggggcagctgattccccgctgcgtctaaaatcaaagcgccaatctcataagtaccaggctgaattccccatgagtcctgtgacctcggcccacgcggggacctacaggtgctacggctcactcagctccaacccctacctgctgactcaccccagtgaccccctggagctcgtggtctcaggagcagctgagaccctcagcccaccacaaaacaagtccgactccaaggctggtgagtgaggagatgcttgccgtgatgacgctgggcacagagggtcaggtcctgtcaagaggagctgggtgtcctgggtggacatttgaagaattatattcattccaacttgaagaattattcaacacctttaacaatgtatatgtgaagtactttattctttcatattttaaaaataaaagataattatccatgagaaaacta

SEQ ID NO: 330256 - DNA, 266 bp, Homo sapiens
catgggtcaggtcctttactgtagttttttcagaaagaaacaggcaaagcgaggtaggcagaattagaattggctaatttgaatattttcagtggactgtggtatgtagggattgcccttagttgccctgttacccctggccctggagtgatattacagaagagagatcccggctcaatctctgagagctaaaggaggtggttggtggctgtgtgctctggactgattggtttgcacaggaaaggcatgccgcagggagtcacttg

SEQ ID NO: 330257 - DNA, 891 bp, Homo sapiens
agcccccattccttggtctcgtctgagcagttaggttccgcctgtggttgcacatttggttcatctgaggatgttcaggttatgtgaccttcaacctgggagtccgtggcaactgaaaaacaactcaccattttattacacaaaattgaaccagaatgggctggttctgcggttacacctccaccaccatccctcctcttctcacacaggctggggctgctggtttgtttctacaatgacctggaattgctggatgccactgtggctcaagtcctgctttaccagatgatcaagtgcagccacctgaggggcttccaggctggcgtccagaagctcaaagcagaactcctggacattgccatggagaaccagaccctcaatgagaccctgggttctttgtcggatgcagttgtaggtttgacctacagccaactggaatccctctcccccgaggctgtgcacggagccatctccaccctcaaccaggtctcaggttgggccaagagccaggtcatcatcttgtctgccaaatacttggcccatgagaaggtgctgtctttctacaatgtcagccagatgggcgcactgctggctggggtcagcacccaggccttctgcagcatgaaacgcaaggacatctcgcaggtcctgagaagtgccgtctcccagtatgtattccgacttgtcacctgcccagcagcaaggtatcctcagcaagatggtccaagcggaagacactgccccaggcatcgtggagatacaaggggctttctttaaggaagtgtctctctttgatttaaggaggcaacctggattcaactctacagtcctgaaggataaggaacttggaaggagccaggtattaccatgaaacacagatcgatcctgtat

SEQ ID NO: 330258 - DNA, 627 bp, Homo sapiens
aggatcctctaaactgacgcgatacttgaaacataatgtgatcatgctctaacttcaatataccaataaaataatcagattgcaatttctgattatagcatctccttctgagtgtttgggactctggaatctgagacccatgttcacattgtaagaacatccaggaccccttctccttgatgtttccagcaagcttctttcctcctttatccttattaagtcatctgcctggggaaggagttccactgtttctttccttctctgtcttcttagctcgaatttaaattgcacaattattttcaggtcatttcctgatagtctagtcagcttatgaatgtaagcaaaacaggaccaatgaaagaaagtcccagaagctgagagaaactttaacaagtttgagagtaacttattttgttttctaggaaagtgagtatggttctatgcctgtattccccagaagccactagacctattttcccctattttatcactgatcagttctgtccctgcctatgattcttaccattcttaagaaaacctgaatggatttcatcaaggcggcagcataatttgaagggcaattgcgtgtgaaaattgatgtgacttgatttacacaatagtcagaaa

SEQ ID NO: 330259 - DNA, 923 bp, Homo sapiens
  misc_feature (67)..(67): n is a, c, g, or t
tgtcagccaagaagacgttcccttggtaatatcagatggaggagactctgagcagttcatagatgangagcgtcagggcccacctttgggaggacagcaatctcaaccctctgctggtgatgggaaccagaatgatggccctcagcagggaccaccccagcaaggaggccagcagcaacaaggtccaccacctcctcaggcaaagtcacaaagcgtgtaggttaaggcgctgtaggtagagcataaagttgggagtgacaccagagccttctgcaagatgcttctgattctgctgtcagtggccctgctggccttcagctcagctcaggacttagatgaagatgtcagccaagaagacgttcccttggtaatatcagatggaggagactctgagcagttcatagatgaggagcgtcagggaccacctttgggaggacagcaatctcaaccctctgctggtgatgggaaccagaatgatggccctcagcagggaccaccccaacaaggaggccagcagcaacaaggtccaccacctcctcagggaaagccacaaggaccaccccaacagggaggccatccccctcctcctcaaggaaggccacaaggaccaccccaacagggaggccatccccgtcctcctcgaggaaggccacaaggaccaccccaacagggaggccatcagcaaggtcctcccccacctcctcctggaaagccccagggaccacctccccaagggggccgcccacaaggacctccacaggggcagtctcctcagtaatctaggattcaatgacaggaagtgaataagaagatgacagtgtttcaaatgccttgaaacataatgtgatcatgctctaacttcaatataccaataaaataatcagattgcggtgtttgaagatcctgctagagtcacccacacg

SEQ ID NO: 330260 - DNA, 1433 bp, Homo sapiens
  misc_feature (67)..(67): n is a, c, g, or t
tgtcagccaagaagacgttcccttggtaatatcagatggaggagactctgagcagttcatagatgangagcgtcagggcccacctttgggaggacagcaatctcaaccctctgctggtgatgggaaccagaatgatggccctcagcagggaccaccccagcaaggaggccagcagcaacaaggtccaccacctcctcaggcaaagtcacaaagcgtgtaggttaaggcgctgtaggtagagcataaagttgggagtgacaccagagccttctgcaagatgcttctgattctgctgtcagtggccctgctggccttcagctcagctcaggacttagatgaagatgtcagccaagaagacgttcccttggtaatatcagatggaggagactctgagcagttcatagatgaggagcgtcagggaccacctttgggaggacagcaatctcaaccctctgctggtgatgggaaccagaatgatggccctcagcagggaccaccccaacaaggaggccagcagcaacaaggtccaccacctcctcagggaaagccacaaggaccaccccaacagggaggccatccccctcctcctcaaggaaggccacaaggaccaccccaacagggaggccatccccgtcctcctcgaggaaggccacaaggaccaccccaacagggaggccatcagcaaggtcctcccccacctcctcctggaaagccccagggaccacctccccaagggggccgcccacaaggacctccacaggggcagtctcctcagtaatctaggattcaatgacaggaagtgaataagaagatgacagtgtttcaaatgccttgaaacataatgtgatcatgctctaacttcaatataccaataaaataatcagattgcaatttctgattatagcatctccttctgagtgtttgggactctggaatctgagacccatgttcacattgtaagaacatccaggaccccttctccttgatgtttccagcaagcttctttcctcctttatccttattaagtcatctgcctggggaaggagttccactgtttctttccttctctgtcttcttagctcgaatttaaattgcacaattattttcaggtcatttcctgatagtctagtcagcttatgaatgtaagcaaaacaggaccaatgaaagaaagtcccagaagctgagagaaactttaacaagtttgagagtaacttattttgttttctaggaaagtgagtatggttctatgcctgtattccccagaagccactagacctattttcccctattttatcactgatcagttctgtccctgcctatgattcttaccattcttaagaaaacctgaatggatttcatcaaggcggcagcataatttgaagggcaattgcgtgtgaaaattgatgtgacttgatttacacaatagtcagaaa

SEQ ID NO: 330261 - DNA, 500 bp, Homo sapiens
tttgtgcctcgtaccccaacaccgaccctctgctggtgatgggaaccagaatgatggccctcagcagggaccaccccaacaaggaggccagcagcaacaaggtccaccacctcctcagggaaagccacaaggaccaccccaacagggaggccatccccctcctcctcaaggaaggccacaaggaccaccccaacagggaggccatccccgtcctcctcgaggaaggccacaaggaccaccccaacagggaggccatcagcaaggtcctcccccacctcctcctggaaagccccagggaccacctccccaagggggccgcccacaaggacctccacaggggcagtctcctcagtaatctaggattcaatgacaggaagtgaataagaagatgacagtgtttcaaatgccttgaaacataatgtgatcatgctctaacttcaatataccaataaaataatcagattgcggtgtttgaagatcctgctagagtcacccacacg

SEQ ID NO: 330262 - DNA, 506 bp, Homo sapiens
tagtcggtgactctgaggatcctaaacacgaccctctgctggtgatgggaaccagaatgatggccctcagcagggaccaccccaacaaggaggccagcagcaacaaggtccaccacctcctcagggaaagccacaaggaccaccccaacagggaggccatccccctcctcctcaaggaaggccacaaggaccaccccaacagggaggccatccccgtcctcctcgaggaaggccacaaggaccaccccaacagggaggccatcagcaaggtcctcccccacctcctcctggaaagccccagggaccacctccccaagggggccgcccacaaggacctccacaggggcagtctcctcagtaatctaggattcaatgacaggaagtgaataagaagatgacagtgtttcaaatgccttgaaacataatgtgatcatgctctaacttcaatataccaataaaataatcagattgcggtgtttgaagatcctgctagagtcacccacacg

SEQ ID NO: 330263 - DNA, 1435 bp, Homo sapiens
tgcagagttgggagtgactccagagcctccagcgagatgctgttgattctgctgtcagtggccctgctggccctgagctcagctgagagttcaagtgaagatgtcagccaggaagaatctctcttcctaatatcaggaaagccagaaggacgacgcccacaaggaggaaaccagccccaacgtcccccacctcctccaggaaagccacaaggaccacccccacaaggaggaaaccagtcccaaggtcccccacctcctccaggaaagccagaaggacgacccccacaaggaggcaaccagtcccaaggtcccccacctcatccaggaaagccagaaagaccacccccacaaggaggaaaccagtcccaaggtaccccacctcctccaggaaagccagaaagaccacccccacaaggaggcaaccagtcccaccgtcccccacctcctccaggaaagccagaaagaccacccccacaaggaggtaaccagtcccaaggtcccccacctcatccaggaaagccagaaggaccacccccacaggaaggaaacaagtcccgaagtgcccgatctcctccaggaaagccacaaggaccaccccaacaagaaggcaacaagcctcaaggtcccccacctcctggaaagccacaaggcccacccccagcaggaggcaatccccagcagcctcaggaccctcctgctggaaagccccaggggccacctccacctcctcaagggggcaggccacccagacctgcccagggacaacagcctccccagtaatctaggattcaatgacaggaagtgaataagaagatgacagtgtttcaaatgccttgaaacataatgtgatcatgctctaacttcaatataccaataaaataatcagattgcaatttctgattatagcatctccttctgagtgtttgggactctggaatctgagacccatgttcacattgtaagaacatccaggaccccttctccttgatgtttccagcaagcttctttcctcctttatccttattaagtcatctgcctggggaaggagttccactgtttctttccttctctgtcttcttagctcgaatttaaattgcacaattattttcaggtcatttcctgatagtctagtcagcttatgaatgtaagcaaaacaggaccaatgaaagaaagtcccagaagctgagagaaactttaacaagtttgagagtaacttattttgttttctaggaaagtgagtatggttctatgcctgtattccccagaagccactagacctattttcccctattttatcactgatcagttctgtccctgcctatgattcttaccattcttaagaaaacctgaatggatttcatcaaggcggcagcataatttgaagggcaattgcgtgtgaaaattgatgtgacttgatttacacaatagtcagaaa

SEQ ID NO: 330264 - DNA, 611 bp, Homo sapiens
  misc_feature (67)..(67): n is a, c, g, or t
tgtcagccaagaagacgttcccttggtaatatcagatggaggagactctgagcagttcatagatgangagcgtcagggcccacctttgggaggacagcaatctcaaccctctgctggtgatgggaaccagaatgatggccctcagcagggaccaccccagcaaggaggccagcagcaacaaggtccaccacctcctcaggcaaagtcacaaagcgtgtaggttaaggcgctgtaggtagagcataaagttgggagtgacaccagagccttctgcaagatgcttctgattctgctgtcagtggccctgctggccttcagctcagctcaggacttagatgaagatgtcagccaagaagacgttcccttggtaatatcagatggaggagactctgagcagttcatagatgaggagcgtcagggaccacctttgggaggacagcaatctcaaccctctgctggtgatgggaaccagaatgatggccctcagcagggaccaccccaacaaggaggccagcagcaacaaggtccaccacctcctcagggaaagccacaaggccgctcaggaggctcaggatgctctacagtcagtcggcagtcatgccagcgcgtcc

SEQ ID NO: 330265 - DNA, 537 bp, Homo sapiens
gctgatcgagaggagtcaccggtgagggatagtagatggaggagactctgagcagttcatagatgaggagcgtcagggaccacctttgggaggacagcaatctcaaccctctgctggtgatgggaaccagaatgatggccctcagcagggaccaccccaacaaggaggccagcagcaacaaggtccaccacctcctcagggaaagccacaagccacaaggaccaccccaacagggaggccatccccgtcctcctcgaggaaggccacaaggaccaccccaacagggaggccatcagcaaggtcctcccccacctcctcctggaaagccccagggaccacctccccaagggggccgcccacaaggacctccacaggggcagtctcctcagtaatctaggattcaatgacaggaagtgaataagaagatgacagtgtttcaaatgccttgaaacataatgtgatcatgctctaacttcaatataccaataaaataatcagattgcggtgtttgaagatcctgctagagtcacccacacg

SEQ ID NO: 330266 - DNA, 812 bp, Homo sapiens
aacaccgcaatctcaaacaccgaccctctgctggtgatgggaaccagaatgatggccctcagcagggaccaccccaacaaggaggccagcagcaacaaggtccaccacctcctcagggaaagccacaagacctccacaggggcagtctcctcagtaatctaggattcaatgacaggaagtgaataagaagatgacagtgtttcaaatgccttgaaacataatgtgatcatgctctaacttcaatataccaataaaataatcagattgcaatttctgattatagcatctccttctgagtgtttgggactctggaatctgagacccatgttcacattgtaagaacatccaggaccccttctccttgatgtttccagcaagcttctttcctcctttatccttattaagtcatctgcctggggaaggagttccactgtttctttccttctctgtcttcttagctcgaatttaaattgcacaattattttcaggtcatttcctgatagtctagtcagcttatgaatgtaagcaaaacaggaccaatgaaagaaagtcccagaagctgagagaaactttaacaagtttgagagtaacttattttgttttctaggaaagtgagtatggttctatgcctgtattccccagaagccactagacctattttcccctattttatcactgatcagttctgtccctgcctatgattcttaccattcttaagaaaacctgaatggatttcatcaaggcggcagcataatttgaagggcaattgcgtgtgaaaattgatgtgacttgatttacacaatagtcagaaa

SEQ ID NO: 330267 - DNA, 507 bp, Homo sapiens
  misc_feature (67)..(67): n is a, c, g, or t
tgtcagccaagaagacgttcccttggtaatatcagatggaggagactctgagcagttcatagatgangagcgtcagggcccacctttgggaggacagcaatctcaaccctctgctggtgatgggaaccagaatgatggccctcagcagggaccaccccagcaaggaggccagcagcaacaaggtccaccacctcctcaggcaaagtcacaaagcgtgtaggttaaggcgctgtaggtagagcataaagttgggagtgacaccagagccttctgcaagatgcttctgattctgctgtcagtggccctgctggccttcagctcagctcaggacttagatgaagatgtcagccaagaagacgttcccttggtaatatcagatggaggagactctgagcagttcatagatgaggagcgtcagggaccacctttgggaggacagcaatctcaaccttgttgctgctggcctccttgttggggtggtccctgctgagggccatcattctggtt

SEQ ID NO: 330268 - DNA, 645 bp, Homo sapiens
tagtcggtgactctgaggatcctaaacacgaccctctgctggtgatgggaaccagaatgatggccctcagcagggaccaccccaacaaggaggccagcagcaacaaggtccaccacctcctcagggaaagccacaaggaccaccccaacagggaggccatccccctcctcctcaaggaaggccacaaggaccaccccaacagggaggccatccccgtcctcctcgaggaaggccacaaggaccaccccaacagggaggccatcagcaaggtcctcccccacctcctcctggaaagccccagggaccacctccccaagggggccgcccacaaggacctccacaggggcagtctcctcagtaatctaggattcaatgacaggaagtgaataagaagatgacagtgtttcaaatgccttgaaacataatgtgatcatgctctaacttcaatataccaataaaataatcagattgcggtgtttgcaaacaccgcaatcttgtagttcacaccattgtcatggcaccatctagatgactcacatctgaaatgaccacttccaaagcctaagcactggcacaacaggttaaagcctgattcagacattcgttcccactcatctcccacggctaatgggaactggtaggggc

SEQ ID NO: 330269 - DNA, 679 bp, Homo sapiens
  misc_feature (17)..(17): n is a, c, g, or t
tgagcctccttggcacngtgagccttctgcaagatgcttctgattctgctgtcagtggccctgctggccttcagctcagctcaggacttagatgaagatgtcagccaagaagacgttcccttggtaatatcagatggaggagactctgagcagttcatagatgaggagcgtcagggaccacctttgggaggacagcaatctcaaccctctgctggtgatgggaaccagaatgatggccctcagcagggaccaccccaacaaggaggccagcagcaacaaggtccaccacctcctcagggaaagccacaaggaccaccccaacagggaggccatccccctcctcctcaaggaaggccacaaggaccaccccaacagggaggccatccccgtcctcctcgaggaaggccacaaggaccaccccaacagggaggccatcagcaaggtcctcccccacctcctcctggaaagccccagggaccacctccccaagggggccgcccacaaggacctccacaggggcagtctcctcagtaatctaggattcaatgacaggaagtgaataagaagatgacagtgtttcaaatgccttgaaacataatgtgatcatgctctaacttcaatataccaataaaataatcagattgcggtgtttgaagatcctgctagagtcacccacacg

SEQ ID NO: 330270 - DNA, 1062 bp, Homo sapiens
  misc_feature (67)..(67): n is a, c, g, or t
tgtcagccaagaagacgttcccttggtaatatcagatggaggagactctgagcagttcatagatgangagcgtcagggcccacctttgggaggacagcaatctcaaccctctgctggtgatgggaaccagaatgatggccctcagcagggaccaccccagcaaggaggccagcagcaacaaggtccaccacctcctcaggcaaagtcacaaagcgtgtaggttaaggcgctgtaggtagagcataaagttgggagtgacaccagagccttctgcaagatgcttctgattctgctgtcagtggccctgctggccttcagctcagctcaggacttagatgaagatgtcagccaagaagacgttcccttggtaatatcagatggaggagactctgagcagttcatagatgaggagcgtcagggaccacctttgggaggacagcaatctcaaccctctgctggtgatgggaaccagaatgatggccctcagcagggaccaccccaacaaggaggccagcagcaacaaggtccaccacctcctcagggaaagccacaaggaccaccccaacagggaggccatccccctcctcctcaaggaaggccacaaggaccaccccaacagggaggccatccccgtcctcctcgaggaaggccacaaggaccaccccaacagggaggccatcagcaaggtcctcccccacctcctcctggaaagccccagggaccacctccccaagggggccgcccacaaggacctccacaggggcagtctcctcagtaatctaggattcaatgacaggaagtgaataagaagatgacagtgtttcaaatgccttgaaacataatgtgatcatgctctaacttcaatataccaataaaataatcagattgcggtgtttgcaaacaccgcaatcttgtagttcacaccattgtcatggcaccatctagatgactcacatctgaaatgaccacttccaaagcctaagcactggcacaacaggttaaagcctgattcagacattcgttcccactcatctcccacggctaatgggaactggtaggggc

SEQ ID NO: 330271 - DNA, 510 bp, Homo sapiens
ggaagaattcctggtggtgatggagaattcctggaccctctgctggtgatgggaaccagaatgatggccctcagcagggaccaccccaacaaggaggccagcagcaacaaggtccaccacctcctcagggaaagccacaaggaccaccccaacagggaggccatccccctcctcctcaaggaaggccacaaggaccaccccaacagggaggccatccccgtcctcctcgaggaaggccacaaggaccaccccaacagggaggccatcagcaaggtcctcccccacctcctcctggaaagccccagggaccacctccccaagggggccgcccacaaggacctccacaggggcagtctcctcagtaatctaggattcaatgacaggaagtgaataagaagatgacagtgtttcaaatgccttgaaacataatgtgatcatgctctaacttcaatataccaataaaataatcagattgcggtgtttgaagatcctgctagagtcacccacacg

SEQ ID NO: 330272 - DNA, 879 bp, Homo sapiens
  misc_feature (67)..(67): n is a, c, g, or t
tgtcagccaagaagacgttcccttggtaatatcagatggaggagactctgagcagttcatagatgangagcgtcagggcccacctttgggaggacagcaatctcaaccctctgctggtgatgggaaccagaatgatggccctcagcagggaccaccccagcaaggaggccagcagcaacaaggtccaccacctcctcaggcaaagtcacaaagcgtgtaggttaaggcgctgtaggtagagcataaagttgggagtgacaccagagccttctgcaagatgcttctgattctgctgtcagtggccctgctggccttcagctcagctcaggacttagatgaagatgtcagccaagaagacgttcccttggtaatatcagatggaggagactctgagcagttcatagatgaggagcgtcagggaccacctttgggaggacagcaatctcaaccctctgctggtgatgggaaccagaatgatggccctcagcagggaccaccccaacaaggaggccagcagcaacaaggtccaccacctcctcagggaaagccacaagccacaaggaccaccccaacagggaggccatccccgtcctcctcgaggaaggccacaaggaccaccccaacagggaggccatcagcaaggtcctcccccacctcctcctggaaagccccagggaccacctccccaagggggccgcccacaaggacctccacaggggcagtctcctcagtaatctaggattcaatgacaggaagtgaataagaagatgacagtgtttcaaatgccttgaaacataatgtgatcatgctctaacttcaatataccaataaaataatcagattgcggtgtttgaagatcctgctagagtcacccacacg

SEQ ID NO: 330273 - DNA, 657 bp, Homo sapiens
  misc_feature (67)..(67): n is a, c, g, or t
tgtcagccaagaagacgttcccttggtaatatcagatggaggagactctgagcagttcatagatgangagcgtcagggcccacctttgggaggacagcaatctcaaccctctgctggtgatgggaaccagaatgatggccctcagcagggaccaccccagcaaggaggccagcagcaacaaggtccaccacctcctcaggcaaagtcacaaagcgtgtaggttaaggcgctgtaggtagagcataaagttgggagtgacaccagagccttctgcaagatgcttctgattctgctgtcagtggccctgctggccttcagctcagctcaggacttagatgaagatgtcagccaagaagacgttcccttggtaatatcagatggaggagactctgagcagttcatagatgaggagcgtcagggaccacctttgggaggacagcaatctcaaccctctgctggtgatgggaaccagaatgatggccctcagcagggaccaccccaacaaggaggccagcagcaacaaggaggcttgatatcatcctcccatcatcccctcagtgttccacgtgcctgccagccacagggacataatcccacctcctgcagccccaacacacacactgggtttgtgaactctttgaggggttcccggacagg

SEQ ID NO: 330274 - DNA, 1129 bp, Homo sapiens
gccagggccagcgggcttcaggagggggacgcgcctgtcccgggctccaggctacgggcaagaccacagggctcctgacctttttcggcatacatgtcaccagtgctatctggaatacacagcatctactcagcgtgggtcacctctgtgaacatcactgactgcaagcctccctcaatttctggtgcagcccatcagggacccacagcgcctgggaggatggtgcggatcttggccaatggggaaatcgtgcaggatgacgacccccgagtgaggaccactacccagccaccaagaggtagcattcctcgacagagcttcttcaataggggccatggtgctcccccagggggtcctggcccccgccagcagcaggcaggtgccaggctgggtgctgctcagtcccccttcaatgacctcaaccggcagctggtgaacatgggctttccgcagtggcatctcggcaaccatgctgtggagccggtgacctccatcctgctcctcttcctgctcatgatgcttggtgttcgtggcctcctcctggttggccttgtctacctggtgtcccacctgagtcagcggtgacctctgagggctgataggggtgggtttgttgagagggacttgctgggccttggtgtgagagcaggcatatttggaggggatctggtggtgccttgaaggtatgatcagagaggggaccacaggtgtgtgtttcccctttgtgttaagcgtgaggcagagggagacgttagtccagcatttccaaagtgtgggtgggtccgttggttcccgagatacttttaggtggtatggggcctgcattaagtggcacaaaatcagagcaagaaagcgatgcccttcccaattctctcaatccttttatgccgagaagatctcagctggatgccaacatgttccgatgcctgtggaagacatgccgacgtctcctctgcctagggagcaggacttgggcttagggcaggtggaaaaaattccagacttttttagcactgtttttgttttaatggtatatttttattggctactttattgtttaggacaagtggtagtggcattctatttattgtgaccttttcaataaatagatttaagtaaaaatgaaaaa

SEQ ID NO: 330275 - DNA, 954 bp, Homo sapiens
ggtgggaggaaaccgcctggagccgccgggagtggacgccgccgaggcccggagtcgcgcctgcagacacagcatctactcagcgtgggtcacctctgtgaacatcactgactgcaagcctccctcaatttctggtgcagcccatcagggacccacagcgcctgggaggatggtgcggatcttggccaatggggaaatcgtgcaggatgacgacccccgagtgaggaccactacccagccaccaagaggtagcattcctcgacagagcttcttcaataggggccatggtgctcccccagggggtcctggcccccgccagcagcaggcaggtgccaggctgggtgctgctcagtcccccttcaatgacctcaaccggcagctggtgaacatgggctttccgcagtggcatctcggcaaccatgctgtggagccggtgacctccatcctgctcctcttcctgctcatgatgcttggtgttcgtggcctcctcctggttggccttgtctacctggtgtcccacctgagtcagcggtgacctctgagggctgataggggtgggtttgttgagagggacttgctgggccttggtgtgagagcaggcatatttggaggggatctggtggtgccttgaaggtatgatcagagaggggaccacaggtgtgtgtttcccctttgtgttaagcgtgaggcagagggagacgttagtccagcatttccaaagtgtgggtgggtccgttggttcccgagatacttttaggtggtatggggcctgcattaagtggcacaaaatcagacttgggcttagggcaggtggaaaaaattccagacttttttagcactgtttttgttttaatggtatatttttattggctactttattgtttaggacaagtggtagtggcattctatttattgtgaccttttcaataaatagatttaagtaaaaatgaaaaa

SEQ ID NO: 330276 - DNA, 824 bp, Homo sapiens
ggtgggaggaaaccgcctggagccgccgggagtggacgccgccgaggcccggagtcgcgcctgcagacacagcatctactcagcgtgggtcacctctgtgaacatcactgactgcaagcctccctcaatttctggtgcagcccatcagggacccacagcgcctgggaggatggtgcggatcttggccaatggggaaatcgtgcaggatgacgacccccgagtgaggaccactacccagccaccaagaggtagcattcctcgacagagcttcttcaataggggccatggtgctcccccagggggtcctggcccccgccagcagcaggcaggtgccaggctgggtgctgctcagtcccccttcaatgacctcaaccggcagctggtgaacatgggctttccgcagtggcatctcggcaaccatgctgtggagccggtgacctccatcctgctcctcttcctgctcatgatgcttggtgttcgtggcctcctcctggttggccttgtctacctggtgtcccacctgagtcagcggtgacctctgagggctgataggggtgggtttgttgagacgttagtccagcatttccaaagtgtgggtgggtccgttggttcccgagatacttttaggtggtatggggcctgcattaagtggcacaaaatcagacttgggcttagggcaggtggaaaaaattccagacttttttagcactgtttttgttttaatggtatatttttattggctactttattgtttaggacaagtggtagtggcattctatttattgtgaccttttcaataaatagatttaagtaaaaatgaaaaa

SEQ ID NO: 330277 - DNA, 1079 bp, Homo sapiens
ggtgggaggaaaccgcctggagccgccgggagtggacgccgccgaggcccggagtcgcgcctgcagacacagcatctactcagcgtgggtcacctctgtgaacatcactgactgcaagcctccctcaatttctggtgcagcccatcagggacccacagcgcctgggaggatggtgcggatcttggccaatggggaaatcgtgcaggatgacgacccccgagtgaggaccactacccagccaccaagaggtagcattcctcgacagagcttcttcaataggggccatggtgctcccccagggggtcctggcccccgccagcagcaggcaggtgccaggctgggtgctgctcagtcccccttcaatgacctcaaccggcagctggtgaacatgggctttccgcagtggcatctcggcaaccatgctgtggagccggtgacctccatcctgctcctcttcctgctcatgatgcttggtgttcgtggcctcctcctggttggccttgtctacctggtgtcccacctgagtcagcggtgacctctgagggctgataggggtgggtttgttgagagggacttgctgggccttggtgtgagagcaggcatatttggaggggatctggtggtgccttgaaggtatgatcagagaggggaccacaggtgtgtgtttcccctttgtgttaagcgtgaggcagagggagacgttagtccagcatttccaaagtgtgggtgggtccgttggttcccgagatacttttaggtggtatggggcctgcattaagtggcacaaaatcagagcaagaaagcgatgcccttcccaattctctcaatccttttatgccgagaagatctcagctggatgccaacatgttccgatgcctgtggaagacatgccgacgtctcctctgcctagggagcaggacttgggcttagggcaggtggaaaaaattccagacttttttagcactgtttttgttttaatggtatatttttattggctactttattgtttaggacaagtggtagtggcattctatttattgtgaccttttcaataaatagatttaagtaaaaatgaaaaa

SEQ ID NO: 330278 - DNA, 1240 bp, Homo sapiens
ggtgggaggaaaccgcctggagccgccgggagtggacgccgccgaggcccggagtcgcgcctgcagacacagcatctactcagcgtgggtcacctctgtgaacatcactgactgcaagcctccctcaatttctggtaaattttttccttcaagctttttgaggtcagggggaaaatcctccacagatcttcacgagtctggtcccagatcactaacagctaaaggttttgtggtggggagaacttctgtgccacttggcttccattagcctgcccaccctgaccacacaatgcaggtgcagcccatcagggacccacagcgcctgggaggatggtgcggatcttggccaatggggaaatcgtgcaggatgacgacccccgagtgaggaccactacccagccaccaagaggtagcattcctcgacagagcttcttcaataggggccatggtgctcccccagggggtcctggcccccgccagcagcaggcaggtgccaggctgggtgctgctcagtcccccttcaatgacctcaaccggcagctggtgaacatgggctttccgcagtggcatctcggcaaccatgctgtggagccggtgacctccatcctgctcctcttcctgctcatgatgcttggtgttcgtggcctcctcctggttggccttgtctacctggtgtcccacctgagtcagcggtgacctctgagggctgataggggtgggtttgttgagagggacttgctgggccttggtgtgagagcaggcatatttggaggggatctggtggtgccttgaaggtatgatcagagaggggaccacaggtgtgtgtttcccctttgtgttaagcgtgaggcagagggagacgttagtccagcatttccaaagtgtgggtgggtccgttggttcccgagatacttttaggtggtatggggcctgcattaagtggcacaaaatcagagcaagaaagcgatgcccttcccaattctctcaatccttttatgccgagaagatctcagctggatgccaacatgttccgatgcctgtggaagacatgccgacgtctcctctgcctagggagcaggacttgggcttagggcaggtggaaaaaattccagacttttttagcactgtttttgttttaatggtatatttttattggctactttattgtttaggacaagtggtagtggcattctatttattgtgaccttttcaataaatagatttaagtaaaaatgaaaaa

SEQ ID NO: 330279 - DNA, 342 bp, Homo sapiens
cattcaacaccatcctgtacttaatgtgaaacttaaaagtattatatttgaaaaaaataaactattacattttcttattgatattaaacaccttaatgtgaaagaaatccataattagtatacatataaaattataagacagtttttctctcgtcattacaaaaacttctgtgacctggttggaattttaaaaatataatcgctaatataatatatatgttccataaaaatgcctaagctgcccgggcatggtggctcatgcctgtaataccagcactttgggaggccgaggcaggtagatcatgaggccaggagttcgagaccagcctggccaacatggtg

SEQ ID NO: 330280 - DNA, 622 bp, Homo sapiens
gaaactgcatatcttctggtttacatgaagatggagtgctaatggaaatgcccaaaaccttcagagattgacacgctgtcattttccatttccgttcctggatctacggagtcttctaagagattttgcaatgaggagaagcattgttttcaaactatataactgagccttatttataattagggatattatcaaaatatgtaaccatgaggcccctcaggtcctgatcagtcagaatggatgctttcaccagcagacccggccatgtggctgctcggtcctgggtgctcgctgctgtgcgagacattagccctttagttatgagcctgtgggaacttcaggggttcccagtggggagagcagtggcagtgggaggcatctgggggccaaaggtcagtggcagggggtatttcagtattatacaactgctgtgaccagacttgtatactggctgaatatcagtgctgtttgtaatttttcactttgagaaccaacattaattccatatgaatcaagtgttttgtaactgctattcatttattcagcaaatatttattgatcatctcttctccataagatagtgtgataaacacagtcatgaataaagttattttccacaaaa

SEQ ID NO: 330281 - DNA, 231 bp, Homo sapiens
gaaactgcatatcttctggtttacatgaagatggagtgctaatggaaatgcccaaaaccttcagagattgacacgctgtcattttccatttccgttcctggatctacggagtcttctaagagattttgcaatgaggagaagcattgttttcaaactatataactgagcaatccctcgggatgtcaacagagtcaggatgctcaaaacatctgtgccaagcctttcatagcc

SEQ ID NO: 330282 - DNA, 2235 bp, Homo sapiens
  misc_feature (12)..(12): n is a, c, g, or t
  misc_feature (23)..(23): n is a, c, g, or t
cgacggcagtanccccgtgttanaggtagcgaggctgcctggcgggcaccgtaaccagcgccgcggacaccggcaccggcgccacggactccgcaggaccccgcgcccgccgccgccgctatgctggggctgctggtggcgttgctggccctggggctcgctgtctttgcgctgctggacgtctggtacctggtgcgccttccgtgcgccgtgctgcgcgcgcgcctgctgcagccgcgcgtccgtgacctgctagctgagcagcgcttcccgggccgcgtgctgccctcggacttggacctgctgctgcacatgaacaacgcgcgctacctgcgcgaggccgactttgcgcgcgtcgcgcacctgacccgctgcggggtgctcggggcgctgagggagttgcgggcgcacacggtgctggcggcctcgtgcgcgcgccaccgccgctcgctgcgcctgctggagcccttcgaggtgcgcacccgcctgctgggctgggacgaccgcgcgttctacctggaggcgcgctttgtcagcctgcgggacggcttcgtgtgcgcgctgctgcgcttccggcagcacctgctgggcacctcacccgagcgcgtcgtgcagcacctgtgccagcgcagggtggagccccctgagctgcccgctgatctgcagcactggatctcctacaacgaggccagcagccagctgctccgcatggagagtgggctcagtgatgtcaccaaggaccagtgaccgccaccttcacaccgtctgccctggccaccatcctgggcctgggggctgcccacagatgggcagtctcagccatactctgttccagctggagtagcctcctgaccagcctggcccaccctgctccacccactgggcccccccagttattgatacccctctgtgctgggctccacgctaggcagaaggaggagtggcattggcatcctgacccagctctgccctcaaggtggggatggatgggcaaaggagagtcctgcctggccctacgatgaggccactcatgtgggcctaggtaggggaggatggtgcctggagcagagggacccacaagtgcctcccgagcctagatcctggctcggaccactgcaagggccgaggcagggccagaccagagcatcctgggtacaggcctgggctctccagggcctgggcctgattcaggtgcagtgggcactcctgaagggtcagagcggcatctgccaggcagcccctctggcttccgctgaggtggttgcaggcctggggcagagcctgggtggtcagaggccggggctagaggcagatggaagggaggcatttgctgacagaggacggggcacccgggctccccactgcagtcggccttgcctcctcctcctcctctacctccagtcaggctggacgggagggtagccttgtggctgagaggggtcagactaggtggcacaggggctcctggaaagacagcaggcttcctgctgggcgttcccttgttggagggaatagagtgggggtgggactctgcaggggtgtccttgtccactcgcacccctcgccgcccaccagggccatgctctgtgacttgggctgatccccaccctttctgggcctacagcaccacaggccgctgtacccccttagagctgcccctctctggcctggccggcaggcgtcttcttaactcctctgtcctctatattcagcatgttccttgtcagctgctgggccggccctgccttgcgctagcagagcctctcctggcagcttctcaggtctccctaatggagacaccaggctactaggacactggctggggccaccccctcctgcctaatgcctcaccttacagctggggaaactgaggcctggaatggcccagagtcaccaaggcaaagttggggctggtcccagcctgaggctccagctgatgccctcagctcccagagagggggtgccccatctagctgggtgcaggggtcactgcttgtcagctcagggccctgtgcccgcttgcctgttcccctacatctgtgcctgcacatccagaactgcctccttgccgctgcctccaggaagcccaccttgagccagagtcaagggctgcagcactgcccgatagaacacgcccgccctcactgctgttcttgccttacagccaccatgggaaagctgcaacctttctgttttatttaaagaaagcccaacattaaagggttttcattgcaa

SEQ ID NO: 330283 - DNA, 2319 bp, Homo sapiens
ctcggccgccctcgcgctgtggttcgctccgggcgcgctgcgctcgtgagttcccaggaggcctggcgggcaccgtaaccagcgccgcggacaccggcaccggcgccacggactccgcaggaccccgcgcccgccgccgccgctatgctggggctgctggtggcgttgctggccctggggctcgctgtctttgcgctgctggacgtctggtacctggtgcgccttccgtgcgccgtgctgcgcgcgcgcctgctgcagccgcgcgtccgtgacctgctagctgagcagcgcttcccgggccgcgtgctgccctcggacttggacctgctgctgcacatgaacaacgcgcgctacctgcgcgaggccgactttgcgcgcgtcgcgcacctgacccgctgcggggtgctcggggcgctgagggagttgcgggcgcacacggtgctggcggcctcgtgcgcgcgccaccgccgctcgctgcgcctgctggagcccttcgaggtgcgcacccgcctgctgggctgggacgaccgcgcgttctacctggaggcgcgctttgtcagcctgcgggacggcttcgtgtgcgcgctgctgcgcttccggcagcacctgctgggcacctcacccgagcgcgtcgtgcagcacctgtgccagcgcagggtggagccccctgagctgcccgctgatctgcagcactggatctcctacaacgaggccagcagccagctgctccgcatggagagtgggctcagtgatgtcaccaaggaccagtgaccgccaccttcacaccgtctgccctggccaccatcctgggcctgggggctgcccacagatgggcagtctcagccatactctgttccagctggagtagcctcctgaccagcctggcccaccctgctccacccactgggcccccccagttattgatacccctctgtgctgggctccacgctaggcagaaggaggagtggcattggcatcctgacccagctctgccctcaaggtggggatggatgggcaaaggagagtcctgcctggccctacgatgaggccactcatgtgggcctaggtaggggaggatggtgcctggagcagagggacccacaagtgcctcccgagcctagatcctggctcggaccactgcaagggccgaggcagggccagaccagagcatcctgggtacaggcctgggctctccagggcctgggcctgattcaggtgcagtgggcactcctgaagggtcagagcggcatctgccaggcagcccctctggcttccgctgaggtggttgcaggcctggggcagagcctgggtggtcagaggccggggctagaggcagatggaagggaggcatttgctgacagaggacggggcacccgggctccccactgcagtcggccttgcctcctcctcctcctctacctccagtcaggctggacgggagggtagccttgtggctgagaggggtcagactaggtggcacaggggctcctggaaagacagcaggcttcctgctgggcgttcccttgttggagggaatagagtgggggtgggactctgcaggggtgtccttgtccactcgcacccctcgccgcccaccagggccatgctctgtgacttgggctgatccccaccctttctgggcctacagcaccacaggccgctgtacccccttagagctgcccctctctggcctggccggcaggcgtcttcttaactcctctgtcctctatattcagcatgttccttgtcagctgctgggccggccctgccttgcgctagcagagcctctcctggcagcttctcaggtctccctaatggagacaccaggctactaggacactggctggggccaccccctcctgcctaatgcctcaccttacagctggggaaactgaggcctggaatggcccagagtcaccaaggcaaagttggggctggtcccagcctgaggctccagctgatgccctcagctcccagagagggggtgccccatctagctgggtgcaggggtcactgcttgtcagctcagggccctgtgcccgcttgcctgttcccctacatctgtgcctgcacatccagaactgcctccttgccgctgcctccaggaagcccaccttgagccagagtcaggtgagatgcgataagaaagcgctcatgtgtctgctaagcacaggaagtgactttgttattaagaagcaataaagttcatgaaaaaaaaaaacgggtttgggggaaggtgaagcgggtaggctgccttgaagggaggggccagggttatcgaacgcgtggtatagtatggagtgagaaggagaatatatt

SEQ ID NO: 330284 - DNA, 2100 bp, Homo sapiens
ctcggccgccctcgcgctgtggttcgctccgggcgcgctgcgctcgtgagttcccaggaggcctggcgggcaccgtaaccagcgccgcggacaccggcaccggcgccacggactccgcaggaccccgcgcccgccgccgccgctatgctggggctgctggtggcgttgctggccctggggctcgctgtctttgcgctgctggacgtctggtacctggtgcgccttccgtgcgccgtgctgcgcgcgcgcctgctgcagccgcgcgtccgtgacctgctagctgagcagcgcttcccgggccgcgtgctgccctcggacttggacctgctgctgcacatgaacaacgcgcgctacctgcgcgaggccgactttgcgcgcgtcgcgcacctgacccgctgcggggtgctcggggcgctgagggagttgcgggcgcacacggtgctggcggcctcgtgcgcgcgccaccgccgctcgctgcgcctgctggagcccttcgaggtggagccccctgagctgcccgctgatctgcagcactggatctcctacaacgaggccagcagccagctgctccgcatggagagtgggctcagtgatgtcaccaaggaccagtgaccgccaccttcacaccgtctgccctggccaccatcctgggcctgggggctgcccacagatgggcagtctcagccatactctgttccagctggagtagcctcctgaccagcctggcccaccctgctccacccactgggcccccccagttattgatacccctctgtgctgggctccacgctaggcagaaggaggagtggcattggcatcctgacccagctctgccctcaaggtggggatggatgggcaaaggagagtcctgcctggccctacgatgaggccactcatgtgggcctaggtaggggaggatggtgcctggagcagagggacccacaagtgcctcccgagcctagatcctggctcggaccactgcaagggccgaggcagggccagaccagagcatcctgggtacaggcctgggctctccagggcctgggcctgattcaggtgcagtgggcactcctgaagggtcagagcggcatctgccaggcagcccctctggcttccgctgaggtggttgcaggcctggggcagagcctgggtggtcagaggccggggctagaggcagatggaagggaggcatttgctgacagaggacggggcacccgggctccccactgcagtcggccttgcctcctcctcctcctctacctccagtcaggctggacgggagggtagccttgtggctgagaggggtcagactaggtggcacaggggctcctggaaagacagcaggcttcctgctgggcgttcccttgttggagggaatagagtgggggtgggactctgcaggggtgtccttgtccactcgcacccctcgccgcccaccagggccatgctctgtgacttgggctgatccccaccctttctgggcctacagcaccacaggccgctgtacccccttagagctgcccctctctggcctggccggcaggcgtcttcttaactcctctgtcctctatattcagcatgttccttgtcagctgctgggccggccctgccttgcgctagcagagcctctcctggcagcttctcaggtctccctaatggagacaccaggctactaggacactggctggggccaccccctcctgcctaatgcctcaccttacagctggggaaactgaggcctggaatggcccagagtcaccaaggcaaagttggggctggtcccagcctgaggctccagctgatgccctcagctcccagagagggggtgccccatctagctgggtgcaggggtcactgcttgtcagctcagggccctgtgcccgcttgcctgttcccctacatctgtgcctgcacatccagaactgcctccttgccgctgcctccaggaagcccaccttgagccagagtcaagggctgcagcactgcccgatagaacacgcccgccctcactgctgttcttgccttacagccaccatgggaaagctgcaacctttctgttttatttaaagaaagcccaacattaaagggttttcattgcaa

SEQ ID NO: 330285 - DNA, 1154 bp, Homo sapiens
ctcggccgccctcgcgctgtggttcgctccgggcgcgctgcgctcgtgagttcccaggaggcctggcgggcaccgtaaccagcgccgcggacaccggcaccggcgccacggactccgcaggaccccgcgcccgccgccgccgctatgctggggctgctggtggcgttgctggccctggggctcgctgtctttgcgctgctggacgtctggtacctggtgcgccttccgtgcgccgtgctgcgcgcgcgcctgctgcagccgcgcgtccgtgacctgctagctgagcagcgcttcccgggccgcgtgctgccctcggacttggacctgctgctgcacatgaacaacgcgcgctacctgcgcgaggccgactttgcgcgcgtcgcgcacctgacccgctgcggggtgctcggggcgctgagggagttgcgggcgcacacggtgctggcggcctcgtgcgcgcgccaccgccgctcgctgcgcctgctggagcccttcgaggtgcgcacccgcctgctgggctgggacgaccgcgcgttctacctggaggcgcgctttgtcagcctgcgggacggcttcgtgtgcgcgctgctgcgcttccggcagcacctgctgggcacctcacccgagcgcgtcgtgcagcacctgtgccagcgcagggtggagccccctgagctgcccgctgatctgcagcactggatctcctacaacgaggccagcagccagctgctccgcatggagagtgggctcagtgatgtcaccaaggaccagtgaccgccaccttcacaccgtctgccctggccaccatcctgggcctgggggctgcccacagatgggcagtctcagccatactctgttccagctggagtagcctcctgaccagcctggcccaccctgctccacccactgggcccccccagttattgatacccctctgtgctgggctccacgctaggcagaaggaggagtggcattggcatcctgacccagctctgccctcaaggtggggatggatgggcaaaggagagtcctgcctggccctacgatgaggcctcattgtggctagtgggagatgtgcctggccagggcccatgctcccggccaaatcggccgcctggggccggggccaccagctgggagcggggccaggggggaaa

SEQ ID NO: 330286 - DNA, 2259 bp, Homo sapiens
ctcggccgccctcgcgctgtggttcgctccgggcgcgctgcgctcgtgagttcccaggaggcctggcgggcaccgtaaccagcgccgcggacaccggcaccggcgccacggactccgcaggaccccgcgcccgccgccgccgctatgctggggctgctggtggcgttgctggccctggggctcgctgtctttgcgctgctggacgtctggtacctggtgcgccttccgtgcgccgtgctgcgcgcgcgcctgctgcagccgcgcgtccgtgacctgctagctgagcagcgcttcccgggccgcgtgctgccctcggacttggacctgctgctgcacatgaacaacgcgcgctacctgcgcgaggccgactttgcgcgcgtcgcgcacctgacccgctgcggggtgctcggggcgctgagggagttgcgggcgcacacggtgctggcggcctcgtgcgcgcgccaccgccgctcgctgcgcctgctggagcccttcgaggtgcgcacccgcctgctgggctgggacgaccgcgcgttctacctggaggcgcgctttgtcagcctgcgggacggcttcgtgtgcgcgctgctgcgcttccggcagcacctgctgggcacctcacccgagcgcgtcgtgcagcacctgtgccagcgcagggtggagccccctgagctgcccgctgatctgcagcactggatctcctacaacgaggccagcagccagctgctccgcatggagagtgggctcagtgatgtcaccaaggaccagtgaccgccaccttcacaccgtctgccctggccaccatcctgggcctgggggctgcccacagatgggcagtctcagccatactctgttccagctggagtagcctcctgaccagcctggcccaccctgctccacccactgggcccccccagttattgatacccctctgtgctgggctccacgctaggcagaaggaggagtggcattggcatcctgacccagctctgccctcaaggtggggatggatgggcaaaggagagtcctgcctggccctacgatgaggccactcatgtgggcctaggtaggggaggatggtgcctggagcagagggacccacaagtgcctcccgagcctagatcctggctcggaccactgcaagggccgaggcagggccagaccagagcatcctgggtacaggcctgggctctccagggcctgggcctgattcaggtgcagtgggcactcctgaagggtcagagcggcatctgccaggcagcccctctggcttccgctgaggtggttgcaggcctggggcagagcctgggtggtcagaggccggggctagaggcagatggaagggaggcatttgctgacagaggacggggcacccgggctccccactgcagtcggccttgcctcctcctcctcctctacctccagtcaggctggacgggagggtagccttgtggctgagaggggtcagactaggtggcacaggggctcctggaaagacagcaggcttcctgctgggcgttcccttgttggagggaatagagtgggggtgggactctgcaggggtgtccttgtccactcgcacccctcgccgcccaccagggccatgctctgtgacttgggctgatccccaccctttctgggcctacagcaccacaggccgctgtacccccttagagctgcccctctctggcctggccggcaggcgtcttcttaactcctctgtcctctatattcagcatgttccttgtcagctgctgggccggccctgccttgcgctagcagagcctctcctggcagcttctcaggtctccctaatggagacaccaggctactaggacactggctggggccaccccctcctgcctaatgcctcaccttacagctggggaaactgaggcctggaatggcccagagtcaccaaggcaaagttggggctggtcccagcctgaggctccagctgatgccctcagctcccagagagggggtgccccatctagctgggtgcaggggtcactgcttgtcagctcagggccctgtgcccgcttgcctgttcccctacatctgtgcctgcacatccagaactgcctccttgccgctgcctccaggaagcccaccttgagccagagtcaagggctgcagcactgcccgatagaacacgcccgccctcactgctgttcttgccttacagccaccatgggaaagctgcaacctttctgttttatttaaagaaagcccaacattaaagggttttcattgcaa

SEQ ID NO: 330287 - DNA, 2783 bp, Homo sapiens
ctcggccgccctcgcgctgtggttcgctccgggcgcgctgcgctcgtgagttcccaggaggcctggcgggcaccgtaaccagcgccgcggacaccggcaccggcgccacggactccgcaggaccccgcgcccgccgccgccgctatgctggggctgctggtggcgttgctggccctggggctcgctgtctttgcgctgctggacgtctggtacctggtgcgccttccgtgcgccgtgctgcgcgcgcgcctgctgcagccgcgcgtccgtgacctgctagctgagcagcgcttcccgggccgcgtgctgccctcggacttggacctgctgctgcacatgaacaacgcgcgctacctgcgcgaggccgactttgcgcgcgtcgcgcacctgacccgctgcggggtgctcggggcgctgagggagttgcgggcgcacacggtgctggcggcctcgtgcgcgcgccaccgccgctcgctgcgcctgctggagcccttcgaggtgcgcacccgcctgctgggctgggacgaccgcgcgttctacctggaggcgcgctttgtcagcctgcgggacggcttcgtgtgcgcgctgctgcgcttccggcagcacctgctgggcacctcacccgagcgcgtcgtgcagcacctgtgccagcgcagggtggagccccctgagctgcccgctgatctgcagcactggatctcctacaacgaggccagcagccagctgctccgcatggagagtgggctcagtgatgtcaccaaggaccagtgaccgccaccttcacaccgtctgccctggccaccatcctgggcctgggggctgcccacagatgggcagtctcagccatactctgttccagctggagtagcctcctgaccagcctggcccaccctgctccacccactgggcccccccagttattgatacccctctgtgctgggctccacgctaggcagaaggaggagtggcattggcatcctgacccagctctgccctcaaggtggggatggatgggcaaaggagagtcctgcctggccctacgatgaggccactcatgtgggcctaggtaggggaggatggtgcctggagcagagggacccacaagtgcctcccgagcctagatcctggctcggaccactgcaagggccgaggcagggccagaccagagcatcctgggtacaggcctgggctctccagggcctgggcctgattcaggtgcagtgggcactcctgaagggtcagagcggcatctgccaggcagcccctctggcttccgctgaggtggttgcaggcctggggcagagcctgggtggtcagaggccggggctagaggcagatggaagggaggcatttgctgacagaggacggggcacccgggctccccactgcagtcggccttgcctcctcctcctcctctacctccagtcaggctggacgggagggtagccttgtggctgagaggggtcagactaggtggcacaggggctcctggaaagacagcaggcttcctgctgggcgttcccttgttggagggaatagagtgggggtgggactctgcaggggtgtccttgtccactcgcacccctcgccgcccaccagggccatgctctgtgacttgggctgatccccaccctttctgggcctacagcaccacaggccgctgtacccccttagagctgcccctctctggcctggccggcaggcgtcttcttaactcctctgtcctctatattcagcatgttccttgtcagctgctgggccggccctgccttgcgctagcagagcctctcctggcagcttctcaggtctccctaatggagacaccaggctactaggacactggctggggccaccccctcctgcctaatgcctcaccttacagctggggaaactgaggcctggaatggcccagagtcaccaaggcaaagttggggctggtcccagcctgaggctccagctgatgccctcagctcccagagagggggtgccccatctagctgggtgcaggggtcactgcttgtcagctcagggccctgtgcccgcttgcctgttcccctacatctgtgcctgcacatccagaactgcctccttgccgctgcctccaggaagcccaccttgagccagagtcaagggctgcagcactgcccgatagaacacgcccgccctcactgctgttcttgccttacagccaccatgggaaagctgcaacctttctgttttatttaaagaaagcccaacattaaagggttttcattgcaaaaaaaaaaaaaaaaaaaaacaaaaaaaaaaaaaaaaaaaaaaaaaaaaaaaaaaaaaaaaaaaaaacaaaaaaaaaaaaaaaaaaaaaaaaaaaagggggggggcgcgcgccccaaaatccccccggggggcccccccattagtctgctccccacacccccgttttttgtataaaaaaaggggcgcccctcctacataatggtgggcttaatatattactaaccaccgcaccgcgccgcccgcactaataaaacacgacggcaggaagggagcgaaacaccactcgctgctagatgaatacttctagttgggagagaagcaccccctcactctcggcggggggcgggcacgcacaatttagggcgaccaccctccctccctccagagagtattcataagccccccgggagagagtacatattacccctgccacgggcatactgtgcggggaaaccacccaccgcatcatcgcgcgcggcaaaagttttctcccgcgctgtgtgtcgttagcaatattcccgcgg

SEQ ID NO: 330288 - DNA, 2195 bp, Homo sapiens
aacttcggctagtacgggcccggtgattcggccgagcggcgccacggactccgcaggaccccgcgcccgccgccgccgctatgctggggctgctggtggcgttgctggccctggggctcgctgtctttgcgctgctggacgtctggtacctggtgcgccttccgtgcgccgtgctgcgcgcgcgcctgctgcagccgcgcgtccgtgacctgctagctgagcagcgcttcccgggccgcgtgctgccctcggacttggacctgctgctgcacatgaacaacgcgcgctacctgcgcgaggccgactttgcgcgcgtcgcgcacctgacccgctgcggggtgctcggggcgctgagggagttgcgggcgcacacggtgctggcggcctcgtgcgcgcgccaccgccgctcgctgcgcctgctggagcccttcgaggtgcgcacccgcctgctgggctgggacgaccgcgcgttctacctggaggcgcgctttgtcagcctgcgggacggcttcgtgtgcgcgctgctgcgcttccggcagcacctgctgggcacctcacccgagcgcgtcgtgcagcacctgtgccagcgcagggtggagccccctgagctgcccgctgatctgcagcactggatctcctacaacgaggccagcagccagctgctccgcatggagagtgggctcagtgatgtcaccaaggaccagtgaccgccaccttcacaccgtctgccctggccaccatcctgggcctgggggctgcccacagatgggcagtctcagccatactctgttccagctggagtagcctcctgaccagcctggcccaccctgctccacccactgggcccccccagttattgatacccctctgtgctgggctccacgctaggcagaaggaggagtggcattggcatcctgacccagctctgccctcaaggtggggatggatgggcaaaggagagtcctgcctggccctacgatgaggccactcatgtgggcctaggtaggggaggatggtgcctggagcagagggacccacaagtgcctcccgagcctagatcctggctcggaccactgcaagggccgaggcagggccagaccagagcatcctgggtacaggcctgggctctccagggcctgggcctgattcaggtgcagtgggcactcctgaagggtcagagcggcatctgccaggcagcccctctggcttccgctgaggtggttgcaggcctggggcagagcctgggtggtcagaggccggggctagaggcagatggaagggaggcatttgctgacagaggacggggcacccgggctccccactgcagtcggccttgcctcctcctcctcctctacctccagtcaggctggacgggagggtagccttgtggctgagaggggtcagactaggtggcacaggggctcctggaaagacagcaggcttcctgctgggcgttcccttgttggagggaatagagtgggggtgggactctgcaggggtgtccttgtccactcgcacccctcgccgcccaccagggccatgctctgtgacttgggctgatccccaccctttctgggcctacagcaccacaggccgctgtacccccttagagctgcccctctctggcctggccggcaggcgtcttcttaactcctctgtcctctatattcagcatgttccttgtcagctgctgggccggccctgccttgcgctagcagagcctctcctggcagcttctcaggtctccctaatggagacaccaggctactaggacactggctggggccaccccctcctgcctaatgcctcaccttacagctggggaaactgaggcctggaatggcccagagtcaccaaggcaaagttggggctggtcccagcctgaggctccagctgatgccctcagctcccagagagggggtgccccatctagctgggtgcaggggtcactgcttgtcagctcagggccctgtgcccgcttgcctgttcccctacatctgtgcctgcacatccagaactgcctccttgccgctgcctccaggaagcccaccttgagccagagtcaagggctgcagcactgcccgatagaacacgcccgccctcactgctgttcttgccttacagccaccatgggaaagctgcaacctttctgttttatttaaagaaagcccaacattaaagggttttcattgcaa

SEQ ID NO: 330289 - DNA, 758 bp, Homo sapiens
ctcggccgccctcgcgctgtggttcgctccgggcgcgctgcgctcgtgagttcccaggaggcctggcgggcaccgtaaccagcgccgcggacaccggcaccggcgccacggactccgcaggaccccgcgcccgccgccgccgctatgctggggctgctggtggcgttgctggccctggggctcgctgtctttgcgctgctggacgtctggtacctggtgcgccttccgtgcgccgtgctgcgcgcgcgcctgctgcagccgcgcgtccgtgacctgctagctgagcagcgcttcccgggccgcgtgctgccctcggacttggacctgctgctgcacatgaacaacgcgcgctacctgcgcgaggccgactttgcgcgcgtcgcgcacctgacccgctgcggggtgctcggggcgctgagggagttgcgggcgcacacggtgctggcggcctcgtgcgcgcgccaccgccgctcgctgcgcctgctggagcccttcgaggtgcgcacccgcctgctgggctgggacgaccgcgcgttctacctggaggcgcgctttgtcagcctgcgggacggcttcgtgtgcgcgctgctgcgcttccggcagcacctgctgggcacctcacccgagcgcgtcgtgcagcacctgtgccagcgcaggacggattctcactctgtcgcccaggctggagtgcagtggcgtgatctcggctcactgcaacctccgccttccgggttcacgccattctcctgcttcagcct

SEQ ID NO: 330290 - DNA, 365 bp, Homo sapiens
gggtcacatgcctagtaagtggtagagccgggtttcaaacccaggcagtctggctcccaagtctgggctcttagctgcctctccttgccgccacctgctctgcagctattgaaagaacaaggcagttcaatgggaactgtcatgaccggctctcaaagcaaggtgcagacagtgctccctatatgttcccatttacagaaaccaacctccccaccaaaacgacgaaaaccacacttcactgtgtgtgtgtctacagatgcataaacggtctaggtgaacacacacactgttaaccatggtcccctctggaaaggggagtggaggtaaaggaagtgtgaaagggaatttttttttttttttttttt

SEQ ID NO: 330291 - DNA, 245 bp, Homo sapiens
ctgctacacaccactctggcttacgcttccagctaacagcggtttgtctgtgtttctggactgaagtgactgatgaaaaacagtagtcaagtctggagggtgattccctttcagttcacttgcctttcagttctggggaaattagaagatttgctctctctctctgcttcttagaatgggctgcaatttgtgcacttttcagaaaagagaggaacactacaaactgctgtatgaagtttcccagg

SEQ ID NO: 330292 - DNA, 261 bp, Homo sapiens
tcattaagaacctacccaaaacagcataattttttaaaaacaagcttagaatggcaaagggattctaatatatgtctcaaaactcaaaatatataaaacaaaagctggcttaatttgactccataaaacttaagacttaccgcatgaaaacaaatatcataaaaaaaatcaaaggagaacgtgaggaaaaaaacacgttcacagaatctggtacatggctaaatattcttagaaatagtcttagattcatgaccaggctgg

SEQ ID NO: 330293 - DNA, 1611 bp, Homo sapiens
cacgactctgggagtggggaaacagagagccggttcctctgctgcagaagtcctcggggttccttctcacaactctgcgaaggggaaagggttgtgagacccaaccagaccccaactccagctcccagcaggaggtggctgcgccacactcgggaggcctcttggtttcagggtctctctgtctctctctcaccctcttcctcgctttctctgtctctctgtctctctctctctctctccctcgtccactcccccaaacatgtccaccggctccctcagcgatgtggaggaccttcaagaggtggagatgttggaatgtgacgggttgaaaatggattcgaacaaggaatttgtgacttccaacgagagcaccgaggagagctccaactgcgagaatgggtctccccagaagggccgcggcggcctgggcaagaggaggaaggcgcccaccaagaagagccccctgagcggggtcagccaggaggggaagcaggtccagcgcaacgccgccaacgcgcgagagcgggcccgcatgcgagtgctgagcaaggccttctccagactcaagaccaccctgccctgggtgccccccgacaccaagctctccaagctggacacgctcaggctggcgtccagctacatcgcccacttgaggcagatcctggctaacgacaaatacgagaacgggtacattcacccggtcaacctgacgtggccctttatggtggccgggaaacccgagagtgacctgaaagaagtggtgaccgcgagccgcttatgtggaaccaccgcgtcctgaccttggagtttggtacctggagcgagagcttctccgcccttccaccaaccccacaggccgcttcgcgggtggagccctctgcctggccatggaggaaggatcccgctaggctggtcccgactggagaagctgctctgccaggtgtgctctctgtcagcaatagtgacctcattaccaaggggtggcgaccacattaccaagcgcaattccccattctccaagggctgagaacttcggtgacttcatccacctgtctatttgcacatggaggacttttcaagatgtcaggatgcccttccatcaccccaccaccgccaccccaacttgactttcaagaacacatttcaagctctggccagagtcccgttcctcaaattcatgtgttctctcctttctaccagagggatagagcccatgcctcaacctatccagagttcaaatcaaagagtccccagtgtgattcaattgtttgcctttcacgtttcgcaaattttccaatctcccactcacgtttttacaaaacgaatgctctaaattctgaggattccaggcaggccatccatagagaaataactttttcttgctcattcccttacaaccccaatctatacatggatttttagaaagtcttcatggctatctatagttccctaccaataatttgaagcctttgctttaggcaggaggcatgtggctatgaatagggaacacgtagatttgaccctgggttctgcatccaactagctgtttcttgaaagagcctggatcctcagttttcccatctctgcaagcagggataacggtaatgagaa

SEQ ID NO: 330294 - DNA, 561 bp, Homo sapiens
cacgactctgggagtggggaaacagagagccggttcctctgctgcagaagtcctcggggttccttctcacaactctgcgaaggggaaagggttgtgagacccaaccagaccccaactccagctcccagcaggaggtggctgcgccacactcgggaggcctcttggtttcagggtctctctgtctctctctcaccctcttcctcgctttctctgtctctctcccgcgagaacactttacaacgacgaggagattcgtttccaaaccagaggagatcaattgtacttacaaagattcccatctatttaactttattaacttctaccgtgaatgactctgcaagccttgctggtccaagtgcaatatgtaattataaatatataaatagataagagcctatcaatgtatcttttgtacaatatgttgtaaaatgtagatcataggatagctgactttgacagtcacatttataaagtaattcacttaaagatatatatttttttcaaacaagttttgctacttttgaaaataaatctttctttatattgctaaaagctctgata

SEQ ID NO: 330295 - DNA, 352 bp, Homo sapiens
ccccctcgcaatgctcctctctctgtcccaccccgcgagaacactttacaacgacgaggagattcgtttccaaaccagaggagatcaattgtacttacaaagattcccatctatttaactttattaacttctaccgtgaatgactctgcaagccttgctggtccaagtgcaatatgtaattataaatatataaatagataagagcctatcaatgtatcttttgtacaatatgttgtaaaatgtagatcataggatagctgactttgacagtcacatttataaagtaattcacttaaagatatatatttttttcaaacaagttttgctacttttgaaaataaatctttcttta

SEQ ID NO: 330296 - DNA, 388 bp, Homo sapiens
ctccaccctcttctttcccgcagacgtggccctttatggtggccgggaaacccgagagtgacctgaaagaagtggtgaccgcgagccgcttatgtggaaccaccgcgtcctgaccttggaggtgcgagtctgggaaaggcgcgctcccggggggagcgggccccgggaaggcgacccctgccctcagtgctctctgtctctgcttccccctcgcaatgctcctctctctgtcccaccccgcgagaacactttacaacgacgaggagattcgtttccaaaccagaggagatcaattgtacttacaaagattcccatctatttaactttattaacttctaccgtgaatgactctgcaagccttgctggtccaagtgcaatatgtaattat

SEQ ID NO: 330297 - DNA, 1263 bp, Homo sapiens
cacgactctgggagtggggaaacagagagccggttcctctgctgcagaagtcctcggggttccttctcacaactctgcgaaggggaaagggttgtgagacccaaccagaccccaactccagctcccagcaggaggtggctgcgccacactcgggaggcctcttggtttcagggtctctctgtctctctctcaccctcttcctcgctttctctgtctctctgtctctctctctctctctccctcgtccactcccccaaacatgtccaccggctccctcagcgatgtggaggaccttcaagaggtggagatgttggaatgtgacgggttgaaaatggattcgaacaaggaatttgtgacttccaacgagagcaccgaggagagctccaactgcgagaatgggtctccccagaagggccgcggcggcctgggcaagaggaggaaggcgcccaccaagaagagccccctgagcggggtcagccaggaggggaagcaggtccagcgcaacgccgccaacgcgcgagagcgggcccgcatgcgagtgctgagcaaggccttctccagactcaagaccaccctgccctgggtgccccccgacaccaagctctccaagctggacacgctcaggctggcgtccagctacatcgcccacttgaggcagatcctggctaacgacaaatacgagaacgggtacattcacccggtcaacctgacgtggccctttatggtggccgggaaacccgagagtgacctgaaagaagtggtgaccgcgagccgcttatgtggaaccaccgcgtcctgaccttggaggtgcgagtctgggaaaggcgcgctcccggggggagcgggccccgggaaggcgacccctgccctcagtgctctctgtctctgcttccccctcgcaatgctcctctctctgtcccaccccgcgagaacactttacaacgacgaggagattcgtttccaaaccagaggagatcaattgtacttacaaagattcccatctatttaactttattaacttctaccgtgaatgactctgcaagccttgctggtccaagtgcaatatgtaattataaatatataaatagataagagcctatcaatgtatcttttgtacaatatgttgtaaaatgtagatcataggatagctgactttgacagtcacatttataaagtaattcacttaaagatatatatttttttcaaacaagttttgctacttttgaaaataaatctttctttatattgctaaaagctctgata

SEQ ID NO: 330298 - DNA, 735 bp, Homo sapiens
cacgactctgggagtggggaaacagagagccggttcctctgctgcagaagtcctcggggttccttctcacaactctgcgaaggggaaagggttgtgagacccaaccagaccccaactccagctcccagcaggaggtggctgcgccacactcgggaggcctcttggtttcagggtctctctgtctctctctcaccctcttcctcgctttctctgtctctctgtctctctctctctctctccctcgtccactcccccaaacatgtccaccggctccctcagcgatgtggaggaccttcaagaggtggagatgttggaatgtgacgggttgaaaatggattcgaacaaggaatttgtgacttccaacgagagcaccgaggagagctccaactgcgagcccgcgagaacactttacaacgacgaggagattcgtttccaaaccagaggagatcaattgtacttacaaagattcccatctatttaactttattaacttctaccgtgaatgactctgcaagccttgctggtccaagtgcaatatgtaattataaatatataaatagataagagcctatcaatgtatcttttgtacaatatgttgtaaaatgtagatcataggatagctgactttgacagtcacatttataaagtaattcacttaaagatatatatttttttcaaacaagttttgctacttttgaaaataaatctttctttatattgctaaaagctctgata

SEQ ID NO: 330299 - DNA, 849 bp, Homo sapiens
cacgactctgggagtggggaaacagagagccggttcctctgctgcagaagtcctcggggttccttctcacaactctgcgaaggggaaagggttgtgagacccaaccagaccccaactccagctcccagcaggaggtggctgcgccacactcgggaggcctcttggtttcagggtctctctgtctctctctcaccctcttcctcgctttctctgtctctctgtctctctctctctctctccctcgtccactcccccaaacatgtccaccggctccctcagcgatgtggaggaccttcaagaggtggagatgttggaatgtgacgggttgaaaatggattcgaacaaggaatttgtgacttccaacgagagcaccgaggagagctccaactgcgagaatgggtctccccagaagggccgcggcggcctgggcaagaggaggaaggcgacccctgccctcagtgctctctgtctctgcttccccctcgcaatgctcctctctctgtcccaccccgcgagaacactttacaacgacgaggagattcgtttccaaaccagaggagatcaattgtacttacaaagattcccatctatttaactttattaacttctaccgtgaatgactctgcaagccttgctggtccaagtgcaatatgtaattataaatatataaatagataagagcctatcaatgtatcttttgtacaatatgttgtaaaatgtagatcataggatagctgactttgacagtcacatttataaagtaattcacttaaagatatatatttttttcaaacaagttttgctacttttgaaaataaatctttctttatattgctaaaagctctgata

SEQ ID NO: 330300 - DNA, 566 bp, Homo sapiens
atctagtgccttcagactgcagacccaagcaagtatcatcttcccaggcagatcttaaggggtggattaaggcttacactaatgagaaaggaagcctcaaagtgtctctgtgccccaccatgaagtgcagccatctaagtaaaggtaccgctgtgtcatttctttcatttagaggccaggttctctgaaccctgactagacccaccaccaaacccagaacttcccacccactggaaacggcaaaaggaaagaaagtgaagaaaacctggcattctctacacaaaccttggtgatgacacctcaagggttttctgccaccagggaggtgaagttcacctccagagtccaatttcagctgctctattctcccagcctctcatccacccacctccacccccagggaggtaaaggaaaggagaagaagagaggagtggatgaaatataaatgaatgtgtgcagtagcagtcagaggcggcatccaatgctctgggccatggcagggctgtgtgcaggtgtccagcaggaaaaggtaaacttccttcattgctctccagccctgtggtgac

SEQ ID NO: 330301 - DNA, 1215 bp, Homo sapiens
agacgaggtttcaccaggttgccgtggctgatctggaactcctggtctcaagtgatctacccaactcagcctcccaaagtgctgggattacaggcgtgagccaccgcacccggcctaatctagcattttctaaaaggaaggacccagcagtgaacggcaatatcaataatcatgttcaagactatcagacatgcaagctggggatgaatgggtggaaggggaaaatgatgaataaatgatgaacacaagtatagacccagtggatttgagatgcccaagatgccagtgagatattcaaagtttaactcaaaagccacttcccatatgaaatcctgacaaacactcctacgtccaactggaattaatttctcttctgggctcccacagcactctgtatttttctaatagcataacactattttgtttgtagatatttctctgatagcattactatctttcctctttatcacaactgtttgaagttcttttgcctcttgcatccactgttgcccaatcccactgctggaaggctcatcttattaagttctgtattcctagtgctaacacactgtctaccatagatgatgttcaataaatggttgctaaatgaattctcttgtgataatagcactatggcaacataatcgacggtaaaaatttcttctcaatgtttacttttagcagaatgcattcatttatcaactttcattgagaatatgctaatttccatgaccctgctaggaaataggaaaataaagatgaatgtaataaggtgctcattctactgaaagtcttgactagtggagaattatggatccaacttttcatgaaatgccttcagtggtaagaattctcatatttggaataaaaaatgttatgggttgtgccaagatacctacatacttcataattttgtagagggctgtccttactgcagaaatgtatactactatagtcatatgtggaaattctttttatgatgctaactgcatgctaaccagactttttaatttaatacttgcattaaataaaccatgctaggaatccaggaatctagcttggtttattttccatacaatgtactctttgtaatatgcatatactacataaaaattctattaatggcctcgtactaaagatgtgtctgttggggaatcagttattctgtataattttatcttaattgatatattaaaatctaccaaaaatataaac

SEQ ID NO: 330302 - DNA, 289 bp, Homo sapiens
tccagctaatttttttggtattttttgcagagacgaggtttcaccaggttgccgtggctgatctggaactcctggtctcaagtgatctacccaactcagcctcccaaagtgctgggattacaggcgtgagccaccgcacccggcctaatctagcattttctaaaaggaaggacccagcagtgaacggcaatatcaataatcatgttcaagactatcagacatgcaagctggggatgaatgggtggaaggggaaaatgatgaataaatgatgaacacaagtatagaccca

SEQ ID NO: 330303 - DNA, 1869 bp, Homo sapiens
  misc_feature (1)..(1): n is a, c, g, or t
  misc_feature (4)..(4): n is a, c, g, or t
nggnggggccacgccttttccggcccgcagcgcggcctgggctcccgcgtgtttaaaagtgcgcttgtggctgctgctgtcttaactcctgtgcttggcggacagacaggcgagatggcggcggaggtgttgccgagtgcgaggtggcagtattgtggggcgcccgacgggagccagagagctgtactggtccagttctccaacgggaagctacagagtccaggcaacatgcgctttaccttgtatgagaacaaagattccaccaaccccaggaagaggaatcaacggatcctggcagctgaaacagataggctctcctatgtgggaaacaattttgggactggagccctcaaatgcaacactttgtgcaggcactttgtgggaattttgaacaagacctctggccaaatggaagtatatgatgctgaattgttcaacatgcagccactattttcagatgtatcagttgagagtgaactggcgctagagagtcagaccaaaacttacagagaaaagatggattcttgtattgaagcctttggtaccaccaaacagaagcgagctctgaacaccaggagaatgaacagagttggcaatgaatctttgaatcgtgcagtggctaaagctgcagagactatcattgatacgaagggtgtgactgctctggtcagcgatgctatccacaatgacttgcaagatgactccctctaccttcctccctgctatgatgatgcagccaagcctgaagacgtgtataaatttgaagatcttctttcccctgcggagtatgaagctcttcagagcccatctgaagctttcaggaacgtcacgtcagaagaaatactgaagatgattgaggagaacagccattgcacctttgtcatagaagcgttgaagtctttgccatcagatgtggagagccgagaccgccaggcccgatgcatatggtttctggataccctcatcaaatttcgagctcatagggtagttaagcggaaaagtgctctgggacctggagttccccacatcatcaacaccaaactgctgaagcactttacttgcttgacctacaacaatggcagattacggaacttaatttcggattctatgaaggcgaagattactgcatatgtgatcatacttgccttgcacatacatgacttccaaattgacctgacagtgttacagagggacttgaagctcagtgagaaaaggatgatggagatagccaaagccatgaggctgaagatctccaaaagaagggtgtctgtggccgccggcagtgaagaagatcacaaactgggcaccctgtccctcccgctgcctccagcccagacctcagaccgcctggcaaagcggaggaagattacctagacgcatgctttccagacagggcgttttggctgcatcacagccactggctggtcctattcatttccatttttatgtatgttttgaaaagaaaaggtccggggatggtggctcacacctgaaatcccagcactttgggaggccgaggcaggaagatcattgagctcaggagtttgaaaccagtctggacaacatagggagaccccatctctaccggaggaaaaaaaaaagagtcaggcctggtggtgtgcgcctgtaatcccagctactcgggaggctgaggcaggacgattacttgagcttgggaaatcaaggttgcagtgagctatgattgtgtggccacactccatcctgggtcacagagtgagaccttgtctcaaaaaagtaacataaggaaaaaagaagccttgctttagcacaggtatgaagccagaagccagcatctcaactgtgcttgtcttatgcagaaatataaagcgatggccaggttggacttca

SEQ ID NO: 330304 - DNA, 2539 bp, Homo sapiens
gcactcaggcaagaactaggctcggggtagaggtgacagctctgtgatggggagctcaggctgcaccaggaggccatgctaggtttgacttcatttaaaaagcacactacacagctgacgggctcaggagctccatgaagggcaccctgcagaggtctggagggtagtgagaaggtaccaatggggcgagcatgcctgtgtcgggaggctgatccgggtaggaataagcccagcatgccccacatgagcccaccatgaggaagcatttggagagaaagcttgctctgtgttgtcagaagggagattgaagaaggtgggcccaggggtgctgttgacagtataggctcatgtgctgttccaaggctcatctctggctcttgcctggtctggccataccatgtccacatccgctgtacttaggacttcctctgggcaccagggcagtggcctcaccaagacctggaggcctagatgatgaaatcatactggtgtttgctgtgcttgtacattcccatcagcagacatccgtgtttgggcctgactggccaacagggaagtccagggaggacacagtataagctgcttgggtagaggtcagctggaacctcttgtgaactctgcaccagagtgaagccttcacccatggcagtattcctgtgggtgggagggaagctactgcagactgaaagcaaatgattccaaggaaacacagtactttagagaattctctttagatccgtgagtgctgcccatggagctgggccattcctcctgagatacaggacaggacgcctcaactctgcttctttgggctctcccagacctacccaggccactggagtgagtctagagaaatgaccagggtggtgaagagacaccctgcaaactggcacatacgagaggaacccaggagggcagcagaccccagggggatgagggtgctgcctgcaaatctctgaagagttgtcacagaacagagtgaagagatgtcctttgggggccccaggaggtagagattctgggaatgaggttgggtttgtttcctcatttgtctgcctgtctgtccgccatccatccaacacttagtgagctttgctctgtgctgggcatagagaatcaacagtgaacaagatgggcaaagtccctgccctcaaccaacagactgaaaagagaggattcagtgccatctgcaggtggcatgtggctgagtgggcacaggagcatggagaaggcgcagttaactgttatttgtagagacaggggaaggtgttccatagaagtagtgactaaggagcttctgaaggaggggtagaatttagcgagggagagagactttggctcaattaagtaaaaagttagatgggctcagttttcttgggcaagtctggcctgttgtgcaaagcacccgcactccctgactcttccccaaacacaagagctaaggtgggtgttctgttcctcccacttctgcctccaaatgacctggagggaatttgtgtcccagctgttcccttccctgccacctttgctccaggtaatagccctcctcacacctctccacatctgatagggaactttcccctgccggatctcaggagcatcagcactcccagcctccaaaatggggacaatgagctcaccaagtcaatgtttaatacattattgacagaacttacgatgattttaggtggctcagggatgtagtaaagtacttgtgttctgctggttaggctaagctgaagtgacaaatggccctcaaatgtctggtttcaacaaaagttcatttgcttttgttgaatgtctggcacatgtctgtcagccagcaggcacctgggaccctgctccgggttagcttcaccccgggactcgggctgccatgtctgacacgtggtggtccactggcagagggacacacgatcggggcaagttctgctggcccttaaagcttctacccagaagtgaccattaaccacttctgcctacattcactgggcaaatcaggtcccatggcaacgtgagagggcatgtactctccctgaggggcagcaaacagtaactaccaaaaccaatgaatattttcattttaatagtttaatgtatgtttatagtaatataaaaagtcttttcagtgtgtgaaaaaaagacatgttgtaggatgggatcctggaatggaaaaaggacattaggtaacaaactaaagaaatctgaggccaggcacagtggctcatgtttgtaatcccagcactttgggggattgaagcaggcggatcacttgagcccaggagtttgagaccaggctaggcaacatggcaaaaccccgtctctacaaaaaaatacataaattggccaggcgtggtggtgcatgcctgtagtcccagctgctcaggaggctgaggtgggaggatcacctgagtgagcctgaggaggtcaaggctgcggtgaaccatgatcacaccactgcactctagcctgggcaacagagtgagatcccgtttcaaaaagaaaaaaatctgaataaactatggactttagttaaaat

SEQ ID NO: 330305 - DNA, 804 bp, Homo sapiens
gcactcaggcaagaactaggctcggggtagaggtgacagctctgtgatggggagctcaggctgcaccaggaggccatgctaggtttgacttcatttaaaaagcacactacacagctgacgggctcaggagctccatgaagggcaccctgcagaggtctggagggtagtgagaaggtaccaatggggcgagcatgcctgtgtcgggaggctgatccgggtaggaataagcccagcatgccccacatgagcccaccatgaggaagcatttggagagaaagcttgctctgtgttgtcagaagggagattgaagaaggtgggcccaggggtgctgttgacagtataggctcatgtgctgttccaaggctcatctctggctcttgcctggtctggccataccatgtccacatccgctgtacttaggacttcctctgggcaccagggcagtggcctcaccaagacctggaggcctagatgatgaaatcatactggtgtttgctgtgcttgtacattcccatcagcagacatccgtgtttgggcctgactggccaacagggaagtccagggaggacacagtataagctgcttgggtagaggtcagctggaacctcttgtgaactctgcaccagagtgaagccttcacccatggcagtattcctgtgggtgggaggatcacctgagtgagcctgaggaggtcaaggctgcggtgaaccatgatcacaccactgcactctagcctgggcaacagagtgagatcccgtttcaaaaagaaaaaaatctgaataaactatggactttagttaaaat

SEQ ID NO: 330306 - DNA, 1886 bp, Homo sapiens
  misc_feature (1)..(1): n is a, c, g, or t
  misc_feature (4)..(4): n is a, c, g, or t
nggnggggccacgccttttccggcccgcagcgcggcctgggctcccgcgtgtttaaaagtgcgcttgtggctgctgctgtcttaactcctgtgcttggcggacagacaggcgagatggcggcggaggtgttgccgagtgcgaggtggcagtattgtggggcgcccgacgggagccagagagctgtactggtccagttctccaacgggaagctacagagtccaggcaacatgcgctttaccttgtatgagaacaaagattccaccaaccccaggaagaggaatcaacggatcctggcagctgaaacagataggctctcctatgtgggaaacaattttgggactggagccctcaaatgcaacactttgtgcaggcactttgtgggaattttgaacaagacctctggccaaatggaagtatatgatgctgaattgttcaacatgcagccactattttcagatgtatcagttgagagtgaactggcgctagagagtcagaccaaaacttacagagaaaagatggattcttgtattgaagcctttggtaccaccaaacagaagcgagctctgaacaccaggagaatgaacagagttggcaatgaatctttgaatcgtgcagtggctaaagctgcagagactatcattgatacgaagggtgtgactgctctggtcagcgatgctatccacaatgacttgcaagatgactccctctaccttcctccctgctatgatgatgcagccaagcctgaagacgtgtataaatttgaagatcttctttcccctgcggagtatgaagctcttcagagcccatctgaagctttcaggaacgtcacgtcagaagaaatactgaagatgattgaggagaacagccattgcacctttgtcatagaagcgttgaagtctttgccatcagatgtggagagccgagaccgccaggcccgatgcatatggtttctggataccctcatcaaatttcgagctcatagggtagttaagcggaaaagtgctctgggacctggagttccccacatcatcaacaccaaactgctgaagcactttacttgcttgacctacaacaatggcagattacggaacttaatttcggattctatgaaggcgaagattactgcatatgtgatcatacttgccttgcacatacatgacttccaaattgacctgacagtgttacagagggacttgaagctcagtgagaaaaggatgatggagatagccaaagccatgaggctgaagatctccaaaagaagggtgtctgtggccgccggcagtgaagaagatcacaaactgggcaccctgtccctcccgctgcctccagcccagacctcagaccgcctggcaaagcggaggaagattacctagacgcatgctttccagacagggcgttttggctgcatcacagccactggctggtcctattcatttccatttttatgtatgttttgaaaagaaaaggtccggggatggtggctcacacctgaaatcccagcactttgggaggccgaggcaggaagatcattgagctcaggagtttgaaaccagtctggacaacatagggagaccccatctctaccggaggaaaaaaaaaagagtcaggcctggtggtgtgcgcctgtaatcccagctactcgggaggctgaggcaggacgattacttgagcttgggaaatcaaggttgcagtgagctatgattgtgtggccacactccatcctgggtcacagagtgagaccttgtctcaaaaaagtaacataaggaaaaaagaagccttgctttagcacaggtatgaagccagaagccagcatctcaactgtgcataatacctccaggaaatataagcatgtcgtcttcccctccctgctccttcctctcctctc

SEQ ID NO: 330307 - DNA, 3204 bp, Homo sapiens
gctctaggtatcttaagaagaatggattttaatgtatggataaggtgctgtagaattgtgacaagggccagaggactgggaatcggaaggttgccgtcaggactgctgaattcaagaacacactgccggggttgccatcggggactcagaagccacttctgctccataactgctcctggaattcatgcagctgaagattcaacactgggctgctgatttcagctacccatgctttcttctttttctttttatttttttgagacagagtcttgctctgtggcccaggctggagtgcagtggcacgatctcgctcactgctacctccgcctcccatggcctggttcaagcaattctcctgcctcagcctcctgagtagctgggattacaggcatgcgccaccatgcccagctaatttttttgcatttttagtagagacagggtttcactgtgttggccaggctggtcttggactcctgacctcatgatccacccgccttggcctcccaaggtgctgggattacaggtatgagccaccgtgcccagcctacccgtgctttcaaaggtcctgtatttccaccactttgtcaccacagacagccagaaggtcaagcagctggcctccaccttgcttccttctggtgcgcatatataggagcctgattagcatgtagaatcctagcagaatgggagtctttgaaataggtttcagctcaccagcctctagttacaggaggcattctagaaggacatgagtggattataactgccaaccaattgtatgtgccactgaggagatggagaagctgtgtccagagcggtgctataaggacaggagtgtgacacaggaaggcttaggtacgtggcctgggcccagtctcacatctcagggtcctgcttcaagtgggagcagttgagatctgtgacactcagcacctgggaggccgggtcagtgaagggaggggtgcttctcctgcctcagcctcccgattacaggcatgcacaccatgcccggtaatttgtatttagtagagacagcgtttctccatgttaggctggtctcaatctcctgacctcaggtgatctgcccgcctcggtctcccaaagtgctggaattataggcgtgagccaccacgcccagccttttgtgattacttttaaaattcagctgggtttgacacttggaggcttaatttctgggaatgactggacacagcatgtggctgggaccctctgaacaacctctgacctagtggagaagcaggtggtaatgactgtaggtatggatagggaaagactaggcgggcaaatacttgtcgtgtgtcaacaggtgtattttgctaaatgtcggggacacattccaagaggctaaaaagcaaatttctgtacattaggagatttgtgagtccttaggaaaggctcagaagagggctccacctagcacaatacctgacatagaaagtggtcagtgtctgcagaatgagtcggcatgaaccgtactttccttggcagggttattaggtggtaaatacctgcagaataatgggattgtactagggtttcttctggctttagaaacccatttgtttactaatagattcccagaggataccttgatctcaccaagctatttgccagaatgtctcctgatggcctcattgaagaaagggggactatgagccagatgctggtgccctgaagatttgtagtttgtgggatagtcttaacttggcagggtttgattaacagaatgaagtctgttccttagagggaagtctttgcttgctgccctgacctgctggacactgttaattgggatgaggtcaaagaaggcatagttaccacatttgcaggagaccctaacctggaaatagtaaattacataacattctttcaagtgtctcctcttttaaaaaagtattttgatatagtttcacacagagaaaacttgcaagaactcttgtatatcctttacccagattctccaactgtcaatactttgtcccatttactatttgctttagacattttgagatttgtttttgaaccatttgaggaaaacatcctacccttctacccataagtactttttcagtgtgtacatcttaagaatcaggactttctcttccataaccacagtccatcagatgcaggaaataagacaataatgcaatactatgacttagcccacagttcatgttcaaatcttaccgatcaccatgcctctttggtcttgcttaatctgaaacagttcagatttttattggactttctcggctttgacattttggagagtgaggtgttattctttagggtgtctgtcagtttacatttggggctttcccgtgatcggattcaggatttacatttttggcaggaacagcacagaaatgatgctgtgacccacatgcatcacattaggggcccatgatgtgggactgcgctttccttgctgctgttaacttttatcagttaaggttgtgttttccgcattgtgaagatactgtttttccttttaataagtaatttctggagggatactttgaaactaagtatcctgttcctcatcaaactttcacctactagtttcagcctcaattgatgattcttgctgaatcaattaccaagatggttgcaaaatggtgattttgcaacattatcgtttcttctaattattggcatgctcttataaggcagtttgttttctcgaccttagaagttttgtgttcatttagttattggcatagactcaagagtcttgtgttctatgtggagtctgttactgtgattccttgtgatgtccagattgtatgtatttggccaatcttgagttccttcaggaaacctcctggatcccatcattttaagggtgcttccttactttctagcatgagatattccaggcctaccttgtactttccctgctgcagccctggagtcagtcttttgttgtggttttgctttttagagacagggtcttgctctgtcgctcaggctggagagcggtggtgcagtcagctcactccactcctgggctcaagccatcctcctgcctcagcctcctgagtagctaggactataggcatgcaccaccacgcccagctttgaatccgtcttttatccaaggagcttctagcctgggcaacagagtgagatcccgtttcaaaaagaaaaaaatctgaataaactatggactttagttaaaat

SEQ ID NO: 330308 - DNA, 3232 bp, Homo sapiens
gctctaggtatcttaagaagaatggattttaatgtatggataaggtgctgtagaattgtgacaagggccagaggactgggaatcggaaggttgccgtcaggactgctgaattcaagaacacactgccggggttgccatcggggactcagaagccacttctgctccataactgctcctggaattcatgcagctgaagattcaacactgggctgctgatttcagctacccatgctttcttctttttctttttatttttttgagacagagtcttgctctgtggcccaggctggagtgcagtggcacgatctcgctcactgctacctccgcctcccatggcctggttcaagcaattctcctgcctcagcctcctgagtagctgggattacaggcatgcgccaccatgcccagctaatttttttgcatttttagtagagacagggtttcactgtgttggccaggctggtcttggactcctgacctcatgatccacccgccttggcctcccaaggtgctgggattacaggtatgagccaccgtgcccagcctacccgtgctttcaaaggtcctgtatttccaccactttgtcaccacagacagccagaaggtcaagcagctggcctccaccttgcttccttctggtgcgcatatataggagcctgattagcatgtagaatcctagcagaatgggagtctttgaaataggtttcagctcaccagcctctagttacaggaggcattctagaaggacatgagtggattataactgccaaccaattgtatgtgccactgaggagatggagaagctgtgtccagagcggtgctataaggacaggagtgtgacacaggaaggcttaggtacgtggcctgggcccagtctcacatctcagggtcctgcttcaagtgggagcagttgagatctgtgacactcagcacctgggaggccgggtcagtgaagggaggggtgcttctcctgcctcagcctcccgattacaggcatgcacaccatgcccggtaatttgtatttagtagagacagcgtttctccatgttaggctggtctcaatctcctgacctcaggtgatctgcccgcctcggtctcccaaagtgctggaattataggcgtgagccaccacgcccagccttttgtgattacttttaaaattcagctgggtttgacacttggaggcttaatttctgggaatgactggacacagcatgtggctgggaccctctgaacaacctctgacctagtggagaagcaggtggtaatgactgtaggtatggatagggaaagactaggcgggcaaatacttgtcgtgtgtcaacaggtgtattttgctaaatgtcggggacacattccaagaggctaaaaagcaaatttctgtacattaggagatttgtgagtccttaggaaaggctcagaagagggctccacctagcacaatacctgacatagaaagtggtcagtgtctgcagaatgagtcggcatgaaccgtactttccttggcagggttattaggtggtaaatacctgcagaataatgggattgtactagggtttcttctggctttagaaacccatttgtttactaatagattcccagaggataccttgatctcaccaagctatttgccagaatgtctcctgatggcctcattgaagaaagggggactatgagccagatgctggtgccctgaagatttgtagtttgtgggatagtcttaacttggcagggtttgattaacagaatgaagtctgttccttagagggaagtctttgcttgctgccctgacctgctggacactgttaattgggatgaggtcaaagaaggcatagttaccacatttgcaggagaccctaacctggaaatagtaaattacataacattctttcaagtgtctcctcttttaaaaaagtattttgatatagtttcacacagagaaaacttgcaagaactcttgtatatcctttacccagattctccaactgtcaatactttgtcccatttactatttgctttagacattttgagatttgtttttgaaccatttgaggaaaacatcctacccttctacccataagtactttttcagtgtgtacatcttaagaatcaggactttctcttccataaccacagtccatcagatgcaggaaataagacaataatgcaatactatgacttagcccacagttcatgttcaaatcttaccgatcaccatgcctctttggtcttgcttaatctgaaacagttcagatttttattggactttctcggctttgacattttggagagtgaggtgttattctttagggtgtctgtcagtttacatttggggctttcccgtgatcggattcaggatttacatttttggcaggaacagcacagaaatgatgctgtgacccacatgcatcacattaggggcccatgatgtgggactgcgctttccttgctgctgttaacttttatcagttaaggttgtgttttccgcattgtgaagatactgtttttccttttaataagtaatttctggagggatactttgaaactaagtatcctgttcctcatcaaactttcacctactagtttcagcctcaattgatgattcttgctgaatcaattaccaagatggttgcaaaatggtgattttgcaacattatcgtttcttctaattattggcatgctcttataaggcagtttgttttctcgaccttagaagttttgtgttcatttagttattggcatagactcaagagtcttgtgttctatgtggagtctgttactgtgattccttgtgatgtccagattgtatgtatttggccaatcttgagttccttcaggaaacctcctggatcccatcattttaagggtgcttccttactttctagcatgagatattccaggcctaccttgtactttccctgctgcagccctggagtcagtcttttgttgtggttttgctttttagagacagggtcttgctctgtcgctcaggctggagagcggtggtgcagtcagctcactccactcctgggctcaagccatcctcctgcctcagcctcctgtagtcccagctgctcaggaggctgaggtgggaggatcacctgagtgagcctgaggaggtcaaggctgcggtgaaccatgatcacaccactgcactctagcctgggcaacagagtgagatcccgtttcaaaaagaaaaaaatctgaataaactatggactttagttaaaat

SEQ ID NO: 330309 - DNA, 2855 bp, Homo sapiens
  misc_feature (1)..(1): n is a, c, g, or t
  misc_feature (4)..(4): n is a, c, g, or t
nggnggggccacgccttttccggcccgcagcgcggcctgggctcccgcgtgtttaaaagtgcgcttgtggctgctgctgtcttaactcctgtgcttggcggacagacaggctggtcttggactcctgacctcatgatccacccgccttggcctcccaaggtgctgggattacaggtatgagccaccgtgcccagcctacccgtgctttcaaaggtcctgtatttccaccactttgtcaccacagacagccagaaggtcaagcagctggcctccaccttgcttccttctggtgcgcatatataggagcctgattagcatgtagaatcctagcagaatgggagtctttgaaataggtttcagctcaccagcctctagttacaggaggcattctagaaggacatgagtggattataactgccaaccaattgtatgtgccactgaggagatggagaagctgtgtccagagcggtgctataaggacaggagtgtgacacaggaaggcttaggtacgtggcctgggcccagtctcacatctcagggtcctgcttcaagtgggagcagttgagatctgtgacactcagcacctgggaggccgggtcagtgaagggaggggtgcttctcctgcctcagcctcccgattacaggcatgcacaccatgcccggtaatttgtatttagtagagacagcgtttctccatgttaggctggtctcaatctcctgacctcaggtgatctgcccgcctcggtctcccaaagtgctggaattataggcgtgagccaccacgcccagccttttgtgattacttttaaaattcagctgggtttgacacttggaggcttaatttctgggaatgactggacacagcatgtggctgggaccctctgaacaacctctgacctagtggagaagcaggtggtaatgactgtaggtatggatagggaaagactaggcgggcaaatacttgtcgtgtgtcaacaggtgtattttgctaaatgtcggggacacattccaagaggctaaaaagcaaatttctgtacattaggagatttgtgagtccttaggaaaggctcagaagagggctccacctagcacaatacctgacatagaaagtggtcagtgtctgcagaatgagtcggcatgaaccgtactttccttggcagggttattaggtggtaaatacctgcagaataatgggattgtactagggtttcttctggctttagaaacccatttgtttactaatagattcccagaggataccttgatctcaccaagctatttgccagaatgtctcctgatggcctcattgaagaaagggggactatgagccagatgctggtgccctgaagatttgtagtttgtgggatagtcttaacttggcagggtttgattaacagaatgaagtctgttccttagagggaagtctttgcttgctgccctgacctgctggacactgttaattgggatgaggtcaaagaaggcatagttaccacatttgcaggagaccctaacctggaaatagtaaattacataacattctttcaagtgtctcctcttttaaaaaagtattttgatatagtttcacacagagaaaacttgcaagaactcttgtatatcctttacccagattctccaactgtcaatactttgtcccatttactatttgctttagacattttgagatttgtttttgaaccatttgaggaaaacatcctacccttctacccataagtactttttcagtgtgtacatcttaagaatcaggactttctcttccataaccacagtccatcagatgcaggaaataagacaataatgcaatactatgacttagcccacagttcatgttcaaatcttaccgatcaccatgcctctttggtcttgcttaatctgaaacagttcagatttttattggactttctcggctttgacattttggagagtgaggtgttattctttagggtgtctgtcagtttacatttggggctttcccgtgatcggattcaggatttacatttttggcaggaacagcacagaaatgatgctgtgacccacatgcatcacattaggggcccatgatgtgggactgcgctttccttgctgctgttaacttttatcagttaaggttgtgttttccgcattgtgaagatactgtttttccttttaataagtaatttctggagggatactttgaaactaagtatcctgttcctcatcaaactttcacctactagtttcagcctcaattgatgattcttgctgaatcaattaccaagatggttgcaaaatggtgattttgcaacattatcgtttcttctaattattggcatgctcttataaggcagtttgttttctcgaccttagaagttttgtgttcatttagttattggcatagactcaagagtcttgtgttctatgtggagtctgttactgtgattccttgtgatgtccagattgtatgtatttggccaatcttgagttccttcaggaaacctcctggatcccatcattttaagggtgcttccttactttctagcatgagatattccaggcctaccttgtactttccctgctgcagccctggagtcagtcttttgttgtggttttgctttttagagacagggtcttgctctgtcgctcaggctggagagcggtggtgcagtcagctcactccactcctgggctcaagccatcctcctgcctcagcctcctgagtagctaggactataggcatgcaccaccacgcccagctttgaatccgtcttttatccaaggagcttctagcctgggcaacagagtgagatcccgtttcaaaaagaaaaaaatctgaataaactatggactttagttaaaat

SEQ ID NO: 330310 - DNA, 1678 bp, Homo sapiens
gcactcaggcaagaactaggctcggggtagaggtgacagctctgtgatggggagctcaggctgcaccaggaggccatgctaggtttgacttcatttaaaaagcacactacacagctgacgggctcaggagctccatgaagggcaccctgcagaggtctggagggtagtgagaaggtaccaatggggcgagcatgcctgtgtcgggaggctgatccgggtaggaataagcccagcatgccccacatgagcccaccatgaggaagcatttggagagaaagcttgctctgtgttgtcagaagggagattgaagaaggtgggcccaggggtgctgttgacagtataggctcatgtgctgttccaaggctcatctctggctcttgcctggtctggccataccatgtccacatccgctgtacttaggacttcctctgggcaccagggcagtggcctcaccaagacctggaggcctagatgatgaaatcatactggtgtttgctgtgcttgtacattcccatcagcagacatccgtgtttgggcctgactggccaacagggaagtccagggaggacacagtataagctgcttgggtagaggtcagctggaacctcttgtgaactctgcaccagagtgaagccttcacccatggcagtattcctgtgggtgggagggaagctactgcagactgaaagcaaatgattccaaggaaacacagtactttagagaattctctttagatccgtgagtgctgcccatggagctgggccattcctcctgagatacaggacaggacgcctcaactctgcttctttgggctctcccagacctacccaggccactggagtgagtctagagaaatgaccagggtggtgaagagacaccctgcaaactggcacatacgagaggaacccaggagggcagcagaccccagggggatgagggtgctgcctgcaaatctctgaagagttgtcacagaacagagtgaagagatgtcctttgggggccccaggaggtagagattctgggaatgaggttgggtttgtttcctcatttgtctgcctgtctgtccgccatccatccaacacttagtgagctttgctctgtgctgggcatagagaatcaacagtgaacaagatgggcaaagtccctgccctcaaccaacagactgaaaagagaggattcagtgccatctgcaggtggcatgtggctgagtgggcacaggagcatggagaaggcgcagttaactgttatttgtagagacaggggaaggtgttccatagaagtagtgactaaggagcttctgaaggaggggtagaatttagcgagggagagagactttggctcaattaagtaaaaagttagatgggctcagttttcttgggcaagtctggcctgttgtgcaaagcacccgcactccctgactcttccccaaacacaagagctaaggtgggtgttctgttcctcccacttctgcctccaaatgacctggagggaatttgtgtcccagctgttcccttccctgccacctttgctccaggtgggaggatcacctgagtgagcctgaggaggtcaaggctgcggtgaaccatgatcacaccactgcactctagcctgggcaacagagtgagatcccgtttcaaaaagaaaaaaatctgaataaactatggactttagttaaaat

SEQ ID NO: 330311 - DNA, 1328 bp, Homo sapiens
gctctaggtatcttaagaagaatggattttaatgtatggataaggtgctgtagaattgtgacaagggccagaggactgggaatcggaaggttgccgtcaggactgctgaattcaagaacacactgccggggttgccatcggggactcagaagccacttctgctccataactgctcctggaattcatgcagctgaagattcaacactgggctgctgatttcagctacccatgctttcttctttttctttttatttttttgagacagagtcttgctctgtggcccaggctggagtgcagtggcacgatctcgctcactgctacctccgcctcccatggcctggttcaagcaattctcctgcctcagcctcctgagtagctgggattacaggcatgcgccaccatgcccagctaatttttttgcatttttagtagagacagggtttcactgtgttggccaggctggtcttggactcctgacctcatgatccacccgccttggcctcccaaggtgctgggattacaggtatgagccaccgtgcccagcctacccgtgctttcaaaggtcctgtatttccaccactttgtcaccacagacagccagaaggtcaagcagctggcctccaccttgcttccttctggtgcgcatatataggagcctgattagcatgtagaatcctagcagaatgggagtctttgaaataggtttcagctcaccagcctctagttacaggaggcattctagaaggacatgagtggattataactgccaaccaattgtatgtgccactgaggagatggagaagctgtgtccagagcggtgctataaggacaggagtgtgacacaggaaggcttaggtacgtggcctgggcccagtctcacatctcagggtcctgcttcaagtgggagcagttgagatctgtgacactcagcacctgggaggccgggtcagtgaagggagggagacagaactcagctcctctgagaggagaagtttacacagcacctggggccctccatttgggagtcacagtggaaaggagtcttggctgagctttggggcaggtgcaccttattttctttgcggtctgggatgccctcagagctgtgctcctctgctttgtccccatctgcctctggccctgggtaggaggcacttggagcatactttgtcttccttcagcagaggtgtgggcagggaatctacttgtctcttgttttcctttaagccgttgtgaaaatcaagtatgtgactctagcctgggcaacagagtgagatcccgtttcaaaaagaaaaaaatctgaataaactatggactttagttaaaat

SEQ ID NO: 330312 - DNA, 567 bp, Homo sapiens
cacctggggccctccatttgggagtcacagtggaaaggagtcttggctgagctttggggcaggtgcaccttattttctttgcggtctgggatgccctcagagctgtgctcctctgctttgtccccatctgcctctggccctgggtaggaggcacttggagcatactttgtcttccttcagcagaggtgtgggcagggaatctacttgtctcttgttttcctttaagccgttgtgaaaatcaagtatgtgaccttccttggaaaaaataatctctcagaaaaggacttctaatacatcctcagggtagaatgtgtttccgtgattactttttttttttgagatggagtttcgctcttgttgcccaggctggagtgcaatggcgtgatcttagctcactgcaacctctgcctcccgggttcaagtgcttctcctgcctcagcctcccgattacaggcatgcacaccatgcccggtaatttgtatttagtagagacagcgtttctccatgttaggctggtctcaatctcctgacctcaggtgatctgcccgcctcggtctcccaaagtgc

SEQ ID NO: 330313 - DNA, 2092 bp, Homo sapiens
  misc_feature (1)..(1): n is a, c, g, or t
  misc_feature (4)..(4): n is a, c, g, or t
nggnggggccacgccttttccggcccgcagcgcggcctgggctcccgcgtgtttaaaagtgcgcttgtggctgctgctgtcttaactcctgtgcttggcggacagacaggcgagatggcggcggaggtgttgccgagtgcgaggtggcagtattgtggggcgcccgacgggagccagagagctgtactggtccagttctccaacgggaagctacagagtccaggcaacatgcgctttaccttgtatgagaacaaagattccaccaaccccaggaagaggaatcaacggatcctggcagctgaaacagataggctctcctatgtgggaaacaattttgggactggagccctcaaatgcaacactttgtgcaggcactttgtgggaattttgaacaagacctctggccaaatggaagtatatgatgctgaattgttcaacatgcagccactattttcagatgtatcagttgagagtgaactggcgctagagagtcagaccaaaacttacagagaaaagatggattcttgtattgaagcctttggtaccaccaaacagaagcgagctctgaacaccaggagaatgaacagagttggcaatgaatctttgaatcgtgcagtggctaaagctgcagagactatcattgatacgaagggtgtgactgctctggtcagcgatgctatccacaatgacttgcaagatgactccctctaccttcctccctgctatgatgatgcagccaagcctgaagacgtgtataaatttgaagatcttctttcccctgcggagtatgaagctcttcagagcccatctgaagctttcaggaacgtcacgtcagaagaaatactgaagatgattgaggagaacagccattgcacctttgtcatagaagcgttgaagtctttgccatcagatgtggagagccgagaccgccaggcccgatgcatatggtttctggataccctcatcaaatttcgagctcatagggtagttaagcggaaaagtgctctgggacctggagttccccacatcatcaacaccaaactgctgaagcactttacttgcttgacctacaacaatggcagattacggaacttaatttcggattctatgaaggcgaagattactgcatatgtgatcatacttgccttgcacatacatgacttccaaattgacctgacagtgttacagagggacttgaagctcagtgagaaaaggatgatggagatagccaaagccatgaggctgaagatctccaaaagaagggtgtctgtggccgccggcagtgaagaagatcacaaactgggcaccctgtccctcccgctgcctccagcccagacctcagaccgcctggcaaagcggaggaagattacctagacgcatgctttccagacagggcgttttggctgcatcacagccactggctggtcctattcatttccatttttatgtatgttttgaaaagaaaaggtccggggatggtggctcacacctgaaatcccagcactttgggaggccgaggcaggaagatcattgagctcaggagtttgaaaccagtctggacaacatagggagaccccatctctaccggaggaaaaaaaaaagagtcaggcctggtggtgtgcgcctgtaatcccagctactcgggaggctgaggcaggacgattacttgagcttgggaaatcaaggttgcagtgagctatgattgtgtggccacactccatcctgggtcacagagtgagaccttgtctcaaaaaagtaacataaggaaaaaagaagccttgctttagcacaggtatgaagccagaagccagcatctcaactgtgcttgtcttatgcagaaatataaagcgatggccaggttggacttcaaaaaaaaaataactgaaaataggcgcatagttgcgaacacagacacaaaaaaaaatttgtttggggcgttggccgaaaaaagctttcaaacactttgttgggggcggccacaatgttatgcacatgtgcaaagggtccaaaagattggctagacatgcgtggcttcacaaaaaagcggggacggggttttagacctcagtggtgggcatggatcagagacagg

SEQ ID NO: 330314 - DNA, 814 bp, Homo sapiens
tctcctttattgccactgattttctagattacggaacttaatttcggattctatgaaggcgaagattactgcatatgtgatcatacttgccttgcacatacatgacttccaaattgacctgacagtgttacagagggacttgaagctcagtgagaaaaggatgatggagatagccaaagccatgaggctgaagatctccaaaagaagggtgtctgtggccgccggcagtgaagaagatcacaaactgggcaccctgtccctcccgctgcctccagcccagacctcagaccgcctggcaaagcggaggaagattacctagacgcatgctttccagacagggcgttttggctgcatcacagccactggctggtcctattcatttccatttttatgtatgttttgaaaagaaaaggtccggggatggtggctcacacctgaaatcccagcactttgggaggccgaggcaggaagatcattgagctcaggagtttgaaaccagtctggacaacatagggagaccccatctctaccggaggaaaaaaaaaagagtcaggcctggtggtgtgcgcctgtaatcccagctactcgggaggctgaggcaggacgattacttgagcttgggaaatcaaggttgcagtgagctatgattgtgtggccacactccatcctgggtcacagagtgagaccttgtctcaaaaaagtaacataaggaaaaaagaagccttgctttagcacaggtatgaagccagaagccagcatctcaactgtgcttgtcttatgcagaaatataaagcgatggccaggttggacttca

SEQ ID NO: 330315 - DNA, 378 bp, Homo sapiens
tgctatcctttttactaactaatcctagtttaggacctttttattttgcctccttgtctctgggcttccagtgtatcattctgttaccaaacacaaatttaatagtcatcctcctgctaaaaagagactttctgtcaaaagtctatcccagactccttactatggcattcatggcttccccatcttaacatagctaatttttttcaatctcatctgcagttgttcctcatcccttatcacccccagttgcactgtttgtaattctttactgtgtaacacatatttgtgttttcatgcttttgttcatacttgtccctcttcttttgataccttttcttttctttctgtctctcttttttcttgagacagggtttttgc

SEQ ID NO: 330316 - DNA, 2833 bp, Homo sapiens
  misc_feature (969)..(969): n is a, c, g, or t
tttttgtgcaggaacagcccctcccgtctttgtcctggcggtgagcacccagggctaagcttttgaacactttctttgtgtttggattcagcccaggcaatgcatatttgctttcatttcttcttgagcttgaggagctcctgggtgcaaatcttggaaaatgaggatctctgagcctttccaggccagctctttgttttgtagcagacaattgaggctttgaaaaggaaagtgggtgggggcaccccacaggtggccctcatcacccaattgccagtgcctgcaggctgcttcagcagaggcccagagtcaaagaggacttaaaaccagctgtcgtttctcccttagcttctgtgtatgagagaaacgacttctgtttttcaaagtaagaacaaggaggaatttgtttctaaaagaacattaaaacacaggctcgtggtctaaaagcaaatggttcagcaggatgttcagggccttaaagcacagtcagcaggactcagcatctcccagcacctgctctccggttgtcatggtaacatcatccccaacccaaccaccttgtccagccgagagacagcaatcataaggagggacctcggtttcccccgaggatcctgggcttcctttctgaaacgcttgcttctgagctcagcaaccaggaacaccaggccagcccatccccagcacctctgtggagatgagggacaaagtcctacagtccctcttcctgttctgatgagaaagggagggaagaaaacataccccgagcgcctgcaatatggtcatgacactttcaaaaagcctgtgctatggagtcatgatcagaaaccagagtgtggagagggtcagcagcctgcctcagagcagccagctaggcggggagtggtaaatttgggacttgtacccaggcatgactggctccgagcccagtgctccactctatggaatgttccctgggcctcagttgcnttcctttcctttgcaggccgcgggctgctgccactctggcagctggtgagttagctggagggcaacattccaaagcaggggcagcatgctgctttcctcctgtgcccactcctgcggggaagtccgttgactcccaccgctgaagggagctggcaacaccaggatgaggtcccaggggacgggagcaggtacccactgtctgtctaccttcccactggaaaagcacggacaggccagcccttgcgggggcaggcagaggacagagttggctttgcgcggtctctgcctgctgagcagttccaattcctctcatgggagaaacaaggaggcagtcgcttgtgcatgttccagaagttttactggggaggaggaagcggacagaggaagctgtgtgtgcatgtgaaggggtgggcagggtgggagggatgcacgcgtatgtgagcatagcatgtgtgagtactacacacatctccatgcagaagcacaactgggcagccctggcttccagctctgggcttcagcacaacagacaccagcctgtggtctctcagaagccagggagaccacatcgggctcaggacgttttacccaaagtccagagtttttatgcctctccctggcattctccataaagaagggaaggtcagatgaccccttagatctgtgtcatctgggaatttccttgggctggtttagacacgatgccctctttttctcaggatagcagataacctgctttgaaagagggcttaattctgtgggtcctaaattttctcctttctctctctctttctgtgtgtgtgtgttgggaaaatggcaagtttccaataccagctttggaggaacgattacgttttccctccaatttcaagtccgaaagaccagagccctcattccaaagccccccacccagatggattttttcgtttcatttgtcatccgtcccatgggagggccccatgtctcctcagaacccatcctggaggcagcaggtcgggtagagtgagtttggcctgctcatgacctccacccctgagattgtgaacaaggatgtctggggcgatgctgagaatgtttttgaagctgctcccagatgacgctgatgatcacaccagattgagtgctgcgatcgccttgagtccaacctctgcataaacgaggttctcataaacaagttcactctaccctaagctaagtctatgtgagcaaacccacttcatcctttgtacctggagacctggttacactaacctgatactgacctgttcatgtagctggaatggtgtgtttcatgcagtgtggaccaagcaatggcatggggtgtgtgtgtgtgtgtgtgtgtgtctgtgtgtgtgtgtttgtgtatgcgttcacacttgtgtgtgtatatgtgcatgtagatgctgcataaatgatttttgatgtcaaagacaaacacattccattgttttaaatattctattatgtaaacaatacgcagagggaccatatctactcttgtcatattatttgtgatggtaaaacatgcatttgcaataaattaagctttctgggaaggcaagcagtattggagccaaacgactgtctcggaacatgtgtgtgttatctcggttcatatcaagtccaaagctaatggagccttccccgccatccagggaggaacaccaggaccccggagtttcttcttagtgctatattttaaagttgcattgacgttttcctccccttccttttgtgcaagttggaagtagcagtgttctaaaagatggtttgacgtttttgctgttgttttatgtttttaaaaatgtatctgctttgtgtttggaaataaaaatctctattttggtctatgaaaaaaaaagtg

SEQ ID NO: 330317 - DNA, 2779 bp, Homo sapiens
  misc_feature (969)..(969): n is a, c, g, or t
tttttgtgcaggaacagcccctcccgtctttgtcctggcggtgagcacccagggctaagcttttgaacactttctttgtgtttggattcagcccaggcaatgcatatttgctttcatttcttcttgagcttgaggagctcctgggtgcaaatcttggaaaatgaggatctctgagcctttccaggccagctctttgttttgtagcagacaattgaggctttgaaaaggaaagtgggtgggggcaccccacaggtggccctcatcacccaattgccagtgcctgcaggctgcttcagcagaggcccagagtcaaagaggacttaaaaccagctgtcgtttctcccttagcttctgtgtatgagagaaacgacttctgtttttcaaagtaagaacaaggaggaatttgtttctaaaagaacattaaaacacaggctcgtggtctaaaagcaaatggttcagcaggatgttcagggccttaaagcacagtcagcaggactcagcatctcccagcacctgctctccggttgtcatggtaacatcatccccaacccaaccaccttgtccagccgagagacagcaatcataaggagggacctcggtttcccccgaggatcctgggcttcctttctgaaacgcttgcttctgagctcagcaaccaggaacaccaggccagcccatccccagcacctctgtggagatgagggacaaagtcctacagtccctcttcctgttctgatgagaaagggagggaagaaaacataccccgagcgcctgcaatatggtcatgacactttcaaaaagcctgtgctatggagtcatgatcagaaaccagagtgtggagagggtcagcagcctgcctcagagcagccagctaggcggggagtggtaaatttgggacttgtacccaggcatgactggctccgagcccagtgctccactctatggaatgttccctgggcctcagttgcnttcctttcctttgcaggccgcgggctgctgccactctggcagctggtgagttagctggagggcaacattccaaagcaggggcagcatgctgctttcctcctgtgcccactcctgcggggaagtccgttgactcccaccgctgaagggagctggcaacaccaggatgaggtcccaggggacgggagcaggtacccactgtctgtctaccttcccactggaaaagcacggacaggccagcccttgcgggggcaggcagaggacagagttggctttgcgcggtctctgcctgctgagcagttccaattcctctcatgggagaaacaaggaggcagtcgcttgtgcatgttccagaagttttactggggaggaggaagcggacagaggaagctgtgtgtgcatgtgaaggggtgggcagggtgggagggatgcacgcgtatgtgagcatagcatgtgtgagtactacacacatctccatgcagaagcacaactgggcagccctggcttccagctctgggcttcagcacaacagacaccagcctgtggtctctcagaagccagggagaccacatcgggctcaggacgttttacccaaagtccagagtttttatgcctctccctggcattctccataaagaagggaaggtcagatgaccccttagatctgtgtcatctgggaatttccttgggctggtttagacacgatgccctctttttctcaggatagcagataacctgctttgaaagagggcttaattctgtgggtcctaaattttctcctttctctctctctttctgtgtgtgtgtgttgggaaaatggcaagtttccaataccagctttggaggaacgattacgttttccctccaatttcaagtccgaaagaccagagccctcattccaaagccccccacccagatggattttttcgtttcatttgtcatccgtcccatgggagggccccatgtctcctcagaacccatcctggaggcagcaggtcgggtagagtgagtttggcctgctcatgacctccacccctgagattgtgaacaaggatgtctggggcgatgctgagaatgtttttgaagctgctcccagatgacgctgatgatcacaccagattgagtgctgcgatcgccttgagtccaacctctgcataaacgaggttctcataaacaagttcactctaccctaagctaagtctatgtgagcaaacccacttcatcctttgtacctggagacctggttacactaacctgatactgacctgttcatgtagctggaatggtgtgtttcatgcagtgtggaccaagcaatggcatggggtgtgtgtgtgtgtgtgtgtgtgtctgtgtgtgtgtgtttgtgtatgcgttcacacttgtgtgtgtatatgtgcatgtagatgctgcataaatgatttttgatgtcaaagacaaacacattccattgttttaaatattctattatgtaaacaatacgcagagggaccatatctactcttgtcatattatttgtgatggtccaaacgactgtctcggaacatgtgtgtgttatctcggttcatatcaagtccaaagctaatggagccttccccgccatccagggaggaacaccaggaccccggagtttcttcttagtgctatattttaaagttgcattgacgttttcctccccttccttttgtgcaagttggaagtagcagtgttctaaaagatggtttgacgtttttgctgttgttttatgtttttaaaaatgtatctgctttgtgtttggaaataaaaatctctattttggtctatgaaaaaaaaagtg

SEQ ID NO: 330318 - DNA, 357 bp, Homo sapiens
caacatagggagacctcatctttaaaaaataaaaataaaaatacattagctaagcacagtaatgcacacctatagtcccagctactcaggaggttgagatggaaggactgtttgagcccagaaggtcaaggctgcagtaagccatagcacttcagcctgggcaacagactgagaccccatcccaaaaaaagaaagaaagcatttaggaaaaaaacaccctaactcaactttgagagaaacttctcccatggaactgagcattagagaataaacagcacgctcagtaccctcagtgacaccttttagttttaaaattgtagtaacagtcttcaaacattccctctctgctcaacttcc

SEQ ID NO: 330319 - DNA, 349 bp, Homo sapiens
ccaaggaaactgaagcttgaaagttaaccacagatgatggcagagcaaggacacagtctcaaactgtctgacttcagagcccaacttgggacttgctccatgaaccaaaaacccatccttgacttcaggatgctgactctggactgccaggaggcagcagagtgcatttttggctgcaaatgcgaaagagcctagaacgctcggctgtgcacaaacacagttcaggtcttcatttaccactttctggccatgggatgtcaggccagttacttaatctctcagagcctcgttttcttacataggaataatacagtgtagtgccaacctcaatgggctattatgaggatta

SEQ ID NO: 330320 - DNA, 985 bp, Homo sapiens
gggccttgttattcttgcttacagcaagtggaatattgcttaagccaaaacatattattgctaaataggtattgaataaacaaaggagtgtgtatgaggggcaggtaaatctggggttgtggcccctaacaaatttagccaggcatttttaggccaggcacggtggctcacgcctgtaatcccagcactttgggaggccgaggtgggcggatcacctgaggtcagcctggctaacatggcaacaccccgtctctactaaaaatatacaaattagccgggcgtggtggcgaacgcctataatcccagctactcgggaggttaagggaagagaatcgcttgaacccgggaggcagaggttgcagtgagccgagatggcgtcactgcactccaacctgggcaacagagtgagacttcgtctcaaaacaaacaaacaaacaaacaaacaaaaaacatacttagccagattttctcgctttttgttttgcaaattaggagtccatctggtggtcacagggggaaaggcattccaggaaaggatataaggatacagaaagcaatggaagaaacagcatgatcttttcttaggggttcttagtctcctgtccccaaacttcttagagttattcctgttggaccgggcgcggtggctcatgcctgtaatcccagcactttgggaggccgaggcaggcggatcacaaggtcaagagatagagaccatcctggccaacacggtgaaacccggtctctactaaaaatacaaaaattagcggggcggcgtcttggcgcgcgcctgtagtcccagctactcgggaggctgaggcaggagaatcgcttgaacccaggaggtggaggtagcagtgagccgagatcgcgccactgcgatgccgccactgggcgacagagtgagacttcgactcaaaaaataaaaataaaaaagaattatttctgtttgtatatgtcttcttctaaggtagggaggagtgtc

SEQ ID NO: 330321 - DNA, 390 bp, Homo sapiens
aaacagaaacggagtcatcagattgctcacagtggccaaatcttgccctaaagtcaaagctctgaagcactgcactaaagagctcttggaacacccgtggattcccaaggaaaggaatggataaagttaagccatgatgaccttgttgaatccagccattctgcaagtgcctgttttgactttagggatggaagtccttccaggcatgccaagagggaaggaaacatggcaggtgcactggctttgaagttgccgtggtggttgcaatcctgcatctgtctgttcctgatggggtgacctcaggtagaggaaaatgtgatttggagacatagacacacatggagtgtgacgatggaggcagcgagtggagcgatgcagctgccagctgag

SEQ ID NO: 330322 - DNA, 1514 bp, Homo sapiens
  misc_feature (1073)..(1073): n is a, c, g, or t
  misc_feature (1120)..(1120): n is a, c, g, or t
  misc_feature (1261)..(1261): n is a, c, g, or t
  misc_feature (1266)..(1266): n is a, c, g, or t
  misc_feature (1368)..(1368): n is a, c, g, or t
  misc_feature (1460)..(1460): n is a, c, g, or t
  misc_feature (1470)..(1470): n is a, c, g, or t
aggaggtggggcctggtgggcggggcctcagcgtaggccttaggtctcaggggagcagcacgcctgagcaccccaggacctgcgctcagggctcccacaaacggtttatcggtttatcgctgggggacagcctgcaggcttcaggaggggacacaagcatggagcggctttggggtctattccagagagcgcaacaactgtccccaagatcctctcagaccgtctaccagcgtgtggaaggcccccggaaagggcacctggaggaggaagaggaagacggggaggagggggcggagacattggcccacttctgccccatggagctgaggggccctgagcccctgggctctagacccaggcagccaaacctcattccctgggcggcagcaggacggagggctgccccctacctggtcctgacggccctgctgatcttcactggggccttcctactgggctacgtcgccttccgagggtcctgccaggcgtgcggagactctgtgttggtggtcagtgaggatgtcaactatgagcctgacctggatttccaccagggcagactctactggagcgacctccaggccatgttcctgcagttcctgggggaggggcgcctggaggacaccatcaggtagggatggccctgccccatcctgttctcgagtgtccctcccctcatccgctcagactgggcctccctgcctcctggcccaggcctctggtgtctgggtccccctcctgagtcctcccatctgccttcctggcccccctgttcagcggtcctgggaaggatggcaggcattcggagctgaggttccaggggactgaggctctgagggtggcatatttgggaggtgagggagctgactgtctgagatcagaggggtgcagcatccagtatcagactggacagacccagaaaagccttgaatgcctcacccaggcgcctagatttggagcagggagcgctgaggggttctgagaagccgcattctagggaatcagaaaaccaagcaagcaagcctgggcaatacgatgaaaccccgtctctaccaaagaaaacacaaaaattngctggggatgatggcgagtgcctgtagtcccagttacttgggagctngacgggggaggattgcctgagccggggaggcggaggttgcagtgagccgagattatgccactgcactccagcctgggagacagagcgagaccctgtttcaaaaacaaaataacggcagggtgcggtggctcaggcctgtantcccngcactttgggaggcggaggcgggcagatcactaggtcaggatatcgagaccatcttggctaacacggtgaaaccccgtctgtactaaaaacacaaaatattngccgggcatggtggcgggcgcctctagtcccagctattcgggaggctgaggcaggagaatggcttgaacccaggaggtggagcatgcattgngccgagatcncgccactgcacttcagcctgggcaacagagcgagactccatctc

SEQ ID NO: 330323 - DNA, 3288 bp, Homo sapiens
  misc_feature (1508)..(1508): n is a, c, g, or t
  misc_feature (1542)..(1542): n is a, c, g, or t
aggaggtggggcctggtgggcggggcctcagcgtaggccttaggtctcaggggagcagcacgcctgagcaccccaggacctgcgctcagggaggaggcaggcgtggggctgtggagagattggcaggggagagcacagccccttgtgctctggcctggacccgggggccacgtctggaaggctggactgaggccaggactgtgcccccacccttgggggtggtgaggagcagccttggttcaggctgcctgccaggactgataaggggccctcctagggctcccacaaacggtttatcggtttatcgctgggggacagcctgcaggcttcaggaggggacacaagcatggagcggctttggggtctattccagagagcgcaacaactgtccccaagatcctctcagaccgtctaccagcgtgtggaaggcccccggaaagggcacctggaggaggaagaggaagacggggaggagggggcggagacattggcccacttctgccccatggagctgaggggccctgagcccctgggctctagacccaggcagccaaacctcattccctgggcggcagcaggacggagggctgccccctacctggtcctgacggccctgctgatcttcactggggccttcctactgggctacgtcgccttccgagggtcctgccaggcgtgcggagactctgtgttggtggtcagtgaggatgtcaactatgagcctgacctggatttccaccagggcagactctactggagcgacctccaggccatgttcctgcagttcctgggggaggggcgcctggaggacaccatcaggcaaaccagccttcgggaacgggtggcaggctcggccgggatggccgctctgactcaggacattcgcgcggcgctctcccgccagaagctggaccacgtgtggaccgacacgcactacgtggggctgcaattcccggatccggctcaccccaacaccctgcactgggtcgatgaggccgggaaggtcggagagcagctgccgctggaggaccctgacgtctactgcccctacagcgccatcggcaacgtcacgggagagctggtgtacgcccactacgggcggcccgaagacctgcaggacctgcgggccaggggcgtggatccagtgggccgcctgctgctggtgcgcgtgggggtgatcagcttcgcccagaaggtgaccaatgctcaggacttcggggctcaaggagtgctcatatacccagagccagcggacttctcccaggacccacccaagccaagcctgtccagccagcaggcagtgtatggacatgtgcacctgggaactggagacccctacacacctggcttcccttccttcaatcaaacccagttccctccagttgcatcatcaggccttcccagcatcccacgcccagcccatcagtgcagacattgcctcccgcctgctgaggctggagtgcagtggtgcaatcttggctcactgcaacctccacctcccgggttcnagtgattcttctgcctcagactccagagtatctnggattacaggaagctcaaaggccctgtggccccccaagaatggcaggggagcctcctaggctccccttatcacctgggccccgggccacgactgcggctagtggtcaacaatcacaggacctccacccccatcaacaacatcttcggctgcatcgaaggccgctcagagccagatcactacgttgtcatcggggcccagagggatgcatggggcccaggagcagctaaatccgctgtggggacggctatactcctggagctggtgcggaccttttcctccatggtgagcaacggcttccggccccgcagaagtctcctcttcatcagctgggacggtggtgactttggaagcgtgggctccacggagtggctagagggctacctcagcgtgctgcacctcaaagccgtagtgtacgtgagcctggacaacgcagtgctgggggatgacaagtttcatgccaagaccagcccccttctgacaagtctcattgagagtgtcctgaagcaggtggattctcccaaccacagtgggcagactctctatgaacaggtggtgttcaccaatcccagctgggatgctgaggtgatccggcccctacccatggacagcagtgcctattccttcacggcctttgtgggagtccctgccgtcgagttctcctttatggaggacgaccaggcctacccattcctgcacacaaaggaggacacttatgagaacctgcataaggtgctgcaaggccgcctgcccgccgtggcccaggccgtggcccagctcgcagggcagctcctcatccggctcagccacgatcgcctgctgcccctcgacttcggccgctacggggacgtcgtcctcaggcacatcgggaacctcaacgagttctctggggacctcaaggcccgcgggctgaccctgcagtgggtgtactcggcgcggggggactacatccgggcggcggaaaagctgcggcaggagatctacagctcggaggagagagacgagcgactgacacgcatgtacaacgtgcgcataatgcgggtggagttctacttcctttcccagtacgtgtcgccagccgactccccgttccgccacatcttcatgggccgtggagaccacacgctgggcgccctgctggaccacctgcggctgctgcgctccaacagctccgggacccccggggccacctcctccactggcttccaggagagccgtttccggcgtcagctagccctgctcacctggacgctgcaaggggcagccaatgcgcttagcggggatgtctggaacattgataacaacttctgaggccctggggatcctcacatccccgtcccccagtcaagagctcctctgctcctcgcttgaatgattcagggtcagggaggtggctcagagtccacctctcattgctgatcaatttctcattacccctacacatctctccacggagcccagaccccagcacagatatccacacaccccagccctgcagtgtagctgaccctaatgtgacggtcatactgtcggttaatcagagagtagcatcccttcaatcacagccccttcccctttctggggtcctccatacctagagaccactctgggaggtttgctaggccctgggacctggccagctctgttagtgggagagatcgctggcaccatagccttatggccaacaggtggtctgtggtgaaaggggcgtggagtttcaatatcaataaaccacctgatatcaataa

SEQ ID NO: 330324 - DNA, 3126 bp, Homo sapiens
aggaggtggggcctggtgggcggggcctcagcgtaggccttaggtctcaggggagcagcacgcctgagcaccccaggacctgcgctcagggaggaggcaggcgtggggctgtggagagattggcaggggagagcacagccccttgtgctctggcctggacccgggggccacgtctggaaggctggactgaggccaggactgtgcccccacccttgggggtggtgaggagcagccttggttcaggctgcctgccaggactgataaggggccctcctagggctcccacaaacggtttatcggtttatcgctgggggacagcctgcaggcttcaggaggggacacaagcatggagcggctttggggtctattccagagagcgcaacaactgtccccaagatcctctcagaccgtctaccagcgtgtggaaggcccccggaaagggcacctggaggaggaagaggaagacggggaggagggggcggagacattggcccacttctgccccatggagctgaggggccctgagcccctgggctctagacccaggcagccaaacctcattccctgggcggcagcaggacggagggctgccccctacctggtcctgacggccctgctgatcttcactggggccttcctactgggctacgtcgccttccgagggtcctgccaggcgtgcggagactctgtgttggtggtcagtgaggatgtcaactatgagcctgacctggatttccaccagggcagactctactggagcgacctccaggccatgttcctgcagttcctgggggaggggcgcctggaggacaccatcaggcaaaccagccttcgggaacgggtggcaggctcggccgggatggccgctctgactcaggacattcgcgcggcgctctcccgccagaagctggaccacgtgtggaccgacacgcactacgtggggctgcaattcccggatccggctcaccccaacaccctgcactgggtcgatgaggccgggaaggtcggagagcagctgccgctggaggaccctgacgtctactgcccctacagcgccatcggcaacgtcacgggagagctggtgtacgcccactacgggcggcccgaagacctgcaggacctgcgggccaggggcgtggatccagtgggccgcctgctgctggtgcgcgtgggggtgatcagcttcgcccagaaggtgaccaatgctcaggacttcggggctcaaggagtgctcatatacccagagccagcggacttctcccaggacccacccaagccaagcctgtccagccagcaggcagtgtatggacatgtgcacctgggaactggagacccctacacacctggcttcccttccttcaatcaaacccagaagctcaaaggccctgtggccccccaagaatggcaggggagcctcctaggctccccttatcacctgggccccgggccacgactgcggctagtggtcaacaatcacaggacctccacccccatcaacaacatcttcggctgcatcgaaggccgctcagagccagatcactacgttgtcatcggggcccagagggatgcatggggcccaggagcagctaaatccgctgtggggacggctatactcctggagctggtgcggaccttttcctccatggtgagcaacggcttccggccccgcagaagtctcctcttcatcagctgggacggtggtgactttggaagcgtgggctccacggagtggctagagggctacctcagcgtgctgcacctcaaagccgtagtgtacgtgagcctggacaacgcagtgctgggggatgacaagtttcatgccaagaccagcccccttctgacaagtctcattgagagtgtcctgaagcaggtggattctcccaaccacagtgggcagactctctatgaacaggtggtgttcaccaatcccagctgggatgctgaggtgatccggcccctacccatggacagcagtgcctattccttcacggcctttgtgggagtccctgccgtcgagttctcctttatggaggacgaccaggcctacccattcctgcacacaaaggaggacacttatgagaacctgcataaggtgctgcaaggccgcctgcccgccgtggcccaggccgtggcccagctcgcagggcagctcctcatccggctcagccacgatcgcctgctgcccctcgacttcggccgctacggggacgtcgtcctcaggcacatcgggaacctcaacgagttctctggggacctcaaggcccgcgggctgaccctgcagtgggtgtactcggcgcggggggactacatccgggcggcggaaaagctgcggcaggagatctacagctcggaggagagagacgagcgactgacacgcatgtacaacgtgcgcataatgcggatccccctctctgcgcaggtggagttctacttcctttcccagtacgtgtcgccagccgactccccgttccgccacatcttcatgggccgtggagaccacacgctgggcgccctgctggaccacctgcggctgctgcgctccaacagctccgggacccccggggccacctcctccactggcttccaggagagccgtttccggcgtcagctagccctgctcacctggacgctgcaaggggcagccaatgcgcttagcggggatgtctggaacattgataacaacttctgaggccctggggatcctcacatccccgtcccccagtcaagagctcctctgctcctcgcttgaatgattcagggtcagggaggtggctcagagtccacctctcattgctgatcaatttctcattacccctacacatctctccacggagcccagaccccagcacagatatccacacaccccagccctgcagtgtagctgaccctaatgtgacggtcatactgtcggttaatcagagagtagcatcccttcaatcacagccccttcccctttctggggtcctccatacctagagaccactctgggaggtttgctaggccctgggacctggccagctctgttagtgggagagatcgctggcaccatagccttatggccaacaggtggtctgtggtgaaaggggcgtggagtttcaatatcaataaaccacctgatatcaataa

SEQ ID NO: 330325 - DNA, 2984 bp, Homo sapiens
aggaggtggggcctggtgggcggggcctcagcgtaggccttaggtctcaggggagcagcacgcctgagcaccccaggacctgcgctcagggaggaggcaggcgtggggctgtggagagattggcaggggagagcacagccccttgtgctctggcctggacccgggggccacgtctggaaggctggactgaggccaggactgtgcccccacccttgggggtggtgaggagcagccttggttcaggctgcctgccaggactgataaggggccctcctagggctcccacaaacggtttatcggtttatcgctgggggacagcctgcaggcttcaggaggggacacaagcatggagcggctttggggtctattccagagagcgcaacaactgtccccaagatcctctcagaccgtctaccagcgtgtggaaggcccccggaaagggcacctggaggaggaagaggaagacggggaggagggggcggagacattggcccacttctgccccatggagctgaggggccctgagcccctgggctctagacccaggcagccaaacctcattccctgggcggcagcaggacggagggctgccccctacctggtcctgacggccctgctgatcttcactggggccttcctactgggctacgtcgccttccgagggtcctgccaggcgtgcggagactctgtgttggtggtcagtgaggatgtcaactatgagcctgacctggatttccaccagggcagactctactggagcgacctccaggccatgttcctgcagttcctgggggaggggcgcctggaggacaccatcaggcaaaccagccttcgggaacgggtggcaggctcggccgggatggccgctctgactcaggacattcgcgcggcgctctcccgccagaagctggaccacgtgtggaccgacacgcactacgtggggctgcaattcccggatccggctcaccccaacaccctgcactgggtcgatgaggccgggaaggtcggagagcagctgccgctggaggaccctgacgtctactgcccctacagcgccatcggcaacgtcacgggagagctggtgtacgcccactacgggcggcccgaagacctgcaggacctgcgggccaggggcgtggatccagtgggccgcctgctgctggtgcgcgtgggggtgatcagcttcgcccagaaggaagctcaaaggccctgtggccccccaagaatggcaggggagcctcctaggctccccttatcacctgggccccgggccacgactgcggctagtggtcaacaatcacaggacctccacccccatcaacaacatcttcggctgcatcgaaggccgctcagagccaggcttccggccccgcagaagtctcctcttcatcagctgggacggtggtgactttggaagcgtgggctccacggagtggctagaggtgatacggggtcccgggcaggtcgttaggcattggggagaggtgggggtggggggttcccactccacactggtcacccacccacagggctacctcagcgtgctgcacctcaaagccgtagtgtacgtgagcctggacaacgcagtgctgggggatgacaagtttcatgccaagaccagcccccttctgacaagtctcattgagagtgtcctgaagcaggtggattctcccaaccacagtgggcagactctctatgaacaggtggtgttcaccaatcccagctgggatgctgaggtgatccggcccctacccatggacagcagtgcctattccttcacggcctttgtgggagtccctgccgtcgagttctcctttatggaggtgagacgtcctccccctgccccagacacagcgctagtccttcagcctgtctgcctccgccccagcgtccaccctgtcctggcaggacgaccaggcctacccattcctgcacacaaaggaggacacttatgagaacctgcataaggtgctgcaaggccgcctgcccgccgtggcccaggccgtggcccagctcgcagggcagctcctcatccggctcagccacgatcgcctgctgcccctcgacttcggccgctacggggacgtcgtcctcaggcacatcgggaacctcaacgagttctctggggacctcaaggcccgcgggctgaccctgcagtgggtgtactcggcgcggggggactacatccgggcggcggaaaagctgcggcaggagatctacagctcggaggagagagacgagcgactgacacgcatgtacaacgtgcgcataatgcgggtggagttctacttcctttcccagtacgtgtcgccagccgactccccgttccgccacatcttcatgggccgtggagaccacacgctgggcgccctgctggaccacctgcggctgctgcgctccaacagctccgggacccccggggccacctcctccactggcttccaggagagccgtttccggcgtcagctagccctgctcacctggacgctgcaaggggcagccaatgcgcttagcggggatgtctggaacattgataacaacttctgaggccctggggatcctcacatccccgtcccccagtcaagagctcctctgctcctcgcttgaatgattcagggtcagggaggtggctcagagtccacctctcattgctgatcaatttctcattacccctacacatctctccacggagcccagaccccagcacagatatccacacaccccagccctgcagtgtagctgaccctaatgtgacggtcatactgtcggttaatcagagagtagcatcccttcaatcacagccccttcccctttctggggtcctccatacctagagaccactctgggaggtttgctaggccctgggacctggccagctctgttagtgggagagatcgctggcaccatagccttatggccaacaggtggtctgtggtgaaaggggcgtggagtttcaatatcaataaaccacctgatatcaataa

SEQ ID NO: 330326 - DNA, 3017 bp, Homo sapiens
aggaggtggggcctggtgggcggggcctcagcgtaggccttaggtctcaggggagcagcacgcctgagcaccccaggacctgcgctcagggaggaggcaggcgtggggctgtggagagattggcaggggagagcacagccccttgtgctctggcctggacccgggggccacgtctggaaggctggactgaggccaggactgtgcccccacccttgggggtggtgaggagcagccttggttcaggctgcctgccaggactgataaggggccctcctagggctcccacaaacggtttatcggtttatcgctgggggacagcctgcaggcttcaggaggggacacaagcatggagcggctttggggtctattccagagagcgcaacaactgtccccaagatcctctcagaccgtctaccagcgtgtggaaggcccccggaaagggcacctggaggaggaagaggaagacggggaggagggggcggagacattggcccacttctgccccatggagctgaggggccctgagcccctgggctctagacccaggcagccaaacctcattccctgggcggcagcaggacggagggctgccccctacctggtcctgacggccctgctgatcttcactggggccttcctactgggctacgtcgccttccgagggtcctgccaggcgtgcggagactctgtgttggtggtcagtgaggatgtcaactatgagcctgacctggatttccaccagggcagactctactggagcgacctccaggccatgttcctgcagttcctgggggaggggcgcctggaggacaccatcaggcaaaccagccttcgggaacgggtggcaggctcggccgggatggccgctctgactcaggacattcgcgcggcgctctcccgccagaagctggaccacgtgtggaccgacacgcactacgtggggctgcaattcccggatccggctcaccccaacaccctgcactgggtcgatgaggccgggaaggtcggagagcagctgccgctggaggaccctgacgtctactgcccctacagcgccatcggcaacgtcacgggagagctggtgtacgcccactacgggcggcccgaagacctgcaggacctgcgggccaggggcgtggatccagtgggccgcctgctgctggtgcgcgtgggggtgatcagcttcgcccagaaggaagctcaaaggccctgtggccccccaagaatggcaggggagcctcctaggctccccttatcacctgggccccgggccacgactgcggctagtggtcaacaatcacaggacctccacccccatcaacaacatcttcggctgcatcgaaggccgctcagagccagatcactacgttgtcatcggggcccagagggatgcatggggcccaggagcagctaaatccgctgtggggacggctatactcctggagctggtgcggaccttttcctccatggtgagcaacggcttccggccccgcagaagtctcctcttcatcagctgggacggtggtgactttggaagcgtgggctccacggagtggctagagggctacctcagcgtgctgcacctcaaagccgtagtgtacgtgagcctggacaacgcagtgctgggggatgacaagtttcatgccaagaccagcccccttctgacaagtctcattgagagtgtcctgaagcaggtggattctcccaaccacagtgggcagactctctatgaacaggtggtgttcaccaatcccagctgggatgctgaggtgatccggcccctacccatggacagcagtgcctattccttcacggcctttgtgggagtccctgccgtcgagttctcctttatggaggtgagacgtcctccccctgccccagacacagcgctagtccttcagcctgtctgcctccgccccagcgtccaccctgtcctggcaggacgaccaggcctacccattcctgcacacaaaggaggacacttatgagaacctgcataaggtgctgcaaggccgcctgcccgccgtggcccaggccgtggcccagctcgcagggcagctcctcatccggctcagccacgatcgcctgctgcccctcgacttcggccgctacggggacgtcgtcctcaggcacatcgggaacctcaacgagttctctggggacctcaaggcccgcgggctgaccctgcagtgggtgtactcggcgcggggggactacatccgggcggcggaaaagctgcggcaggagatctacagctcggaggagagagacgagcgactgacacgcatgtacaacgtgcgcataatgcgggtggagttctacttcctttcccagtacgtgtcgccagccgactccccgttccgccacatcttcatgggccgtggagaccacacgctgggcgccctgctggaccacctgcggctgctgcgctccaacagctccgggacccccggggccacctcctccactggcttccaggagagccgtttccggcgtcagctagccctgctcacctggacgctgcaaggggcagccaatgcgcttagcggggatgtctggaacattgataacaacttctgaggccctggggatcctcacatccccgtcccccagtcaagagctcctctgctcctcgcttgaatgattcagggtcagggaggtggctcagagtccacctctcattgctgatcaatttctcattacccctacacatctctccacggagcccagaccccagcacagatatccacacaccccagccctgcagtgtagctgaccctaatgtgacggtcatactgtcggttaatcagagagtagcatcccttcaatcacagccccttcccctttctggggtcctccatacctagagaccactctgggaggtttgctaggccctgggacctggccagctctgttagtgggagagatcgctggcaccatagccttatggccaacaggtggtctgtggtgaaaggggcgtggagtttcaatatcaataaaccacctgatatcaataa

SEQ ID NO: 330327 - DNA, 2537 bp, Homo sapiens
  misc_feature (585)..(585): n is a, c, g, or t
  misc_feature (619)..(619): n is a, c, g, or t
gaaaaaagaaaatgttggctgggaacaaattgggtgttgggggaaatcagatggggaagggaacagaaacatggggtaccctggagcccggtggggtttgagggctgcctaggagctgctgaggttgggaagacacaggccaggtagtgcccccacatcctctccgtgggatggacagttgcaagcaaaggccttgccatttcctggtttctcctgcccttatgaatcgggtttttttctgggaggagtcctctagtcaccttcctccccaggtgaccaatgctcaggacttcggggctcaaggagtgctcatatacccagagccagcggacttctcccaggacccacccaagccaagcctgtccagccagcaggcagtgtatggacatgtgcacctgggaactggagacccctacacacctggcttcccttccttcaatcaaacccagttccctccagttgcatcatcaggccttcccagcatcccacgcccagcccatcagtgcagacattgcctcccgcctgctgaggctggagtgcagtggtgcaatcttggctcactgcaacctccacctcccgggttcnagtgattcttctgcctcagactccagagtatctnggattacaggaagctcaaaggccctgtggccccccaagaatggcaggggagcctcctaggctccccttatcacctgggccccgggccacgactgcggctagtggtcaacaatcacaggacctccacccccatcaacaacatcttcggctgcatcgaaggccgctcagagccagatcactacgttgtcatcggggcccagagggatgcatggggcccaggagcagctaaatccgctgtggggacggctatactcctggagctggtgcggaccttttcctccatggtgagcaacggcttccggccccgcagaagtctcctcttcatcagctgggacggtggtgactttggaagcgtgggctccacggagtggctagaggtgatacggggtcccgggcaggtcgttaggcattggggagaggtgggggtggggggttcccactccacactggtcacccacccacagggctacctcagcgtgctgcacctcaaagccgtagtgtacgtgagcctggacaacgcagtgctgggggatgacaagtttcatgccaagaccagcccccttctgacaagtctcattgagagtgtcctgaagcaggtggattctcccaaccacagtgggcagactctctatgaacaggtggtgttcaccaatcccagctgggatgctgaggtgatccggcccctacccatggacagcagtgcctattccttcacggcctttgtgggagtccctgccgtcgagttctcctttatggaggtgagacgtcctccccctgccccagacacagcgctagtccttcagcctgtctgcctccgccccagcgtccaccctgtcctggcaggacgaccaggcctacccattcctgcacacaaaggaggacacttatgagaacctgcataaggtgctgcaaggccgcctgcccgccgtggcccaggccgtggcccagctcgcagggcagctcctcatccggctcagccacgatcgcctgctgcccctcgacttcggccgctacggggacgtcgtcctcaggcacatcgggaacctcaacgagttctctggggacctcaaggcccgcgggctgaccctgcagtgggtgtactcggcgcggggggactacatccgggcggcggaaaagctgcggcaggagatctacagctcggaggagagagacgagcgactgacacgcatgtacaacgtgcgcataatgcgggtggagttctacttcctttcccagtacgtgtcgccagccgactccccgttccgccacatcttcatgggccgtggagaccacacgctgggcgccctgctggaccacctgcggctgctgcgctccaacagctccgggacccccggggccacctcctccactggcttccaggagagccgtttccggcgtcagctagccctgctcacctggacgctgcaaggggcagccaatgcgcttagcggggatgtctggaacattgataacaacttctgaggccctggggatcctcacatccccgtcccccagtcaagagctcctctgctcctcgcttgaatgattcagggtcagggaggtggctcagagtccacctctcattgctgatcaatttctcattacccctacacatctctccacggagcccagaccccagcacagatatccacacaccccagccctgcagtgtagctgaccctaatgtgacggtcatactgtcggttaatcagagagtagcatcccttcaatcacagccccttcccctttctggggtcctccatacctagagaccactctgggaggtttgctaggccctgggacctggccagctctgttagtgggagagatcgctggcaccatagccttatggccaacaggtggtctgtggtgaaaggggcgtggagtttcaatatcaataaaccacctgatatcaataa

SEQ ID NO: 330328 - DNA, 1920 bp, Homo sapiens
cgcgcgcgggcggggggcgcgcggggagggggacgcggctcggggcgctcaccagccccgctccccagggctcaccccaacaccctgcactgggtcgatgaggccgggaaggtcggagagcagctgccgctggaggaccctgacgtctactgcccctacagcgccatcggcaacgtcacgggagagctggtgtacgcccactacgggcggcccgaagacctgcaggacctgcgggccaggggcgtggatccagtgggccgcctgctgctggtgcgcgtgggggtgatcagcttcgcccagaaggaagctcaaaggccctgtggccccccaagaatggcaggggagcctcctaggctccccttatcacctgggccccgggccacgactgcggctagtggtcaacaatcacaggacctccacccccatcaacaacatcttcggctgcatcgaaggccgctcagagccaggcttccggccccgcagaagtctcctcttcatcagctgggacggtggtgactttggaagcgtgggctccacggagtggctagagggctacctcagcgtgctgcacctcaaagccgtagtgtacgtgagcctggacaacgcagtgctgggggatgacaagtttcatgccaagaccagcccccttctgacaagtctcattgagagtgtcctgaagcaggtggattctcccaaccacagtgggcagactctctatgaacaggtggtgttcaccaatcccagctgggatgctgaggtgatccggcccctacccatggacagcagtgcctattccttcacggcctttgtgggagtccctgccgtcgagttctcctttatggaggacgaccaggcctacccattcctgcacacaaaggaggacacttatgagaacctgcataaggtgctgcaaggccgcctgcccgccgtggcccaggccgtggcccagctcgcagggcagctcctcatccggctcagccacgatcgcctgctgcccctcgacttcggccgctacggggacgtcgtcctcaggcacatcgggaacctcaacgagttctctggggacctcaaggcccgcgggctgaccctgcagtgggtgtactcggcgcggggggactacatccgggcggcggaaaagctgcggcaggagatctacagctcggaggagagagacgagcgactgacacgcatgtacaacgtgcgcataatgcgggtggagttctacttcctttcccagtacgtgtcgccagccgactccccgttccgccacatcttcatgggccgtggagaccacacgctgggcgccctgctggaccacctgcggctgctgcgctccaacagctccgggacccccggggccacctcctccactggcttccaggagagccgtttccggcgtcagctagccctgctcacctggacgctgcaaggggcagccaatgcgcttagcggggatgtctggaacattgataacaacttctgaggccctggggatcctcacatccccgtcccccagtcaagagctcctctgctcctcgcttgaatgattcagggtcagggaggtggctcagagtccacctctcattgctgatcaatttctcattacccctacacatctctccacggagcccagaccccagcacagatatccacacaccccagccctgcagtgtagctgaccctaatgtgacggtcatactgtcggttaatcagagagtagcatcccttcaatcacagccccttcccctttctggggtcctccatacctagagaccactctgggaggtttgctaggccctgggacctggccagctctgttagtgggagagatcgctggcaccatagccttatggccaacaggtggtctgtggtgaaaggggcgtggagtttcaatatcaataaaccacctgatatcaataa

SEQ ID NO: 330329 - DNA, 1443 bp, Homo sapiens
aggaggtggggcctggtgggcggggcctcagcgtaggccttaggtctcaggggagcagcacgcctgagcaccccaggacctgcgctcagggaggaggcaggcgtggggctgtggagagattggcaggggagagcacagccccttgtgctctggcctggacccgggggccacgtctggaaggctggactgaggccaggactgtgcccccacccttgggggtggtgaggagcagccttggttcaggctgcctgccaggactgataaggggccctcctagggctcccacaaacggtttatcggtttatcgctgggggacagcctgcaggcttcaggaggggacacaagcatggagcggctttggggtctattccagagagcgcaacaactgtccccaagatcctctcagaccgtctaccagcgtgtggaaggcccccggaaagggcacctggaggaggaagaggaagacggggaggagggggcggagacattggcccacttctgccccatggagctgaggggccctgagcccctgggctctagacccaggcagccaaacctcattccctgggcggcagcaggacggagggctgccccctacctggtcctgacggccctgctgatcttcactggggccttcctactgggctacgtcgccttccgagggtcctgccaggcgtgcggagactctgtgttggtggtcagtgaggatgtcaactatgagcctgacctggatttccaccagggcagactctactggagcgacctccaggccatgttcctgcagttcctgggggaggggcgcctggaggacaccatcaggcaaaccagccttcgggaacgggtggcaggctcggccgggatggccgctctgactcaggacattcgcgcggcgctctcccgccagaagctggaccacgtgtggaccgacacgcactacgtggggctgcaattcccggatccggctcaccccaacaccctgcactgggtcgatgaggccgggaaggtcggagagcagctgccgctggaggaccctgacgtctactgcccctacagcgccatcggcaacgtcacgggagagctggtgtacgcccactacgggcggcccgaagacctgcaggacctgcgggccaggggcgtggatccagtgggccgcctgctgctggtgcgcgtgggggtgatcagcttcgcccagaaggtgaccaatgctcaggacttcggggctcaaggagtgctcatatacccagagccagcggacttctcccaggacccacccaagccaagcctgtccagccagcaggcagtgtatggacatgtgcacctgggaactggagacccctacacacctggcttcccttccttcaatcaaacccagttccctccagttgcatcatcaggccttcccagcatcccacgcccagccctatggagtctcaaaaaaaaaaa

SEQ ID NO: 330330 - DNA, 1427 bp, Homo sapiens
aggaggtggggcctggtgggcggggcctcagcgtaggccttaggtctcaggggagcagcacgcctgagcaccccaggacctgcgctcagggaggaggcaggcgtggggctgtggagagattggcaggggagagcacagccccttgtgctctggcctggacccgggggccacgtctggaaggctggactgaggccaggactgtgcccccacccttgggggtggtgaggagcagccttggttcaggctgcctgccaggactgataaggggccctcctagggctcccacaaacggtttatcggtttatcgctgggggacagcctgcaggcttcaggaggggacacaagcatggagcggctttggggtctattccagagagcgcaacaactgtccccaagatcctctcagaccgtctaccagcgtgtggaaggcccccggaaagggcacctggaggaggaagaggaagacggggaggagggggcggagacattggcccacttctgccccatggagctgaggggccctgagcccctgggctctagacccaggcagccaaacctcattccctgggcggcagcaggacggagggctgccccctacctggtcctgacggccctgctgatcttcactggggccttcctactgggctacgtcgccttccgagggtcctgccaggcgtgcggagactctgtgttggtggtcagtgaggatgtcaactatgagcctgacctggatttccaccagggcagactctactggagcgacctccaggccatgttcctgcagttcctgggggaggggcgcctggaggacaccatcaggcaaaccagccttcgggaacgggtggcaggctcggccgggatggccgctctgactcaggacattcgcgcggcgctctcccgccagaagctggaccacgtgtggaccgacacgcactacgtggggctgcaattcccggatccggctcaccccaacaccctgcactgggtcgatgaggccgggaaggtcggagagcagctgccgctggaggaccctgacgtctactgcccctacagcgccatcggcaacgtcacgggagagctggtgtacgcccactacgggcggcccgaagacctgcaggacctgcgggccaggggcgtggatccagtgggccgcctgctgctggtgcgcgtgggggtgatcagcttcgcccagaaggtaagtgtccctggacagagggagggcttgagcccgggaaccggagggtcggactgccagtgagaatcgttcagggtgctgtgagagggagacaggaaagaaccatgtggctggatggtaagaaaatataagctgggcacgatggttctcacctgcaatcccagcactttaggaggccaagacaggaggatcgcttgaggccaggaattcaaggcaacacggtgagaacccc

SEQ ID NO: 330331 - DNA, 384 bp, Homo sapiens
gggtctactgtctggcaactaaagttcccactggattgcacacctacctcagctgagaaccatccaaggcagccctgactgcactgccctacccaggcagcgtccagaggcagcgatctggagccagaaagggtgggagggaaagaaataaggaaaagagtgatttggactcttctgggtctctctacaacttccccctttctgccttcctcctctccaggaagctcaaaggccctgtggccccccaagaatggcaggggagcctcctaggctccccttatcacctgggccccgggccacgactgcggctagtggtcaacaatcacaggacctccacccccatcaacaacatcttcggctgcatcgaaggccgctcagagccag

SEQ ID NO: 330332 - DNA, 3190 bp, Homo sapiens
aggaggtggggcctggtgggcggggcctcagcgtaggccttaggtctcaggggagcagcacgcctgagcaccccaggacctgcgctcagggaggaggcaggcgtggggctgtggagagattggcaggggagagcacagccccttgtgctctggcctggacccgggggccacgtctggaaggctggactgaggccaggactgtgcccccacccttgggggtggtgaggagcagccttggttcaggctgcctgccaggactgataaggggccctcctagggctcccacaaacggtttatcggtttatcgctgggggacagcctgcaggcttcaggaggggacacaagcatggagcggctttggggtctattccagagagcgcaacaactgtccccaagatcctctcagaccgtctaccagcgtgtggaaggcccccggaaagggcacctggaggaggaagaggaagacggggaggagggggcggagacattggcccacttctgccccatggagctgaggggccctgagcccctgggctctagacccaggcagccaaacctcattccctgggcggcagcaggacggagggctgccccctacctggtcctgacggccctgctgatcttcactggggccttcctactgggctacgtcgccttccgagggtcctgccaggcgtgcggagactctgtgttggtggtcagtgaggatgtcaactatgagcctgacctggatttccaccagggcagactctactggagcgacctccaggccatgttcctgcagttcctgggggaggggcgcctggaggacaccatcaggcaaaccagccttcgggaacgggtggcaggctcggccgggatggccgctctgactcaggacattcgcgcggcgctctcccgccagaagctggaccacgtgtggaccgacacgcactacgtggggctgcaattcccggatccggctcaccccaacaccctgcactgggtcgatgaggccgggaaggtcggagagcagctgccgctggaggaccctgacgtctactgcccctacagcgccatcggcaacgtcacgggagagctggtgtacgcccactacgggcggcccgaagacctgcaggacctgcgggccaggggcgtggatccagtgggccgcctgctgctggtgcgcgtgggggtgatcagcttcgcccagaaggtgaccaatgctcaggacttcggggctcaaggagtgctcatatacccagagccagcggacttctcccaggacccacccaagccaagcctgtccagccagcaggcagtgtatggacatgtgcacctgggaactggagacccctacacacctggcttcccttccttcaatcaaacccagttccctccagttgcatcatcaggccttcccagcatcccacgcccagcccatcagtgcagacattgcctcccgcctgctgaggaagctcaaaggccctgtggccccccaagaatggcaggggagcctcctaggctccccttatcacctgggccccgggccacgactgcggctagtggtcaacaatcacaggacctccacccccatcaacaacatcttcggctgcatcgaaggccgctcagagccagatcactacgttgtcatcggggcccagagggatgcatggggcccaggagcagctaaatccgctgtggggacggctatactcctggagctggtgcggaccttttcctccatggtgagcaacggcttccggccccgcagaagtctcctcttcatcagctgggacggtggtgactttggaagcgtgggctccacggagtggctagagggctacctcagcgtgctgcacctcaaagccgtagtgtacgtgagcctggacaacgcagtgctgggggatgacaagtttcatgccaagaccagcccccttctgacaagtctcattgagagtgtcctgaagcaggtggattctcccaaccacagtgggcagactctctatgaacaggtggtgttcaccaatcccagctgggatgctgaggtgatccggcccctacccatggacagcagtgcctattccttcacggcctttgtgggagtccctgccgtcgagttctcctttatggaggacgaccaggcctacccattcctgcacacaaaggaggacacttatgagaacctgcataaggtgctgcaaggccgcctgcccgccgtggcccaggccgtggcccagctcgcagggcagctcctcatccggctcagccacgatcgcctgctgcccctcgacttcggccgctacggggacgtcgtcctcaggcacatcgggaacctcaacgagttctctggggacctcaaggcccgcgggctgaccctgcagtgggtgtactcggcgcggggggactacatccgggcggcggaaaagctgcggcaggagatctacagctcggaggagagagacgagcgactgacacgcatgtacaacgtgcgcataatgcgggtggagttctacttcctttcccagtacgtgtcgccagccgactccccgttccgccacatcttcatgggccgtggagaccacacgctgggcgccctgctggaccacctgcggctgctgcgctccaacagctccgggacccccggggccacctcctccactggcttccaggagagccgtttccggcgtcagctagccctgctcacctggacgctgcaaggggcagccaatgcgcttagcggggatgtctggaacattgataacaacttctgaggccctggggatcctcacatccccgtcccccagtcaagagctcctctgctcctcgcttgaatgattcagggtcagggaggtggctcagagtccacctctcattgctgatcaatttctcattacccctacacatctctccacggagcccagaccccagcacagatatccacacaccccagccctgcagtgtagctgaccctaatgtgacggtcatactgtcggttaatcagagagtagcatcccttcaatcacagccccttcccctttctggggtcctccatacctagagaccactctgggaggtttgctaggccctgggacctggccagctctgttagtgggagagatcgctggcaccatagccttatggccaacaggtggtctgtggtgaaaggggcgtggagtttcaatatcaataaaccacctgatatcaataa

SEQ ID NO: 330333 - DNA, 3460 bp, Homo sapiens
  misc_feature (1508)..(1508): n is a, c, g, or t
  misc_feature (1542)..(1542): n is a, c, g, or t
aggaggtggggcctggtgggcggggcctcagcgtaggccttaggtctcaggggagcagcacgcctgagcaccccaggacctgcgctcagggaggaggcaggcgtggggctgtggagagattggcaggggagagcacagccccttgtgctctggcctggacccgggggccacgtctggaaggctggactgaggccaggactgtgcccccacccttgggggtggtgaggagcagccttggttcaggctgcctgccaggactgataaggggccctcctagggctcccacaaacggtttatcggtttatcgctgggggacagcctgcaggcttcaggaggggacacaagcatggagcggctttggggtctattccagagagcgcaacaactgtccccaagatcctctcagaccgtctaccagcgtgtggaaggcccccggaaagggcacctggaggaggaagaggaagacggggaggagggggcggagacattggcccacttctgccccatggagctgaggggccctgagcccctgggctctagacccaggcagccaaacctcattccctgggcggcagcaggacggagggctgccccctacctggtcctgacggccctgctgatcttcactggggccttcctactgggctacgtcgccttccgagggtcctgccaggcgtgcggagactctgtgttggtggtcagtgaggatgtcaactatgagcctgacctggatttccaccagggcagactctactggagcgacctccaggccatgttcctgcagttcctgggggaggggcgcctggaggacaccatcaggcaaaccagccttcgggaacgggtggcaggctcggccgggatggccgctctgactcaggacattcgcgcggcgctctcccgccagaagctggaccacgtgtggaccgacacgcactacgtggggctgcaattcccggatccggctcaccccaacaccctgcactgggtcgatgaggccgggaaggtcggagagcagctgccgctggaggaccctgacgtctactgcccctacagcgccatcggcaacgtcacgggagagctggtgtacgcccactacgggcggcccgaagacctgcaggacctgcgggccaggggcgtggatccagtgggccgcctgctgctggtgcgcgtgggggtgatcagcttcgcccagaaggtgaccaatgctcaggacttcggggctcaaggagtgctcatatacccagagccagcggacttctcccaggacccacccaagccaagcctgtccagccagcaggcagtgtatggacatgtgcacctgggaactggagacccctacacacctggcttcccttccttcaatcaaacccagttccctccagttgcatcatcaggccttcccagcatcccacgcccagcccatcagtgcagacattgcctcccgcctgctgaggctggagtgcagtggtgcaatcttggctcactgcaacctccacctcccgggttcnagtgattcttctgcctcagactccagagtatctnggattacaggaagctcaaaggccctgtggccccccaagaatggcaggggagcctcctaggctccccttatcacctgggccccgggccacgactgcggctagtggtcaacaatcacaggacctccacccccatcaacaacatcttcggctgcatcgaaggccgctcagagccagatcactacgttgtcatcggggcccagagggatgcatggggcccaggagcagctaaatccgctgtggggacggctatactcctggagctggtgcggaccttttcctccatggtgagcaacggcttccggccccgcagaagtctcctcttcatcagctgggacggtggtgactttggaagcgtgggctccacggagtggctagaggtgatacggggtcccgggcaggtcgttaggcattggggagaggtgggggtggggggttcccactccacactggtcacccacccacagggctacctcagcgtgctgcacctcaaagccgtagtgtacgtgagcctggacaacgcagtgctgggggatgacaagtttcatgccaagaccagcccccttctgacaagtctcattgagagtgtcctgaagcaggtggattctcccaaccacagtgggcagactctctatgaacaggtggtgttcaccaatcccagctgggatgctgaggtgatccggcccctacccatggacagcagtgcctattccttcacggcctttgtgggagtccctgccgtcgagttctcctttatggaggtgagacgtcctccccctgccccagacacagcgctagtccttcagcctgtctgcctccgccccagcgtccaccctgtcctggcaggacgaccaggcctacccattcctgcacacaaaggaggacacttatgagaacctgcataaggtgctgcaaggccgcctgcccgccgtggcccaggccgtggcccagctcgcagggcagctcctcatccggctcagccacgatcgcctgctgcccctcgacttcggccgctacggggacgtcgtcctcaggcacatcgggaacctcaacgagttctctggggacctcaaggcccgcgggctgaccctgcagtgggtgtactcggcgcggggggactacatccgggcggcggaaaagctgcggcaggagatctacagctcggaggagagagacgagcgactgacacgcatgtacaacgtgcgcataatgcgggtggagttctacttcctttcccagtacgtgtcgccagccgactccccgttccgccacatcttcatgggccgtggagaccacacgctgggcgccctgctggaccacctgcggctgctgcgctccaacagctccgggacccccggggccacctcctccactggcttccaggagagccgtttccggcgtcagctagccctgctcacctggacgctgcaaggggcagccaatgcgcttagcggggatgtctggaacattgataacaacttctgaggccctggggatcctcacatccccgtcccccagtcaagagctcctctgctcctcgcttgaatgattcagggtcagggaggtggctcagagtccacctctcattgctgatcaatttctcattacccctacacatctctccacggagcccagaccccagcacagatatccacacaccccagccctgcagtgtagctgaccctaatgtgacggtcatactgtcggttaatcagagagtagcatcccttcaatcacagccccttcccctttctggggtcctccatacctagagaccactctgggaggtttgctaggccctgggacctggccagctctgttagtgggagagatcgctggcaccatagccttatggccaacaggtggtctgtggtgaaaggggcgtggagtttcaatatcaataaaccacctgatatcaataa

SEQ ID NO: 330334 - DNA, 2470 bp, Homo sapiens
cgcgcgcgggcggggggcgcgcggggagggggacgcggctcggggcgctcaccagccccgctccccagggctcaccccaacaccctgcactgggtcgatgaggccgggaaggtcggagagcagctgccgctggaggaccctgacgtctactgcccctacagcgccatcggcaacgtcacgggagagctggtgtacgcccactacgggcggcccgaagacctgcaggacctgcgggccaggggcgtggatccagtgggccgcctgctgctggtgcgcgtgggggtgatcagcttcgcccagaaggtgaccaatgctcaggacttcggggctcaaggagtgctcatatacccagagccagcggacttctcccaggacccacccaagccaagcctgtccagccagcaggcagtgtatggacatgtgcacctgggaactggagacccctacacacctggcttcccttccttcaatcaaacccagttccctccagttgcatcatcaggccttcccagcatcccacgcccagcccatcagtgcagacattgcctcccgcctgctgaggaagctcaaaggccctgtggccccccaagaatggcaggggagcctcctaggctccccttatcacctgggccccgggccacgactgcggctagtggtcaacaatcacaggacctccacccccatcaacaacatcttcggctgcatcgaaggccgctcagagccagatcactacgttgtcatcggggcccagagggatgcatggggcccaggagcagctaaatccgctgtggggacggctatactcctggagctggtgcggaccttttcctccatggtgagcaacggcttccggccccgcagaagtctcctcttcatcagctgggacggtggtgactttggaagcgtgggctccacggagtggctagaggtgatacggggtcccgggcaggtcgttaggcattggggagaggtgggggtggggggttcccactccacactggtcacccacccacagggctacctcagcgtgctgcacctcaaagccgtagtgtacgtgagcctggacaacgcagtgctgggggatgacaagtttcatgccaagaccagcccccttctgacaagtctcattgagagtgtcctgaagcaggtggattctcccaaccacagtgggcagactctctatgaacaggtggtgttcaccaatcccagctgggatgctgaggtgatccggcccctacccatggacagcagtgcctattccttcacggcctttgtgggagtccctgccgtcgagttctcctttatggaggtgagacgtcctccccctgccccagacacagcgctagtccttcagcctgtctgcctccgccccagcgtccaccctgtcctggcaggacgaccaggcctacccattcctgcacacaaaggaggacacttatgagaacctgcataaggtgctgcaaggccgcctgcccgccgtggcccaggccgtggcccagctcgcagggcagctcctcatccggctcagccacgatcgcctgctgcccctcgacttcggccgctacggggacgtcgtcctcaggcacatcgggaacctcaacgagttctctggggacctcaaggcccgcgggctgaccctgcagtgggtgtactcggcgcggggggactacatccgggcggcggaaaagctgcggcaggagatctacagctcggaggagagagacgagcgactgacacgcatgtacaacgtgcgcataatgcgggtggagttctacttcctttcccagtacgtgtcgccagccgactccccgttccgccacatcttcatgggccgtggagaccacacgctgggcgccctgctggaccacctgcggctgctgcgctccaacagctccgggacccccggggccacctcctccactggcttccaggagagccgtttccggcgtcagctagccctgctcacctggacgctgcaaggggcagccaatgcgcttagcggggatgtctggaacattgataacaacttctgaggccctggggatcctcacatccccgtcccccagtcaagagctcctctgctcctcgcttgaatgattcagggtcagggaggtggctcagagtccacctctcattgctgatcaatttctcattacccctacacatctctccacggagcccagaccccagcacagatatccacacaccccagccctgcagtgtagctgaccctaatgtgacggtcatactgtcggttaatcagagagtagcatcccttcaatcacagccccttcccctttctggggtcctccatacctagagaccactctgggaggtttgctaggccctgggacctggccagctctgttagtgggagagatcgctggcaccatagccttatggccaacaggtggtctgtggtgaaaggggcgtggagtttcaatatcaataaaccacctgatatcaataa

SEQ ID NO: 330335 - DNA, 1958 bp, Homo sapiens
gtgctgttcccaggtcccgaggccacaccttcttgctcagaatagggctggcatgtttttcgtttttcctggaagcccagctcgcagctttgcgtgggcacccctttccctgcaggtgcacctgggaactggagacccctacacacctggcttcccttccttcaatcaaacccagttccctccagttgcatcatcaggccttcccagcatcccacgcccagcccatcagtgcagacattgcctcccgcctgctgaggaagctcaaaggccctgtggccccccaagaatggcaggggagcctcctaggctccccttatcacctgggccccgggccacgactgcggctagtggtcaacaatcacaggacctccacccccatcaacaacatcttcggctgcatcgaaggccgctcagagccaggcttccggccccgcagaagtctcctcttcatcagctgggacggtggtgactttggaagcgtgggctccacggagtggctagagggctacctcagcgtgctgcacctcaaagccgtagtgtacgtgagcctggacaacgcagtgctgggggatgacaagtttcatgccaagaccagcccccttctgacaagtctcattgagagtgtcctgaagcaggtggattctcccaaccacagtgggcagactctctatgaacaggtggtgttcaccaatcccagctgggatgctgaggtgatccggcccctacccatggacagcagtgcctattccttcacggcctttgtgggagtccctgccgtcgagttctcctttatggaggtgagacgtcctccccctgccccagacacagcgctagtccttcagcctgtctgcctccgccccagcgtccaccctgtcctggcaggacgaccaggcctacccattcctgcacacaaaggaggacacttatgagaacctgcataaggtgctgcaaggccgcctgcccgccgtggcccaggccgtggcccagctcgcagggcagctcctcatccggctcagccacgatcgcctgctgcccctcgacttcggccgctacggggacgtcgtcctcaggcacatcgggaacctcaacgagttctctggggacctcaaggcccgcgggctgaccctgcagtgggtgtactcggcgcggggggactacatccgggcggcggaaaagctgcggcaggagatctacagctcggaggagagagacgagcgactgacacgcatgtacaacgtgcgcataatgcgggtggagttctacttcctttcccagtacgtgtcgccagccgactccccgttccgccacatcttcatgggccgtggagaccacacgctgggcgccctgctggaccacctgcggctgctgcgctccaacagctccgggacccccggggccacctcctccactggcttccaggagagccgtttccggcgtcagctagccctgctcacctggacgctgcaaggggcagccaatgcgcttagcggggatgtctggaacattgataacaacttctgaggccctggggatcctcacatccccgtcccccagtcaagagctcctctgctcctcgcttgaatgattcagggtcagggaggtggctcagagtccacctctcattgctgatcaatttctcattacccctacacatctctccacggagcccagaccccagcacagatatccacacaccccagccctgcagtgtagctgaccctaatgtgacggtcatactgtcggttaatcagagagtagcatcccttcaatcacagccccttcccctttctggggtcctccatacctagagaccactctgggaggtttgctaggccctgggacctggccagctctgttagtgggagagatcgctggcaccatagccttatggccaacaggtggtctgtggtgaaaggggcgtggagtttcaatatcaataaaccacctgatatcaataa

SEQ ID NO: 330336 - DNA, 3588 bp, Homo sapiens
  misc_feature (1508)..(1508): n is a, c, g, or t
  misc_feature (1542)..(1542): n is a, c, g, or t
aggaggtggggcctggtgggcggggcctcagcgtaggccttaggtctcaggggagcagcacgcctgagcaccccaggacctgcgctcagggaggaggcaggcgtggggctgtggagagattggcaggggagagcacagccccttgtgctctggcctggacccgggggccacgtctggaaggctggactgaggccaggactgtgcccccacccttgggggtggtgaggagcagccttggttcaggctgcctgccaggactgataaggggccctcctagggctcccacaaacggtttatcggtttatcgctgggggacagcctgcaggcttcaggaggggacacaagcatggagcggctttggggtctattccagagagcgcaacaactgtccccaagatcctctcagaccgtctaccagcgtgtggaaggcccccggaaagggcacctggaggaggaagaggaagacggggaggagggggcggagacattggcccacttctgccccatggagctgaggggccctgagcccctgggctctagacccaggcagccaaacctcattccctgggcggcagcaggacggagggctgccccctacctggtcctgacggccctgctgatcttcactggggccttcctactgggctacgtcgccttccgagggtcctgccaggcgtgcggagactctgtgttggtggtcagtgaggatgtcaactatgagcctgacctggatttccaccagggcagactctactggagcgacctccaggccatgttcctgcagttcctgggggaggggcgcctggaggacaccatcaggcaaaccagccttcgggaacgggtggcaggctcggccgggatggccgctctgactcaggacattcgcgcggcgctctcccgccagaagctggaccacgtgtggaccgacacgcactacgtggggctgcaattcccggatccggctcaccccaacaccctgcactgggtcgatgaggccgggaaggtcggagagcagctgccgctggaggaccctgacgtctactgcccctacagcgccatcggcaacgtcacgggagagctggtgtacgcccactacgggcggcccgaagacctgcaggacctgcgggccaggggcgtggatccagtgggccgcctgctgctggtgcgcgtgggggtgatcagcttcgcccagaaggtgaccaatgctcaggacttcggggctcaaggagtgctcatatacccagagccagcggacttctcccaggacccacccaagccaagcctgtccagccagcaggcagtgtatggacatgtgcacctgggaactggagacccctacacacctggcttcccttccttcaatcaaacccagttccctccagttgcatcatcaggccttcccagcatcccacgcccagcccatcagtgcagacattgcctcccgcctgctgaggctggagtgcagtggtgcaatcttggctcactgcaacctccacctcccgggttcnagtgattcttctgcctcagactccagagtatctnggattacaggaagctcaaaggccctgtggccccccaagaatggcaggggagcctcctaggctccccttatcacctgggccccgggccacgactgcggctagtggtcaacaatcacaggacctccacccccatcaacaacatcttcggctgcatcgaaggccgctcagagccagatcactacgttgtcatcggggcccagagggatgcatggggcccaggagcagctaaatccgctgtggggacggctatactcctggagctggtgcggaccttttcctccatggtgagcaacggcttccggccccgcagaagtctcctcttcatcagctgggacggtggtgactttggaagcgtgggctccacggagtggctagaggtgatacggggtcccgggcaggtcgttaggcattggggagaggtgggggtggggggttcccactccacactggtcacccacccacagggctacctcagcgtgctgcacctcaaagccgtagtgtacgtgagcctggacaacgcagtgctgggggatgacaagtttcatgccaagaccagcccccttctgacaagtctcattgagagtgtcctgaagcaggtggattctcccaaccacagtgggcagactctctatgaacaggtggtgttcaccaatcccagctgggatgctgaggtgatccggcccctacccatggacagcagtgcctattccttcacggcctttgtgggagtccctgccgtcgagttctcctttatggaggtgagacgtcctccccctgccccagacacagcgctagtccttcagcctgtctgcctccgccccagcgtccaccctgtcctggcaggacgaccaggcctacccattcctgcacacaaaggaggacacttatgagaacctgcataaggtgctgcaaggccgcctgcccgccgtggcccaggccgtggcccagctcgcagggcagctcctcatccggctcagccacgatcgcctgctgcccctcgacttcggccgctacggggacgtcgtcctcaggcacatcgggaacctcaacgagttctctggggacctcaaggcccgcgggctgaccctgcagtgggtgtactcggcgcggggggactacatccgggcggcggaaaagctgcggcaggagatctacagctcggaggagagagacgagcgactgacacgcatgtacaacgtgcgcataatgcgggtggagttctacttcctttcccagtacgtgtcgccagccgactccccgttccgccacatcttcatgggccgtggagaccacacgctgggcgccctgctggaccacctgcggctgctgcgctccaacagctccgggacccccggggccacctcctccactggcttccaggagagccgtttccggcgtcagctagccctgctcacctggacgctgcaaggggcagccaatgcgcttagcggggatgtctggaacattgataacaacttctgaggccctggggatcctcacatccccgtcccccagtcaagagctcctctgctcctcgcttgaatgattcagggtcagggaggtggctcagagtccacctctcattgctgatcaatttctcattacccctacacatctctccacggagcccagaccccagcacagatatccacacaccccagccctgcagtgtagctgaccctaatgtgacggtcatactgtcggttaatcagagagtagcatcccttcaatcacagccccttcccctttctggggtcctccatacctagagaccactctgggaggtttgctaggccctgggacctggccagctctgttagtgggagagatcgctggcaccatagccttatggccaacaggtggtctgtggtgaaaggggcgtggagtttcaatatcaataaaccacctgatatcaataatggcctcgttggccttagcgggggagctttgggcccgtccctttagggagggtaattagagccctcgtaactgactcgtggcctcgggcttcgggtgcgggaaccggataacttacttaaggggggat

SEQ ID NO: 330337 - DNA, 761 bp, Homo sapiens
gcgcggttggactacatccgggcggcgggcatgtacaacgtgcgcataatgcgggtggagttctacttcctttcccagtacgtgtcgccagccgactccccgttccgccacatcttcatgggccgtggagaccacacgctgggcgccctgctggaccacctgcggctgctgcgctccaacagctccgggacccccggggccacctcctccactggcttccaggagagccgtttccggcgtcagctagccctgctcacctggacgctgcaaggggcagccaatgcgcttagcggggatgtctggaacattgataacaacttctgaggccctggggatcctcacatccccgtcccccagtcaagagctcctctgctcctcgcttgaatgattcagggtcagggaggtggctcagagtccacctctcattgctgatcaatttctcattacccctacacatctctccacggagcccagaccccagcacagatatccacacaccccagccctgcagtgtagctgaccctaatgtgacggtcatactgtcggttaatcagagagtagcatcccttcaatcacagccccttcccctttctggggtcctccatacctagagaccactctgggaggtttgctaggccctgggacctggccagctctgttagtgggagagatcgctggcaccatagccttatggccaacaggtggtctgtggtgaaaggggcgtggagtttcaatatcaataaaccacctgatatcaataa

SEQ ID NO: 330338 - DNA, 1036 bp, Homo sapiens
ggccttgttgctgtgtcatccatgtcagaagagctgaagaacaagctagccaaatgctatgctaagcctcttttgtaagggccttaatgaggggggacccctcccggcctaatcacctcctaaaggctccacctcttaatatcatcacattggcaatgccttaattttggagggaacacactcaaactatagcattaagatatgggaaaggaacaagaaagagtctatttttctttggtgatctgtttaaggagtagatgtgtttcgtttgcatcacatctatgtacagtattaaaaataaaatgtatctctctctctctctctatatatatatatatatacactgaaacctttactatatatatatagatatatacactgaaacctttactgtctttcattgtctttctagtttttaaggataggaaattttagttaaaatgctagcctggcatttttcttattccccacttttatttcccccatggggaattgggttatgaaactggaaattttattaattttccagaaattgttctggtgggtttgtgtaaggaggagagtaataactggcatggcattgcagttactctttatttataattaagacatgctctttatttcaaaatattaagttaataatactcttaacttattgcacttaagtagattgagacaatttgcgatttattttgacatcctaataaagtggataaaaggagaagctgcttggaaaactttcccacttgggaattttttccacattcctaattttcctttgtggaatgtcactcaccatttcccatttggaactgctctttctagatagtagatggaatggagtggttgcagtggtggtggtggtgttactgtttacatcaacctagagaaaaatggaagcatcttaacttggttaaaatgtttctgttgtttatataattctttaagcctcattccagtgcttgctgctattaaaaaaaaaacaaaaaactaaaaacttgcatttcttttactgatcattttgtagacatagaaa

SEQ ID NO: 330339 - DNA, 999 bp, Homo sapiens
ggccttgttgctgtgtcatccatgtcagaagagctgaagaacaagctagccaaatgctatgctaagcctcttttgtaagggccttaatgaggggggacccctcccggcctaatcacctcctaaaggctccacctcttaatatcatcacattggcaatgccttaattttggagggaacacactcaaactatagcattaagatatgggaaaggaacaagaaagagtctatttttctttggtgatctgtttaaggagtagatgtgtttcgtttgcatcacatctatgtacagtattaaaaataaaatgtatctctctctctctatatatatatagatatatacactgaaacctttactgtctttcattgtctttctagtttttaaggataggaaattttagttaaaatgctagcctggcatttttcttattccccacttttatttcccccatggggaattgggttatgaaactggaaattttattaattttccagaaattgttctggtgggtttgtgtaaggaggagagtaataactggcatggcattgcagttactctttatttataattaagacatgctctttatttcaaaatattaagttaataatactcttaacttattgcacttaagtagattgagacaatttgcgatttattttgacatcctaataaagtggataaaaggagaagctgcttggaaaactttcccacttgggaattttttccacattcctaattttcctttgtggaatgtcactcaccatttcccatttggaactgctctttctagatagtagatggaatggagtggttgcagtggtggtggtggtgttactgtttacatcaacctagagaaaaatggaagcatcttaacttggttaaaatgtttctgttgtttatataattctttaagcctcattccagtgcttgctgctattaaaaaaaaaacaaaaaactaaaaacttgcatttcttttactgatcattttgtagacatagaaa

SEQ ID NO: 330340 - DNA, 532 bp, Homo sapiens
attgtatgtttcaatatttgaatattgaatgaatattcgatatcgaatattgaatgaatattgaaacattccactctctttaactttttgaaatagtttcggtagaattgatattagctcttctttaaatgttttgatagaattcagcaataaagacatcaagtgcagtgttttactttgatgggagattgtttgttattgttttaatcttgttgcctgttggtggtctattaaagttttctatttctttattattcaatcttggtaagttgtatgtgtccagaagtttatccctttcttctaggttttctaatttgttgacatatagttgtatttgtagtggtttgttataatcttttgtatttctgttatatcagttgtaatgtttccttttcatctctgattttatttgagttttctttgtttcttagttaatcttgctaaaggtttgctgattttgtttatcttcaaaaaaccagctctttgatatattaattttttgtgtgttttttaaaagtctctactaggttta

SEQ ID NO: 330341 - DNA, 530 bp, Homo sapiens
cctacattattataccttctgattaaccacaatgacatacaactccaaaaaagaaaaaggtgcattcttaggtcttgaaatttaagtcacattaattgcaatcctagataatggtacaacatgggttttgtgctacactgaaaaatttgttgtctcttgttactcaagagatccttgaggttacaggtgattctgtaaatgagaaagagtaagcagagagcatcactcaactatctagaaagaagtggaaaaggaaagatatcaggtcgattttttataccacatatgtaggagaaagctgaagatacgcaaaagagcatagatctttggcttatgacttatggtcagcctgcccagatgtccccagcaggaaagaagcatcagcaattgtgttaattatgcctctgtttgcacttctttcaaggctaattgtccgcttgcttcatttagtccttgatcagaagttagtctgggaaagcattcctggtatgaacacccatggaattcatcttgtgaaaatgcaaatccca

SEQ ID NO: 330342 - DNA, 815 bp, Homo sapiens
attgggtacccgggccccccccgcccgggagccacagcctgaggccctcaggtctctgcaggtgtcgtggaggaacctagcacctgccatcctcttccccaatttgccacttccagcagctttagcccatgaggaggatgtgaccgggactgagtcaggagccctctggaagcatggagactgtggtgattgttgccataggtgtgctggccaccatctttctggcttcgtttgcagccttggtgctggtttgcaggcagcgctactgccggccgcgagacctgctgcagcgctatgattctaagcccattgtggacctcattggtgccatggagacccagtctgagccctctgagttagaactggacgatgtcgttatcaccaacccccacattgaggccattctggagaatgaagactggatcgaagatgcctcgggtctcatgtcccactgcattgccatcttgaagatttgtcacactctgacagagaagcttgttgccatgacaatgggctctggggccaagatgaagacttcagccagtgtcagcgacatcattgtggtggccaagcggatcagccccaggtaaggagaccaaagcagaaagatcagtaaccctcctggagtctcacaattaatatgaatcagagcaggatcttcaactcctcaacttgtgtttttaactggcacatcttcctgcctgggtgcagcaggtgggaaatccatcatggaaaggaaagaacagacatgagagtcattccattctcttccagttcaaatctttttttgtgaaaaaaatggtagttgtgaccca

SEQ ID NO: 330343 - DNA, 1848 bp, Homo sapiens
taagctcgtgtaatcggacgaggctctccgtctgccgcccggacgggccaccgcgggggcgcgaggaaggggtgttgggtcgccaggcccgcctcccagctgccccggccgccggggggcctggcggtgacggcggcgcctggcggcggggatttggcgcgggccgggggccgggggccggggcgcgggggcgcgaggctggattcctagggccgcggcgcttcccggcatgctccgctgcaggcccgcgcccgcgcccggactttgccatcggcggggcagtcgcgggatgcgcccgggagccacagcctgagggtttaaaaagctattttaaggccgggctcggtgtctcacgcgtgtaatcccagcactttgggaggcccgaggccctcaggtctctgcaggtgtcgtggaggaacctagcacctgccatcctcttccccaatttgccacttccagcagctttagcccatgaggaggatgtgaccgggactgagtcaggagccctctggaagcatggagactgtggtgattgttgccataggtgtgctggccaccatctttctggcttcgtttgcagccttggtgctggtttgcaggcagcgctactgccggccgcgagacctgctgcagcgctatgattctaagcccattgtggacctcattggtgccatggagacccagtctgagccctctgagttagaactggacgatgtcgttatcaccaacccccacattgaggccattctggagaatgaagactggatcgaagatgcctcgggtctcatgtcccactgcattgccatcttgaagatttgtcacactctgacagagaagcttgttgccatgacaatgggctctggggccaagatgaagacttcagccagtgtcagcgacatcattgtggtggccaagcggatcagccccagggtggatgatgttgtgaagtcgatgtaccctccgttggaccccaaactcctggacgcacggacgactgccctgctcctgtctgtcagtcacctggtgctggtgacaaggaatgcctgccatctgacgggaggcctggactggattgaccagtctctgtcggctgctgaggagcatttggaagtccttcgagaagcagccctagcttctgagccagataaaggcctcccaggccctgaaggcttcctgcaggagcagtctgcaatttagtgcctacaggccagcagctagccatgaaggcccctgccgccatccctggatggctcagcttagccttctactttttcctatagagttagttgttctccatggctggagagttcagctgtgtgtgcatagtaaagcaggagatccccgtcagtttatgcctcttttgcagttgcaaactgtggctggtgagtggcagtctaatactacagttaggggagatgccattcactctctgcaagaggagtattgaaaactggtggactgtcagctttatttagctcacctagtgttttcaagaaaattgagccaccgtctaagaaatcaagaggtttcacattaaaattagaatttctggcctctctcgatcggtcagaatgtgtggcaattctgatctgcattttcagaagaggacaatcaattgaaactaagtaggggtttcttcttttggcaagacttgtactctctcacctggcctgtttcatttatttgtattatctgcctggtccctgaggcgtctgggtctctcctctcccttgcaggtttgggtttgaagctgaggaactacaaagttgatgatttcttttttatctttatgcctgcaattttacctagctaccactaggtggatagtaaatttatacttatgtttcc

SEQ ID NO: 330344 - DNA, 1739 bp, Homo sapiens
taagctcgtgtaatcggacgaggctctccgtctgccgcccggacgggccaccgcgggggcgcgaggaaggggtgttgggtcgccaggcccgcctcccagctgccccggccgccggggggcctggcggtgacggcggcgcctggcggcggggatttggcgcgggccgggggccgggggccggggcgcgggggcgcgaggctggattcctagggccgcggcgcttcccggcatgctccgctgcaggcccgcgcccgcgcccggactttgccatcggcggggcagtcgcgggatgcgcccgggagccacagcctgaggccctcaggtctctgcaggtgtcgtggaggaacctagcacctgccatcctcttccccaatttgccacttccagcagctttagcccatgaggaggatgtgaccgggactgagtcaggagccctctggaagcatggagactgtggtgattgttgccataggtgtgctggccaccatctttctggcttcgtttgcagccttggtgctggtttgcaggcagcgctactgccggccgcgagacctgctgcagcgctatgattctaagcccattgtggacctcattggtgccatggagacccagtctgagccctctgagttagaactggacgatgtcgttatcaccaacccccacattgaggccattctggagaatgaagactggatcgaagatgcctcgggtctcatgtcccactgcattgccatcttgaagatttgtcacactctgacagagaagcttgttgccatgacaatgggctctggggccaagatgaagacttcagccagtgtcagcgacatcattgtggtggccaagcggatcagccccagggtggatgatgttgtgaagtcgatgtaccctccgttggaccccaaactcctggacgcacggacgactgccctgctcctgtctgtcagtcacctggtgctggtgacaaggaatgcctgccatctgacgggaggcctggactggattgaccagtctctgtcggctgctgaggagcatttggaagtccttcgagaagcagccctagcttctgagccagataaaggcctcccaggccctgaaggcttcctgcaggagcagtctgcaatttagtgcctacaggccagcagctagccatgaaggcccctgccgccatccctggatggctcagcttagccttctactttttccctgtgtgtgcatagtaaagcaggagatccccgtcagtttatgcctcttttgcagttgcaaactgtggctggtgagtggcagtctaatactacagttaggggagatgccattcactctctgcaagaggagtattgaaaactggtggactgtcagctttatttagctcacctagtgttttcaagaaaattgagccaccgtctaagaaatcaagaggtttcacattaaaattagaatttctggcctctctcgatcggtcagaatgtgtggcaattctgatctgcattttcagaagaggacaatcaattgaaactaagtaggggtttcttcttttggcaagacttgtactctctcacctggcctgtttcatttatttgtattatctgcctggtccctgaggcgtctgggtctctcctctcccttgcaggtttgggtttgaagctgaggaactacaaagttgatgatttcttttttatctttatgcctgcaattttacctagctaccactaggtggatagtaaatttatacttatgtttcc

SEQ ID NO: 330345 - DNA, 1287 bp, Homo sapiens
  misc_feature (18)..(19): n is a, c, g, or t
ggcacgagtgcaaacgannccagaaagatggtttgcaggcagcgctactgccggccgcgagacctgctgcagcgctatgattctaagcccattgtggacctcattggtgccatggagacccagtctgagccctctgagttagaactggacgatgtcgttatcaccaacccccacattgaggccattctggagaatgaagactggatcgaagatgcctcgggtctcatgtcccactgcattgccatcttgaagatttgtcacactctgacagagaagcttgttgccatgacaatgggctctggggccaagatgaagacttcagccagtgtcagcgacatcattgtggtggccaagcggatcagccccagggtggatgatgttgtgaagtcgatgtaccctccgttggaccccaaactcctggacgcacggacgactgccctgctcctgtctgtcagtcacctggtgctggtgacaaggaatgcctgccatctgacgggaggcctggactggattgaccagtctctgtcggctgctgaggagcatttggaagtccttcgagaagcagccctagcttctgagccagataaaggcctcccaggccctgaaggcttcctgcaggagcagtctgcaatttagtgcctacaggccagcagctagccatgaaggcccctgccgccatccctggatggctcagcttagccttctactttttcctatagagttagttgttctccatggctggagagttcagctgtgtgtgcatagtaaagcaggagatccccgtcagtttatgcctcttttgcagttgcaaactgtggctggtgagtggcagtctaatactacagttaggggagatgccattcactctctgcaagaggagtattgaaaactggtggactgtcagctttatttagctcacctagtgttttcaagaaaattgagccaccgtctaagaaatcaagaggtttcacattaaaattagaatttctggcctctctcgatcggtcagaatgtgtggcaattctgatctgcattttcagaagaggacaatcaattgaaactaagtaggggtttcttcttttggcaagacttgtactctctcacctggcctgtttcatttatttgtattatctgcctggtccctgaggcgtctgggtctctcctctcccttgcaggtttgggtttgaagctgaggaactacaaagttgatgatttcttttttatctttatgcctgcaattttacctagctaccactaggtggatagtaaatttatacttatgtttcc

SEQ ID NO: 330346 - DNA, 1640 bp, Homo sapiens
taagctcgtgtaatcggacgaggctctccgtctgccgcccggacgggccaccgcgggggcgcgaggaaggggtgttgggtcgccaggcccgcctcccagctgccccggccgccggggggcctggcggtgacggcggcgcctggcggcggggatttggcgcgggccgggggccgggggccggggcgcgggggcgcgaggctggattcctagggccgcggcgcttcccggcatgctccgctgcaggcccgcgcccgcgcccggactttgccatcggcggggcagtcgcgggatgcgcccgggagccacagcctgagctttagcccatgaggaggatgtgaccgggactgagtcaggagccctctggaagcatggagactgtggtgattgttgccataggtgtgctggccaccatctttctggcttcgtttgcagccttggtgctggtttgcaggcagcgctactgccggccgcgagacctgctgcagcgctatgattctaagcccattgtggacctcattggtgccatggagacccagtctgagccctctgagttagaactggacgatgtcgttatcaccaacccccacattgaggccattctggagaatgaagactggatcgaagatgcctcgggtctcatgtcccactgcattgccatcttgaagatttgtcacactctgacagagaagcttgttgccatgacaatgggctctggggccaagatgaagacttcagccagtgtcagcgacatcattgtggtggccaagcggatcagccccaggacgactgccctgctcctgtctgtcagtcacctggtgctggtgacaaggaatgcctgccatctgacgggaggcctggactggattgaccagtctctgtcggctgctgaggagcatttggaagtccttcgagaagcagccctagcttctgagccagataaaggcctcccaggccctgaaggcttcctgcaggagcagtctgcaatttagtgcctacaggccagcagctagccatgaaggcccctgccgccatccctggatggctcagcttagccttctactttttcctatagagttagttgttctccatggctggagagttcagctgtgtgtgcatagtaaagcaggagatccccgtcagtttatgcctcttttgcagttgcaaactgtggctggtgagtggcagtctaatactacagttaggggagatgccattcactctctgcaagaggagtattgaaaactggtggactgtcagctttatttagctcacctagtgttttcaagaaaattgagccaccgtctaagaaatcaagaggtttcacattaaaattagaatttctggcctctctcgatcggtcagaatgtgtggcaattctgatctgcattttcagaagaggacaatcaattgaaactaagtaggggtttcttcttttggcaagacttgtactctctcacctggcctgtttcatttatttgtattatctgcctggtccctgaggcgtctgggtctctcctctcccttgcaggtttgggtttgaagctgaggaactacaaagttgatgatttcttttttatctttatgcctgcaattttacctagctaccactaggtggatagtaaatttatacttatgtttcc

SEQ ID NO: 330347 - DNA, 546 bp, Homo sapiens
ctgtgatctagaggatccctcataggtcgcaggagatccccgtcagtttatgcctcttttgcagttgcaaactgtggctggtgagtggcagtctaatactacagttaggggagatgccattcactctctgcaagaggagtattgaaaactggtggactgtcagctttatttagctcacctagtgttttcaagaaaattgagccaccgtctaagaaatcaagaggtttcacattaaaattagaatttctggcctctctcgatcggtcagaatgtgtggcaattctgatctgcattttcagaagaggacaatcaattgaaactaagtaggggtttcttcttttggcaagacttgtactctctcacctggcctgtttcatttatttgtattatctgcctggtccctgaggcgtctgggtctctcctctcccttgcaggtttgggtttgaagctgaggaactacaaagttgatgatttcttttttatctttatgcctgcaattttacctagctaccactaggtggatagtaaatttatacttatgtttcc

SEQ ID NO: 330348 - DNA, 473 bp, Homo sapiens
atggagccaactttaaattgcatacctaccaacatcctagggaagggtgtgcagtttggggaatactagtcaaaaagtctatctatttgggcttttgtgcaaagtccctcatttcctaggaaacctgaccctattttctttttttccctaggacgactgccctgctcctgtctgtcagtcacctggtgctggtgacaaggaatgcctgccatctgacgggaggcctggactggattgaccagtctctgtcggctgctgaggagcatttggaagtccttcgagaagcagccctagcttctgagccagataaaggcctcccaggccctgaaggcttcctgcaggagcagtctgcaatttagtgcctacaggccagcagctagccatgaaggcccctgccgccatccctggatggctcagcttagccttctactttttcctatagagttagttgttctccatggctggagagttca

SEQ ID NO: 330349 - DNA, 509 bp, Homo sapiens
tccccgtcagtttatgcctcttttgcagttgcaaactgtggctggtgagtggcagtctaatactacagttaggggagatgccattcactctctgcaagaggagtattgaaaactggtggactgtcagctttatttagctcacctagtgttttcaagaaaattgagccaccgtctaagaaatcaagaggtttcacattaaaattagaatttctggcctctctcgatcggtcagaatgtgtggcaattctgatctgcattttcagaagaggacaatcaattgaaactaagtaggggtttcttcttttggcaagacttgtactctctcacctggcctgtttcatttatttgtattatctgcctggtccctgaggcgtctgggtctctcctctcccttgcaggtttgggtttgaagctgaggaactacaaagttgatgatttcttttttatctttatgcctgcaattttacctagctaccactaggtggatagtaaatttatacttatgtttc

SEQ ID NO: 330350 - DNA, 1776 bp, Homo sapiens
taagctcgtgtaatcggacgaggctctccgtctgccgcccggacgggccaccgcgggggcgcgaggaaggggtgttgggtcgccaggcccgcctcccagctgccccggccgccggggggcctggcggtgacggcggcgcctggcggcggggatttggcgcgggccgggggccgggggccggggcgcgggggcgcgaggctggattcctagggccgcggcgcttcccggcatgctccgctgcaggcccgcgcccgcgcccggactttgccatcggcggggcagtcgcgggatgcgcccgggagccacagcctgaggccctcaggtctctgcaggtgtcgtggaggaacctagcacctgccatcctcttccccaatttgccacttccagcagctttagcccatgaggaggatgtgaccgggactgagtcaggagccctctggaagcatggagactgtggtgattgttgccataggtgtgctggccaccatctttctggcttcgtttgcagccttggtgctggtttgcaggcagcgctactgccggccgcgagacctgctgcagcgctatgattctaagcccattgtggacctcattggtgccatggagacccagtctgagccctctgagttagaactggacgatgtcgttatcaccaacccccacattgaggccattctggagaatgaagactggatcgaagatgcctcgggtctcatgtcccactgcattgccatcttgaagatttgtcacactctgacagagaagcttgttgccatgacaatgggctctggggccaagatgaagacttcagccagtgtcagcgacatcattgtggtggccaagcggatcagccccagggtggatgatgttgtgaagtcgatgtaccctccgttggaccccaaactcctggacgcacggacgactgccctgctcctgtctgtcagtcacctggtgctggtgacaaggaatgcctgccatctgacgggaggcctggactggattgaccagtctctgtcggctgctgaggagcatttggaagtccttcgagaagcagccctagcttctgagccagataaaggcctcccaggccctgaaggcttcctgcaggagcagtctgcaatttagtgcctacaggccagcagctagccatgaaggcccctgccgccatccctggatggctcagcttagccttctactttttcctatagagttagttgttctccatggctggagagttcagctgtgtgtgcatagtaaagcaggagatccccgtcagtttatgcctcttttgcagttgcaaactgtggctggtgagtggcagtctaatactacagttaggggagatgccattcactctctgcaagaggagtattgaaaactggtggactgtcagctttatttagctcacctagtgttttcaagaaaattgagccaccgtctaagaaatcaagaggtttcacattaaaattagaatttctggcctctctcgatcggtcagaatgtgtggcaattctgatctgcattttcagaagaggacaatcaattgaaactaagtaggggtttcttcttttggcaagacttgtactctctcacctggcctgtttcatttatttgtattatctgcctggtccctgaggcgtctgggtctctcctctcccttgcaggtttgggtttgaagctgaggaactacaaagttgatgatttcttttttatctttatgcctgcaattttacctagctaccactaggtggatagtaaatttatacttatgtttcc

SEQ ID NO: 330351 - DNA, 2009 bp, Homo sapiens
taagctcgtgtaatcggacgaggctctccgtctgccgcccggacgggccaccgcgggggcgcgaggaaggggtgttgggtcgccaggcccgcctcccagctgccccggccgccggggggcctggcggtgacggcggcgcctggcggcggggatttggcgcgggccgggggccgggggccggggcgcgggggcgcgaggctggattcctagggccgcggcgcttcccggcatgctccgctgcaggcccgcgcccgcgcccggactttgccatcggcggggcagtcgcgggatgcgcccgggagccacagcctgaggccctcaggtctctgcaggtgtcgtggaggaacctagcacctgccatcctcttccccaatttgccacttccagcagctttagcccatgaggaggatgtgaccgggactgagtcaggagccctctggaagcatggagactgtggtgattgttgccataggtgtgctggccaccatctttctggcttcgtttgcagccttggtgctggtttgcaggcagcgctactgccggccgcgagacctgctgcagcgctatgattctaagcccattgtggacctcattggtgccatggagacccagtctgagccctctgagttagaactggacgatgtcgttatcaccaacccccacattgaggccattctggagaatgaagactggatcgaagatgcctcgggtctcatgtcccactgcattgccatcttgaagatttgtcacactctgacagagaagcttgttgccatgacaatgggctctggggccaagatgaagacttcagccagtgtcagcgacatcattgtggtggccaagcggatcagccccagggtggatgatgttgtgaagtcgatgtaccctccgttggaccccaaactcctggacgcacggacgactgccctgctcctgtctgtcagtcacctggtgctggtgacaaggaatgcctgccatctgacgggaggcctggactggattgaccagtctctgtcggctgctgaggagcatttggaagtccttcgagaagcagccctagcttctgagccagataaaggcctcccaggccctgaaggcttcctgcaggagcagtctgcaatttagtgcctacaggccagcagctagccatgaaggcccctgccgccatccctggatggctcagcttagccttctactttttcctatagagttagttgttctccatggctggagagttcagctgtgtgtgcatagtaaagcaggagatccccgtcagtttatgcctcttttgcagttgcaaactgtggctggtgagtggcagtctaatactacagttaggggagatgccattcactctctgcaagaggagtattgaaaactggtggactgtcagctttatttagctcacctagtgttttcaagaaaattgagccaccgtctaagaaatcaagaggtttcacattaaaattagaatttctggcctctctcgatcggtcagaatgtgtggcaattctgatctgcattttcagaagaggacaatcaattgaaactaagtaggggtttcttcttttggcaagacttgtactctctcacctggcctgtttcatttatttgtattatctgcctggtccctgaggcgtctgggtctctcctctcccttgcaggtttgggtttgaagctgaggaactacaaagttgatgatttcttttttatctttatgcctgcaattttacctagctaccactaggtggatagtaaatttatacttatgtttccaaaaaaaaaaaagaaatgaaaaaacaaaaaacataaacaaacagcaaacaagaacaaaacaaaaacaaaaacagaaaaaagagaggggggggaacatattatccggggggacaaataacacccacttttttaaggggcccaatagaggttatattaaaagggggggcgataaaacgtgggggaaaaactgtgttttgtggagacccttctgggttgattggacacacagaaat

SEQ ID NO: 330352 - DNA, 1505 bp, Homo sapiens
attgggtacccgggccccccccgcccgggagccacagcctgaggccctcaggtctctgcaggtgtcgtggaggaacctagcacctgccatcctcttccccaatttgccacttccagcagctttagcccatgaggaggatgtgaccgggactgagtcaggagccctctggaagcatggagactgtggtgattgttgccataggtgtgctggccaccatctttctggcttcgtttgcagccttggtgctggtttgcaggcagcgctactgccggccgcgagacctgctgcagcgctatgattctaagcccattgtggacctcattggtgccatggagacccagtctgagccctctgagttagaactggacgatgtcgttatcaccaacccccacattgaggccattctggagaatgaagactggatcgaagatgcctcgggtctcatgtcccactgcattgccatcttgaagatttgtcacactctgacagagaagcttgttgccatgacaatgggctctggggccaagatgaagacttcagccagtgtcagcgacatcattgtggtggccaagcggatcagccccagggtggatgatgttgtgaagtcgatgtaccctccgttggaccccaaactcctggacgcacggacgactgccctgctcctgtctgtcagtcacctggtgctggtgacaaggaatgcctgccatctgacgggaggcctggactggattgaccagtctctgtcggctgctgaggagcatttggaagtccttcgagaagcagccctagcttctgagccagataaaggcctcccaggccctgaaggcttcctgcaggagcagtctgcaatttagtgcctacaggccagcagctagccatgaaggcccctgccgccatccctggatggctcagcttagccttctactttttcctatagagttagttgttctccatggctggagagttcagctgtgtgtgcatagtaaagcaggagatccccgtcagtttatgcctcttttgcagttgcaaactgtggctggtgagtggcagtctaatactacagttaggggagatgccattcactctctgcaagaggagtattgaaaactggtggactgtcagctttatttagctcacctagtgttttcaagaaaattgagccaccgtctaagaaatcaagaggtttcacattaaaattagaatttctggcctctctcgatcggtcagaatgtgtggcaattctgatctgcattttcagaagaggacaatcaattgaaactaagtaggggtttcttcttttggcaagacttgtactctctcacctggcctgtttcatttatttgtattatctgcctggtccctgaggcgtctgggtctctcctctcccttgcaggtttgggtttgaagctgaggaactacaaagttgatgatttcttttttatctttatgcctgcaattttacctagctaccactaggtggatagtaaatttatacttatgtttcc

SEQ ID NO: 330353 - DNA, 1700 bp, Homo sapiens
taagctcgtgtaatcggacgaggctctccgtctgccgcccggacgggccaccgcgggggcgcgaggaaggggtgttgggtcgccaggcccgcctcccagctgccccggccgccggggggcctggcggtgacggcggcgcctggcggcggggatttggcgcgggccgggggccgggggccggggcgcgggggcgcgaggctggattcctagggccgcggcgcttcccggcatgctccgctgcaggcccgcgcccgcgcccggactttgccatcggcggggcagtcgcgggatgcgcccgggagccacagcctgagctttagcccatgaggaggatgtgaccgggactgagtcaggagccctctggaagcatggagactgtggtgattgttgccataggtgtgctggccaccatctttctggcttcgtttgcagccttggtgctggtttgcaggcagcgctactgccggccgcgagacctgctgcagcgctatgattctaagcccattgtggacctcattggtgccatggagacccagtctgagccctctgagttagaactggacgatgtcgttatcaccaacccccacattgaggccattctggagaatgaagactggatcgaagatgcctcgggtctcatgtcccactgcattgccatcttgaagatttgtcacactctgacagagaagcttgttgccatgacaatgggctctggggccaagatgaagacttcagccagtgtcagcgacatcattgtggtggccaagcggatcagccccagggtggatgatgttgtgaagtcgatgtaccctccgttggaccccaaactcctggacgcacggacgactgccctgctcctgtctgtcagtcacctggtgctggtgacaaggaatgcctgccatctgacgggaggcctggactggattgaccagtctctgtcggctgctgaggagcatttggaagtccttcgagaagcagccctagcttctgagccagataaaggcctcccaggccctgaaggcttcctgcaggagcagtctgcaatttagtgcctacaggccagcagctagccatgaaggcccctgccgccatccctggatggctcagcttagccttctactttttcctatagagttagttgttctccatggctggagagttcagctgtgtgtgcatagtaaagcaggagatccccgtcagtttatgcctcttttgcagttgcaaactgtggctggtgagtggcagtctaatactacagttaggggagatgccattcactctctgcaagaggagtattgaaaactggtggactgtcagctttatttagctcacctagtgttttcaagaaaattgagccaccgtctaagaaatcaagaggtttcacattaaaattagaatttctggcctctctcgatcggtcagaatgtgtggcaattctgatctgcattttcagaagaggacaatcaattgaaactaagtaggggtttcttcttttggcaagacttgtactctctcacctggcctgtttcatttatttgtattatctgcctggtccctgaggcgtctgggtctctcctctcccttgcaggtttgggtttgaagctgaggaactacaaagttgatgatttcttttttatctttatgcctgcaattttacctagctaccactaggtggatagtaaatttatacttatgtttcc

SEQ ID NO: 330354 - DNA, 1124 bp, Homo sapiens
taagctcgtgtaatcggacgaggctctccgtctgccgcccggacgggccaccgcgggggcgcgaggaaggggtgttgggtcgccaggcccgcctcccagctgccccggccgccggggggcctggcggtgacggcggcgcctggcggcggggatttggcgcgggccgggggccgggggccggggcgcgggggcgcgaggctggattcctagggccgcggcgcttcccggcatgctccgctgcaggcccgcgcccgcgcccggacttgacgactgccctgctcctgtctgtcagtcacctggtgctggtgacaaggaatgcctgccatctgacgggaggcctggactggattgaccagtctctgtcggctgctgaggagcatttggaagtccttcgagaagcagccctagcttctgagccagataaaggcctcccaggccctgaaggcttcctgcaggagcagtctgcaatttagtgcctacaggccagcagctagccatgaaggcccctgccgccatccctggatggctcagcttagccttctactttttcctatagagttagttgttctccatggctggagagttcagctgtgtgtgcatagtaaagcaggagatccccgtcagtttatgcctcttttgcagttgcaaactgtggctggtgagtggcagtctaatactacagttaggggagatgccattcactctctgcaagaggagtattgaaaactggtggactgtcagctttatttagctcacctagtgttttcaagaaaattgagccaccgtctaagaaatcaagaggtttcacattaaaattagaatttctggcctctctcgatcggtcagaatgtgtggcaattctgatctgcattttcagaagaggacaatcaattgaaactaagtaggggtttcttcttttggcaagacttgtactctctcacctggcctgtttcatttatttgtattatctgcctggtccctgaggcgtctgggtctctcctctcccttgcaggtttgggtttgaagctgaggaactacaaagttgatgatttcttttttatctttatgcctgcaattttacctagctaccactaggtggatagtaaatttatacttatgtttcc

SEQ ID NO: 330355 - DNA, 343 bp, Homo sapiens
cagaacttccatgttgggtggaaggaagaatgaggacagcaccccgtcccttgcacagctcagcggcaagtggtcaggagtgtagcaagaagcacagatttgggaagcagtggaaagagttcagttttggatgtgtggggtgcatgtagaccatccatgtgacatttactgtgggttactagatacagaatctgatgtctggggaggctgagacaggagaatcgcttaaacctgggaggcggaggttgcagtgagctgagactgtgccactgcactccagcctgggcaaaagagcaagactccatctcaaaaagagagagagaggaaaaaatgaggtttatct

SEQ ID NO: 330356 - DNA, 89 bp, Homo sapiens
atgtgccacagtgaatgttaaattaaaaattttctggcaggagtatattaccagatagcaacctggatctgcaaaaagaaacaaaagca

SEQ ID NO: 330357 - DNA, 317 bp, Homo sapiens
ccaccacatccaccgtggttcgtttattattatgatactactttcagttcggggatacatatgcagagaggtacaggtttgttacgcaggtagtatatatgccagggtgggttggctgcaaacaaacaaacaaaaacaaaaaaacccacaaataagtcttgacttttaactcaaaccaggtagactgtaactgtaaatataaaaggcgaatgaaaaagcttctaaagataatcaaaaagaacatcttcatgaccttgggaaagagtaagatttcttacacatgacattaaaaaaccataacattttgataaactgga

SEQ ID NO: 330358 - DNA, 320 bp, Homo sapiens
tataaaaaagacaaacaaaatatattttccatcttatgcatattactaacatctttcaaaaccaacccatgaaggcaaatacaattaaaaagagcattgtttcataatattttaaggtatcggcaaaacactgtatttcacaacacagcaaccactagtttttgtttttgttttttttttgagatgaagtctcactctgttgcccgggcttgagtgcagtggcgcaatctcggctcactgcaagcttcgcgtcctgggttcacgccattctcctgcctcagcctcccgagtagctgggactacaggcgcctgccaccatg

SEQ ID NO: 330359 - DNA, 5916 bp, Homo sapiens
  misc_feature (28)..(28): n is a, c, g, or t
  misc_feature (30)..(30): n is a, c, g, or t
gcgctgcccgcctcgtccccaccccccnancccccgcgcccgccctcggacagtccctgctcgcccgcgcgctgcagccccatctcctagcggcagcccaggcgcggagggagcgagtccgccccgaggtaggtccaggacgggcgcacagcagcagccgaggctggccgggagagggaggaagaggatggcagggccacgccccagcccatgggccaggctgctcctggcagccttgatcagcgtcagcctctctgggaccttggcaaaccgctgcaagaaggccccagtgaagagctgcacggagtgtgtccgtgtggataaggactgcgcctactgcacagacgagatgttcagggaccggcgctgcaacacccaggcggagctgctggccgcgggctgccagcgggagagcatcgtggtcatggagagcagcttccaaatcacagaggagacccagattgacaccaccctgcggcgcagccagatgtccccccaaggcctgcgggtccgtctgcggcccggtgaggagcggcattttgagctggaggtgtttgagccactggagagccccgtggacctgtacatcctcatggacttctccaactccatgtccgatgatctggacaacctcaagaagatggggcagaacctggctcgggtcctgagccagctcaccagcgactacactattggatttggcaagtttgtggacaaagtcagcgtcccgcagacggacatgaggcctgagaagctgaaggagccctggcccaacagtgacccccccttctccttcaagaacgtcatcagcctgacagaagatgtggatgagttccggaataaactgcagggagagcggatctcaggcaacctggatgctcctgagggcggcttcgatgccatcctgcagacagctgtgtgcacgagggacattggctggcgcccggacagcacccacctgctggtcttctccaccgagtcagccttccactatgaggctgatggcgccaacgtgctggctggcatcatgagccgcaacgatgaacggtgccacctggacaccacgggcacctacacccagtacaggacacaggactacccgtcggtgcccaccctggtgcgcctgctcgccaagcacaacatcatccccatctttgctgtcaccaactactcctatagctactacgagaagcttcacacctatttccctgtctcctcactgggggtgctgcaggaggactcgtccaacatcgtggagctgctggaggaggccttcaatcggatccgctccaacctggacatccgggccctagacagcccccgaggccttcggacagaggtcacctccaagatgttccagaagacgaggactgggtcctttcacatccggcggggggaagtgggtatataccaggtgcagctgcgggcccttgagcacgtggatgggacgcacgtgtgccagctgccggaggaccagaagggcaacatccatctgaaaccttccttctccgacggcctcaagatggacgcgggcatcatctgtgatgtgtgcacctgcgagctgcaaaaagaggtgcggtcagctcgctgcagcttcaacggagacttcgtgtgcggacagtgtgtgtgcagcgagggctggagtggccagacctgcaactgctccaccggctctctgagtgacattcagccctgcctgcgggagggcgaggacaagccgtgctccggccgtggggagtgccagtgcgggcactgtgtgtgctacggcgaaggccgctacgagggtcagttctgcgagtatgacaacttccagtgtccccgcacttccgggttcctctgcaatgaccgaggacgctgctccatgggccagtgtgtgtgtgagcctggttggacaggcccaagctgtgactgtcccctcagcaatgccacctgcatcgacagcaatgggggcatctgtaatggacgtggccactgtgagtgtggccgctgccactgccaccagcagtcgctctacacggacaccatctgcgagatcaactactcggcgatccacccgggcctctgcgaggacctacgctcctgcgtgcagtgccaggcgtggggcaccggcgagaagaaggggcgcacgtgtgaggaatgcaacttcaaggtcaagatggtggacgagcttaagagagccgaggaggtggtggtgcgctgctccttccgggacgaggatgacgactgcacctacagctacaccatggaaggtgacggcgcccctgggcccaacagcactgtcctggtgcacaagaagaaggactgccctccgggctccttctggtggctcatccccctgctcctcctcctcctgccgctcctggccctgctactgctgctatgctggaagtactgtgcctgctgcaaggcctgcctggcacttctcccgtgctgcaaccgaggtcacatggtgggctttaaggaagaccactacatgctgcgggagaacctgatggcctctgaccacttggacacgcccatgctgcgcagcgggaacctcaagggccgtgacgtggtccgctggaaggtcaccaacaacatgcagcggcctggctttgccactcatgccgccagcatcaaccccacagagctggtgccctacgggctgtccttgcgcctggcccgcctttgcaccgagaacctgctgaagcctgacactcgggagtgcgcccagctgcgccaggaggtggaggagaacctgaacgaggtctacaggcagatctccggtgtacacaagctccagcagaccaagttccggcagcagcccaatgccgggaaaaagcaagaccacaccattgtggacacagtgctgatggcgccccgctcggccaagccggccctgctgaagcttacagagaagcaggtggaacagagggccttccacgacctcaaggtggcccccggctactacaccctcactgcagaccaggacgcccggggcatggtggagttccaggagggcgtggagctggtggacgtacgggtgcccctctttatccggcctgaggatgacgacgagaagcagctgctggtggaggccatcgacgtgcccgcaggcactgccaccctcggccgccgcctggtaaacatcaccatcatcaaggagcaagccagagacgtggtgtcctttgagcagcctgagttctcggtcagccgcggggaccaggtggcccgcatccctgtcatccggcgtgtcctggacggcgggaagtcccaggtctcctaccgcacacaggatggcaccgcgcagggcaaccgggactacatccccgtggagggtgagctgctgttccagcctggggaggcctggaaagagctgcaggtgaagctcctggagctgcaagaagttgactccctcctgcggggccgccaggtccgccgtttccacgtccagctcagcaaccctaagtttggggcccacctgggccagccccactccaccaccatcatcatcagggacccagatgaactggaccggagcttcacgagtcagatgttgtcatcacagccaccccctcacggcgacctgggcgccccgcagaaccccaatgctaaggccgctgggtccaggaagatccatttcaactggctgcccccttctggcaagccaatggggtacagggtaaagtactggattcagggtgactccgaatccgaagcccacctgctcgacagcaaggtgccctcagtggagctcaccaacctgtacccgtattgcgactatgagatgaaggtgtgcgcctacggggctcagggcgagggaccctacagctccctggtgtcctgccgcacccaccaggaagtgcccagcgagccagggcgtctggccttcaatgtcgtctcctccacggtgacccagctgagctgggctgagccggctgagaccaacggtgagatcacagcctacgaggtctgctatggcctggtcaacgatgacaaccgacctattgggcccatgaagaaagtgctggttgacaaccctaagaaccggatgctgcttattgagaaccttcgggagtcccagccctaccgctacacggtgaaggcgcgcaacggggccggctgggggcctgagcgggaggccatcatcaacctggccacccagcccaagaggcccatgtccatccccatcatccctgacatccctatcgtggacgcccagagcggggaggactacgacagcttccttatgtacagcgatgacgttctacgctctccatcgggcagccagaggcccagcgtctccgatgacactggctgcggctggaagttcgagcccctgctgggggaggagctggactgcggcgcgtcacgtggcggctgcccccggagctcatccccgcgtgtcggccagcagcgggcgctcctccgacgccgaggcccccacgggcccccggacgacggcggcgcgggcgggaagggcggcagcctgccccgcagtgcgacacccgggccccccggagagcacctggtgaatggccggatggactttgccttcccgggcagcaccaactccctgcacaggatgaccacgaccagtgctgctgcctatggcacccacctgagcccacacgtgccccaccgcgtgctaagcacatcctccaccctcacacgggactacaactcactgacccgctcagaacactcacactcgaccacactgcccagggactactccaccctcacctccgtctcctcccacgactctcgcctgactgctggtgtgcccgacacgcccacccgcctggtgttctctgccctggggcccacatctctcagagtgagctggcaggagccgcggtgcgagcggccgctgcagggctacagtgtggagtaccagctgctgaacggcggtgagctgcatcggctcaacatccccaaccctgcccagacctcggtggtggtggaagacctcctgcccaaccactcctacgtgttccgcgtgcgggcccagagccaggaaggctggggccgagagcgtgagggtgtcatcaccattgaatcccaggtgcacccgcagagcccactgtgtcccctgccaggctccgccttcactttgagcactcccagtgccccaggcccgctggtgttcactgccctgagcccagactcgctgcagctgagctgggagcggccacggaggcccaatggggatatcgtcggctacctggtgacctgtgagatggcccaaggaggagggccagccaccgcattccgggtggatggagacagccccgagagccggctgaccgtgccgggcctcagcgagaacgtgccctacaagttcaaggtgcaggccaggaccactgagggcttcgggccagagcgcgagggcatcatcaccatagagtcccaggatggaggacccttcccgcagctgggcagccgtgccgggctcttccagcacccgctgcaaagcgagtacagcagcatcaccaccacccacaccagcgccaccgagcccttcctagtggatgggccgaccctgggggcccagcacctggaggcaggcggctccctcacccggcatgtgacccaggagtttgtgagccggacactgaccaccagcggaacccttagcacccacatggaccaacagttcttccaaacttgaccgcaccctgccccacccccgccatgtcccactaggcgtcctcccgactcctctcccggagcctcctcagctactccatccttgcacccctgggggcccagcccacccgcatgcacagagcaggggctaggtgtctcctgggaggcatgaagggggcaaggtccgtcctctgtgggcccaaacctatttgtaaccaaagagctgggagcagcacaaggacccagcctttgttctgcacttaataaatggttttgctactgcta

SEQ ID NO: 330360 - DNA, 750 bp, Homo sapiens
gactctagagatcccccacacttcgatcgcgagaacaggaaggcttggggatctccccagggcagagctgactgcagacgcagcaaacccccgccactgccagggtcagcagtgctcacaccgatagagtggccggccagaggatatgggctgtggaagcctgggtggcccttgggctcctgcagggacagagggcctctgtccctagtggtttgagggaaactggttgtatttaagcaaaagccacccagagggtgggtgaccaggaatgtgcagggcccagcctgccccacggggcccgggtctggggcaggcctgaccaagggaccctgctctccccctgcagagcacctggtgaatggccggatggactttgccttcccgggcagcaccaactccctgcacaggatgaccacgaccagtgctgctgcctatggcacccacctgagcccacacgtgccccaccgcgtgctaagcacatcctccaccctcacacgggactacaactcactgacccgctcagaacactcacactcgaccacactgcccagggactactccaccctcacctccgtctcctcccacggtgagtgacctcagccaaccctgcctctcccactaacccttcctctcttccagctcctggagcctcgggcttctgtctgctgtccccaccgcccattctccaacatacacacacgcatgcacacatgcacgcacacacgtgcacacgcatgcacacatgtacac

SEQ ID NO: 330361 - DNA, 5746 bp, Homo sapiens
  misc_feature (28)..(28): n is a, c, g, or t
  misc_feature (30)..(30): n is a, c, g, or t
gcgctgcccgcctcgtccccaccccccnancccccgcgcccgccctcggacagtccctgctcgcccgcgcgctgcagccccatctcctagcggcagcccaggcgcggagggagcgagtccgccccgaggtaggtccaggacgggcgcacagcagcagccgaggctggccgggagagggaggaagaggatggcagggccacgccccagcccatgggccaggctgctcctggcagccttgatcagcgtcagcctctctgggaccttggcaaaccgctgcaagaaggccccagtgaagagctgcacggagtgtgtccgtgtggataaggactgcgcctactgcacagacgagatgttcagggaccggcgctgcaacacccaggcggagctgctggccgcgggctgccagcgggagagcatcgtggtcatggagagcagcttccaaatcacagaggagacccagattgacaccaccctgcggcgcagccagatgtccccccaaggcctgcgggtccgtctgcggcccggtgaggagcggcattttgagctggaggtgtttgagccactggagagccccgtggacctgtacatcctcatggacttctccaactccatgtccgatgatctggacaacctcaagaagatggggcagaacctggctcgggtcctgagccagctcaccagcgactacactattggatttggcaagtttgtggacaaagtcagcgtcccgcagacggacatgaggcctgagaagctgaaggagccctggcccaacagtgacccccccttctccttcaagaacgtcatcagcctgacagaagatgtggatgagttccggaataaactgcagggagagcggatctcaggcaacctggatgctcctgagggcggcttcgatgccatcctgcagacagctgtgtgcacgagggacattggctggcgcccggacagcacccacctgctggtcttctccaccgagtcagccttccactatgaggctgatggcgccaacgtgctggctggcatcatgagccgcaacgatgaacggtgccacctggacaccacgggcacctacacccagtacaggacacaggactacccgtcggtgcccaccctggtgcgcctgctcgccaagcacaacatcatccccatctttgctgtcaccaactactcctatagctactacgagaagcttcacacctatttccctgtctcctcactgggggtgctgcaggaggactcgtccaacatcgtggagctgctggaggaggccttcaatcggatccgctccaacctggacatccgggccctagacagcccccgaggccttcggacagaggtcacctccaagatgttccagaagacgaggactgggtcctttcacatccggcggggggaagtgggtatataccaggtgcagctgcgggcccttgagcacgtggatgggacgcacgtgtgccagctgccggaggaccagaagggcaacatccatctgaaaccttccttctccgacggcctcaagatggacgcgggcatcatctgtgatgtgtgcacctgcgagctgcaaaaagaggtgcggtcagctcgctgcagcttcaacggagacttcgtgtgcggacagtgtgtgtgcagcgagggctggagtggccagacctgcaactgctccaccggctctctgagtgacattcagccctgcctgcgggagggcgaggacaagccgtgctccggccgtggggagtgccagtgcgggcactgtgtgtgctacggcgaaggccgctacgagggtcagttctgcgagtatgacaacttccagtgtccccgcacttccgggttcctctgcaatgaccgaggacgctgctccatgggccagtgtgtgtgtgagcctggttggacaggcccaagctgtgactgtcccctcagcaatgccacctgcatcgacagcaatgggggcatctgtaatggacgtggccactgtgagtgtggccgctgccactgccaccagcagtcgctctacacggacaccatctgcgagatcaactactcggcgatccacccgggcctctgcgaggacctacgctcctgcgtgcagtgccaggcgtggggcaccggcgagaagaaggggcgcacgtgtgaggaatgcaacttcaaggtcaagatggtggacgagcttaagagagccgaggaggtggtggtgcgctgctccttccgggacgaggatgacgactgcacctacagctacaccatggaaggtgacggcgcccctgggcccaacagcactgtcctggtgcacaagaagaaggactgccctccgggctccttctggtggctcatccccctgctcctcctcctcctgccgctcctggccctgctactgctgctatgctggaagtactgtgcctgctgcaaggcctgcctggcacttctcccgtgctgcaaccgaggtcacatggtgggctttaaggaagaccactacatgctgcgggagaacctgatggcctctgaccacttggacacgcccatgctgcgcagcgggaacctcaagggccgtgacgtggtccgctggaaggtcaccaacaacatgcagcggcctggctttgccactcatgccgccagcatcaaccccacagagctggtgccctacgggctgtccttgcgcctggcccgcctttgcaccgagaacctgctgaagcctgacactcgggagtgcgcccagctgcgccaggaggtggaggagaacgtaaggacccaggaactaggcctggccggagatgtggctgaacgaggtctacaggcagatctccggtgtacacaagctccagcagaccaagttccggcagcagcccaatgccgggaaaaagcaagaccacaccattgtggacacagtgctgatggcgccccgctcggccaagccggccctgctgaagcttacagagaagcaggtggaacagagggccttccacgacctcaaggtggcccccggctactacaccctcactgcagaccaggacgcccggggcatggtggagttccaggagggcgtggagctggtggacgtacgggtgcccctctttatccggcctgaggatgacgacgagaagcagctgctggtggaggccatcgacgtgcccgcaggcactgccaccctcggccgccgcctggtaaacatcaccatcatcaaggagcaagccagagacgtggtgtcctttgagcagcctgagttctcggtcagccgcggggaccaggtggcccgcatccctgtcatccggcgtgtcctggacggcgggaagtcccaggtctcctaccgcacacaggatggcaccgcgcagggcaaccgggactacatccccgtggagggtgagctgctgttccagcctggggaggcctggaaagagctgcaggtgaagctcctggagctgcaagaagttgactccctcctgcggggccgccaggtccgccgtttccacgtccagctcagcaaccctaagtttggggcccacctgggccagccccactccaccaccatcatcatcagggacccagatgaactggaccggagcttcacgagtcagatgttgtcatcacagccaccccctcacggcgacctgggcgccccgcagaaccccaatgctaaggccgctgggtccaggaagatccatttcaactggctgcccccttctggcaagccaatggggtacagggtaaagtactggattcagggtgactccgaatccgaagcccacctgctcgacagcaaggtgccctcagtggagctcaccaacctgtacccgtattgcgactatgagatgaaggtgtgcgcctacggggctcagggcgagggaccctacagctccctggtgtcctgccgcacccaccaggaagtgcccagcgagccagggcgtctggccttcaatgtcgtctcctccacggtgacccagctgagctgggctgagccggctgagaccaacggtgagatcacagcctacgaggtctgctatggcctggtcaacgatgacaaccgacctattgggcccatgaagaaagtgctggttgacaaccctaagaaccggatgctgcttattgagaaccttcgggagtcccagccctaccgctacacggtgaaggcgcgcaacggggccggctgggggcctgagcgggaggccatcatcaacctggccacccagcccaagaggcccatgtccatccccatcatccctgacatccctatcgtggacgcccagagcggggaggactacgacagcttccttatgtacagcgatgacgttctacgctctccatcgggcagccagaggcccagcgtctccgatgacactgagcacctggtgaatggccggatggactttgccttcccgggcagcaccaactccctgcacaggatgaccacgaccagtgctgctgcctatggcacccacctgagcccacacgtgccccaccgcgtgctaagcacatcctccaccctcacacgggactacaactcactgacccgctcagaacactcacactcgaccacactgcccagggactactccaccctcacctccgtctcctcccacgactctcgcctgactgctggtgtgcccgacacgcccacccgcctggtgttctctgccctggggcccacatctctcagagtgagctggcaggagccgcggtgcgagcggccgctgcagggctacagtgtggagtaccagctgctgaacggcggtgagctgcatcggctcaacatccccaaccctgcccagacctcggtggtggtggaagacctcctgcccaaccactcctacgtgttccgcgtgcgggcccagagccaggaaggctggggccgagagcgtgagggtgtcatcaccattgaatcccaggtgcacccgcagagcccactgtgtcccctgccaggctccgccttcactttgagcactcccagtgccccaggcccgctggtgttcactgccctgagcccagactcgctgcagctgagctgggagcggccacggaggcccaatggggatatcgtcggctacctggtgacctgtgagatggcccaaggaggagggccagccaccgcattccgggtggatggagacagccccgagagccggctgaccgtgccgggcctcagcgagaacgtgccctacaagttcaaggtgcaggccaggaccactgagggcttcgggccagagcgcgagggcatcatcaccatagagtcccaggatggaggacccttcccgcagctgggcagccgtgccgggctcttccagcacccgctgcaaagcgagtacagcagcatcaccaccacccacaccagcgccaccgagcccttcctagtggatgggccgaccctgggggcccagcacctggaggcaggcggctccctcacccggcatgtgacccaggagtttgtgagccggacactgaccaccagcggaacccttagcacccacatggaccaacagttcttccaaacttgaccgcaccctgccccacccccgccatgtcccactaggcgtcctcccgactcctctcccggagcctcctcagctactccatccttgcacccctgggggcccagcccacccgcatgcacagagcaggggctaggtgtctcctgggaggcatgaagggggcaaggtccgtcctctgtgggcccaaacctatttgtaaccaaagagctgggagcagcacaaggacccagcctttgttctgcacttaataaatggttttgctactgcta

SEQ ID NO: 330362 - DNA, 5869 bp, Homo sapiens
  misc_feature (28)..(28): n is a, c, g, or t
  misc_feature (30)..(30): n is a, c, g, or t
gcgctgcccgcctcgtccccaccccccnancccccgcgcccgccctcggacagtccctgctcgcccgcgcgctgcagccccatctcctagcggcagcccaggcgcggagggagcgagtccgccccgaggtaggtccaggacgggcgcacagcagcagccgaggctggccgggagagggaggaagaggatggcagggccacgccccagcccatgggccaggctgctcctggcagccttgatcagcgtcagcctctctgggaccttggcaaaccgctgcaagaaggccccagtgaagagctgcacggagtgtgtccgtgtggataaggactgcgcctactgcacagacgagatgttcagggaccggcgctgcaacacccaggcggagctgctggccgcgggctgccagcgggagagcatcgtggtcatggagagcagcttccaaatcacagaggagacccagattgacaccaccctgcggcgcagccagatgtccccccaaggcctgcgggtccgtctgcggcccggtgaggagcggcattttgagctggaggtgtttgagccactggagagccccgtggacctgtacatcctcatggacttctccaactccatgtccgatgatctggacaacctcaagaagatggggcagaacctggctcgggtcctgagccagctcaccagcgactacactattggatttggcaagtttgtggacaaagtcagcgtcccgcagacggacatgaggcctgagaagctgaaggagccctggcccaacagtgacccccccttctccttcaagaacgtcatcagcctgacagaagatgtggatgagttccggaataaactgcagggagagcggatctcaggcaacctggatgctcctgagggcggcttcgatgccatcctgcagacagctgtgtgcacgagggacattggctggcgcccggacagcacccacctgctggtcttctccaccgagtcagccttccactatgaggctgatggcgccaacgtgctggctggcatcatgagccgcaacgatgaacggtgccacctggacaccacgggcacctacacccagtacaggacacaggactacccgtcggtgcccaccctggtgcgcctgctcgccaagcacaacatcatccccatctttgctgtcaccaactactcctatagctactacgagaagcttcacacctatttccctgtctcctcactgggggtgctgcaggaggactcgtccaacatcgtggagctgctggaggaggccttcaatcggatccgctccaacctggacatccgggccctagacagcccccgaggccttcggacagaggtcacctccaagatgttccagaagacgaggactgggtcctttcacatccggcggggggaagtgggtatataccaggtgcagctgcgggcccttgagcacgtggatgggacgcacgtgtgccagctgccggaggaccagaagggcaacatccatctgaaaccttccttctccgacggcctcaagatggacgcgggcatcatctgtgatgtgtgcacctgcgagctgcaaaaagaggtgcggtcagctcgctgcagcttcaacggagacttcgtgtgcggacagtgtgtgtgcagcgagggctggagtggccagacctgcaactgctccaccggctctctgagtgacattcagccctgcctgcgggagggcgaggacaagccgtgctccggccgtggggagtgccagtgcgggcactgtgtgtgctacggcgaaggccgctacgagggtcagttctgcgagtatgacaacttccagtgtccccgcacttccgggttcctctgcaatgaccgaggacgctgctccatgggccagtgtgtgtgtgagcctggttggacaggcccaagctgtgactgtcccctcagcaatgccacctgcatcgacagcaatgggggcatctgtaatggacgtggccactgtgagtgtggccgctgccactgccaccagcagtcgctctacacggacaccatctgcgagatcaactactcggcgatccacccgggcctctgcgaggacctacgctcctgcgtgcagtgccaggcgtggggcaccggcgagaagaaggggcgcacgtgtgaggaatgcaacttcaaggtcaagatggtggacgagcttaagagagccgaggaggtggtggtgcgctgctccttccgggacgaggatgacgactgcacctacagctacaccatggaaggtgacggcgcccctgggcccaacagcactgtcctggtgcacaagaagaaggactgccctccgggctccttctggtggctcatccccctgctcctcctcctcctgccgctcctggccctgctactgctgctatgctggaagtactgtgcctgctgcaaggcctgcctggcacttctcccgtgctgcaaccgaggtcacatggtgggctttaaggaagaccactacatgctgcgggagaacctgatggcctctgaccacttggacacgcccatgctgcgcagcgggaacctcaagggccgtgacgtggtccgctggaaggtcaccaacaacatgcagcggcctggctttgccactcatgccgccagcatcaaccccacagagctggtgccctacgggctgtccttgcgcctggcccgcctttgcaccgagaacctgctgaagcctgacactcgggagtgcgcccagctgcgccaggaggtggaggagaacgtaaggacccaggaactaggcctggccggagatgtggctgaacgaggtctacaggcagatctccggtgtacacaagctccagcagaccaagttccggcagcagcccaatgccgggaaaaagcaagaccacaccattgtggacacagtgctgatggcgccccgctcggccaagccggccctgctgaagcttacagagaagcaggtggaacagagggccttccacgacctcaaggtggcccccggctactacaccctcactgcagaccaggacgcccggggcatggtggagttccaggagggcgtggagctggtggacgtacgggtgcccctctttatccggcctgaggatgacgacgagaagcagctgctggtggaggccatcgacgtgcccgcaggcactgccaccctcggccgccgcctggtaaacatcaccatcatcaaggagcaagccagagacgtggtgtcctttgagcagcctgagttctcggtcagccgcggggaccaggtggcccgcatccctgtcatccggcgtgtcctggacggcgggaagtcccaggtctcctaccgcacacaggatggcaccgcgcagggcaaccggacagagtttcgctcttgttgcccaggctggagtgcaatggcacaatctcagctcaccgcaacctccacctctcgggttcaagcgattctgctgcctcagcctccctagtagctgggattacaggactacatccccgtggagggtgagctgctgttccagcctggggaggcctggaaagagctgcaggtgaagctcctggagctgcaagaagttgactccctcctgcggggccgccaggtccgccgtttccacgtccagctcagcaaccctaagtttggggcccacctgggccagccccactccaccaccatcatcatcagggacccagatgaactggaccggagcttcacgagtcagatgttgtcatcacagccaccccctcacggcgacctgggcgccccgcagaaccccaatgctaaggccgctgggtccaggaagatccatttcaactggctgcccccttctggcaagccaatggggtacagggtaaagtactggattcagggtgactccgaatccgaagcccacctgctcgacagcaaggtgccctcagtggagctcaccaacctgtacccgtattgcgactatgagatgaaggtgtgcgcctacggggctcagggcgagggaccctacagctccctggtgtcctgccgcacccaccaggaagtgcccagcgagccagggcgtctggccttcaatgtcgtctcctccacggtgacccagctgagctgggctgagccggctgagaccaacggtgagatcacagcctacgaggtctgctatggcctggtcaacgatgacaaccgacctattgggcccatgaagaaagtgctggttgacaaccctaagaaccggatgctgcttattgagaaccttcgggagtcccagccctaccgctacacggtgaaggcgcgcaacggggccggctgggggcctgagcgggaggccatcatcaacctggccacccagcccaagaggcccatgtccatccccatcatccctgacatccctatcgtggacgcccagagcggggaggactacgacagcttccttatgtacagcgatgacgttctacgctctccatcgggcagccagaggcccagcgtctccgatgacactgagcacctggtgaatggccggatggactttgccttcccgggcagcaccaactccctgcacaggatgaccacgaccagtgctgctgcctatggcacccacctgagcccacacgtgccccaccgcgtgctaagcacatcctccaccctcacacgggactacaactcactgacccgctcagaacactcacactcgaccacactgcccagggactactccaccctcacctccgtctcctcccacgactctcgcctgactgctggtgtgcccgacacgcccacccgcctggtgttctctgccctggggcccacatctctcagagtgagctggcaggagccgcggtgcgagcggccgctgcagggctacagtgtggagtaccagctgctgaacggcggtgagctgcatcggctcaacatccccaaccctgcccagacctcggtggtggtggaagacctcctgcccaaccactcctacgtgttccgcgtgcgggcccagagccaggaaggctggggccgagagcgtgagggtgtcatcaccattgaatcccaggtgcacccgcagagcccactgtgtcccctgccaggctccgccttcactttgagcactcccagtgccccaggcccgctggtgttcactgccctgagcccagactcgctgcagctgagctgggagcggccacggaggcccaatggggatatcgtcggctacctggtgacctgtgagatggcccaaggaggagggccagccaccgcattccgggtggatggagacagccccgagagccggctgaccgtgccgggcctcagcgagaacgtgccctacaagttcaaggtgcaggccaggaccactgagggcttcgggccagagcgcgagggcatcatcaccatagagtcccaggatggaggacccttcccgcagctgggcagccgtgccgggctcttccagcacccgctgcaaagcgagtacagcagcatcaccaccacccacaccagcgccaccgagcccttcctagtggatgggccgaccctgggggcccagcacctggaggcaggcggctccctcacccggcatgtgacccaggagtttgtgagccggacactgaccaccagcggaacccttagcacccacatggaccaacagttcttccaaacttgaccgcaccctgccccacccccgccatgtcccactaggcgtcctcccgactcctctcccggagcctcctcagctactccatccttgcacccctgggggcccagcccacccgcatgcacagagcaggggctaggtgtctcctgggaggcatgaagggggcaaggtccgtcctctgtgggcccaaacctatttgtaaccaaagagctgggagcagcacaaggacccagcctttgttctgcacttaataaatggttttgctactgcta

SEQ ID NO: 330363 - DNA, 5848 bp, Homo sapiens
  misc_feature (28)..(28): n is a, c, g, or t
  misc_feature (30)..(30): n is a, c, g, or t
  misc_feature (5770)..(5770): n is a, c, g, or t
  misc_feature (5787)..(5787): n is a, c, g, or t
  misc_feature (5830)..(5830): n is a, c, g, or t
gcgctgcccgcctcgtccccaccccccnancccccgcgcccgccctcggacagtccctgctcgcccgcgcgctgcagccccatctcctagcggcagcccaggcgcggagggagcgagtccgccccgaggtaggtccaggacgggcgcacagcagcagccgaggctggccgggagagggaggaagaggatggcagggccacgccccagcccatgggccaggctgctcctggcagccttgatcagcgtcagcctctctgggaccttggcaaaccgctgcaagaaggccccagtgaagagctgcacggagtgtgtccgtgtggataaggactgcgcctactgcacagacgagatgttcagggaccggcgctgcaacacccaggcggagctgctggccgcgggctgccagcgggagagcatcgtggtcatggagagcagcttccaaatcacagaggagacccagattgacaccaccctgcggcgcagccagatgtccccccaaggcctgcgggtccgtctgcggcccggtgaggagcggcattttgagctggaggtgtttgagccactggagagccccgtggacctgtacatcctcatggacttctccaactccatgtccgatgatctggacaacctcaagaagatggggcagaacctggctcgggtcctgagccagctcaccagcgactacactattggatttggcaagtttgtggacaaagtcagcgtcccgcagacggacatgaggcctgagaagctgaaggagccctggcccaacagtgacccccccttctccttcaagaacgtcatcagcctgacagaagatgtggatgagttccggaataaactgcagggagagcggatctcaggcaacctggatgctcctgagggcggcttcgatgccatcctgcagacagctgtgtgcacgagggacattggctggcgcccggacagcacccacctgctggtcttctccaccgagtcagccttccactatgaggctgatggcgccaacgtgctggctggcatcatgagccgcaacgatgaacggtgccacctggacaccacgggcacctacacccagtacaggacacaggactacccgtcggtgcccaccctggtgcgcctgctcgccaagcacaacatcatccccatctttgctgtcaccaactactcctatagctactacgagaagcttcacacctatttccctgtctcctcactgggggtgctgcaggaggactcgtccaacatcgtggagctgctggaggaggccttcaatcggatccgctccaacctggacatccgggccctagacagcccccgaggccttcggacagaggtcacctccaagatgttccagaagacgaggactgggtcctttcacatccggcggggggaagtgggtatataccaggtgcagctgcgggcccttgagcacgtggatgggacgcacgtgtgccagctgccggaggaccagaagggcaacatccatctgaaaccttccttctccgacggcctcaagatggacgcgggcatcatctgtgatgtgtgcacctgcgagctgcaaaaagaggtgcggtcagctcgctgcagcttcaacggagacttcgtgtgcggacagtgtgtgtgcagcgagggctggagtggccagacctgcaactgctccaccggctctctgagtgacattcagccctgcctgcgggagggcgaggacaagccgtgctccggccgtggggagtgccagtgcgggcactgtgtgtgctacggcgaaggccgctacgagggtcagttctgcgagtatgacaacttccagtgtccccgcacttccgggttcctctgcaatgaccgaggacgctgctccatgggccagtgtgtgtgtgagcctggttggacaggcccaagctgtgactgtcccctcagcaatgccacctgcatcgacagcaatgggggcatctgtaatggacgtggccactgtgagtgtggccgctgccactgccaccagcagtcgctctacacggacaccatctgcgagatcaactactcggcgatccacccgggcctctgcgaggacctacgctcctgcgtgcagtgccaggcgtggggcaccggcgagaagaaggggcgcacgtgtgaggaatgcaacttcaaggtcaagatggtggacgagcttaagagagccgaggaggtggtggtgcgctgctccttccgggacgaggatgacgactgcacctacagctacaccatggaaggtgacggcgcccctgggcccaacagcactgtcctggtgcacaagaagaaggactgccctccgggctccttctggtggctcatccccctgctcctcctcctcctgccgctcctggccctgctactgctgctatgctggaagtactgtgcctgctgcaaggcctgcctggcacttctcccgtgctgcaaccgaggtcacatggtgggctttaaggaagaccactacatgctgcgggagaacctgatggcctctgaccacttggacacgcccatgctgcgcagcgggaacctcaagggccgtgacgtggtccgctggaaggtcaccaacaacatgcagcggcctggctttgccactcatgccgccagcatcaaccccacagagctggtgccctacgggctgtccttgcgcctggcccgcctttgcaccgagaacctgctgaagcctgacactcgggagtgcgcccagctgcgccaggaggtggaggagaacgtaaggacccaggaactaggcctggccggagatgtggctgaacgaggtctacaggcagatctccggtgtacacaagctccagcagaccaagttccggcagcagcccaatgccgggaaaaagcaagaccacaccattgtggacacagtgctgatggcgccccgctcggccaagccggccctgctgaagcttacagagaagcaggtggaacagagggccttccacgacctcaaggtggcccccggctactacaccctcactgcagaccaggacgcccggggcatggtggagttccaggagggcgtggagctggtggacgtacgggtgcccctctttatccggcctgaggatgacgacgagaagcagctgctggtggaggccatcgacgtgcccgcaggcactgccaccctcggccgccgcctggtaaacatcaccatcatcaaggagcaagccagagacgtggtgtcctttgagcagcctgagttctcggtcagccgcggggaccaggtggcccgcatccctgtcatccggcgtgtcctggacggcgggaagtcccaggtctcctaccgcacacaggatggcaccgcgcagggcaaccgggactacatccccgtggagggtgagctgctgttccagcctggggaggcctggaaagagctgcaggtgaagctcctggagctgcaagaagttgactccctcctgcggggccgccaggtccgccgtttccacgtccagctcagcaaccctaagtttggggcccacctgggccagccccactccaccaccatcatcatcagggacccagatgaactggaccggagcttcacgagtcagatgttgtcatcacagccaccccctcacggcgacctgggcgccccgcagaaccccaatgctaaggccgctgggtccaggaagatccatttcaactggctgcccccttctggcaagccaatggggtacagggtaaagtactggattcagggtgactccgaatccgaagcccacctgctcgacagcaaggtgccctcagtggagctcaccaacctgtacccgtattgcgactatgagatgaaggtgtgcgcctacggggctcagggcgagggaccctacagctccctggtgtcctgccgcacccaccaggaagtgcccagcgagccagggcgtctggccttcaatgtcgtctcctccacggtgacccagctgagctgggctgagccggctgagaccaacggtgagatcacagcctacgaggtctgctatggcctggtcaacgatgacaaccgacctattgggcccatgaagaaagtgctggttgacaaccctaagaaccggatgctgcttattgagaaccttcgggagtcccagccctaccgctacacggtgaaggcgcgcaacggggccggctgggggcctgagcgggaggccatcatcaacctggccacccagcccaagaggcccatgtccatccccatcatccctgacatccctatcgtggacgcccagagcggggaggactacgacagcttccttatgtacagcgatgacgttctacgctctccatcgggcagccagaggcccagcgtctccgatgacactgagcacctggtgaatggccggatggactttgccttcccgggcagcaccaactccctgcacaggatgaccacgaccagtgctgctgcctatggcacccacctgagcccacacgtgccccaccgcgtgctaagcacatcctccaccctcacacgggactacaactcactgacccgctcagaacactcacactcgaccacactgcccagggactactccaccctcacctccgtctcctcccacgactctcgcctgactgctggtgtgcccgacacgcccacccgcctggtgttctctgccctggggcccacatctctcagagtgagctggcaggagccgcggtgcgagcggccgctgcagggctacagtgtggagtaccagctgctgaacggcggtgagctgcatcggctcaacatccccaaccctgcccagacctcggtggtggtggaagacctcctgcccaaccactcctacgtgttccgcgtgcgggcccagagccaggaaggctggggccgagagcgtgagggtgtcatcaccattgaatcccaggtgcacccgcagagcccactgtgtcccctgccaggctccgccttcactttgagcactcccagtgccccaggcccgctggtgttcactgccctgagcccagactcgctgcagctgagctgggagcggccacggaggcccaatggggatatcgtcggctacctggtgacctgtgagatggcccaaggaggagggccagccaccgcattccgggtggatggagacagccccgagagccggctgaccgtgccgggcctcagcgagaacgtgccctacaagttcaaggtgcaggccaggaccactgagggcttcgggccagagcgcgagggcatcatcaccatagagtcccaggatggaggacccttcccgcagctgggcagccgtgccgggctcttccagcacccgctgcaaagcgagtacagcagcatcaccaccacccacaccagcgccaccgagcccttcctagtggatgggccgaccctgggggcccagcacctggaggcaggcggctccctcacccggcatgtgacccaggagtttgtgagccggacactgaccaccagcggaacccttagcacccacatggaccaacagttcttccaaacttgaccgcaccctgccccacccccgccatgtcccactaggcgtcctcccgactcctctcccggagcctcctcagctactccatccttgcacccctgggggcccagcccacccgcatgcacagagcaggggctaggtgtctcctgggaggcatgaagggggcaaggtccgtcctctgtgggcccaaacctatttgtaaccaaagagctgggagcagcacaaggacccagcctttgttctgcacttaataaatggttttgctactgctaaaaaaaagaaaaaaaaaattcggnggggggggcccggttancccaatttcgggccctattaggtgaggtcgtatttacaatttnatttggcccgttggtttt

SEQ ID NO: 330364 - DNA, 5697 bp, Homo sapiens
  misc_feature (28)..(28): n is a, c, g, or t
  misc_feature (30)..(30): n is a, c, g, or t
gcgctgcccgcctcgtccccaccccccnancccccgcgcccgccctcggacagtccctgctcgcccgcgcgctgcagccccatctcctagcggcagcccaggcgcggagggagcgagtccgccccgaggtaggtccaggacgggcgcacagcagcagccgaggctggccgggagagggaggaagaggatggcagggccacgccccagcccatgggccaggctgctcctggcagccttgatcagcgtcagcctctctgggaccttggcaaaccgctgcaagaaggccccagtgaagagctgcacggagtgtgtccgtgtggataaggactgcgcctactgcacagacgagatgttcagggaccggcgctgcaacacccaggcggagctgctggccgcgggctgccagcgggagagcatcgtggtcatggagagcagcttccaaatcacagaggagacccagattgacaccaccctgcggcgcagccagatgtccccccaaggcctgcgggtccgtctgcggcccggtgaggagcggcattttgagctggaggtgtttgagccactggagagccccgtggacctgtacatcctcatggacttctccaactccatgtccgatgatctggacaacctcaagaagatggggcagaacctggctcgggtcctgagccagctcaccagcgactacactattggatttggcaagtttgtggacaaagtcagcgtcccgcagacggacatgaggcctgagaagctgaaggagccctggcccaacagtgacccccccttctccttcaagaacgtcatcagcctgacagaagatgtggatgagttccggaataaactgcagggagagcggatctcaggcaacctggatgctcctgagggcggcttcgatgccatcctgcagacagctgtgtgcacgagggacattggctggcgcccggacagcacccacctgctggtcttctccaccgagtcagccttccactatgaggctgatggcgccaacgtgctggctggcatcatgagccgcaacgatgaacggtgccacctggacaccacgggcacctacacccagtacaggacacaggactacccgtcggtgcccaccctggtgcgcctgctcgccaagcacaacatcatccccatctttgctgtcaccaactactcctatagctactacgagaagcttcacacctatttccctgtctcctcactgggggtgctgcaggaggactcgtccaacatcgtggagctgctggaggaggccttcaatcggatccgctccaacctggacatccgggccctagacagcccccgaggccttcggacagaggtcacctccaagatgttccagaagacgaggactgggtcctttcacatccggcggggggaagtgggtatataccaggtgcagctgcgggcccttgagcacgtggatgggacgcacgtgtgccagctgccggaggaccagaagggcaacatccatctgaaaccttccttctccgacggcctcaagatggacgcgggcatcatctgtgatgtgtgcacctgcgagctgcaaaaagaggtgcggtcagctcgctgcagcttcaacggagacttcgtgtgcggacagtgtgtgtgcagcgagggctggagtggccagacctgcaactgctccaccggctctctgagtgacattcagccctgcctgcgggagggcgaggacaagccgtgctccggccgtggggagtgccagtgcgggcactgtgtgtgctacggcgaaggccgctacgagggtcagttctgcgagtatgacaacttccagtgtccccgcacttccgggttcctctgcaatgaccgaggacgctgctccatgggccagtgtgtgtgtgagcctggttggacaggcccaagctgtgactgtcccctcagcaatgccacctgcatcgacagcaatgggggcatctgtaatggacgtggccactgtgagtgtggccgctgccactgccaccagcagtcgctctacacggacaccatctgcgagatcaactactcggcgatccacccgggcctctgcgaggacctacgctcctgcgtgcagtgccaggcgtggggcaccggcgagaagaaggggcgcacgtgtgaggaatgcaacttcaaggtcaagatggtggacgagcttaagagagccgaggaggtggtggtgcgctgctccttccgggacgaggatgacgactgcacctacagctacaccatggaaggtgacggcgcccctgggcccaacagcactgtcctggtgcacaagaagaaggactgccctccgggctccttctggtggctcatccccctgctcctcctcctcctgccgctcctggccctgctactgctgctatgctggaagtactgtgcctgctgcaaggcctgcctggcacttctcccgtgctgcaaccgaggtcacatggtgggctttaaggaagaccactacatgctgcgggagaacctgatggcctctgaccacttggacacgcccatgctgcgcagcgggaacctcaagggccgtgacgtggtccgctggaaggtcaccaacaacatgcagcggcctggctttgccactcatgccgccagcatcaaccccacagagctggtgccctacgggctgtccttgcgcctggcccgcctttgcaccgagaacctgctgaagcctgacactcgggagtgcgcccagctgcgccaggaggtggaggagaacgtaaggacccaggaactaggcctggccggagatgtggctgaacgaggtctacaggcagatctccggtgtacacaagctccagcagaccaagttccggcagcagcccaatgccgggaaaaagcaagaccacaccattgtggacacagtgctgatggcgccccgctcggccaagccggccctgctgaagcttacagagaagcaggtggaacagagggccttccacgacctcaaggtggcccccggctactacaccctcactgcagaccaggacgcccggggcatggtggagttccaggagggcgtggagctggtggacgtacgggtgcccctctttatccggcctgaggatgacgacgagaagcagctgctggtggaggccatcgacgtgcccgcaggcactgccaccctcggccgccgcctggtaaacatcaccatcatcaaggagcaagccagagacgtggtgtcctttgagcagcctgagttctcggtcagccgcggggaccaggtggcccgcatccctgtcatccggcgtgtcctggacggcgggaagtcccaggtctcctaccgcacacaggatggcaccgcgcagggcaaccgggactacatccccgtggagggtgagctgctgttccagcctggggaggcctggaaagagctgcaggtgaagctcctggagctgcaagaagttgactccctcctgcggggccgccaggtccgccgtttccacgtccagctcagcaaccctaagtttggggcccacctgggccagccccactccaccaccatcatcatcagggacccagatgaactggaccggagcttcacgagtcagatgttgtcatcacagccaccccctcacggcgacctgggcgccccgcagaaccccaatgctaaggccgctgggtccaggaagatccatttcaactggctgcccccttctggcaagccaatggggtacagggtaaagtactggattcagggtgactccgaatccgaagcccacctgctcgacagcaaggtgccctcagtggagctcaccaacctgtacccgtattgcgactatgagatgaaggtgtgcgcctacggggctcagggcgagggaccctacagctccctggtgtcctgccgcacccaccaggaagtgcccagcgagccagggcgtctggccttcaatgtcgtctcctccacggtgacccagctgagctgggctgagccggctgagaccaacggtgagatcacagcctacgaggtctgctatggcctggtcaacgatgacaaccgacctattgggcccatgaagaaagtgctggttgacaaccctaagaaccggatgctgcttattgagaaccttcgggagtcccagccctaccgctacacggtgaaggcgcgcaacggggccggctgggggcctgagcgggaggccatcatcaacctggccacccagcccaagaggcccatgtccatccccatcatccctgacatccctatcgtggacgcccagagcggggaggactacgacagcttccttatgtacagcgatgacgttctacgctctccatcgggcagccagaggcccagcgtctccgatgacactgagcacctggtgaatggccggatggactttgccttcccgggcagcaccaactccctgcacaggatgaccacgaccagtgctgctgcctatggcacccacctgagcccacacgtgccccaccgcgtgctaagcacatcctccaccctcacacgggactacaactcactgacccgctcagaacactcacactcgaccacactgcccagggactactccaccctcacctccgtctcctcccacgactctcgcctgactgctggtgtgcccgacacgcccacccgcctggtgttctctgccctggggcccacatctctcagagtgagctggcaggagccgcggtgcgagcggccgctgcagggctacagtgtggagtaccagctgctgaacggcggtgagctgcatcggctcaacatccccaaccctgcccagacctcggtggtggtggaagacctcctgcccaaccactcctacgtgttccgcgtgcgggcccagagccaggaaggctggggccgagagcgtgagggtgtcatcaccattgaatcccaggtgcacccgcagagcccactgtgtcccctgccaggctccgccttcactttgagcactcccagtgccccaggcccgctggtgttcactgccctgagcccagactcgctgcagctgagctgggagcggccacggaggcccaatggggatatcgtcggctacctggtgacctgtgagatggcccaaggaggagggccagccaccgcattccgggtggatggagacagccccgagagccggctgaccgtgccgggcctcagcgagaacgtgccctacaagttcaaggtgcaggccaggaccactgagggcttcgggccagagcgcgagggcatcatcaccatagagtcccaggatggaggacccttcccgcagctgggcagccgtgccgggctcttccagcacccgctgcaaagcgagtacagcagcatcaccaccacccacaccagcgccaccgagcccttcctagtggatgggccgaccctgggggcccagcacctggaggcaggcggctccctcacccggcatgtgacccaggagtttgtgagccggacactgaccaccagcggaacccttagcacccacatggaccaacagttcttccaaacttgaccgcaccctgccccacccccgccatgtcccactaggcgtcctcccgactcctctcccggagcctcctcagctactccatccttgcacccctgggggcccagcccacccgcatgcacagagcaggggctaggtgtctcctgggaggcatgaagggggcaaggtccgtcctctgggcccgtccagtctctgggccccgtccagtctctgggccccg

SEQ ID NO: 330365 - DNA, 2720 bp, Homo sapiens
ccggcactttggaaaggctgaagtggtttgatcacctgaggtccggagttcaaagaccagcctggtctacacagagcattattccctttctaattttttaccttacttatccattttaaaacttattttagcaaggaggcatactagagtaatatataacgtaaagaatccgcttgttagtgtaactactcccaaccttatctagtccgagagtcccaagttatttatgtggttgggagggagcgtgtggccatgactcttgcctcagcccccagccatgaccctgaccctgaccccctccactcccaggactacatccccgtggagggtgagctgctgttccagcctggggaggcctggaaagagctgcaggtgaagctcctggagctgcaagaagttgactccctcctgcggggccgccaggtccgccgtttccacgtccagctcagcaaccctaagtttggggcccacctgggccagccccactccaccaccatcatcatcagggacccagatgaactggaccggagcttcacgagtcagatgttgtcatcacagccaccccctcacggcgacctgggcgccccgcagaaccccaatgctaaggccgctgggtccaggaagatccatttcaactggctgcccccttctggcaagccaatggggtacagggtaaagtactggattcagggtgactccgaatccgaagcccacctgctcgacagcaaggtgccctcagtggagctcaccaacctgtacccgtattgcgactatgagatgaaggtgtgcgcctacggggctcagggcgagggaccctacagctccctggtgtcctgccgcacccaccaggaagtgcccagcgagccagggcgtctggccttcaatgtcgtctcctccacggtgacccagctgagctgggctgagccggctgagaccaacggtgagatcacagcctacgaggtctgctatggcctggtcaacgatgacaaccgacctattgggcccatgaagaaagtgctggttgacaaccctaagaaccggatgctgcttattgagaaccttcgggagtcccagccctaccgctacacggtgaaggcgcgcaacggggccggctgggggcctgagcgggaggccatcatcaacctggccacccagcccaagaggcccatgtccatccccatcatccctgacatccctatcgtggacgcccagagcggggaggactacgacagcttccttatgtacagcgatgacgttctacgctctccatcgggcagccagaggcccagcgtctccgatgacactgagcacctggtgaatggccggatggactttgccttcccgggcagcaccaactccctgcacaggatgaccacgaccagtgctgctgcctatggcacccacctgagcccacacgtgccccaccgcgtgctaagcacatcctccaccctcacacgggactacaactcactgacccgctcagaacactcacactcgaccacactgcccagggactactccaccctcacctccgtctcctcccacgactctcgcctgactgctggtgtgcccgacacgcccacccgcctggtgttctctgccctggggcccacatctctcagagtgagctggcaggagccgcggtgcgagcggccgctgcagggctacagtgtggagtaccagctgctgaacggcggtgagctgcatcggctcaacatccccaaccctgcccagacctcggtggtggtggaagacctcctgcccaaccactcctacgtgttccgcgtgcgggcccagagccaggaaggctggggccgagagcgtgagggtgtcatcaccattgaatcccaggtgcacccgcagagcccactgtgtcccctgccaggctccgccttcactttgagcactcccagtgccccaggcccgctggtgttcactgccctgagcccagactcgctgcagctgagctgggagcggccacggaggcccaatggggatatcgtcggctacctggtgacctgtgagatggcccaaggaggagggccagccaccgcattccgggtggatggagacagccccgagagccggctgaccgtgccgggcctcagcgagaacgtgccctacaagttcaaggtgcaggccaggaccactgagggcttcgggccagagcgcgagggcatcatcaccatagagtcccaggatggaggacccttcccgcagctgggcagccgtgccgggctcttccagcacccgctgcaaagcgagtacagcagcatcaccaccacccacaccagcgccaccgagcccttcctagtggatgggccgaccctgggggcccagcacctggaggcaggcggctccctcacccggcatgtgacccaggagtttgtgagccggacactgaccaccagcggaacccttagcacccacatggaccaacagttcttccaaacttgaccgcaccctgccccacccccgccatgtcccactaggcgtcctcccgactcctctcccggagcctcctcagctactccatccttgcacccctgggggcccagcccacccgcatgcacagagcaggggctaggtgtctcctgggaggcatgaagggggcaaggtccgtcctctgtgggcccaaacctatttgtaaccaaagagctgggagcagcacaaggacccagcctttgttctgcacttaataaatggttttgctactgcta

SEQ ID NO: 330366 - DNA, 5288 bp, Homo sapiens
  misc_feature (28)..(28): n is a, c, g, or t
  misc_feature (30)..(30): n is a, c, g, or t
gcgctgcccgcctcgtccccaccccccnancccccgcgcccgccctcggacagtccctgctcgcccgcgcgctgcagccccatctcctagcggcagcccaggcgcggagggagcgagtccgccccgaggtaggtccaggacgggcgcacagcagcagccgaggctggccgggagagggaggaagaggatggcagggccacgccccagcccatgggccaggctgctcctggcagccttgatcagcgtcagcctctctgggaccttggcaaaccgctgcaagaaggccccagtgaagagctgcacggagtgtgtccgtgtggataaggactgcgcctactgcacagacgagatgttcagggaccggcgctgcaacacccaggcggagctgctggccgcgggctgccagcgggagagcatcgtggtcatggagagcagcttccaaatcacagaggagacccagattgacaccaccctgcggcgcagccagatgtccccccaaggcctgcgggtccgtctgcggcccggtgaggagcggcattttgagctggaggtgtttgagccactggagagccccgtggacctgtacatcctcatggacttctccaactccatgtccgatgatctggacaacctcaagaagatggggcagaacctggctcgggtcctgagccagctcaccagcgactacactattggatttggcaagtttgtggacaaagtcagcgtcccgcagacggacatgaggcctgagaagctgaaggagccctggcccaacagtgacccccccttctccttcaagaacgtcatcagcctgacagaagatgtggatgagttccggaataaactgcagggagagcggatctcaggcaacctggatgctcctgagggcggcttcgatgccatcctgcagacagctgtgtgcacgagggacattggctggcgcccggacagcacccacctgctggtcttctccaccgagtcagccttccactatgaggctgatggcgccaacgtgctggctggcatcatgagccgcaacgatgaacggtgccacctggacaccacgggcacctacacccagtacaggacacaggactacccgtcggtgcccaccctggtgcgcctgctcgccaagcacaacatcatccccatctttgctgtcaccaactactcctatagctactacgagaagcttcacacctatttccctgtctcctcactgggggtgctgcaggaggactcgtccaacatcgtggagctgctggaggaggccttcaatcggatccgctccaacctggacatccgggccctagacagcccccgaggccttcggacagaggtcacctccaagatgttccagaagacgaggactgggtcctttcacatccggcggggggaagtgggtatataccaggtgcagctgcgggcccttgagcacgtggatgggacgcacgtgtgccagctgccggaggaccagaagggcaacatccatctgaaaccttccttctccgacggcctcaagatggacgcgggcatcatctgtgatgtgtgcacctgcgagctgcaaaaagaggtgcggtcagctcgctgcagcttcaacggagacttcgtgtgcggacagtgtgtgtgcagcgagggctggagtggccagacctgcaactgctccaccggctctctgagtgacattcagccctgcctgcgggagggcgaggacaagccgtgctccggccgtggggagtgccagtgcgggcactgtgtgtgctacggcgaaggccgctacgagggtcagttctgcgagtatgacaacttccagtgtccccgcacttccgggttcctctgcaatgaccgaggacgctgctccatgggccagtgtgtgtgtgagcctggttggacaggcccaagctgtgactgtcccctcagcaatgccacctgcatcgacagcaatgggggcatctgtaatggacgtggccactgtgagtgtggccgctgccactgccaccagcagtcgctctacacggacaccatctgcgagatcaactactcggcgatccacccgggcctctgcgaggacctacgctcctgcgtgcagtgccaggcgtggggcaccggcgagaagaaggggcgcacgtgtgaggaatgcaacttcaaggtcaagatggtggacgagcttaagagagccgaggaggtggtggtgcgctgctccttccgggacgaggatgacgactgcacctacagctacaccatggaaggtgacggcgcccctgggcccaacagcactgtcctggtgcacaagaagaaggactgccctccgggctccttctggtggctcatccccctgctcctcctcctcctgccgctcctggccctgctactgctgctatgctggaagtactgtgcctgctgcaaggcctgcctggcacttctcccgtgctgcaaccgaggtcacatggtgggctttaaggaagaccactacatgctgcgggagaacctgatggcctctgaccacttggacacgcccatgctgcgcagcgggaacctcaagggccgtgacgtggtccgctggaaggtcaccaacaacatgcagcggcctggctttgccactcatgccgccagcatcaaccccacagagctggtgccctacgggctgtccttgcgcctggcccgcctttgcaccgagaacctgctgaagcctgacactcgggagtgcgcccagctgcgccaggaggtggaggagaacgtaaggacccaggaactaggcctggccggagatgtggctgaacgaggtctacaggcagatctccggtgtacacaagctccagcagaccaagttccggcagcagcccaatgccgggaaaaagcaagaccacaccattgtggacacagtgctgatggcgccccgctcggccaagccggccctgctgaagcttacagagaagcaggtggaacagagggccttccacgacctcaaggtggcccccggctactacaccctcactgcagaccaggacgcccggggcatggtggagttccaggagggcgtggagctggtggacgtacgggtgcccctctttatccggcctgaggatgacgacgagaagcagctgctggtggaggccatcgacgtgcccgcaggcactgccaccctcggccgccgcctggtaaacatcaccatcatcaaggagcaagccagagacgtggtgtcctttgagcagcctgagttctcggtcagccgcggggaccaggtggcccgcatccctgtcatccggcgtgtcctggacggcgggaagtcccaggtctcctaccgcacacaggatggcaccgcgcagggcaaccgggactacatccccgtggagggtgagctgctgttccagcctggggaggcctggaaagagctgcaggtgaagctcctggagctgcaagaagttgactccctcctgcggggccgccaggtccgccgtttccacgtccagctcagcaaccctaagtttggggcccacctgggccagccccactccaccaccatcatcatcagggacccagatgaactggaccggagcttcacgagtcagatgttgtcatcacagccaccccctcacggcgacctgggcgccccgcagaaccccaatgctaaggccgctgggtccaggaagatccatttcaactggctgcccccttctggcaagccaatggggtacagggtaaagtactggattcagggtgactccgaatccgaagcccacctgctcgacagcaaggtgccctcagtggagctcaccaacctgtacccgtattgcgactatgagatgaaggtgtgcgcctacggggctcagggcgagggaccctacagctccctggtgtcctgccgcacccaccaggaagtgcccagcgagccagggcgtctggccttcaatgtcgtctcctccacggtgacccagctgagctgggctgagccggctgagaccaacggtgagatcacagcctacgaggtctgctatggcctggtcaacgatgacaaccgacctattgggcccatgaagaaagtgctggttgacaaccctaagaaccggatgctgcttattgagaaccttcgggagtcccagccctaccgctacacggtgaaggcgcgcaacggggccggctgggggcctgagcgggaggccatcatcaacctggccacccagcccaagaggcccatgtccatccccatcatccctgacatccctatcgtggacgcccagagcggggaggactacgacagcttccttatgtacagcgatgacgttctacgctctccatcgggcagccagaggcccagcgtctccgatgacactgagcacctggtgaatggccggatggactttgccttcccgggcagcaccaactccctgcacaggatgaccacgaccagtgctgctgcctatggcacccacctgagcccacacgtgccccaccgcgtgctaagcacatcctccaccctcacacgggactacaactcactgacccgctcagaacactcacactcgaccacactgcccagggactactccaccctcacctccgtctcctcccacgactctcgcctgactgctggtgtgcccgacacgcccacccgcctggtgttctctgccctggggcccacatctctcagagtgagctggcaggagccgcggtgcgagcggccgctgcagggctacagtgtggagtaccagctgctgaacggcggtgagctgcatcggctcaacatccccaaccctgcccagacctcggtggtggtggaagacctcctgcccaaccactcctacgtgttccgcgtgcgggcccagagccaggaaggctggggccgagagcgtgagggtgtcatcaccattgaatcccaggtgcacccgcagagcccactgtgtcccctgccaggctccgccttcactttgagcactcccagtgccccaggcccgctggtgttcactgccctgagcccagactcgctgcagctgagctgggagcggccacggaggcccaatggggatatcgtcggctacctggtgacctgtgagatggcccaaggaggagggccagccaccgcattccgggtggatggagacagccccgagagccggctgaccgtgccgggcctcagcgagaacgtgccctacaagttcaaggtgcaggccaggaccactgagggcttcgggccagagcgcgagggcatcatcaccatagagtcccaggatggaggacccttcccgcagctgggcagtcgtgcggcctctacggcaacggggtagagctgc

SEQ ID NO: 330367 - DNA, 5073 bp, Homo sapiens
  misc_feature (28)..(28): n is a, c, g, or t
  misc_feature (30)..(30): n is a, c, g, or t
gcgctgcccgcctcgtccccaccccccnancccccgcgcccgccctcggacagtccctgctcgcccgcgcgctgcagccccatctcctagcggcagcccaggcgcggagggagcgagtccgccccgaggtaggtccaggacgggcgcacagcagcagccgaggctggccgggagagggaggaagaggatggcagggccacgccccagcccatgggccaggctgctcctggcagccttgatcagcgtcagcctctctgggaccttggcaaaccgctgcaagaaggccccagtgaagagctgcacggagtgtgtccgtgtggataaggactgcgcctactgcacagacgagatgttcagggaccggcgctgcaacacccaggcggagctgctggccgcgggctgccagcgggagagcatcgtggtcatggagagcagcttccaaatcacagaggagacccagattgacaccaccctgcggcgcagccagatgtccccccaaggcctgcgggtccgtctgcggcccggtgaggagcggcattttgagctggaggtgtttgagccactggagagccccgtggacctgtacatcctcatggacttctccaactccatgtccgatgatctggacaacctcaagaagatggggcagaacctggctcgggtcctgagccagctcaccagcgactacactattggatttggcaagtttgtggacaaagtcagcgtcccgcagacggacatgaggcctgagaagctgaaggagccctggcccaacagtgacccccccttctccttcaagaacgtcatcagcctgacagaagatgtggatgagttccggaataaactgcagggagagcggatctcaggcaacctggatgctcctgagggcggcttcgatgccatcctgcagacagctgtgtgcacgagggacattggctggcgcccggacagcacccacctgctggtcttctccaccgagtcagccttccactatgaggctgatggcgccaacgtgctggctggcatcatgagccgcaacgatgaacggtgccacctggacaccacgggcacctacacccagtacaggacacaggactacccgtcggtgcccaccctggtgcgcctgctcgccaagcacaacatcatccccatctttgctgtcaccaactactcctatagctactacgagaagcttcacacctatttccctgtctcctcactgggggtgctgcaggaggactcgtccaacatcgtggagctgctggaggaggccttcaatcggatccgctccaacctggacatccgggccctagacagcccccgaggccttcggacagaggtcacctccaagatgttccagaagacgaggactgggtcctttcacatccggcggggggaagtgggtatataccaggtgcagctgcgggcccttgagcacgtggatgggacgcacgtgtgccagctgccggaggaccagaagggcaacatccatctgaaaccttccttctccgacggcctcaagatggacgcgggcatcatctgtgatgtgtgcacctgcgagctgcaaaaagaggtgcggtcagctcgctgcagcttcaacggagacttcgtgtgcggacagtgtgtgtgcagcgagggctggagtggccagacctgcaactgctccaccggctctctgagtgacattcagccctgcctgcgggagggcgaggacaagccgtgctccggccgtggggagtgccagtgcgggcactgtgtgtgctacggcgaaggccgctacgagggtcagttctgcgagtatgacaacttccagtgtccccgcacttccgggttcctctgcaatgaccgaggacgctgctccatgggccagtgtgtgtgtgagcctggttggacaggcccaagctgtgactgtcccctcagcaatgccacctgcatcgacagcaatgggggcatctgtaatggacgtggccactgtgagtgtggccgctgccactgccaccagcagtcgctctacacggacaccatctgcgagatcaactactcggcgatccacccgggcctctgcgaggacctacgctcctgcgtgcagtgccaggcgtggggcaccggcgagaagaaggggcgcacgtgtgaggaatgcaacttcaaggtcaagatggtggacgagcttaagagagccgaggaggtggtggtgcgctgctccttccgggacgaggatgacgactgcacctacagctacaccatggaaggtgacggcgcccctgggcccaacagcactgtcctggtgcacaagaagaaggactgccctccgggctccttctggtggctcatccccctgctcctcctcctcctgccgctcctggccctgctactgctgctatgctggaagtactgtgcctgctgcaaggcctgcctggcacttctcccgtgctgcaaccgaggtcacatggtgggctttaaggaagaccactacatgctgcgggagaacctgatggcctctgaccacttggacacgcccatgctgcgcagcgggaacctcaagggccgtgacgtggtccgctggaaggtcaccaacaacatgcagcggcctggctttgccactcatgccgccagcatcaaccccacagagctggtgccctacgggctgtccttgcgcctggcccgcctttgcaccgagaacctgctgaagcctgacactcgggagtgcgcccagctgcgccaggaggtggaggagaacgtaaggacccaggaactaggcctggccggagatgtggctgaacgaggtctacaggcagatctccggtgtacacaagctccagcagaccaagttccggcagcagcccaatgccgggaaaaagcaagaccacaccattgtggacacagtgctgatggcgccccgctcggccaagccggccctgctgaagcttacagagaagcaggtggaacagagggccttccacgacctcaaggtggcccccggctactacaccctcactgcagaccaggacgcccggggcatggtggagttccaggagggcgtggagctggtggacgtacgggtgcccctctttatccggcctgaggatgacgacgagaagcagctgctggtggaggccatcgacgtgcccgcaggcactgccaccctcggccgccgcctggtaaacatcaccatcatcaaggagcaagccagagacgtggtgtcctttgagcagcctgagttctcggtcagccgcggggaccaggtggcccgcatccctgtcatccggcgtgtcctggacggcgggaagtcccaggtctcctaccgcacacaggatggcaccgcgcagggcaaccgggactacatccccgtggagggtgagctgctgttccagcctggggaggcctggaaagagctgcaggtgaagctcctggagctgcaagaagttgactccctcctgcggggccgccaggtccgccgtttccacgtccagctcagcaaccctaagtttggggcccacctgggccagccccactccaccaccatcatcatcagggacccagatgaactggaccggagcttcacgagtcagatgttgtcatcacagccaccccctcacggcgacctgggcgccccgcagaaccccaatgctaaggccgctgggtccaggaagatccatttcaactggctgcccccttctggcaagccaatggggtacagggtaaagtactggattcagggtgactccgaatccgaagcccacctgctcgacagcaaggtgccctcagtggagctcaccaacctgtacccgtattgcgactatgagatgaaggtgtgcgcctacggggctcagggcgagggaccctacagctccctggtgtcctgccgcacccaccaggaagtgcccagcgagccagggcgtctggccttcaatgtcgtctcctccacggtgacccagctgagctgggctgagccggctgagaccaacggtgagatcacagcctacgaggtctgctatggcctggtcaacgatgacaaccgacctattgggcccatgaagaaagtgctggttgacaaccctaagaaccggatgctgcttattgagaaccttcgggagtcccagccctaccgctacacggtgaaggcgcgcaacggggccggctgggggcctgagcgggaggccatcatcaacctggccacccagcccaagaggcccatgtccatccccatcatccctgacatccctatcgtggacgcccagagcggggaggactacgacagcttccttatgtacagcgatgacgttctacgctctccatcgggcagccagaggcccagcgtctccgatgacactgagcacctggtgaatggccggatggactttgccttcccgggcagcaccaactccctgcacaggatgaccacgaccagtgctgctgcctatggcacccacctgagcccacacgtgccccaccgcgtgctaagcacatcctccaccctcacacgggactacaactcactgacccgctcagaacactcacactcgaccacactgcccagggactactccaccctcacctccgtctcctcccacgactctcgcctgactgctggtgtgcccgacacgcccacccgcctggtgttctctgccctggggcccacatctctcagagtgagctggcaggagccgcggtgcgagcggccgctgcagggctacagtgtggagtaccagctgctgaacggcggtgagctgcatcggctcaacatccccaaccctgcccagacctcggtggtggtggaagacctcctgcccaaccactcctacgtgttccgcgtgcgggcccagagccaggaaggctggggccgagagcgtgagggtgtcatcaccattgaatcccaggtgcacccgcagagcccactgtgtcccctgccagcccacccgcatgcacagagcaggggctaggtgtctcctgggaggcatgaagggggcaaggtccgtcctctgtgggcccaaacctatttgtaaccaaagagctgggagcagcacaaggacccagcctttgttctgcacttaataaatggttttgctactgcta

SEQ ID NO: 330368 - DNA, 1710 bp, Homo sapiens
aagacatgatcgatcgagccggtaccgaacgggtgatgcggttgagaaccttcgggagtcccagccctaccgctacacggtgaaggcgcgcaacggggccggctgggggcctgagcgggaggccatcatcaacctggccacccagcccaagaggcccatgtccatccccatcatccctgacatccctatcgtggacgcccagagcggggaggactacgacagcttccttatgtacagcgatgacgttctacgctctccatcgggcagccagaggcccagcgtctccgatgacactgagcacctggtgaatggccggatggactttgccttcccgggcagcaccaactccctgcacaggatgaccacgaccagtgctgctgcctatggcacccacctgagcccacacgtgccccaccgcgtgctaagcacatcctccaccctcacacgggactacaactcactgacccgctcagaacactcacactcgaccacactgcccagggactactccaccctcacctccgtctcctcccacgactctcgcctgactgctggtgtgcccgacacgcccacccgcctggtgttctctgccctggggcccacatctctcagagtgagctggcaggagccgcggtgcgagcggccgctgcagggctacagtgtggagtaccagctgctgaacggcggtgagctgcatcggctcaacatccccaaccctgcccagacctcggtggtggtggaagacctcctgcccaaccactcctacgtgttccgcgtgcgggcccagagccaggaaggctggggccgagagcgtgagggtgtcatcaccattgaatcccaggtgcacccgcagagcccactgtgtcccctgccaggctccgccttcactttgagcactcccagtgccccaggcccgctggtgttcactgccctgagcccagactcgctgcagctgagctgggagcggccacggaggcccaatggggatatcgtcggctacctggtgacctgtgagatggcccaaggaggagggccagccaccgcattccgggtggatggagacagccccgagagccggctgaccgtgccgggcctcagcgagaacgtgccctacaagttcaaggtgcaggccaggaccactgagggcttcgggccagagcgcgagggcatcatcaccatagagtcccaggatggaggacccttcccgcagctgggcagccgtgccgggctcttccagcacccgctgcaaagcgagtacagcagcatcaccaccacccacaccagcgccaccgagcccttcctagtggatgggccgaccctgggggcccagcacctggaggcaggcggctccctcacccggcatgtgacccaggagtttgtgagccggacactgaccaccagcggaacccttagcacccacatggaccaacagttcttccaaacttgaccgcaccctgccccacccccgccatgtcccactaggcgtcctcccgactcctctcccggagcctcctcagctactccatccttgcacccctgggggcccagcccacccgcatgcacagagcaggggctaggtgtctcctgggaggcatgaagggggcaaggtccgtcctctgtgggcccaaacctatttgtaaccaaagagctgggagcagcacaaggacccagcctttgttctgcacttaataaatggttttgctactgcta

SEQ ID NO: 330369 - DNA, 4782 bp, Homo sapiens
  misc_feature (28)..(28): n is a, c, g, or t
  misc_feature (30)..(30): n is a, c, g, or t
gcgctgcccgcctcgtccccaccccccnancccccgcgcccgccctcggacagtccctgctcgcccgcgcgctgcagccccatctcctagcggcagcccaggcgcggagggagcgagtccgccccgaggtaggtccaggacgggcgcacagcagcagccgaggctggccgggagagggaggaagaggatggcagggccacgccccagcccatgggccaggctgctcctggcagccttgatcagcgtcagcctctctgggaccttggcaaaccgctgcaagaaggccccagtgaagagctgcacggagtgtgtccgtgtggataaggactgcgcctactgcacagacgagatgttcagggaccggcgctgcaacacccaggcggagctgctggccgcgggctgccagcgggagagcatcgtggtcatggagagcagcttccaaatcacagaggagacccagattgacaccaccctgcggcgcagccagatgtccccccaaggcctgcgggtccgtctgcggcccggtgaggagcggcattttgagctggaggtgtttgagccactggagagccccgtggacctgtacatcctcatggacttctccaactccatgtccgatgatctggacaacctcaagaagatggggcagaacctggctcgggtcctgagccagctcaccagcgactacactattggatttggcaagtttgtggacaaagtcagcgtcccgcagacggacatgaggcctgagaagctgaaggagccctggcccaacagtgacccccccttctccttcaagaacgtcatcagcctgacagaagatgtggatgagttccggaataaactgcagggagagcggatctcaggcaacctggatgctcctgagggcggcttcgatgccatcctgcagacagctgtgtgcacgagggacattggctggcgcccggacagcacccacctgctggtcttctccaccgagtcagccttccactatgaggctgatggcgccaacgtgctggctggcatcatgagccgcaacgatgaacggtgccacctggacaccacgggcacctacacccagtacaggacacaggactacccgtcggtgcccaccctggtgcgcctgctcgccaagcacaacatcatccccatctttgctgtcaccaactactcctatagctactacgagaagcttcacacctatttccctgtctcctcactgggggtgctgcaggaggactcgtccaacatcgtggagctgctggaggaggccttcaatcggatccgctccaacctggacatccgggccctagacagcccccgaggccttcggacagaggtcacctccaagatgttccagaagacgaggactgggtcctttcacatccggcggggggaagtgggtatataccaggtgcagctgcgggcccttgagcacgtggatgggacgcacgtgtgccagctgccggaggaccagaagggcaacatccatctgaaaccttccttctccgacggcctcaagatggacgcgggcatcatctgtgatgtgtgcacctgcgagctgcaaaaagaggtgcggtcagctcgctgcagcttcaacggagacttcgtgtgcggacagtgtgtgtgcagcgagggctggagtggccagacctgcaactgctccaccggctctctgagtgacattcagccctgcctgcgggagggcgaggacaagccgtgctccggccgtggggagtgccagtgcgggcactgtgtgtgctacggcgaaggccgctacgagggtcagttctgcgagtatgacaacttccagtgtccccgcacttccgggttcctctgcaatgaccgaggacgctgctccatgggccagtgtgtgtgtgagcctggttggacaggcccaagctgtgactgtcccctcagcaatgccacctgcatcgacagcaatgggggcatctgtaatggacgtggccactgtgagtgtggccgctgccactgccaccagcagtcgctctacacggacaccatctgcgagatcaactactcggcgatccacccgggcctctgcgaggacctacgctcctgcgtgcagtgccaggcgtggggcaccggcgagaagaaggggcgcacgtgtgaggaatgcaacttcaaggtcaagatggtggacgagcttaagagagccgaggaggtggtggtgcgctgctccttccgggacgaggatgacgactgcacctacagctacaccatggaaggtgacggcgcccctgggcccaacagcactgtcctggtgcacaagaagaaggactgccctccgggctccttctggtggctcatccccctgctcctcctcctcctgccgctcctggccctgctactgctgctatgctggaagtactgtgcctgctgcaaggcctgcctggcacttctcccgtgctgcaaccgaggtcacatggtgggctttaaggaagaccactacatgctgcgggagaacctgatggcctctgaccacttggacacgcccatgctgcgcagcgggaacctcaagggccgtgacgtggtccgctggaaggtcaccaacaacatgcagcggcctggctttgccactcatgccgccagcatcaaccccacagagctggtgccctacgggctgtccttgcgcctggcccgcctttgcaccgagaacctgctgaagcctgacactcgggagtgcgcccagctgcgccaggaggtggaggagaacgtaaggacccaggaactaggcctggccggagatgtggctgaacgaggtctacaggcagatctccggtgtacacaagctccagcagaccaagttccggcagcagcccaatgccgggaaaaagcaagaccacaccattgtggacacagtgctgatggcgccccgctcggccaagccggccctgctgaagcttacagagaagcaggtggaacagagggccttccacgacctcaaggtggcccccggctactacaccctcactgcagaccaggacgcccggggcatggtggagttccaggagggcgtggagctggtggacgtacgggtgcccctctttatccggcctgaggatgacgacgagaagcagctgctggtggaggccatcgacgtgcccgcaggcactgccaccctcggccgccgcctggtaaacatcaccatcatcaaggagcaagccagagacgtggtgtcctttgagcagcctgagttctcggtcagccgcggggaccaggtggcccgcatccctgtcatccggcgtgtcctggacggcgggaagtcccaggtctcctaccgcacacaggatggcaccgcgcagggcaaccgggactacatccccgtggagggtgagctgctgttccagcctggggaggcctggaaagagctgcaggtgaagctcctggagctgcaagaagttgactccctcctgcggggccgccaggtccgccgtttccacgtccagctcagcaaccctaagtttggggcccacctgggccagccccactccaccaccatcatcatcagggacccagatgaactggaccggagcttcacgagtcagatgttgtcatcacagccaccccctcacggcgacctgggcgccccgcagaaccccaatgctaaggccgctgggtccaggaagatccatttcaactggctgcccccttctggcaagccaatggggtacagggtaaagtactggattcagggtgactccgaatccgaagcccacctgctcgacagcaaggtgccctcagtggagctcaccaacctgtacccgtattgcgactatgagatgaaggtgtgcgcctacggggctcagggcgagggaccctacagctccctggtgtcctgccgcacccaccaggaagtgcccagcgagccagggcgtctggccttcaatgtcgtctcctccacggtgacccagctgagctgggctgagccggctgagaccaacggtgagatcacagcctacgaggtctgctatggcctggtcaacgatgacaaccgacctattgggcccatgaagaaagtgctggttgacaaccctaagaaccggatgctgcttattgagaaccttcgggagtcccagccctaccgctacacggtgaaggcgcgcaacggggccggctgggggcctgagcgggaggccatcatcaacctggccacccagcccaagaggcccatgtccatccccatcatccctgacatccctatcgtggacgcccagagcggggaggactacgacagcttccttatgtacagcgatgacgttctacgctctccatcgggcagccagaggcccagcgtctccgatgacactgagcacctggtgaatggccggatggactttgccttcccgggcagcaccaactccctgcacaggatgaccacgaccagtgctgctgcctatggcacccacctgagcccacacgtgccccaccgcgtgctaagcacatcctccaccctcacacgggactacaactcactgacccgctcagaacactcacactcgaccacactgcccagggactactccaccctcacctccgtctcctcccacgactctcgcctgactgctggtgtgcccgacacgcccacccgcctggtgttctctgccctggggcccacatctctcagagtgagctggcaggagccgcggtgcgttggcccaacgttgggccacgcaccgtacagctgacacggtggctcatgcctgtaatcccagcactttgggaggaatggatgaatcagtgaattaatacgtgcgtgcc

SEQ ID NO: 330370 - DNA, 4429 bp, Homo sapiens
  misc_feature (28)..(28): n is a, c, g, or t
  misc_feature (30)..(30): n is a, c, g, or t
gcgctgcccgcctcgtccccaccccccnancccccgcgcccgccctcggacagtccctgctcgcccgcgcgctgcagccccatctcctagcggcagcccaggcgcggagggagcgagtccgccccgaggtaggtccaggacgggcgcacagcagcagccgaggctggccgggagagggaggaagaggatggcagggccacgccccagcccatgggccaggctgctcctggcagccttgatcagcgtcagcctctctgggaccttggcaaaccgctgcaagaaggccccagtgaagagctgcacggagtgtgtccgtgtggataaggactgcgcctactgcacagacgagatgttcagggaccggcgctgcaacacccaggcggagctgctggccgcgggctgccagcgggagagcatcgtggtcatggagagcagcttccaaatcacagaggagacccagattgacaccaccctgcggcgcagccagatgtccccccaaggcctgcgggtccgtctgcggcccggtgaggagcggcattttgagctggaggtgtttgagccactggagagccccgtggacctgtacatcctcatggacttctccaactccatgtccgatgatctggacaacctcaagaagatggggcagaacctggctcgggtcctgagccagctcaccagcgactacactattggatttggcaagtttgtggacaaagtcagcgtcccgcagacggacatgaggcctgagaagctgaaggagccctggcccaacagtgacccccccttctccttcaagaacgtcatcagcctgacagaagatgtggatgagttccggaataaactgcagggagagcggatctcaggcaacctggatgctcctgagggcggcttcgatgccatcctgcagacagctgtgtgcacgagggacattggctggcgcccggacagcacccacctgctggtcttctccaccgagtcagccttccactatgaggctgatggcgccaacgtgctggctggcatcatgagccgcaacgatgaacggtgccacctggacaccacgggcacctacacccagtacaggacacaggactacccgtcggtgcccaccctggtgcgcctgctcgccaagcacaacatcatccccatctttgctgtcaccaactactcctatagctactacgagaagcttcacacctatttccctgtctcctcactgggggtgctgcaggaggactcgtccaacatcgtggagctgctggaggaggccttcaatcggatccgctccaacctggacatccgggccctagacagcccccgaggccttcggacagaggtcacctccaagatgttccagaagacgaggactgggtcctttcacatccggcggggggaagtgggtatataccaggtgcagctgcgggcccttgagcacgtggatgggacgcacgtgtgccagctgccggaggaccagaagggcaacatccatctgaaaccttccttctccgacggcctcaagatggacgcgggcatcatctgtgatgtgtgcacctgcgagctgcaaaaagaggtgcggtcagctcgctgcagcttcaacggagacttcgtgtgcggacagtgtgtgtgcagcgagggctggagtggccagacctgcaactgctccaccggctctctgagtgacattcagccctgcctgcgggagggcgaggacaagccgtgctccggccgtggggagtgccagtgcgggcactgtgtgtgctacggcgaaggccgctacgagggtcagttctgcgagtatgacaacttccagtgtccccgcacttccgggttcctctgcaatgaccgaggacgctgctccatgggccagtgtgtgtgtgagcctggttggacaggcccaagctgtgactgtcccctcagcaatgccacctgcatcgacagcaatgggggcatctgtaatggacgtggccactgtgagtgtggccgctgccactgccaccagcagtcgctctacacggacaccatctgcgagatcaactactcggcgatccacccgggcctctgcgaggacctacgctcctgcgtgcagtgccaggcgtggggcaccggcgagaagaaggggcgcacgtgtgaggaatgcaacttcaaggtcaagatggtggacgagcttaagagagccgaggaggtggtggtgcgctgctccttccgggacgaggatgacgactgcacctacagctacaccatggaaggtgacggcgcccctgggcccaacagcactgtcctggtgcacaagaagaaggactgccctccgggctccttctggtggctcatccccctgctcctcctcctcctgccgctcctggccctgctactgctgctatgctggaagtactgtgcctgctgcaaggcctgcctggcacttctcccgtgctgcaaccgaggtcacatggtgggctttaaggaagaccactacatgctgcgggagaacctgatggcctctgaccacttggacacgcccatgctgcgcagcgggaacctcaagggccgtgacgtggtccgctggaaggtcaccaacaacatgcagcggcctggctttgccactcatgccgccagcatcaaccccacagagctggtgccctacgggctgtccttgcgcctggcccgcctttgcaccgagaacctgctgaagcctgacactcgggagtgcgcccagctgcgccaggaggtggaggagaacgtaaggacccaggaactaggcctggccggagatgtggctgaacgaggtctacaggcagatctccggtgtacacaagctccagcagaccaagttccggcagcagcccaatgccgggaaaaagcaagaccacaccattgtggacacagtgctgatggcgccccgctcggccaagccggccctgctgaagcttacagagaagcaggtggaacagagggccttccacgacctcaaggtggcccccggctactacaccctcactgcagaccaggacgcccggggcatggtggagttccaggagggcgtggagctggtggacgtacgggtgcccctctttatccggcctgagacgaccagtgctgctgcctatggcacccacctgagcccacacgtgccccaccgcgtgctaagcacatcctccaccctcacacgggactacaactcactgacccgctcagaacactcacactcgaccacactgcccagggactactccaccctcacctccgtctcctcccacgactctcgcctgactgctggtgtgcccgacacgcccacccgcctggtgttctctgccctggggcccacatctctcagagtgagctggcaggagccgcggtgcgagcggccgctgcagggctacagtgtggagtaccagctgctgaacggcggtgagctgcatcggctcaacatccccaaccctgcccagacctcggtggtggtggaagacctcctgcccaaccactcctacgtgttccgcgtgcgggcccagagccaggaaggctggggccgagagcgtgagggtgtcatcaccattgaatcccaggtgcacccgcagagcccactgtgtcccctgccaggctccgccttcactttgagcactcccagtgccccaggcccgctggtgttcactgccctgagcccagactcgctgcagctgagctgggagcggccacggaggcccaatggggatatcgtcggctacctggtgacctgtgagatggcccaaggaggagggccagccaccgcattccgggtggatggagacagccccgagagccggctgaccgtgccgggcctcagcgagaacgtgccctacaagttcaaggtgcaggccaggaccactgagggcttcgggccagagcgcgagggcatcatcaccatagagtcccaggatggaggacccttcccgcagctgggcagccgtgccgggctcttccagcacccgctgcaaagcgagtacagcagcatcaccaccacccacaccagcgccaccgagcccttcctagtggatgggccgaccctgggggcccagcacctggaggcaggcggctccctcacccggcatgtgacccaggagtttgtgagccggacactgaccaccagcggaacccttagcacccacatggaccaacagttcttccaaacttgaccgcaccctgccccacccccgccatgtcccactaggcgtcctcccgactcctctcccggagcctcctcagctactccatccttgcacccctgggggcccagcccacccgcatgcacagagcaggggctaggtgtctcctgggaggcatgaagggggcaaggtccgtcctctgtgggcccaaacctatttgtaaccaaagagctgggagcagcacaaggacccagcctttgttctgcacttaataaatggttttgctactgcta

SEQ ID NO: 330371 - DNA, 4392 bp, Homo sapiens
  misc_feature (28)..(28): n is a, c, g, or t
  misc_feature (30)..(30): n is a, c, g, or t
gcgctgcccgcctcgtccccaccccccnancccccgcgcccgccctcggacagtccctgctcgcccgcgcgctgcagccccatctcctagcggcagcccaggcgcggagggagcgagtccgccccgaggtaggtccaggacgggcgcacagcagcagccgaggctggccgggagagggaggaagaggatggcagggccacgccccagcccatgggccaggctgctcctggcagccttgatcagcgtcagcctctctgggaccttggcaaaccgctgcaagaaggccccagtgaagagctgcacggagtgtgtccgtgtggataaggactgcgcctactgcacagacgagatgttcagggaccggcgctgcaacacccaggcggagctgctggccgcgggctgccagcgggagagcatcgtggtcatggagagcagcttccaaatcacagaggagacccagattgacaccaccctgcggcgcagccagatgtccccccaaggcctgcgggtccgtctgcggcccggtgaggagcggcattttgagctggaggtgtttgagccactggagagccccgtggacctgtacatcctcatggacttctccaactccatgtccgatgatctggacaacctcaagaagatggggcagaacctggctcgggtcctgagccagctcaccagcgactacactattggatttggcaagtttgtggacaaagtcagcgtcccgcagacggacatgaggcctgagaagctgaaggagccctggcccaacagtgacccccccttctccttcaagaacgtcatcagcctgacagaagatgtggatgagttccggaataaactgcagggagagcggatctcaggcaacctggatgctcctgagggcggcttcgatgccatcctgcagacagctgtgtgcacgagggacattggctggcgcccggacagcacccacctgctggtcttctccaccgagtcagccttccactatgaggctgatggcgccaacgtgctggctggcatcatgagccgcaacgatgaacggtgccacctggacaccacgggcacctacacccagtacaggacacaggactacccgtcggtgcccaccctggtgcgcctgctcgccaagcacaacatcatccccatctttgctgtcaccaactactcctatagctactacgagaagcttcacacctatttccctgtctcctcactgggggtgctgcaggaggactcgtccaacatcgtggagctgctggaggaggccttcaatcggatccgctccaacctggacatccgggccctagacagcccccgaggccttcggacagaggtcacctccaagatgttccagaagacgaggactgggtcctttcacatccggcggggggaagtgggtatataccaggtgcagctgcgggcccttgagcacgtggatgggacgcacgtgtgccagctgccggaggaccagaagggcaacatccatctgaaaccttccttctccgacggcctcaagatggacgcgggcatcatctgtgatgtgtgcacctgcgagctgcaaaaagaggtgcggtcagctcgctgcagcttcaacggagacttcgtgtgcggacagtgtgtgtgcagcgagggctggagtggccagacctgcaactgctccaccggctctctgagtgacattcagccctgcctgcgggagggcgaggacaagccgtgctccggccgtggggagtgccagtgcgggcactgtgtgtgctacggcgaaggccgctacgagggtcagttctgcgagtatgacaacttccagtgtccccgcacttccgggttcctctgcaatgaccgaggacgctgctccatgggccagtgtgtgtgtgagcctggttggacaggcccaagctgtgactgtcccctcagcaatgccacctgcatcgacagcaatgggggcatctgtaatggacgtggccactgtgagtgtggccgctgccactgccaccagcagtcgctctacacggacaccatctgcgagatcaactactcggcgatccacccgggcctctgcgaggacctacgctcctgcgtgcagtgccaggcgtggggcaccggcgagaagaaggggcgcacgtgtgaggaatgcaacttcaaggtcaagatggtggacgagcttaagagagccgaggaggtggtggtgcgctgctccttccgggacgaggatgacgactgcacctacagctacaccatggaaggtgacggcgcccctgggcccaacagcactgtcctggtgcacaagaagaaggactgccctccgggctccttctggtggctcatccccctgctcctcctcctcctgccgctcctggccctgctactgctgctatgctggaagtactgtgcctgctgcaaggcctgcctggcacttctcccgtgctgcaaccgaggtcacatggtgggctttaaggaagaccactacatgctgcgggagaacctgatggcctctgaccacttggacacgcccatgctgcgcagcgggaacctcaagggccgtgacgtggtccgctggaaggtcaccaacaacatgcagcggcctggctttgccactcatgccgccagcatcaaccccacagagctggtgccctacgggctgtccttgcgcctggcccgcctttgcaccgagaacctgctgaagcctgacactcgggagtgcgcccagctgcgccaggaggtggaggagaacctgaacgaggtctacaggcagatctccggtgtacacaagctccagcagaccaagttccggcagcagcccaatgccgggaaaaagcaagaccacaccattgtggacacagtgctgatggcgccccgctcggccaagccggccctgctgaagcttacagagaagcaggtggaacagagggccttccacgacctcaaggtggcccccggctactacaccctcactgcagaccaggacgcccggggcatggtggagttccaggagggcgtggagctggtggacgtacgggtgcccctctttatccggcctgagacgaccagtgctgctgcctatggcacccacctgagcccacacgtgccccaccgcgtgctaagcacatcctccaccctcacacgggactacaactcactgacccgctcagaacactcacactcgaccacactgcccagggactactccaccctcacctccgtctcctcccacgactctcgcctgactgctggtgtgcccgacacgcccacccgcctggtgttctctgccctggggcccacatctctcagagtgagctggcaggagccgcggtgcgagcggccgctgcagggctacagtgtggagtaccagctgctgaacggcggtgagctgcatcggctcaacatccccaaccctgcccagacctcggtggtggtggaagacctcctgcccaaccactcctacgtgttccgcgtgcgggcccagagccaggaaggctggggccgagagcgtgagggtgtcatcaccattgaatcccaggtgcacccgcagagcccactgtgtcccctgccaggctccgccttcactttgagcactcccagtgccccaggcccgctggtgttcactgccctgagcccagactcgctgcagctgagctgggagcggccacggaggcccaatggggatatcgtcggctacctggtgacctgtgagatggcccaaggaggagggccagccaccgcattccgggtggatggagacagccccgagagccggctgaccgtgccgggcctcagcgagaacgtgccctacaagttcaaggtgcaggccaggaccactgagggcttcgggccagagcgcgagggcatcatcaccatagagtcccaggatggaggacccttcccgcagctgggcagccgtgccgggctcttccagcacccgctgcaaagcgagtacagcagcatcaccaccacccacaccagcgccaccgagcccttcctagtggatgggccgaccctgggggcccagcacctggaggcaggcggctccctcacccggcatgtgacccaggagtttgtgagccggacactgaccaccagcggaacccttagcacccacatggaccaacagttcttccaaacttgaccgcaccctgccccacccccgccatgtcccactaggcgtcctcccgactcctctcccggagcctcctcagctactccatccttgcacccctgggggcccagcccacccgcatgcacagagcaggggctaggtgtctcctgggaggcatgaagggggcaaggtccgtcctctgtgggcccaaacctatttgtaaccaaagagctgggagcagcacaaggacccagcctttgttctgcacttaataaatggttttgctactgcta

SEQ ID NO: 330372 - DNA, 1693 bp, Homo sapiens
tgggggtttggctgcgtctgcagtcagctctgccctggggagcagtgctcacaccgatagagtggccggccagaggatatgggctgtggaagcctgggtggcccttgggctcctgcagggacagagggcctctgtccctagtggtttgagggaaactggttgtatttaagcaaaagccacccagagggtgggtgaccaggaatgtgcagggcccagcctgccccacggggcccgggtctggggcaggcctgaccaagggaccctgctctccccctgcagagcacctggtgaatggccggatggactttgccttcccgggcagcaccaactccctgcacaggatgaccacgaccagtgctgctgcctatggcacccacctgagcccacacgtgccccaccgcgtgctaagcacatcctccaccctcacacgggactacaactcactgacccgctcagaacactcacactcgaccacactgcccagggactactccaccctcacctccgtctcctcccacgactctcgcctgactgctggtgtgcccgacacgcccacccgcctggtgttctctgccctggggcccacatctctcagagtgagctggcaggagccgcggtgcgagcggccgctgcagggctacagtgtggagtaccagctgctgaacggcggtgagctgcatcggctcaacatccccaaccctgcccagacctcggtggtggtggaagacctcctgcccaaccactcctacgtgttccgcgtgcgggcccagagccaggaaggctggggccgagagcgtgagggtgtcatcaccattgaatcccaggtgcacccgcagagcccactgtgtcccctgccaggctccgccttcactttgagcactcccagtgccccaggcccgctggtgttcactgccctgagcccagactcgctgcagctgagctgggagcggccacggaggcccaatggggatatcgtcggctacctggtgacctgtgagatggcccaaggaggagggccagccaccgcattccgggtggatggagacagccccgagagccggctgaccgtgccgggcctcagcgagaacgtgccctacaagttcaaggtgcaggccaggaccactgagggcttcgggccagagcgcgagggcatcatcaccatagagtcccaggatggaggacccttcccgcagctgggcagccgtgccgggctcttccagcacccgctgcaaagcgagtacagcagcatcaccaccacccacaccagcgccaccgagcccttcctagtggatgggccgaccctgggggcccagcacctggaggcaggcggctccctcacccggcatgtgacccaggagtttgtgagccggacactgaccaccagcggaacccttagcacccacatggaccaacagttcttccaaacttgaccgcaccctgccccacccccgccatgtcccactaggcgtcctcccgactcctctcccggagcctcctcagctactccatccttgcacccctgggggcccagcccacccgcatgcacagagcaggggctaggtgtctcctgggaggcatgaagggggcaaggtccgtcctctgtgggcccaaacctatttgtaaccaaagagctgggagcagcacaaggacccagcctttgttctgcacttaataaatggttttgctactgcta

SEQ ID NO: 330373 - DNA, 1406 bp, Homo sapiens
cccctggcacaggaatgaccacgaccaaggtgctgctgcccctatgggcacccccaacccttggaaggcccccccaaacaatcagttggcccccccccaccccgggcggtatgtcttaaagccacatcctccaccctcacacgggactacaactcactgacccgctcagaacactcacactcgaccacactgcccagggactactccaccctcacctccgtctcctcccacgactctcgcctgactgctggtgtgcccgacacgcccacccgcctggtgttctctgccctggggcccacatctctcagagtgagctggcaggagccgcggtgcgagcggccgctgcagggctacagtgtggagtaccagctgctgaacggcggtgagctgcatcggctcaacatccccaaccctgcccagacctcggtggtggtggaagacctcctgcccaaccactcctacgtgttccgcgtgcgggcccagagccaggaaggctggggccgagagcgtgagggtgtcatcaccattgaatcccaggtgcacccgcagagcccactgtgtcccctgccaggctccgccttcactttgagcactcccagtgccccaggcccgctggtgttcactgccctgagcccagactcgctgcagctgagctgggagcggccacggaggcccaatggggatatcgtcggctacctggtgacctgtgagatggcccaaggaggagggccagccaccgcattccgggtggatggagacagccccgagagccggctgaccgtgccgggcctcagcgagaacgtgccctacaagttcaaggtgcaggccaggaccactgagggcttcgggccagagcgcgagggcatcatcaccatagagtcccaggatggaggacccttcccgcagctgggcagccgtgccgggctcttccagcacccgctgcaaagcgagtacagcagcatcaccaccacccacaccagcgccaccgagcccttcctagtggatgggccgaccctgggggcccagcacctggaggcaggcggctccctcacccggcatgtgacccaggagtttgtgagccggacactgaccaccagcggaacccttagcacccacatggaccaacagttcttccaaacttgaccgcaccctgccccacccccgccatgtcccactaggcgtcctcccgactcctctcccggagcctcctcagctactccatccttgcacccctgggggcccagcccacccgcatgcacagagcaggggctaggtgtctcctgggaggcatgaagggggcaaggtccgtcctctgtgggcccaaacctatttgtaaccaaagagctgggagcagcacaaggacccagcctttgttctgcacttaataaatggttttgctactgcta

SEQ ID NO: 330374 - DNA, 1044 bp, Homo sapiens
gtaccgcagacgttaactatgtgagctgcatcggctcaacatccccaaccctgcccagacctcggtggtggtggaagacctcctgcccaaccactcctacgtgttccgcgtgcgggcccagagccaggaaggctggggccgagagcgtgagggtgtcatcaccattgaatcccaggtgcacccgcagagcccactgtgtcccctgccaggctccgccttcactttgagcactcccagtgccccaggcccgctggtgttcactgccctgagcccagactcgctgcagctgagctgggagcggccacggaggcccaatggggatatcgtcggctacctggtgacctgtgagatggcccaaggaggagggccagccaccgcattccgggtggatggagacagccccgagagccggctgaccgtgccgggcctcagcgagaacgtgccctacaagttcaaggtgcaggccaggaccactgagggcttcgggccagagcgcgagggcatcatcaccatagagtcccaggatggaggacccttcccgcagctgggcagccgtgccgggctcttccagcacccgctgcaaagcgagtacagcagcatcaccaccacccacaccagcgccaccgagcccttcctagtggatgggccgaccctgggggcccagcacctggaggcaggcggctccctcacccggcatgtgacccaggagtttgtgagccggacactgaccaccagcggaacccttagcacccacatggaccaacagttcttccaaacttgaccgcaccctgccccacccccgccatgtcccactaggcgtcctcccgactcctctcccggagcctcctcagctactccatccttgcacccctgggggcccagcccacccgcatgcacagagcaggggctaggtgtctcctgggaggcatgaagggggcaaggtccgtcctctgtgggcccaaacctatttgtaaccaaagagctgggagcagcacaaggacccagcctttgttctgcacttaataaatggttttgctactgcta

SEQ ID NO: 330375 - DNA, 1593 bp, Homo sapiens
  misc_feature (28)..(28): n is a, c, g, or t
  misc_feature (30)..(30): n is a, c, g, or t
gcgctgcccgcctcgtccccaccccccnancccccgcgcccgccctcggacagtccctgctcgcccgcgcgctgcagccccatctcctagcggcagcccaggcgcggagggagcgagtccgccccgaggtaggtccaggacgggcgcacagcagcagccgaggctggccgggagagggaggaagaggatggcagggccacgccccagcccatgggccaggctgctcctggcagccttgatcagcgtcagcctctctgggaccttggcaaaccgctgcaagaaggccccagtgaagagctgcacggagtgtgtccgtgtggataaggactgcgcctactgcacagacgagatgttcagggaccggcgctgcaacacccaggcggagctgctggccgcgggctgccagcgggagagcatcgtggtcatggagagcagcttccaaatcacagaggagacccagattgacaccaccctgcggcgcagccagatgtccccccaaggcctgcgggtccgtctgcggcccggtgaggagcggcattttgagctggaggtgtttgagccactggagagccccgtggacctgtacatcctcatggacttctccaactccatgtccgatgatctggacaacctcaagaagatggggcagaacctggctcgggtcctgagccagctcaccagcgactacactattggatttggcaagtttgtggacaaagtcagcgtcccgcagacggacatgaggcctgagaagctgaaggagccctggcccaacagtgacccccccttctccttcaagaacgtcatcagcctgacagaagatgtggatgagttccggaataaactgcagggagagcggatctcaggcaacctggatgctcctgagggcggcttcgatgccatcctgcagacagctgtgtgcacgagggacattggctggcgcccggacagcacccacctgctggtcttctccaccgagtcagccttccactatgaggctgatggcgccaacgtgctggctggcatcatgagccgcaacgatgaacggtgccacctggacaccacgggcacctacacccagtacaggacacaggactacccgtcggtgcccaccctggtgcgcctgctcgccaagcacaacatcatccccatctttgctgtcaccaactactcctatagctactacgagaagcttcacacctatttccctgtctcctcactgggggtgctgcaggaggactccggatccgctccaacctggacatccgggccctagacagcccccgaggccttcggacagaggtcacctccaagatgttccagaagacgaggactgggtcctttcacatccggcggggggaagtgggtatataccaggtgcagctgcgggcccttgagcacgtggatgggacgcacgtgtgccagctgccggaggaccagaagggcaacatccatctgaaaccttccttctccgacggcctcaagatggacgcgggcatcatctgtgatgtgtgcacctgcgagctgcaaaaagaggtgcggtcagctcgctgcagctcgcgcctgagttagcagctcgcacctagttggtcc

SEQ ID NO: 330376 - DNA, 550 bp, Homo sapiens
acacatataaggaaagtaagcccccccttagaaaccccccggcttaaccctttaagctacggatagatttgttgggtgaaacttgaagcgaataacattttcaccaggggaaccgccaagccccattattacgccaagctttaaacgacctcccaataggaaaagttggtacccctcaaggacccggcccgaatttccggggcgactacaactaaaaaattcgcgaccgggtcaacaccagcggaacccttagcacccacatggaccaacagttcttccaaacttgaccgcaccctgccccacccccgccatgtcccactaggcgtcctcccgactcctctcccggagcctcctcagctactccatccttgcacccctgggggcccagcccacccgcatgcacagagcaggggctaggtgtctcctgggaggcatgaagggggcaaggtccgtcctctgtgggcccaaacctatttgtaaccaaagagctgggagcagcacaaggacccagcctttgttctgcacttaataaatggttttgctactgcta

SEQ ID NO: 330377 - DNA, 1064 bp, Homo sapiens
  misc_feature (28)..(28): n is a, c, g, or t
  misc_feature (30)..(30): n is a, c, g, or t
gcgctgcccgcctcgtccccaccccccnancccccgcgcccgccctcggacagtccctgctcgcccgcgcgctgcagccccatctcctagcggcagcccaggcgcggagggagcgagtccgccccgaggtaggtccaggacgggcgcacagcagcagccgaggctggccgggagagggaggaagaggatggcagggccacgccccagcccatgggccaggctgctcctggcagccttgatcagcgtcagcctctctgggaccttggcaaaccgctgcaagaaggccccagtgaagagctgcacggagtgtgtccgtgtggataaggactgcgcctactgcacagacgagatgttcagggaccggcgctgcaacacccaggcggagctgctggccgcgggctgccagcgggagagcatcgtggtcatggagagcagcttccaaatcacagaggagacccagattgacaccaccctgcggcgcagccagatgtccccccaaggcctgcgggtccgtctgcggcccggtgaggagcggcattttgagctggaggtgtttgagccactggagagccccgtggacctgtacatcctcatggacttctccaactccatgtccgatgatctggacaacctcaagaagatggggcagaacctggctcgggtcctgagccagctcaccagcgactacactattggatttggcaagtttgtggacaaagtcagcgtcccgcagacggacatgaggcctgagaagctgaaggagccctggcccaacagtgacccccccttctccttcaagaacgtcatcagcctgacagaagatgtggatgagttccggaataaactgcagggagagcggatctcagctcagctactccatccttgcacccctgggggcccagcccacccgcatgcacagagcaggggctaggtgtctcctgggaggcatgaagggggcaaggtccgtcctctgtgggcccaaacctatttgtaaccaaagagctgggagcagcacaaggacccagcctttgttctgcacttaataaatggttttgctactgcta

SEQ ID NO: 330378 - DNA, 539 bp, Homo sapiens
gcccccatccagcctgagagggtctcccaccccattctccaccccacttctttgcctcccctcttctgaggtctcacccacctccctgggcctctctcctggtcattctctgctaggttttgcctaacaaggcccctttgggctgggatcctagggcctctgctggcctgagatgcctttgggggaacaaggaagtggcacttccctgggcaggcacattcaaagcagcatgaccaggatgcaggatgttgcctaaacatgagtgggattacaggctccactcttgtatagtacacaatctgaacaaccagccataccatactgtacccaacctgtacccaaaccacagctagtcctgggtgggtgataactaggtctcgatggcagcttagggacgaggaggatcaggccaggggtgggagtaacactgcactactgtgtgcccccacctgatccccccaggtgagctgcatcggctcaacatccccaaccctgcccagacctcggtggtggtggaagacctcctgcccaaccactcc

SEQ ID NO: 330379 - DNA, 5709 bp, Homo sapiens
  misc_feature (28)..(28): n is a, c, g, or t
  misc_feature (30)..(30): n is a, c, g, or t
gcgctgcccgcctcgtccccaccccccnancccccgcgcccgccctcggacagtccctgctcgcccgcgcgctgcagccccatctcctagcggcagcccaggcgcggagggagcgagtccgccccgaggtaggtccaggacgggcgcacagcagcagccgaggctggccgggagagggaggaagaggatggcagggccacgccccagcccatgggccaggctgctcctggcagccttgatcagcgtcagcctctctgggaccttggcaaaccgctgcaagaaggccccagtgaagagctgcacggagtgtgtccgtgtggataaggactgcgcctactgcacagacgagatgttcagggaccggcgctgcaacacccaggcggagctgctggccgcgggctgccagcgggagagcatcgtggtcatggagagcagcttccaaatcacagaggagacccagattgacaccaccctgcggcgcagccagatgtccccccaaggcctgcgggtccgtctgcggcccggtgaggagcggcattttgagctggaggtgtttgagccactggagagccccgtggacctgtacatcctcatggacttctccaactccatgtccgatgatctggacaacctcaagaagatggggcagaacctggctcgggtcctgagccagctcaccagcgactacactattggatttggcaagtttgtggacaaagtcagcgtcccgcagacggacatgaggcctgagaagctgaaggagccctggcccaacagtgacccccccttctccttcaagaacgtcatcagcctgacagaagatgtggatgagttccggaataaactgcagggagagcggatctcaggcaacctggatgctcctgagggcggcttcgatgccatcctgcagacagctgtgtgcacgagggacattggctggcgcccggacagcacccacctgctggtcttctccaccgagtcagccttccactatgaggctgatggcgccaacgtgctggctggcatcatgagccgcaacgatgaacggtgccacctggacaccacgggcacctacacccagtacaggacacaggactacccgtcggtgcccaccctggtgcgcctgctcgccaagcacaacatcatccccatctttgctgtcaccaactactcctatagctactacgagaagcttcacacctatttccctgtctcctcactgggggtgctgcaggaggactcgtccaacatcgtggagctgctggaggaggccttcaatcggatccgctccaacctggacatccgggccctagacagcccccgaggccttcggacagaggtcacctccaagatgttccagaagacgaggactgggtcctttcacatccggcggggggaagtgggtatataccaggtgcagctgcgggcccttgagcacgtggatgggacgcacgtgtgccagctgccggaggaccagaagggcaacatccatctgaaaccttccttctccgacggcctcaagatggacgcgggcatcatctgtgatgtgtgcacctgcgagctgcaaaaagaggtgcggtcagctcgctgcagcttcaacggagacttcgtgtgcggacagtgtgtgtgcagcgagggctggagtggccagacctgcaactgctccaccggctctctgagtgacattcagccctgcctgcgggagggcgaggacaagccgtgctccggccgtggggagtgccagtgcgggcactgtgtgtgctacggcgaaggccgctacgagggtcagttctgcgagtatgacaacttccagtgtccccgcacttccgggttcctctgcaatgaccgaggacgctgctccatgggccagtgtgtgtgtgagcctggttggacaggcccaagctgtgactgtcccctcagcaatgccacctgcatcgacagcaatgggggcatctgtaatggacgtggccactgtgagtgtggccgctgccactgccaccagcagtcgctctacacggacaccatctgcgagatcaactactcggcgatccacccgggcctctgcgaggacctacgctcctgcgtgcagtgccaggcgtggggcaccggcgagaagaaggggcgcacgtgtgaggaatgcaacttcaaggtcaagatggtggacgagcttaagagagccgaggaggtggtggtgcgctgctccttccgggacgaggatgacgactgcacctacagctacaccatggaaggtgacggcgcccctgggcccaacagcactgtcctggtgcacaagaagaaggactgccctccgggctccttctggtggctcatccccctgctcctcctcctcctgccgctcctggccctgctactgctgctatgctggaagtactgtgcctgctgcaaggcctgcctggcacttctcccgtgctgcaaccgaggtcacatggtgggctttaaggaagaccactacatgctgcgggagaacctgatggcctctgaccacttggacacgcccatgctgcgcagcgggaacctcaagggccgtgacgtggtccgctggaaggtcaccaacaacatgcagcggcctggctttgccactcatgccgccagcatcaaccccacagagctggtgccctacgggctgtccttgcgcctggcccgcctttgcaccgagaacctgctgaagcctgacactcgggagtgcgcccagctgcgccaggaggtggaggagaacctgaacgaggtctacaggcagatctccggtgtacacaagctccagcagaccaagttccggcagcagcccaatgccgggaaaaagcaagaccacaccattgtggacacagtgctgatggcgccccgctcggccaagccggccctgctgaagcttacagagaagcaggtggaacagagggccttccacgacctcaaggtggcccccggctactacaccctcactgcagaccaggacgcccggggcatggtggagttccaggagggcgtggagctggtggacgtacgggtgcccctctttatccggcctgaggatgacgacgagaagcagctgctggtggaggccatcgacgtgcccgcaggcactgccaccctcggccgccgcctggtaaacatcaccatcatcaaggagcaagccagagacgtggtgtcctttgagcagcctgagttctcggtcagccgcggggaccaggtggcccgcatccctgtcatccggcgtgtcctggacggcgggaagtcccaggtctcctaccgcacacaggatggcaccgcgcagggcaaccgggactacatccccgtggagggtgagctgctgttccagcctggggaggcctggaaagagctgcaggtgaagctcctggagctgcaagaagttgactccctcctgcggggccgccaggtccgccgtttccacgtccagctcagcaaccctaagtttggggcccacctgggccagccccactccaccaccatcatcatcagggacccagatgaactggaccggagcttcacgagtcagatgttgtcatcacagccaccccctcacggcgacctgggcgccccgcagaaccccaatgctaaggccgctgggtccaggaagatccatttcaactggctgcccccttctggcaagccaatggggtacagggtaaagtactggattcagggtgactccgaatccgaagcccacctgctcgacagcaaggtgccctcagtggagctcaccaacctgtacccgtattgcgactatgagatgaaggtgtgcgcctacggggctcagggcgagggaccctacagctccctggtgtcctgccgcacccaccaggaagtgcccagcgagccagggcgtctggccttcaatgtcgtctcctccacggtgacccagctgagctgggctgagccggctgagaccaacggtgagatcacagcctacgaggtctgctatggcctggtcaacgatgacaaccgacctattgggcccatgaagaaagtgctggttgacaaccctaagaaccggatgctgcttattgagaaccttcgggagtcccagccctaccgctacacggtgaaggcgcgcaacggggccggctgggggcctgagcgggaggccatcatcaacctggccacccagcccaagaggcccatgtccatccccatcatccctgacatccctatcgtggacgcccagagcggggaggactacgacagcttccttatgtacagcgatgacgttctacgctctccatcgggcagccagaggcccagcgtctccgatgacactgagcacctggtgaatggccggatggactttgccttcccgggcagcaccaactccctgcacaggatgaccacgaccagtgctgctgcctatggcacccacctgagcccacacgtgccccaccgcgtgctaagcacatcctccaccctcacacgggactacaactcactgacccgctcagaacactcacactcgaccacactgcccagggactactccaccctcacctccgtctcctcccacgactctcgcctgactgctggtgtgcccgacacgcccacccgcctggtgttctctgccctggggcccacatctctcagagtgagctggcaggagccgcggtgcgagcggccgctgcagggctacagtgtggagtaccagctgctgaacggcggtgagctgcatcggctcaacatccccaaccctgcccagacctcggtggtggtggaagacctcctgcccaaccactcctacgtgttccgcgtgcgggcccagagccaggaaggctggggccgagagcgtgagggtgtcatcaccattgaatcccaggtgcacccgcagagcccactgtgtcccctgccaggctccgccttcactttgagcactcccagtgccccaggcccgctggtgttcactgccctgagcccagactcgctgcagctgagctgggagcggccacggaggcccaatggggatatcgtcggctacctggtgacctgtgagatggcccaaggaggagggccagccaccgcattccgggtggatggagacagccccgagagccggctgaccgtgccgggcctcagcgagaacgtgccctacaagttcaaggtgcaggccaggaccactgagggcttcgggccagagcgcgagggcatcatcaccatagagtcccaggatggaggacccttcccgcagctgggcagccgtgccgggctcttccagcacccgctgcaaagcgagtacagcagcatcaccaccacccacaccagcgccaccgagcccttcctagtggatgggccgaccctgggggcccagcacctggaggcaggcggctccctcacccggcatgtgacccaggagtttgtgagccggacactgaccaccagcggaacccttagcacccacatggaccaacagttcttccaaacttgaccgcaccctgccccacccccgccatgtcccactaggcgtcctcccgactcctctcccggagcctcctcagctactccatccttgcacccctgggggcccagcccacccgcatgcacagagcaggggctaggtgtctcctgggaggcatgaagggggcaaggtccgtcctctgtgggcccaaacctatttgtaaccaaagagctgggagcagcacaaggacccagcctttgttctgcacttaataaatggttttgctactgcta

SEQ ID NO: 330380 - DNA, 399 bp, Homo sapiens
tgggccaaacgcaccgtcaagcagagtgcaagagccgcgtcacagcaatctccccatgtaaggccactaggagcagagagagagccgaggaggtggtggtgcgctgctccttccgggacgaggatgacgactgcacctacagctacaccatggaaggtgacggcgcccctgggcccaacagcactgtcctggtgcacaagaagaaggactgccctccgggctccttctggtggctcatccccctgctcctcctcctcctgccgctcctggccctgctactgctgctatgctggaagtactgtgcctgctgcaaggcctgcctggcacttctcccgtgctgcaaccgaggtcacatggtgggtcagaacatcagttgtatcctctagagtcagctagcag

SEQ ID NO: 330381 - DNA, 5868 bp, Homo sapiens
  misc_feature (28)..(28): n is a, c, g, or t
  misc_feature (30)..(30): n is a, c, g, or t
gcgctgcccgcctcgtccccaccccccnancccccgcgcccgccctcggacagtccctgctcgcccgcgcgctgcagccccatctcctagcggcagcccaggcgcggagggagcgagtccgccccgaggtaggtccaggacgggcgcacagcagcagccgaggctggccgggagagggaggaagaggatggcagggccacgccccagcccatgggccaggctgctcctggcagccttgatcagcgtcagcctctctgggaccttggcaaaccgctgcaagaaggccccagtgaagagctgcacggagtgtgtccgtgtggataaggactgcgcctactgcacagacgagatgttcagggaccggcgctgcaacacccaggcggagctgctggccgcgggctgccagcgggagagcatcgtggtcatggagagcagcttccaaatcacagaggagacccagattgacaccaccctgcggcgcagccagatgtccccccaaggcctgcgggtccgtctgcggcccggtgaggagcggcattttgagctggaggtgtttgagccactggagagccccgtggacctgtacatcctcatggacttctccaactccatgtccgatgatctggacaacctcaagaagatggggcagaacctggctcgggtcctgagccagctcaccagcgactacactattggatttggcaagtttgtggacaaagtcagcgtcccgcagacggacatgaggcctgagaagctgaaggagccctggcccaacagtgacccccccttctccttcaagaacgtcatcagcctgacagaagatgtggatgagttccggaataaactgcagggagagcggatctcaggcaacctggatgctcctgagggcggcttcgatgccatcctgcagacagctgtgtgcacgagggacattggctggcgcccggacagcacccacctgctggtcttctccaccgagtcagccttccactatgaggctgatggcgccaacgtgctggctggcatcatgagccgcaacgatgaacggtgccacctggacaccacgggcacctacacccagtacaggacacaggactacccgtcggtgcccaccctggtgcgcctgctcgccaagcacaacatcatccccatctttgctgtcaccaactactcctatagctactacgagaagcttcacacctatttccctgtctcctcactgggggtgctgcaggaggactcgtccaacatcgtggagctgctggaggaggccttcaatcggatccgctccaacctggacatccgggccctagacagcccccgaggccttcggacagaggtcacctccaagatgttccagaagacgaggactgggtcctttcacatccggcggggggaagtgggtatataccaggtgcagctgcgggcccttgagcacgtggatgggacgcacgtgtgccagctgccggaggaccagaagggcaacatccatctgaaaccttccttctccgacggcctcaagatggacgcgggcatcatctgtgatgtgtgcacctgcgagctgcaaaaagaggtgcggtcagctcgctgcagcttcaacggagacttcgtgtgcggacagtgtgtgtgcagcgagggctggagtggccagacctgcaactgctccaccggctctctgagtgacattcagccctgcctgcgggagggcgaggacaagccgtgctccggccgtggggagtgccagtgcgggcactgtgtgtgctacggcgaaggccgctacgagggtcagttctgcgagtatgacaacttccagtgtccccgcacttccgggttcctctgcaatgaccgaggacgctgctccatgggccagtgtgtgtgtgagcctggttggacaggcccaagctgtgactgtcccctcagcaatgccacctgcatcgacagcaatgggggcatctgtaatggacgtggccactgtgagtgtggccgctgccactgccaccagcagtcgctctacacggacaccatctgcgagatcaactactcggcgatccacccgggcctctgcgaggacctacgctcctgcgtgcagtgccaggcgtggggcaccggcgagaagaaggggcgcacgtgtgaggaatgcaacttcaaggtcaagatggtggacgagcttaagagagccgaggaggtggtggtgcgctgctccttccgggacgaggatgacgactgcacctacagctacaccatggaaggtgacggcgcccctgggcccaacagcactgtcctggtgcacaagaagaaggactgccctccgggctccttctggtggctcatccccctgctcctcctcctcctgccgctcctggccctgctactgctgctatgctggaagtactgtgcctgctgcaaggcctgcctggcacttctcccgtgctgcaaccgaggtcacatggtgggctttaaggaagaccactacatgctgcgggagaacctgatggcctctgaccacttggacacgcccatgctgcgcagcgggaacctcaagggccgtgacgtggtccgctggaaggtcaccaacaacatgcagcggcctggctttgccactcatgccgccagcatcaaccccacagagctggtgccctacgggctgtccttgcgcctggcccgcctttgcaccgagaacctgctgaagcctgacactcgggagtgcgcccagctgcgccaggaggtggaggagaacctgaacgaggtctacaggcagatctccggtgtacacaagctccagcagaccaagttccggcagcagcccaatgccgggaaaaagcaagaccacaccattgtggacacagtgctgatggcgccccgctcggccaagccggccctgctgaagcttacagagaagcaggtggaacagagggccttccacgacctcaaggtggcccccggctactacaccctcactgcagaccaggacgcccggggcatggtggagttccaggagggcgtggagctggtggacgtacgggtgcccctctttatccggcctgaggatgacgacgagaagcagctgctggtggaggccatcgacgtgcccgcaggcactgccaccctcggccgccgcctggtaaacatcaccatcatcaaggagcaagccagagacgtggtgtcctttgagcagcctgagttctcggtcagccgcggggaccaggtggcccgcatccctgtcatccggcgtgtcctggacggcgggaagtcccaggtctcctaccgcacacaggatggcaccgcgcagggcaaccgggactacatccccgtggagggtgagctgctgttccagcctggggaggcctggaaagagctgcaggtgaagctcctggagctgcaagaagttgactccctcctgcggggccgccaggtccgccgtttccacgtccagctcagcaaccctaagtttggggcccacctgggccagccccactccaccaccatcatcatcagggacccagatgaactggaccggagcttcacgagtcagatgttgtcatcacagccaccccctcacggcgacctgggcgccccgcagaaccccaatgctaaggccgctgggtccaggaagatccatttcaactggctgcccccttctggcaagccaatggggtacagggtaaagtactggattcagggtgactccgaatccgaagcccacctgctcgacagcaaggtgccctcagtggagctcaccaacctgtacccgtattgcgactatgagatgaaggtgtgcgcctacggggctcagggcgagggaccctacagctccctggtgtcctgccgcacccaccaggaagtgcccagcgagccagggcgtctggccttcaatgtcgtctcctccacggtgacccagctgagctgggctgagccggctgagaccaacggtgagatcacagcctacgaggtctgctatggcctggtcaacgatgacaaccgacctattgggcccatgaagaaagtgctggttgacaaccctaagaaccggatgctgcttattgagaaccttcgggagtcccagccctaccgctacacggtgaaggcgcgcaacggggccggctgggggcctgagcgggaggccatcatcaacctggccacccagcccaagaggcccatgtccatccccatcatccctgacatccctatcgtggacgcccagagcggggaggactacgacagcttccttatgtacagcgatgacgttctacgctctccatcgggcagccagaggcccagcgtctccgatgacactgagcacctggtgaatggccggatggactttgccttcccgggcagcaccaactccctgcacaggatgaccacgaccagtgctgctgcctatggcacccacctgagcccacacgtgccccaccgcgtgctaagcacatcctccaccctcacacgggactacaactcactgacccgctcagaacactcacactcgaccacactgcccagggactactccaccctcacctccgtctcctcccacggcctccctcccatctgggaacacgggaggagcaggcttccgctgtcctgggccctggggtcccggagtcgggctcagatgaaagggttccccccttccaggggcccacgagactctataatcctggctgggaggccagcagcgccctcctggggcccagactctcgcctgactgctggtgtgcccgacacgcccacccgcctggtgttctctgccctggggcccacatctctcagagtgagctggcaggagccgcggtgcgagcggccgctgcagggctacagtgtggagtaccagctgctgaacggcggtgagctgcatcggctcaacatccccaaccctgcccagacctcggtggtggtggaagacctcctgcccaaccactcctacgtgttccgcgtgcgggcccagagccaggaaggctggggccgagagcgtgagggtgtcatcaccattgaatcccaggtgcacccgcagagcccactgtgtcccctgccaggctccgccttcactttgagcactcccagtgccccaggcccgctggtgttcactgccctgagcccagactcgctgcagctgagctgggagcggccacggaggcccaatggggatatcgtcggctacctggtgacctgtgagatggcccaaggaggagggccagccaccgcattccgggtggatggagacagccccgagagccggctgaccgtgccgggcctcagcgagaacgtgccctacaagttcaaggtgcaggccaggaccactgagggcttcgggccagagcgcgagggcatcatcaccatagagtcccaggatggaggacccttcccgcagctgggcagccgtgccgggctcttccagcacccgctgcaaagcgagtacagcagcatcaccaccacccacaccagcgccaccgagcccttcctagtggatgggccgaccctgggggcccagcacctggaggcaggcggctccctcacccggcatgtgacccaggagtttgtgagccggacactgaccaccagcggaacccttagcacccacatggaccaacagttcttccaaacttgaccgcaccctgccccacccccgccatgtcccactaggcgtcctcccgactcctctcccggagcctcctcagctactccatccttgcacccctgggggcccagcccacccgcatgcacagagcaggggctaggtgtctcctgggaggcatgaagggggcaaggtccgtcctctgtgggcccaaacctatttgtaaccaaagagctgggagcagcacaaggacccagcctttgttctgcacttaataaatggttttgctactgcta

SEQ ID NO: 330382 - DNA, 5672 bp, Homo sapiens
  misc_feature (28)..(28): n is a, c, g, or t
  misc_feature (30)..(30): n is a, c, g, or t
gcgctgcccgcctcgtccccaccccccnancccccgcgcccgccctcggacagtccctgctcgcccgcgcgctgcagccccatctcctagcggcagcccaggcgcggagggagcgagtccgccccgaggtaggtccaggacgggcgcacagcagcagccgaggctggccgggagagggaggaagaggatggcagggccacgccccagcccatgggccaggctgctcctggcagccttgatcagcgtcagcctctctgggaccttggcaaaccgctgcaagaaggccccagtgaagagctgcacggagtgtgtccgtgtggataaggactgcgcctactgcacagacgagatgttcagggaccggcgctgcaacacccaggcggagctgctggccgcgggctgccagcgggagagcatcgtggtcatggagagcagcttccaaatcacagaggagacccagattgacaccaccctgcggcgcagccagatgtccccccaaggcctgcgggtccgtctgcggcccggtgaggagcggcattttgagctggaggtgtttgagccactggagagccccgtggacctgtacatcctcatggacttctccaactccatgtccgatgatctggacaacctcaagaagatggggcagaacctggctcgggtcctgagccagctcaccagcgactacactattggatttggcaagtttgtggacaaagtcagcgtcccgcagacggacatgaggcctgagaagctgaaggagccctggcccaacagtgacccccccttctccttcaagaacgtcatcagcctgacagaagatgtggatgagttccggaataaactgcagggagagcggatctcaggcaacctggatgctcctgagggcggcttcgatgccatcctgcagacagctgtgtgcacgagggacattggctggcgcccggacagcacccacctgctggtcttctccaccgagtcagccttccactatgaggctgatggcgccaacgtgctggctggcatcatgagccgcaacgatgaacggtgccacctggacaccacgggcacctacacccagtacaggacacaggactacccgtcggtgcccaccctggtgcgcctgctcgccaagcacaacatcatccccatctttgctgtcaccaactactcctatagctactacgagaagcttcacacctatttccctgtctcctcactgggggtgctgcaggaggactccggatccgctccaacctggacatccgggccctagacagcccccgaggccttcggacagaggtcacctccaagatgttccagaagacgaggactgggtcctttcacatccggcggggggaagtgggtatataccaggtgcagctgcgggcccttgagcacgtggatgggacgcacgtgtgccagctgccggaggaccagaagggcaacatccatctgaaaccttccttctccgacggcctcaagatggacgcgggcatcatctgtgatgtgtgcacctgcgagctgcaaaaagaggtgcggtcagctcgctgcagcttcaacggagacttcgtgtgcggacagtgtgtgtgcagcgagggctggagtggccagacctgcaactgctccaccggctctctgagtgacattcagccctgcctgcgggagggcgaggacaagccgtgctccggccgtggggagtgccagtgcgggcactgtgtgtgctacggcgaaggccgctacgagggtcagttctgcgagtatgacaacttccagtgtccccgcacttccgggttcctctgcaatgaccgaggacgctgctccatgggccagtgtgtgtgtgagcctggttggacaggcccaagctgtgactgtcccctcagcaatgccacctgcatcgacagcaatgggggcatctgtaatggacgtggccactgtgagtgtggccgctgccactgccaccagcagtcgctctacacggacaccatctgcgagatcaactactcggcgatccacccgggcctctgcgaggacctacgctcctgcgtgcagtgccaggcgtggggcaccggcgagaagaaggggcgcacgtgtgaggaatgcaacttcaaggtcaagatggtggacgagcttaagagagccgaggaggtggtggtgcgctgctccttccgggacgaggatgacgactgcacctacagctacaccatggaaggtgacggcgcccctgggcccaacagcactgtcctggtgcacaagaagaaggactgccctccgggctccttctggtggctcatccccctgctcctcctcctcctgccgctcctggccctgctactgctgctatgctggaagtactgtgcctgctgcaaggcctgcctggcacttctcccgtgctgcaaccgaggtcacatggtgggctttaaggaagaccactacatgctgcgggagaacctgatggcctctgaccacttggacacgcccatgctgcgcagcgggaacctcaagggccgtgacgtggtccgctggaaggtcaccaacaacatgcagcggcctggctttgccactcatgccgccagcatcaaccccacagagctggtgccctacgggctgtccttgcgcctggcccgcctttgcaccgagaacctgctgaagcctgacactcgggagtgcgcccagctgcgccaggaggtggaggagaacctgaacgaggtctacaggcagatctccggtgtacacaagctccagcagaccaagttccggcagcagcccaatgccgggaaaaagcaagaccacaccattgtggacacagtgctgatggcgccccgctcggccaagccggccctgctgaagcttacagagaagcaggtggaacagagggccttccacgacctcaaggtggcccccggctactacaccctcactgcagaccaggacgcccggggcatggtggagttccaggagggcgtggagctggtggacgtacgggtgcccctctttatccggcctgaggatgacgacgagaagcagctgctggtggaggccatcgacgtgcccgcaggcactgccaccctcggccgccgcctggtaaacatcaccatcatcaaggagcaagccagagacgtggtgtcctttgagcagcctgagttctcggtcagccgcggggaccaggtggcccgcatccctgtcatccggcgtgtcctggacggcgggaagtcccaggtctcctaccgcacacaggatggcaccgcgcagggcaaccgggactacatccccgtggagggtgagctgctgttccagcctggggaggcctggaaagagctgcaggtgaagctcctggagctgcaagaagttgactccctcctgcggggccgccaggtccgccgtttccacgtccagctcagcaaccctaagtttggggcccacctgggccagccccactccaccaccatcatcatcagggacccagatgaactggaccggagcttcacgagtcagatgttgtcatcacagccaccccctcacggcgacctgggcgccccgcagaaccccaatgctaaggccgctgggtccaggaagatccatttcaactggctgcccccttctggcaagccaatggggtacagggtaaagtactggattcagggtgactccgaatccgaagcccacctgctcgacagcaaggtgccctcagtggagctcaccaacctgtacccgtattgcgactatgagatgaaggtgtgcgcctacggggctcagggcgagggaccctacagctccctggtgtcctgccgcacccaccaggaagtgcccagcgagccagggcgtctggccttcaatgtcgtctcctccacggtgacccagctgagctgggctgagccggctgagaccaacggtgagatcacagcctacgaggtctgctatggcctggtcaacgatgacaaccgacctattgggcccatgaagaaagtgctggttgacaaccctaagaaccggatgctgcttattgagaaccttcgggagtcccagccctaccgctacacggtgaaggcgcgcaacggggccggctgggggcctgagcgggaggccatcatcaacctggccacccagcccaagaggcccatgtccatccccatcatccctgacatccctatcgtggacgcccagagcggggaggactacgacagcttccttatgtacagcgatgacgttctacgctctccatcgggcagccagaggcccagcgtctccgatgacactgagcacctggtgaatggccggatggactttgccttcccgggcagcaccaactccctgcacaggatgaccacgaccagtgctgctgcctatggcacccacctgagcccacacgtgccccaccgcgtgctaagcacatcctccaccctcacacgggactacaactcactgacccgctcagaacactcacactcgaccacactgcccagggactactccaccctcacctccgtctcctcccacgactctcgcctgactgctggtgtgcccgacacgcccacccgcctggtgttctctgccctggggcccacatctctcagagtgagctggcaggagccgcggtgcgagcggccgctgcagggctacagtgtggagtaccagctgctgaacggcggtgagctgcatcggctcaacatccccaaccctgcccagacctcggtggtggtggaagacctcctgcccaaccactcctacgtgttccgcgtgcgggcccagagccaggaaggctggggccgagagcgtgagggtgtcatcaccattgaatcccaggtgcacccgcagagcccactgtgtcccctgccaggctccgccttcactttgagcactcccagtgccccaggcccgctggtgttcactgccctgagcccagactcgctgcagctgagctgggagcggccacggaggcccaatggggatatcgtcggctacctggtgacctgtgagatggcccaaggaggagggccagccaccgcattccgggtggatggagacagccccgagagccggctgaccgtgccgggcctcagcgagaacgtgccctacaagttcaaggtgcaggccaggaccactgagggcttcgggccagagcgcgagggcatcatcaccatagagtcccaggatggaggacccttcccgcagctgggcagccgtgccgggctcttccagcacccgctgcaaagcgagtacagcagcatcaccaccacccacaccagcgccaccgagcccttcctagtggatgggccgaccctgggggcccagcacctggaggcaggcggctccctcacccggcatgtgacccaggagtttgtgagccggacactgaccaccagcggaacccttagcacccacatggaccaacagttcttccaaacttgaccgcaccctgccccacccccgccatgtcccactaggcgtcctcccgactcctctcccggagcctcctcagctactccatccttgcacccctgggggcccagcccacccgcatgcacagagcaggggctaggtgtctcctgggaggcatgaagggggcaaggtccgtcctctgtgggcccaaacctatttgtaaccaaagagctgggagcagcacaaggacccagcctttgttctgcacttaataaatggttttgctactgcta

SEQ ID NO: 330383 - DNA, 3616 bp, Homo sapiens
tgggccaaacgcaccgtcaagcagagtgcaagagccgcgtcacagcaatctccccatgtaaggccactaggagcagagagagagccgaggaggtggtggtgcgctgctccttccgggacgaggatgacgactgcacctacagctacaccatggaaggtgacggcgcccctgggcccaacagcactgtcctggtgcacaagaagaaggactgccctccgggctccttctggtggctcatccccctgctcctcctcctcctgccgctcctggccctgctactgctgctatgctggaagtactgtgcctgctgcaaggcctgcctggcacttctcccgtgctgcaaccgaggtcacatggtgggctttaaggaagaccactacatgctgcgggagaacctgatggcctctgaccacttggacacgcccatgctgcgcagcgggaacctcaagggccgtgacgtggtccgctggaaggtcaccaacaacatgcagcggcctggctttgccactcatgccgccagcatcaaccccacagagctggtgccctacgggctgtccttgcgcctggcccgcctttgcaccgagaacctgctgaagcctgacactcgggagtgcgcccagctgcgccaggaggtggaggagaacctgaacgaggtctacaggcagatctccggtgtacacaagctccagcagaccaagttccggcagcagcccaatgccgggaaaaagcaagaccacaccattgtggacacagtgctgatggcgccccgctcggccaagccggccctgctgaagcttacagagaagcaggtggaacagagggccttccacgacctcaaggtggcccccggctactacaccctcactgcagaccaggacgcccggggcatggtggagttccaggagggcgtggagctggtggacgtacgggtgcccctctttatccggcctgaggatgacgacgagaagcagctgctggtggaggccatcgacgtgcccgcaggcactgccaccctcggccgccgcctggtaaacatcaccatcatcaaggagcaagccagagacgtggtgtcctttgagcagcctgagttctcggtcagccgcggggaccaggtggcccgcatccctgtcatccggcgtgtcctggacggcgggaagtcccaggtctcctaccgcacacaggatggcaccgcgcagggcaaccgggactacatccccgtggagggtgagctgctgttccagcctggggaggcctggaaagagctgcaggtgaagctcctggagctgcaagaagttgactccctcctgcggggccgccaggtccgccgtttccacgtccagctcagcaaccctaagtttggggcccacctgggccagccccactccaccaccatcatcatcagggacccagatgaactggaccggagcttcacgagtcagatgttgtcatcacagccaccccctcacggcgacctgggcgccccgcagaaccccaatgctaaggccgctgggtccaggaagatccatttcaactggctgcccccttctggcaagccaatggggtacagggtaaagtactggattcagggtgactccgaatccgaagcccacctgctcgacagcaaggtgccctcagtggagctcaccaacctgtacccgtattgcgactatgagatgaaggtgtgcgcctacggggctcagggcgagggaccctacagctccctggtgtcctgccgcacccaccaggaagtgcccagcgagccagggcgtctggccttcaatgtcgtctcctccacggtgacccagctgagctgggctgagccggctgagaccaacggtgagatcacagcctacgaggtctgctatggcctggtcaacgatgacaaccgacctattgggcccatgaagaaagtgctggttgacaaccctaagaaccggatgctgcttattgagaaccttcgggagtcccagccctaccgctacacggtgaaggcgcgcaacggggccggctgggggcctgagcgggaggccatcatcaacctggccacccagcccaagaggcccatgtccatccccatcatccctgacatccctatcgtggacgcccagagcggggaggactacgacagcttccttatgtacagcgatgacgttctacgctctccatcgggcagccagaggcccagcgtctccgatgacactgagcacctggtgaatggccggatggactttgccttcccgggcagcaccaactccctgcacaggatgaccacgaccagtgctgctgcctatggcacccacctgagcccacacgtgccccaccgcgtgctaagcacatcctccaccctcacacgggactacaactcactgacccgctcagaacactcacactcgaccacactgcccagggactactccaccctcacctccgtctcctcccacgactctcgcctgactgctggtgtgcccgacacgcccacccgcctggtgttctctgccctggggcccacatctctcagagtgagctggcaggagccgcggtgcgagcggccgctgcagggctacagtgtggagtaccagctgctgaacggcggtgagctgcatcggctcaacatccccaaccctgcccagacctcggtggtggtggaagacctcctgcccaaccactcctacgtgttccgcgtgcgggcccagagccaggaaggctggggccgagagcgtgagggtgtcatcaccattgaatcccaggtgcacccgcagagcccactgtgtcccctgccaggctccgccttcactttgagcactcccagtgccccaggcccgctggtgttcactgccctgagcccagactcgctgcagctgagctgggagcggccacggaggcccaatggggatatcgtcggctacctggtgacctgtgagatggcccaaggaggagggccagccaccgcattccgggtggatggagacagccccgagagccggctgaccgtgccgggcctcagcgagaacgtgccctacaagttcaaggtgcaggccaggaccactgagggcttcgggccagagcgcgagggcatcatcaccatagagtcccaggatggaggacccttcccgcagctgggcagccgtgccgggctcttccagcacccgctgcaaagcgagtacagcagcatcaccaccacccacaccagcgccaccgagcccttcctagtggatgggccgaccctgggggcccagcacctggaggcaggcggctccctcacccggcatgtgacccaggagtttgtgagccggacactgaccaccagcggaacccttagcacccacatggaccaacagttcttccaaacttgaccgcaccctgccccacccccgccatgtcccactaggcgtcctcccgactcctctcccggagcctcctcagctactccatccttgcacccctgggggcccagcccacccgcatgcacagagcaggggctaggtgtctcctgggaggcatgaagggggcaaggtccgtcctctgtgggcccaaacctatttgtaaccaaagagctgggagcagcacaaggacccagcctttgttctgcacttaataaatggttttgctactgcta

SEQ ID NO: 330384 - DNA, 5308 bp, Homo sapiens
  misc_feature (28)..(28): n is a, c, g, or t
  misc_feature (30)..(30): n is a, c, g, or t
gcgctgcccgcctcgtccccaccccccnancccccgcgcccgccctcggacagtccctgctcgcccgcgcgctgcagccccatctcctagcggcagcccaggcgcggagggagcgagtccgccccgaggtaggtccaggacgggcgcacagcagcagccgaggctggccgggagagggaggaagaggatggcagggccacgccccagcccatgggccaggctgctcctggcagccttgatcagcgtcagcctctctgggaccttggcaaaccgctgcaagaaggccccagtgaagagctgcacggagtgtgtccgtgtggataaggactgcgcctactgcacagacgagatgttcagggaccggcgctgcaacacccaggcggagctgctggccgcgggctgccagcgggagagcatcgtggtcatggagagcagcttccaaatcacagaggagacccagattgacaccaccctgcggcgcagccagatgtccccccaaggcctgcgggtccgtctgcggcccggtgaggagcggcattttgagctggaggtgtttgagccactggagagccccgtggacctgtacatcctcatggacttctccaactccatgtccgatgatctggacaacctcaagaagatggggcagaacctggctcgggtcctgagccagctcaccagcgactacactattggatttggcaagtttgtggacaaagtcagcgtcccgcagacggacatgaggcctgagaagctgaaggagccctggcccaacagtgacccccccttctccttcaagaacgtcatcagcctgacagaagatgtggatgagttccggaataaactgcagggagagcggatctcaggcaacctggatgctcctgagggcggcttcgatgccatcctgcagacagctgtgtgcacgagggacattggctggcgcccggacagcacccacctgctggtcttctccaccgagtcagccttccactatgaggctgatggcgccaacgtgctggctggcatcatgagccgcaacgatgaacggtgccacctggacaccacgggcacctacacccagtacaggacacaggactacccgtcggtgcccaccctggtgcgcctgctcgccaagcacaacatcatccccatctttgctgtcaccaactactcctatagctactacgagaagcttcacacctatttccctgtctcctcactgggggtgctgcaggaggactcgtccaacatcgtggagctgctggaggaggccttcaatcggatccgctccaacctggacatccgggccctagacagcccccgaggccttcggacagaggtcacctccaagatgttccagaagacgaggactgggtcctttcacatccggcggggggaagtgggtatataccaggtgcagctgcgggcccttgagcacgtggatgggacgcacgtgtgccagctgccggaggaccagaagggcaacatccatctgaaaccttccttctccgacggcctcaagatggacgcgggcatcatctgtgatgtgtgcacctgcgagctgcaaaaagaggtgcggtcagctcgctgcagcttcaacggagacttcgtgtgcggacagtgtgtgtgcagcgagggctggagtggccagacctgcaactgctccaccggctctctgagtgacattcagccctgcctgcgggagggcgaggacaagccgtgctccggccgtggggagtgccagtgcgggcactgtgtgtgctacggcgaaggccgctacgagggtcagttctgcgagtatgacaacttccagtgtccccgcacttccgggttcctctgcaatgaccgaggacgctgctccatgggccagtgtgtgtgtgagcctggttggacaggcccaagctgtgactgtcccctcagcaatgccacctgcatcgacagcaatgggggcatctgtaatggacgtggccactgtgagtgtggccgctgccactgccaccagcagtcgctctacacggacaccatctgcgagatcaactactcggcgatccacccgggcctctgcgaggacctacgctcctgcgtgcagtgccaggcgtggggcaccggcgagaagaaggggcgcacgtgtgaggaatgcaacttcaaggtcaagatggtggacgagcttaagagagccgaggaggtggtggtgcgctgctccttccgggacgaggatgacgactgcacctacagctacaccatggaaggtgacggcgcccctgggcccaacagcactgtcctggtgcacaagaagaaggactgccctccgggctccttctggtggctcatccccctgctcctcctcctcctgccgctcctggccctgctactgctgctatgctggaagtactgtgcctgctgcaaggcctgcctggcacttctcccgtgctgcaaccgaggtcacatggtgggctttaaggaagaccactacatgctgcgggagaacctgatggcctctgaccacttggacacgcccatgctgcgcagcgggaacctcaagggccgtgacgtggtccgctggaaggtcaccaacaacatgcagcggcctggctttgccactcatgccgccagcatcaaccccacagagctggtgccctacgggctgtccttgcgcctggcccgcctttgcaccgagaacctgctgaagcctgacactcgggagtgcgcccagctgcgccaggaggtggaggagaacgtaaggacccaggaactaggcctggccggagatgtggctgaacgaggtctacaggcagatctccggtgtacacaagctccagcagaccaagttccggcagcagcccaatgccgggaaaaagcaagaccacaccattgtggacacagtgctgatggcgccccgctcggccaagccggccctgctgaagcttacagagaagcaggtggaacagagggccttccacgacctcaaggtggcccccggctactacaccctcactgcagaccaggacgcccggggcatggtggagttccaggagggcgtggagctggtggacgtacgggtgcccctctttatccggcctgaggatgacgacgagaagcagctgctggtggaggccatcgacgtgcccgcaggcactgccaccctcggccgccgcctggtaaacatcaccatcatcaaggagcaagccagagacgtggtgtcctttgagcagcctgagttctcggtcagccgcggggaccaggtggcccgcatccctgtcatccggcgtgtcctggacggcgggaagtcccaggtctcctaccgcacacaggatggcaccgcgcagggcaaccgggactacatccccgtggagggtgagctgctgttccagcctggggaggcctggaaagagctgcaggtgaagctcctggagctgcaagaagttgactccctcctgcggggccgccaggtccgccgtttccacgtccagctcagcaaccctaagtttggggcccacctgggccagccccactccaccaccatcatcatcagggacccagatgaactggaccggagcttcacgagtcagatgttgtcatcacagccaccccctcacggcgacctgggcgccccgcagaaccccaatgctaaggccgctgggtccaggaagatccatttcaactggctgcccccttctggcaagccaatggggtacagggtaaagtactggattcagggtgactccgaatccgaagcccacctgctcgacagcaaggtgccctcagtggagctcaccaacctgtacccgtattgcgactatgagatgaaggtgtgcgcctacggggctcagggcgagggaccctacagctccctggtgtcctgccgcacccaccaggaagtgcccagcgagccagggcgtctggccttcaatgtcgtctcctccacggtgacccagctgagctgggctgagccggctgagaccaacggtgagatcacagcctacgaggtctgctatggcctggtcaacgatgacaaccgacctattgggcccatgaagaaagtgctggttgacaaccctaagaaccggatgctgcttattgagaaccttcgggagtcccagccctaccgctacacggtgaaggcgcgcaacggggccggctgggggcctgagcgggaggccatcatcaacctggccacccagcccaagaggcccatgtccatccccatcatccctgacatccctatcgtggacgcccagagcggggaggactacgacagcttccttatgtacagcgatgacgttctacgctctccatcgggcagccagaggcccagcgtctccgatgacactgagcacctggtgaatggccggatggactttgccttcccgggcagcaccaactccctgcacaggatgaccacgaccagtgctgctgcctatggcacccacctgagcccacacgtgccccaccgcgtgctaagcacatcctccaccctcacacgggactacaactcactgacccgctcagaacactcacactcgaccacactgcccagggactactccaccctcacctccgtctcctcccacgactctcgcctgactgctggtgtgcccgacacgcccacccgcctggtgttctctgccctggggcccacatctctcagagtgagctggcaggagccgcggtgcgagcggccgctgcagggctacagtgtggagtaccagctgctgaacggcggtgagctgcatcggctcaacatccccaaccctgcccagacctcggtggtggtggaagacctcctgcccaaccactcctacgtgttccgcgtgcgggcccagagccaggaaggctggggccgagagcgtgagggtgtcatcaccattgaatcccaggtgcacccgcagagcccactgtgtcccctgccaggctccgccttcactttgagcactcccagtgccccaggcccgctggtgttcactgccctgagcccagactcgctgcagctgagctgggagcggccacggaggcccaatggggatatcgtcggctacctggtgacctgtgagatggcccaaggaggagggccagccaccgcattccgggtggatggagacagccccgagagctcagctactccatccttgcacccctgggggcccagcccacccgcatgcacagagcaggggctaggtgtctcctgggaggcatgaagggggcaaggtccgtcctctgtgggcccaaacctatttgtaaccaaagagctgggagcagcacaaggacccagcctttgttctgcacttaataaatggttttgctactgcta

SEQ ID NO: 330385 - DNA, 1773 bp, Homo sapiens
gcctagcagaacagttatttctccagtcctggaagggaggcagggacctattgggcccatgaagaaagtgctggttgacaaccctaagaaccggatgctgcttattgagaaccttcgggagtcccagccctaccgctacacggtgaaggcgcgcaacggggccggctgggggcctgagcgggaggccatcatcaacctggccacccagcccaagaggcccatgtccatccccatcatccctgacatccctatcgtggacgcccagagcggggaggactacgacagcttccttatgtacagcgatgacgttctacgctctccatcgggcagccagaggcccagcgtctccgatgacactgagcacctggtgaatggccggatggactttgccttcccgggcagcaccaactccctgcacaggatgaccacgaccagtgctgctgcctatggcacccacctgagcccacacgtgccccaccgcgtgctaagcacatcctccaccctcacacgggactacaactcactgacccgctcagaacactcacactcgaccacactgcccagggactactccaccctcacctccgtctcctcccacgactctcgcctgactgctggtgtgcccgacacgcccacccgcctggtgttctctgccctggggcccacatctctcagagtgagctggcaggagccgcggtgcgagcggccgctgcagggctacagtgtggagtaccagctgctgaacggcggtgagctgcatcggctcaacatccccaaccctgcccagacctcggtggtggtggaagacctcctgcccaaccactcctacgtgttccgcgtgcgggcccagagccaggaaggctggggccgagagcgtgagggtgtcatcaccattgaatcccaggtgcacccgcagagcccactgtgtcccctgccaggctccgccttcactttgagcactcccagtgccccaggcccgctggtgttcactgccctgagcccagactcgctgcagctgagctgggagcggccacggaggcccaatggggatatcgtcggctacctggtgacctgtgagatggcccaaggaggagggccagccaccgcattccgggtggatggagacagccccgagagccggctgaccgtgccgggcctcagcgagaacgtgccctacaagttcaaggtgcaggccaggaccactgagggcttcgggccagagcgcgagggcatcatcaccatagagtcccaggatggaggacccttcccgcagctgggcagccgtgccgggctcttccagcacccgctgcaaagcgagtacagcagcatcaccaccacccacaccagcgccaccgagcccttcctagtggatgggccgaccctgggggcccagcacctggaggcaggcggctccctcacccggcatgtgacccaggagtttgtgagccggacactgaccaccagcggaacccttagcacccacatggaccaacagttcttccaaacttgaccgcaccctgccccacccccgccatgtcccactaggcgtcctcccgactcctctcccggagcctcctcagctactccatccttgcacccctgggggcccagcccacccgcatgcacagagcaggggctaggtgtctcctgggaggcatgaagggggcaaggtccgtcctctgtgggcccaaacctatttgtaaccaaagagctgggagcagcacaaggacccagcctttgttctgcacttaataaatggttttgctactgcta

SEQ ID NO: 330386 - DNA, 4886 bp, Homo sapiens
  misc_feature (28)..(28): n is a, c, g, or t
  misc_feature (30)..(30): n is a, c, g, or t
gcgctgcccgcctcgtccccaccccccnancccccgcgcccgccctcggacagtccctgctcgcccgcgcgctgcagccccatctcctagcggcagcccaggcgcggagggagcgagtccgccccgaggtaggtccaggacgggcgcacagcagcagccgaggctggccgggagagggaggaagaggatggcagggccacgccccagcccatgggccaggctgctcctggcagccttgatcagcgtcagcctctctgggaccttggcaaaccgctgcaagaaggccccagtgaagagctgcacggagtgtgtccgtgtggataaggactgcgcctactgcacagacgagatgttcagggaccggcgctgcaacacccaggcggagctgctggccgcgggctgccagcgggagagcatcgtggtcatggagagcagcttccaaatcacagaggagacccagattgacaccaccctgcggcgcagccagatgtccccccaaggcctgcgggtccgtctgcggcccggtgaggagcggcattttgagctggaggtgtttgagccactggagagccccgtggacctgtacatcctcatggacttctccaactccatgtccgatgatctggacaacctcaagaagatggggcagaacctggctcgggtcctgagccagctcaccagcgactacactattggatttggcaagtttgtggacaaagtcagcgtcccgcagacggacatgaggcctgagaagctgaaggagccctggcccaacagtgacccccccttctccttcaagaacgtcatcagcctgacagaagatgtggatgagttccggaataaactgcagggagagcggatctcaggcaacctggatgctcctgagggcggcttcgatgccatcctgcagacagctgtgtgcacgagggacattggctggcgcccggacagcacccacctgctggtcttctccaccgagtcagccttccactatgaggctgatggcgccaacgtgctggctggcatcatgagccgcaacgatgaacggtgccacctggacaccacgggcacctacacccagtacaggacacaggactacccgtcggtgcccaccctggtgcgcctgctcgccaagcacaacatcatccccatctttgctgtcaccaactactcctatagctactacgagaagcttcacacctatttccctgtctcctcactgggggtgctgcaggaggactcgtccaacatcgtggagctgctggaggaggccttcaatcggatccgctccaacctggacatccgggccctagacagcccccgaggccttcggacagaggtcacctccaagatgttccagaagacgaggactgggtcctttcacatccggcggggggaagtgggtatataccaggtgcagctgcgggcccttgagcacgtggatgggacgcacgtgtgccagctgccggaggaccagaagggcaacatccatctgaaaccttccttctccgacggcctcaagatggacgcgggcatcatctgtgatgtgtgcacctgcgagctgcaaaaagaggtgcggtcagctcgctgcagcttcaacggagacttcgtgtgcggacagtgtgtgtgcagcgagggctggagtggccagacctgcaactgctccaccggctctctgagtgacattcagccctgcctgcgggagggcgaggacaagccgtgctccggccgtggggagtgccagtgcgggcactgtgtgtgctacggcgaaggccgctacgagggtcagttctgcgagtatgacaacttccagtgtccccgcacttccgggttcctctgcaatgaccgaggacgctgctccatgggccagtgtgtgtgtgagcctggttggacaggcccaagctgtgactgtcccctcagcaatgccacctgcatcgacagcaatgggggcatctgtaatggacgtggccactgtgagtgtggccgctgccactgccaccagcagtcgctctacacggacaccatctgcgagatcaactactcggcgatccacccgggcctctgcgaggacctacgctcctgcgtgcagtgccaggcgtggggcaccggcgagaagaaggggcgcacgtgtgaggaatgcaacttcaaggtcaagatggtggacgagcttaagagagccgaggaggtggtggtgcgctgctccttccgggacgaggatgacgactgcacctacagctacaccatggaaggtgacggcgcccctgggcccaacagcactgtcctggtgcacaagaagaaggactgccctccgggctccttctggtggctcatccccctgctcctcctcctcctgccgctcctggccctgctactgctgctatgctggaagtactgtgcctgctgcaaggcctgcctggcacttctcccgtgctgcaaccgaggtcacatggtgggctttaaggaagaccactacatgctgcgggagaacctgatggcctctgaccacttggacacgcccatgctgcgcagcgggaacctcaagggccgtgacgtggtccgctggaaggtcaccaacaacatgcagcggcctggctttgccactcatgccgccagcatcaaccccacagagctggtgccctacgggctgtccttgcgcctggcccgcctttgcaccgagaacctgctgaagcctgacactcgggagtgcgcccagctgcgccaggaggtggaggagaacgtaaggacccaggaactaggcctggccggagatgtggctgaacgaggtctacaggcagatctccggtgtacacaagctccagcagaccaagttccggcagcagcccaatgccgggaaaaagcaagaccacaccattgtggacacagtgctgatggcgccccgctcggccaagccggccctgctgaagcttacagagaagcaggtggaacagagggccttccacgacctcaaggtggcccccggctactacaccctcactgcagaccaggacgcccggggcatggtggagttccaggagggcgtggagctggtggacgtacgggtgcccctctttatccggcctgaggatgacgacgagaagcagctgctggtggaggccatcgacgtgcccgcaggcactgccaccctcggccgccgcctggtaaacatcaccatcatcaaggagcaagccagagacgtggtgtcctttgagcagcctgagttctcggtcagccgcggggaccaggtggcccgcatccctgtcatccggcgtgtcctggacggcgggaagtcccaggtctcctaccgcacacaggatggcaccgcgcagggcaaccgggactacatccccgtggagggtgagctgctgttccagcctggggaggcctggaaagagctgcaggtgaagctcctggagctgcaagaagttgactccctcctgcggggccgccaggtccgccgtttccacgtccagctcagcaaccctaagtttggggcccacctgggccagccccactccaccaccatcatcatcagggacccagacgaccagtgctgctgcctatggcacccacctgagcccacacgtgccccaccgcgtgctaagcacatcctccaccctcacacgggactacaactcactgacccgctcagaacactcacactcgaccacactgcccagggactactccaccctcacctccgtctcctcccacgactctcgcctgactgctggtgtgcccgacacgcccacccgcctggtgttctctgccctggggcccacatctctcagagtgagctggcaggagccgcggtgcgagcggccgctgcagggctacagtgtggagtaccagctgctgaacggcggtgagctgcatcggctcaacatccccaaccctgcccagacctcggtggtggtggaagacctcctgcccaaccactcctacgtgttccgcgtgcgggcccagagccaggaaggctggggccgagagcgtgagggtgtcatcaccattgaatcccaggtgcacccgcagagcccactgtgtcccctgccaggctccgccttcactttgagcactcccagtgccccaggcccgctggtgttcactgccctgagcccagactcgctgcagctgagctgggagcggccacggaggcccaatggggatatcgtcggctacctggtgacctgtgagatggcccaaggaggagggccagccaccgcattccgggtggatggagacagccccgagagccggctgaccgtgccgggcctcagcgagaacgtgccctacaagttcaaggtgcaggccaggaccactgagggcttcgggccagagcgcgagggcatcatcaccatagagtcccaggatggaggacccttcccgcagctgggcagccgtgccgggctcttccagcacccgctgcaaagcgagtacagcagcatcaccaccacccacaccagcgccaccgagcccttcctagtggatgggccgaccctgggggcccagcacctggaggcaggcggctccctcacccggcatgtgacccaggagtttgtgagccggacactgaccaccagcggaacccttagcacccacatggaccaacagttcttccaaacttgaccgcaccctgccccacccccgccatgtcccactaggcgtcctcccgactcctctcccggagcctcctcagctactccatccttgcacccctgggggcccagcccacccgcatgcacagagcaggggctaggtgtctcctgggaggcatgaagggggcaaggtccgtcctctgtgggcccaaacctatttgtaaccaaagagctgggagcagcacaaggacccagcctttgttctgcacttaataaatggttttgctactgcta

SEQ ID NO: 330387 - DNA, 4736 bp, Homo sapiens
  misc_feature (28)..(28): n is a, c, g, or t
  misc_feature (30)..(30): n is a, c, g, or t
gcgctgcccgcctcgtccccaccccccnancccccgcgcccgccctcggacagtccctgctcgcccgcgcgctgcagccccatctcctagcggcagcccaggcgcggagggagcgagtccgccccgaggtaggtccaggacgggcgcacagcagcagccgaggctggccgggagagggaggaagaggatggcagggccacgccccagcccatgggccaggctgctcctggcagccttgatcagcgtcagcctctctgggaccttggcaaaccgctgcaagaaggccccagtgaagagctgcacggagtgtgtccgtgtggataaggactgcgcctactgcacagacgagatgttcagggaccggcgctgcaacacccaggcggagctgctggccgcgggctgccagcgggagagcatcgtggtcatggagagcagcttccaaatcacagaggagacccagattgacaccaccctgcggcgcagccagatgtccccccaaggcctgcgggtccgtctgcggcccggtgaggagcggcattttgagctggaggtgtttgagccactggagagccccgtggacctgtacatcctcatggacttctccaactccatgtccgatgatctggacaacctcaagaagatggggcagaacctggctcgggtcctgagccagctcaccagcgactacactattggatttggcaagtttgtggacaaagtcagcgtcccgcagacggacatgaggcctgagaagctgaaggagccctggcccaacagtgacccccccttctccttcaagaacgtcatcagcctgacagaagatgtggatgagttccggaataaactgcagggagagcggatctcaggcaacctggatgctcctgagggcggcttcgatgccatcctgcagacagctgtgtgcacgagggacattggctggcgcccggacagcacccacctgctggtcttctccaccgagtcagccttccactatgaggctgatggcgccaacgtgctggctggcatcatgagccgcaacgatgaacggtgccacctggacaccacgggcacctacacccagtacaggacacaggactacccgtcggtgcccaccctggtgcgcctgctcgccaagcacaacatcatccccatctttgctgtcaccaactactcctatagctactacgagaagcttcacacctatttccctgtctcctcactgggggtgctgcaggaggactcgtccaacatcgtggagctgctggaggaggccttcaatcggatccgctccaacctggacatccgggccctagacagcccccgaggccttcggacagaggtcacctccaagatgttccagaagacgaggactgggtcctttcacatccggcggggggaagtgggtatataccaggtgcagctgcgggcccttgagcacgtggatgggacgcacgtgtgccagctgccggaggaccagaagggcaacatccatctgaaaccttccttctccgacggcctcaagatggacgcgggcatcatctgtgatgtgtgcacctgcgagctgcaaaaagaggtgcggtcagctcgctgcagcttcaacggagacttcgtgtgcggacagtgtgtgtgcagcgagggctggagtggccagacctgcaactgctccaccggctctctgagtgacattcagccctgcctgcgggagggcgaggacaagccgtgctccggccgtggggagtgccagtgcgggcactgtgtgtgctacggcgaaggccgctacgagggtcagttctgcgagtatgacaacttccagtgtccccgcacttccgggttcctctgcaatgaccgaggacgctgctccatgggccagtgtgtgtgtgagcctggttggacaggcccaagctgtgactgtcccctcagcaatgccacctgcatcgacagcaatgggggcatctgtaatggacgtggccactgtgagtgtggccgctgccactgccaccagcagtcgctctacacggacaccatctgcgagatcaactactcggcgatccacccgggcctctgcgaggacctacgctcctgcgtgcagtgccaggcgtggggcaccggcgagaagaaggggcgcacgtgtgaggaatgcaacttcaaggtcaagatggtggacgagcttaagagagccgaggaggtggtggtgcgctgctccttccgggacgaggatgacgactgcacctacagctacaccatggaaggtgacggcgcccctgggcccaacagcactgtcctggtgcacaagaagaaggactgccctccgggctccttctggtggctcatccccctgctcctcctcctcctgccgctcctggccctgctactgctgctatgctggaagtactgtgcctgctgcaaggcctgcctggcacttctcccgtgctgcaaccgaggtcacatggtgggctttaaggaagaccactacatgctgcgggagaacctgatggcctctgaccacttggacacgcccatgctgcgcagcgggaacctcaagggccgtgacgtggtccgctggaaggtcaccaacaacatgcagcggcctggctttgccactcatgccgccagcatcaaccccacagagctggtgccctacgggctgtccttgcgcctggcccgcctttgcaccgagaacctgctgaagcctgacactcgggagtgcgcccagctgcgccaggaggtggaggagaacgtaaggacccaggaactaggcctggccggagatgtggctgaacgaggtctacaggcagatctccggtgtacacaagctccagcagaccaagttccggcagcagcccaatgccgggaaaaagcaagaccacaccattgtggacacagtgctgatggcgccccgctcggccaagccggccctgctgaagcttacagagaagcaggtggaacagagggccttccacgacctcaaggtggcccccggctactacaccctcactgcagaccaggacgcccggggcatggtggagttccaggagggcgtggagctggtggacgtacgggtgcccctctttatccggcctgaggatgacgacgagaagcagctgctggtggaggccatcgacgtgcccgcaggcactgccaccctcggccgccgcctggtaaacatcaccatcatcaaggagcaagccagagacgtggtgtcctttgagcagcctgagttctcggtcagccgcggggaccaggtggcccgcatccctgtcatccggcgtgtcctggacggcgggaagtcccaggtctcctaccgcacacaggatggcaccgcgcagggcaaccgggactacatccccgtggagggtgagctgctgttccagcctggggaggcctggaaagagctgcaggtgaagctcctggagctgcaagaagttgactccctcctgcggggccgccaggtccgccgtttccacgtccagctcagcaaccctaagtttggggcccacctgggccagccccactccaccaccatcatcatcagggacccagatgaactggaccggagcttcacgagtcagatgttgtcatcacagccaccccctcacggcgacctgggcgccccgcagaaccccaatgctaaggccgctgggtccaggaagatccatttcaactggctgcccccttctggcaagccaatggggtacagggtaaagtactggattcagggtgactccgaatccgaagcccacctgctcgacagcaaggtgccctcagtggagctcaccaacctgtacccgtattgcgactatgagatgaaggtgtgcgcctacggggctcagggcgagggaccctacagctccctggtgtcctgccgcacccaccaggaagtgcccagcgagccagggcgtctggccttcaatgtcgtctcctccacggtgacccagctgagctgggctgagccggctgagaccaacggtgagatcacagcctacgaggtctgctatggcctggtcaacgatgacaaccgacctattgggcccatgaagaaagtgctggttgacaaccctaagaaccggatgctgcttattgagaaccttcgggagtcccagccctaccgctacacggtgaaggcgcgcaacggggccggctgggggcctgagcgggaggccatcatcaacctggccacccagcccaagaggcccatgtccatccccatcatccctgacatccctatcgtggacgcccagagcggggaggactacgacagcttccttatgtacagcgatgacgttctacgctctccatcgggcagccagaggcccagcgtctccgatgacactgagcacctggtgaatggccggatggactttgccttcccgggcagcaccaactccctgcacaggatgaccacgaccagtgctgctgcctatggcacccacctgagcccacacgtgccccaccgcgtgctaagcacatcctccaccctcacacgggactacaactcactgacccgctcagaacactcacactcgaccacactgcccagggactactccaccctcacctccgtctcctcccacggtgagtgacctcagccaaccctgcctctcccactaacccttcctctcttccagctcctggagcctcgggcttctgtctgctgtccccaccgcccattctccaacatacacacacgcatgcacacatgcacgcacacacgtgcacacgcatgcacacatgtacac

SEQ ID NO: 330388 - DNA, 1760 bp, Homo sapiens
gactctagagatcccccacacttcgatcgcgagaacaggaaggcttggggatctccccagggcagagctgactgcagacgcagcaaacccccgccactgccagggtcagcagtgctcacaccgatagagtggccggccagaggatatgggctgtggaagcctgggtggcccttgggctcctgcagggacagagggcctctgtccctagtggtttgagggaaactggttgtatttaagcaaaagccacccagagggtgggtgaccaggaatgtgcagggcccagcctgccccacggggcccgggtctggggcaggcctgaccaagggaccctgctctccccctgcagagcacctggtgaatggccggatggactttgccttcccgggcagcaccaactccctgcacaggatgaccacgaccagtgctgctgcctatggcacccacctgagcccacacgtgccccaccgcgtgctaagcacatcctccaccctcacacgggactacaactcactgacccgctcagaacactcacactcgaccacactgcccagggactactccaccctcacctccgtctcctcccacgactctcgcctgactgctggtgtgcccgacacgcccacccgcctggtgttctctgccctggggcccacatctctcagagtgagctggcaggagccgcggtgcgagcggccgctgcagggctacagtgtggagtaccagctgctgaacggcggtgagctgcatcggctcaacatccccaaccctgcccagacctcggtggtggtggaagacctcctgcccaaccactcctacgtgttccgcgtgcgggcccagagccaggaaggctggggccgagagcgtgagggtgtcatcaccattgaatcccaggtgcacccgcagagcccactgtgtcccctgccaggctccgccttcactttgagcactcccagtgccccaggcccgctggtgttcactgccctgagcccagactcgctgcagctgagctgggagcggccacggaggcccaatggggatatcgtcggctacctggtgacctgtgagatggcccaaggaggagggccagccaccgcattccgggtggatggagacagccccgagagccggctgaccgtgccgggcctcagcgagaacgtgccctacaagttcaaggtgcaggccaggaccactgagggcttcgggccagagcgcgagggcatcatcaccatagagtcccaggatggaggacccttcccgcagctgggcagccgtgccgggctcttccagcacccgctgcaaagcgagtacagcagcatcaccaccacccacaccagcgccaccgagcccttcctagtggatgggccgaccctgggggcccagcacctggaggcaggcggctccctcacccggcatgtgacccaggagtttgtgagccggacactgaccaccagcggaacccttagcacccacatggaccaacagttcttccaaacttgaccgcaccctgccccacccccgccatgtcccactaggcgtcctcccgactcctctcccggagcctcctcagctactccatccttgcacccctgggggcccagcccacccgcatgcacagagcaggggctaggtgtctcctgggaggcatgaagggggcaaggtccgtcctctgtgggcccaaacctatttgtaaccaaagagctgggagcagcacaaggacccagcctttgttctgcacttaataaatggttttgctactgcta

SEQ ID NO: 330389 - DNA, 1629 bp, Homo sapiens
ggaccaggctgggacctgggtgaccctctgaagcactctctctgccccaggacctattgggcccatgaagaaagtgctggttgacaaccctaagaaccggatgctgcttattgagaaccttcgggagtcccagccctaccgctacacggtgaaggcgcgcaacggggccggctgggggcctgagcgggaggccatcatcaacctggccacccagcccaagaggcccatgtccatccccatcatccctgacatccctatcgtggacgcccagagcggggaggactacgacagcttccttatgtacagcgatgacgttctacgctctccatcgggcagccagaggcccagcgtctccgatgacactgagcacctggtgaatggccggatggactttgccttcccgggcagcaccaactccctgcacaggatgaccacgaccagtgctgctgcctatggcacccacctgagcccacacgtgccccaccgcgtgctaagcacatcctccaccctcacacgggactacaactcactgacccgctcagaacactcacactcgaccacactgcccagggactactccaccctcacctccgtctcctcccacggtgagctgcatcggctcaacatccccaaccctgcccagacctcggtggtggtggaagacctcctgcccaaccactcctacgtgttccgcgtgcgggcccagagccaggaaggctggggccgagagcgtgagggtgtcatcaccattgaatcccaggtgcacccgcagagcccactgtgtcccctgccaggctccgccttcactttgagcactcccagtgccccaggcccgctggtgttcactgccctgagcccagactcgctgcagctgagctgggagcggccacggaggcccaatggggatatcgtcggctacctggtgacctgtgagatggcccaaggaggagggccagccaccgcattccgggtggatggagacagccccgagagccggctgaccgtgccgggcctcagcgagaacgtgccctacaagttcaaggtgcaggccaggaccactgagggcttcgggccagagcgcgagggcatcatcaccatagagtcccaggatggaggacccttcccgcagctgggcagccgtgccgggctcttccagcacccgctgcaaagcgagtacagcagcatcaccaccacccacaccagcgccaccgagcccttcctagtggatgggccgaccctgggggcccagcacctggaggcaggcggctccctcacccggcatgtgacccaggagtttgtgagccggacactgaccaccagcggaacccttagcacccacatggaccaacagttcttccaaacttgaccgcaccctgccccacccccgccatgtcccactaggcgtcctcccgactcctctcccggagcctcctcagctactccatccttgcacccctgggggcccagcccacccgcatgcacagagcaggggctaggtgtctcctgggaggcatgaagggggcaaggtccgtcctctgtgggcccaaacctatttgtaaccaaagagctgggagcagcacaaggacccagcctttgttctgcacttaataaatggttttgctactgcta

SEQ ID NO: 330390 - DNA, 1566 bp, Homo sapiens
tccattccatccacaggacccccgcctgcccacaggcgctaaccacctgccctaccatcagtgctgatgcctaactctgcctctgccctcccagggggcggggctggggctggggcaggagaggggccaggccagctgagcagttgagggggtggggctggcagactcacggggctcactctcttttggcacaagcagggcctgcaccctgctggaggatgtgcggtaggtgctgggcagcctggacagggtgttgcagggtgagtgagttgtccagccagcggtcagtgtagacatgccagctgagggagggaggtcagggggcagcactgtgactcccactgagaccctagcccctgcatctctggctgactgcggcctcctgtccccagactctcgcctgactgctggtgtgcccgacacgcccacccgcctggtgttctctgccctggggcccacatctctcagagtgagctggcaggagccgcggtgcgagcggccgctgcagggctacagtgtggagtaccagctgctgaacggcggtgagctgcatcggctcaacatccccaaccctgcccagacctcggtggtggtggaagacctcctgcccaaccactcctacgtgttccgcgtgcgggcccagagccaggaaggctggggccgagagcgtgagggtgtcatcaccattgaatcccaggtgcacccgcagagcccactgtgtcccctgccaggctccgccttcactttgagcactcccagtgccccaggcccgctggtgttcactgccctgagcccagactcgctgcagctgagctgggagcggccacggaggcccaatggggatatcgtcggctacctggtgacctgtgagatggcccaaggaggagggccagccaccgcattccgggtggatggagacagccccgagagccggctgaccgtgccgggcctcagcgagaacgtgccctacaagttcaaggtgcaggccaggaccactgagggcttcgggccagagcgcgagggcatcatcaccatagagtcccaggatggaggacccttcccgcagctgggcagccgtgccgggctcttccagcacccgctgcaaagcgagtacagcagcatcaccaccacccacaccagcgccaccgagcccttcctagtggatgggccgaccctgggggcccagcacctggaggcaggcggctccctcacccggcatgtgacccaggagtttgtgagccggacactgaccaccagcggaacccttagcacccacatggaccaacagttcttccaaacttgaccgcaccctgccccacccccgccatgtcccactaggcgtcctcccgactcctctcccggagcctcctcagctactccatccttgcacccctgggggcccagcccacccgcatgcacagagcaggggctaggtgtctcctgggaggcatgaagggggcaaggtccgtcctctgtgggcccaaacctatttgtaaccaaagagctgggagcagcacaaggacccagcctttgttctgcacttaataaatggttttgctactgcta

SEQ ID NO: 330391 - DNA, 2551 bp, Homo sapiens
  misc_feature (28)..(28): n is a, c, g, or t
  misc_feature (30)..(30): n is a, c, g, or t
gcgctgcccgcctcgtccccaccccccnancccccgcgcccgccctcggacagtccctgctcgcccgcgcgctgcagccccatctcctagcggcagcccaggcgcggagggagcgagtccgccccgaggtaggtccaggacgggcgcacagcagcagccgaggctggccgggagagggaggaagaggatggcagggccacgccccagcccatgggccaggctgctcctggcagccttgatcagcgtcagcctctctgggaccttggcaaaccgctgcaagaaggccccagtgaagagctgcacggagtgtgtccgtgtggataaggactgcgcctactgcacagacgagatgttcagggaccggcgctgcaacacccaggcggagctgctggccgcgggctgccagcgggagagcatcgtggtcatggagagcagcttccaaatcacagaggagacccagattgacaccaccctgcggcgcagccagatgtccccccaaggcctgcgggtccgtctgcggcccggtgaggagcggcattttgagctggaggtgtttgagccactggagagccccgtggacctgtacatcctcatggacttctccaactccatgtccgatgatctggacaacctcaagaagatggggcagaacctggctcgggtcctgagccagctcaccagcgactacactattggatttggcaagtttgtggacaaagtcagcgtcccgcagacggacatgaggcctgagaagctgaaggagccctggcccaacagtgacccccccttctccttcaagaacgtcatcagcctgacagaagatgtggatgagttccggaataaactgcagggagagcggatctcaggcaacctggatgctcctgagggcggcttcgatgccatcctgcagacagctgtgtgcacgagggacattggctggcgcccggacagcacccacctgctggtcttctccaccgagtcagccttccactatgaggctgatggcgccaacgtgctggctggcatcatgagccgcaacgatgaacggtgccacctggacaccacgggcacctacacccagtacaggacacaggactacccgtcggtgcccaccctggtgcgcctgctcgccaagcacaacatcatccccatctttgctgtcaccaactactcctatagctactacgagaagcttcacacctatttccctgtctcctcactgggggtgctgcaggaggactcgtccaacatcgtggagctgctggaggaggccttcaatcggatccgctccaacctggacatccgggccctagacagcccccgaggccttcggacagaggtcacctccaagatgttccagaagacgaggactgggtcctttcacatccggcggggggaagtgggtatataccaggtgcagctgcgggcccttgagcacgtggatgggacgcacgtgtgccagctgccggaggaccagaagggcaacatccatctgaaaccttccttctccgacggcctcaagatggacgcgggcatcatctgtgatgtgtgcacctgcgagctgcaaaaagaggtgcggtcagctcgctgcagcttcaacggagacttcgtgtgcggacagtgtgtgtgcagcgagggctggagtggccagacctgcaactgctccaccggctctctgagtgacattcagccctgcctgcgggagggcgaggacaagccgtgctccggccgtggggagtgccagtgcgggcactgtgtgtgctacggcgaaggccgctacgagggtcagttctgcgagtatgacaacttccagtgtccccgcacttccgggttcctctgcaatgaccgaggacgctgctccatgggccagtgtgtgtgtgagcctggttggacaggcccaagctgtgactgtcccctcagcaatgccacctgcatcgacagcaatgggggcatctgtaatggacgtggccactgtgagtgtggccgctgccactgccaccagcagtcgctctacacggacaccatctgcgagatcaactactcggcgatccacccgggcctctgcgaggacctacgctcctgcgtgcagtgccaggcgtggggcaccggcgagaagaaggggcgcacgtgtgaggaatgcaacttcaaggtcaagatggtggacgagcttaagagagccgaggaggtggtggtgcgctgctccttccgggacgaggatgacgactgcacctacagctacaccatggaaggtgacggcgcccatggaccaacagttcttccaaacttgaccgcaccctgccccacccccgccatgtcccactaggcgtcctcccgactcctctcccggagcctcctcagctactccatccttgcacccctgggggcccagcccacccgcatgcacagagcaggggctaggtgtctcctgggaggcatgaagggggcaaggtccgtcctctgtgggcccaaacctatttgtaaccaaagagctgggagcagcacaaggacccagcctttgttctgcacttaataaatggttttgctactgcta

SEQ ID NO: 330392 - DNA, 100 bp, Homo sapiens
cggctttcacatggaggagaggcatgaatctttcaaatgaaagacacatgtgttcttgctggaggagctaagatttccatgacttctcaggaagaccggg

SEQ ID NO: 330393 - DNA, 263 bp, Homo sapiens
taattaagactcgaggatttctcaagctatagttacatttttaatcctgggtaaaaaataagaagcaagtattctgagaaaactaataggttagctaggagttgtgtacagtatgacttaaaactcttcatttatgagaattgcagaataaagaaagtttagttgtttataatagcatttaatagcatttaatttcatggaaggagcttgttcctgaaaaatcaatttttcttggtcaggagataggaattagtggttaacat

SEQ ID NO: 330394 - DNA, 130 bp, Homo sapiens
ttgtgaaaacattcaagctctggctctgtgggcttagctttgatgagtctgatcactgattttgcttaagttaagtcatagctaaaggctcagcgtctccgaatgtgaaacaggctttatgtggccacca

SEQ ID NO: 330395 - DNA, 284 bp, Homo sapiens
atgtccattatatcttatccaagtatgccttcattctggcagttatcctgcattataactcttgcaggtctcagtcactggacaaagtactttaagtacagggaacaaatctgatccattttggtgtccaatatagtctgccacatagtgggtaatgcttcccttgaatcagcaccatcatccacgctatacactacatatggccagtaaacccagtaaaatgagttaaccaattatttcactaatgttagccttttaaatttatctccaggaactagtatgat

SEQ ID NO: 330396 - DNA, 1627 bp, Homo sapiens
ggtaaggctgggtgtgtaatcggccgaggccagatgaggactctgaagctcagagagcagtggccggtgtccagctgcctactttctgcccggatctctggctcctcatctctccggtctccgcagactaaagccctcgggatatgcagcagccatgcctgtgcacacgctgagccccggagccccgtccgcccccgccctaccttgccgcctgcggaccagggtccctggctacctgctacgggggccggcagatggtggagcccggaaaccgagcgctgtggagcgcctggaggccgacaaggccaagtacgtcaagagcctgcacgtggccaacacccgccaggagcctgtgcagcccctgctgtccaaacagccgctcttcagccctgagactcgccgcacagtgctcacgcccagccgccgagccctgcctggcccctgccgacggccccagctggacctggacatcctcagcagcctcatcgacttgtgtgacagccccgtgtcccctgccgaggccagccgcactcctggacgggccgagggagccggccgtcctcccccagccacccctccgcgaccgccgcccagtacctctgcggtccgccgggtggacgtccgccccctgcccgcctcgcctgcccggccctgcccatcacccggccctgccgccgcctccagcccagcccggccgccgggtttgcaacgctccaagtcggacttgagcgagcgcttttctagggcagccgctgatctcgagcgcttttttaacttctgcggcctggacccggaggaggcgagagggttgggtgtggcccacctggcacgggccagctcggatatcgtgtccctggcagggcccagtgctgggccgggcagctctgaagggggctgctcccgccgcagctcggtgactgttgaggagcgggcccgggagcgcgttccctatggcgtgtcggtggtggagcgcaatgcccgcgtgatcaagtggttgtatgggctaaggcaggctcgggagagcccagcagctgaaggctaggcgccactgggcctggaattcgccacaggacggatcttacagaggcaagtggtccctggacctctcttgcatccattctctagacggccgtgtcagaggctccaccctgttgtgaacttggtatggaggcaaaggcttagaggctggaccagcattcttgggcaaggactgactctccaagggttttgttcttggctttggacacctgagaaccccctcctcccctcccccaatacaaggtttttgacatgagtgtactcctgcttagttcctcttgtggggctgcatttgcggtgctttgccctccccactgtgagtgaggggccaagggatctcctcaatcctgtctccccagcggctctgtttcctccttccttccttggcctctgtcctttgctgacttcctcttccttacccagcagaactcaccctggggtcggggcagtggggaggggcctatccactgctcttcctagtccttggcagctggcctaggtgggcagactataggagggactggttaggagtctgcattgctttgacttccctctccttggttaataaacacaaatgcttgtttctcaa

SEQ ID NO: 330397 - DNA, 1784 bp, Homo sapiens
gggactgtccctgcggtgggggccttcgacagtgagggccacccgctcagctcgaccgcggagggcagctccaaaggggaccccaaaggtgcccacgcggggctggggcctcctgggcgtcgttgggagcggccactaccggcccgggtccgagctgtcagcctctccaaagcctgcgcgagaggagccgggacacgcctagcgcgggctccagcagtggccggtgtccagctgcctactttctgcccggatctctggctcctcatctctccggtctccgcagactaaagccctcgggatatgcagcagccatgcctgtgcacacgctgagccccggagccccgtccgcccccgccctaccttgccgcctgcggaccagggtccctggctacctgctacgggggccggcagatggtggagcccggaaaccgagcgctgtggagcgcctggaggccgacaaggccaagtacgtcaagagcctgcacgtggccaacacccgccaggagcctgtgcagcccctgctgtccaaacagccgctcttcagccctgagactcgccgcacagtgctcacgcccagccgccgagccctgcctggcccctgccgacggccccagctggacctggacatcctcagcagcctcatcgacttgtgtgacagccccgtgtcccctgccgaggccagccgcactcctggacgggccgagggagccggccgtcctcccccagccacccctccgcgaccgccgcccagtacctctgcggtccgccgggtggacgtccgccccctgcccgcctcgcctgcccggccctgcccatcacccggccctgccgccgcctccagcccagcccggccgccgggtttgcaacgctccaagtcggacttgagcgagcgcttttctagggcagccgctgatctcgagcgcttttttaacttctgcggcctggacccggaggaggcgagagggttgggtgtggcccacctggcacgggccagctcggatatcgtgtccctggcagggcccagtgctgggccgggcagctctgaagggggctgctcccgccgcagctcggtgactgttgaggagcgggcccgggagcgcgttccctatggcgtgtcggtggtggagcgcaatgcccgcgtgatcaagtggttgtatgggctaaggcaggctcgggagagcccagcagctgaaggctaggcgccactgggcctggaattcgccacaggacggatcttacagaggcaagtggtccctggacctctcttgcatccattctctagacggccgtgtcagaggctccaccctgttgtgaacttggtatggaggcaaaggcttagaggctggaccagcattcttgggcaaggactgactctccaagggttttgttcttggctttggacacctgagaaccccctcctcccctcccccaatacaaggtttttgacatgagtgtactcctgcttagttcctcttgtggggctgcatttgcggtgctttgccctccccactgtgagtgaggggccaagggatctcctcaatcctgtctccccagcggctctgtttcctccttccttccttggcctctgtcctttgctgacttcctcttccttacccagcagaactcaccctggggtcggggcagtggggaggggcctatccactgctcttcctagtccttggcagctggcctaggtgggcagactataggagggactggttaggagtctgcattgctttgacttccctctccttggttaataaacacaaatgcttgtttctcaa

SEQ ID NO: 330398 - DNA, 1838 bp, Homo sapiens
gggactgtccctgcggtgggggccttcgacagtgagggccacccgctcagctcgaccgcggagggcagctccaaaggggaccccaaaggtgcccacgcggggctggggcctcctgggcgtcgttgggagcggccactaccggcccgggtccgagctgtcagcctctccaaagcctgcgcgagaggagccgggacacgcctagcgcgggctccagcagtggccggtgtccagctgcctactttctgcccggatctctggctcctcatctctccggtctccgcagactaaagccctcgggatatgcagcagccatgcctgtgcacacgctgagccccggagccccgtccgcccccgccctaccttgccgcctgcggaccagggtccctggctacctgctacgggggccggcagatggtggagcccggaaaccgagcgctgtggagcgcctggaggccgacaaggccaagtacgtcaagagcctgcacgtggccaacacccgccaggagcctgtgcagcccctgctgtccaaacagccgctcttcagccctgagactcgccgcacagtgctcacgcccagccgccgagccctgcctggcccctgccgacggccccagctggacctggacatcctcagcagcctcatcgacttgtgtgacagccccgtgtcccctgccgaggccagccgcactcctggacgggccgagggagccggccgtcctcccccagccacccctccgcgaccgccgcccagtacctctgcggtccgccgggtggacgtccgccccctgcccgcctcgcctgcccggccctgcccatcacccggccctgccgccgcctccagcccagcccggccgccgggtttgcaacgctccaagtcggacttgagcgagcgcttttctagggcagccgctgatctcgagcgcttttttaacttctgcggcctggacccggaggaggcgagagggttgggtgtggcccacctggcacgggccagctcggatatcgtgtccctggcagggcccagtgctgggccgggcagctctgaagggggctgctcccgccgcagctcggtgactgttgaggagcgggcccgggagcgcgttccctatggcgtgtcggtggtggagcgcaatgcccgcgtgatcaagtggttgtatgggctaaggcaggctcgggagagcccagcagctgaaggctaggcgccactgggcctggaattcgccacaggacggatcttacagaggcaagtggtccctggacctctcttgcatccattctctagacggccgtgtcagaggctccaccctgttgtgaacttggtatggaggcaaaggcttagaggctggaccagcattcttgggcaaggactgactctccaagggttttgttcttggctttggacacctgagaaccccctcctcccctcccccaatacaaggtttttgacatgagtgtactcctgcttagttcctcttgtggggctgcatttgcggtgctttgccctccccactgtgagtgaggggccaagggatctcctcaatcctgtctccccagcggctctgtttcctccttccttccttggcctctgtcctttgctgacttcctcttccttacccagcagaactcaccctggggtcggggcagtggggaggggcctatccactgctcttcctagtccttggcagctggcctaggtgggcagactataggagggactggttaggagtctgcattgctttgacttccctctccttggttaataaacacaaatgcttgtttctcaaaaagcaaagaaaaaattcgcgggatatattgaggggggggaaaaaaggtacgga

SEQ ID NO: 330399 - DNA, 1825 bp, Homo sapiens
gggactgtccctgcggtgggggccttcgacagtgagggccacccgctcagctcgaccgcggagggcagctccaaaggggaccccaaaggtgcccacgcggggctggggcctcctgggcgtcgttgggagcggccactaccggcccgggtccgagctgtcagcctctccaaagcctgcgcgagaggagccgggacacgcctagcgcgggctccagcagtggccggtgtccagctgcctactttctgcccggatctctggctcctcatctctccggtctccgcagactaaagccctcgggatatgcagcagccatgcctgtgcacacgctgagccccggagccccgtccgcccccgccctaccttgccgcctgcggaccagggtccctggctacctgctacgggggccggcagatggtggagcccggaaaccgagcgctgtggagcgcctggaggccgacaaggccaagtacgtcaagagcctgcacgtggccaacacccgccaggagcctgtgcagcccctgctgtccaaacagccgctcttcagccctgagactcgccgcacagtgctcacgcccagccgccgagccctgcctggcccctgccgacggccccagctggacctggacatcctcagcagcctcatcgacttgtgtgacagccccgtgtcccctgccgaggccagccgcactcctggacgggccgagggagccggccgtcctcccccagccacccctccgcgaccgccgcccagtacctctgcggtccgccgggtggacgtccgccccctgcccgcctcgcctgcccggccctgcccatcacccggccctgccgccgcctccagcccagcccggccgccgggtttgcaacgctccaagtcggacttgagcgagcgcttttctagggcagccgctgatctcgagcgcttttttaacttctgcggcctggacccggaggaggcgagagggttgggtgtggcccacctggcacgggccagctcggatatcgtgtccctggcagggcccagtgctgggccgggcagctctgaagggggctgctcccgccgcagctcggtgactgttgaggagcgggcccgggagcgcgttccctatggcgtgtcggtggtggagcgcaatgcccgcgtgatcaagtggttgtatgggctaaggcaggctcgggagagcccagcagctgaaggctaggcgccactgggctggaattcgccacaggacggatcttacagaggcaagtggtcctggaattcgccacaggacggatcttacagaggcaagtggtccctggacctctcttgcatccattctctagacggccgtgtcagaggctccaccctgttgtgaacttggtatggaggcaaaggcttagaggctggaccagcattcttgggcaaggactgactctccaagggttttgttcttggctttggacacctgagaaccccctcctcccctcccccaatacaaggtttttgacatgagtgtactcctgcttagttcctcttgtggggctgcatttgcggtgctttgccctccccactgtgagtgaggggccaagggatctcctcaatcctgtctccccagcggctctgtttcctccttccttccttggcctctgtcctttgctgacttcctcttccttacccagcagaactcaccctggggtcggggcagtggggaggggcctatccactgctcttcctagtccttggcagctggcctaggtgggcagactataggagggactggttaggagtctgcattgctttgacttccctctccttggttaataaacacaaatgcttgtttctcaa

SEQ ID NO: 330400 - DNA, 748 bp, Homo sapiens
ttcgtggggaacctggcgctaaaccattcgtagacgacctgttgaggagcgggcccgggagcgcgttccctatggcgtgtcggtggtggagcgcaatgcccgcgtgatcaagtggttgtatgggctaaggcaggctcgggagagcccagcagctgaaggctaggcgccactgggcctggaattcgccacaggacggatcttacagaggcaagtggtccctggacctctcttgcatccattctctagacggccgtgtcagaggctccaccctgttgtgaacttggtatggaggcaaaggcttagaggctggaccagcattcttgggcaaggactgactctccaagggttttgttcttggctttggacacctgagaaccccctcctcccctcccccaatacaaggtttttgacatgagtgtactcctgcttagttcctcttgtggggctgcatttgcggtgctttgccctccccactgtgagtgaggggccaagggatctcctcaatcctgtctccccagcggctctgtttcctccttccttccttggcctctgtcctttgctgacttcctcttccttacccagcagaactcaccctggggtcggggcagtggggaggggcctatccactgctcttcctagtccttggcagctggcctaggtgggcagactataggagggactggttaggagtctgcattgctttgacttccctctccttggttaataaacacaaatgcttgtttctcaa

SEQ ID NO: 330401 - DNA, 447 bp, Homo sapiens
aacctcatgccacactgtgggctctgcccagcttggttttgtggctccaccctctacggtcatatttgggtttccacacacacagcacccaaaggaaatcccagctaacgcacatcaggttctgggctgggccacccgccaaggtggttggtgggcatgacaccgccccgggaatggcgtcgtccaaatgcctgagcaatgacacggcctcagatggaatgatgccactgcccacagtctcacaggccctcccatctcgcctttgttctgcagcctccaggtgggtgtatggacactccaaaacagccatccctgtcaatgaatcagcctgcagggactgaattcattccttcattcatcaatatccattgagcacctactgtgtgccaaacactcttctaggaactgaagatgcaacagaaaacaaaacagataaaaatccctgcc

SEQ ID NO: 330402 - DNA, 1628 bp, Homo sapiens
tgttctaagtactttacaagtatgaactcatttaattccctcaactctgtgatataagcagtggccggtgtccagctgcctactttctgcccggatctctggctcctcatctctccggtctccgcagactaaagccctcgggatatgcagcagccatgcctgtgcacacgctgagccccggagccccgtccgcccccgccctaccttgccgcctgcggaccagggtccctggctacctgctacgggggccggcagatggtggagcccggaaaccgagcgctgtggagcgcctggaggccgacaaggccaagtacgtcaagagcctgcacgtggccaacacccgccaggagcctgtgcagcccctgctgtccaaacagccgctcttcagccctgagactcgccgcacagtgctcacgcccagccgccgagccctgcctggcccctgccgacggccccagctggacctggacatcctcagcagcctcatcgacttgtgtgacagccccgtgtcccctgccgaggccagccgcactcctggacgggccgagggagccggccgtcctcccccagccacccctccgcgaccgccgcccagtacctctgcggtccgccgggtggacgtccgccccctgcccgcctcgcctgcccggccctgcccatcacccggccctgccgccgcctccagcccagcccggccgccgggtttgcaacgctccaagtcggacttgagcgagcgcttttctagggcagccgctgatctcgagcgcttttttaacttctgcggcctggacccggaggaggcgagagggttgggtgtggcccacctggcacgggccagctcggatatcgtgtccctggcagggcccagtgctgggccgggcagctctgaagggggctgctcccgccgcagctcggtgactgttgaggagcgggcccgggagcgcgttccctatggcgtgtcggtggtggagcgcaatgcccgcgtgatcaagtggttgtatgggctaaggcaggctcgggagagcccagcagctgaaggctaggcgccactgggcctggaattcgccacaggacggatcttacagaggcaagtggtccctggacctctcttgcatccattctctagacggccgtgtcagaggctccaccctgttgtgaacttggtatggaggcaaaggcttagaggctggaccagcattcttgggcaaggactgactctccaagggttttgttcttggctttggacacctgagaaccccctcctcccctcccccaatacaaggtttttgacatgagtgtactcctgcttagttcctcttgtggggctgcatttgcggtgctttgccctccccactgtgagtgaggggccaagggatctcctcaatcctgtctccccagcggctctgtttcctccttccttccttggcctctgtcctttgctgacttcctcttccttacccagcagaactcaccctggggtcggggcagtggggaggggcctatccactgctcttcctagtccttggcagctggcctaggtgggcagactataggagggactggttaggagtctgcattgctttgacttccctctccttggttaataaacacaaatgcttgtttctcaa

SEQ ID NO: 330403 - DNA, 945 bp, Homo sapiens
tcctgccctgcagctcgctccggggccccccggtgcctgttccaggtccgcctccctcgcgcgattaaagggtctgcctttaaaagtggcccggtctacttcttcaccgctgagcatgggttatctgcttcggccccccaactctgggtcaagggccccccactcccgcctcctggccgctgactaagacgtgtaccaccgggccttgttataattgtgagaatagagaccaggtctactatttgcccaggctgtcttgactcctggtttccaccatcctccccctggcccccctaaagctggattaccggggtggggccccccccccccccccgggggagagagaactttctcgagtttttttttgtttttttgttttttggctgtaagtttattcaatgcaaaagaatcctctccaattttactgaggtggctgaccacgtccacgaccaaatccgcctctaaactggaattcggttgctgacccagccccagcctcggctttcttgtcggcaccaggtggcacagcactccgtctgtaggtatctctgtcagcttcccctcttgtgagtctcgcaggtcgctcaccctccagacctttaggccgaggcctgccagtctctggacggctacggcgtagggtggcaggcacaatctccgggggcagatgaaggtaatcacggagatactggataccctcattggtaaggtaccagtagaaatgtctccaggcaaactgttccttcacgtagcctcgggacttgagagactgcatggccttcatgacatgaaggttgggcacattcttgtctgccagctccgggtgcttaggcatgtggacatccttcttggccaccatgactccctccttaaaaaggagttcataaatggcaatccggttcttcttaggcatcaacatctctgcggctgcagggtccggggctg

SEQ ID NO: 330404 - DNA, 1893 bp, Homo sapiens
gggactgtccctgcggtgggggccttcgacagtgagggccacccgctcagctcgaccgcggagggcagctccaaaggggaccccaaaggtgcccacgcggggctggggcctcctgggcgtcgttgggagcggccactaccggcccgggtccgagctgtcagcctctccaaagcctgcgcgagaggagccgggacacgcctagcgcgggctccaggtggctgaccacgtccacgaccaaatccgcctctaaactggaattcggttgctgacccagccccagcctcggctttcttgtcggcaccaggtggcacagcactccgtctcagtggccggtgtccagctgcctactttctgcccggatctctggctcctcatctctccggtctccgcagactaaagccctcgggatatgcagcagccatgcctgtgcacacgctgagccccggagccccgtccgcccccgccctaccttgccgcctgcggaccagggtccctggctacctgctacgggggccggcagatggtggagcccggaaaccgagcgctgtggagcgcctggaggccgacaaggccaagtacgtcaagagcctgcacgtggccaacacccgccaggagcctgtgcagcccctgctgtccaaacagccgctcttcagccctgagactcgccgcacagtgctcacgcccagccgccgagccctgcctggcccctgccgacggccccagctggacctggacatcctcagcagcctcatcgacttgtgtgacagccccgtgtcccctgccgaggccagccgcactcctggacgggccgagggagccggccgtcctcccccagccacccctccgcgaccgccgcccagtacctctgcggtccgccgggtggacgtccgccccctgcccgcctcgcctgcccggccctgcccatcacccggccctgccgccgcctccagcccagcccggccgccgggtttgcaacgctccaagtcggacttgagcgagcgcttttctagggcagccgctgatctcgagcgcttttttaacttctgcggcctggacccggaggaggcgagagggttgggtgtggcccacctggcacgggccagctcggatatcgtgtccctggcagggcccagtgctgggccgggcagctctgaagggggctgctcccgccgcagctcggtgactgttgaggagcgggcccgggagcgcgttccctatggcgtgtcggtggtggagcgcaatgcccgcgtgatcaagtggttgtatgggctaaggcaggctcgggagagcccagcagctgaaggctaggcgccactgggcctggaattcgccacaggacggatcttacagaggcaagtggtccctggacctctcttgcatccattctctagacggccgtgtcagaggctccaccctgttgtgaacttggtatggaggcaaaggcttagaggctggaccagcattcttgggcaaggactgactctccaagggttttgttcttggctttggacacctgagaaccccctcctcccctcccccaatacaaggtttttgacatgagtgtactcctgcttagttcctcttgtggggctgcatttgcggtgctttgccctccccactgtgagtgaggggccaagggatctcctcaatcctgtctccccagcggctctgtttcctccttccttccttggcctctgtcctttgctgacttcctcttccttacccagcagaactcaccctggggtcggggcagtggggaggggcctatccactgctcttcctagtccttggcagctggcctaggtgggcagactataggagggactggttaggagtctgcattgctttgacttccctctccttggttaataaacacaaatgcttgtttctcaa

SEQ ID NO: 330405 - DNA, 1983 bp, Homo sapiens
gggactgtccctgcggtgggggccttcgacagtgagggccacccgctcagctcgaccgcggagggcagctccaaaggggaccccaaaggtgcccacgcggggctggggcctcctgggcgtcgttgggagcggccactaccggcccgggtccgagctgtcagcctctccaaagcctgcgcgagaggagccgggacacgcctagcgcgggctccagcagtggccggtgtccagctgcctactttctgcccggatctctggctcctcatctctccggtctccgcagactaaagccctcgggatatgcagcagccatgcctgtgcacacgctgagccccggagccccgtccgcccccgccctaccttgccgcctgcggaccagggtccctggctacctgctacgggggccggcagatggtggagcccggaaaccgagcgctgtggagcgcctggaggccgacaaggccaagtacgtcaagagcctgcacgtggccaacacccgccaggagcctgtgcagcccctgctgtccaaacagccgctcttcagccctgagactcgccgcacagtgctcacgcccagccgccgagccctgcctggcccctgccgacggccccagctggacctggacatcctcagcagcctcatcgacttgtgtgacagccccgtgtcccctgccgaggccagccgcactcctggacgggccgagggagccggccgtcctcccccagccacccctccgcgaccgccgcccagtacctctgcggtccgccgggtggacgtccgccccctgcccgcctcgcctgcccggccctgcccatcacccggccctgccgccgcctccagcccagcccggccgccgggtttgcaacgctccaagtcggacttgagcgagcgcttttctagggcagccgctgatctcgagcgcttttttaacttctgcggcctggacccggaggaggcgagagggttgggtgtggcccacctggcacgggccagctcggatatcgtgtccctggcagggcccagtgctgggccgggcagctctgaagggggctgctcccgccgcagctcggtgactgttgaggagcgggcccgggagcgcgttccctatggcgtgtcggtggtggagcgcaatgcccgcgtgatcaagtggttgtatgggctaaggcaggctcgggagagcccagcagctgaaggctaggcgccactgggcctggaattcgccacaggacggatcttacagagcctccaggtgggtgtatggacactccaaaacagccatccctgtcaatgaatcagcctgcagggactgaattcattccttcattcatcaatatccattgagcacctactgtgtgccaaacactcttctaggaactgaagatgcaacagaaaacaaaacagataaaaatccctgccctcgaggagctgacattccagaggggacacagacaatacttgccagagtgaaaatgctaaggagaaaaatgaagcagggaaggatgggggactagagattttttttcctttttttattgaggttgaattgataaacaataaaattggcccattttaggtgtacagttggatgcattttgacagttgtatggcactacagacaagtgctagaattcctgtatcatcccaccatgttccttcacgccccccacagtcagcccctgactcccacccgctcccacccgaagaaactacagatcagttttctttcactgtagatcagctttgtctttcccagagttcatgcaaatggaatctggcttctctcagtcagcatcatggacttggttgagattcgcccgtgttgctgagtgtatctgtagcttgttcctttttactgacgagtagtattccacagtgtggatgcactgtattttgtttattcatccaacttgttgacggacatacaggttgttcccatttcttggctattacaaataaagctactataaacatttgtgaacaac

SEQ ID NO: 330406 - DNA, 160 bp, Homo sapiens
tgctgacattattcatttagacattcttttttttctctaaccttttttccttttttattgttttcttattttctgacagcgtcttgctctgtcactcagagtactggagtgcagtggcatgatcctcaacttcccaggccaagtgattctactaccttag

SEQ ID NO: 330407 - DNA, 90 bp, Homo sapiens
attgctattattctgaaatattatgttaggattaaatatgtaatatttcgatttttattgatgtataacatgcatacagaaatacatcca

SEQ ID NO: 330408 - DNA, 315 bp, Homo sapiens
ctacttgaatagtacctggcacctcttgcttcctccattaactactccctcgggcagcgacgtccctcctttccctcttctctcccgattagagccactacgggccgtgccttcctcttccacgggagctctatcttggtacacccagaaccacctccctccctaacccgctgccacactcgtgggggtctctacctgtctcctcttgatccaggtaagttatgtggacctgaataatagagtacagaaaagtcactcttatgcactcactatgaaaatgactgaacaactttctggagccgtgttgacataata

SEQ ID NO: 330409 - DNA, 709 bp, Homo sapiens
gaagaaagagaggaaggaaggaagaaagagagagagaaaggaaggaagagagaggaaggaaggaagaaagagagagaggaaggaaggaaggaaagaaagaaagaaagaaagaaagaaaggaagaggtaattgtgatctcaggctgaatgactacaagatgactgcagactggtgtccagatgaaggagtcaatggttcagaccacacaggaggagcgtgtttactccataagaggaacattggtaatatggagtgcatctgtggaggaaggctaggatgcttaagaaaggtacatacttccagaacagaagatcttggaggaacatgactgttaccttcaatatttaaagaactaccatgcagaagatggttggtcttacactgtgcaggcgagagtgctgaactaggacagagggtggaagggacagagagaccaatttcccctttatgtgagggagtcctactagtgagaaccaacccagaatgggagagctgccgtcaccaggagttgttaggagacaagaaaagcctctctaatcagagatgccatcacagcacggcagttaaaccaggtgacctccacggccccttccttctttctctttctttcgaaagaaagagaaagaaggaaggaaacaagaaagaaagaaaaagaaatcacagaaagggcaagaaaggacaagtgggagggaaactcaagctttggcac

SEQ ID NO: 330410 - DNA, 778 bp, Homo sapiens
ccggcctcgagtctcgctcaggctcggttttaccccggagtctattcgaagggggctgctacgtcagcgcgtctcagcgtaagacggcgctattccgctgtaacagcttccggcgggtcctggatgttgatgtcctgcatctaacgcggtgtaacccccgaagccgagcgagctccggaggaatttcagtatctgctacggtaacttcatcagcccgccaagatggcgatgcaagcggccaagagggcgaacattcgacttccacctgaagtaaatcggatattgtatataagaaatttgccatacaaaatcacagctgaagaaatgtatgatatatttgggaaatatggacctattcgtcaaatcagagtggggaacacacctgaaactagaggaacagcttatgtggtctatgaggacatctttgatgccaagaatgcatgtgatcacctatcgggattcaatgtttgtaacagataccttgtggttttgtactataatgccaacagggcatttcagaagatggacacaaagaagaaggaggaacagttgaagcttctcaaggagaaatatggcatcaacacagatccaccaaaataaatgttttctacattttcatttggactaaatcccacgaatgacaactaccacctttttttcctttttaattaatactaaatattgtgatttcttatttgaggttcaaaatgacctgcttgaaactttgatacatattggaatacattatgttaataaacttgtagctttttgtgaaaca

SEQ ID NO: 330411 - DNA, 819 bp, Homo sapiens
ccggcctcgagtctcgctcaggctcggttttaccccggagtctattcgaagggggctgctacgtcagcgcgtctcagcgtaagacggcgctattccgctgtaacagcttccggcgggtcctggatgttgatgtcctgcatctaacgcggtgtaacccccgaagccgagcgagctccggaggaatttcagtatctgctacggtaacttcatcagcccgccaagatggcgatgcaagcggccaagagggcgaacattcgacttccacctgaagtaaatcggatattgtatataagaaatttgccatacaaaatcacagctgaagaaatgtatgatatatttgggaaatatggacctattcgtcaaatcagagtggggaacacacctgaaactagaggaacagcttatgtggtctatgaggacatctttgatgccaagaatgcatgtgatcacctatcgggattcaatgtttgtaacagataccttgtggttttgtactataatgccaacagggcatttcagaagatggacacaaagaagaaggaggaacagttgaagcttctcaaggagaaatatggcatcaacacagatccaccaaaataaatgttttctacattttcatttggactaaatcccacgaatgacaactaccacctttttttcctttttaattaatactaaatattgtgatttcttatttgaggttcaaaatgacctgcttgaaactttgatacatattggaatacattatgttaataaacttgtagctttttgtgaaacaaaaaaaaaaagtcgacgcggccggcaatttagtagtagtag

SEQ ID NO: 330412 - DNA, 733 bp, Homo sapiens
ccggcctcgagtctcgctcaggctcggttttaccccggagtctattcgaagggggctgctacgtcagcgcgtctcagcgtaagacggcgctattccgctgtaacagcttccggcgggtcctggatgttgatgtcctgcatctaacgcggtgtaacccccgaagccgagcgagctccggaggaatttcagtatctgctacggtaacttcatcagcccgccaagatggcgatgcaagcggccaagagggcgaacattcgacttccacctgaagtaaatcggatattgtatataagaaatttgccatacaaaatcacagctgaagaaatggggaacacacctgaaactagaggaacagcttatgtggtctatgaggacatctttgatgccaagaatgcatgtgatcacctatcgggattcaatgtttgtaacagataccttgtggttttgtactataatgccaacagggcatttcagaagatggacacaaagaagaaggaggaacagttgaagcttctcaaggagaaatatggcatcaacacagatccaccaaaataaatgttttctacattttcatttggactaaatcccacgaatgacaactaccacctttttttcctttttaattaatactaaatattgtgatttcttatttgaggttcaaaatgacctgcttgaaactttgatacatattggaatacattatgttaataaacttgtagctttttgtgaaaca

SEQ ID NO: 330413 - DNA, 890 bp, Homo sapiens
ccggcctcgagtctcgctcaggctcggttttaccccggagtctattcgaagggggctgctacgtcagcgcgtctcagcgtaagacggcgctattccgctgtaacagcttccggcgggtcctggatgttgatgtcctgcatctaacgcggtgtaacccccgaagccgagcgagctccggaggaatttcagtatctgctacggtaacttcatcagcccgccaagatggcgatgcaagcggccaagagggcgaacattcgacttccacctgaagtaaatcggatattgtatataagaaatttgccatacaaaatcacagctgaagaaatgtatgatatatttgggaaatatggacctattcgtcaaatcagagtgtgagtcttactgagtcatttaaagaaaatgatagcataatctgtaatttcagaattatagctgacgatgaggccaccctgtgctgtgtgcagtgcgacaacccttaccaagagccttgagactagcagattgagatcagagagatgagatctttttgaaggggggagaaaacctactgagaccctaatgatccagctcaatgagagccaagaagaggatttgagtttcctcaaagcattcattgaagtagtaatgaatgctttgaggaaactggttgagaagggaaagaactaacatttattgcatacctgttatttgtaaagctagcttgttacactgtgttttttgtatgcagcagctctataattttctcaacaatcatcactgtctctttaaataaccccagaatttctgaataaactaagtaaaagagtataaaagtaacagaaaaaaatgatattttcaactacagctctttcaattgaagatgtaaaagtatagaggaaaacatctaatta

SEQ ID NO: 330414 - DNA, 1005 bp, Homo sapiens
atcagcgatgacaaatgcgcacatctgaataatccctttgtctaccacacatttttttccaagtaaaaaccagtgttccattaaacaaagtggctagtgtggctgagcgccggatgtaatcctaacacttggccaaggcaggagaatcgcttgaacccgggacccgggaggtggaggttgcagtgagccgatatcgtgtcattgcaccccagcctgggcgacagggcgagactccgtctcaaaaaaaaaaaacagagagacagagtctgggtatgtggccctgtctccaactccgtgggctcaagtgattctcctacttcagccccgggagtagctggagactggcaggcacacacacaccttgccgggctattaaagctaatttctttgggcactctgtagcctcccacattcagtatctgctacggtaacttcatcagcccgccaagatggcgatgcaagcggccaagagggcgaacattcgacttccacctgaagtaaatcggatattgtatataagaaatttgccatacaaaatcacagctgaagaaatgtatgatatatttgggaaatatggacctattcgtcaaatcagagtggggaacacacctgaaactagaggaacagcttatgtggtctatgaggacatctttgatgccaagaatgcatgtgatcacctatcgggattcaatgtttgtaacagataccttgtggttttgtactataatgccaacagggcatttcagaagatggacacaaagaagaaggaggaacagttgaagcttctcaaggagaaatatggcatcaacacagatccaccaaaataaatgttttctacattttcatttggactaaatcccacgaatgacaactaccacctttttttcctttttaattaatactaaatattgtgatttcttatttgaggttcaaaatgacctgcttgaaactttgatacatattggaatacattatgttaataaacttgtagctttttgtgaaaca

SEQ ID NO: 330415 - DNA, 1231 bp, Homo sapiens
ccggcctcgagtctcgctcaggctcggttttaccccggagtctattcgaagggggctgctacgtcagcgcgtctcagcgtaagacggcgctattccgctgtaacagcttccggcgggtcctggatgttgatgtcctgcatctaacgcggtgtaacccccgaagccgagcgagctccggaggaatttcagtatctgctacggtaacttcatcagcccgccaagatggcgatgcaagcggccaagagggcgaacattcgacttccacctgaagtaaatcggatattgtatataagaaatttgccatacaaaatcacagctgaagaaatgtatgatatatttgggaaatatggacctattcgtcaaatcagagtggggaacacacctgaaactagaggaacagcttatgtggtctatgaggacatctttgatgccaagaatgcatgtgatcacctatcgggattcaatgtttgtaacagataccttgtggttttgtactataatgccaacagggcatttcagaagatggacacaaagaagaaggaggaacagttgaagcttctcaaggagaaatatggcatcaacacagatccaccaaaataaatgttttctacattttcatttggactaaatcccacgaatgacaactaccacctttttttcctttttaattaatactaaatattgtgatttcttatttgaggttcaaaatgacctgcttgaaactttgatacatattggaatacattatgttaataaacttgtagctttttgtgaaacaaaaaaaaaaaaagggggggccgcccttttttttttttagccttttttatttttattttgtttttattatttttattatggaagagaaaacccggggaaatttaatgcggggtgtcagcagtgagatcaaagagaaaaaaggggggagaagatggggtgttattaaaaaacgaagggggaggttctacgcgacaggtagcaccagggctacatagggctgcaccaaaccgggggggggaagcaaacccccatgagagtggggcaaacaactaaggcggaggacacagaggaacgccaccaacacagtacgacacctagtcaacagaagagactcactattagacaagcaacaaggtttcacaggcggagaccagctcccgaaagagaaaaacaggaggggaaacaacaaaaacgaggctacaaagaccacgaaagccttgcgcggaaacaaagg

SEQ ID NO: 330416 - DNA, 378 bp, Homo sapiens
gaactgtactgtgatgatatatgtctactatgactttcttttttggctaatgctattgatgaaattcatttggctgtagattggtaatttaattttggtgcttaccacatttccaggcatttcagaagatggacacaaagaagaaggaggaacagttgaagcttctcaaggagaaatatggcatcaacacagatccaccaaaataaatgttttctacattttcatttggactaaatcccacgaatgacaactaccacctttttttcctttttaattaatactaaatattgtgatttcttatttgaggttcaaaatgacctgcttgaaactttgatacatattggaatacattatgttaataaacttgtagctttttgt

SEQ ID NO: 330417 - DNA, 662 bp, Homo sapiens
ccggcctcgagtctcgctcaggctcggttttaccccggagtctattcgaagggggctgctacgtcagcgcgtctcagcgtaagacggcgctattccgctgtaacagcttccggcgggtcctggatgttgatgtcctgcatctaacgcggtgtaacccccgaagccgagcgagctccggaggaatttcagtatctgctacggtaacttcatcagcccgccaagatggcgatgcaagcggccaagagggcgaacgtgagtatcgggtgttctgcggagggtgggagaacttcgggtttgactttcttagcggcgtggatcggagcattcttgctcctcctccgtccccagagcggagaactccagaattcctatcctgtcagcgaagacactatccggccccatcctcagagatatgctccttgagccacatttctgtccccaccccttttgagagttcctcagtctctaccctagtgtcagtgatagtgttacccctatagcctctttgcttgacccgcacctaaggacctggcgttaggattatctccttgacttaaagtcgatatctcagaagagtcctcaactaacttaatggttcaccaacaactaggacctgggattcccctcagatcatggtgcttttcggatccttcattaacaca

SEQ ID NO: 330418 - DNA, 455 bp, Homo sapiens
ccgggctgcaggaattcggcacgagggacctattcgtcaaatcagagtggggaacacacctgaaactagaggaacagcttatgtggtctatgaggacatctttgatgccaagaatgcatgtgatcacctatcgggattcaatgtttgtaacagataccttgtggttttgtactataatgccaacagggcatttcagaagatggacacaaagaagaaggaggaacagttgaagcttctcaaggagaaatatggcatcaacacagatccaccaaaataaatgttttctacattttcatttggactaaatcccacgaatgacaactaccacctttttttcctttttaattaatactaaatattgtgatttcttatttgaggttcaaaatgacctgcttgaaactttgatacatattggaatacattatgttaataaacttgtagctttttgtgaaaca

SEQ ID NO: 330419 - DNA, 461 bp, Homo sapiens
tttacgggtacggagcgtgatgacaaaaaaagaaaagaaggcgggcgcgcttgaggggaacacacctgaaactagaggaacagcttatgtggtctatgaggacatctttgatgccaagaatgcatgtgatcacctatcgggattcaatgtttgtaacagataccttgtggttttgtactataatgccaacagggcatttcagaagatggacacaaagaagaaggaggaacagttgaagcttctcaaggagaaatatggcatcaacacagatccaccaaaataaatgttttctacattttcatttggactaaatcccacgaatgacaactaccacctttttttcctttttaattaatactaaatattgtgatttcttatttgaggttcaaaatgacctgcttgaaactttgatacatattggaatacattatgttaataaacttgtagctttttgtgaaaca

SEQ ID NO: 330420 - DNA, 836 bp, Homo sapiens
ccggcctcgagtctcgctcaggctcggttttaccccggagtctattcgaagggggctgctacgtcagcgcgtctcagcgtaagacggcgctattccgctgtaacagcttccggcgggtcctggatgttgatgtcctgcatctaacgcggtgtaacccccgaagccgagcgagctccggaggaatttcagtatctgctacggtaacttcatcagcccgccaagatggcgatgcaagcggccaagagggcgaacattcgacttccacctgaagtaaatcggatattgtatataagaaatttgccatacaaaatcacagctgaagaaatgtatgatatatttgggaaatatggacctattcgtcaaatcagagtgtgagtcttactgagtcatttaaagtgtgctgtgtgcagtgcgacaacccttaccaagagccttgagactagcagattgagatcagagagatgagatctttttgaaggggggagaaaacctactgagaccctaatgatccagctcaatgagagccaagaagaggatttgagtttcctcaaagcattcattgaagtagtaatgaatgctttgaggaaactggttgagaagggaaagaactaacatttattgcatacctgttatttgtaaagctagcttgttacactgtgttttttgtatgcagcagctctataattttctcaacaatcatcactgtctctttaaataaccccagaatttctgaataaactaagtaaaagagtataaaagtaacagaaaaaaatgatattttcaactacagctctttcaattgaagatgtaaaagtatagaggaaaacatctaatta

SEQ ID NO: 330421 - DNA, 812 bp, Homo sapiens
ccggcctcgagtctcgctcaggctcggttttaccccggagtctattcgaagggggctgctacgtcagcgcgtctcagcgtaagacggcgctattccgctgtaacagcttccggcgggtcctggatgttgatgtcctgcatctaacgcggtgtaacccccgaagccgagcgagctccggaggaatttcagtatctgctacggtaacttcatcagcccgccaagatggcgatgcaagcggccaagagggcgaacattcgacttccacctgaagtaaatcggatattgtatataagaaatttgccatacaaaatcacagctgaagaaatgtatgatatatttgggaaatatggacctattcgtcaaatcagagtggggaacacacctgaaactagaggaacagcttatgtggtctatgaggacatctttgatgccaagaatgcatgtgatcacctatcgggattcaatgtttgtaacagataccttgtggttttgtactataatgccaacagggcatttcagaagatggacacaaagaagaaggaggaacagttgaagcttctcaaggagaaatatggcatcaacacagatccaccaaaataaatgttttctacattttcatttggactaaatcccacgaatgacaactaccacctttttttcctttttaattaatactaaatattgtgatttcttatttgaggttcaaaatgacctgcttgaaactttgatacatattggaatacattatgttaataaacttgtagctttttgtgaaacaaaacacaaaaaaaaatggcctagctggtctcaca

SEQ ID NO: 330422 - DNA, 815 bp, Homo sapiens
aaaaaaaaaaaaaaaaaaaaaaaaaggaagagacacaattacctgagggatgaatggcaaatgttctatttagaaacgcatttttaaagctcaccttgtagggtttcttgtcatgcatcatttaaaaaaataaattaaaaaccttgaatattaggctgaggattttctcttgaaagagacaaagagacatggtcaagtcactgggaatttcatgacttaggaggattctctcagaagactttctaagaataacttcaataatctccaataatctgcaacctacttttctttcattgaaacaaacaaagttagctatggaattaatatttggaaaatgaagaaagcttaaaggaaataaacatttcccataatcttaccatccactgaaaaccatggttaacttgacatgggagtgggcttgggttggaaaaaaatagggagagagttttatctctggaaagcattgctggctcccttccacactttacagcatgtattagcttagtgacactgtagggagaagcacaagccatgtaaagaggacttaatttgtcaagatttactgactagctaagggctaaaaagagatgagtggggtggaagcaatggtttccacaacacccccaagataaggggtatcacttgtgcaaatttagcaccagggagtggggccagcccagaacttcaactcaacatttgtcaagccctcagtataccttccaacccagaaaaacaataaaaatgttaatttttgaaatcactagcaaaatactaaatacaaggtcaatattttaaaccaaagtgccctgagagca

SEQ ID NO: 330423 - DNA, 236 bp, Homo sapiens
atatgaaactcggtgaactccctcacaatgaagtttccgtcaatccctcagcctctatggcaacccacctggggtagaggcagaggggagatcaccagcttctgatggggggagaatgaagccgttacctggaaatgcagtgatgagaacagtggttctcaactgggggtgattttgctccaaaggggacatttggcaatctctgaagacagtttctgttgtcacagctagggggg

SEQ ID NO: 330424 - DNA, 321 bp, Homo sapiens
caggcagaaacacatttggtcacaataacaggggggatgatatcaaaccggagtgttgtggctatgcagtgaagtgcggaattagaggtggagccttcgtggcatcactgaggtggaaggctttttcaagaccattggattcagttaaacaaatgagttgtagaatggggataagctgagggataagtaatcccatcctttacggaacatattttttggaggtggaactggatacagcaaattacagcatacagaataacataggtgctatcttgaggcaggtgtcatatccttgagcctgctgagggatcagagtggact

SEQ ID NO: 330425 - DNA, 601 bp, Homo sapiens
aatgttattaccataacccagctttcctttggtttagtatgtacttattgagaagggcactcaaaatactgccttattactttccaccagtggctttttacaactacaaattacttaaatgcttgacaacagacctttaacaaaaaagttaactgcaccaagtaaatgtcaataatactaagttcagaaagctgtatttttgataaatcaaattcatcttgtgggaaactgtcaacaaggaaaatgttcagttggtaattttcagttggtgtgtagagaaatgtaattagcagatcatttttaaaactggagattagagcagaaatatagctatgggattaaaacaagtcagctggtggcagtattttctcttgtaacttaggaaacagttaacctctcaaagtacctttacatccaataactcaaaaatgttactactatttgggcaatatgtagttgtggataaaatttactttaaaaacacaagatataaagtatgaatagtttatctgtataggacattgagcatttctggtgtgcttatccgcttaaagtttaaattaccagcagaatttgttatactttggggtcctgtgaaaaa

SEQ ID NO: 330426 - DNA, 471 bp, Homo sapiens
tgtgatccaatacaattttatttacaaaaatacaggttgggctgaatttggtccctgggcagtggtgtgctgacccatgcttgaaattatgatttcaattatgtacattttgagtgtgctatatactttaaaatgtgaatttcaagctgaaaaatgtattgtttaaagcgtaactagagtaaggtccttggagtgatgggcttgtcgggtattctccctagaggagtgcacattcaggtagggacagtcttcacatatttattccatgtaacaaatacgtagctctttgtatatgccaggtacagttctcggtgcttgtattagtctgtttttgcactgctccaaagaaatacctaggactgagtaatttataaggaaaagaggcttaattggctcatgttttcgcaggctgtacaggaagcatggcaccatcagctcggcttctggggaggcctcaggaaactgtaatca

SEQ ID NO: 330427 - DNA, 738 bp, Homo sapiens
cctctccgcccgctgcctgtgaatgatgcaatggaaggtgtgctggggtcgccctgtgtcccgtgcataggagcatctcagcctccaggtcctctcctttggggctcacggcacccccatgctacgaaccgcaggcagggacggcctctgtcgcctgtccacctacttggaagaactcgaggctgtggaactgaagaagttcaagttatacctggggaccgcgacagagctgggagaaggcaagatcccctggggaagcatggagaaggccggtcccctggaaatggcccagctgctcatcacccacttcgggccagaggaggcctggaggttggctctcagcacctttgagcggataaacaggaaggacctgtgggagagaggacagagagaggacctggtgagggataccccacctggtggcccgtcctcacttgggaaccagtcaacatgccttctggaagtctctcttgtcactccaagaaaagatccccaggaaacctacagggactatgtccgcaggaaattccggctcatggaagaccgcaatgcgcgcctaggggaatgtgtcaacctcagccaccggtacacccggctcctgctggtgaaggagcactcaaaccccatgcaggtccagcagcagcttctggacacaggccggggacacgcgaggaccgtgggacaccaggctagccccatcaagatagagaccctctttgagccagacgaggagcgccc

SEQ ID NO: 330428 - DNA, 672 bp, Homo sapiens
atgtatattaaagcaagagttgagatgacacttttccttataaaacagacagggattcagggacattgggactctaatgctgctggtaagacatgaataaatacataccatctctggcaatcaataccagaagctttaagcattgccttttgactttgaaattgtacctggaaatgtatgtttcagtaaccatcatgaatgtacacaaaatcctgaaactcttaaaactgatgtcacaggccaggcacagtggctcatgcctgtaatcccagcactttgggaggctgaggcgggtggatcacctgagatcaggagttcgagaccagcctgaccaatatggtgaaaccccgtctctactaaaaatacaaaacaattagctggtgtggtggcatgtgcctgtagtcccagctacttgggaggctgagacaggagaattgcatgaacccgggaggtggaggttgcggtgagccgagattgtgccactgtattccagcctgggtgacagagtgagactgtgtctcaaaaaaaaaaaaaaaaaaaaaaaaaaaactgatgtcaattaatattaaatgaagtattcatgatatattgttaagtaaaaatattacaaaacaatatgtacagtatgatcctatgtaaaatatatatttatgtattaaaaatactgaaaac

SEQ ID NO: 330429 - DNA, 483 bp, Homo sapiens
gagatggagttcgctcttgtccaggctggagtgcaatggcacgatcttggctcaccgcaaactctgcctcctgggttcaagcgattctcctgcctcagccttctgagtagctgggattacaggcatgcaccaccacagctgaccaatatggtgaaaccccgtctctactaaaaatacaaaacaattagctggtgtggtggcatgtgcctgtagtcccagctacttgggaggctgagacaggagaattgcatgaacccgggaggtggaggttgcggtgagccgagattgtgccactgtattccagcctgggtgacagagtgagactgtgtctcaaaaaaaaaaaaaaaaaaaaaaaaaaaactgatgtcaattaatattaaatgaagtattcatgatatattgttaagtaaaaatattacaaaacaatatgtacagtatgatcctatgtaaaatatatatttatgtattaaaaatactgaaaac

SEQ ID NO: 330430 - DNA, 1402 bp, Homo sapiens
gagatggagttcgctcttgtccaggctggagtgcaatggcacgatcttggctcaccgcaaactctgcctcctgggttcaagcgattctcctgcctcagccttctgagtagctgggattacaggcatgcaccaccacagctggctaattttgtatttttaggaaagacagggtttctccatgttggtcaggctggtctcgaattctcgatctcaggtgatccgcccgcctcggccccccaaagtgctgggattacaggcgtgagccatggcgcccaaccatcttttgcaaattttattaaagacaatgctaaaaggaagtgacaactgaaactaatggtcacagtcagtcaagacttcccttttctgaggggcctagcaggaagagaatatttagactgatgcttagtgtaagaaggaatgttgtacaggttaaccagcaacacaaagacatattcaaaagacctaataggtcagaagaataacataccacaccaaaaacaaatctgtatggaaatctagaatcatgtgcatagaaaaagaattttcatgaggataaaaagaagcaaagagaagtaatgctcttattggggcgtgcatcagtggacatgtgctaaccagtaagaacagcaggaggcctaaatgcccatgtttagggagagaatatggaaaaaatggatgggattatttggaaaagatgtaagagattaaaatacgtggtaagagctactcaactcttgtttttctccttttccatagataaagacctgaacaaactgaaaaggtaggacgtaaagtaggaattgtaaaacggaaatactctttatataagaaagctctactgtatgtcagaaagcaatgtaatagatagaccaagcacagtggctcacacctataatgccagcactttgggaggccaaggctggaggattgcttgagtctaggagttcaagccgagcctgggcagcatagtgagaccccatctctacaaaaaataaacagaatttgccagacgtggtagtgcatgcctgtagacccaagtatttgggaggctgaggtgagaggttcgcttgagccctggaagtcgaggcttcagtgaggcaagatcacaccactgcactccagcctgggagagcaagaccctgtctccaaaccaaaaaaaaaggaaaaaagtaaatgtaatagatacttgctaagggctttgtatatacttattattgttatttctcagcacgtatgtagcagatgcaggaaatgaaggctaaaggtcatatatctacaaagtggggaggtcagactttgaacccacaacctgactgtggagccacttcagtatactctctccccataagaaagttccaatagaaaaaaaatgctacttaagtagggaaatcacaaaataagt

SEQ ID NO: 330431 - DNA, 1311 bp, Homo sapiens
taatgctgctggtaagacatgaataaatacataccatctctggcaatcaataccagaagctttaagcattgccttttgactttgaaattgtacctggaaatgtatgtttcagtaaccatcatgaatgtacacaaaatcctgaaactcttaaaactgggattacaggcgtgagccatggcgcccaaccatcttttgcaaattttattaaagacaatgctaaaaggaagtgacaactgaaactaatggtcacagtcagtcaagacttcccttttctgaggggcctagcaggaagagaatatttagactgatgcttagtgtaagaaggaatgttgtacaggttaaccagcaacacaaagacatattcaaaagacctaataggtcagaagaataacataccacaccaaaaacaaatctgtatggaaatctagaatcatgtgcatagaaaaagaattttcatgaggataaaaagaagcaaagagaagtaatgctcttattggggcgtgcatcagtggacatgtgctaaccagtaagaacagcaggaggcctaaatgcccatgtttagggagagaatatggaaaaaatggatgggattatttggaaaagatgtaagagattaaaatacgtggtaagagctactcaactcttgtttttctccttttccatagataaagacctgaacaaactgaaaaggtaggacgtaaagtaggaattgtaaaacggaaatactctttatataagaaagctctactgtatgtcagaaagcaatgtaatagatagaccaagcacagtggctcacacctataatgccagcactttgggaggccaaggctggaggattgcttgagtctaggagttcaagccgagcctgggcagcatagtgagaccccatctctacaaaaaataaacagaatttgccagacgtggtagtgcatgcctgtagacccaagtatttgggaggctgaggtgagaggttcgcttgagccctggaagtcgaggcttcagtgaggcaagatcacaccactgcactccagcctgggagagcaagaccctgtctccaaaccaaaaaaaaaggaaaaaagtaaatgtaatagatacttgctaagggctttgtatatacttattattgttatttctcagcacgtatgtagcagatgcaggaaatgaaggctaaaggtcatatatctacaaagtggggaggtcagactttgaacccacaacctgactgtggagccacttcagtatactctctccccataagaaagttccaatagaaaaaaaatgctacttaagtagggaaatcacaaaataagt

SEQ ID NO: 330432 - DNA, 744 bp, Homo sapiens
tgatgccgtatatagtgaaggggtgaggatattctaaacaaacaaaaattgaataatttattcacagaaactattaagattgtattgtaaagctcacagcaagctcagtgggcagcagctgcaacatctcaccggggaaattattttatttaacgtgagtgagatgtgggccggagaaggtagctgaagctatttataaaacgttgtgtaccttcttccgagctctctcccctttgtgaagggcgcagcaactatacccttgatggatggagatttatgcaatgtgttttactgggtagagtgacagaccttggctgtccctggaattgagaatctggaccttatttccaggcagagaacactgtcctcagaaatgggacttctgataatgaaacaggttgtccaacattttctaatacgcattctacagaacacaggttccaggaggcatcaggttggtgtgatgcagactaagggttttgtggtcaaatatccttaagaaacaaagttaagtcagtttcctttctgcaaggacttttcagccttcaatgtgtgctgtgcatggtgaatccccaaaaataatccttgagtctgtagcatttcctgaacttacatgaccaggatactctattttgcagatcaccccacagagctagggttccaccgagtatactttgcttaggttgacttagcatatctgaggtcttcaaggataaaaactgccaccccaacacccttccatta

SEQ ID NO: 330433 - DNA, 2682 bp, Homo sapiens
tgatgccgtatatagtgaaggggtgaggatattctaaacaaacaaaaattgaataatttattcacagaaactattaagattgtattgtaaagctcacagcaagctcagtgggcagcagctgcaacatctcaccggggaaattattttatttaacgtgagtgagatgtgggccggagaaggtagctgaagctatttataaaacgttgtgtaccttcttccgagctctctcccctttgtgaagggcgcagcaactatacccttgatggatggagatttatgcaatgtgttttactgggtagagtgacagaccttggctgtccctggaattgagaatctggaccttatttccaggcagagaacactgtcctcagaaatgggacttctgataatgaaacaggttgtccaacattttctaatacgcattctacagaacacaggttccaggaggcatcaggttggtgtgatgcagactaagggttttgtggtcaaatatccttaagaaacaaagttaagtcagtttcctttctgcaaggacttttcagccttcaatgtgtgctgtgcatggtgaatccccaaaaataatccttgagtctgtagcatttcctgaacttacatgaccaggatactctattttgcagatcaccccacagagctagggttccaccgagtatactttgcttaggttgacttagcatatctgaggtcttcaaggataaaaactgccaccccaacacccttccattaaaaaaaaaaatacaaaatagcaccacagtctccatctggtttatagcaacagaggtactttatttaatgaagcaatggttctaatcctggatactgccacggactacaattctatccctcccagagggagtggaggaagtcttgggtggtgtggacagaaggaagagaggagagggtgagtggggtatagggcccagggtggctccctactcctcaggctcaaaaggatgctcagtgggaacagatgatctcttgatgagtgcttcttcagtttcatagtttggaatcgttcactgtgtgctttttggggggttttcaatggaaattcacgttgctttgcatttctgtgtccgtctttggtcagttgtgcaagcctgctcactgtcatgtgaagatggcctttcatctggcttctctctcttaagtgagaaagattgtccttcaggggacatgacatcaataggtttctggaatgagggactctttctccccgtgttttgctttgtgttcacattttcttttctaatggcattgaaactttaaaaaaaatggattcaactgtttttgcagaatgtagaaagtattctgtgtccttggttaaagaaatccacttgtgaagtgtgcctggaaaatgaaagtttgtgttttttaaagaggaatatttgaaactgctttctatgcatgcttagctggagaaaagtacaggcaggcgtcccatctcccagccacttctcaaaggtgctgctgtgttttaaagaccaggtacagccagggcagtatttgcaaggacattcctgcttactttatccctttggttggaaagctctagatgattcccgcagctcctccagaccccgcctccctgccctccccagctggtctgggaagaggtggtctgctgacctgtggtatctcagaggggacgttcctcctcctccctgtgcaccaggtgggctgcaccctcctgcctattcaggatgtggatgccacaggagagcagcaggcagtggaaacttcagttgcactggttctcctggtggcaaaggcatgaagcacaggggtcgattaatccaggctactagaaagctccagagcaaagtgtgcgggtcccacaaatgcttggctggtggggtctggatcagtgctgagatagagttggcagaagaagcagaggcactctgcttgctttcctagccagtcctcccctacacacacacacacacacacacacacacacacacacacaatctcagctgcgccattctgtgcaatcccagtgaccaaatcccttccttgcccacctctatgtcagcaggactgaccacatcactcccccgagttcccaccaccagcatttcctccaacctttttccatcacaaccagttagaaccctacaggcaacaaggccttctagaatccgcttaacccttggctgataacaggcaaatttcagtctgctacactttgttaggtccagaaggagctgcccatactactttcttatgagcatgctcagtatggcatatggacatgtaatgtcacatctttgtggagtgtgattttctttttttacatatttgtatgcagtagagagcctgttgtagaaaacgctccctgtatcttgctgtactgttaaagaaagctgaattccacattgccaacaaaagcgtgaaaatgttcatgaaccttcctccaggaaaagccattcaagcctgattatttttctaagtaacttcaattaaattgaagaaaaaaaaaaaaacaacaaaaacaaaaaaagacaagaaaaaaaaaaaaaaaggggggtttatttgtgtggggggagaaaaaggagattaagaaggggaaaggaattagttgtatccagaccgttttgtggtaaaggggaatatgaggcccaagagggggtatatatacggtcgttttgttgtctggat

SEQ ID NO: 330434 - DNA, 918 bp, Homo sapiens
gggtgacttagaggatcctgggatgaggaacgtcactgggattgacagaatggcgcagctgagattgtgtgtgtgtgtgtgtgcgggtcccacaaatgcttggctggtggggtctggatcagtgctgagatagagttggcagaagaagcagaggcactctgcttgctttcctagccagtcctcccctacacacacacacacacacacacacacacacacacacacaatctcagctgcgccattctgtgcaatcccagtgaccaaatcccttccttgcccacctctatgtcagcaggactgaccacatcactcccccgagttcccaccaccagcatttcctccaacctttttccatcacaaccagttagaaccctacaggcaacaaggccttctagaatccgcttaacccttggctgataacaggcaaatttcagtctgctacactttgttaggtccagaaggagctgcccatactactttcttatgagcatgctcagtatggcatatggacatgtaatgtcacatctttgtggagtgtgattttctttttttacatatttgtatgcagtagagagcctgttgtagaaaacgctccctgtatcttgctgtactgttaaagaaagctgaattccacattgccaacaaaagcgtgaaaatgttcatgaaccttcctccaggaaaagccattcaagcctgattatttttctaagtaacttcaattaaattgaagaaaaaaaaaaaaacaacaaaaacaaaaaaagacaagaaaaaaaaaaaaaaaggggggtttatttgtgtggggggagaaaaaggagattaagaaggggaaaggaattagttgtatccagaccgttttgtggtaaaggggaatatgaggcccaagagggggtatatatacggtcgttttgttgtctggat

SEQ ID NO: 330435 - DNA, 627 bp, Homo sapiens
tgcctgccaggtttggttactagaatagctgtgcatcagccacattcctcaaagtggctcaaaacgagagaataaagaggaccctgtagagataagtactacttaactggaaagaagtctgttaagcattgctgctgttccgttgtcctgtgaaagaaccaagacatgcttgtttactaagtgtatagttttataaaattccagtcatactcataagttcttaaactgggagtgtgagagaatggttctgttgagtttgttgatggtagaacataaggtgggtgttcacttattttgtaaaaatggtttgtaattgtagaataaccagttttcgtcaatgcacatattttaccatggatattaatatttatcaggcttttgatgaggccattgctgaacttgatacactgaatgaagactcatacaaagacagcaccctcatcatgcagttgcttagagacaacctaacagtgagttgtttactcttttaattttattttcttttcagaaacaaaagtatttatattttattttggacttcgtgtcttttagggaagatacatacgagctgaaagtatgagatacgtgttagtattttatgggacgaacattattttgtaggcaggt

SEQ ID NO: 330436 - DNA, 2246 bp, Homo sapiens
attgggcggtggaccgcccctcggccccggggtaggctgacacgggagggtcctcagctaaagccaaaagcagatcaaagtggtgggactcgcgtcgcggccgcggagacgtgaagctctcgaggctcctcccgctgcgggtcggcgctcgccctcgctctcctcgccctccgccccggccccggccccgcgcccgccatggagaagactgagctgatccagaaggccaagctggccgagcaggccgagcgctacgacgacatggccacctgcatgaaggcagtgaccgagcagggcgccgagctgtccaacgaggagcgcaacctgctctccgtggcctacaagaacgtggtcgggggccgcaggtccgcctggagggtcatctctagcatcgagcagaagaccgacacctccgacaagaagttgcagctgattaaggactatcgggagaaagtggagtccgagctgagatccatctgcaccacggtgctggaattgttggataaatatttaatagccaatgcaactaatccagagagtaaggtcttctatctgaaaatgaagggtgattacttccggtaccttgctgaagttgcgtgtggtgatgatcgaaaacaaacgatagataattcccaaggagcttaccaagaggcatttgatataagcaagaaagagatgcaacccacacacccaatccgcctggggcttgctcttaacttttctgtattttactatgagattcttaataacccagagcttgcctgcacgctggctaaaacggcttttgatgaggccattgctgaacttgatacactgaatgaagactcatacaaagacagcaccctcatcatgcagttgcttagagacaacctaacactttggacatcagacagtgcaggagaagaatgtgatgcggcagaaggggctgaaaactaaatccatacagggtgtcatccttctttccttcaagaaacctttttacacatctccattccttattccacttggatttcctatagcaaagaaacccattcatgtgtatggaatcaactgtttatagtcttttcacactgcagctttgggaaaacttcattccttgatttgtgtttgtcttggccttcctggtgtgcagtactgctgtagaaaagtattaatagcttcatttcatataaacataagtaactcccaaacacttatgtagaggactaaaaatgtatctggtatttaagtaatctgaaccagttctgcaagtgactgtgttttgtattactgtgaaaataagaaaatgtagttaattacaatttaaagagtattccacataacttcttaatttctacattccctcccttactcttcgggggtttcctttcagtaagcaacttttccatgctcttaatgtattcctttttagtaggaatccggaagtattagattgaatggaaaagcacttgccatctctgtctaggggtcacaaattgaaatggctcctgtatcacatacggaggtcttgtgtatctgtggcaacagggagtttccttattcactctttatttgctgctgtttaagttgccaacctcccctcccaataaaaattcacttacacctcctgcctttgtagttctggtattcactttactatgtgatagaagtagcatgttgctgccagaatacaagcattgcttttggcaaattaaagtgcatgtcatttcttaatacactagaaaggggaaataaattaaagtacacaagtccaagtctaaaactttagtacttttccatgcagatttgtgcacatgtgagagggtgtccagtttgtctagtgattgttatttagagagttggaccactattgtgtgttgctaatcattgactgtagtcccaaaaaagccttgtgaaaatgttatgccctatgtaacagcagagtaacataaaataaaagtacattttataaacccatttactatggctttgtaacaattgcatacccatattttaagggacaggtgaatttactactttctaaagtttattgatacttcccttttatgtaaaatgtagtagtgatacctatatttccacattgtgcattgtgacacacttgtctagggatgcctggaagtgtataaaattggactgcatttcttagagtgttttactatagatcagtctcatgggccatctcttcctcagatgtaaatgatatctggttaagtgttatatggaataaagtggacattttaaaacta

SEQ ID NO: 330437 - DNA, 2285 bp, Homo sapiens
  misc_feature (2249)..(2249): n is a, c, g, or t
attgggcggtggaccgcccctcggccccggggtaggctgacacgggagggtcctcagctaaagccaaaagcagatcaaagtggtgggactcgcgtcgcggccgcggagacgtgaagctctcgaggctcctcccgctgcgggtcggcgctcgccctcgctctcctcgccctccgccccggccccggccccgcgcccgccatggagaagactgagctgatccagaaggccaagctggccgagcaggccgagcgctacgacgacatggccacctgcatgaaggcagtgaccgagcagggcgccgagctgtccaacgaggagcgcaacctgctctccgtggcctacaagaacgtggtcgggggccgcaggtccgcctggagggtcatctctagcatcgagcagaagaccgacacctccgacaagaagttgcagctgattaaggactatcgggagaaagtggagtccgagctgagatccatctgcaccacggtgctggaattgttggataaatatttaatagccaatgcaactaatccagagagtaaggtcttctatctgaaaatgaagggtgattacttccggtaccttgctgaagttgcgtgtggtgatgatcgaaaacaaacgatagataattcccaaggagcttaccaagaggcatttgatataagcaagaaagagatgcaacccacacacccaatccgcctggggcttgctcttaacttttctgtattttactatgagattcttaataacccagagcttgcctgcacgctggctaaaacggcttttgatgaggccattgctgaacttgatacactgaatgaagactcatacaaagacagcaccctcatcatgcagttgcttagagacaacctaacactttggacatcagacagtgcaggagaagaatgtgatgcggcagaaggggctgaaaactaaatccatacagggtgtcatccttctttccttcaagaaacctttttacacatctccattccttattccacttggatttcctatagcaaagaaacccattcatgtgtatggaatcaactgtttatagtcttttcacactgcagctttgggaaaacttcattccttgatttgtgtttgtcttggccttcctggtgtgcagtactgctgtagaaaagtattaatagcttcatttcatataaacataagtaactcccaaacacttatgtagaggactaaaaatgtatctggtatttaagtaatctgaaccagttctgcaagtgactgtgttttgtattactgtgaaaataagaaaatgtagttaattacaatttaaagagtattccacataacttcttaatttctacattccctcccttactcttcgggggtttcctttcagtaagcaacttttccatgctcttaatgtattcctttttagtaggaatccggaagtattagattgaatggaaaagcacttgccatctctgtctaggggtcacaaattgaaatggctcctgtatcacatacggaggtcttgtgtatctgtggcaacagggagtttccttattcactctttatttgctgctgtttaagttgccaacctcccctcccaataaaaattcacttacacctcctgcctttgtagttctggtattcactttactatgtgatagaagtagcatgttgctgccagaatacaagcattgcttttggcaaattaaagtgcatgtcatttcttaatacactagaaaggggaaataaattaaagtacacaagtccaagtctaaaactttagtacttttccatgcagatttgtgcacatgtgagagggtgtccagtttgtctagtgattgttatttagagagttggaccactattgtgtgttgctaatcattgactgtagtcccaaaaaagccttgtgaaaatgttatgccctatgtaacagcagagtaacataaaataaaagtacattttataaacccatttactatggctttgtaacaattgcatacccatattttaagggacaggtgaatttactactttctaaagtttattgatacttcccttttatgtaaaatgtagtagtgatacctatatttccacattgtgcattgtgacacacttgtctagggatgcctggaagtgtataaaattggactgcatttcttagagtgttttactatagatcagtctcatgggccatctcttcctcagatgtaaatgatatctggttaagtgttatatggaataaagtggacattttaaaactaaanaaaaaaaaaaagggcgccgctcgcgatctagaacta

SEQ ID NO: 330438 - DNA, 2625 bp, Homo sapiens
attgggcggtggaccgcccctcggccccggggtaggctgacacgggagggtcctcagctaaagccaaaagcagatcaaagtggtgggactcgcgtcgcggccgcggagacgtgaagctctcgaggctcctcccgctgcgggtcggcgctcgccctcgctctcctcgccctccgccccggccccggccccgcgcccgccatggagaagactgagctgatccagaaggccaagctggccgagcaggccgagcgctacgacgacatggccacctgcatgaaggcagtgaccgagcagggcgccgagctgtccaacgaggagcgcaacctgctctccgtggcctacaagaacgtggtcgggggccgcaggtccgcctggagggtcatctctagcatcgagcagaagaccgacacctccgacaagaagttgcagctgattaaggactatcgggagaaagtggagtccgagctgagatccatctgcaccacggtgctggaattgttggataaatatttaatagccaatgcaactaatccagagagtaaggtcttctatctgaaaatgaagggtgattacttccggtaccttgctgaagttgcgtgtggtgatgatcgaaaacaaacgatagataattcccaaggagcttaccaagaggcatttgatataagcaagaaagagatgcaacccacacacccaatccgcctggggcttgctcttaacttttctgtattttactatgagattcttaataacccagagcttgcctgcacgctggctaaaacggcttttgatgaggccattgctgaacttgatacactgaatgaagactcatacaaagacagcaccctcatcatgcagttgcttagagacaacctaacactttggacatcagacagtgcaggagaagaatgtgatgcggcagaaggggctgaaaactaaatccatacagggtgtcatccttctttccttcaagaaacctttttacacatctccattccttattccacttggatttcctatagcaaagaaacccattcatgtgtatggaatcaactgtttatagtcttttcacactgcagctttgggaaaacttcattccttgatttgtgtttgtcttggccttcctggtgtgcagtactgctgtagaaaagtattaatagcttcatttcatataaacataagtaactcccaaacacttatgtagaggactaaaaatgtatctggtatttaagtaatctgaaccagttctgcaagtgactgtgttttgtattactgtgaaaataagaaaatgtagttaattacaatttaaagagtattccacataacttcttaatttctacattccctcccttactcttcgggggtttcctttcagtaagcaacttttccatgctcttaatgtattcctttttagtaggaatccggaagtattagattgaatggaaaagcacttgccatctctgtctaggggtcacaaattgaaatggctcctgtatcacatacggaggtcttgtgtatctgtggcaacagggagtttccttattcactctttatttgctgctgtttaagttgccaacctcccctcccaataaaaattcacttacacctcctgcctttgtagttctggtattcactttactatgtgatagaagtagcatgttgctgccagaatacaagcattgcttttggcaaattaaagtgcatgtcatttcttaatacactagaaaggggaaataaattaaagtacacaagtccaagtctaaaactttagtacttttccatgcagatttgtgcacatgtgagagggtgtccagtttgtctagtgattgttatttagagagttggaccactattgtgtgttgctaatcattgactgtagtcccaaaaaagccttgtgaaaatgttatgccctatgtaacagcagagtaacataaaataaaagtacattttataaacccatttactatggctttgtaacaattgcatacccatattttaagggacaggtgaatttactactttctaaagtttattgatacttcccttttatgtaaaatgtagtagtgatacctatatttccacattgtgcattgtgacacacttgtctagggatgcctggaagtgtataaaattggactgcatttcttagagtgttttactatagatcagtctcatgggccatctcttcctcagatgtaaatgatatctggttaagtgttatatggaataaagtggacattttaaaactatataaaaaaaaaaaaaagggggccgtcggggatttaaaatagggcgaagaaaaaaaatttttttcagccttagttgtttttgccggggggctttggagcaagaaagtgggttgggggggtaattggcctggatgtagcctgggggtggtggattcctccggtataaattgaccccaggatgattgttcttccctcagtaaacgtatagttcaaaaatcgagagtgatgcaaggtaaattgttcaacgggatgaaaggtggtacaaaaaagggggggataatactagggcatggacgtttaaggcatgggtaaagggggaaatgacgtgtgggattgggtagacacacgtattttttgtggtttttattttataggaggc

SEQ ID NO: 330439 - DNA, 2126 bp, Homo sapiens
attgggcggtggaccgcccctcggccccggggtaggctgacacgggagggtcctcagctaaagccaaaagcagatcaaagtggtgggactcgcgtcgcggccgcggagacgtgaagctctcgaggctcctcccgctgcgggtcggcgctcgccctcgctctcctcgccctccgccccggccccggccccgcgcccgccatggagaagactgagctgatccagaaggccaagctggccgagcaggccgagcgctacgacgacatggccacctgcatgaaggcagtgaccgagcagggcgccgagctgtccaacgaggagcgcaacctgctctccgtggcctacaagaacgtggtcgggggccgcaggtccgcctggagggtcatctctagcatcgagcagaagaccgacacctccgacaagaagttgcagctgattaaggactatcgggagaaagtggagtccgagctgagatccatctgcaccacggtgctggaattgttggataaatatttaatagccaatgcaactaatccagagagtaaggtcttctatctgaaaatgaagggtgattacttccggtaccttgctgaagttgcgtgtggtgatgatcgaaaacaaacgatagataattcccaaggagcttaccaagaggcatttgatataagcaagaaagagatgcaacccacacacccaatccgcctggggcttgctcttaacttttctgtattttactatgagattcttaataacccagagcttgcctgcacgctggctaaaacggcttttgatgaggccattgctgaacttgatacactgaatgaagactcatacaaagacagcaccctcatcatgcagttgcttagagacaacctaacactttggacatcagacagtgcaggagaagaatgtgatgcggcagaaggggctgaaaactaaatccatacagggtgtcatccttctttccttcaagaaacctttttacacatctccattccttattccacttggatttcctatagcaaagaaacccattcatgtgtatggaatcaactgtttatagtcttttcacactgcagctttgggaaaacttcattccttgatttgtgtttgtcttggccttcctggtgtgcagtactgctgtagaaaagtattaatagcttcatttcatataaacataagtaactcccaaacacttatgtagaggactaaaaatgtatctggtatttaagtaatctgaaccagttctgcaagtgactgtgttttgtattactgtgaaaataagaaaatgtagttaattacaatttaaagagtattccacataacttcttaatttctacattccctcccttactcttcgggggtttcctttcagtaagcaacttttccatgctcttaatgtattcctttttagtaggaatccggaagtattagattgaatggaaaagcacttgccatctctgtctaggggtcacaaattgaaatggctcctgtatcacatacggaggtcttgtgtatctgtggcaacagggagtttccttattcactctttatttgctgctgtttaagttgccaacctcccctcccaataaaaattcacttacacctcctgcctttgtagttctggtattcactttactatgtgatagaagtagcatgttgctgccagaatacaagcattgcttttggcaaattaaagtgcatgtcatttcttaatacactagaaaggggaaataaattaaagtacacaagtccaagtctaaaactttagtacttttccatgcagatttgtgcacatgtgagagggtgtccagtttgtctagtgattgttatttagagagttggaccactattgtgtgttgctaatcattgactgtagtcccaaaaaagccttgtgaaaatgttatgccctatgtaacagcagagtaacataaaataaaagtacattttataaacccaaaaaaaaaaaaaaaaaaaaaaattttggggcgctgcgcccagaaagtttataacctctttgggcgcgggccaggaatgaacgtgcacggttccaggaacccgcaacaaggtgttttcccaaaaaagcgggccggtctgaaaccacagggtgggtggtcaagcgtaagcgg

SEQ ID NO: 330440 - DNA, 2175 bp, Homo sapiens
  misc_feature (5)..(5): n is a, c, g, or t
  misc_feature (22)..(22): n is a, c, g, or t
  misc_feature (32)..(32): n is a, c, g, or t
gggangaaaattagcctaggtngggctgggtntgaattggcgaggctctcgaggctcctcccgctgcgggtcggcgctcgccctcgctctcctcgccctccgccccggccccggccccgcgcccgccatggagaagactgagctgatccagaaggccaagctggccgagcaggccgagcgctacgacgacatggccacctgcatgaaggcagtgaccgagcagggcgccgagctgtccaacgaggagcgcaacctgctctccgtggcctacaagaacgtggtcgggggccgcaggtccgcctggagggtcatctctagcatcgagcagaagaccgacacctccgacaagaagttgcagctgattaaggactatcgggagaaagtggagtccgagctgagatccatctgcaccacggtgctggaattgttggataaatatttaatagccaatgcaactaatccagagagtaaggtcttctatctgaaaatgaagggtgattacttccggtaccttgctgaagttgcgtgtggtgatgatcgaaaacaaacgatagataattcccaaggagcttaccaagaggcatttgatataagcaagaaagagatgcaacccacacacccaatccgcctggggcttgctcttaacttttctgtattttactatgagattcttaataacccagagcttgcctgcacgctggctaaaacggcttttgatgaggccattgctgaacttgatacactgaatgaagactcatacaaagacagcaccctcatcatgcagttgcttagagacaacctaacactttggacatcagacagtgcaggagaagaatgtgatgcggcagaaggggctgaaaactaaatccatacagggtgtcatccttctttccttcaagaaacctttttacacatctccattccttattccacttggatttcctatagcaaagaaacccattcatgtgtatggaatcaactgtttatagtcttttcacactgcagctttgggaaaacttcattccttgatttgtgtttgtcttggccttcctggtgtgcagtactgctgtagaaaagtattaatagcttcatttcatataaacataagtaactcccaaacacttatgtagaggactaaaaatgtatctggtatttaagtaatctgaaccagttctgcaagtgactgtgttttgtattactgtgaaaataagaaaatgtagttaattacaatttaaagagtattccacataacttcttaatttctacattccctcccttactcttcgggggtttcctttcagtaagcaacttttccatgctcttaatgtattcctttttagtaggaatccggaagtattagattgaatggaaaagcacttgccatctctgtctaggggtcacaaattgaaatggctcctgtatcacatacggaggtcttgtgtatctgtggcaacagggagtttccttattcactctttatttgctgctgtttaagttgccaacctcccctcccaataaaaattcacttacacctcctgcctttgtagttctggtattcactttactatgtgatagaagtagcatgttgctgccagaatacaagcattgcttttggcaaattaaagtgcatgtcatttcttaatacactagaaaggggaaataaattaaagtacacaagtccaagtctaaaactttagtacttttccatgcagatttgtgcacatgtgagagggtgtccagtttgtctagtgattgttatttagagagttggaccactattgtgtgttgctaatcattgactgtagtcccaaaaaagccttgtgaaaatgttatgccctatgtaacagcagagtaacataaaataaaagtacattttataaacccatttactatggctttgtaacaattgcatacccatattttaagggacaggtgaatttactactttctaaagtttattgatacttcccttttatgtaaaatgtagtagtgatacctatatttccacattgtgcattgtgacacacttgtctagggatgcctggaagtgtataaaattggactgcatttcttagagtgttttactatagatcagtctcatgggccatctcttcctcagatgtaaatgatatctggttaagtgttatatggaataaagtggacattttaaaacta

SEQ ID NO: 330441 - DNA, 2198 bp, Homo sapiens
attgggcggtggaccgcccctcggccccggggtaggctgacacgggagggtcctcagctaaagccaaaagcagatcaaagtggtgggactcgcgtcgcggccgcggagacgtgaagctctcgaggctcctcccgctgcgggtcggcgctcgccctcgctctcctcgccctccgccccggccccggccccgcgcccgccatggagaagactgagctgatccagaaggccaagctggccgagcaggccgagcgctacgacgacatggccacctgcatgaaggcagtgaccgagcagggcgccgagctgtccaacgaggagcgcaacctgctctccgtggcctacaagaacgtggtcgggggccgcaggtccgcctggagggtcatctctagcatcgagcagaagaccgacacctccgacaagaagttgcagctgattaaggactatcgggagaaagtggagtccgagctgagatccatctgcaccacggtgctggaattgttggataaatatttaatagccaatgcaactaatccagagagtaaggtcttctatctgaaaatgaagggtgattacttccggtaccttgctgaagttgcgtgtggtgatgatcgaaaacaaacgatagataattcccaaggagcttaccaagaggcatttgatataagcaagaaagagatgcaacccacacacccaatccgcctggggcttgctcttaacttttctgtattttactatgagattcttaataacccagagcttgcctgcacgctggctaaaacggcttttgatgaggccattgctgaacttgatacactgaatgaagactcatacaaagacagcaccctcatcatgcagttgcttagagacaacctaacactttggacatcagacagtgcaggagaagaatgtgatgcggcagaaggggctgaaaactaaatccatacagggtgtcatccttctttccttcaagaaacctttttacacatctccattccttattccacttggatttcctatagcaaagaaacccattcatgtgtatggaatcaactgtttatagtcttttcacactgcagctttgggaaaacttcattccttgatttgtgtttgtcttggccttcctggtgtgcagtactgctgtagaaaagtattaatagcttcatttcatataaacataagtaactcccaaacacttatgtagaggactaaaaatgtatctggtatttaagtaatctgaaccagttctgcaagtgactgtgttttgtattactgtgaaaataagaaaatgtagttaattacaatttaaagagtattccacataacttcttaatttctacattccctcccttactcttcgggggtttcctttcagtaagcaacttttccatgctcttaatgtattcctttttagtaggaatccggaagtattagattgaatggaaaagcacttgccatctctgtctaggggtcacaaattgaaatggctcctgtatcacatacggaggtcttgtgtatctgtggcaacagggagtttccttattcactctttatttgctgctgtttaagttgccaacctcccctcccaataaaaattcacttacacctcctgcctttgtagttctggtattcactttactatgtgatagaagtagcatgttgctgccagaatacaagcattgcttttggcaaattaaagtgcatgtcatttcttaatacactagaaaggggaaataaattaaagtacacaagtccaagtctaaaactttagtacttttccatgcagatttgtgcacatgtgagagggtgtccagtttgtctagtgattgttatttagagagttggaccactattgtgtgttgctaatcattgactgtagtcccaaaaaagccttgtgaaaatgttatgccctatgtaacagcagagtaacataaacatacccatattttaagggacaggtgaatttactactttctaaagtttattgatacttcccttttatgtaaaatgtagtagtgatacctatatttccacattgtgcattgtgacacacttgtctagggatgcctggaagtgtataaaattggactgcatttcttagagtgttttactatagatcagtctcatgggccatctcttcctcagatgtaaatgatatctggttaagtgttatatggaataaagtggacattttaaaacta

SEQ ID NO: 330442 - DNA, 2323 bp, Homo sapiens
attgggcggtggaccgcccctcggccccggggtaggctgacacgggagggtcctcagctaaagccaaaagcagatcaaagtggtgggactcgcgtcgcggccgcggagacgtgaagctctcgaggctcctcccgctgcgggtcggcgctcgccctcgctctcctcgccctccgccccggccccggccccgcgcccgccatggagaagactgagctgatccagaaggccaagctggccgagcaggccgagcgctacgacgacatggccacctgcatgaaggcagtgaccgagcagggcgccgagctgtccaacgaggagcgcaacctgctctccgtggcctacaagaacgtggtcgggggccgcaggtccgcctggagggtcatctctagcatcgagcagaagaccgacacctccgacaagaagttgcagctgattaaggactatcgggagaaagtggagtccgagctgagatccatctgcaccacggtgctggaattgttggataaatatttaatagccaatgcaactaatccagagagtaaggtcttctatctgaaaatgaagggtgattacttccggtaccttgctgaagttgcgtgtggtgatgatcgaaaacaaacgatagataattcccaaggagcttaccaagaggcatttgatataagcaagaaagagatgcaacccacacacccaatccgcctggggcttgctcttaacttttctgtattttactatgagattcttaataacccagagcttgcctgcacgctggctaaaacggcttttgatgaggccattgctgaacttgatacactgaatgaagactcatacaaagacagcaccctcatcatgcagttgcttagagacaacctaacactttggacatcagacagtgcaggagaagaatgtgatgcggcagaaggggctgaaaactaaatccatacagggtgtcatccttctttccttcaagaaacctttttacacatctccattccttattccacttggatttcctatagcaaagaaacccattcatgtgtatggaatcaactgtttatagtcttttcacactgcagctttgggaaaagactataaacagttgattccattcatgtgtatggaatcaactgtttatagtcttttcacactgcagctttgggaaaacttcattccttgatttgtgtttgtcttggccttcctggtgtgcagtactgctgtagaaaagtattaatagcttcatttcatataaacataagtaactcccaaacacttatgtagaggactaaaaatgtatctggtatttaagtaatctgaaccagttctgcaagtgactgtgttttgtattactgtgaaaataagaaaatgtagttaattacaatttaaagagtattccacataacttcttaatttctacattccctcccttactcttcgggggtttcctttcagtaagcaacttttccatgctcttaatgtattcctttttagtaggaatccggaagtattagattgaatggaaaagcacttgccatctctgtctaggggtcacaaattgaaatggctcctgtatcacatacggaggtcttgtgtatctgtggcaacagggagtttccttattcactctttatttgctgctgtttaagttgccaacctcccctcccaataaaaattcacttacacctcctgcctttgtagttctggtattcactttactatgtgatagaagtagcatgttgctgccagaatacaagcattgcttttggcaaattaaagtgcatgtcatttcttaatacactagaaaggggaaataaattaaagtacacaagtccaagtctaaaactttagtacttttccatgcagatttgtgcacatgtgagagggtgtccagtttgtctagtgattgttatttagagagttggaccactattgtgtgttgctaatcattgactgtagtcccaaaaaagccttgtgaaaatgttatgccctatgtaacagcagagtaacataaaataaaagtacattttataaacccatttactatggctttgtaacaattgcatacccatattttaagggacaggtgaatttactactttctaaagtttattgatacttcccttttatgtaaaatgtagtagtgatacctatatttccacattgtgcattgtgacacacttgtctagggatgcctggaagtgtataaaattggactgcatttcttagagtgttttactatagatcagtctcatgggccatctcttcctcagatgtaaatgatatctggttaagtgttatatggaataaagtggacattttaaaacta

SEQ ID NO: 330443 - DNA, 1931 bp, Homo sapiens
gactcgcgtcgcggcgcggagacgtgaagctctcgaggctcctcccgcaggtccgcctggagggtcatctctagcatcgagcagaagaccgacacctccgacaagaagttgcagctgattaaggactatcgggagaaagtggagtccgagctgagatccatctgcaccacggtgctggaattgttggataaatatttaatagccaatgcaactaatccagagagtaaggtcttctatctgaaaatgaagggtgattacttccggtaccttgctgaagttgcgtgtggtgatgatcgaaaacaaacgatagataattcccaaggagcttaccaagaggcatttgatataagcaagaaagagatgcaacccacacacccaatccgcctggggcttgctcttaacttttctgtattttactatgagattcttaataacccagagcttgcctgcacgctggctaaaacggcttttgatgaggccattgctgaacttgatacactgaatgaagactcatacaaagacagcaccctcatcatgcagttgcttagagacaacctaacactttggacatcagacagtgcaggagaagaatgtgatgcggcagaaggggctgaaaactaaatccatacagggtgtcatccttctttccttcaagaaacctttttacacatctccattccttattccacttggatttcctatagcaaagaaacccattcatgtgtatggaatcaactgtttatagtcttttcacactgcagctttgggaaaacttcattccttgatttgtgtttgtcttggccttcctggtgtgcagtactgctgtagaaaagtattaatagcttcatttcatataaacataagtaactcccaaacacttatgtagaggactaaaaatgtatctggtatttaagtaatctgaaccagttctgcaagtgactgtgttttgtattactgtgaaaataagaaaatgtagttaattacaatttaaagagtattccacataacttcttaatttctacattccctcccttactcttcgggggtttcctttcagtaagcaacttttccatgctcttaatgtattcctttttagtaggaatccggaagtattagattgaatggaaaagcacttgccatctctgtctaggggtcacaaattgaaatggctcctgtatcacatacggaggtcttgtgtatctgtggcaacagggagtttccttattcactctttatttgctgctgtttaagttgccaacctcccctcccaataaaaattcacttacacctcctgcctttgtagttctggtattcactttactatgtgatagaagtagcatgttgctgccagaatacaagcattgcttttggcaaattaaagtgcatgtcatttcttaatacactagaaaggggaaataaattaaagtacacaagtccaagtctaaaactttagtacttttccatgcagatttgtgcacatgtgagagggtgtccagtttgtctagtgattgttatttagagagttggaccactattgtgtgttgctaatcattgactgtagtcccaaaaaagccttgtgaaaatgttatgccctatgtaacagcagagtaacataaaataaaagtacattttataaacccatttactatggctttgtaacaattgcatacccatattttaagggacaggtgaatttactactttctaaagtttattgatacttcccttttatgtaaaatgtagtagtgatacctatatttccacattgtgcattgtgacacacttgtctagggatgcctggaagtgtataaaattggactgcatttcttagagtgttttactatagatcagtctcatgggccatctcttcctcagatgtaaatgatatctggttaagtgttatatggaataaagtggacattttaaaacta

SEQ ID NO: 330444 - DNA, 2105 bp, Homo sapiens
attgggcggtggaccgcccctcggccccggggtaggctgacacgggagggtcctcagctaaagccaaaagcagatcaaagtggtgggactcgcgtcgcggccgcggagacgtgaagctctcgaggctcctcccgctgcgggtcggcgctcgccctcgctctcctcgccctccgccccggccccggccccgcgcccgccatggagaagactgagctgatccgcaggtccgcctggagggtcatctctagcatcgagcagaagaccgacacctccgacaagaagttgcagctgattaaggactatcgggagaaagtggagtccgagctgagatccatctgcaccacggtgctggaattgttggataaatatttaatagccaatgcaactaatccagagagtaaggtcttctatctgaaaatgaagggtgattacttccggtaccttgctgaagttgcgtgtggtgatgatcgaaaacaaacgatagataattcccaaggagcttaccaagaggcatttgatataagcaagaaagagatgcaacccacacacccaatccgcctggggcttgctcttaacttttctgtattttactatgagattcttaataacccagagcttgcctgcacgctggctaaaacggcttttgatgaggccattgctgaacttgatacactgaatgaagactcatacaaagacagcaccctcatcatgcagttgcttagagacaacctaacactttggacatcagacagtgcaggagaagaatgtgatgcggcagaaggggctgaaaactaaatccatacagggtgtcatccttctttccttcaagaaacctttttacacatctccattccttattccacttggatttcctatagcaaagaaacccattcatgtgtatggaatcaactgtttatagtcttttcacactgcagctttgggaaaacttcattccttgatttgtgtttgtcttggccttcctggtgtgcagtactgctgtagaaaagtattaatagcttcatttcatataaacataagtaactcccaaacacttatgtagaggactaaaaatgtatctggtatttaagtaatctgaaccagttctgcaagtgactgtgttttgtattactgtgaaaataagaaaatgtagttaattacaatttaaagagtattccacataacttcttaatttctacattccctcccttactcttcgggggtttcctttcagtaagcaacttttccatgctcttaatgtattcctttttagtaggaatccggaagtattagattgaatggaaaagcacttgccatctctgtctaggggtcacaaattgaaatggctcctgtatcacatacggaggtcttgtgtatctgtggcaacagggagtttccttattcactctttatttgctgctgtttaagttgccaacctcccctcccaataaaaattcacttacacctcctgcctttgtagttctggtattcactttactatgtgatagaagtagcatgttgctgccagaatacaagcattgcttttggcaaattaaagtgcatgtcatttcttaatacactagaaaggggaaataaattaaagtacacaagtccaagtctaaaactttagtacttttccatgcagatttgtgcacatgtgagagggtgtccagtttgtctagtgattgttatttagagagttggaccactattgtgtgttgctaatcattgactgtagtcccaaaaaagccttgtgaaaatgttatgccctatgtaacagcagagtaacataaaataaaagtacattttataaacccatttactatggctttgtaacaattgcatacccatattttaagggacaggtgaatttactactttctaaagtttattgatacttcccttttatgtaaaatgtagtagtgatacctatatttccacattgtgcattgtgacacacttgtctagggatgcctggaagtgtataaaattggactgcatttcttagagtgttttactatagatcagtctcatgggccatctcttcctcagatgtaaatgatatctggttaagtgttatatggaataaagtggacattttaaaacta

SEQ ID NO: 330445 - DNA, 1924 bp, Homo sapiens
accaaccgcgacccaaagccaaggactaactgtatataacatacactcacaggaatccacactgtcacccgggctgcagtgcagtagcatgatctcggctcactgcaacctccacctcccaggttcaagcaattctcctgcctcagcctcctgagtagctgggattacaggaattgttggataaatatttaatagccaatgcaactaatccagagagtaaggtcttctatctgaaaatgaagggtgattacttccggtaccttgctgaagttgcgtgtggtgatgatcgaaaacaaacgatagataattcccaaggagcttaccaagaggcatttgatataagcaagaaagagatgcaacccacacacccaatccgcctggggcttgctcttaacttttctgtattttactatgagattcttaataacccagagcttgcctgcacgctggctaaaacggcttttgatgaggccattgctgaacttgatacactgaatgaagactcatacaaagacagcaccctcatcatgcagttgcttagagacaacctaacactttggacatcagacagtgcaggagaagaatgtgatgcggcagaaggggctgaaaactaaatccatacagggtgtcatccttctttccttcaagaaacctttttacacatctccattccttattccacttggatttcctatagcaaagaaacccattcatgtgtatggaatcaactgtttatagtcttttcacactgcagctttgggaaaacttcattccttgatttgtgtttgtcttggccttcctggtgtgcagtactgctgtagaaaagtattaatagcttcatttcatataaacataagtaactcccaaacacttatgtagaggactaaaaatgtatctggtatttaagtaatctgaaccagttctgcaagtgactgtgttttgtattactgtgaaaataagaaaatgtagttaattacaatttaaagagtattccacataacttcttaatttctacattccctcccttactcttcgggggtttcctttcagtaagcaacttttccatgctcttaatgtattcctttttagtaggaatccggaagtattagattgaatggaaaagcacttgccatctctgtctaggggtcacaaattgaaatggctcctgtatcacatacggaggtcttgtgtatctgtggcaacagggagtttccttattcactctttatttgctgctgtttaagttgccaacctcccctcccaataaaaattcacttacacctcctgcctttgtagttctggtattcactttactatgtgatagaagtagcatgttgctgccagaatacaagcattgcttttggcaaattaaagtgcatgtcatttcttaatacactagaaaggggaaataaattaaagtacacaagtccaagtctaaaactttagtacttttccatgcagatttgtgcacatgtgagagggtgtccagtttgtctagtgattgttatttagagagttggaccactattgtgtgttgctaatcattgactgtagtcccaaaaaagccttgtgaaaatgttatgccctatgtaacagcagagtaacataaaataaaagtacattttataaacccatttactatggctttgtaacaattgcatacccatattttaagggacaggtgaatttactactttctaaagtttattgatacttcccttttatgtaaaatgtagtagtgatacctatatttccacattgtgcattgtgacacacttgtctagggatgcctggaagtgtataaaattggactgcatttcttagagtgttttactatagatcagtctcatgggccatctcttcctcagatgtaaatgatatctggttaagtgttatatggaataaagtggacattttaaaacta

SEQ ID NO: 330446 - DNA, 1840 bp, Homo sapiens
atggttgttctcacgttttcttcgtccctttctctcctcttcgtcttctcgcattcacaccgcgtccgggcccctggtcggtcgacgaattgttggataaatatttaatagccaatgcaactaatccagagagtaaggtcttctatctgaaaatgaagggtgattacttccggtaccttgctgaagttgcgtgtggtgatgatcgaaaacaaacgatagataattcccaaggagcttaccaagaggcatttgatataagcaagaaagagatgcaacccacacacccaatccgcctggggcttgctcttaacttttctgtattttactatgagattcttaataacccagagcttgcctgcacgctggctaaaacggcttttgatgaggccattgctgaacttgatacactgaatgaagactcatacaaagacagcaccctcatcatgcagttgcttagagacaacctaacactttggacatcagacagtgcaggagaagaatgtgatgcggcagaaggggctgaaaactaaatccatacagggtgtcatccttctttccttcaagaaacctttttacacatctccattccttattccacttggatttcctatagcaaagaaacccattcatgtgtatggaatcaactgtttatagtcttttcacactgcagctttgggaaaacttcattccttgatttgtgtttgtcttggccttcctggtgtgcagtactgctgtagaaaagtattaatagcttcatttcatataaacataagtaactcccaaacacttatgtagaggactaaaaatgtatctggtatttaagtaatctgaaccagttctgcaagtgactgtgttttgtattactgtgaaaataagaaaatgtagttaattacaatttaaagagtattccacataacttcttaatttctacattccctcccttactcttcgggggtttcctttcagtaagcaacttttccatgctcttaatgtattcctttttagtaggaatccggaagtattagattgaatggaaaagcacttgccatctctgtctaggggtcacaaattgaaatggctcctgtatcacatacggaggtcttgtgtatctgtggcaacagggagtttccttattcactctttatttgctgctgtttaagttgccaacctcccctcccaataaaaattcacttacacctcctgcctttgtagttctggtattcactttactatgtgatagaagtagcatgttgctgccagaatacaagcattgcttttggcaaattaaagtgcatgtcatttcttaatacactagaaaggggaaataaattaaagtacacaagtccaagtctaaaactttagtacttttccatgcagatttgtgcacatgtgagagggtgtccagtttgtctagtgattgttatttagagagttggaccactattgtgtgttgctaatcattgactgtagtcccaaaaaagccttgtgaaaatgttatgccctatgtaacagcagagtaacataaaataaaagtacattttataaacccatttactatggctttgtaacaattgcatacccatattttaagggacaggtgaatttactactttctaaagtttattgatacttcccttttatgtaaaatgtagtagtgatacctatatttccacattgtgcattgtgacacacttgtctagggatgcctggaagtgtataaaattggactgcatttcttagagtgttttactatagatcagtctcatgggccatctcttcctcagatgtaaatgatatctggttaagtgttatatggaataaagtggacattttaaaacta

SEQ ID NO: 330447 - DNA, 2197 bp, Homo sapiens
attgggcggtggaccgcccctcggccccggggtaggctgacacgggagggtcctcagctaaagccaaaagcagatcaaagtggtgggactcgcgtcgcggccgcggagacgtgaagctctcgaggctcctcccgctgcgggtcggcgctcgccctcgctctcctcgccctccgccccggccccggccccgcgcccgccatggagaagactgagctgatccagaaggccaagctggccgagcaggccgagcgctacgacgacatggccacctgcatgaaggcagtgaccgagcagggcgccgagctgtccaacgaggagcgcaacctgctctccgtggcctacaagaacgtggtcgggggccgcaggtccgcctggagggtcatctctagcatcgagcagaagaccgacacctccgacaagaagttgcagctgattaaggactatcgggagaaagtggagtccgagctgagatccatctgcaccacggtgctggaattgttggataaatatttaatagccaatgcaactaatccagagagtaaggtcttctatctgaaaatgaagggtgattacttccggtaccttgctgaagttgcgtgtggtgatgatcgaaaaccaagaaagagatgcaacccacacacccaatccgcctggggcttgctcttaacttttctgtattttactatgagattcttaataacccagagcttgcctgcacgctggctaaaacggcttttgatgaggccattgctgaacttgatacactgaatgaagactcatacaaagacagcaccctcatcatgcagttgcttagagacaacctaacactttggacatcagacagtgcaggagaagaatgtgatgcggcagaaggggctgaaaactaaatccatacagggtgtcatccttctttccttcaagaaacctttttacacatctccattccttattccacttggatttcctatagcaaagaaacccattcatgtgtatggaatcaactgtttatagtcttttcacactgcagctttgggaaaacttcattccttgatttgtgtttgtcttggccttcctggtgtgcagtactgctgtagaaaagtattaatagcttcatttcatataaacataagtaactcccaaacacttatgtagaggactaaaaatgtatctggtatttaagtaatctgaaccagttctgcaagtgactgtgttttgtattactgtgaaaataagaaaatgtagttaattacaatttaaagagtattccacataacttcttaatttctacattccctcccttactcttcgggggtttcctttcagtaagcaacttttccatgctcttaatgtattcctttttagtaggaatccggaagtattagattgaatggaaaagcacttgccatctctgtctaggggtcacaaattgaaatggctcctgtatcacatacggaggtcttgtgtatctgtggcaacagggagtttccttattcactctttatttgctgctgtttaagttgccaacctcccctcccaataaaaattcacttacacctcctgcctttgtagttctggtattcactttactatgtgatagaagtagcatgttgctgccagaatacaagcattgcttttggcaaattaaagtgcatgtcatttcttaatacactagaaaggggaaataaattaaagtacacaagtccaagtctaaaactttagtacttttccatgcagatttgtgcacatgtgagagggtgtccagtttgtctagtgattgttatttagagagttggaccactattgtgtgttgctaatcattgactgtagtcccaaaaaagccttgtgaaaatgttatgccctatgtaacagcagagtaacataaaataaaagtacattttataaacccatttactatggctttgtaacaattgcatacccatattttaagggacaggtgaatttactactttctaaagtttattgatacttcccttttatgtaaaatgtagtagtgatacctatatttccacattgtgcattgtgacacacttgtctagggatgcctggaagtgtataaaattggactgcatttcttagagtgttttactatagatcagtctcatgggccatctcttcctcagatgtaaatgatatctggttaagtgttatatggaataaagtggacattttaaaacta

SEQ ID NO: 330448 - DNA, 1775 bp, Homo sapiens
attgggcggtggaccgcccctcggccccggggtaggctgacacgggagggtcctcagctaaagccaaaagcagatcaaagtggtgggactcgcgtcgcggccgcggagacgtgaagctctcgaggctcctcccgctgcgggtcggcgctcgccctcgctctcctcgccctccgccccggccccggccccgcgcccgccatggagaagactgagctgatccagaaggccaagctggccgagcaggccgagcgctacgacgacatggccacctgcatgaaggcagtgaccgagcagggcgccgagctgtccaacgaggagcgcaacctgctctccgtggcctacaagaacgtggtcgggggccgcaggtccgcctggagggtcatctctagcatcgagcagaagaccgacacctccgacaagaagttgcagctgattaaggactatcgggagaaagtggagtccgagctgagatccatctgcaccacggtgctggaattgttggataaatatttaatagccaatgcaactaatccagagagtaaggtcttctatctgaaaatgaagggtgattacttccggtaccttgctgaagttgcgtgtggtgatgatcgaaaacaaacgatagataattcccaaggagcttaccaagaggcatttgatataagcaagaaagagatgcaacccacacacccaatccgcctggggcttgctcttaacttttctgtattttactatgagattcttaataacccagagcttgcctgcacgctggctaaaacggcttttgatgaggccattgctgaacttgatacactgaatgaagactcatacaaagacagcaccctcatcatgcagttgcttagagacaacctaacactttggacatcagacagtgcaggagaagaatgtgatgcggcagaaggggctgaaaactaaatccatacagggtgtcatccttctttccttcaagaaacctttttacacatctccattccttattccacttggatttcctatagcaaagaaacccattcatgtgtatggaatcaactgtttatagtcttttcacactgcagctttgggaaaacttcattccttgatttgtgtttgtcttggccttcctggtgtgcagtactgctgtagaaaagtattaatagcttcatttcatataaacataagtaactcccaaacacttatgtagaggactaaaaatgtatctggtatttaagtaatctgaaccagttctgcaagtgactgtgttttgtattactgtgaaaataagaaaatgtagttaattacaatttaaagagtattccacataacttcttaatttctacattccctcccttactcttcgggggtttcctttcagtaagcaacttttccatgctcttaatgtattcctttttagtaggaatccggaagtattagattgaatggaaaagcacttgccatctctgtctaggggtcacaaattgaaatggctcctgtatcacatacggaggtcttgtgtatctgtggcaacagggagtttccttattcactctttatttgctgctgtttaagttgccaacctcccctcccaataaaaattcacttacacctaaaaaaaaaaaaaaaaaaaaaattttggggcgctgcgcccagaaagtttataacctctttgggcgcgggccaggaatgaacgtgcacggttccaggaacccgcaacaaggtgttttcccaaaaaagcgggccggtctgaaaccacagggtgggtggtcaagcgtaagcgg

SEQ ID NO: 330449 - DNA, 2082 bp, Homo sapiens
attgggcggtggaccgcccctcggccccggggtaggctgacacgggagggtcctcagctaaagccaaaagcagatcaaagtggtgggactcgcgtcgcggccgcggagacgtgaagctctcgaggctcctcccgctgcgggtcggcgctcgccctcgctctcctcgccctccgccccggccccggccccgcgcccgccatggagaagactgagctgatccagaaggccaagctggccgagcaggccgagcgctacgacgacatggccacctgcatgaaggcagtgaccgagcagggcgccgagctgtccaacgaggagcgcaacctgctctccgtggcctacaagaacgtggtcgggggccgcaggtccgcctggagggtcatctctagcatcgagcagaagaccgacacctccgacaagaagttgcagctgattaaggactatcgggagaaagtggagtccgagctgagatccatctgcaccacggtgctggaattgttggataaatatttaatagccaatgcaactaatccagagagtaaggtcttctatctgaaaatgaagggtgattacttccggtaccttgctgaagttgcgtgtggtgatgatcgaaaacgcttttgatgaggccattgctgaacttgatacactgaatgaagactcatacaaagacagcaccctcatcatgcagttgcttagagacaacctaacactttggacatcagacagtgcaggagaagaatgtgatgcggcagaaggggctgaaaactaaatccatacagggtgtcatccttctttccttcaagaaacctttttacacatctccattccttattccacttggatttcctatagcaaagaaacccattcatgtgtatggaatcaactgtttatagtcttttcacactgcagctttgggaaaacttcattccttgatttgtgtttgtcttggccttcctggtgtgcagtactgctgtagaaaagtattaatagcttcatttcatataaacataagtaactcccaaacacttatgtagaggactaaaaatgtatctggtatttaagtaatctgaaccagttctgcaagtgactgtgttttgtattactgtgaaaataagaaaatgtagttaattacaatttaaagagtattccacataacttcttaatttctacattccctcccttactcttcgggggtttcctttcagtaagcaacttttccatgctcttaatgtattcctttttagtaggaatccggaagtattagattgaatggaaaagcacttgccatctctgtctaggggtcacaaattgaaatggctcctgtatcacatacggaggtcttgtgtatctgtggcaacagggagtttccttattcactctttatttgctgctgtttaagttgccaacctcccctcccaataaaaattcacttacacctcctgcctttgtagttctggtattcactttactatgtgatagaagtagcatgttgctgccagaatacaagcattgcttttggcaaattaaagtgcatgtcatttcttaatacactagaaaggggaaataaattaaagtacacaagtccaagtctaaaactttagtacttttccatgcagatttgtgcacatgtgagagggtgtccagtttgtctagtgattgttatttagagagttggaccactattgtgtgttgctaatcattgactgtagtcccaaaaaagccttgtgaaaatgttatgccctatgtaacagcagagtaacataaaataaaagtacattttataaacccatttactatggctttgtaacaattgcatacccatattttaagggacaggtgaatttactactttctaaagtttattgatacttcccttttatgtaaaatgtagtagtgatacctatatttccacattgtgcattgtgacacacttgtctagggatgcctggaagtgtataaaattggactgcatttcttagagtgttttactatagatcagtctcatgggccatctcttcctcagatgtaaatgatatctggttaagtgttatatggaataaagtggacattttaaaacta

SEQ ID NO: 330450 - DNA, 1658 bp, Homo sapiens
cggacgcgtgggtcgacccacgcgtccgaaacgatagataattcccaaggagcttaccaagaggcatttgatataagcaagaaagagatgcaacccacacacccaatccgcctggggcttgctcttaacttttctgtattttactatgagattcttaataacccagagcttgcctgcacgctggctaaaacggcttttgatgaggccattgctgaacttgatacactgaatgaagactcatacaaagacagcaccctcatcatgcagttgcttagagacaacctaacactttggacatcagacagtgcaggagaagaatgtgatgcggcagaaggggctgaaaactaaatccatacagggtgtcatccttctttccttcaagaaacctttttacacatctccattccttattccacttggatttcctatagcaaagaaacccattcatgtgtatggaatcaactgtttatagtcttttcacactgcagctttgggaaaacttcattccttgatttgtgtttgtcttggccttcctggtgtgcagtactgctgtagaaaagtattaatagcttcatttcatataaacataagtaactcccaaacacttatgtagaggactaaaaatgtatctggtatttaagtaatctgaaccagttctgcaagtgactgtgttttgtattactgtgaaaataagaaaatgtagttaattacaatttaaagagtattccacataacttcttaatttctacattccctcccttactcttcgggggtttcctttcagtaagcaacttttccatgctcttaatgtattcctttttagtaggaatccggaagtattagattgaatggaaaagcacttgccatctctgtctaggggtcacaaattgaaatggctcctgtatcacatacggaggtcttgtgtatctgtggcaacagggagtttccttattcactctttatttgctgctgtttaagttgccaacctcccctcccaataaaaattcacttacacctcctgcctttgtagttctggtattcactttactatgtgatagaagtagcatgttgctgccagaatacaagcattgcttttggcaaattaaagtgcatgtcatttcttaatacactagaaaggggaaataaattaaagtacacaagtccaagtctaaaactttagtacttttccatgcagatttgtgcacatgtgagagggtgtccagtttgtctagtgattgttatttagagagttggaccactattgtgtgttgctaatcattgactgtagtcccaaaaaagccttgtgaaaatgttatgccctatgtaacagcagagtaacataaaataaaagtacattttataaacccatttactatggctttgtaacaattgcatacccatattttaagggacaggtgaatttactactttctaaagtttattgatacttcccttttatgtaaaatgtagtagtgatacctatatttccacattgtgcattgtgacacacttgtctagggatgcctggaagtgtataaaattggactgcatttcttagagtgttttactatagatcagtctcatgggccatctcttcctcagatgtaaatgatatctggttaagtgttatatggaataaagtggacattttaaaacta

SEQ ID NO: 330451 - DNA, 1796 bp, Homo sapiens
ctggccacgataatgttttttgttagctaccatgattttaaaagacccatacagagaaaaaatcttggttctaccaagagctagtagcatatgttcaagttgttaatgtactgtgtactggatggttatttttaatattgcacttcttatttttcgctcttcacagaaacgatagataattcccaaggagcttaccaagaggcatttgatataagcaagaaagagatgcaacccacacacccaatccgcctggggcttgctcttaacttttctgtattttactatgagattcttaataacccagagcttgcctgcacgctggctaaaacggcttttgatgaggccattgctgaacttgatacactgaatgaagactcatacaaagacagcaccctcatcatgcagttgcttagagacaacctaacactttggacatcagacagtgcaggagaagaatgtgatgcggcagaaggggctgaaaactaaatccatacagggtgtcatccttctttccttcaagaaacctttttacacatctccattccttattccacttggatttcctatagcaaagaaacccattcatgtgtatggaatcaactgtttatagtcttttcacactgcagctttgggaaaacttcattccttgatttgtgtttgtcttggccttcctggtgtgcagtactgctgtagaaaagtattaatagcttcatttcatataaacataagtaactcccaaacacttatgtagaggactaaaaatgtatctggtatttaagtaatctgaaccagttctgcaagtgactgtgttttgtattactgtgaaaataagaaaatgtagttaattacaatttaaagagtattccacataacttcttaatttctacattccctcccttactcttcgggggtttcctttcagtaagcaacttttccatgctcttaatgtattcctttttagtaggaatccggaagtattagattgaatggaaaagcacttgccatctctgtctaggggtcacaaattgaaatggctcctgtatcacatacggaggtcttgtgtatctgtggcaacagggagtttccttattcactctttatttgctgctgtttaagttgccaacctcccctcccaataaaaattcacttacacctcctgcctttgtagttctggtattcactttactatgtgatagaagtagcatgttgctgccagaatacaagcattgcttttggcaaattaaagtgcatgtcatttcttaatacactagaaaggggaaataaattaaagtacacaagtccaagtctaaaactttagtacttttccatgcagatttgtgcacatgtgagagggtgtccagtttgtctagtgattgttatttagagagttggaccactattgtgtgttgctaatcattgactgtagtcccaaaaaagccttgtgaaaatgttatgccctatgtaacagcagagtaacataaaataaaagtacattttataaacccatttactatggctttgtaacaattgcatacccatattttaagggacaggtgaatttactactttctaaagtttattgatacttcccttttatgtaaaatgtagtagtgatacctatatttccacattgtgcattgtgacacacttgtctagggatgcctggaagtgtataaaattggactgcatttcttagagtgttttactatagatcagtctcatgggccatctcttcctcagatgtaaatgatatctggttaagtgttatatggaataaagtggacattttaaaacta

SEQ ID NO: 330452 - DNA, 1601 bp, Homo sapiens
ttggctgggtgtcgctgtgcacatggatgcccgacaaaggctggtccatgtccgcggtcgggaggtcgaaaattttctgtattttactatgagattcttaataacccagagcttgcctgcacgctggctaaaacggcttttgatgaggccattgctgaacttgatacactgaatgaagactcatacaaagacagcaccctcatcatgcagttgcttagagacaacctaacactttggacatcagacagtgcaggagaagaatgtgatgcggcagaaggggctgaaaactaaatccatacagggtgtcatccttctttccttcaagaaacctttttacacatctccattccttattccacttggatttcctatagcaaagaaacccattcatgtgtatggaatcaactgtttatagtcttttcacactgcagctttgggaaaacttcattccttgatttgtgtttgtcttggccttcctggtgtgcagtactgctgtagaaaagtattaatagcttcatttcatataaacataagtaactcccaaacacttatgtagaggactaaaaatgtatctggtatttaagtaatctgaaccagttctgcaagtgactgtgttttgtattactgtgaaaataagaaaatgtagttaattacaatttaaagagtattccacataacttcttaatttctacattccctcccttactcttcgggggtttcctttcagtaagcaacttttccatgctcttaatgtattcctttttagtaggaatccggaagtattagattgaatggaaaagcacttgccatctctgtctaggggtcacaaattgaaatggctcctgtatcacatacggaggtcttgtgtatctgtggcaacagggagtttccttattcactctttatttgctgctgtttaagttgccaacctcccctcccaataaaaattcacttacacctcctgcctttgtagttctggtattcactttactatgtgatagaagtagcatgttgctgccagaatacaagcattgcttttggcaaattaaagtgcatgtcatttcttaatacactagaaaggggaaataaattaaagtacacaagtccaagtctaaaactttagtacttttccatgcagatttgtgcacatgtgagagggtgtccagtttgtctagtgattgttatttagagagttggaccactattgtgtgttgctaatcattgactgtagtcccaaaaaagccttgtgaaaatgttatgccctatgtaacagcagagtaacataaaataaaagtacattttataaacccatttactatggctttgtaacaattgcatacccatattttaagggacaggtgaatttactactttctaaagtttattgatacttcccttttatgtaaaatgtagtagtgatacctatatttccacattgtgcattgtgacacacttgtctagggatgcctggaagtgtataaaattggactgcatttcttagagtgttttactatagatcagtctcatgggccatctcttcctcagatgtaaatgatatctggttaagtgttatatggaataaagtggacattttaaaacta

SEQ ID NO: 330453 - DNA, 1581 bp, Homo sapiens
acataagtaccctagatccagcatggaatctggcgctatcagagctcgagtatgtaattatggatcatactctagtaacctcgatgatgcatatgcctgcacgctggctaaaacggcttttgatgaggccattgctgaacttgatacactgaatgaagactcatacaaagacagcaccctcatcatgcagttgcttagagacaacctaacactttggacatcagacagtgcaggagaagaatgtgatgcggcagaaggggctgaaaactaaatccatacagggtgtcatccttctttccttcaagaaacctttttacacatctccattccttattccacttggatttcctatagcaaagaaacccattcatgtgtatggaatcaactgtttatagtcttttcacactgcagctttgggaaaacttcattccttgatttgtgtttgtcttggccttcctggtgtgcagtactgctgtagaaaagtattaatagcttcatttcatataaacataagtaactcccaaacacttatgtagaggactaaaaatgtatctggtatttaagtaatctgaaccagttctgcaagtgactgtgttttgtattactgtgaaaataagaaaatgtagttaattacaatttaaagagtattccacataacttcttaatttctacattccctcccttactcttcgggggtttcctttcagtaagcaacttttccatgctcttaatgtattcctttttagtaggaatccggaagtattagattgaatggaaaagcacttgccatctctgtctaggggtcacaaattgaaatggctcctgtatcacatacggaggtcttgtgtatctgtggcaacagggagtttccttattcactctttatttgctgctgtttaagttgccaacctcccctcccaataaaaattcacttacacctcctgcctttgtagttctggtattcactttactatgtgatagaagtagcatgttgctgccagaatacaagcattgcttttggcaaattaaagtgcatgtcatttcttaatacactagaaaggggaaataaattaaagtacacaagtccaagtctaaaactttagtacttttccatgcagatttgtgcacatgtgagagggtgtccagtttgtctagtgattgttatttagagagttggaccactattgtgtgttgctaatcattgactgtagtcccaaaaaagccttgtgaaaatgttatgccctatgtaacagcagagtaacataaaataaaagtacattttataaacccatttactatggctttgtaacaattgcatacccatattttaagggacaggtgaatttactactttctaaagtttattgatacttcccttttatgtaaaatgtagtagtgatacctatatttccacattgtgcattgtgacacacttgtctagggatgcctggaagtgtataaaattggactgcatttcttagagtgttttactatagatcagtctcatgggccatctcttcctcagatgtaaatgatatctggttaagtgttatatggaataaagtggacattttaaaacta

SEQ ID NO: 330454 - DNA, 1494 bp, Homo sapiens
cggacgcgtgggtcgacccacgcgtccggcttttgatgaggccattgctgaacttgatacactgaatgaagactcatacaaagacagcaccctcatcatgcagttgcttagagacaacctaacactttggacatcagacagtgcaggagaagaatgtgatgcggcagaaggggctgaaaactaaatccatacagggtgtcatccttctttccttcaagaaacctttttacacatctccattccttattccacttggatttcctatagcaaagaaacccattcatgtgtatggaatcaactgtttatagtcttttcacactgcagctttgggaaaacttcattccttgatttgtgtttgtcttggccttcctggtgtgcagtactgctgtagaaaagtattaatagcttcatttcatataaacataagtaactcccaaacacttatgtagaggactaaaaatgtatctggtatttaagtaatctgaaccagttctgcaagtgactgtgttttgtattactgtgaaaataagaaaatgtagttaattacaatttaaagagtattccacataacttcttaatttctacattccctcccttactcttcgggggtttcctttcagtaagcaacttttccatgctcttaatgtattcctttttagtaggaatccggaagtattagattgaatggaaaagcacttgccatctctgtctaggggtcacaaattgaaatggctcctgtatcacatacggaggtcttgtgtatctgtggcaacagggagtttccttattcactctttatttgctgctgtttaagttgccaacctcccctcccaataaaaattcacttacacctcctgcctttgtagttctggtattcactttactatgtgatagaagtagcatgttgctgccagaatacaagcattgcttttggcaaattaaagtgcatgtcatttcttaatacactagaaaggggaaataaattaaagtacacaagtccaagtctaaaactttagtacttttccatgcagatttgtgcacatgtgagagggtgtccagtttgtctagtgattgttatttagagagttggaccactattgtgtgttgctaatcattgactgtagtcccaaaaaagccttgtgaaaatgttatgccctatgtaacagcagagtaacataaaataaaagtacattttataaacccatttactatggctttgtaacaattgcatacccatattttaagggacaggtgaatttactactttctaaagtttattgatacttcccttttatgtaaaatgtagtagtgatacctatatttccacattgtgcattgtgacacacttgtctagggatgcctggaagtgtataaaattggactgcatttcttagagtgttttactatagatcagtctcatgggccatctcttcctcagatgtaaatgatatctggttaagtgttatatggaataaagtggacattttaaaacta

SEQ ID NO: 330455 - DNA, 1840 bp, Homo sapiens
tgcctgccaggtttggttactagaatagctgtgcatcagccacattcctcaaagtggctcaaaacgagagaataaagaggaccctgtagagataagtactacttaactggaaagaagtctgttaagcattgctgctgttccgttgtcctgtgaaagaaccaagacatgcttgtttactaagtgtatagttttataaaattccagtcatactcataagttcttaaactgggagtgtgagagaatggttctgttgagtttgttgatggtagaacataaggtgggtgttcacttattttgtaaaaatggtttgtaattgtagaataaccagttttcgtcaatgcacatattttaccatggatattaatatttatcaggcttttgatgaggccattgctgaacttgatacactgaatgaagactcatacaaagacagcaccctcatcatgcagttgcttagagacaacctaacactttggacatcagacagtgcaggagaagaatgtgatgcggcagaaggggctgaaaactaaatccatacagggtgtcatccttctttccttcaagaaacctttttacacatctccattccttattccacttggatttcctatagcaaagaaacccattcatgtgtatggaatcaactgtttatagtcttttcacactgcagctttgggaaaacttcattccttgatttgtgtttgtcttggccttcctggtgtgcagtactgctgtagaaaagtattaatagcttcatttcatataaacataagtaactcccaaacacttatgtagaggactaaaaatgtatctggtatttaagtaatctgaaccagttctgcaagtgactgtgttttgtattactgtgaaaataagaaaatgtagttaattacaatttaaagagtattccacataacttcttaatttctacattccctcccttactcttcgggggtttcctttcagtaagcaacttttccatgctcttaatgtattcctttttagtaggaatccggaagtattagattgaatggaaaagcacttgccatctctgtctaggggtcacaaattgaaatggctcctgtatcacatacggaggtcttgtgtatctgtggcaacagggagtttccttattcactctttatttgctgctgtttaagttgccaacctcccctcccaataaaaattcacttacacctcctgcctttgtagttctggtattcactttactatgtgatagaagtagcatgttgctgccagaatacaagcattgcttttggcaaattaaagtgcatgtcatttcttaatacactagaaaggggaaataaattaaagtacacaagtccaagtctaaaactttagtacttttccatgcagatttgtgcacatgtgagagggtgtccagtttgtctagtgattgttatttagagagttggaccactattgtgtgttgctaatcattgactgtagtcccaaaaaagccttgtgaaaatgttatgccctatgtaacagcagagtaacataaaataaaagtacattttataaacccatttactatggctttgtaacaattgcatacccatattttaagggacaggtgaatttactactttctaaagtttattgatacttcccttttatgtaaaatgtagtagtgatacctatatttccacattgtgcattgtgacacacttgtctagggatgcctggaagtgtataaaattggactgcatttcttagagtgttttactatagatcagtctcatgggccatctcttcctcagatgtaaatgatatctggttaagtgttatatggaataaagtggacattttaaaacta

SEQ ID NO: 330456 - DNA, 1442 bp, Homo sapiens
  misc_feature (41)..(42): n is a, c, g, or t
  misc_feature (49)..(49): n is a, c, g, or t
  misc_feature (51)..(52): n is a, c, g, or t
  misc_feature (54)..(54): n is a, c, g, or t
cggacgcgtgggtcgacccacgcgtccgtcgacccacgcgnnccggacncnngngtcgacccacgcgtccgcctttggacatcagacagtgcaggagaagaatgtgatgcggcagaaggggctgaaaactaaatccatacagggtgtcatccttctttccttcaagaaacctttttacacatctccattccttattccacttggatttcctatagcaaagaaacccattcatgtgtatggaatcaactgtttatagtcttttcacactgcagctttgggaaaacttcattccttgatttgtgtttgtcttggccttcctggtgtgcagtactgctgtagaaaagtattaatagcttcatttcatataaacataagtaactcccaaacacttatgtagaggactaaaaatgtatctggtatttaagtaatctgaaccagttctgcaagtgactgtgttttgtattactgtgaaaataagaaaatgtagttaattacaatttaaagagtattccacataacttcttaatttctacattccctcccttactcttcgggggtttcctttcagtaagcaacttttccatgctcttaatgtattcctttttagtaggaatccggaagtattagattgaatggaaaagcacttgccatctctgtctaggggtcacaaattgaaatggctcctgtatcacatacggaggtcttgtgtatctgtggcaacagggagtttccttattcactctttatttgctgctgtttaagttgccaacctcccctcccaataaaaattcacttacacctcctgcctttgtagttctggtattcactttactatgtgatagaagtagcatgttgctgccagaatacaagcattgcttttggcaaattaaagtgcatgtcatttcttaatacactagaaaggggaaataaattaaagtacacaagtccaagtctaaaactttagtacttttccatgcagatttgtgcacatgtgagagggtgtccagtttgtctagtgattgttatttagagagttggaccactattgtgtgttgctaatcattgactgtagtcccaaaaaagccttgtgaaaatgttatgccctatgtaacagcagagtaacataaaataaaagtacattttataaacccatttactatggctttgtaacaattgcatacccatattttaagggacaggtgaatttactactttctaaagtttattgatacttcccttttatgtaaaatgtagtagtgatacctatatttccacattgtgcattgtgacacacttgtctagggatgcctggaagtgtataaaattggactgcatttcttagagtgttttactatagatcagtctcatgggccatctcttcctcagatgtaaatgatatctggttaagtgttatatggaataaagtggacattttaaaacta

SEQ ID NO: 330457 - DNA, 1338 bp, Homo sapiens
  misc_feature (41)..(42): n is a, c, g, or t
  misc_feature (49)..(49): n is a, c, g, or t
  misc_feature (51)..(52): n is a, c, g, or t
  misc_feature (54)..(54): n is a, c, g, or t
cggacgcgtgggtcgacccacgcgtccgtcgacccacgcgnnccggacncnngngtcgacccacgcgtccgcacacatctccattccttattccacttggatttcctatagcaaagaaacccattcatgtgtatggaatcaactgtttatagtcttttcacactgcagctttgggaaaacttcattccttgatttgtgtttgtcttggccttcctggtgtgcagtactgctgtagaaaagtattaatagcttcatttcatataaacataagtaactcccaaacacttatgtagaggactaaaaatgtatctggtatttaagtaatctgaaccagttctgcaagtgactgtgttttgtattactgtgaaaataagaaaatgtagttaattacaatttaaagagtattccacataacttcttaatttctacattccctcccttactcttcgggggtttcctttcagtaagcaacttttccatgctcttaatgtattcctttttagtaggaatccggaagtattagattgaatggaaaagcacttgccatctctgtctaggggtcacaaattgaaatggctcctgtatcacatacggaggtcttgtgtatctgtggcaacagggagtttccttattcactctttatttgctgctgtttaagttgccaacctcccctcccaataaaaattcacttacacctcctgcctttgtagttctggtattcactttactatgtgatagaagtagcatgttgctgccagaatacaagcattgcttttggcaaattaaagtgcatgtcatttcttaatacactagaaaggggaaataaattaaagtacacaagtccaagtctaaaactttagtacttttccatgcagatttgtgcacatgtgagagggtgtccagtttgtctagtgattgttatttagagagttggaccactattgtgtgttgctaatcattgactgtagtcccaaaaaagccttgtgaaaatgttatgccctatgtaacagcagagtaacataaaataaaagtacattttataaacccatttactatggctttgtaacaattgcatacccatattttaagggacaggtgaatttactactttctaaagtttattgatacttcccttttatgtaaaatgtagtagtgatacctatatttccacattgtgcattgtgacacacttgtctagggatgcctggaagtgtataaaattggactgcatttcttagagtgttttactatagatcagtctcatgggccatctcttcctcagatgtaaatgatatctggttaagtgttatatggaataaagtggacattttaaaacta

SEQ ID NO: 330458 - DNA, 1511 bp, Homo sapiens
  misc_feature (55)..(55): n is a, c, g, or t
  misc_feature (57)..(57): n is a, c, g, or t
  misc_feature (257)..(257): n is a, c, g, or t
tgaaaaggctatcttagtacacattccagtgttggccgtccgacggcgagtccangntagcgttaagatgaaacactcgtgatcaatatgtctggtatctactcctagagcagattgccatggatcaatgactatgtgcgcttggattctcgagcgcatgtaaaaatacgcccgtagaggagagtcgtagcgcttctgaacatattccaaatgcgagttcatgacgagtctctcattgcgtatctattcaactcagngatttccacatatcagagactacgaatatcaaattcatcgtcgccctgggactgacaactgtttatagtcttttcacactgcagctttgggaaaacttcattccttgatttgtgtttgtcttggccttcctggtgtgcagtactgctgtagaaaagtattaatagcttcatttcatataaacataagtaactcccaaacacttatgtagaggactaaaaatgtatctggtatttaagtaatctgaaccagttctgcaagtgactgtgttttgtattactgtgaaaataagaaaatgtagttaattacaatttaaagagtattccacataacttcttaatttctacattccctcccttactcttcgggggtttcctttcagtaagcaacttttccatgctcttaatgtattcctttttagtaggaatccggaagtattagattgaatggaaaagcacttgccatctctgtctaggggtcacaaattgaaatggctcctgtatcacatacggaggtcttgtgtatctgtggcaacagggagtttccttattcactctttatttgctgctgtttaagttgccaacctcccctcccaataaaaattcacttacacctcctgcctttgtagttctggtattcactttactatgtgatagaagtagcatgttgctgccagaatacaagcattgcttttggcaaattaaagtgcatgtcatttcttaatacactagaaaggggaaataaattaaagtacacaagtccaagtctaaaactttagtacttttccatgcagatttgtgcacatgtgagagggtgtccagtttgtctagtgattgttatttagagagttggaccactattgtgtgttgctaatcattgactgtagtcccaaaaaagccttgtgaaaatgttatgccctatgtaacagcagagtaacataaaataaaagtacattttataaacccatttactatggctttgtaacaattgcatacccatattttaagggacaggtgaatttactactttctaaagtttattgatacttcccttttatgtaaaatgtagtagtgatacctatatttccacattgtgcattgtgacacacttgtctagggatgcctggaagtgtataaaattggactgcatttcttagagtgttttactatagatcagtctcatgggccatctcttcctcagatgtaaatgatatctggttaagtgttatatggaataaagtggacattttaaaacta

SEQ ID NO: 330459 - DNA, 1181 bp, Homo sapiens
cgcactgcagctatgagaaaacttcaatcaatcgttcatgattgtggtgatgggccctccgtgcagtacatgctgtaaacccacagcaggagcttcatttcatataaacataagtaactcccaaacacttatgtagaggactaaaaatgtatctggtatttaagtaatctgaaccagttctgcaagtgactgtgttttgtattactgtgaaaataagaaaatgtagttaattacaatttaaagagtattccacataacttcttaatttctacattccctcccttactcttcgggggtttcctttcagtaagcaacttttccatgctcttaatgtattcctttttagtaggaatccggaagtattagattgaatggaaaagcacttgccatctctgtctaggggtcacaaattgaaatggctcctgtatcacatacggaggtcttgtgtatctgtggcaacagggagtttccttattcactctttatttgctgctgtttaagttgccaacctcccctcccaataaaaattcacttacacctcctgcctttgtagttctggtattcactttactatgtgatagaagtagcatgttgctgccagaatacaagcattgcttttggcaaattaaagtgcatgtcatttcttaatacactagaaaggggaaataaattaaagtacacaagtccaagtctaaaactttagtacttttccatgcagatttgtgcacatgtgagagggtgtccagtttgtctagtgattgttatttagagagttggaccactattgtgtgttgctaatcattgactgtagtcccaaaaaagccttgtgaaaatgttatgccctatgtaacagcagagtaacataaaataaaagtacattttataaacccatttactatggctttgtaacaattgcatacccatattttaagggacaggtgaatttactactttctaaagtttattgatacttcccttttatgtaaaatgtagtagtgatacctatatttccacattgtgcattgtgacacacttgtctagggatgcctggaagtgtataaaattggactgcatttcttagagtgttttactatagatcagtctcatgggccatctcttcctcagatgtaaatgatatctggttaagtgttatatggaataaagtggacattttaaaacta

SEQ ID NO: 330460 - DNA, 1337 bp, Homo sapiens
attgggcggtggaccgcccctcggccccggggtaggctgacacgggagggtcctcagctaaagccaaaagcagatcaaagtggtgggactcgcgtcgcggccgcggagacgtgaagctctcgaggctcctcccgctgcgggtcggcgctcgccctcgctctcctcgccctccgccccggccccggccccgcgcccgccatggagaagactgagctgatccagaaggccaagctggccgagcaggccgagcgctacgacgacatggccacctgcatgaaggcagtgaccgagcagggcgccgagctgtccaacgaggagcgcaacctgctctccgtggcctacaagaacgtggtcgggggccgcaggtccgcctggagggtcatctctagcatcgagcagaagaccgacacctccgacaagaagttgcagctgattaaggactatcgggagaaagtggagtccgagctgagatccatctgcaccacggtgctggaattgttggataaatatttaatagccaatgcaactaatccagagagtaaggtcttctatctgaaaatgaagggtgattacttccggtaccttgctgaagttgcgtgtggtgatgatcgaaaacaaacgatagataattcccaaggagcttaccaagaggcatttgatataagcaagaaagagatgcaacccacacacccaatccgcctggggcttgctcttaacttttctgtattttactatgagattcttaataacccagagcttgcctgcacgctggctaaaacggcttttgatgaggccattgctgaacttgatacactgaatgaagactcatacaaagacagcaccctcatcatgcagttgcttagagacaacctaacactttggacatcagacagtgcaggagaagaatgtgatgcggcagaaggggctgaaaactaaatccatacagggtgtcatccttctttccttcaagaaacctttttcgtctctactaaaaatacaaaaattagccaggcatggtggcacacgcctatagtcccagctactcaggaggctgaggcaggagaatcacttgaacccaggaggcagaggttgcagtgagctgagatcacgtcattgcactccatcctgagccacaagagcaaaactccgtctcaaaaaaaaaaaaagaagaaggtggatctccaaccaggccagagaatcttctctgggcctgggttgggcagaagattctcacagaaggtttggaactctaagaaataaatgggttgggtaataaatggcttcgggtcagataaaaaaaaaaaaaaaaaaaaaaaaaaaaaaaaaaaaaaaaagaa

SEQ ID NO: 330461 - DNA, 1033 bp, Homo sapiens
attgggcggtggaccgcccctcggccccggggtaggctgacacgggagggtcctcagctaaagccaaaagcagatcaaagtggtgggactcgcgtcgcggccgcggagacgtgaagctctcgaggctcctcccgctgcgggtcggcgctcgccctcgctctcctcgccctccgccccggccccggccccgcgcccgccatggagaagactgagctgatccagaaggccaagctggccgagcaggccgagcgctacgacgacatggccacctgcatgaaggcagtgaccgagcagggcgccgagctgtccaacgaggagcgcaacctgctctccgtggcctacaagaacgtggtcgggggccgcaggtccgcctggagggtcatctctagcatcgagcagaagaccgacacctccgacaagaagttgcagctgattaaggactatcgggagaaagtggagtccgagctgagatccatctgcaccacggtgctggaattgttggataaatatttaatagccaatgcaactaatccagagagtaaggtcttctatctgaaaatgaagggtgattacttccggtaccttgctgaagttgcgtgtggtgatgatcgaaaacaaacgatagataattcccaaggagcttaccaagaggcatttgatataagcaagaaagagatgcaacccacacacccaatccgcctggggcttgctcttaacttttctgtattttactatgagattcttaataacccagagcttgcctgcacgctggctaaaacggcttttgatgaggccattgctgaacttgatacactgaatgaagactcatacaaagacagcaccctcatcatgcagttgcttagagacaacctaacagtgagttgtttactcttttaattttattttcttttcagaaacaaaagtatttatattttattttggacttcgtgtcttttagggaagatacatacgagctgaaagtatgagatacgtgttagtattttatgggacgaacattattttgtaggcaggt

SEQ ID NO: 330462 - DNA, 965 bp, Homo sapiens
  misc_feature (831)..(831): n is a, c, g, or t
  misc_feature (857)..(857): n is a, c, g, or t
attgggcggtggaccgcccctcggccccggggtaggctgacacgggagggtcctcagctaaagccaaaagcagatcaaagtggtgggactcgcgtcgcggccgcggagacgtgaagctctcgaggctcctcccgctgcgggtcggcgctcgccctcgctctcctcgccctccgccccggccccggccccgcgcccgccatggagaagactgagctgatccagaaggccaagctggccgagcaggccgagcgctacgacgacatggccacctgcatgaaggcagtgaccgagcagggcgccgagctgtccaacgaggagcgcaacctgctctccgtggcctacaagaacgtggtcgggggccgcaggtccgcctggagggtcatctctagcatcgagcagaagaccgacacctccgacaagaagttgcagctgattaaggactatcgggagaaagtggagtccgagctgagatccatctgcaccacggtgctggaattgttggataaatatttaatagccaatgcaactaatccagagagtaaggtcttctatctgaaaatgaagggtgattacttccggtaccttgctgaagttgcgtgtggtgatgatcgaaaacaaacgatagataattcccaaggagcttaccaagaggcatttgatataagcaagaaagagatgcaacccacacacccaatccgcctggggcttgctcttaacttttctgtattttactatgagattcttaataacccagagcttgcctgcacgctggctaaaacggacagacctctcatgcagtgctagaacacctacattgcataacatcagaangatgtatgcgaagggtgactatcacngtgatcttttaactactcctctgttaacttgagagagtcgtgaatttgtcgtggcgagtactacacactgatgaaactgcttaaataagatatctggtaacagtagga

SEQ ID NO: 330463 - DNA, 848 bp, Homo sapiens
ctggaaggttctcaggtctttatttgctctctcaacttccaggaattgacttatttaattaatccatcaacctctcatagcaaatatttgagaaaacaaatttatattcagattcttattttcagtagggaagtaagaagttggagagagagagagagagagagaaagttgccaacctcccctcccaataaaaattcacttacacctcctgcctttgtagttctggtattcactttactatgtgatagaagtagcatgttgctgccagaatacaagcattgcttttggcaaattaaagtgcatgtcatttcttaatacactagaaaggggaaataaattaaagtacacaagtccaagtctaaaactttagtacttttccatgcagatttgtgcacatgtgagagggtgtccagtttgtctagtgattgttatttagagagttggaccactattgtgtgttgctaatcattgactgtagtcccaaaaaagccttgtgaaaatgttatgccctatgtaacagcagagtaacataaaataaaagtacattttataaacccatttactatggctttgtaacaattgcatacccatattttaagggacaggtgaatttactactttctaaagtttattgatacttcccttttatgtaaaatgtagtagtgatacctatatttccacattgtgcattgtgacacacttgtctagggatgcctggaagtgtataaaattggactgcatttcttagagtgttttactatagatcagtctcatgggccatctcttcctcagatgtaaatgatatctggttaagtgttatatggaataaagtggacattttaaaacta

SEQ ID NO: 330464 - DNA, 673 bp, Homo sapiens
attgggcggtggaccgcccctcggccccggggtaggctgacacgggagggtcctcagctaaagccaaaagcagatcaaagtggtgggactcgcgtcgcggccgcggagacgtgaagctctcgaggctcctcccgctgcgggtcggcgctcgccctcgctctcctcgccctccgccccggccccggccccgcgcccgccatggagaagactgagctgatccagaaggccaagctggccgagcaggccgagcgctacgacgacatggccacctgcatgaaggcagtgaccgagcagggcgccgagctgtccaacgaggagcgcaacctgctctccgtggcctacaagaacgtggtcgggggccgcaggtccgcctggagggtcatctctagcatcgagcagaagaccgacacctccgacaagaagttgcagctgattaaggactatcgggagaaagtggagtccgagctgagatccatctgcaccacggtgctggaattgttggataaatatttaatagccaatgcaactaatccagagagtaaggtcttctatctgaaaatgaagggtgattacttccggtaccttgctgaagttgcgtgtggtgatgatcgaaaaccgtaagtttatttgttatatgggcaaaagtagaatataaaaaaaagaaatggggata

SEQ ID NO: 330465 - DNA, 1298 bp, Homo sapiens
ctgttgctgtgtgtgcttgtttggtcgtgctgctgtctcttgtcgcgttcttttcctttgtcttttttgcggtgtcttttttttgttcttttttgttttgctgtggctgttaggtgtgtcgtctggtcttgtttcgcgtgtctcgcgactgctgtccatggcgttctctgttctgtcttttctgtgcttgtgtgttttggttcggtgtgtctgttgtgtatctggtttgttggtgggtgttgtagtctcgttcctgccgttcgttcgcttagccgttcgcgtctcagtgctgttcttgttgctttcgatgtccgcgtgtgctccgtgtcctatttctgctctcttgtgtagtctgccgtccttgtttgtcctcttgttctgtttttgttgggtgtttgctcgtgttgtgttcttttttgttgtggttttgcctgctgctgtctgtctttgcttgtttgtttttttttttctgcttgtgttttgttgtgtttagtagtatggtacgtgttatgttgtagtgttacttcttgctggtgtacattagggcgatcaccgttttcaaccaagggcttttttgtgggatctcctagtcaatgatttagctactacacgatagtggtccaactctctgtatacactatcaactagtctaactggacaccctctcacatgtgcacaaatctgtctatggataagtactaaagttttagacttggacttgtgtactttaatgtatttcccctttctagtgtattaagaaatgtacatgccactttaaatttgccataagcgaatgcttgtattctggctagcaacatgctacttctatcacatagtaatgataccagatacaaaggcaggaggtgtaatgaattttattgggaggggagttggaccactattgtgtgttgctaatcattgactgtagtcccaaaaaagccttgtgaaaatgttatgccctatgtaacagcagagtaacataaaataaaagtacattttataaacccatttactatggctttgtaacaattgcatacccatattttaagggacaggtgaatttactactttctaaagtttattgatacttcccttttatgtaaaatgtagtagtgatacctatatttccacattgtgcattgtgacacacttgtctagggatgcctggaagtgtataaaattggactgcatttcttagagtgttttactatagatcagtctcatgggccatctcttcctcagatgtaaatgatatctggttaagtgttatatggaataaagtggacattttaaaacta

SEQ ID NO: 330466 - DNA, 728 bp, Homo sapiens
attgggcggtggaccgcccctcggccccggggtaggctgacacgggagggtcctcagctaaagccaaaagcagatcaaagtggtgggactcgcgtcgcggccgcggagacgtgaagctctcgaggctcctcccgctgcgggtcggcgctcgccctcgctctcctcgccctccgccccggccccggccccgcgcccgccatggagaagactgagctgatccagaaggccaagctggccgagcaggccgagcgctacgacgacatggccacctgcatgaaggcagtgaccgagcagggcgccgagctgtccaacgaggagcgcaacctgctctccgtggcctacaagaacgtggtcgggggccgcaggtccgcctggagggtcatctctagcatcgagcagaagaccgacacctccgacaagaagttgcagctgattaaggactatcgggagaaagtggagtccgagctgagatccatctgcaccacggtgctggcgatccggacaaaatcatggctgatggaaataactggtaaagaggcaaagaaagtaatgcagacagtgtgtactaaagtggagaaaacttaagattatttactttatgaagtcaaaacttcgttgtattcttccgtgtgctcttagcttccagtccctgcttggcattgaagaagcacttgtaaaagctttttggactgaattgctcgtattaaaaaattttgccaacttgaaag

SEQ ID NO: 330467 - DNA, 856 bp, Homo sapiens
  misc_feature (12)..(12): n is a, c, g, or t
  misc_feature (14)..(14): n is a, c, g, or t
  misc_feature (36)..(36): n is a, c, g, or t
  misc_feature (38)..(38): n is a, c, g, or t
  misc_feature (570)..(570): n is a, c, g, or t
  misc_feature (778)..(778): n is a, c, g, or t
  misc_feature (824)..(824): n is a, c, g, or t
aagggggaaggngnaagggagtgggggaagggggtnantttgtatttttggaaattcagaattgttggataaatatttaatagccaatgcaactaatccagagagtaaggtcttctatctgaaaatgaagggtgattacttccggtaccttgctgaagttgcgtgtggtgatgatcgaaaacaaacgatagataattcccaaggagcttaccaagaggcatttgatataagcaagaaagagatgcaacccacacacccaatccgcctggggcttgctcttaacttttctgtattttactatgagattcttaataacccagagcttgcctgcacgctggctaaaacgatgtgtctgctcggttgcattgctttatatgatgtcattgctgcaccttatccattgcctgtagactcctcttatcatttccctccctctcactcactcgctactgaaactctctatccccttgttcatttatcaaggtaggagagtaagtatgggcggagataatgagcgtaaaaactatattagccaaagtatatctaaggtataaactctagagagagctnagtcaaaactttgtgaggtatagggatcaacgagagtatctatttcttactatcgtctttgttgcatccgtcatcccactccgcccccccccctccccaccgtagccacgcggacaaatcgcaccggccccacgcccgcccctagcgtctccgccctcctctgcgtgcacccccagcaagactatatttcatgccccttctttccccnccccttctcttcctggcatcattcccgtcatacgtcatcgttgccntagctcacgtgcgacattctcactaaaatgat

SEQ ID NO: 330468 - DNA, 2530 bp, Homo sapiens
attgggcggtggaccgcccctcggccccggggtaggctgacacgggagggtcctcagctaaagccaaaagcagatcaaagtggtgggactcgcgtcgcggccgcggagacgtgaagctctcgaggctcctcccgctgcgggtcggcgctcgccctcgctctcctcgccctccgccccggccccggccccgcgcccgccatggagaagactgagctgatccagaaggccaagctggccgagcaggccgagcgctacgacgacatggccacctgcatgaaggcagtgaccgagcagggcgccgagctgtccaacgaggagcgcaacctgctctccgtggcctacaagaacgtggtcgggggccgcaggtccgcctggagggtcatctctagcatcgagcagaagaccgacacctccgacaagaagttgcagctgattaaggactatcgggagaaagtggagtccgagctgagatccatctgcaccacggtgctggaattgttggataaatatttaatagccaatgcaactaatccagagagtaaggtcttctatctgaaaatgaagggtgattacttccggtaccttgctgaagttgcgtgtggtgatgatcgaaaacaaacgatagataattcccaaggagcttaccaagaggcatttgatataagcaagaaagagatgcaacccacacacccaatccgcctggggcttgctcttaacttttctgtattttactatgagattcttaataacccagagcttgcctgcacgctggctaaaacggcttttgatgaggccattgctgaacttgatacactgaatgaagactcatacaaagacagcaccctcatcatgcagttgcttagagacaacctaacactttggacatcagacagtgcaggagaagaatgtgatgcggcagaaggggctgaaaactaaatccatacagggtgtcatccttctttccttcaagaaacctttttacacatctccattccttattccacttggatttcctatagcaaagaaacccattcatgtgtatggaatcaactgtttatagtcttttcacactgcagctttgggaaaacttcattccttgatttgtgtttgtcttggccttcctggtgtgcagtactgctgtagaaaagtattaatagcttcatttcatataaacataagtaactcccaaacacttatgtagaggactaaaaatgtatctggtatttaagtaatctgaaccagttctgcaagtgactgtgttttgtattactgtgaaaataagaaaatgtagttaattacaatttaaagagtattccacataacttcttaatttctacattccctcccttactcttcgggggtttcctttcagtaagcaacttttccatgctcttaatgtattcctttttagtaggaatccggaagtattagattgaatggaaaagcacttgccatctctgtctaggggtcacaaattgaaatggctcctgtatcacatacggaggtcttgtgtatctgtggcaacagggagtttccttattcactctttatttgctgctgtttaagttgccaacctcccctcccaataaaaattcacttacacctcctgcctttgtagttctggtattcactttactatgtgatagaagtagcatgttgctgccagaatacaagcattgcttttggcaaattaaagtgcatgtcatttcttaatacactagaaaggggaaataaattaaagtacacaagtccaagtctaaaactttagtacttttccatgcagatttgtgcacatgtgagagggtgtccagtttgtctagtgattgttatttagagagttggaccactattgtgtgttgctaatcattgactgtagtcccaaaaaagccttgtgaaaatgttatgccctatgtaacagcagagtaacataaaataaaagtacattttataaacccatttactatggctttgtaacaattgcatacccatattttaagggacaggtgaatttactactttctaaagtttattgatacttcccttttatgtaaaatgtagtagtgatacctatatttccacattgtgcattgtgacacacttgtctagggatgcctggaagtgtataaaattggactgcatttcttagagtgttttactatagatcagtctcatgggccatctcttcctcagatgtaaatgatatctggttaagtgttatatggaataaagtggacattttaaaactaaaaaaaaagaagcacagacacaacaagccacagatcaaacaccacgacacaacaacaaaataagcaaaaacaaacacacagaaaccgaaaacacaaagaaaaccacaacaaagcagcaggaagcggccagcagaaaaaccaagaaaagcgagagcacaaaaaacacaacaatcacggaccgccagacaccaccgacacacaataaacaggaaaggcgcgcaaacagacagcgcgaccacgacagaatcaggcacaacccgtcgggcacaacagcaccaaaaaaa

SEQ ID NO: 330469 - DNA, 2290 bp, Homo sapiens
attgggcggtggaccgcccctcggccccggggtaggctgacacgggagggtcctcagctaaagccaaaagcagatcaaagtggtgggactcgcgtcgcggccgcggagacgtgaagctctcgaggctcctcccgctgcgggtcggcgctcgccctcgctctcctcgccctccgccccggccccggccccgcgcccgccatggagaagactgagctgatccagaaggccaagctggccgagcaggccgagcgctacgacgacatggccacctgcatgaaggcagtgaccgagcagggcgccgagctgtccaacgaggagcgcaacctgctctccgtggcctacaagaacgtggtcgggggccgcaggtccgcctggagggtcatctctagcatcgagcagaagaccgacacctccgacaagaagttgcagctgattaaggactatcgggagaaagtggagtccgagctgagatccatctgcaccacggtgctggaattgttggataaatatttaatagccaatgcaactaatccagagagtaaggtcttctatctgaaaatgaagggtgattacttccggtaccttgctgaagttgcgtgtggtgatgatcgaaaacaaacgatagataattcccaaggagcttaccaagaggcatttgatataagcaagaaagagatgcaacccacacacccaatccgcctggggcttgctcttaacttttctgtattttactatgagattcttaataacccagagcttgcctgcacgctggctaaaacggcttttgatgaggccattgctgaacttgatacactgaatgaagactcatacaaagacagcaccctcatcatgcagttgcttagagacaacctaacactttggacatcagacagtgcaggagaagaatgtgatgcggcagaaggggctgaaaactaaatccatacagggtgtcatccttctttccttcaagaaacctttttacacatctccattccttattccacttggatttcctatagcaaagaaacccattcatgtgtatggaatcaactgtttatagtcttttcacactgcagctttgggaaaacttcattccttgatttgtgtttgtcttggccttcctggtgtgcagtactgctgtagaaaagtattaatagcttcatttcatataaacataagtaactcccaaacacttatgtagaggactaaaaatgtatctggtatttaagtaatctgaaccagttctgcaagtgactgtgttttgtattactgtgaaaataagaaaatgtagttaattacaatttaaagagtattccacataacttcttaatttctacattccctcccttactcttcgggggtttcctttcagtaagcaacttttccatgctcttaatgtattcctttttagtaggaatccggaagtattagattgaatggaaaagcacttgccatctctgtctaggggtcacaaattgaaatggctcctgtatcacatacggaggtcttgtgtatctgtggcaacagggagtttccttattcactctttatttgctgctgtttaagttgccaacctcccctcccaataaaaattcacttacacctcctgcctttgtagttctggtattcactttactatgtgatagaagtagcatgttgctgccagaatacaagcattgcttttggcaaattaaagtgcatgtcatttcttaatacactagaaaggggaaataaattaaagtacacaagtccaagtctaaaactttagtacttttccatgcagatttgtgcacatgtgagagggtgtccagtttgtctagtgattgttatttagagagttggaccactattgtgtgttgctaatcattgactgtagtcccaaaaaagccttgtgaaaatgttatgccctatgtaacagcagagtaacataaaataaaagtacattttataaacccatttactatggctttgtaacaattgcatacccatattttaagggacaggtgaatttactactttctaaagtttattgatacttcccttttatgtaaaatgtagtagtgatacctatatttccacattgtgcattgtgacacacttgtctagggatgcctggaagtgtataaaattggactgcatttcttagagtgttttactatagatcagtctcatgggccatctcttcctcagatgtaaatgatatctggttaagtgttatatggaataaagtggacattttaaaactaaaaaaaaaaaaaaaaaaaaaaaaaaaaaaaaaaaaaaaaaagaa

SEQ ID NO: 330470 - DNA, 2359 bp, Homo sapiens
ggcgggagcggccgcggctcgggctccctgcgcgcggggcctccgcgccgcccccgcctcctccagccgcgggccgcggcctccccgggtgcccagcgggggagggggcgggggagagggaaattcaagcggccgcgtgtgcgggagacaaaagcgggcggcgggccgcattgtctgacggcgctccctctctgctttttgttctcgcctcgccgccccgcccctccgcctctcgaggctcctcccgctgcgggtcggcgctcgccctcgctctcctcgccctccgccccggccccggccccgcgcccgccatggagaagactgagctgatccagaaggccaagctggccgagcaggccgagcgctacgacgacatggccacctgcatgaaggcagtgaccgagcagggcgccgagctgtccaacgaggagcgcaacctgctctccgtggcctacaagaacgtggtcgggggccgcaggtccgcctggagggtcatctctagcatcgagcagaagaccgacacctccgacaagaagttgcagctgattaaggactatcgggagaaagtggagtccgagctgagatccatctgcaccacggtgctggaattgttggataaatatttaatagccaatgcaactaatccagagagtaaggtcttctatctgaaaatgaagggtgattacttccggtaccttgctgaagttgcgtgtggtgatgatcgaaaacaaacgatagataattcccaaggagcttaccaagaggcatttgatataagcaagaaagagatgcaacccacacacccaatccgcctggggcttgctcttaacttttctgtattttactatgagattcttaataacccagagcttgcctgcacgctggctaaaacggcttttgatgaggccattgctgaacttgatacactgaatgaagactcatacaaagacagcaccctcatcatgcagttgcttagagacaacctaacactttggacatcagacagtgcaggagaagaatgtgatgcggcagaaggggctgaaaactaaatccatacagggtgtcatccttctttccttcaagaaacctttttacacatctccattccttattccacttggatttcctatagcaaagaaacccattcatgtgtatggaatcaactgtttatagtcttttcacactgcagctttgggaaaacttcattccttgatttgtgtttgtcttggccttcctggtgtgcagtactgctgtagaaaagtattaatagcttcatttcatataaacataagtaactcccaaacacttatgtagaggactaaaaatgtatctggtatttaagtaatctgaaccagttctgcaagtgactgtgttttgtattactgtgaaaataagaaaatgtagttaattacaatttaaagagtattccacataacttcttaatttctacattccctcccttactcttcgggggtttcctttcagtaagcaacttttccatgctcttaatgtattcctttttagtaggaatccggaagtattagattgaatggaaaagcacttgccatctctgtctaggggtcacaaattgaaatggctcctgtatcacatacggaggtcttgtgtatctgtggcaacagggagtttccttattcactctttatttgctgctgtttaagttgccaacctcccctcccaataaaaattcacttacacctcctgcctttgtagttctggtattcactttactatgtgatagaagtagcatgttgctgccagaatacaagcattgcttttggcaaattaaagtgcatgtcatttcttaatacactagaaaggggaaataaattaaagtacacaagtccaagtctaaaactttagtacttttccatgcagatttgtgcacatgtgagagggtgtccagtttgtctagtgattgttatttagagagttggaccactattgtgtgttgctaatcattgactgtagtcccaaaaaagccttgtgaaaatgttatgccctatgtaacagcagagtaacataaaataaaagtacattttataaacccatttactatggctttgtaacaattgcatacccatattttaagggacaggtgaatttactactttctaaagtttattgatacttcccttttatgtaaaatgtagtagtgatacctatatttccacattgtgcattgtgacacacttgtctagggatgcctggaagtgtataaaattggactgcatttcttagagtgttttactatagatcagtctcatgggccatctcttcctcagatgtaaatgatatctggttaagtgttatatggaataaagtggacattttaaaacta

SEQ ID NO: 330471 - DNA, 2227 bp, Homo sapiens
ccggccgcgctcggattgagggccgggcggaggtgccgcccttgagagcagccggttgtcgatgccgctcccctcagggacggctccgggcgggaagctctcgaggctcctcccgctgcgggtcggcgctcgccctcgctctcctcgccctccgccccggccccggccccgcgcccgccatggagaagactgagctgatccagaaggccaagctggccgagcaggccgagcgctacgacgacatggccacctgcatgaaggcagtgaccgagcagggcgccgagctgtccaacgaggagcgcaacctgctctccgtggcctacaagaacgtggtcgggggccgcaggtccgcctggagggtcatctctagcatcgagcagaagaccgacacctccgacaagaagttgcagctgattaaggactatcgggagaaagtggagtccgagctgagatccatctgcaccacggtgctggaattgttggataaatatttaatagccaatgcaactaatccagagagtaaggtcttctatctgaaaatgaagggtgattacttccggtaccttgctgaagttgcgtgtggtgatgatcgaaaacaaacgatagataattcccaaggagcttaccaagaggcatttgatataagcaagaaagagatgcaacccacacacccaatccgcctggggcttgctcttaacttttctgtattttactatgagattcttaataacccagagcttgcctgcacgctggctaaaacggcttttgatgaggccattgctgaacttgatacactgaatgaagactcatacaaagacagcaccctcatcatgcagttgcttagagacaacctaacactttggacatcagacagtgcaggagaagaatgtgatgcggcagaaggggctgaaaactaaatccatacagggtgtcatccttctttccttcaagaaacctttttacacatctccattccttattccacttggatttcctatagcaaagaaacccattcatgtgtatggaatcaactgtttatagtcttttcacactgcagctttgggaaaacttcattccttgatttgtgtttgtcttggccttcctggtgtgcagtactgctgtagaaaagtattaatagcttcatttcatataaacataagtaactcccaaacacttatgtagaggactaaaaatgtatctggtatttaagtaatctgaaccagttctgcaagtgactgtgttttgtattactgtgaaaataagaaaatgtagttaattacaatttaaagagtattccacataacttcttaatttctacattccctcccttactcttcgggggtttcctttcagtaagcaacttttccatgctcttaatgtattcctttttagtaggaatccggaagtattagattgaatggaaaagcacttgccatctctgtctaggggtcacaaattgaaatggctcctgtatcacatacggaggtcttgtgtatctgtggcaacagggagtttccttattcactctttatttgctgctgtttaagttgccaacctcccctcccaataaaaattcacttacacctcctgcctttgtagttctggtattcactttactatgtgatagaagtagcatgttgctgccagaatacaagcattgcttttggcaaattaaagtgcatgtcatttcttaatacactagaaaggggaaataaattaaagtacacaagtccaagtctaaaactttagtacttttccatgcagatttgtgcacatgtgagagggtgtccagtttgtctagtgattgttatttagagagttggaccactattgtgtgttgctaatcattgactgtagtcccaaaaaagccttgtgaaaatgttatgccctatgtaacagcagagtaacataaaataaaagtacattttataaacccatttactatggctttgtaacaattgcatacccatattttaagggacaggtgaatttactactttctaaagtttattgatacttcccttttatgtaaaatgtagtagtgatacctatatttccacattgtgcattgtgacacacttgtctagggatgcctggaagtgtataaaattggactgcatttcttagagtgttttactatagatcagtctcatgggccatctcttcctcagatgtaaatgatatctggttaagtgttatatggaataaagtggacattttaaaacta

SEQ ID NO: 330472 - DNA, 2086 bp, Homo sapiens
  misc_feature (1951)..(1951): n is a, c, g, or t
  misc_feature (1962)..(1962): n is a, c, g, or t
  misc_feature (1969)..(1969): n is a, c, g, or t
attgggcggtggaccgcccctcggccccggggtaggctgacacgggagggtcctcagctaaagccaaaagcagatcaaagtggtgggactcgcgtcgcggccgcggagacgtgaagctctcgaggctcctcccgctgcgggtcggcgctcgccctcgctctcctcgccctccgccccggccccggccccgcgcccgccatggagaagactgagctgatccagaaggccaagctggccgagcaggccgagcgctacgacgacatggccacctgcatgaaggcagtgaccgagcagggcgccgagctgtccaacgaggagcgcaacctgctctccgtggcctacaagaacgtggtcgggggccgcaggtccgcctggagggtcatctctagcatcgagcagaagaccgacacctccgacaagaagttgcagctgattaaggactatcgggagaaagtggagtccgagctgagatccatctgcaccacggtgctggaattgttggataaatatttaatagccaatgcaactaatccagagagtaaggtcttctatctgaaaatgaagggtgattacttccggtaccttgctgaagttgcgtgtggtgatgatcgaaaacaaacgatagataattcccaaggagcttaccaagaggcatttgatataagcaagaaagagatgcaacccacacacccaatccgcctggggcttgctcttaacttttctgtattttactatgagattcttaataacccagagcttgcctgcacgctggctaaaacggcttttgatgaggccattgctgaacttgatacactgaatgaagactcatacaaagacagcaccctcatcatgcagttgcttagagacaacctaacactttggacatcagacagtgcaggagaagaatgtgatgcggcagaaggggctgaaaactaaatccatacagggtgtcatccttctttccttcaagaaacctttttacacatctccattccttattccacttggatttcctatagcaaagaaacccattcatgtgtatggaatcaactgtttatagtcttttcacactgcagctttgggaaaacttcattccttgatttgtgtttgtcttggccttcctggtgtgcagtactgctgtagaaaagtattaatagcttcatttcatataaacataagtaactcccaaacacttatgtagaggactaaaaatgtatctggtatttaagtaatctgaaccagttctgcaagtgactgtgttttgtattactgtgaaaataagaaaatgtagttaattacaatttaaagagtattccacataacttcttaatttctacattccctcccttactcttcgggggtttcctttcagtaagcaacttttccatgctcttaatgtattcctttttagtaggaatccggaagtattagattgaatggaaaagcacttgccatctctgtctaggggtcacaaattgaaatggctcctgtatcacatacggaggtcttgtgtatctgtggcaacagggagtttccttattcactctttatttgctgctgtttaagttgccaacctcccctcccaataaaaattcacttacacctcctgcctttgtagttctggtattcactttactatgtgatagaagtagcatgttgctgccagaatacaagcattgcttttggcaaattaaagtgcatgtcatttcttaatacactagaaaggggaaataaattaaagtacacaagtccaagtctaaaactttagtacttttccatgcagatttgtgcacatgtgagagggtgtccagtttgtctagtgattgttatttagagagttggaccactattgtgtgttgctaatcattgactgtagtcccaaaaaagccttgtgaaaatgttatgccctatgtaacagcagagtaacataaataagtcattttaacctttntgggtggtacntgctccntttaggcagggaattcactttaaggtttgaaatccttttaaggagggacatatcctggtgcacctgtgggcggagtaaacggcggcaggttaaacgggccaaaaaggtggagggaaa

SEQ ID NO: 330473 - DNA, 2542 bp, Homo sapiens
  misc_feature (2001)..(2001): n is a, c, g, or t
  misc_feature (2029)..(2029): n is a, c, g, or t
attgggcggtggaccgcccctcggccccggggtaggctgacacgggagggtcctcagctaaagccaaaagcagatcaaagtggtgggactcgcgtcgcggccgcggagacgtgaagctctcgaggctcctcccgctgcgggtcggcgctcgccctcgctctcctcgccctccgccccggccccggccccgcgcccgccatggagaagactgagctgatccagaaggccaagctggccgagcaggccgagcgctacgacgacatggccacctgcatgaaggcagtgaccgagcagggcgccgagctgtccaacgaggagcgcaacctgctctccgtggcctacaagaacgtggtcgggggccgcaggtccgcctggagggtcatctctagcatcgagcagaagaccgacacctccgacaagaagttgcagctgattaaggactatcgggagaaagtggagtccgagctgagatccatctgcaccacggtgctggaattgttggataaatatttaatagccaatgcaactaatccagagagtaaggtcttctatctgaaaatgaagggtgattacttccggtaccttgctgaagttgcgtgtggtgatgatcgaaaacaaacgatagataattcccaaggagcttaccaagaggcatttgatataagcaagaaagagatgcaacccacacacccaatccgcctggggcttgctcttaacttttctgtattttactatgagattcttaataacccagagcttgcctgcacgctggctaaaacggcttttgatgaggccattgctgaacttgatacactgaatgaagactcatacaaagacagcaccctcatcatgcagttgcttagagacaacctaacactttggacatcagacagtgcaggagaagaatgtgatgcggcagaaggggctgaaaactaaatccatacagggtgtcatccttctttccttcaagaaacctttttacacatctccattccttattccacttggatttcctatagcaaagaaacccattcatgtgtatggaatcaactgtttatagtcttttcacactgcagctttgggaaaacttcattccttgatttgtgtttgtcttggccttcctggtgtgcagtactgctgtagaaaagtattaatagcttcatttcatataaacataagtaactcccaaacacttatgtagaggactaaaaatgtatctggtatttaagtaatctgaaccagttctgcaagtgactgtgttttgtattactgtgaaaataagaaaatgtagttaattacaatttaaagagtattccacataacttcttaatttctacattccctcccttactcttcgggggtttcctttcagtaagcaacttttccatgctcttaatgtattcctttttagtaggaatccggaagtattagattgaatggaaaagcacttgccatctctgtctaggggtcacaaattgaaatggctcctgtatcacatacggaggtcttgtgtatctgtggcaacagggagtttccttattcactctttatttgctgctgtttaagttgccaacctcccctcccaataaaaattcacttacacctcctgcctttgtagttctggtattcactttactatgtgatagaagtagcatgttgctgccagaatacaagcattgcttttggcaaattaaagtgcatgtcatttcttaatacactagaaaggggaaataaattaaagtacacaagtccaagtctaaaactttagtacttttccatgcagatttgtgcacatgtgagagggtgtccagttgtctagtgattgttatttagagagtggaccactatgtgtgttgctaatcattgactgtagtcccaataaaaattcacttacacctcctgcctttgtagttctggtattcactttactatgtgatagaagtagcatgttgctgccagaatacaagcattgcttttggcaaattaaagtgcatgtcattntcttaatacactagaaaggggaaataanacttaaagtacacaagtccaagtctaaaactttagtacttttccatgcagatttgtgcacatgtgagagggtgtccagtttgtctagtgattgttatttagagagttggaccactattgtgtgttgctaatcattgactgtagtcccaaaaaagccttgtgaaaatgttatgccctatgtaacagcagagtaacataaaataaaagtacattttataaacccatttactatggctttgtaacaattgcatacccatattttaagggacaggtgaatttactactttctaaagtttattgatacttcccttttatgtaaaatgtagtagtgatacctatatttccacattgtgcattgtgacacacttgtctagggatgcctggaagtgtataaaattggactgcatttcttagagtgttttactatagatcagtctcatgggccatctcttcctcagatgtaaatgatatctggttaagtgttatatggaataaagtggacattttaaaacta

SEQ ID NO: 330474 - DNA, 2205 bp, Homo sapiens
attgggcggtggaccgcccctcggccccggggtaggctgacacgggagggtcctcagctaaagccaaaagcagatcaaagtggtgggactcgcgtcgcggccgcggagacgtgaagctctcgaggctcctcccgctgcgggtcggcgctcgccctcgctctcctcgccctccgccccggccccggccccgcgcccgccatggagaagactgagctgatccagaaggccaagctggccgagcaggccgagcgctacgacgacatggccacctgcatgaaggcagtgaccgagcagggcgccgagctgtccaacgaggagcgcaacctgctctccgtggcctacaagaacgtggtcgggggccgcaggtccgcctggagggtcatctctagcatcgagcagaagaccgacacctccgacaagaagttgcagctgattaaggactatcgggagaaagtggagtccgagctgagatccatctgcaccacggtgctggaattgttggataaatatttaatagccaatgcaactaatccagagagtaaggtcttctatctgaaaatgaagggtgattacttccggtaccttgctgaagttgcgtgtggtgatgatcgaaaacaaacgatagataattcccaaggagcttaccaagaggcatttgatataagcaagaaagagatgcaacccacacacccaatccgcctggggcttgctcttaacttttctgtattttactatgagattcttaataacccagagcttgcctgcacgctggctaaaacgagactcatacaaagacagcaccctcatcatgcagttgcttagagacaacctaacactttggacatcagacagtgcaggagaagaatgtgatgcggcagaaggggctgaaaactaaatccatacagggtgtcatccttctttccttcaagaaacctttttacacatctccattccttattccacttggatttcctatagcaaagaaacccattcatgtgtatggaatcaactgtttatagtcttttcacactgcagctttgggaaaacttcattccttgatttgtgtttgtcttggccttcctggtgtgcagtactgctgtagaaaagtattaatagcttcatttcatataaacataagtaactcccaaacacttatgtagaggactaaaaatgtatctggtatttaagtaatctgaaccagttctgcaagtgactgtgttttgtattactgtgaaaataagaaaatgtagttaattacaatttaaagagtattccacataacttcttaatttctacattccctcccttactcttcgggggtttcctttcagtaagcaacttttccatgctcttaatgtattcctttttagtaggaatccggaagtattagattgaatggaaaagcacttgccatctctgtctaggggtcacaaattgaaatggctcctgtatcacatacggaggtcttgtgtatctgtggcaacagggagtttccttattcactctttatttgctgctgtttaagttgccaacctcccctcccaataaaaattcacttacacctcctgcctttgtagttctggtattcactttactatgtgatagaagtagcatgttgctgccagaatacaagcattgcttttggcaaattaaagtgcatgtcatttcttaatacactagaaaggggaaataaattaaagtacacaagtccaagtctaaaactttagtacttttccatgcagatttgtgcacatgtgagagggtgtccagtttgtctagtgattgttatttagagagttggaccactattgtgtgttgctaatcattgactgtagtcccaaaaaagccttgtgaaaatgttatgccctatgtaacagcagagtaacataaaataaaagtacattttataaacccatttactatggctttgtaacaattgcatacccatattttaagggacaggtgaatttactactttctaaagtttattgatacttcccttttatgtaaaatgtagtagtgatacctatatttccacattgtgcattgtgacacacttgtctagggatgcctggaagtgtataaaattggactgcatttcttagagtgttttactatagatcagtctcatgggccatctcttcctcagatgtaaatgatatctggttaagtgttatatggaataaagtggacattttaaaacta

SEQ ID NO: 330475 - DNA, 1605 bp, Homo sapiens
attgggcggtggaccgcccctcggccccggggtaggctgacacgggagggtcctcagctaaagccaaaagcagatcaaagtggtgggactcgcgtcgcggccgcggagacgtgaagctctcgaggctcctcccgctgcgggtcggcgctcgccctcgctctcctcgccctccgccccggccccggccccgcgcccgccatggagaagactgagctgatccagaaggccaagctggccgagcaggccgagcgctacgacgacatggccacctgcatgaaggcagtgaccgagcagggcgccgagctgtccaacgaggagcgcaacctgctctccgtggcctacaagaacgtggtcgggggccgcaggtccgcctggagggtcatctctagcatcgagcagaagaccgacacctccgacaagaagttgcagctgattaaggactatcgggagaaagtggagtccgagctgagatccatctgcaccacggtgctggaattgttggataaatatttaatagccaatgcaactaatccagagagtaaggtcttctatctgaaaatgaagggtgattacttccggtaccttgctgaagttgcgtgtggtgatgatcgaaaacaaacgatagataattcccaaggagcttaccaagaggcatttgatataagcaagaaagagatgcaacccacacacccaatccgcctggggcttgctcttaacttttctgtattttactatgagattcttaataacccagagcttgcctgcacgctggctaaaacggcttttgatgaggccattgctgaacttgatacactgaatgaagactcatacaaagacagcaccctcatcatgcagttgcttagagacaacctaacactttggacatcagacagtgcaggagaagaatgtgatgcggcagaaggggctgaaaactaaatccatacagggtgtcatccttctttccttcaagaaacctttttacacatctccattccttattccacttggatttcctatagcaaagaaacccattcatgtgtatggaatcaactgtttatagtcttttcacactgcagctttgggaaaacttcattccttgatttgtgtttgtcttggccttcctggtgtgcagtactgctgtagaaaagtattaatagcttcatttcatataaacataagtaactcccaaacacttatgtagaggactaaaaatgtatctggtatttaagtaatctgaaccagttctgcaagtgactgtgttttgtattactgtgaaaataagaaaatgtagttaattacaatttaaagagtattccacataacttcttaatttctacattccctcccttactcttcgggggtttcctttcagtaagcaacttttccatgctcttaatgtattcctttttagtaggaatccggaagtattagattgaatggaaaagcacttgccatctctgtctaggggtcacaaattgaaatggctcctgtatcacatacggaggtcttgtgtatctgtggcaacagggagtttccttattcactctttatttgctgctgtttaagttgccaacctcccctcccaataaaaattcacttacacct

SEQ ID NO: 330476 - DNA, 2011 bp, Homo sapiens
  misc_feature (2011)..(2011): n is a, c, g, or t
attgggcggtggaccgcccctcggccccggggtaggctgacacgggagggtcctcagctaaagccaaaagcagatcaaagtggtgggactcgcgtcgcggccgcggagacgtgaagctctcgaggctcctcccgctgcgggtcggcgctcgccctcgctctcctcgccctccgccccggccccggccccgcgcccgccatggagaagactgagctgatccagaaggccaagctggccgagcaggccgagcgctacgacgacatggccacctgcatgaaggcagtgaccgagcagggcgccgagctgtccaacgaggagcgcaacctgctctccgtggcctacaagaacgtggtcgggggccgcaggtccgcctggagggtcatctctagcatcgagcagaagaccgacacctccgacaagaagttgcagctgattaaggactatcgggagaaagtggagtccgagctgagatccatctgcaccacggtgctggaattgttggataaatatttaatagccaatgcaactaatccagagagtaaggtcttctatctgaaaatgaagggtgattacttccggtaccttgctgaagttgcgtgtggtgatgatcgaaaacaaacgatagataattcccaaggagcttaccaagaggcatttgatataagcaagaaagagatgcaacccacacacccaatccgcctggggcttgctcttaacttttctgtattttactatgagattcttaataacccagagcttgcctgcacgctggctaaaacggcttttgatgaggccattgctgaacttgatacactgaatgaagactcatacaaagacagcaccctcatcatgcagttgcttagagacaacctaacactttggacatcagacagtgcaggagaagaatgtgatgcggcagaaggggctgaaaactaaatccatacagggtgtcatccttctttccttcaagaaacctttttacacatctccattccttattccacttggatttcctatagcaaagaaacccattcatgtgtatggaatcaactgtttatagtcttttcacactgcagctttgggaaaacttcattccttgatttgtgtttgtcttggccttcctggtgtgcagtactgctgtagaaaagtattaatagcttcatttcatataaacataagtaactcccaaacacttatgtagaggactaaaaatgtatctggtatttaagtaatctgaaccagttctgcaagtgactgtgttttgtattactgtgaaaataagaaaatgtagttaattacaatttaaagagtattccacataacttcttaatttctacattccctcccttactcttcgggggtttcctttcagtaagcaacttttccatgctcttaatgtattcctttttagtaggaatccggaagtattagattgaatggaaaagcacttgccatctctgtctaggggtcacaaattgaaatggctcctgtatcacatacggaggtcttgtgtatctgtggcaacagggagtttccttattcactctttatttgctgctgtttaagttgccaacctcccctcccaataaaaattcacttacacctaaaaaaaaaaaaaaaaaaaaaaaaaaaaaaaggggggggggctaaaaatttccccgggggggcccagtttggggtccccggcttttttctggttacaaggggggcgcccctatagtaggggaggcgccgttttattaacgcaagcgaccggggccggcggttaccacaccggctcgggcgactggggcgacaccgtggcgctggctggggagctctgggggagaagggacccctaccttccgggggcgtcgggccctccgttggggccaactctccctaccggaggttcaaccggccacggcgtccttatacacttttcacgtggtctctggggttacccaacgctgatatgcttgccggtagaagtcggtaccggtttggtttcgacctttttcgaggggtatan

SEQ ID NO: 330477 - DNA, 1695 bp, Homo sapiens
  misc_feature (1573)..(1573): n is a, c, g, or t
  misc_feature (1576)..(1576): n is a, c, g, or t
attgggcggtggaccgcccctcggccccggggtaggctgacacgggagggtcctcagctaaagccaaaagcagatcaaagtggtgggactcgcgtcgcggccgcggagacgtgaagctctcgaggctcctcccgctgcgggtcggcgctcgccctcgctctcctcgccctccgccccggccccggccccgcgcccgccatggagaagactgagctgatccagaaggccaagctggccgagcaggccgagcgctacgacgacatggccacctgcatgaaggcagtgaccgagcagggcgccgagctgtccaacgaggagcgcaacctgctctccgtggcctacaagaacgtggtcgggggccgcaggtccgcctggagggtcatctctagcatcgagcagaagaccgacacctccgacaagaagttgcagctgattaaggactatcgggagaaagtggagtccgagctgagatccatctgcaccacggtgctggaattgttggataaatatttaatagccaatgcaactaatccagagagtaaggtcttctatctgaaaatgaagggtgattacttccggtaccttgctgaagttgcgtgtggtgatgatcgaaaacaaacgatagataattcccaaggagcttaccaagaggcatttgatataagcaagaaagagatgcaacccacacacccaatccgcctggggcttgctcttaacttttctgtattttactatgagattcttaataacccagagcttgcctgcacgctggctaaaacggcttttgatgaggccattgctgaacttgatacactgaatgaagactcatacaaagacagcaccctcatcatgcagttgcttagagacaacctaacactttggacatcagacagtgcaggagaagaatgtgatgcggcagaaggggctgaaaactaaatccatacagggtgtcatccttctttccttcaagaaacctttttacacatctccattccttattccacttggatttcctatagcaaagaaacccattcatgtgtatggaatcaactgtttatagtcttttcacactgcagctttgggaaaacttcattccttgatttgtgtttgtcttggccttcctggtgtgcagtactgctgtagaaaagtattaatagcttcatttcatataaacataagtaactcccaaacacttatgtagaggactaaaaatgtatctggtatttaagtaatctgaaccagttctgcaagtgactgtgttttgtattactgtgaaaataagaaaatgtagttaattacaatttaaagagtattccacataacttcttaatttctacattccctcccttactcttcgggggtttcctttcagtaagcaacttttccatgctcttaatgtattcctttttagtaggaatccggaagtattagattgaatggaaaagcacttgccatctctgtctaggggtcacaaattgaaatggctcctgtatcacatacggaggtcttgtgtatctgtggcaacagggagtttccttattcactctttatttgctgctgtttatgggcggtnagntggcacccccccaaaaaatattacctggcttgggtggtactaatgtaagagggggggcaaaacgtgggagggggtcccaaggggaaacaccaaaacgagggagggggaaaaacacgaaa

SEQ ID NO: 330478 - DNA, 1407 bp, Homo sapiens
attgggcggtggaccgcccctcggccccggggtaggctgacacgggagggtcctcagctaaagccaaaagcagatcaaagtggtgggactcgcgtcgcggccgcggagacgtgaagctctcgaggctcctcccgctgcgggtcggcgctcgccctcgctctcctcgccctccgccccggccccggccccgcgcccgccatggagaagactgagctgatccagaaggccaagctggccgagcaggccgagcgctacgacgacatggccacctgcatgaaggcagtgaccgagcagggcgccgagctgtccaacgaggagcgcaacctgctctccgtggcctacaagaacgtggtcgggggccgcaggtccgcctggagggtcatctctagcatcgagcagaagaccgacacctccgacaagaagttgcagctgattaaggactatcgggagaaagtggagtccgagctgagatccatctgcaccacggtgctggaattgttggataaatatttaatagccaatgcaactaatccagagagtaaggtcttctatctgaaaatgaagggtgattacttccggtaccttgctgaagttgcgtgtggtgatgatcgaaaacaaacgatagataattcccaaggagcttaccaagaggcatttgatataagcaagaaagagatgcaacccacacacccaatccgcctggggcttgctcttaacttttctgtattttactatgagattcttaataacccagagcttgcctgcacgctggctaaaacggcttttgatgaggccattgctgaacttgatacactgaatgaagactcatacaaagacagcaccctcatcatgcagttgcttagagacaacctaacactttggacatcagacagtgcaggagaagaatgtgatgcggcagaaggggctgaaaactaaatccatacagggtgtcatccttctttccttcaagaaacctttttacacatctccattccttattccacttggatttcctatagcaaagaaacccattcatgtgtatggaatcaactgtttatagtcttttcacactgcagctttgggaaaacttcattccttgatttgtgtttgtcttggccttcctggtgtgcagtactgctgtagaaaagtattaatagcttcatttcatataaacataagtaactcccaaacacttatgtagaggactaaaaatgtatctggtatttaagtaatctgaaccagttctgcaagtgactgtgttttgtattactgtgaaaataagaaaatgtagttaattacaatttaaagagtattccacataacttcttaatttctacattccctccatgcctagctggattgcagagttaagtttatgattatgaaataaaaactaaataacaaaaa

SEQ ID NO: 330479 - DNA, 1244 bp, Homo sapiens
attgggcggtggaccgcccctcggccccggggtaggctgacacgggagggtcctcagctaaagccaaaagcagatcaaagtggtgggactcgcgtcgcggccgcggagacgtgaagctctcgaggctcctcccgctgcgggtcggcgctcgccctcgctctcctcgccctccgccccggccccggccccgcgcccgccatggagaagactgagctgatccagaaggccaagctggccgagcaggccgagcgctacgacgacatggccacctgcatgaaggcagtgaccgagcagggcgccgagctgtccaacgaggagcgcaacctgctctccgtggcctacaagaacgtggtcgggggccgcaggtccgcctggagggtcatctctagcatcgagcagaagaccgacacctccgacaagaagttgcagctgattaaggactatcgggagaaagtggagtccgagctgagatccatctgcaccacggtgctggaattgttggataaatatttaatagccaatgcaactaatccagagagtaaggtcttctatctgaaaatgaagggtgattacttccggtaccttgctgaagttgcgtgtggtgatgatcgaaaacaaacgatagataattcccaaggagcttaccaagaggcatttgatataagcaagaaagagatgcaacccacacacccaatccgcctggggcttgctcttaacttttctgtattttactatgagattcttaataacccagagcttgcctgcacgctggctaaaacggcttttgatgaggccattgctgaacttgatacactgaatgaagactcatacaaagacagcaccctcatcatgcagttgcttagagacaacctaacactttggacatcagacagtgcaggagaagaatgtgatgcggcagaaggggctgaaaactaaatccatacagggtgtcatccttctttccttcaagaaacctttttacacatctccattccttattccacttggatttcctatagcaaagaaacccattcatgtgtatggaatcaactgtttatagtcttttcacactgcagctttgggaaaacttcattccttgatttgtgtttgtcttggccttcctggtgtgcagtactgctgtagaaaagtattaatagcttcatttcatataaacataagtaactcccaaacacttatgtagaggactgggtcatgttctgtggggatcctctaggtcacctcga

SEQ ID NO: 330480 - DNA, 697 bp, Homo sapiens
  misc_feature (41)..(42): n is a, c, g, or t
  misc_feature (49)..(49): n is a, c, g, or t
  misc_feature (51)..(52): n is a, c, g, or t
  misc_feature (54)..(54): n is a, c, g, or t
cggacgcgtgggtcgacccacgcgtccgtcgacccacgcgnnccggacncnngngtcgacccacgcgtccgcacacatctccattccttattccacttggatttcctatagcaaagaaacccattcatgtgtatggaatcaactgtttatagtcttttcacactgcagctttgggaaaacttcattccttgatttgtgtttgtcttggccttcctggtgtgcagtactgctgtagaaaagtattaatagcttcatttcatataaacataagtaactcccaaacacttatgtagaggactaaaaatgtatctggtatttaagtaatctgaaccagttctgcaagtgactgtgttttgtattactgtgaaaataagaaaatgtagttaattacaatttaaagagtattccacataacttcttaatttctacattccctcccttactcttcgggggtttcctttcagtaagcaacttttccatgctcttaatgtattcctttttagtaggaatccggaagtattagattgaatggaaaagcacttgccatctctgtctaggggtcacaaattgaaatggctcctgtatcacatacggaggtcttgtgtatctgtggcaacagggagtttccttattcactctttatttgctgctgtttaagttgccaacctcccctcccaataaaaattcacttacacct

SEQ ID NO: 330481 - DNA, 316 bp, Homo sapiens
atgtatatggggacaattagaaacttctgcaacaagtttcctaagacaatgaactgtaagaataatggaagtattttgccttaagagcgaatgtaagtaaagcattctgaatcacttgagaaacactcaaacaagtaatatgtgtacttcttaccaaagctctacatctatttgttacaagatagaagattcttactcattaactccaggaatatttaaccaactgctaaataagagacactataataagttgggtattttaataaaagcaatgaggtacagaaaacgctttgtcatccacaagcctagattttct

SEQ ID NO: 330482 - DNA, 663 bp, Homo sapiens
tggaggttgcagtgagccgagattatgccattgcactccagccgggggagcaacaaagccagactccatctcaaaaaaaaaccaaaaaaaatcctatttagtacaaggtacattatttaggtaatgagtccattaaaagccaacactttccccactacactatatgtgtatgtaacacaactgcccttgtaacttcctaaacctataattaagaaacaataaaaggcaaattaagaatgcttttttaaaaggtgggggcattatgctaataagttactgtggatttcagagtgcagagtagaaagatcacaagaatttagtgtggtaggtgggaacagaaaatgggtgtataaattttattgacgtgggagtactggatattgtagagacagatatcatcagggcaaggagattaaagatttttgcattgacggtttgacactatattgtggtaataacactgtatgtgttgggagatagaacaggaaacatcttccctggaatatgtatactattaaatgttttatcaaacttttgatcaaacaagacagcacaatttataatttcatttctatttctatgttatgagaaactgatcatttattcaaatgtttaacaggcatgttcatgttactataaactcttctgtttcaccaaaaaaaa

SEQ ID NO: 330483 - DNA, 549 bp, Homo sapiens
ctgccgttcctagctcaggtccttatcatctttcatattgattattgtagtaacctaactgatctcccttattccagtctgtactccactttgtaacccaggaagaaatataaaatagtaattaagtttaagtgtgccagaaatagatgtcctgattttgagcttcagtcatagattagtcacttagtgtcttcaagtctaagttttctgagtttcctgtgaaatcgatatatattcttcagcacagtgcctcgcacatagaattagtaaaaatatgttaacgaggattatttatctttctgtcagatctcagcacaatgtagtataatcacatgtgcacttgttttatttttccatgtagaccatgaacttcattggggtggacactgaatcttactgattttttagtatacaacaattacccaggaaactaacagtatggtaaccgtaacaggatgtgataaatatttatcaggtactattagatagattttatttaccagacatttgtgaatattcttctcaatgctgatcccctgtggaaagtaa

SEQ ID NO: 330484 - DNA, 484 bp, Homo sapiens
ccaaacatccagaaacgcggtgtttattaaatcaattctttaaacaggcagccaacaccaagttttgacaatgcattacaaacagtgcaaagcctccggagccgaatgctctgtgaatatcagtgcagcactgataagctggaccctgaaccagtatcaccctctgaccacacagagccaggaacagccctatttattttcttcattccaccttctcctgccactttaaaatgggggagaggggaacggcctgtgtgctgttcttccagaagctggtggaaagacatgcccaaaaccgctgacttcgtccatgtagcttatcagcagggccattttgaacaagttatctaagctcagggcctcaatgtcctcacgcgtaagtgatggctccagagggagtgttcttctaagacctggtgaggtaagtgtgcttatgagtttggtacatcataagtactgcattaatattcgttgttggcggccg

SEQ ID NO: 330485 - DNA, 403 bp, Homo sapiens
ccagagcagggaggaatggtcccaaaaggaagaaactgtgcttgtcttcacaataaagagcagagaagtggggagaggtattgaaagctgtgggtggagttttgcaggtaagattgtgtgaaagaggtgagggaactacaatctgggggaatgtggataggagagtaaaagggaattctagagaacaatccctactgacttcacacaacttaagaaatgcaagtaaagggccgggcgcggtggcccacacctgtaatcccagtactttgggaggcagaggcaggtggatcacttgaagtcaggagttcaagaagagcctggccaacatggtgaaaccccatctgggttagtcaggcatggtggcatgtgtctgtaatcccagctacagaaagatagagaggtg

SEQ ID NO: 330486 - DNA, 904 bp, Homo sapiens
ttgtctttctttttaatagactttattttttgcaacacttttaagcacagcaaagttgagcggagggtacagatttccaagcctccccaccgccatcctccccgactgtcgagatcccagtcacccacagtgggacatacagctggggaacctacagggacatggcataatcccctggagcgcagattgacattagggctcactcgtagtgttacccattctatgaatttggacaaatacataatgacatccatccctcatcacagtgtcatacagaatagtttcactgccttaaaaagcctgtgttttccaccttttcatccctccctcccccagcccctgacaaccaccagtaatttaattccttcatattttgccctttccagaacaggtggaatcacacattatttggtctttgcaggttggcctctttcatttagcaataggcattcaagattccttccatgtcttgatagtgcatttctgtttagcactgactaatattctgttgttggttgtcaagatttactagtttattcaagttcattctttttcaaataaattctcaatcatattttattttattgcaggttcatacttataacacaatttagtatttctatcacttaagaactcttggcaacacatatcagaaacttgcatgtatcagacagtagcgaactcaaggcggtgtttatgtagcaggtctcgggtgggcctctgggaccgcgcctgttgaactcagtgctgctgatggctgcagtcccaactcctctggtcacacggggggtttgcatagatccagcaagtagagtgacccactttcctgatttgcccagtactgaggggttcccctttctgattttccactgattcattagacaactatgtattaagcatagac

SEQ ID NO: 330487 - DNA, 259 bp, Homo sapiens
gagtgaatggctggggatgaactcacaggggtgtctaaactgtctttgcatagctgagtcagtttccgggagggagtctcaggaccagggggtgtttctcagcctgccaaaatgccaaatctgaaacatatctcaaagaccagttacttaggttttacaatagtgatgttatctgtaggagtagttggggaagttatcgatcttgtgactcccttaattgctgaggcagtaagcaattaatacgaaaacaacagcagta

SEQ ID NO: 330488 - DNA, 399 bp, Homo sapiens
ccccaggggtggggagaagtcgggcactggagaggaacaggcatccggagtgatgtgatgccacatgggtggatggggcagagcccaccccgcctccagcatagcccagaagcctctggctgcttctctgagtgaggccattggaaggcttgggtggaatgttttagaggactgctggtttccatgtttgtgtagacaacagatgggaagggctgaaggaggagagtggtgaggtgtctgctcgggtccacgtgggagaggtgggcggttccggccacggagcagcctgtgcgaggagtgtcgggctctggatagactttgggtgtagagcctgagggatttgctcccaggtgagatgaggaaggtaggagaagagaggcgtgatcatgactcccaaag

SEQ ID NO: 330489 - DNA, 738 bp, Homo sapiens
ggagagctgggcttcgaggcgtcagtgtgaagggaaggctaaggacgcatcggtgctggagagttgagaatatgccttcccctccacccccaacccagtcaccttatttgaaaaaaaattaaaaaacaccttttatttaaaaacctaaccctggaagtttgctcgggaaggcattctcttcctcttcctccagctgcctgaaaatcatatgcgtggtttttcctgtttcctgctctgtagctgacatcaggggagcaacgtgaacacaggaaaatggaaatcaacatttgaaacttttaaatggaagctttattggggttccacatatggaaaactgcaaatagcagaagtatgtgactcaataaattattctggagtgaccacatcctctaactgcctcccaggacaagacggagaatgtgaacaatgctcctgaaggcccctttccctcaaagaatcactgcaattgaaggaaaaatgctccatgtcccctctgccagttggtgtttatcaaaggacaacggaggaagagagacaaagtgcctggatgtgtgtgttaatcaagagttgtcaggaccctgcctctaaaagaaagcgctaaaatgatgcttttgacaagacttttctcaaagtggatgcagtctaagggttggaaaacaaggcccaatcaggctaggtctgacttgtcgcctgcttttgtaaataaagttttattggctcacagacaaaaaaaaaagt

SEQ ID NO: 330490 - DNA, 710 bp, Homo sapiens
ggagagctgggcttcgaggcgtcagtgtgaagggaaggctaaggacgcatcggtgctggagagttgagaatatgccttcccctccacccccaacccagtcaccttatttgaaaaaaaattaaaaaacaccttttatttaaaaacctaaccctggaagtttgctcgctgcctgaaaatcatatgcgtggtttttcctgtttcctgctctgtagctgacatcaggggagcaacgtgaacacaggaaaatggaaatcaacatttgaaacttttaaatggaagctttattggggttccacatatggaaaactgcaaatagcagaagtatgtgactcaataaattattctggagtgaccacatcctctaactgcctcccaggacaagacggagaatgtgaacaatgctcctgaaggcccctttccctcaaagaatcactgcaattgaaggaaaaatgctccatgtcccctctgccagttggtgtttatcaaaggacaacggaggaagagagacaaagtgcctggatgtgtgtgttaatcaagagttgtcaggaccctgcctctaaaagaaagcgctaaaatgatgcttttgacaagacttttctcaaagtggatgcagtctaagggttggaaaacaaggcccaatcaggctaggtctgacttgtcgcctgcttttgtaaataaagttttattggctcacagacaaaaaaaaaagt

SEQ ID NO: 330491 - DNA, 663 bp, Homo sapiens
ggagagctgggcttcgaggcgtcagtgtgaagggaaggctaaggacgcatcggtgctggagagttgagaatatgccttcccctccacccccaacccagtcaccttatttgaaaaaaaattaaaaaacaccttttatttaaaaacctaaccctggaagtttgctcgctgacatcaggggagcaacgtgaacacaggaaaatggaaatcaacatttgaaacttttaaatggaagctttattggggttccacatatggaaaactgcaaatagcagaagtatgtgactcaataaattattctggagtgaccacatcctctaactgcctcccaggacaagacggagaatgtgaacaatgctcctgaaggcccctttccctcaaagaatcactgcaattgaaggaaaaatgctccatgtcccctctgccagttggtgtttatcaaaggacaacggaggaagagagacaaagtgcctggatgtgtgtgttaatcaagagttgtcaggaccctgcctctaaaagaaagcgctaaaatgatgcttttgacaagacttttctcaaagtggatgcagtctaagggttggaaaacaaggcccaatcaggctaggtctgacttgtcgcctgcttttgtaaataaagttttattggctcacagacaaaaaaaaaagt

SEQ ID NO: 330492 - DNA, 784 bp, Homo sapiens
ggagagctgggcttcgaggcgtcagtgtgaagggaaggctaaggacgcatcggtgctggagagttgagaatatgccttcccctccacccccaacccagtcaccttatttgaaaaaaaattaaaaaacaccttttatttaaaaacctaaccctggaagtttgctcgctgcctgaaaatcatatgcgtggtttttcctgtttcctgctctgtagctgacatcaggggagcaacgtgaacacaggaaaatggaaatcaacatttgaaacttttaaatggaagctttattggggttccacatatggaaaactgcaaatagcagaagtatgtgactcaataaattattctggagtgaccacatcctctaactgcctcccaggacaagacggagaatgtgaacaatgctcctgaaggcccctttccctcaaaggtaaccactggcctgacttctgacaccatacatttgttttgcttttttgaacttcatgtaaatggaatcatatgaatcactgcaattgaaggaaaaatgctccatgtcccctctgccagttggtgtttatcaaaggacaacggaggaagagagacaaagtgcctggatgtgtgtgttaatcaagagttgtcaggaccctgcctctaaaagaaagcgctaaaatgatgcttttgacaagacttttctcaaagtggatgcagtctaagggttggaaaacaaggcccaatcaggctaggtctgacttgtcgcctgcttttgtaaataaagttttattggctcacagacaaaaaaaaaagt

SEQ ID NO: 330493 - DNA, 448 bp, Homo sapiens
ggagagctgggcttcgaggcgtcagtgtgaagggaaggctaaggacgcatcggtgctggagagttgagaatatgccttcccctccacccccaacccagtcaccttatttgaaaaaaaattaaaaaacaccttttatttaaaaacctaaccctggaagtttgctcgaatcactgcaattgaaggaaaaatgctccatgtcccctctgccagttggtgtttatcaaaggacaacggaggaagagagacaaagtgcctggatgtgtgtgttaatcaagagttgtcaggaccctgcctctaaaagaaagcgctaaaatgatgcttttgacaagacttttctcaaagtggatgcagtctaagggttggaaaacaaggcccaatcaggctaggtctgacttgtcgcctgcttttgtaaataaagttttattggctcacagacaaaaaaaaaagt

SEQ ID NO: 330494 - DNA, 438 bp, Homo sapiens
acctggcccccataccctcactaaaagactattaagtgaaagaatagctctattttctttattaaggtataccgctagctcagtacaatttgaagaggggcacttgatatgccgagcatggcacaaagacctcgggtctggttttaatctctgccccggctttgtctttcagaatcactgcaattgaaggaaaaatgctccatgtcccctctgccagttggtgtttatcaaaggacaacggaggaagagagacaaagtgcctggatgtgtgtgttaatcaagagttgtcaggaccctgcctctaaaagaaagcgctaaaatgatgcttttgacaagacttttctcaaagtggatgcagtctaagggttggaaaacaaggcccaatcaggctaggtctgacttgtcgcctgcttttgtaaataaagttttattggctca

SEQ ID NO: 330495 - DNA, 294 bp, Homo sapiens
taacagatatctactcccaagtttggcatgctaacgccaggatgcagctgcctaagattactctgtgttcttgagggttttgagcacaagtttagtgtggctgtcgctcagagggttggattcagtactgcctgtggataccaattggccctgaggaacctgcagatataaaagtccgccctctgtagacgggagttttgcatgtatgaataccgtattttcttttctttctttctttctttttttttttggggtaacatataagggggggaaccgagcctcgaatccgaaacc

SEQ ID NO: 330496 - DNA, 183 bp, Homo sapiens
gaggttattatgatgaaaactttgaagaaattcttaaactttatcttcctctgtggattgaggagtaaaaatcacaattagagatgtttaaagaacttcttttaagaaataattcaaaaaaactactcatgtcattaagtaaaaaatataatacatattagaataattggtttgggtctgcta

SEQ ID NO: 330497 - DNA, 416 bp, Homo sapiens
atgattttgagggctccaaatttaaaggggaaagggtgggatactgagaaatacagttttcatgtgagagggtagcagggggaaaatagtcattcatgcctctgtctggcttagtcaatctgaatctgcatttttacgtaagataacatagacaaatggggcaggggaacaatcagatatgcatttgtgtcaggagggcagaggggtgactgtacctgaaaacagaagctatctatttacattgccatggtaaattttcatagaaacactttatggtaaagatcttggcgctcactgagaatttccttgtgggcaaaatatgagcgaggtgtgtagcttttcatctggtagccatctcatttaaaaaccaagaggcaaggcagttttgcgtgacccagttcccagcttaacttttc

SEQ ID NO: 330498 - DNA, 428 bp, Homo sapiens
acattaggatggctgaggcaacaagataggagaatgaaaagtaagatgtagtcgtgggatgagggctctgaaccccaggctcaggggtttgtcatcagtgatgccagttaaaaagggatccactgcattgaaataattaacaaaaggttaaaaaatccagaaaaagcatagagttagaagggacctgatcttgtccaatagccacatttttacagagaaggaaagtgatgaacagagtgcttagaaaacatactcagggttcaatttccatcgagaagcattccctgacctcggagctgggctgcagttggcatttcaaacccactgtccgcattaacctgaacgtaacacacaaccctgtgtatacctttaccatacaaaacacattaacaacacattaacatctctcacgttcaccctgacaattc

SEQ ID NO: 330499 - DNA, 1175 bp, Homo sapiens
agaaaaaggctctggagccagactgccagagttcaaatccaagctccagctttattagctgtgtgatcttgggcaagttatcagacctctctgtgaccggttttcttatgtgtgcattaatcacatgtaaagtgaatagagacaaacaagtgctcattgtgattctctctctttttttttttttttgagttggagtcttgctttgtcacccaggctggagtgcagtcgtactatcttggctcactgccatttccacttctggggtttaagtgatcctcctgcctcagcctcccaagtagctgggattacaggcatgcaccactaagcctggctaatttttgtatttttagtagagacggggtttcaccgtgttggccatgctggtctcaaactcctgaccttaagtgatctgccctacttaaaggcgtgagccactacgcccagcccattgtgatttttatgataactcatagtgaaatgaaatcacgtgcccacgctgtggtgactctgtccagcaacttctctgcagagccccctagattcatgcttctcagactttaaaatgtgcctgcaaatctcctggcatccttgttaaaatgcaggtttgatctggtgggtctttggggtggggcccaagactacatttgtgatgagctcccgatgctgtgggttttgctggttcaggagcacactttgaatttcaaggctcaggcctgtaggcattctcccctctgtggcttggtgccctcgccagaccatggctgatgtcagagctggtttcctagtgattgcccctcagggtcttcctgcttttctaccctaccctgccggtgagggacacctactcatgcaccacttgaagttgagttccagaaagaagacgccagggatgaggctggacagagggtctcacggatggccccgctgccaggagcagaactggttcggaggccactgcagctctaccgatacttgctgcgctgttgccagcagctgccgaccaagggcatccagcagcattacaagcatgctgtcaggcagagttttcgggttcattcagatgaagacaaccctgagagaatccagcagattattaaaagagccattgaagatgctgactggatcatgaacaaagtaggtgcttggcccctgggctctgcctgcgagctggggtg

SEQ ID NO: 330500 - DNA, 1087 bp, Homo sapiens
agaaaaaggctctggagccagactgccagagttcaaatccaagctccagctttattagctgtgtgatcttgggcaagttatcagacctctctgtgaccggttttcttatgtgtgcattaatcacatgtaaagtgaatagagacaaacaagtgctcattgtgattctctctctttttttttttttttgagttggagtcttgctttgtcacccaggctggagtgcagtcgtactatcttggctcactgccatttccacttctggggtttaagtgatcctcctgcctcagcctcccaagtagctgggattacaggcatgcaccactaagcctggctaatttttgtatttttagtagagacggggtttcaccgtgttggccatgctggtctcaaactcctgaccttaagtgatctgccctacttaaaggcgtgagccactacgcccagcccattgtgatttttatgataactcatagtgaaatgaaatcacgtgcccacgctgtggtgactctgtccagcaacttctctgcagagccccctagattcatgcttctcagactttaaaatgtgcctgcaaatctcctggcatccttgttaaaatgcaggtttgatctggtgggtctttggggtggggcccaagactacatttgtgatgagctcccgatgctgtgggttttgctggttcaggagcacactttgaatttcaaggctcaggcctgtaggcattctcccctctgtggcttggtgccctcgccagaccatggctgatgtcagagctggtttcctagtgattgcccctcagggtcttcctgcttttctaccctaccctgccggtgagggacacctactcatgcaccacttgaagttgagttccagaaagaagacgccagggatgaggctgtaagtctccctccacactcacctttggtcttgtgggcctgctctgggctagagcttctgttgaactgaatgcccaccccaccccaaggtgcaggctccatgggatgggacaggaggggcctctgcactgcaccaagcttgcttcccagagtactgggaactgggggtcagggctgagtactgaacttgg

SEQ ID NO: 330501 - DNA, 265 bp, Homo sapiens
attgggtgggaaatggtggcctcttaatgtctatcaactgtaaagactgcaaaaagggatccatggctgttggagcaattagatacccgattacgtagacagatccggaaagcgcattgtttccttagcaaaagggcactcagccacagggatgaactagtgtttgtttgtatccttgcagttatgtgacttaaagtgactcagagatatctatgtatgcgagtgtactccgctggcaatgaagtaaatatatcaatttgtggaa

SEQ ID NO: 330502 - DNA, 1942 bp, Homo sapiens
cgctcagtccccggggagcgggcactcgtcgccgcggcggcgtccggggctggcgttaccctggaggctgggacagagggtctcacggatggccccgctgccaggagcagaactggttcggaggccactgcagctctaccgatacttgctgcgctgttgccagcagctgccgaccaagggcatccagcagcattacaagcatgctgtcaggcagagttttcgggttcattcagatgaagacaaccctgagagaatccagcagattattaaaagagccattgaagatgctgactggatcatgaacaaatataaaaaacaaaactgagagctccgagggtgagccttcctggcctctggaagttgagaggcccctcttctggagctcagcagcagcagctggtttggaagatccattggccttgttggctgaaagccagaaatcaggggagaagctgaccttgctccagaggctcctcttgccgcggccatgttgctagcatcctttatgtttgcacttccagccacttacgatgtgaaatttggggagaatgtagtatttttttgcttcttttgtgtgttttttatttttgtgtttttgttcttttacttttctctgaaagtgattcatttattctggagatctctttatcattctctgagtcccagagcagatgtcccctcaggtagcaacctgtacagaagaaagcacgtgggttttagaaccagacagatctggatttgaatcccagatgcaataagatgaaggtgaagtgcctcacacaggatgtggcacatgacagtgcctgaagggctcccttcaaggaagccgtcctgccccgccccctcctctgctcctgcagcgccctgcacagctctgctccccgcatgcaccgcatcgggtctcagttttttgtttgcgagcttgccctgtccctgcttgtagcccctgagccctcacagttgtcacacacccagcagtctgccaaggagctgcttttcctgactactgtctctccatgcctagggaagtcaaagccctgggccttgccttcagggagttgacagtgtccttgaagtggtgaagtgcccaccacatgaaccaaggagagacgccaaagcagctgccatggactctggcctgtccaagcctctgtgcacctgcagtctctttccactggcacttccctgctttgctaccatcgtggaagaatggaagggagggggagaaggtgggtgggctcagggagaacggccagagtggccagaagatgcagagagaagccccactgggatctgagtattccccaagggcactcagccacagggatgaactagtgtttgtttgtatccttgcagttatgtgacttaaagtgactcagagatatctatgtatgcgagtgtactccgctggcaatgaagtaaatatatcaatttgtggaaaaaaaaaaaaaaaaaaaaacaaagaaacaatacaaaaaaacaaagaaagacgaggggggggccgcgccactaaaaatatacccccggagggggccccaaatttgggcgcttacaccacattttttttgtcaccgaggggcgcccctaatggggagcacagttatataaagctgaggcagcggtgcaccccaccttttttacacacaacagtggagagccgttggaaacaaactgtcacagcgtgggaacaactcgttggggagagaagaaaaacccattaattacttggggggggggggggggcaaaacataattttgggggacaccaattatcaccttcaaacaggaaaatttttaagaggcccctctgaggagagaacaatatgaaaacttctaagaggaggtaatagcggtcgttaaccacacaggagtagtgttattctcttggttgtctatgagaaatttggggactaacggaatatattctttgaaaaattttccc

SEQ ID NO: 330503 - DNA, 1491 bp, Homo sapiens
cgctcagtccccggggagcgggcactcgtcgccgcggcggcgtccggggctggcgttaccctggaggctgggacagagggtctcacggatggccccgctgccaggagcagaactggttcggaggccactgcagctctaccgatacttgctgcgctgttgccagcagctgccgaccaagggcatccagcagcattacaagcatgctgtcaggcagagttttcgggttcattcagatgaagacaaccctgagagaatccagcagattattaaaagagccattgaagatgctgactggatcatgaacaaatataaaaaacaaaactgagagctccgagggtgagccttcctggcctctggaagttgagaggcccctcttctggagctcagcagcagcagctggtttggaagatccattggccttgttggctgaaagccagaaatcaggggagaagctgaccttgctccagaggctcctcttgccgcggccatgttgctagcatcctttatgtttgcacttccagccacttacgatgtgaaatttggggagaatgtagtatttttttgcttcttttgtgtgttttttatttttgtgtttttgttcttttacttttctctgaaagtgattcatttattctggagatctctttatcattctctgagtcccagagcagatgtcccctcaggtagcaacctgtacagaagaaagcacgtgggttttagaaccagacagatctggatttgaatcccagatgcaataagatgaaggtgaagtgcctcacacaggatgtggcacatgacagtgcctgaagggctcccttcaaggaagccgtcctgccccgccccctcctctgctcctgcagcgccctgcacagctctgctccccgcatgcaccgcatcgggtctcagttttttgtttgcgagcttgccctgtccctgcttgtagcccctgagccctcacagttgtcacacacccagcagtctgccaaggagctgcttttcctgactactgtctctccatgcctagggaagtcaaagccctgggccttgccttcagggagttgacagtgtccttgaagtggtgaagtgcccaccacatgaaccaaggagagacgccaaagcagctgccatggactctggcctgtccaagcctctgtgcacctgcagtctctttccactggcacttccctgctttgctaccatcgtggaagaatggaagggagggggagaaggtgggtgggctcagggagaacggccagagtggccagaagatgcagagagaagccccactgggatctgagtattccccaagggcactcagccacagggatgaactagtgtttgtttgtatccttgcagttatgtgacttaaagtgactcagagatatctatgtatgcgagtgtactccgctggcaatgaagtaaatatatcaatttgtggaagctcgtgtgtcttctcaactgataaaccatacgttccctaagcaaaaaatg

SEQ ID NO: 330504 - DNA, 2769 bp, Homo sapiens
agaaaaaggctctggagccagactgccagagttcaaatccaagctccagctttattagctgtgtgatcttgggcaagttatcagacctctctgtgaccggttttcttatgtgtgcattaatcacatgtaaagtgaatagagacaaacaagtgctcattgtgattctctctctttttttttttttttgagttggagtcttgctttgtcacccaggctggagtgcagtcgtactatcttggctcactgccatttccacttctggggtttaagtgatcctcctgcctcagcctcccaagtagctgggattacaggcatgcaccactaagcctggctaatttttgtatttttagtagagacggggtttcaccgtgttggccatgctggtctcaaactcctgaccttaagtgatctgccctacttaaaggcgtgagccactacgcccagcccattgtgatttttatgataactcatagtgaaatgaaatcacgtgcccacgctgtggtgactctgtccagcaacttctctgcagagccccctagattcatgcttctcagactttaaaatgtgcctgcaaatctcctggcatccttgttaaaatgcaggtttgatctggtgggtctttggggtggggcccaagactacatttgtgatgagctcccgatgctgtgggttttgctggttcaggagcacactttgaatttcaaggctcaggcctgtaggcattctcccctctgtggcttggtgccctcgccagaccatggctgatgtcagagctggtttcctagtgattgcccctcagggtcttcctgcttttctaccctaccctgccggtgagggacacctactcatgcaccacttgaagttgagttccagaaagaagacgccagggatgaggctggacagagggtctcacggatggccccgctgccaggagcagaactggttcggaggccactgcagctctaccgatacttgctgcgctgttgccagcagctgccgaccaagggcatccagcagcattacaagcatgctgtcaggcagagttttcgggttcattcagatgaagacaaccctgagagaatccagcagattattaaaagagccattgaagatgctgactggatcatgaacaaatataaaaaacaaaactgagagctccgagggtgagccttcctggcctctggaagttgagaggcccctcttctggagctcagcagcagcagctggtttggaagatccattggccttgttggctgaaagccagaaatcaggggagaagctgaccttgctccagaggctcctcttgccgcggccatgttgctagcatcctttatgtttgcacttccagccacttacgatgtgaaatttggggagaatgtagtatttttttgcttcttttgtgtgttttttatttttgtgtttttgttcttttacttttctctgaaagtgattcatttattctggagatctctttatcattctctgagtcccagagcagatgtcccctcaggtagcaacctgtacagaagaaagcacgtgggttttagaaccagacagatctggatttgaatcccagatgcaataagatgaaggtgaagtgcctcacacaggatgtggcacatgacagtgcctgaagggctcccttcaaggaagccgtcctgccccgccccctcctctgctcctgcagcgccctgcacagctctgctccccgcatgcaccgcatcgggtctcagttttttgtttgcgagcttgccctgtccctgcttgtagcccctgagccctcacagttgtcacacacccagcagtctgccaaggagctgcttttcctgactactgtctctccatgcctagggaagtcaaagccctgggccttgccttcagggagttgacagtgtccttgaagtggtgaagtgcccaccacatgaaccaaggagagacgccaaagcagctgccatggactctggcctgtccaagcctctgtgcacctgcagtctctttccactggcacttccctgctttgctaccatcgtggaagaatggaagggagggggagaaggtgggtgggctcagggagaacggccagagtggccagaagatgcagagagaagccccactgggatctgagtattccccaagggcactcagccacagggatgaactagtgtttgtttgtatccttgcagttatgtgacttaaagtgactcagagatatctatgtatgcgagtgtactccgctggcaatgaagtaaatatatcaatttgtggaaaaaaaaaaaaaaaaaaaaacaaagaaacaatacaaaaaaacaaagaaagacgaggggggggccgcgccactaaaaatatacccccggagggggccccaaatttgggcgcttacaccacattttttttgtcaccgaggggcgcccctaatggggagcacagttatataaagctgaggcagcggtgcaccccaccttttttacacacaacagtggagagccgttggaaacaaactgtcacagcgtgggaacaactcgttggggagagaagaaaaacccattaattacttggggggggggggggggcaaaacataattttgggggacaccaattatcaccttcaaacaggaaaatttttaagaggcccctctgaggagagaacaatatgaaaacttctaagaggaggtaatagcggtcgttaaccacacaggagtagtgttattctcttggttgtctatgagaaatttggggactaacggaatatattctttgaaaaattttccc

SEQ ID NO: 330505 - DNA, 1364 bp, Homo sapiens
cgctcagtccccggggagcgggcactcgtcgccgcggcggcgtccggggctggcgttaccctggaggctgggacagagggtctcacggatggccccgctgccaggagcagaactggttcggaggccactgcagctctaccgatacttgctgcgctgttgccagcagctgccgaccaagggcatccagcagcattacaagcatgctgtcaggcagagttttcgggttcattcagatgaagacaaccctgagagaatccagcagattattaaaagagccattgaagatgctgactggatcatgaacaaatataaaaaacaaaactgagagctccgagggtgagccttcctggcctctggaagttgagaggcccctcttctggagctcagcagcagcagctggtttggaagatccattggccttgttggctgaaagccagaaatcaggggagaagctgaccttgctccagaggctcctcttgccgcggccatgttgctagcatcctttatgtttgcacttccagccacttacgatgtgaaatttggggagaatgtagtatttttttgcttcttttgtgtgttttttatttttgtgtttttgttcttttacttttctctgaaagtgattcatttattctggagatctctttatcattctctgagtcccagagcagatgtcccctcaggtagcaacctgtacagaagaaagcacgtgggttttagaaccagacagatctggatttgaatcccagatgcaataagatgaaggtgaagtgcctcacacaggatgtggcacatgacagtgcctgaagggctcccttcaaggaagccgtcctgccccgccccctcctctgctcctgcagcgccctgcacagctctgctccccgcatgcaccgcatcgggtctcagttttttgtttgcgagcttgccctgtccctgcttgtagcccctgagccctcacagttgtcacacacccagcagtctgccaaggagctgcttttcctgactactgtctctccacatgaaccaaggagagacgccaaagcagctgccatggactctggcctgtccaagcctctgtgcacctgcagtctctttccactggcacttccctgctttgctaccatcgtggaagaatggaagggagggggagaaggtgggtgggctcagggagaacggccagagtggccagaagatgcagagagaagccccactgggatctgagtattccccaagggcactcagccacagggatgaactagtgtttgtttgtatccttgcagttatgtgacttaaagtgactcagagatatctatgtatgcgagtgtactccgctggcaatgaagtaaatatatcaatttgtggaa

SEQ ID NO: 330506 - DNA, 2005 bp, Homo sapiens
cgctcagtccccggggagcgggcactcgtcgccgcggcggcgtccggggctggcgttaccctggaggctgggacagagggtctcacggatggccccgctgccaggagcagaactggttcggaggccactgcagctctaccgatacttgctgcgctgttgccagcagctgccgaccaagggcatccagcagcattacaagcatgctgtcaggcagagttttcgggttcattcagatgaagacaaccctgagagaatccagcagattattaaaagagccattgaagatgctgactggatcatgaacaaattgagaatggtccctgtggaggaggccaccagccagctgcttccctcctccagaagctgaaagtataaaaaacaaaactgagagctccgagggtgagccttcctggcctctggaagttgagaggcccctcttctggagctcagcagcagcagctggtttggaagatccattggccttgttggctgaaagccagaaatcaggggagaagctgaccttgctccagaggctcctcttgccgcggccatgttgctagcatcctttatgtttgcacttccagccacttacgatgtgaaatttggggagaatgtagtatttttttgcttcttttgtgtgttttttatttttgtgtttttgttcttttacttttctctgaaagtgattcatttattctggagatctctttatcattctctgagtcccagagcagatgtcccctcaggtagcaacctgtacagaagaaagcacgtgggttttagaaccagacagatctggatttgaatcccagatgcaataagatgaaggtgaagtgcctcacacaggatgtggcacatgacagtgcctgaagggctcccttcaaggaagccgtcctgccccgccccctcctctgctcctgcagcgccctgcacagctctgctccccgcatgcaccgcatcgggtctcagttttttgtttgcgagcttgccctgtccctgcttgtagcccctgagccctcacagttgtcacacacccagcagtctgccaaggagctgcttttcctgactactgtctctccatgcctagggaagtcaaagccctgggccttgccttcagggagttgacagtgtccttgaagtggtgaagtgcccaccacatgaaccaaggagagacgccaaagcagctgccatggactctggcctgtccaagcctctgtgcacctgcagtctctttccactggcacttccctgctttgctaccatcgtggaagaatggaagggagggggagaaggtgggtgggctcagggagaacggccagagtggccagaagatgcagagagaagccccactgggatctgagtattccccaagggcactcagccacagggatgaactagtgtttgtttgtatccttgcagttatgtgacttaaagtgactcagagatatctatgtatgcgagtgtactccgctggcaatgaagtaaatatatcaatttgtggaaaaaaaaaaaaaaaaaaaaacaaagaaacaatacaaaaaaacaaagaaagacgaggggggggccgcgccactaaaaatatacccccggagggggccccaaatttgggcgcttacaccacattttttttgtcaccgaggggcgcccctaatggggagcacagttatataaagctgaggcagcggtgcaccccaccttttttacacacaacagtggagagccgttggaaacaaactgtcacagcgtgggaacaactcgttggggagagaagaaaaacccattaattacttggggggggggggggggcaaaacataattttgggggacaccaattatcaccttcaaacaggaaaatttttaagaggcccctctgaggagagaacaatatgaaaacttctaagaggaggtaatagcggtcgttaaccacacaggagtagtgttattctcttggttgtctatgagaaatttggggactaacggaatatattctttgaaaaattttccc

SEQ ID NO: 330507 - DNA, 1440 bp, Homo sapiens
cgctcagtccccggggagcgggcactcgtcgccgcggcggcgtccggggctggcgttaccctggaggctgggacagagggtctcacggatggccccgctgccaggagcagaactggttcggaggccactgcagctctaccgatacttgctgcgctgttgccagcagctgccgaccaagggcatccagcagcattacaagcatgctgtcaggcagagttttcgggttcattcagatgaagacaaccctgagagaatccagcagattattaaaagagccattgaagatgctgactggatcatgaacaaatataaaaaacaaaactgagagctccgagggtgagccttcctggcctctggaagttgagaggcccctcttctggagctcagcagcagcagctggtttggaagatccattggccttgttggctgaaagccagaaatcaggggagaagctgaccttgctccagaggctcctcttgccgcggccatgttgctagcatcctttatgtttgcacttccagccacttacgatgtgaaatttggggagaatgtagtatttttttgcttcttttgtgtgttttttatttttgtgtttttgttcttttacttttctctgaaagtgattcatttattctggagatctctttatcattctctgagtcccagagcagatgtcccctcaggtagcaacctgtacagaagaaagcacgtgggttttagaaccagacagatctggatttgaatcccagatgcaataagatgaaggtgaagtgcctcacacaggatgtggcacatgacagtgcctgaagggctcccttcaaggaagccgtcctgccccgccccctcctctgctcctgcagcgccctgcacagctctgctccccgcatgcaccgcatcgggtctcagttttttgtttgcgagcttgccctgtccctgcttgtagcccctgagccctcacagttgtcacacacccagcagtctgccaaggagctgcttttcctgactactgtctctccatgcctagggaagtcaaagccctgggccttgccttcagggagttgacagtgtccttgaagtggtgaagtgcccaccacatgaaccaaggagagacgccaaagcagctgccatggactctggcctgtccaagcctctgtgcacctgcagtctctttccactggcacttccctgctttgctaccatcgtggaagaatggaagggagggggagaaggtgggtgggctcagggagaacggccagagtggccagaagatgcagagagaagccccactgggatctgagtattccccaagggcactcagccacagggatgaactagtgtttgtttgtatccttgcagttatgtgacttaaagtgactcagagatatctatgtatgcgagtgtactccgctggcaatgaagtaaatatatcaatttgtggaa

SEQ ID NO: 330508 - DNA, 1336 bp, Homo sapiens
  misc_feature (1233)..(1233): n is a, c, g, or t
cgctcagtccccggggagcgggcactcgtcgccgcggcggcgtccggggctggcgttaccctggaggctgggacagagggtctcacggatggccccgctgccaggagcagaactggttcggaggccactgcagctctaccgatacttgctgcgctgttgccagcagctgccgaccaagggcatccagcagcattacaagcatgctgtcaggcagagttttcgggttcattcagatgaagacaaccctgagagaatccagcagattattaaaagagccattgaagatgctgactggatcatgaacaaatataaaaaacaaaactgagagctccgagggtgagccttcctggcctctggaagttgagaggcccctcttctggagctcagcagcagcagctggtttggaagatccattggccttgttggctgaaagccagaaatcaggggagaagctgaccttgctccagaggctcctcttgccgcggccatgttgctagcatcctttatgtttgcacttccagccacttacgatgtgaaatttggggagaatgtagtatttttttgcttcttttgtgtgttttttatttttgtgtttttgttcttttacttttctctgaaagtgattcatttattctggagatctctttatcattctctgagtcccagagcagatgtcccctcaggtagcaacctgtacagaagaaagcacgtgggttttagaaccagacagatctggatttgaatcccagatgcaataagatgaaggtgaagtgcctcacacaggatgtggcacatgacagtgcctgaagggctcccttcaaggaagccgtcctgccccgccccctcctctgctcctgcagcgccctgcacagctctgctccccgcatgcaccgcatcgggtctcagttttttgtttgcgagcttgccctgtccctgcttgtagcccctgagccctcacagttgtcacacacccagcagtctgccaaggagctgcttttcctgactactgtctctccatgcctagggaagtcaaagccctgggccttgccttcagggagttgacagtgtccttgaagtggtgaagtgcccaccacatgaaccaaggagagacgccaaagcagctgccatggactctggcctgtccaagcctctgtgcacctgcagtctctttccactggcacttccctgctttgctaccatcgtggaagaatggaagggagggggagaatgttncttatacccctggtctccttgccccttttcctctctttgccttctcttaaggccctctttaagccctaaataattctaattatctgagtgtcttgtcttttag

SEQ ID NO: 330509 - DNA, 1882 bp, Homo sapiens
cgctcagtccccggggagcgggcactcgtcgccgcggcggcgtccggggctggcgttaccctggaggctgggacagagggtctcacggatggccccgctgccaggagcagaactggttcggaggccactgcagctctaccgatacttgctgcgctgttgccagcagctgccgaccaagggcatccagcagcattacaagcatgctgtcaggcagagttttcgggttcattcagatgaagacaaccctgagagaatccagcagattattaaaagagccattgaagatgctgactggatcatgaacaaatataaaaaacaaaactgagagctccgagggtgagccttcctggcctctggaagttgagaggcccctcttctggagctcagcagcagcagctggtttggaagatccattggccttgttggctgaaagccagaaatcaggggagaagctgaccttgctccagaggctcctcttgccgcggccatgttgctagcatcctttatgtttgcacttccagccacttacgatgtgaaatttggggagaatgtagtatttttttgcttcttttgtgtgttttttatttttgtgtttttgttcttttacttttctctgaaagtgattcatttattctggagatctctttatcattctctgagtcccagagcagatgtcccctcaggtagcaacctgtacagaagaaagcacgtgggttttagaaccagacagatctggatttgaatcccagatgcaataagatgaaggtgaagtgcctcacacaggatgtggcacatgacagtgccctgcacagctctgctccccgcatgcaccgcatcgggtctcagttttttgtttgcgagcttgccctgtccctgcttgtagcccctgagccctcacagttgtcacacacccagcagtctgccaaggagctgcttttcctgactactgtctctccatgcctagggaagtcaaagccctgggccttgccttcagggagttgacagtgtccttgaagtggtgaagtgcccaccacatgaaccaaggagagacgccaaagcagctgccatggactctggcctgtccaagcctctgtgcacctgcagtctctttccactggcacttccctgctttgctaccatcgtggaagaatggaagggagggggagaaggtgggtgggctcagggagaacggccagagtggccagaagatgcagagagaagccccactgggatctgagtattccccaagggcactcagccacagggatgaactagtgtttgtttgtatccttgcagttatgtgacttaaagtgactcagagatatctatgtatgcgagtgtactccgctggcaatgaagtaaatatatcaatttgtggaaaaaaaaaaaaaaaaaaaaacaaagaaacaatacaaaaaaacaaagaaagacgaggggggggccgcgccactaaaaatatacccccggagggggccccaaatttgggcgcttacaccacattttttttgtcaccgaggggcgcccctaatggggagcacagttatataaagctgaggcagcggtgcaccccaccttttttacacacaacagtggagagccgttggaaacaaactgtcacagcgtgggaacaactcgttggggagagaagaaaaacccattaattacttggggggggggggggggcaaaacataattttgggggacaccaattatcaccttcaaacaggaaaatttttaagaggcccctctgaggagagaacaatatgaaaacttctaagaggaggtaatagcggtcgttaaccacacaggagtagtgttattctcttggttgtctatgagaaatttggggactaacggaatatattctttgaaaaattttccc

SEQ ID NO: 330510 - DNA, 414 bp, Homo sapiens
ctgggaattgggatttggggaagactgggcagctgagcttacagcactctggtgaccatgactcaacacccccacctccaacccctagaagggccatgaacctggcgatgatgccaacaccagggggaccacttctctggtagccttcaacccgatctcttccaaccagcaagaaacatcctccaaacacaaggcacgtgagatacctctttaaacaagccctcagtcctccggtctagtaatcgtgggatatatcccgagagtctggtcctgattttatgtgactccccagagaccttttgcttgttgggtccctcgccctgctctgaaggctggtttcatttctggtagttagaaaacgggcctacttaagaagagaaactaagcacccagctccaatgcccaggtaaggcc

SEQ ID NO: 330511 - DNA, 277 bp, Homo sapiens
catcctatttgacaccactgcttatttgtatcagaaaattggaatgtaccaaagggattcagaaatgagaaaatgcccagtaggtaggagaaattggagaaagtcccgagaaggaagcaataaatgagttcatgcttgaagggtgaaggggaagagtgagggatcatatattttgggtaaagaggaggaagcaaggacaagaatgtttgggaaggagagagtagttgagtttggctgcagcagaggagccaaagactggagaagtacatggggtgtg

SEQ ID NO: 330512 - DNA, 319 bp, Homo sapiens
ggtattgatgaagagggggaaaatgagaaagggatgaaaagataataatttgatgaaaagaaaaggatgaaaagaggaacaactataaaacaagggatggagataggaaagatagacaagtgattctaatatattggcatcaattgttggagacagtggatcatatgatacaagccatataaaggtaaaaagaccagctcctgatcccaaggtgctttgagtcttacgtgtacagcacacactatattatctttattaaatggtctacattctcatcttgagcatgaaattattctattttagtctgatcacaaaatcc

SEQ ID NO: 330513 - DNA, 523 bp, Homo sapiens
ccatagtttcccaaaacccataatttggcaattatacttctgtttgtattcaactcattgatttaaatgaccaatcagaactggttttgctttgctggtaaagaataggaaaagtatgaagcaaaatttcatggggctagtttaatatacattattttcttcttttataaatttggaaaaaatttgatgtagacactagaaatctataaaggaaataggatatttgatttctagttcctaaattgttatgctatctggcaagctataaaatctctgtgccttaccttcttaaccttcttaatttctaaaattaaaaggctgctatactatcatcttgaaggataagttggcaatgccacttaaaatgtaaaatgcatttacgcttccctatgtatcccaaagaaggccaatacttatgcacaaggaggtgtgtgcattccagcatcattggtaacagaaaaaaaattaaaacaagccaaatatccatttaaggagaaagtgaaaaaaatgatggcgcatccat

SEQ ID NO: 330514 - DNA, 210 bp, Homo sapiens
ttttaatcaaaacggtggcaggaatgtacttttaagaaatattctctgcaaaaaaaattctttccataatgttgcatacaccataggtcaaatcctgccattctccaatatcttatcaatatgccttaaaaattctgatctgctgggattagactgttaagtgagtgttggccctgtcattctagtgccaatatcaccaagaggtttgtg

SEQ ID NO: 330515 - DNA, 293 bp, Homo sapiens
ggatactcctggtacttttgttatgaaattcttatacattattttcagttactcatcagatagtttttcatcaattgcaaaattatattatccaaagctgaattgagatttgtgggaatcagaattttgatagagtgattaggaagatccctggtatacaaaagtgaaatgtatacctatcataatttattatataaagcatgtgtattgaatcatcaagaatagatggctcctactgggatcgattgtactttattatattttgccttttctataatttttagttgtgtcgt

SEQ ID NO: 330516 - DNA, 377 bp, Homo sapiens
ccattgaaagcttccatgtagagattttgtatgaacatggagattccaattataaacttatctgatccactattgtattggaaatcttcaagaacaccctcagatttgatgattcactaggaggactcagaaaactcagcacatagttgtactcatggccgtgctttatcacagcaaagggatataaagcaaaatcagcaaaggaaaaaggtacatggggcaatgtccagagaaaaccaggcgcaagtgtccaagtcttctcccagtggagtcacacaagacatacttacttcctccagcaatgaattaaaacaacatgtgtaaaatgctgtctccaaggttcttcttagggggtgatcacataagcaccctctgcc

SEQ ID NO: 330517 - DNA, 333 bp, Homo sapiens
tcccctttcaatttcttgagtcggcctgcaatcaaacctttgtaattaaaccctcaaagaacctgttgaaattattccagactagttattctaaaccagtttttactctccttttcaaatgtctagtatataatggattctcaatgaatgtgatagagatataacagtttagttcacatgcaaaatcatgagaaaacctatgaaaaacttaaggtctatacccaaagaatgctatatcaagtattatcccactcacaccaaatattcagctattaaatgattgatagtctgtgttaaggaagtttagaggctttttttcatattcactctaag

SEQ ID NO: 330518 - DNA, 2122 bp, Homo sapiens
ttttgtatttttagtagagatggggtttcaccatgttgggcaggctggtctgtgaactcctgaccttgtgatccgcccacctcggtctcccaaagtgctgggattacgagcgtgagccacggcgcccgaccccctaatcctgattttcgaagatatgacgcatgtatcctgcccccgcgagcgccgtcgcgccgtcgcgccacatacgtcacacgctcttcggaaagcgttgctgcgtaaatggcgggggcgtgtcttttggctcctccgcgtgtagttacctgagaaacgcgggaagttgggcccaggcagtgttgctgcggttgcctaagttgttttactatttctggagagagccgtgagcttgtccaggggccccaatcctgaggccgacccggtttctggcgcggtgcgatggaggtagtggaggccgccgccgctcagctggaaactctgaaattcaatggcaccgactttggagttggggaaggtccggcggctccgtctccgggctctgcccctgtgccagggacacagccgccgctacagtcgtttgaggggtccccggacgctgggcagaccgtggaggttaagcctgccggggagcagcctctgcagcccgttctgaacgccgtcgcggccgggaccccggcgccgcagccacagccaccggctgaatcgccggcctgcggagactgcgtcacctccccaggagccgcagagcctgcgcgggcgccggactccttggagacctcggactcggattcggactcggacagtgaaacagattcagatagttcaagttcatcgtcttcctcttcatcttcctcatcgtcgtcttcttcctcttgtatatcacttcctccagtgctgtcagatggagatgatgatttacaagttgagaaggaaaataagaattttcctcttaaaacaaaagatgaattacttcttaatgaactgccttctgttgaagaactcactattattctgcctgaagatattgagttaaagcctcttgggatggtttcaagtattattgaacaactagtaataattgaatctatgactaacctacctccagttaatgaggagactgtaatttttaaaagtgatcgacaagcagcaggaaagatattcgagatatttggacctgttgcacatccattttatgtgttacggtttaattcttcagatcacattgagagtaaaggtattaaaataaaggagactatgtattttgctccatcaatgaaagatttcactcaatatatattcacagaaaaactaaaacaggataagggatcagatgcatcatggaagaatgatcaggaaccaccaccagaggccttagattttagtgatgatgaaaaagagaaggaagccaaacagaggaaaaaatctcagattcaaggccggaaaaaactcaaatctgaatttaatgagcctggtgaagattttactgaagtacatcagaattggaatgctcatagctctgcttcagagcatgcaaaaggatatcgtaacagagaattcacacgaggattttccagggccagataccctcgatcttgccatggcaggcctccacctcagcatttctataactcagaacatatggtatctcaggagacttcaggatttccttctcagagacaaaataatcccattatgccacaatacccctttcctcttccagtgtttgacatgcataattttcccctccgccctccacccccaccaccacccccacctgtaaacatgggttgggctacaccaaacatggctgctcatccattacttaacttaccatactccctacccccaccccctccccctccaccactgcctcctccaccctcttctggagatagtaattctcattttggaccttactattaggtgactatgcatttccagagaaatgtggacttttcatattatgtggtaaggattttttttttttcaagagtgattatggagctagatttttaaaaacactgtaaaatactaaatgattccttctgttgtaagttgatatatatttgtaacctttgtgaaattgtattcatatgaaaatgtcagctcaaattcttgggagaacattaaattatgtaatatttaa

SEQ ID NO: 330519 - DNA, 1072 bp, Homo sapiens
actgaaagttctttatataattttactttagaaagtcatcaatttactgatactcttttttgctcaataagccttcacaaatgcttgaaaagtcaacagtgttgtaaattataaatgttaccttttcagagggccacttttgacatattagcttcttccatttttgcattgaaagttttaggcacccattttttgactggtatgtctataacctcatttttaataggatggatttttaatgttatgtggtactcttttgaatattttgcttaactgaataaccttgtagaccatacagatgttagaaaattaaaatataataatcttacaaaacagacaataattgctctttcatggatattccagaagtgtggttaggatcttgcatttctttaatgccatcgttacgagtatctgttatcacagaagcacagtaatttttttattgggatctagtatataatttctgtattaatgtgttgtctttttgattacatgcagttggacatttaaattgtcgttagccatttgtgtaactgtttagaacttgtgctcagtttccttactattcgtaggtaagaaaaatgaaaccagaaagaaagagacttgtctgaagtcatattagtggggaggagcagatctgaactggtaatagatacattccaaactgctgtgtttttagtatttgtggagacctgcatagcaacgttggaatctggtcgtttggactttctcattatttggtttctgaataatcatgtagcatattttctcaaagtgaaggatgaatgtatcatctaatgtaagctttttaaaattgtatttgcttggattatattgcctctcaataaagcttttgacttggaactgtgtagtgtgtgggaaataaatggtggagcttctttagtatgttgaattttagtagttcatttgcgaaatgctgtggtgtttggggatgtttatttccatgcaagcttttcatttgctaatgatgtgaatgaaatagttttcttcctttcctttcctactctttgttatgtgtagaagtattgaataaatgagtccagaaaaa

SEQ ID NO: 330520 - DNA, 569 bp, Homo sapiens
ccttgttactgctggatgagggtagaagttctgacatcccacgaggtcttatgcctggtagggacaggagtactttgtcactcctccccatatggtatgcactgacaccagtggaggatggccttgttatcactggttggggacaaaaatcctaactctactccatcttctctgacattgccccagtgtaaaagagggaagaacactgggttgccgccagtggaggtggaagttcaggttccccatgtgatgttcattgtttgcagggaggcttgttactggcaccctgttcagcctgttcctgatgctactgtggtggaagggttggagtacctcattactgcctgtcaaggatagaagtctaggatctgtactcagcctttgagagtgtgtagggatggtgccacattttcttctgtggtgtttggctagagtagaatggttatcatctaagtgttttctgacttgctgggttctctttctttggcattaagttttgtcttttcagttcatttcaaatttaccattttatgtcttacacttttttaactgccacaagatatactgga

SEQ ID NO: 330521 - DNA, 383 bp, Homo sapiens
tccccttttctaattgattctcttttccctgtctcttaaggtaggagggtcacagagttcatgcttgatccatttatgttttttatgtacacatttctcttccagacacttggactcagaaatgcacaaactccctgacatctttatttaaatgactaatagaccatggttgactgaaggtaactgaaaccacgaaaagtgacagcacagatgaggggagagtactgtatcctcaaatgatggtatggctggtgatggtaacagcaagtctaccagcctagtcaagcattcttatccatagaagagttgccatgggaacctcatggcaacccacagatttcaagtactgtatgttctgcctaaataaataatgaaaagctatc

SEQ ID NO: 330522 - DNA, 2964 bp, Homo sapiens
ttttgtatttttagtagagatggggtttcaccatgttgggcaggctggtctgtgaactcctgaccttgtgatccgcccacctcggtctcccaaagtgctgggattacgagcgtgagccacggcgcccgaccccctaatcctgattttcgaagatatgacgcatgtatcctgcccccgcgagcgccgtcgcgccgtcgcgccacatacgtcacacgctcttcggaaagcgttgctgcgtaaatggcgggggcgtgtcttttggctcctccgcgtgtagttacctgagaaacgcgggaagttgggcccaggcagtgttgctgcggttgcctaagttgttttactatttctggagagagccgtgagcttgtccaggggccccaatcctgaggccgacccggtttctggcgcggtgcgatggaggtagtggaggccgccgccgctcagctggaaactctgaaattcaatggcaccgactttggagttggggaaggtccggcggctccgtctccgggctctgcccctgtgccagggacacagccgccgctacagtcgtttgaggggtccccggacgctgggcagaccgtggaggttaagcctgccggggagcagcctctgcagcccgttctgaacgccgtcgcggccgggaccccggcgccgcagccacagccaccggctgaatcgccggcctgcggagactgcgtcacctccccaggagccgcagagcctgcgcgggcgccggactccttggagacctcggactcggattcggactcggacagtgaaacagattcagatagttcaagttcatcgtcttcctcttcatcttcctcatcgtcgtcttcttcctcttgtatatcacttcctccagtgctgtcagatggagatgatgatttacaagttgagaaggaaaataagaattttcctcttaaaacaaaagatgaattacttcttaatgaactgccttctgttgaagaactcactattattctgcctgaagatattgagttaaagcctcttgggatggtttcaagtattattgaacaactagtaataattgaatctatgactaacctacctccagttaatgaggagactgtaatttttaaaagtgatcgacaagcagcaggaaagatattcgagatatttggacctgttgcacatccattttatgtgttacggtttaattcttcagatcacattgagagtaaaggtattaaaataaaggagactatgtattttgctccatcaatgaaagatttcactcaatatatattcacagaaaaactaaaacaggataagggatcagatgcatcatggaagaatgatcaggaaccaccaccagaggccttagattttagtgatgatgaaaaagagaaggaagccaaacagaggaaaaaatctcagattcaaggccggaaaaaactcaaatctgaatttaatgagcctggtgaagattttactgaagtacatcagaattggaatgctcatagctctgcttcagagcatgcaaaaggatatcgtaacagagaattcacacgaggattttccagggccagataccctcgatcttgccatggcaggcctccacctcagcatttctataactcagaacatatggtatctcaggagacttcaggatttccttctcagagacaaaataatcccattatgccacaatacccctttcctcttccagtgtttgacatgcataattttcccctccgccctccacccccaccaccacccccacctgtaaacatgggttgggctacaccaaacatggctgctcatccattacttaacttaccatactccctacccccaccccctccccctccaccactgcctcctccaccctcttctggagatagtaattctcattttggaccttactattaggtgactatgcatttccagagaaatgtggacttttcatattatgtggtaaggattttttttttttcaagagtgattatggagctagatttttaaaaacactgtaaaatactaaatgattccttctgttgtaagttgatatatatttgtaacctttgtgaaattgtattcatatgaaaatgtcagctcaaattcttgggagaacattaaattatgtaatatttaattaaaattttgaattcatgccttctccctcccaaccccacccagttaaactatatatatatatatatagtaatggatatgggacaagtttcatcatgggtaaaatatatggagcacattgattttcttgctataatctgaatataagatgaagtcctttgagagtctttaaactatttttataaatttatactttggaaatcaattttaattataaatgtaatttgtgagtaagtttaaatgaccataatttttctttttaaagcagttgagggatatagaggagaaaattcttatatattggtagaagctctgattatagctaaagtaaaaaatatttattatgcataggcaagcttccattatctgtgcaaaataattcctttatttgggcactgttcagaaggctttactatttaacctcctaaaagggatgcaaagattattcacaataagatctatttagggattttgtcttccatatttgttttccagatcctcacatgcagactaggttccataaataacaaatagttattgaatatctgaattaagagtttttaattaaatgagtaatgactactgctttatattatgaagtgtcaatgtaagggaaattatgagttttagaactagaagagaccattgaaatactccagttttcatttagtaaatgaggagcctaagtgttccaaagaggttaaaataatttaactaagatcactcagctagtgagttgacaaggagttgaacctagttcttctggttttcttattagcagtttccactaagtagatgtttcccaatcttacattcctttacacacttaggaaacagtatttg

SEQ ID NO: 330523 - DNA, 1565 bp, Homo sapiens
ttttgtatttttagtagagatggggtttcaccatgttgggcaggctggtctgtgaactcctgaccttgtgatccgcccacctcggtctcccaaagtgctgggattacgagcgtgagccacggcgcccgaccccctaatcctgattttcgaagatatgacgcatgtatcctgcccccgcgagcgccgtcgcgccgtcgcgccacatacgtcacacgctcttcggaaagcgttgctgcgtaaatggcgggggcgtgtcttttggctcctccgcgtgtagttacctgagaaacgcgggaagttgggcccaggcagtgttgctgcggttgcctaagttgttttactatttctggagagagccgtgagcttgtccaggggccccaatcctgaggccgacccggtttctggcgcggtgcgatggaggtagtggaggccgccgccgctcagctggaaactctgaaattcaatggcaccgactttggagttggggaaggtccggcggctccgtctccgggctctgcccctgtgccagggacacagccgccgctacagtcgtttgaggggtccccggacgctgggcagaccgtggaggttaagcctgccggggagcagcctctgcagcccgttctgaacgccgtcgcggccgggaccccggcgccgcagccacagccaccggctgaatcgccggcctgcggagactgcgtcacctccccaggagccgcagagcctgcgcgggcgccggactccttggagacctcggactcggattcggactcggacagtgaaacagattcagatagttcaagttcatcgtcttcctcttcatcttcctcatcgtcgtcttcttcctcttgtatatcacttcctccagtgctgtcagatggagatgatgatttacaagttgagaaggaaaataagaattttcctcttaaaacaaaagatgaattacttcttaatgaactgccttctgttgaagaactcactattattctgcctgaagatattgagttaaagcctcttgggatggtttcaagtattattgaacaactagtaataattgaatctatgactaacctacctccagttaatgaggagactgtaatttttaaaagtgatcgacaagcagcaggaaagatattcgagatatttggacctgttgcacatccattttatgtgttacggtttaattcttcagatcacattgagagtaaaggtattaaaataaaggagactatgtattttgctccatcaatgaaagatttcactcaatatatattcacagaaaaactaaaacaggataagggatcagatgcatcatggaagaatgatcaggaaccaccaccagagaccatggttgactgaaggtaactgaaaccacgaaaagtgacagcacagatgaggggagagtactgtatcctcaaatgatggtatggctggtgatggtaacagcaagtctaccagcctagtcaagcattcttatccatagaagagttgccatgggaacctcatggcaacccacagatttcaagtactgtatgttctgcctaaataaataatgaaaagctatc

SEQ ID NO: 330524 - DNA, 395 bp, Homo sapiens
tgtggtggaagggttggagtacctcattactgcctgtcaaggatagaagtctaggatctgtactcagcctttgagagtgtgtagggatggtgccacattttcttctgtggtgtttggctagagtagaatggttatcatctaagtgttttctgacttgctgggttctctttctttggcattaagttttgtcttttcagttcatttcaaatttaccattttatgtcttacacttttttaactgccacaagatatactggataataaaaatcataattgaaatttcaaacaatgctttttgatatattaaacttattttcctttttatgttttccctcccctcactcaaaggtgaagattttactgaagtacatcagaattggaatgctcatagctct

SEQ ID NO: 330525 - DNA, 202 bp, Homo sapiens
gactatgcatttccagagaaatgtggacttttcatattatgtggtaaggattttttttttttcaagagtgattatggagctagatttttaaaaacactgtaaaatactaaatgattccttctgttgtaagttgatatatatttgtaacctttgtgaaattgtattcatatgaaaatgtcagctcaaattcttgggagaacat

SEQ ID NO: 330526 - DNA, 1555 bp, Homo sapiens
ttttgtatttttagtagagatggggtttcaccatgttgggcaggctggtctgtgaactcctgaccttgtgatccgcccacctcggtctcccaaagtgctgggattacgagcgtgagccacggcgcccgaccccctaatcctgattttcgaagatatgacgcatgtatcctgcccccgcgagcgccgtcgcgccgtcgcgccacatacgtcacacgctcttcggaaagcgttgctgcgtaaatggcgggggcgtgtcttttggctcctccgcgtgtagttacctgagaaacgcgggaagttgggcccaggcagtgttgctgcggttgcctaagttgttttactatttctggagagagccgtgagcttgtccaggggccccaatcctgaggccgacccggtttctggcgcggtgcgatggaggtagtggaggccgccgccgctcagctggaaactctgaaattcaatggcaccgactttggagttggggaaggtccggcggctccgtctccgggctctgcccctgtgccagggacacagccgccgctacagtcgtttgaggggtccccggacgctgggcagaccgtggaggttaagcctgccggggagcagcctctgcagcccgttctgaacgccgtcgcggccgggaccccggcgccgcagccacagccaccggctgaatcgccggcctgcggagactgcgtcacctccccaggagccgcagagcctgcgcgggcgccggactccttggagacctcggactcggattcggactcggacagtgaaacagattcagatagttcaagttcatcgtcttcctcttcatcttcctcatcgtcgtcttcttcctcttgtatatcacttcctccagtgctgtcagatggagatgatgatttacaagttgagaaggaaaataagaattttcctcttaaaacaaaagatgaattacttcttaatctatagagaaaaaaaaaaattcagtcatggctctcagtactccagggattggatcctactttccaaccatatctgaaaagtgaaggctcacctaatagcatcaggtaagaaaaatgaaaccagaaagaaagagacttgtctgaagtcatattagtggggaggagcagatctgaactggtaatagatacattccaaactgctgtgtttttagtatttgtggagacctgcatagcaacgttggaatctggtcgtttggactttctcattatttggtttctgaataatcatgtagcatattttctcaaagtgaaggatgaatgtatcatctaatgtaagctttttaaaattgtatttgcttggattatattgcctctcaataaagcttttgacttggaactgtgtagtgtgtgggaaataaatggtggagcttctttagtatgttgaattttagtagttcatttgcgaaatgctgtggtgtttggggatgtttatttccatgcaagcttttcatttgctaatgatgtgaatgaaatagttttcttcctttcctttcctactctttgttatgtgtagaagtattgaataaatgagtccagaaaaa

SEQ ID NO: 330527 - DNA, 2821 bp, Homo sapiens
ttttgtatttttagtagagatggggtttcaccatgttgggcaggctggtctgtgaactcctgaccttgtgatccgcccacctcggtctcccaaagtgctgggattacgagcgtgagccacggcgcccgaccccctaatcctgattttcgaagatatgacgcatgtatcctgcccccgcgagcgccgtcgcgccgtcgcgccacatacgtcacacgctcttcggaaagcgttgctgcgtaaatggcgggggcgtgtcttttggctcctccgcgtgtagttacctgagaaacgcgggaagttgggcccaggcagtgttgctgcggttgcctaagttgttttactatttctggagagagccgtgagcttgtccaggggccccaatcctgaggccgacccggtttctggcgcggtgcgatggaggtagtggaggccgccgccgctcagctggaaactctgaaattcaatggcaccgactttggagttggggaaggtccggcggctccgtctccgggctctgcccctgtgccagggacacagccgccgctacagtcgtttgaggggtccccggacgctgggcagaccgtggaggttaagcctgccggggagcagcctctgcagcccgttctgaacgccgtcgcggccgggaccccggcgccgcagccacagccaccggctgaatcgccggcctgcggagactgcgtcacctccccaggagccgcagagcctgcgcgggcgccggactccttggagacctcggactcggattcggactcggacagtgaaacagattcagatagttcaagttcatcgtcttcctcttcatcttcctcatcgtcgtcttcttcctcttgtatatcacttcctccagtgctgtcagatggagatgatgatttacaagttgagaaggaaaataagaattttcctcttaaaacaaaagatgaattacttcttaatgaactgccttctgttgaagaactcactattattctgcctgaagatattgagttaaagcctcttgggatggtttcaagtattattgaacaactagtaataattgaatctatgactaacctacctccagttaatgaggagactgtaatttttaaaagtgatcgacaagcagcaggaaagatattcgagatatttggacctgttgcacatccattttatgtgttacggtttaattcttcagatcacattgagagtaaaggtattaaaataaaggagactatgtattttgctccatcaatgaaagatttcactcaatatatattcacagaaaaactaaaacaggataagggatcagatgcatcatggaagaatgatcaggaaccaccaccagaggccttagattttagtgatgatgaaaaagagaaggaagccaaacagaggaaaaaatctcagattcaaggccggaaaaaactcaaatctgaatttaatgagcctggtgaagattttactgaagtacatcagaattggaatgctcatagctctgcttcagagcatgcaaaaggatatcgtaacagagaattcacacgaggattttccagggccagataccctcgatcttgccatggcaggcctccacctcagcatttctataactcagaacatatggtatctcaggagacttcaggatttccttctcagagacaaaataatcccattatgccacaatacccctttcctcttccagtgtttgacatgcataattttcccctccgccctccacccccaccaccacccccacctgtaaacatgggttgggctacaccaaacatggctgctcatccattacttaacttaccatactccctacccccaccccctccccctccaccactgcctcctccaccctcttctggagatagtaattctcattttggaccttactattaggtgactatgcatttccagagaaatgtggacttttcatattatgtggtacaggtatatctcacagatattgtggcctcggatccagaccattgcagtcaagtgagtcacacaaactttttggtttccaaatgcatataaaagttacgtttacatgctactttagtttattaagtatgcaatagcattgtgtctaaaaaaaccaatgtgcatatctcaattggagaatactttactgttcaaaaaataataatgaccctttgagcctgcagtgagttacagtcttttagctgttggaaggtctggactcaagtgctgttggccgctgactaatcagggtagttgttgctaaaagtggcagtttctcctaatagatagcagtgaagtgtgctacattaattggctcttcctttcaccaaagatttctgtgtagcatgtgatgctacttgatagcattttattctctgtaaaactttgaaatttgggatcaagtcctctcaaaccctgccactgccttatcaactaagaaggtagcattctaagtcctttgttatcatttcaacagtgttcatagcgtcttcaccatgagtagcttttacttgagaaacctcatttttgcttatgcataagaagtaactcctcatctgttcaagttttttcgtgagattgcagcaattcagtcacatctttaggttccacttctaattctagttctcttcctatttctaccacatattcagttatttcctccagtgaagtcttaaacacctcaaaattattaatgagggttggaatcaaattatcaaacatccatgcttcaattctgcgtatcttgcaaaaaaaatatcaaaataataaagttaattaatgaaatattaaaatggatgaaataatttaaagcggtttaaagattctctttcgcaac

SEQ ID NO: 330528 - DNA, 420 bp, Homo sapiens
ttcacttcttcacactgtttctaccactggaaagtgggacagattgaatctgcctaaactgctagcagaatgaaatacgaccatgaatataaaaagaagtttccaaattctaaagaaacaaatgcctgtaagactattctagtgaacaatgaatatttcacttattttcaaaaaaagtattgtagtgcagtgacagccaccatcatagccatcgtgcaaatccttcaacatcatgatgtgcacagttgaacaaagcatgagaaatatagttctttcacggacttatgctaaaagtaaaatatagaaatactacgtggctgggcgtggcggcttatgcctgtaatccaaggagcacaagacaggaggatcactagagtccaggagttcgagaccagcctgaacaacataggaaaaccgtgt

SEQ ID NO: 330529 - DNA, 275 bp, Homo sapiens
tagaggcgaggtttcaccatgttggccaggctggtcttgaactcctgacctcaagtaatccgcccacatcagcctcccaaagtgctgggattacagatgtgagccaccgcgcccggccttatctgttctttagttggacaaccagagccactttcatgatggctaaaatttgaatatgattttatgagaattggcatgcattctttttaaactttagcgacttggaatgctttattataatctaagcacataaatggggtgtggaaaatggtcga

SEQ ID NO: 330530 - DNA, 2031 bp, Homo sapiens
gccgtcagctgatagtgggaagccagtcaagtgccgcgaaagcaggaggcggggccgcggccaacgtcattcccgcggccgcacgtcaccgccacttgccgcatccgcaagatctctctggaccagctcgggtgcagggcctctgcgggagccctcctagacctctgcggcttctcctctaacatggccgactcggaaaaccaggggcctgcggagcctagccaggcggcggcagcggcggaggcagcggcagaggaggtaatggcggaaggcggtgcgcagggtggagactgtgacagcgcggctggtgaccctgacagcgcggctggtcagatggctgaggagccccagacccctgcagagaatgccccaaagccgaaaaatgactttatcgagagcctgcctaattcggtgaaatgccgagtcctggccctcaaaaagctgcagaagcgatgcgataagatagaagccaaatttgataaggaatttcaggctctggaaaaaaagtataatgacatctataagcccctactcgccaagatccaagagctcaccggcgagatggaggggtgtgcatggaccttggagggggaggaggaggaggaagaggagtacgaggatgacgaggaggagggggaagacgaggaggaggaggaggctgcggcagaggctgccgcgggggccaaacatgacgatgcccacgccgagatgcctgatgacgccaagaagtaaggggggcagagatggatgaagagaaagcccacgaagaaaaaagcctggttttgtttttcccagaatatcgatggacttaaaaaggctcaggtttttgaccaaaatacaatgtgaatttattctgacattcctaaaatagattaaattaaagcaattagatcctggccagctcgattcaaatttgactttcattttgaacataataaatatatcaaaaggtgttaaagaaaactgaattaaacccaaaattatgttttcatggtctcttctctgaggattgaggtttacaaagggtgttagcagatgcgaagtaaagaacgtcactttgaaacccattcatcacacagcatacgctacacatggaacacccaagccatgactgaacacgttctcagtgcttaattcttaaatttctttactcatgacatttcgcagtgcagagaaggcagaacccaagaaaaacgtcatctttgagactttgcttttgtaacgcagacatcagctttacacttcacaggagattgatggcattgaggaagattgcaatggagatcatgacactactgttaataaggccaggaaaactgccatttcaagttctgaaaaatgttttgagtatttgaatttagagaaacaacatggttccaagaaggagggtgtaaaacctgtaaaatactgtcaacatatgtattcattagttacaatctcatgtttgtgttttcttagtactgtctatttacaaacacgtaaaaaataccccaaatatgtttaagtattaaatcactttacctagcgttttagaaatattaatttacttgaagagatgtagaatgtagcaaattatgtaaagcatgtgtatccagcgttatgtactttgcgccttgtgacgtctttctgtcatgtagcttttagggtgtagctgtgaaaatcatcagaactcttcactgaagctaatgtttggaaaaaatatatacttgaagaaccaatccaagtgtgtgcccctacccccagctcagaagtagaaagggtttaagtttgcttgtattagctgtgccttcattattttgctatgtaaatgtgacatattaattataaaatggtgcataatcaaattttactgcttgaggacagatgcatacagtaaggatttttaggaagaatatatttaatgtaaagactcttagcttctgtgtgggttttgaattatgtgtgagccagtgatctataaagaaacataagcttaaagttgtttatcactgtggtgttaataaaacagtattttcaaaaaatataaaaaaa

SEQ ID NO: 330531 - DNA, 2024 bp, Homo sapiens
gccgtcagctgatagtgggaagccagtcaagtgccgcgaaagcaggaggcggggccgcggccaacgtcattcccgcggccgcacgtcaccgccacttgccgcatccgcaagatctctctggaccagctcgggtgcagggcctctgcgggagccctcctagacctctgcggcttctcctctaacatggccgactcggaaaaccaggggcctgcggagcctagccaggcggcggcagcggcggaggcagcggcagaggaggtaatggcggaaggcggtgcgcagggtggagactgtgacagcgcggctggtgaccctgacagcgcggctggtcagatggctgaggagccccagacccctgcagagaatgccccaaagccgaaaaatgactttatcgagagcctgcctaattcggtgaaatgccgagtcctggccctcaaaaagctgcagaagcgatgcgataagatagaagccaaatttgataaggaatttcaggctctggaaaaaaagtataatgacatctataagcccctactcgccaagatccaagagctcaccggcgagatggaggggtgtgcatggaccttggagggggaggaggaggaggaagaggagtacgaggatgacgaggaggagggggaagacgaggaggaggaggaggctgcggcagaggctgccgcgggggccaaacatgacgatgcccacgccgagatgcctgatgacgccaagaagtaaggggggcagagatggatgaagagaaagcccacgaagaaaaaagcctggttttgtttttcccagaatatcgatggacttaaaaaggctcaggtttttgaccaaaatacaatgtgaatttattctgacattcctaaaatagattaaattaaagcaattagatcctggccagctcgattcaaatttgactttcattttgaacataataaatatatcaaaaggtgttaaagaaaactgaattaaacccaaaattatgttttcatggtctcttctctgaggattgaggtttacaaagggtgttagcagatgcgaagtaaagaacgtcactttgaaacccattcatcacacagcatacgctacacatggaacacccaagccatgactgaacacgttctcagtgcttaattcttaaatttctttactcatgacatttcgcagtgcagagaaggcagaacccaagaaaaacgtcatctttgagactttgcttttgtaacgcagacatcagctttacacttcacaggagattgatggcattgaggaagattgcaatggagatcatgacactactgttaataaggccaggaaaactgccatttcaagttctgaaaaatgttttgagtatttgaatttagagaaacaacatggttccaagaaggagggtgtaaaacctgtaaaatactgtcaacatatgtattcattagttacaatctcatgtttgtgttttcttagtactgtctatttacaaacacgtaaaaaataccccaaatatgtttaagtattaaatcactttacctagcgttttagaaatattaatttacttgaagagatgtagaatgtagcaaattatgtaaagcatgtgtatccagcgttatgtactttgcgccttgtgacgtctttctgtcatgtagcttttagggtgtagctgtgaaaatcatcagaactcttcactgaagctaatgtttggaaaaaatatatacttgaagaaccaatccaagtgtgtgcccctacccccagctcagaagtagaaagggtttaagtttgcttgtattagctgtgccttcattattttgctatgtaaatgtgacatattaattataaaatggtgcataatcaaattttactgcttgaggacagatgcatacagtaaggatttttaggaagaatatatttaatgtaaagactcttagctttcgtatggcatccgaatggtgtgagacccagtgtcctttaaattcaccttaagccatggtagggtgtgtgtatggggttctttgggcagtcctttcacaatatac

SEQ ID NO: 330532 - DNA, 1918 bp, Homo sapiens
gccgtcagctgatagtgggaagccagtcaagtgccgcgaaagcaggaggcggggccgcggccaacgtcattcccgcggccgcacgtcaccgccacttgccgcatccgcaagatctctctggaccagctcgggtgcagggcctctgcgggagccctcctagacctctgcggcttctcctctaacatggccgactcggaaaaccaggggcctgcggagcctagccaggcggcggcagcggcggaggcagcggcagaggaggtaatggcggaaggcggtgcgcagggtggagactgtgacagcgcggctggtgaccctgacagcgcggctggtcagatggctgaggagccccagacccctgcagagaatgccccaaagccgaaaaatgaaaaaaaagtataatgacatctataagcccctactcgccaagatccaagagctcaccggcgagatggaggggtgtgcatggaccttggagggggaggaggaggaggaagaggagtacgaggatgacgaggaggagggggaagacgaggaggaggaggaggctgcggcagaggctgccgcgggggccaaacatgacgatgcccacgccgagatgcctgatgacgccaagaagtaaggggggcagagatggatgaagagaaagcccacgaagaaaaaagcctggttttgtttttcccagaatatcgatggacttaaaaaggctcaggtttttgaccaaaatacaatgtgaatttattctgacattcctaaaatagattaaattaaagcaattagatcctggccagctcgattcaaatttgactttcattttgaacataataaatatatcaaaaggtgttaaagaaaactgaattaaacccaaaattatgttttcatggtctcttctctgaggattgaggtttacaaagggtgttagcagatgcgaagtaaagaacgtcactttgaaacccattcatcacacagcatacgctacacatggaacacccaagccatgactgaacacgttctcagtgcttaattcttaaatttctttactcatgacatttcgcagtgcagagaaggcagaacccaagaaaaacgtcatctttgagactttgcttttgtaacgcagacatcagctttacacttcacaggagattgatggcattgaggaagattgcaatggagatcatgacactactgttaataaggccaggaaaactgccatttcaagttctgaaaaatgttttgagtatttgaatttagagaaacaacatggttccaagaaggagggtgtaaaacctgtaaaatactgtcaacatatgtattcattagttacaatctcatgtttgtgttttcttagtactgtctatttacaaacacgtaaaaaataccccaaatatgtttaagtattaaatcactttacctagcgttttagaaatattaatttacttgaagagatgtagaatgtagcaaattatgtaaagcatgtgtatccagcgttatgtactttgcgccttgtgacgtctttctgtcatgtagcttttagggtgtagctgtgaaaatcatcagaactcttcactgaagctaatgtttggaaaaaatatatacttgaagaaccaatccaagtgtgtgcccctacccccagctcagaagtagaaagggtttaagtttgcttgtattagctgtgccttcattattttgctatgtaaatgtgacatattaattataaaatggtgcataatcaaattttactgcttgaggacagatgcatacagtaaggatttttaggaagaatatatttaatgtaaagactcttagcttctgtgtgggttttgaattatgtgtgagccagtgatctataaagaaacataagcttaaagttgtttatcactgtggtgttaataaaacagtattttcaaaaaatataaaaaaa

SEQ ID NO: 330533 - DNA, 1091 bp, Homo sapiens
tagtgatgttcagcattttttcatttacttattggccattcaaaattcatttcaataaatcaaaattatttttaaaccttctggggaaataggagcttgagaatagggtccagttgagttataaatgaattaaaaaacactgtagacatgtggctgcatgagccatatactttatgctggatagatatacatttgttgaaacatctgttgagtgactgtaagttgtaggctttatattttagaaacacagtgagtgaggaaggctgataagtaaatggacaagcaatataaaaaaggctgagaagcaagtctctgcataatgacagggaagttaagtctaaatctgaccctaaagggctgggacactggacagtggaagcagaagaaaaggtcaggaaacaaactatgaagaagacaatatctgacgtggatatcaaaggatgagaaaatattggatgcctgctggagaaagttgccaaataagaggcgagtattctagcaaaggaatccatctgcaacagcaaaagtctggtgacttgaaggaatgtgtcaggcactgggtactaagacagtatcaacagcaatgaagagaacaggaaagattcaagagataattagaaggtggaacaggctaggatagcaattaaatgaatgtagagcacttgggagaagtcaggatgactcctggattttggctttgaaatcctgagtgagtggtggctccattaataagataaagacaattagagaagaaatcattttctagatgtgttgagtttgaggttcttatgacacacataacatgaaatatctgaaatactgacttggagctcaggcaagaggtctgagttagatttaaagtttagattgactcatgggtagtagttgaagctctgggtggggatgagtttgcttaggaagaatgtataaaagaagagacaataattaaaatcctttaaaaaagcacttgaagggcaggccatgcaaagaagaataacagtggcctgagagggagaaaaacaaggaagccaggggaggagtgaggctggataagctgggaaaagtcaaaagtgtgggttgcaacacaagaa

SEQ ID NO: 330534 - DNA, 98 bp, Homo sapiens
ctttggtgaggctcgataaaaatattgtgatggatagggcacaggtagtgcctgaatgtatttcagatagttgggccaacaaccaatctatgcttaaa

SEQ ID NO: 330535 - DNA, 372 bp, Homo sapiens
gtgggcggattatatgaggtcaggagttcaagaccagcctggccaaaatggagaaaccctgtctctactaaaaatacaaaaattaggtgggtgtggtgtcacatgctggtagtcccagctactcgggaggctgacgcaggagaaccgcttgaacccaggagacagaggttgctgtgagccgaaatagtgctactgcagtcgagcttgggcgacagagtgagaatccatcttaaaaaaaaaaaaaaggaagtggagaaggtatggaattgagggaaaggacacagatgaaattctaaaaaggaggaagcctgcttcttctcatgagatacggaaaaaataataagtaaatcaagtttctacacagaatataat

SEQ ID NO: 330536 - DNA, 2297 bp, Homo sapiens
ggcacgaggatttctggcgctggcgcggctccaagaaggcatccgcatttgctaccagcggcggccgcggcggagccaggccggtcctcagcgcccagcaccgccgctcccggcaacccggagcgcgcaccgcaggccggcggccgagctcgcgcatcccagccatcactcttccacctgctccttagagaagggaagatgagtgagtcgagctcgaagtccagccagcccttggcctccaagcaggaaaaggacggcactgagaagcggggccggggcaggccgcgcaagcagcctccggtgagtcccgggacagcgctggtagggagtcagaaggagcccagcgaagtgccaacacctaagagacctcggggccgaccaaagggaagcaaaaacaagggtgctgccaagacccggaaaaccaccacaactccaggaaggaaaccaaggggcagacccaaaaaactggagaaggaggaagaggagggcatctcgcaggagtcctcggaggaggagcagtgacccatgcgtgccgcctgctcctcactggaggagcagcttccttctgggactggacagctttgctccgctcccaccgcccccgccccttccccaggcccaccatcaccaccgcctctggccgccacccccatcttccacctgtgccctcaccaccacactacacagcacaccagccgctgcagggctcccatgggctgagtggggagcagttttcccctggcctcagttcccagctccccccgcccacccacgcatacacacatgccctcctggacaaggctaacatcccacttagccgcaccctgcacctgctgcgtccccactcccttggtggtggggacattgctctctgggcttttggtttgggggcgccctctctgctccttcactgttccccacaacaagtctgacctcgtcttctacttctggaagtagtgataaggtctatgcccaccagatggttcgtacagattcccgggaacagaagcttgatgcatttctgcagcctctgagcaaacccctgtccagtcagccccaggccattgtcacagaggataagacagatatttctagtggcagggctaggcagcaagatgaggagatgcttgaactcccagcccctgctgaagtggctgccaaaaatcagagcttggagggggatacaacaaaggggacttcagaaatgtcagagaagagaggacctacttccagcaaccccagaaagagacatcgggaagattctgatgtggaaatggtggaagatgattcccgaaaggaaatgactgcagcttgtaccccccggagaaggatcattaacctcactagtgttttgagtctccaggaagaaattaatgagcagggacatgaggttctccgggagatgttgcataaccactccttcgtgggctgtgtgaatcctcagtgggccttggcacagcatcaaaccaagttataccttctcaacaccaccaagcttagtgaagaactgttctaccagatactcatttatgattttgccaattttggtgttctcaggttatcggagccagcaccgctctttgaccttgccatgcttgccttagatagtccagagagtggctggacagaggaagatggtcccaaagaaggacttgctgaatacattgttgagtttctgaagaagaaggctgagatgcttgcagactatttctctttggaaattgatgaggaagggaacctgattggattaccccttctgattgacaactatgtgccccctttggagggactgcctatcttcattcttcgactagccactgaggtgaattgggacgaagaaaaggaatgttttgaaagcctcagtaaagaatgcgctatgttctattccatccggaagcagtacatatctgaggagtcgaccctctcaggccagcagagtgaagtgcctggctccattccaaactcctggaagtggactgtggaacacattgtctataaagccttgcgctcacacattctgcctcctaaacatttcacagaagatggaaatatcctgcagcttgctaacctgcctgatctatacaaagtctttgagaggtgttaaatatggttatttatgcactgtgggatgtgttcttctttctctgtattccgatacaaagtgttgtatcaaagtgtgatatacaaagtgtaccaacataagtgttggtagcacttaagacttatacttgccttctgatagtattcctttatacacagtggattgattataaataaatagatgtgtcttaacataa

SEQ ID NO: 330537 - DNA, 952 bp, Homo sapiens
  misc_feature (58)..(58): n is a, c, g, or t
  misc_feature (60)..(60): n is a, c, g, or t
aagcccaaattttttcgagccttgggtattcacgtggtaatccagtattttttgccanangcctatcccgttaaatgctacccatcagggtttttacaccacagttttcgacttaactgccagtgactctcttaataaccaccgctaccaggagccagcaccgctctttgaccttgccatgcttgccttagatagtccagagagtggctggacagaggaagatggtcccaaagaaggacttgctgaatacattgttgagtttctgaagaagaaggctgagatgcttgcagactatttctctttggaaattgatgaggaagggaacctgattggattaccccttctgattgacaactatgtgccccctttggagggactgcctatcttcattcttcgactagccactgaggtgaattgggacgaagaaaaggaatgttttgaaagcctcagtaaagaatgcgctatgttctattccatccggaagcagtacatatctgaggagtcgaccctctcaggccagcagagtgaagtgcctggctccattccaaactcctggaagtggactgtggaacacattgtctataaagccttgcgctcacacattctgcctcctaaacatttcacagaagatggaaatatcctgcagcttgctaacctgcctgatctatacaaagtctttgagaggtgttaaatatggttatttatgcactgtgggatgtgttcttctttctctgtattccgatacaaagtgttgtatcaaagtgtgatatacaaagtgtaccaacataagtgttggtagcacttaagacttatacttgccttctgatagtattcctttatacacagtggattgattataaataaatagatgtgtcttaacataaaagatgcagacaagccccggctttctcttctcttctatttcaaatactctaaatatagagactcttac

SEQ ID NO: 330538 - DNA, 791 bp, Homo sapiens
  misc_feature (23)..(23): n is a, c, g, or t
  misc_feature (690)..(690): n is a, c, g, or t
  misc_feature (692)..(692): n is a, c, g, or t
  misc_feature (695)..(695): n is a, c, g, or t
  misc_feature (697)..(698): n is a, c, g, or t
  misc_feature (702)..(702): n is a, c, g, or t
  misc_feature (707)..(707): n is a, c, g, or t
taggtaggtacgaggctgggtgntgcgggttccctgacgagcggagtcaggccttctccttttccgcagaccgtgtgtttctttaccgctctcccccgagaccttttaagggttgtttggagttttagatgcaaaatccacaagtattcaagtgattgttaaagagggaggcctgaagttgattcagatccaagacaatggcaccgggatcaggaaagaagatctggatattgtatgtgaaaggttcactactagtaaactgcagtcctttgaggatttagccagtatttctacctatggctttcgaggtgaggctttggccagcataagccatgtggctcatgttactattacaacgaaaacagctgatggaaagtgtgcatacagagcaagttactcagatggaaaactgaaagcccctcctaaaccatgtgctggcaatcaagggacccagatcacggtggaggaccttttttacaacatagccacgaggagaaaagctttaaaaaatccaagtgaagaatatgggaaaattttggaagttgttggcaggtattcagtacacaatgcaggcattagtttctcagttaaaaaacaaggagagacagtagctgatgttaggacactacccaatgcctcaaccgtggacaatattcgctccatctttggaaatgctgttagtcgagaacngntgnanntggntgtgnggtaaaaccctaccttcaatgaatggtgctatccatgggactatcctgtgctcttctacctcacaccacgctgggacctccggg

SEQ ID NO: 330539 - DNA, 829 bp, Homo sapiens
ttgtcaccatttgggtagcgggggggggatttgaggctacgggactctctttagaagcccgacacaggagccagcaccgctctttgaccttgccatgcttgccttagatagtccagagagtggctggacagaggaagatggtcccaaagaaggacttgctgaatacattgttgagtttctgaagaagaaggctgagatgcttgcagactatttctctttggaaattgatgaggaagggaacctgattggattaccccttctgattgacaactatgtgccccctttggagggactgcctatcttcattcttcgactagccactgaggtgaattgggacgaagaaaaggaatgttttgaaagcctcagtaaagaatgcgctatgttctattccatccggaagcagtacatatctgaggagtcgaccctctcaggccagcagagtgaagtgcctggctccattccaaactcctggaagtggactgtggaacacattgtctataaagccttgcgctcacacattctgcctcctaaacatttcacagaagatggaaatatcctgcagcttgctaacctgcctgatctatacaaagtctttgagaggtgttaaatatggttatttatgcactgtgggatgtgttcttctttctctgtattccgatacaaagtgttgtatcaaagtgtgatatacaaagtgtaccaacataagtgttggtagcacttaagacttatacttgccttctgatagtattcctttatacacagtggattgattataaataaatagatgtgtcttaacataaatttatccctcacttagcggccaggtttc

SEQ ID NO: 330540 - DNA, 2292 bp, Homo sapiens
acgaggcactgaggtgattggctgaaggcacttccgttgagcatctagacgtttccttggctcttctggcgccaaaatgtcgttcgtggcaggggttattcggcggctggacgagacagtggtgaaccgcatcgcggcgggggaagttatccagcggccagctaatgctatcaaagagatgattgagaactgtttagatgcaaaatccacaagtattcaagtgattgttaaagagggaggcctgaagttgattcagatccaagacaatggcaccgggatcaggaaagaagatctggatattgtatgtgaaaggttcactactagtaaactgcagtcctttgaggatttagccagtatttctacctatggctttcgaggtgaggctttggccagcataagccatgtggctcatgttactattacaacgaaaacagctgatggaaagtgtgcatacagagcaagttactcagatggaaaactgaaagcccctcctaaaccatgtgctggcaatcaagggacccagatcacggtggaggaccttttttacaacatagccacgaggagaaaagctttaaaaaatccaagtgaagaatatgggaaaattttggaagttgttggcaggtattcagtacacaatgcaggcattagtttctcagttaaaaaacaaggagagacagtagctgatgttaggacactacccaatgcctcaaccgtggacaatattcgctccatctttggaaatgctgttagtcgagaactgatagaaattggatgtgaggataaaaccctagccttcaaaatgaatggttacatatccaatgcaaactactcagtgaagaagtgcatcttcttactcttcatcaaccactttgctaccaggacttgctggcccctctggggagatggttaaatccacaacaagtctgacctcgtcttctacttctggaagtagtgataaggtctatgcccaccagatggttcgtacagattcccgggaacagaagcttgatgcatttctgcagcctctgagcaaacccctgtccagtcagccccaggccattgtcacagaggataagacagatatttctagtggcagggctaggcagcaagatgaggagatgcttgaactcccagcccctgctgaagtggctgccaaaaatcagagcttggagggggatacaacaaaggggacttcagaaatgtcagagaagagaggacctacttccagcaaccccagaaagagacatcgggaagattctgatgtggaaatggtggaagatgattcccgaaaggaaatgactgcagcttgtaccccccggagaaggatcattaacctcactagtgttttgagtctccaggaagaaattaatgagcagggacatgaggttctccgggagatgttgcataaccactccttcgtgggctgtgtgaatcctcagtgggccttggcacagcatcaaaccaagttataccttctcaacaccaccaagcttagtgaagaactgttctaccagatactcatttatgattttgccaattttggtgttctcaggttatcggagccagcaccgctctttgaccttgccatgcttgccttagatagtccagagagtggctggacagaggaagatggtcccaaagaaggacttgctgaatacattgttgagtttctgaagaagaaggctgagatgcttgcagactatttctctttggaaattgatgaggaagggaacctgattggattaccccttctgattgacaactatgtgccccctttggagggactgcctatcttcattcttcgactagccactgaggtgaattgggacgaagaaaaggaatgttttgaaagcctcagtaaagaatgcgctatgttctattccatccggaagcagtacatatctgaggagtcgaccctctcaggccagcagagtgaagtgcctggctccattccaaactcctggaagtggactgtggaacacattgtctataaagccttgcgctcacacattctgcctcctaaacatttcacagaagatggaaatatcctgcagcttgctaacctgcctgatctatacaaagtctttgagaggtgttaaatatggttatttatgcactgtgggatgtgttcttctttctctgtattccgatacaaagtgttgtatcaaagtgtgatatacaaagtgtaccaacataagtgttggtagcacttaagacttatacttgccttctgatagtattcctttatacacagtggattgattataaataaatagatgtgtcttaacataa

SEQ ID NO: 330541 - DNA, 2441 bp, Homo sapiens
acgaggcactgaggtgattggctgaaggcacttccgttgagcatctagacgtttccttggctcttctggcgccaaaatgtcgttcgtggcaggggttattcggcggctggacgagacagtggtgaaccgcatcgcggcgggggaagttatccagcggccagctaatgctatcaaagagatgattgagaactgtttagatgcaaaatccacaagtattcaagtgattgttaaagagggaggcctgaagttgattcagatccaagacaatggcaccgggatcagggctttggccagcataagccatgtggctcatgttactattacaacgaaaacagctgatggaaagtgtgcatacagagcaagttactcagatggaaaactgaaagcccctcctaaaccatgtgctggcaatcaagggacccagatcacggtggaggaccttttttacaacatagccacgaggagaaaagctttaaaaaatccaagtgaagaatatgggaaaattttggaagttgttggcaggtattcagtacacaatgcaggcattagtttctcagttaaaaaacaaggagagacagtagctgatgttaggacactacccaatgcctcaaccgtggacaatattcgctccatctttggaaatgctgttagtcgagaactgatagaaattggatgtgaggataaaaccctagccttcaaaatgaatggttacatatccaatgcaaactactcagtgaagaagtgcatcttcttactcttcatcaaccatcgtctggtagaatcaacttccttgagaaaagccatagaaacagtgtatgcagcctatttgcccaaaaacacacacccattcctgtacctcagtttagaaatcagtccccagaatgtggatgttaatgtgcaccccacaaagcatgaagttcacttcctgcacgaggagagcatcctggagcgggtgcagcagcacatcgagagcaagctcctgggctccaattcctccaggatgtacttcacccagactttgctaccaggacttgctggcccctctggggagatggttaaatccacaacaagtctgacctcgtcttctacttctggaagtagtgataaggtctatgcccaccagatggttcgtacagattcccgggaacagaagcttgatgcatttctgcagcctctgagcaaacccctgtccagtcagccccaggccattgtcacagaggataagacagatatttctagtggcagggctaggcagcaagatgaggagatgcttgaactcccagcccctgctgaagtggctgccaaaaatcagagcttggagggggatacaacaaaggggacttcagaaatgtcagagaagagaggacctacttccagcaaccccagaaagagacatcgggaagattctgatgtggaaatggtggaagatgattcccgaaaggaaatgactgcagcttgtaccccccggagaaggatcattaacctcactagtgttttgagtctccaggaagaaattaatgagcagggacatgaggttctccgggagatgttgcataaccactccttcgtgggctgtgtgaatcctcagtgggccttggcacagcatcaaaccaagttataccttctcaacaccaccaagcttagtgaagaactgttctaccagatactcatttatgattttgccaattttggtgttctcaggttatcggagccagcaccgctctttgaccttgccatgcttgccttagatagtccagagagtggctggacagaggaagatggtcccaaagaaggacttgctgaatacattgttgagtttctgaagaagaaggctgagatgcttgcagactatttctctttggaaattgatgaggaagggaacctgattggattaccccttctgattgacaactatgtgccccctttggagggactgcctatcttcattcttcgactagccactgaggtgaattgggacgaagaaaaggaatgttttgaaagcctcagtaaagaatgcgctatgttctattccatccggaagcagtacatatctgaggagtcgaccctctcaggccagcagagtgaagtgcctggctccattccaaactcctggaagtggactgtggaacacattgtctataaagccttgcgctcacacattctgcctcctaaacatttcacagaagatggaaatatcctgcagcttgctaacctgcctgatctatacaaagtctttgagaggtgttaaatatggttatttatgcactgtgggatgtgttcttctttctctgtattccgatacaaagtgttgtatcaaagtgtgatatacaaagtgtaccaacataagtgttggtagcacttaagacttatacttgccttctgatagtattcctttatacacagtggattgattataaataaatagatgtgtcttaacataa

SEQ ID NO: 330542 - DNA, 2223 bp, Homo sapiens
  misc_feature (23)..(23): n is a, c, g, or t
taggtaggtacgaggctgggtgntgcgggttccctgacgagcggagtcaggccttctccttttccgcagaccgtgtgtttctttaccgctctcccccgagaccttttaagggttgtttggagttttagatgcaaaatccacaagtattcaagtgattgttaaagagggaggcctgaagttgattcagatccaagacaatggcaccgggatcaggaaagaagatctggatattgtatgtgaaaggttcactactagtaaactgcagtcctttgaggatttagccagtatttctacctatggctttcgaggtgaggctttggccagcataagccatgtggctcatgttactattacaacgaaaacagctgatggaaagtgtgcatacagagcaagttactcagatggaaaactgaaagcccctcctaaaccatgtgctggcaatcaagggacccagatcacggtggaggaccttttttacaacatagccacgaggagaaaagctttaaaaaatccaagtgaagaatatgggaaaattttggaagttgttggcaggtattcagtacacaatgcaggcattagtttctcagttaaaaaacaaggagagacagtagctgatgttaggacactacccaatgcctcaaccgtggacaatattcgctccatctttggaaatgctgttagtcgagaactgatagaaattggatgtgaggataaaaccctagccttcaaaatgaatggttacatatccaatgcaaactactcagtgaagaagtgcatcttcttactcttcatcaaccactttgctaccaggacttgctggcccctctggggagatggttaaatccacaacaagtctgacctcgtcttctacttctggaagtagtgataaggtctatgcccaccagatggttcgtacagattcccgggaacagaagcttgatgcatttctgcagcctctgagcaaacccctgtccagtcagccccaggccattgtcacagaggataagacagatatttctagtggcagggctaggcagcaagatgaggagatgcttgaactcccagcccctgctgaagtggctgccaaaaatcagagcttggagggggatacaacaaaggggacttcagaaatgtcagagaagagaggacctacttccagcaaccccagaaagagacatcgggaagattctgatgtggaaatggtggaagatgattcccgaaaggaaatgactgcagcttgtaccccccggagaaggatcattaacctcactagtgttttgagtctccaggaagaaattaatgagcagggacatgaggttctccgggagatgttgcataaccactccttcgtgggctgtgtgaatcctcagtgggccttggcacagcatcaaaccaagttataccttctcaacaccaccaagcttagtgaagaactgttctaccagatactcatttatgattttgccaattttggtgttctcaggttatcggagccagcaccgctctttgaccttgccatgcttgccttagatagtccagagagtggctggacagaggaagatggtcccaaagaaggacttgctgaatacattgttgagtttctgaagaagaaggctgagatgcttgcagactatttctctttggaaattgatgaggaagggaacctgattggattaccccttctgattgacaactatgtgccccctttggagggactgcctatcttcattcttcgactagccactgaggtgaattgggacgaagaaaaggaatgttttgaaagcctcagtaaagaatgcgctatgttctattccatccggaagcagtacatatctgaggagtcgaccctctcaggccagcagagtgaagtgcctggctccattccaaactcctggaagtggactgtggaacacattgtctataaagccttgcgctcacacattctgcctcctaaacatttcacagaagatggaaatatcctgcagcttgctaacctgcctgatctatacaaagtctttgagaggtgttaaatatggttatttatgcactgtgggatgtgttcttctttctctgtattccgatacaaagtgttgtatcaaagtgtgatatacaaagtgtaccaacataagtgttggtagcacttaagacttatacttgccttctgatagtattcctttatacacagtggattgattataaataaatagatgtgtcttaacataa

SEQ ID NO: 330543 - DNA, 2744 bp, Homo sapiens
acgaggcactgaggtgattggctgaaggcacttccgttgagcatctagacgtttccttggctcttctggcgccaaaatgtcgttcgtggcaggggttattcggcggctggacgagacagtggtgaaccgcatcgcggcgggggaagttatccagcggccagctaatgctatcaaagagatgattgagaactgtttagatgcaaaatccacaagtattcaagtgattgttaaagagggaggcctgaagttgattcagatccaagacaatggcaccgggatcaggaaagaagatctggatattgtatgtgaaaggttcactactagtaaactgcagtcctttgaggatttagccagtatttctacctatggctttcgaggtgaggctttggccagcataagccatgtggctcatgttactattacaacgaaaacagctgatggaaagtgtgcatacagagcaagttactcagatggaaaactgaaagcccctcctaaaccatgtgctggcaatcaagggacccagatcacggtggaggaccttttttacaacatagccacgaggagaaaagctttaaaaaatccaagtgaagaatatgggaaaattttggaagttgttggcaggtattcagtacacaatgcaggcattagtttctcagttaaaaaacaaggagagacagtagctgatgttaggacactacccaatgcctcaaccgtggacaatattcgctccatctttggaaatgctgttagtcgagaactgatagaaattggatgtgaggataaaaccctagccttcaaaatgaatggttacatatccaatgcaaactactcagtgaagaagtgcatcttcttactcttcatcaaccatcgtctggtagaatcaacttccttgagaaaagccatagaaacagtgtatgcagcctatttgcccaaaaacacacacccattcctgtacctcagtttagaaatcagtccccagaatgtggatgttaatgtgcaccccacaaagcatgaagttcacttcctgcacgaggagagcatcctggagcgggtgcagcagcacatcgagagcaagctcctgggctccaattcctccaggatgtacttcacccagactttgctaccaggacttgctggcccctctggggagatggttaaatccacaacaagtctgacctcgtcttctacttctggaagtagtgataaggtctatgcccaccagatggttcgtacagattcccgggaacagaagcttgatgcatttctgcagcctctgagcaaacccctgtccagtcagccccaggccattgtcacagaggataagacagatatttctagtggcagggctaggcagcaagatgaggagatgcttgaactcccagcccctgctgaagtggctgccaaaaatcagagcttggagggggatacaacaaaggggacttcagaaatgtcagagaagagaggacctacttccagcaaccccagaaagagacatcgggaagattctgatgtggaaatggtggaagatgattcccgaaaggaaatgactgcagcttgtaccccccggagaaggatcattaacctcactagtgttttgagtctccaggaagaaattaatgagcagggacatgaggttctccgggagatgttgcataaccactccttcgtgggctgtgtgaatcctcagtgggccttggcacagcatcaaaccaagttataccttctcaacaccaccaagcttagtgaagaactgttctaccagatactcatttatgattttgccaattttggtgttctcaggttatcggagccagcaccgctctttgaccttgccatgcttgccttagatagtccagagagtggctggacagaggaagatggtcccaaagaaggacttgctgaatacattgttgagtttctgaagaagaaggctgagatgcttgcagactatttctctttggaaattgatgaggaagggaacctgattggattaccccttctgattgacaactatgtgccccctttggagggactgcctatcttcattcttcgactagccactgaggtgaattgggacgaagaaaaggaatgttttgaaagcctcagtaaagaatgcgctatgttctattccatccggaagcagtacatatctgaggagtcgaccctctcaggccagcagagtgaagtgcctggctccattccaaactcctggaagtggactgtggaacacattgtctataaagccttgcgctcacacattctgcctcctaaacatttcacagaagatggaaatatcctgcagcttgctaacctgcctgatctatacaaagtctttgagaggtgttaaatatggttatttatgcactgtgggatgtgttcttctttctctgtattccgatacaaagtgttgtatcaaagtgtgatatacaaagtgtaccaacataagtgttggtagcacttaagacttatacttgccttctgatagtattcctttatacacagtggattgattataaataaatagatgtgtcttaacataaaaaaaaaaaaaaaaaacaaaaaaacaagaaacaagaaaaaacaaaagagaaaaaaacaaaacaaaaaaagaaacaaaaacaaaacacaagcacacgcaaacaaaaaaagaacgagagggggggcggcggccccgagaattacactacctcggcgggcgcacacagacagcgcagcgcccacggattgtaggacggcgcggcgac

SEQ ID NO: 330544 - DNA, 2608 bp, Homo sapiens
acgaggcactgaggtgattggctgaaggcacttccgttgagcatctagacgtttccttggctcttctggcgccaaaatgtcgttcgtggcaggggttattcggcggctggacgagacagtggtgaaccgcatcgcggcgggggaagttatccagcggccagctaatgctatcaaagagatgattgagaactgtttagatgcaaaatccacaagtattcaagtgattgttaaagagggaggcctgaagttgattcagatccaagacaatggcaccgggatcaggaaagaagatctggatattgtatgtgaaaggttcactactagtaaactgcagtcctttgaggatttagccagtatttctacctatggctttcgaggtgaggctttggccagcataagccatgtggctcatgttactattacaacgaaaacagctgatggaaagtgtgcatacagagcaagttactcagatggaaaactgaaagcccctcctaaaccatgtgctggcaatcaagggacccagatcacggtggaggaccttttttacaacatagccacgaggagaaaagctttaaaaaatccaagtgaagaatatgggaaaattttggaagttgttggcaggtattcagtacacaatgcaggcattagtttctcagttaaaaaacaaggagagacagtagctgatgttaggacactacccaatgcctcaaccgtggacaatattcgctccatctttggaaatgctgttagtcgagaactgatagaaattggatgtgaggataaaaccctagccttcaaaatgaatggttacatatccaatgcaaactactcagtgaagaagtgcatcttcttactcttcatcaaccatcgtctggtagaatcaacttccttgagaaaagccatagaaacagtgtatgcagcctatttgcccaaaaacacacacccattcctgtacctcagtttagaaatcagtccccagaatgtggatgttaatgtgcaccccacaaagcatgaagttcacttcctgcacgaggagagcatcctggagcgggtgcagcagcacatcgagagcaagctcctgggctccaattcctccaggatgtacttcacccagactttgctaccaggacttgctggcccctctggggagatggttaaatccacaacaagtctgacctcgtcttctacttctggaagtagtgataaggtctatgcccaccagatggttcgtacagattcccgggaacagaagcttgatgcatttctgcagcctctgagcaaacccctgtccagtcagccccaggccattgtcacagaggataagacagatatttctagtggcagggctaggcagcaagatgaggagatgcttgaactcccagcccctgctgaagtggctgccaaaaatcagagcttggagggggatacaacaaaggggacttcagaaatgtcagagaagagaggacctacttccagcaaccccagaaagagacatcgggaagattctgatgtggaaatggtggaagatgattcccgaaaggaaatgactgcagcttgtaccccccggagaaggatcattaacctcactagtgttttgagtctccaggaagaaattaatgagcagggacatgaggttctccgggagatgttgcataaccactccttcgtgggctgtgtgaatcctcagtgggccttggcacagcatcaaaccaagttataccttctcaacaccaccaagcttagtgaagaactgttctaccagatactcatttatgattttgccaattttggtgttctcaggttatcggagccagcaccgctctttgaccttgccatgcttgccttagatagtccagagagtggctggacagaggaagatggtcccaaagaaggacttgctgaatacattgttgagtttctgaagaagaaggctgagatgcttgcagactatttctctttggaaattgatgaggaagggaacctgattggattaccccttctgattgacaactatgtgccccctttggagggactgcctatcttcattcttcgactagccactgaggtgaattgggacgaagaaaaggaatgttttgaaagcctcagtaaagaatgcgctatgttctattccatccggaagcagtacatatctgaggagtcgaccctctcaggccagcagagtgaagtgcctggctccattccaaactcctggaagtggactgtggaacacattgtctataaagccttgcgctcacacattctgcctcctaaacatttcacagaagatggaaatatcctgcagcttgctaacctgcctgatctatacaaagtctttgagaggtgttaaatatggttatttatgcactgtgggatgtgttcttctttctctgtattccgatacaaagtgttgtatcaaagtgtgatatacaaagtgtaccaacataagtgttggtagcacttaagacttatacttgccttctgatagtattcctttatacacagtggattgattataaataaatagatgtgtcttaacataaaagatgcagacaagccccggctttctcttctcttctatttcaaatactctaaatatagagactcttac

SEQ ID NO: 330545 - DNA, 2211 bp, Homo sapiens
acgaggcactgaggtgattggctgaaggcacttccgttgagcatctagacgtttccttggctcttctggcgccaaaatgtcgttcgtggcaggggttattcggcggctggacgagacagtggtgaaccgcatcgcggcgggggaagttatccagcggccagctaatgctatcaaagagatgattgagaactgtttagatgcaaaatccacaagtattcaagtgattgttaaagagggaggcctgaagttgattcagatccaagacaatggcaccgggatcaggaaagaagatctggatattgtatgtgaaaggttcactactagtaaactgcagtcctttgaggatttagccagtatttctacctatggctttcgaggtgaggctttggccagcataagccatgtggctcatgttactattacaacgaaaacagctgatggaaagtgtgcatacagagcaagttactcagatggaaaactgaaagcccctcctaaaccatgtgctggcaatcaagggacccagatcacggtggaggaccttttttacaacatagccacgaggagaaaagctttaaaaaatccaagtgaagaatatgggaaaattttggaagttgttggcaggtattcagtacacaatgcaggcattagtttctcagttaaaaaacaaggagagacagtagctgatgttaggacactacccaatgcctcaaccgtggacaatattcgctccatctttggaaatgctgttagtcgagaactgatagaaattggatgtgaggataaaaccctagccttcaaaatgaatggttacatatccaatgcaaactactcagtgaagaagtgcatcttcttactcttcatcaaccatcgtctggtagaatcaacttccttgagaaaagccatagaaacagtgtatgcagcctatttgcccaaaaacacacacccattcctgtacctcagtttagaaatcagtccccagaatgtggatgttaatgtgcaccccacaaagcatgaagttcacttcctgcacgaggagagcatcctggagcgggtgcagcagcacatcgagagcaagctcctgggctccaattcctccaggatgtacttcacccagactttgctaccaggacttgctggcccctctggggagatggttaaatccacaacaagtctgacctcgtcttctacttctggaagtagtgataaggtctatgcccaccagatggttcgtacagattcccgggaacagaagcttgatgcatttctgcagcctctgagcaaacccctgtccagtcagccccaggccattgtcacagaggataagacagatatttctagtggcagggctaggcagcaagatgaggagatgcttgaactcccagcccctgctgaagtggctgccaaaaatcagagcttggagggggatacaacaaaggggacttcagaaatgtcagagaagagaggacctacttccagcaaccccagaaagagacatcgggaagattctgatgtggaaatggtggaagatgattcccgaaaggaaatgactgcagcttgtaccccccggagaaggatcattaacctcactagtgttttgagtctccaggaagaaattaatgagcagggacatgaggttctccgggagatgttgcataaccactccttcgtgggctgtgtgaatcctcagtgggccttggcacagcatcaaaccaagttataccttctcaacaccaccaagcttagtgaagaactgttctaccagatactcatttatgattttgccaattttggtgttctcaggttatcggagccagcaccgctctttgaccttgccatgcttgccttagatagtccagagagtggctggacagaggaagatggtcccaaagaaggacttgctgaatacattgttgagtttctgaagaagaaggctgagatgcttgcagactatttctctttggaaattgatgaggaagggaacctgattggattaccccttctgattgacaactatgtgccccctttggagggactgcctatcttcattcttcgactagccactgaggtgaattgggacgaagaaaaggaatgttttgaaagcctcagtaaagaatgcgctatgttctattccatccggaagtatgtagtcgactacatactggagccaagtgctaacatgccttggttcaagggatggaaagtcacccgtaa

SEQ ID NO: 330546 - DNA, 2005 bp, Homo sapiens
acgaggcactgaggtgattggctgaaggcacttccgttgagcatctagacgtttccttggctcttctggcgccaaaatgtcgttcgtggcaggggttattcggcggctggacgagacagtggtgaaccgcatcgcggcgggggaagttatccagcggccagctaatgctatcaaagagatgattgagaactgtttagatgcaaaatccacaagtattcaagtgattgttaaagagggaggcctgaagttgattcagatccaagacaatggcaccgggatcaggaaagaagatctggatattgtatgtgaaaggttcactactagtaaactgcagtcctttgaggatttagccagtatttctacctatggctttcgaggtgaggctttggccagcataagccatgtggctcatgttactattacaacgaaaacagctgatggaaagtgtgcatacagagcaagttactcagatggaaaactgaaagcccctcctaaaccatgtgctggcaatcaagggacccagatcacggtggaggaccttttttacaacatagccacgaggagaaaagctttaaaaaatccaagtgaagaatatgggaaaattttggaagttgttggcaggtattcagtacacaatgcaggcattagtttctcagttaaaaaacaaggagagacagtagctgatgttaggacactacccaatgcctcaaccgtggacaatattcgctccatctttggaaatgctgttagtcgagaactgatagaaattggatgtgaggataaaaccctagccttcaaaatgaatggttacatatccaatgcaaactactcagtgaagaagtgcatcttcttactcttcatcaaccatcgtctggtagaatcaacttccttgagaaaagccatagaaacagtgtatgcagcctatttgcccaaaaacacacacccattcctgtacctcagtttagaaatcagtccccagaatgtggatgttaatgtgcaccccacaaagcatgaagttcacttcctgcacgaggagagcatcctggagcgggtgcagcagcacatcgagagcaagctcctgggctccaattcctccaggatgtacttcacccagactttgctaccaggacttgctggcccctctggggagatggttaaatccacaacaagtctgacctcgtcttctacttctggaagtagtgataaggtctatgcccaccagatggttcgtacagattcccgggaacagaagcttgatgcatttctgcagcctctgagcaaacccctgtccagtcagccccaggccattgtcacagaggataagacagatatttctagtggcagggctaggcagcaagatgaggagatgcttgaactcccagcccctgctgaagtggctgccaaaaatcagagcttggagggggatacaacaaaggggacttcagaaatgtcagagaagagaggacctacttccagcaaccccagaaagagacatcgggaagattctgatgtggaaatggtggaagatgattcccgaaaggaaatgactgcagcttgtaccccccggagaaggatcattaacctcactagtgttttgagtctccaggaagaaattaatgagcagggacatgaggttctccgggagatgttgcataaccactccttcgtgggctgtgtgaatcctcagtgggccttggcacagcatcaaaccaagttataccttctcaacaccaccaagcttagtgaagaactgttctaccagatactcatttatgattttgccaattttggtgttctcaggttatcggagccagcaccgctctttgaccttgccatgcttgccttagatagtccagagagtggctggacagaggaagatggtcccaaagaaggacttgctgaatacattgttgagtttctgaagaagaaggctgagatgcttgcagactatttctctttggaaattgatgagagtgttaacgccctccgttccctctatagccca

SEQ ID NO: 330547 - DNA, 1632 bp, Homo sapiens
  misc_feature (1510)..(1510): n is a, c, g, or t
  misc_feature (1514)..(1514): n is a, c, g, or t
  misc_feature (1516)..(1516): n is a, c, g, or t
  misc_feature (1544)..(1544): n is a, c, g, or t
  misc_feature (1551)..(1551): n is a, c, g, or t
acgaggcactgaggtgattggctgaaggcacttccgttgagcatctagacgtttccttggctcttctggcgccaaaatgtcgttcgtggcaggggttattcggcggctggacgagacagtggtgaaccgcatcgcggcgggggaagttatccagcggccagctaatgctatcaaagagatgattgagaactgtttagatgcaaaatccacaagtattcaagtgattgttaaagagggaggcctgaagttgattcagatccaagacaatggcaccgggatcaggaaagaagatctggatattgtatgtgaaaggttcactactagtaaactgcagtcctttgaggatttagccagtatttctacctatggctttcgaggtgaggctttggccagcataagccatgtggctcatgttactattacaacgaaaacagctgatggaaagtgtgcatacagagcaagttactcagatggaaaactgaaagcccctcctaaaccatgtgctggcaatcaagggacccagatcacggtggaggaccttttttacaacatagccacgaggagaaaagctttaaaaaatccaagtgaagaatatgggaaaattttggaagttgttggcaggtattcagtacacaatgcaggcattagtttctcagttaaaaaacaaggagagacagtagctgatgttaggacactacccaatgcctcaaccgtggacaatattcgctccatctttggaaatgctgttagtcgagaactgatagaaattggatgtgaggataaaaccctagccttcaaaatgaatggttacatatccaatgcaaactactcagtgaagaagtgcatcttcttactcttcatcaaccatcgtctggtagaatcaacttccttgagaaaagccatagaaacagtgtatgcagcctatttgcccaaaaacacacacccattcctgtacctcagtttagaaatcagtccccagaatgtggatgttaatgtgcaccccacaaagcatgaagttcacttcctgcacgaggagagcatcctggagcgggtgcagcagcacatcgagagcaagctcctgggctccaattcctccaggatgtacttcacccagactttgctaccaggacttgctggcccctctggggagatggttaaatccacaacaagtctgacctcgtcttctacttctggaagtagtgataaggtctatgcccaccagatggttcgtacagattcccgggaacagaagcttgatgcatttctgcagcctctgagcaaacccctgtccagtcagccccaggccattgtcacagaggataagacagatatttctagtggcagggctaggcagcaagatgaggagatgcttgaactcccagcccctgctgaagtggctgccaaaaatcagagcttggagggggatacaacaaaggggacttcagaaatgtcagagaagagaggacctacttccagcaaccccagaaagagaatcgggaagatctgatgngganangggggagatgattccgaaggaatgatgngttgtanccccggaaaggtctaactccataggtagagttcggggagaataggggggacagaggtcgcgaaagtggtaccccctcgggg

SEQ ID NO: 330548 - DNA, 949 bp, Homo sapiens
acgaggcactgaggtgattggctgaaggcacttccgttgagcatctagacgtttccttggctcttctggcgccaaaatgtcgttcgtggcaggggttattcggcggctggacgagacagtggtgaaccgcatcgcggcgggggaagttatccagcggccagctaatgctatcaaagagatgattgagaactgtttagatgcaaaatccacaagtattcaagtgattgttaaagagggaggcctgaagttgattcagatccaagacaatggcaccgggatcaggaaagaagatctggatattgtatgtgaaaggttcactactagtaaactgcagtcctttgaggatttagccagtatttctacctatggctttcgaggtgaggctttggccagcataagccatgtggctcatgttactattacaacgaaaacagctgatggaaagtgtgcatacagagcaagttactcagatggaaaactgaaagcccctcctaaaccatgtgctggcaatcaagggacccagatcacggtggaggaccttttttacaacatagccacgaggagaaaagctttaaaaaatccaagtgaagaatatgggaaaattttggaagttgttggcaggtattcagtacacaatgcaggcattagtttctcagttaaaaaacaaggagagacagtagctgatgttaggacactacccaatgcctcaaccgtggacaatattcgctccatctttggaaatgctgttagtcgagaactgatagaaattggatgtgaggataaaaccctagccttcaaaatgaatggttacatatccaatgcaaactactcagtgaagaagtgcatcttcttactcttcatcaacccatcgctggtaaaatcactccttaaaaggctaaaacggtttggctattccaaaaaaaccatccgctcttaaatccccatgggt

SEQ ID NO: 330549 - DNA, 927 bp, Homo sapiens
  misc_feature (763)..(763): n is a, c, g, or t
  misc_feature (766)..(766): n is a, c, g, or t
  misc_feature (773)..(773): n is a, c, g, or t
acgaggcactgaggtgattggctgaaggcacttccgttgagcatctagacgtttccttggctcttctggcgccaaaatgtcgttcgtggcaggggttattcggcggctggacgagacagtggtgaaccgcatcgcggcgggggaagttatccagcggccagctaatgctatcaaagagatgattgagaactgtttagatgcaaaatccacaagtattcaagtgattgttaaagagggaggcctgaagttgattcagatccaagacaatggcaccgggatcaggaaagaagatctggatattgtatgtgaaaggttcactactagtaaactgcagtcctttgaggatttagccagtatttctacctatggctttcgaggtgaggctttggccagcataagccatgtggctcatgttactattacaacgaaaacagctgatggaaagtgtgcatacagagcaagttactcagatggaaaactgaaagcccctcctaaaccatgtgctggcaatcaagggacccagatcacggtggaggaccttttttacaacatagccacgaggagaaaagctttaaaaaatccaagtgaagaatatgggaaaattttggaagttgttggcaggtattcagtacacaatgcaggcattagtttctcagttaaaaaacaaggagagacagtagctgatgttaggacactacccaatgcctcaaccgtggacaatattcgctccatctttggaaatgctgttagtcgagaactgtanaantggtgtnagggttaaacccttacctttaaaagggaagggttccatttccagggcaaactcttaagggaaaaagggccttttttacctttaaattaccataggtcgggtaaaaaaaacttcttttgaaaaagcccttaaaaacatgttttgccccctttttg

SEQ ID NO: 330550 - DNA, 2540 bp, Homo sapiens
acgaggcactgaggtgattggctgaaggcacttccgttgagcatctagacgtttccttggctcttctggcgccaaaatgtcgttcgtggcaggggttattcggcggctggacgagacagtggtgaaccgcatcgcggcgggggaagttatccagcggccagctaatgctatcaaagagatgattgagaactgtttagatgcaaaatccacaagtattcaagtgattgttaaagagggaggcctgaagttgattcagatccaagacaatggcaccgggatcaggaaagaagatctggatattgtatgtgaaaggttcactactagtaaactgcagtcctttgaggatttagccagtatttctacctatggctttcgaggtgaggctttggccagcataagccatgtggctcatgttactattacaacgaaaacagctgatggaaagtgtgcatacagagcaagttactcagatggaaaactgaaagcccctcctaaaccatgtgctggcaatcaagggacccagatcacggtggaggaccttttttacaacatagccacgaggagaaaagctttaaaaaatccaagtgaagaatatgggaaaattttggaagttgttggcaggtattcagtacacaatgcaggcattagtttctcagttaaaaaacaaggagagacagtagctgatgttaggacactacccaatgcctcaaccgtggacaatattcgctccatctttggaaatgctgttagtcgagaactgatagaaattggatgtgaggataaaaccctagccttcaaaatgaatggttacatatccaatgcaaactactcagtgaagaagtgcatcttcttactcttcatcaaccatcgtctggtagaatcaacttccttgagaaaagccatagaaacagtgtatgcagcctatttgcccaaaaacacacacccattcctgtacctcagtttagaaatcagtccccagaatgtggatgttaatgtgcaccccacaaagcatgaagttcacttcctgcacgaggagagcatcctggagcgggtgcagcagcacatcgagagcaagctcctgggctccaattcctccaggatgtacttcacccagactttgctaccaggacttgctggcccctctggggagatggttaaatccacaacaagtctgacctcgtcttctacttctggaagtagtgataaggtctatgcccaccagatggttcgtacagattcccgggaacagaagcttgatgcatttctgcagcctctgagcaaacccctgtccagtcagccccaggccattgtcacagaggataagacagatatttctagtggcagggctaggcagcaagatgaggagatgcttgaactcccagcccctgctgaagtggctgccaaaaatcagagcttggagggggatacaacaaaggggacttcagaaatgtcagagaagagaggacctacttccagcaaccccagaaagagacatcgggaagattctgatgtggaaatggtggaagatgattcccgaaaggaaatgactgcagcttgtaccccccggagaaggatcattaacctcactagtgttttgagtctccaggaagaaattaatgagcagggacatgaggttctccgggagatgttgcataaccactccttcgtgggctgtgtgaatcctcagtgggccttggcacagcatcaaaccaagttataccttctcaacaccaccaagcttagtgaagaactgttctaccagatactcatttatgattttgccaattttggtgttctcaggttatcggagccagcaccgctctttgaccttgccatgcttgccttagatagtccagagagtggctggacagaggaagatggtcccaaagaaggacttgctgaatacattgttgagtttctgaagaagaaggctgagatgcttgcagactatttctctttggaaattgatgaggaagggaacctgattggattaccccttctgattgacaactatgtgccccctttggagggactgcctatcttcattcttcgactagccactgaggtgaattgggacgaagaaaaggaatgttttgaaagcctcagtaaagaatgcgctatgttctattccatccggaagcagtacatatctgaggagtcgaccctctcaggccagcagagtgaagtgcctggctccattccaaactcctggaagtggactgtggaacacattgtctataaagccttgcgctcacacattctgcctcctaaacatttcacagaagatggaaatatcctgcagcttgctaacctgcctgatctatacaaagtctttgagaggtgttaaatatggttatttatgcactgtgggatgtgttcttctttctctgtattccgatacaaagtgttgtatcaaagtgtgatatacaaagtgtaccaacataagtgttggtagcacttaagacttatacttgccttctgatagtattcctttatacacagtggattgattataaataaatagatgtgtcttaacataa

SEQ ID NO: 330551 - DNA, 2471 bp, Homo sapiens
  misc_feature (23)..(23): n is a, c, g, or t
taggtaggtacgaggctgggtgntgcgggttccctgacgagcggagtcaggccttctccttttccgcagaccgtgtgtttctttaccgctctcccccgagaccttttaagggttgtttggagttttagatgcaaaatccacaagtattcaagtgattgttaaagagggaggcctgaagttgattcagatccaagacaatggcaccgggatcaggaaagaagatctggatattgtatgtgaaaggttcactactagtaaactgcagtcctttgaggatttagccagtatttctacctatggctttcgaggtgaggctttggccagcataagccatgtggctcatgttactattacaacgaaaacagctgatggaaagtgtgcatacagagcaagttactcagatggaaaactgaaagcccctcctaaaccatgtgctggcaatcaagggacccagatcacggtggaggaccttttttacaacatagccacgaggagaaaagctttaaaaaatccaagtgaagaatatgggaaaattttggaagttgttggcaggtattcagtacacaatgcaggcattagtttctcagttaaaaaacaaggagagacagtagctgatgttaggacactacccaatgcctcaaccgtggacaatattcgctccatctttggaaatgctgttagtcgagaactgatagaaattggatgtgaggataaaaccctagccttcaaaatgaatggttacatatccaatgcaaactactcagtgaagaagtgcatcttcttactcttcatcaaccatcgtctggtagaatcaacttccttgagaaaagccatagaaacagtgtatgcagcctatttgcccaaaaacacacacccattcctgtacctcagtttagaaatcagtccccagaatgtggatgttaatgtgcaccccacaaagcatgaagttcacttcctgcacgaggagagcatcctggagcgggtgcagcagcacatcgagagcaagctcctgggctccaattcctccaggatgtacttcacccagactttgctaccaggacttgctggcccctctggggagatggttaaatccacaacaagtctgacctcgtcttctacttctggaagtagtgataaggtctatgcccaccagatggttcgtacagattcccgggaacagaagcttgatgcatttctgcagcctctgagcaaacccctgtccagtcagccccaggccattgtcacagaggataagacagatatttctagtggcagggctaggcagcaagatgaggagatgcttgaactcccagcccctgctgaagtggctgccaaaaatcagagcttggagggggatacaacaaaggggacttcagaaatgtcagagaagagaggacctacttccagcaaccccagaaagagacatcgggaagattctgatgtggaaatggtggaagatgattcccgaaaggaaatgactgcagcttgtaccccccggagaaggatcattaacctcactagtgttttgagtctccaggaagaaattaatgagcagggacatgaggttctccgggagatgttgcataaccactccttcgtgggctgtgtgaatcctcagtgggccttggcacagcatcaaaccaagttataccttctcaacaccaccaagcttagtgaagaactgttctaccagatactcatttatgattttgccaattttggtgttctcaggttatcggagccagcaccgctctttgaccttgccatgcttgccttagatagtccagagagtggctggacagaggaagatggtcccaaagaaggacttgctgaatacattgttgagtttctgaagaagaaggctgagatgcttgcagactatttctctttggaaattgatgaggaagggaacctgattggattaccccttctgattgacaactatgtgccccctttggagggactgcctatcttcattcttcgactagccactgaggtgaattgggacgaagaaaaggaatgttttgaaagcctcagtaaagaatgcgctatgttctattccatccggaagcagtacatatctgaggagtcgaccctctcaggccagcagagtgaagtgcctggctccattccaaactcctggaagtggactgtggaacacattgtctataaagccttgcgctcacacattctgcctcctaaacatttcacagaagatggaaatatcctgcagcttgctaacctgcctgatctatacaaagtctttgagaggtgttaaatatggttatttatgcactgtgggatgtgttcttctttctctgtattccgatacaaagtgttgtatcaaagtgtgatatacaaagtgtaccaacataagtgttggtagcacttaagacttatacttgccttctgatagtattcctttatacacagtggattgattataaataaatagatgtgtcttaacataa

SEQ ID NO: 330552 - DNA, 2545 bp, Homo sapiens
  misc_feature (23)..(23): n is a, c, g, or t
taggtaggtacgaggctgggtgntgcgggttccctgacgagcggagtcaggccttctccttttccgcagaccgtgtgtttctttaccgctctcccccgagaccttttaagggttgtttggagtacggagtctcactttgtcacccaggctggagtgcagtggcgcgatctcagctgactgcaacctcctcctcacagtttagatgcaaaatccacaagtattcaagtgattgttaaagagggaggcctgaagttgattcagatccaagacaatggcaccgggatcaggaaagaagatctggatattgtatgtgaaaggttcactactagtaaactgcagtcctttgaggatttagccagtatttctacctatggctttcgaggtgaggctttggccagcataagccatgtggctcatgttactattacaacgaaaacagctgatggaaagtgtgcatacagagcaagttactcagatggaaaactgaaagcccctcctaaaccatgtgctggcaatcaagggacccagatcacggtggaggaccttttttacaacatagccacgaggagaaaagctttaaaaaatccaagtgaagaatatgggaaaattttggaagttgttggcaggtattcagtacacaatgcaggcattagtttctcagttaaaaaacaaggagagacagtagctgatgttaggacactacccaatgcctcaaccgtggacaatattcgctccatctttggaaatgctgttagtcgagaactgatagaaattggatgtgaggataaaaccctagccttcaaaatgaatggttacatatccaatgcaaactactcagtgaagaagtgcatcttcttactcttcatcaaccatcgtctggtagaatcaacttccttgagaaaagccatagaaacagtgtatgcagcctatttgcccaaaaacacacacccattcctgtacctcagtttagaaatcagtccccagaatgtggatgttaatgtgcaccccacaaagcatgaagttcacttcctgcacgaggagagcatcctggagcgggtgcagcagcacatcgagagcaagctcctgggctccaattcctccaggatgtacttcacccagactttgctaccaggacttgctggcccctctggggagatggttaaatccacaacaagtctgacctcgtcttctacttctggaagtagtgataaggtctatgcccaccagatggttcgtacagattcccgggaacagaagcttgatgcatttctgcagcctctgagcaaacccctgtccagtcagccccaggccattgtcacagaggataagacagatatttctagtggcagggctaggcagcaagatgaggagatgcttgaactcccagcccctgctgaagtggctgccaaaaatcagagcttggagggggatacaacaaaggggacttcagaaatgtcagagaagagaggacctacttccagcaaccccagaaagagacatcgggaagattctgatgtggaaatggtggaagatgattcccgaaaggaaatgactgcagcttgtaccccccggagaaggatcattaacctcactagtgttttgagtctccaggaagaaattaatgagcagggacatgaggttctccgggagatgttgcataaccactccttcgtgggctgtgtgaatcctcagtgggccttggcacagcatcaaaccaagttataccttctcaacaccaccaagcttagtgaagaactgttctaccagatactcatttatgattttgccaattttggtgttctcaggttatcggagccagcaccgctctttgaccttgccatgcttgccttagatagtccagagagtggctggacagaggaagatggtcccaaagaaggacttgctgaatacattgttgagtttctgaagaagaaggctgagatgcttgcagactatttctctttggaaattgatgaggaagggaacctgattggattaccccttctgattgacaactatgtgccccctttggagggactgcctatcttcattcttcgactagccactgaggtgaattgggacgaagaaaaggaatgttttgaaagcctcagtaaagaatgcgctatgttctattccatccggaagcagtacatatctgaggagtcgaccctctcaggccagcagagtgaagtgcctggctccattccaaactcctggaagtggactgtggaacacattgtctataaagccttgcgctcacacattctgcctcctaaacatttcacagaagatggaaatatcctgcagcttgctaacctgcctgatctatacaaagtctttgagaggtgttaaatatggttatttatgcactgtgggatgtgttcttctttctctgtattccgatacaaagtgttgtatcaaagtgtgatatacaaagtgtaccaacataagtgttggtagcacttaagacttatacttgccttctgatagtattcctttatacacagtggattgattataaataaatagatgtgtcttaacataa

SEQ ID NO: 330553 - DNA, 1656 bp, Homo sapiens
  misc_feature (23)..(23): n is a, c, g, or t
taggtaggtacgaggctgggtgntgagtgtatgcagcctatttgcccaaaaacacacacccattcctgtacctcagtttagaaatcagtccccagaatgtggatgttaatgtgcaccccacaaagcatgaagttcacttcctgcacgaggagagcatcctggagcgggtgcagcagcacatcgagagcaagctcctgggctccaattcctccaggatgtacttcacccagactttgctaccaggacttgctggcccctctggggagatggttaaatccacaacaagtctgacctcgtcttctacttctggaagtagtgataaggtctatgcccaccagatggttcgtacagattcccgggaacagaagcttgatgcatttctgcagcctctgagcaaacccctgtccagtcagccccaggccattgtcacagaggataagacagatatttctagtggcagggctaggcagcaagatgaggagatgcttgaactcccagcccctgctgaagtggctgccaaaaatcagagcttggagggggatacaacaaaggggacttcagaaatgtcagagaagagaggacctacttccagcaaccccagaaagagacatcgggaagattctgatgtggaaatggtggaagatgattcccgaaaggaaatgactgcagcttgtaccccccggagaaggatcattaacctcactagtgttttgagtctccaggaagaaattaatgagcagggacatgaggttctccgggagatgttgcataaccactccttcgtgggctgtgtgaatcctcagtgggccttggcacagcatcaaaccaagttataccttctcaacaccaccaagcttagtgaagaactgttctaccagatactcatttatgattttgccaattttggtgttctcaggttatcggagccagcaccgctctttgaccttgccatgcttgccttagatagtccagagagtggctggacagaggaagatggtcccaaagaaggacttgctgaatacattgttgagtttctgaagaagaaggctgagatgcttgcagactatttctctttggaaattgatgaggaagggaacctgattggattaccccttctgattgacaactatgtgccccctttggagggactgcctatcttcattcttcgactagccactgaggtgaattgggacgaagaaaaggaatgttttgaaagcctcagtaaagaatgcgctatgttctattccatccggaagcagtacatatctgaggagtcgaccctctcaggccagcagagtgaagtgcctggctccattccaaactcctggaagtggactgtggaacacattgtctataaagccttgcgctcacacattctgcctcctaaacatttcacagaagatggaaatatcctgcagcttgctaacctgcctgatctatacaaagtctttgagaggtgttaaatatggttatttatgcactgtgggatgtgttcttctttctctgtattccgatacaaagtgttgtatcaaagtgtgatatacaaagtgtaccaacataagtgttggtagcacttaagacttatacttgccttctgatagtattcctttatacacagtggattgattataaataaatagatgtgtcttaacataa

SEQ ID NO: 330554 - DNA, 2447 bp, Homo sapiens
acgaggcactgaggtgattggctgaaggcacttccgttgagcatctagacgtttccttggctcttctggcgccaaaatgtcgttcgtggcaggggttattcggcggctggacgagacagtggtgaaccgcatcgcggcgggggaagttatccagcggccagctaatgctatcaaagagatgattgagaactgtttagatgcaaaatccacaagtattcaagtgattgttaaagagggaggcctgaagttgattcagatccaagacaatggcaccgggatcaggaaagaagatctggatattgtatgtgaaaggttcactactagtaaactgcagtcctttgaggatttagccagtatttctacctatggctttcgaggtgaggctttggccagcataagccatgtggctcatgttactattacaacgaaaacagctgatggaaagtgtgcatacagagcaagttactcagatggaaaactgaaagcccctcctaaaccatgtgctggcaatcaagggacccagatcacggtggaggaccttttttacaacatagccacgaggagaaaagctttaaaaaatccaagtgaagaatatgggaaaattttggaagttgttggcaggtattcagtacacaatgcaggcattagtttctcagttaaaaaacaaggagagacagtagctgatgttaggacactacccaatgcctcaaccgtggacaatattcgctccatctttggaaatgctgttagtcgagaactgatagaaattggatgtgaggataaaaccctagccttcaaaatgaatggttacatatccaatgcaaactactcagtgaagaagtgcatcttcttactcttcatcaaccatcgtctggtagaatcaacttccttgagaaaagccatagaaacagtgtatgcagcctatttgcccaaaaacacacacccattcctgtacctcagtttagaaatcagtccccagaatgtggatgttaatgtgcaccccacaaagcatgaagttcacttcctgcacgaggagagcatcctggagcgggtgcagcagcacatcgagagcaagctcctgggctccaattcctccaggatgtacttcacccagactttgctaccaggacttgctggcccctctggggagatggttaaatccacaacaagtctgacctcgtcttctacttctggaagtagtgataaggtctatgcccaccagatggttcgtacagattcccgggaacagaagcttgatgcatttctgcagcctctgagcaaacccctgtccagtcagccccaggccattgtcacagaggataagacagatatttctagtggcagggctaggcagcaagatgaggagatgcttgaactcccagcccctgctgaagtggctgccaaaaatcagagcttggagggggatacaacaaaggggacttcagaaatgtcagagaagagaggacctacttccagcaaccccagaaagagacatcgggaagattctgatgtggaaatggtggaagatgattcccgaaaggaaatgactgcagcttgtaccccccggagaaggatcattaacctcactagtgttttgagtctccaggaagaaattaatgagcagggacatgaggttctccgggagatgttgcataaccactccttcgtgggctgtgtgaatcctcagtgggccttggcacagcatcaaaccaagttataccttctcaacaccaccaagcttagtgaagaactgttctaccagatactcatttatgattttgccaattttggtgttctcaggttatcggagccagcaccgctctttgaccttgccatgcttgccttagatagtccagagagtggctggacagaggaagatggtcccaaagaaggacttgctgaatacattgttgagtttctgaagaagaaggctgagatgcttgcagactatttctctttggaaattgatgaggtgaattgggacgaagaaaaggaatgttttgaaagcctcagtaaagaatgcgctatgttctattccatccggaagcagtacatatctgaggagtcgaccctctcaggccagcagagtgaagtgcctggctccattccaaactcctggaagtggactgtggaacacattgtctataaagccttgcgctcacacattctgcctcctaaacatttcacagaagatggaaatatcctgcagcttgctaacctgcctgatctatacaaagtctttgagaggtgttaaatatggttatttatgcactgtgggatgtgttcttctttctctgtattccgatacaaagtgttgtatcaaagtgtgatatacaaagtgtaccaacataagtgttggtagcacttaagacttatacttgccttctgatagtattcctttatacacagtggattgattataaataaatagatgtgtcttaacataa

SEQ ID NO: 330555 - DNA, 800 bp, Homo sapiens
ttgtcaccatttgggtagcgggggggggatttgaggctacgggactctctttagaagcccgacacaggagccagcaccgctctttgaccttgccatgcttgccttagatagtccagagagtggctggacagaggaagatggtcccaaagaaggacttgctgaatacattgttgagtttctgaagaagaaggctgagatgcttgcagactatttctctttggaaattgatgaggaagggaacctgattggattaccccttctgattgacaactatgtgccccctttggagggactgcctatcttcattcttcgactagccactgaggtgaattgggacgaagaaaaggaatgttttgaaagcctcagtaaagaatgcgctatgttctattccatccggaagcagtacatatctgaggagtcgaccctctcaggccagcagagtgaagtgcctggctccattccaaactcctggaagtggactgtggaacacattgtctataaagccttgcgctcacacattctgcctcctaaacatttcacagaagatggaaatatcctgcagcttgctaacctgcctgatctatacaaagtctttgagaggtgttaaatatggttatttatgcactgtgggatgtgttcttctttctctgtattccgatacaaagtgttgtatcaaagtgtgatatacaaagtgtaccaacataagtgttggtagcacttaagacttatacttgccttctgatagtattcctttatacacagtggattgattataaataaatagatgtgtcttaacataa

SEQ ID NO: 330556 - DNA, 2608 bp, Homo sapiens
acgaggcactgaggtgattggctgaaggcacttccgttgagcatctagacgtttccttggctcttctggcgccaaaatgtcgttcgtggcaggggttattcggcggctggacgagacagtggtgaaccgcatcgcggcgggggaagttatccagcggccagctaatgctatcaaagagatgattgagaactgtttagatgcaaaatccacaagtattcaagtgattgttaaagagggaggcctgaagttgattcagatccaagacaatggcaccgggatcaggaaagaagatctggatattgtatgtgaaaggttcactactagtaaactgcagtcctttgaggatttagccagtatttctacctatggctttcgaggtgaggctttggccagcataagccatgtggctcatgttactattacaacgaaaacagctgatggaaagtgtgcatacagagcaagttactcagatggaaaactgaaagcccctcctaaaccatgtgctggcaatcaagggacccagatcacggtggaggaccttttttacaacatagccacgaggagaaaagctttaaaaaatccaagtgaagaatatgggaaaattttggaagttgttggcaggtattcagtacacaatgcaggcattagtttctcagttaaaaaacaaggagagacagtagctgatgttaggacactacccaatgcctcaaccgtggacaatattcgctccatctttggaaatgctgttagtcgagaactgatagaaattggatgtgaggataaaaccctagccttcaaaatgaatggttacatatccaatgcaaactactcagtgaagaagtgcatcttcttactcttcatcaaccatcgtctggtagaatcaacttccttgagaaaagccatagaaacagtgtatgcagcctatttgcccaaaaacacacacccattcctgtacctcagtttagaaatcagtccccagaatgtggatgttaatgtgcaccccacaaagcatgaagttcacttcctgcacgaggagagcatcctggagcgggtgcagcagcacatcgagagcaagctcctgggctccaattcctccaggatgtacttcacccagactttgctaccaggacttgctggcccctctggggagatggttaaatccacaacaagtctgacctcgtcttctacttctggaagtagtgataaggtctatgcccaccagatggttcgtacagattcccgggaacagaagcttgatgcatttctgcagcctctgagcaaacccctgtccagtcagccccaggccattgtcacagaggataagacagatatttctagtggcagggctaggcagcaagatgaggagatgcttgaactcccagcccctgctgaagtggctgccaaaaatcagagcttggagggggatacaacaaaggggacttcagaaatgtcagagaagagaggacctacttccagcaaccccagaaagagacatcgggaagattctgatgtggaaatggtggaagatgattcccgaaaggaaatgactgcagcttgtaccccccggagaaggatcattaacctcactagtgttttgagtctccaggaagaaattaatgagcagggacatgaggttctccgggagatgttgcataaccactccttcgtgggctgtgtgaatcctcagtgggccttggcacagcatcaaaccaagttataccttctcaacaccaccaagcttagtgaagaactgttctaccagatactcatttatgattttgccaattttggtgttctcaggttatcggagccagcaccgctctttgaccttgccatgcttgccttagatagtccagagagtggctggacagaggaagatggtcccaaagaaggacttgctgaatacattgttgagtttctgaagaagaaggctgagatgcttgcagactatttctctttggaaattgatgaggtgaattgggacgaagaaaaggaatgttttgaaagcctcagtaaagaatgcgctatgttctattccatccggaagcagtacatatctgaggagtcgaccctctcaggccagcagagtgaagtgcctggctccattccaaactcctggaagtggactgtggaacacattgtctataaagccttgcgctcacacattctgcctcctaaacatttcacagaagatggaaatatcctgcagcttgctaacctgcctgatctatacaaagtctttgagaggtgttaaatatggttatttatgcactgtgggatgtgttcttctttctctgtattccgatacaaagtgttgtatcaaagtgtgatatacaaagtgtaccaacataagtgttggtagcacttaagacttatacttgccttctgatagtattcctttatacacagtggattgattataaataaatagatgtgtcttaacataacgatgcggtcggttcccttaagtgaggttaaatcatgatcccgctcattgctcgctggctcgggcgttcggtgggggaagcgtttcacttactaaaggcgtaatccggtttccccaaatcggggtaccgggaagaactttgtgcaaagccagaaaggccag

SEQ ID NO: 330557 - DNA, 2031 bp, Homo sapiens
acgaggcactgaggtgattggctgaaggcacttccgttgagcatctagacgtttccttggctcttctggcgccaaaatgtcgttcgtggcaggggttattcggcggctggacgagacagtggtgaaccgcatcgcggcgggggaagttatccagcggccagctaatgctatcaaagagatgattgagaactgtttagatgcaaaatccacaagtattcaagtgattgttaaagagggaggcctgaagttgattcagatccaagacaatggcaccgggatcaggaaagaagatctggatattgtatgtgaaaggttcactactagtaaactgcagtcctttgaggatttagccagtatttctacctatggctttcgaggtgaggctttggccagcataagccatgtggctcatgttactattacaacgaaaacagctgatggaaagtgtgcatacagagcaagttactcagatggaaaactgaaagcccctcctaaaccatgtgctggcaatcaagggacccagatcacggtggaggaccttttttacaacatagccacgaggagaaaagctttaaaaaatccaagtgaagaatatgggaaaattttggaagttgttggcaggtattcagtacacaatgcaggcattagtttctcagttaaaaaacaaggagagacagtagctgatgttaggacactacccaatgcctcaaccgtggacaatattcgctccatctttggaaatgctgttagtcgagaactgatagaaattggatgtgaggataaaaccctagccttcaaaatgaatggttacatatccaatgcaaactactcagtgaagaagtgcatcttcttactcttcatcaaccatcgtctggtagaatcaacttccttgagaaaagccatagaaacagtgtatgcagcctatttgcccaaaaacacacacccattcctgtacctcagtttagaaatcagtccccagaatgtggatgttaatgtgcaccccacaaagcatgaagttcacttcctgcacgaggagagcatcctggagcgggtgcagcagcacatcgagagcaagctcctgggctccaattcctccaggatgtacttcacccagactttgctaccaggacttgctggcccctctggggagatggttaaatccacaacaagtctgacctcgtcttctacttctggaagtagtgataaggtctatgcccaccagatggttcgtacagattcccgggaacagaagcttgatgcatttctgcagcctctgagcaaacccctgtccagtcagccccaggccattgtcacagaggataagacagatatttctagtggcagggctaggcagcaagatgaggagatgcttgaactcccagcccctgctgaagtggctgccaaaaatcagagcttggagggggatacaacaaaggggacttcagaaatgtcagagaagagaggacctacttccagcaaccccagaaagagacatcgggaagattctgatgtggaaatggtggaagatgattcccgaaaggaaatgactgcagcttgtaccccccggagaaggatcattaacctcactagtgttttgagtctccaggaagaaattaatgagcagggacatgaggttctccgggagatgttgcataaccactccttcgtgggctgtgtgaatcctcagtgggccttggcacagcatcaaaccaagttataccttctcaacaccaccaagcttagtgaagaactgttctaccagatactcatttatgattttgccaattttggtgttctcaggttatcggagccagcaccgctctttgaccttgccatgcttgccttagatagtccagagagtggctggacagaggaagatggtcccaaagaaggacttgctgaatacattgttgagtttctgaagaagaaggctgagatgcttgcagactatttctctttggaaattgatgagaggtgtgacagccattcttatacttctgttgtattcttcaaataaaatttccagccggg

SEQ ID NO: 330558 - DNA, 1518 bp, Homo sapiens
  misc_feature (1498)..(1498): n is a, c, g, or t
acgaggcactgaggtgattggctgaaggcacttccgttgagcatctagacgtttccttggctcttctggcgccaaaatgtcgttcgtggcaggggttattcggcggctggacgagacagtggtgaaccgcatcgcggcgggggaagttatccagcggccagctaatgctatcaaagagatgattgagaactgtttagatgcaaaatccacaagtattcaagtgattgttaaagagggaggcctgaagttgattcagatccaagacaatggcaccgggatcaggaaagaagatctggatattgtatgtgaaaggttcactactagtaaactgcagtcctttgaggatttagccagtatttctacctatggctttcgaggtgaggctttggccagcataagccatgtggctcatgttactattacaacgaaaacagctgatggaaagtgtgcatacagagcaagttactcagatggaaaactgaaagcccctcctaaaccatgtgctggcaatcaagggacccagatcacggtggaggaccttttttacaacatagccacgaggagaaaagctttaaaaaatccaagtgaagaatatgggaaaattttggaagttgttggcaggtattcagtacacaatgcaggcattagtttctcagttaaaaaacaaggagagacagtagctgatgttaggacactacccaatgcctcaaccgtggacaatattcgctccatctttggaaatgctgttagtcgagaactgatagaaattggatgtgaggataaaaccctagccttcaaaatgaatggttacatatccaatgcaaactactcagtgaagaagtgcatcttcttactcttcatcaaccatcgtctggtagaatcaacttccttgagaaaagccatagaaacagtgtatgcagcctatttgcccaaaaacacacacccattcctgtacctcagtttagaaatcagtccccagaatgtggatgttaatgtgcaccccacaaagcatgaagttcacttcctgcacgaggagagcatcctggagcgggtgcagcagcacatcgagagcaagctcctgggctccaattcctccaggatgtacttcacccagactttgctaccaggacttgctggcccctctggggagatggttaaatccacaacaagtctgacctcgtcttctacttctggaagtagtgataaggtctatgcccaccagatggttcgtacagattcccgggaacagaagcttgatgcatttctgcagcctctgagcaaacccctgtccagtcagccccaggccattgtcacagaggataagacagatatttctagtggcagggctaggcagcaagatgaggagatgcttgaactcccagcccctgctgaagtggctgccaaaaatcagagcttggagggggatacaacaaaggggacttcagaaatgtcagagaagagaggacctacttccagcaaccccagaaaggagacattnggaaaattcctggatgttgg

SEQ ID NO: 330559 - DNA, 874 bp, Homo sapiens
acgaggcactgaggtgattggctgaaggcacttccgttgagcatctagacgtttccttggctcttctggcgccaaaatgtcgttcgtggcaggggttattcggcggctggacgagacagtggtgaaccgcatcgcggcgggggaagttatccagcggccagctaatgctatcaaagagatgattgagaactgtttagatgcaaaatccacaagtattcaagtgattgttaaagagggaggcctgaagttgattcagatccaagacaatggcaccgggatcaggaaagaagatctggatattgtatgtgaaaggttcactactagtaaactgcagtcctttgaggatttagccagtatttctacctatggctttcgaggtgaggctttggccagcataagccatgtggctcatgttactattacaacgaaaacagctgatggaaagtgtgcatacagagcaagttactcagatggaaaactgaaagcccctcctaaaccatgtgctggcaatcaagggacccagatcacggtgcaggacctttttcactacatacccacgaggagcaaaccttctacaatatccaactgaagtatatggtaaattactagaaattgttgtcgggtattcactactcgatgccagccttagtttctcagttaaatcacaaggaagttgattctaccagacgatggttgatgaagagtaagaagatgcacttcttcactgagtagtttgcattggatactgaagcctttagtcttttccagatgcaaccttaaaatcagtgacaagaaacattccaaacaagcaacagtctcagaaatgtaaactggccaagtggaaatgttaaagggatcctctaggtcgcccgcg

SEQ ID NO: 330560 - DNA, 855 bp, Homo sapiens
catatgtctgtattacaattcagagaaggaaaaaagtaacattcaaagaaggaaggaaggaaaaagggaaagagagagggagggagggaggcaggcaggcaggctgtaaaaggaatctgcatcacacagcactggggagaagacagggggctcttccgtgaggtgtggcgaagttgagtcctcatgatggctgcagacctgggtctctgcaaactaattctcggcacacaaagagcagaatctctagtccaagagttaaattcagaaaaccaatttattgattcataatgagaagtaaaaatggatatgaaaacttacataaattaatacatgaaataattaaaaggaaagtatgtgtgtagtttccaaaggttgtttcaataagaatttttttcaaatacaaggtaagactttttagtattgggctaaatgggttttaagatgaaaaacattatgatgccaaaaagcaatgttatatactgccaaaacagtgtgctagatcaagaagatagtagttatgaataaataagccctttaaaatagctcatcacaatatataaaataacaactgacagcattacaagagaacatagagacaacaaaatttattgcccaagattttcacaaagccctattagagactggtagattagagggacaaaaaaaaaaatcagaacaaaaaagcataaatgtatacaaaatttgattgacaagattaataaaaatcccagagcaaaatatatgtgtgtgtggagcgaagctttcacaaccacggatgatggacgaggttggaagctacaatgagcccaaacaatccacccagcttagtatgttccctgagcacaaagcagtgaa

SEQ ID NO: 330561 - DNA, 417 bp, Homo sapiens
ctgggctcctgggtctgagggaagaggggctgggggtctggactcctgggtctgagggaggaggggctggggtactggactcctgggtctgagggaaggagtgggctcaggaccaaaactctagtttcctgaagaggaaaggttcctaggatttctgggtctccagtggggcctggaactctacctaggccccttagttttaaccttgatttcttcctttcagactttgctgttccagccaacatgcgctgtggggtgcagacacccactgcctgatctcacttctgtcagatgctcccatccactattaatgcactaggtgggaggagagggcggcaatgacactgcacctctcctttcccaccgcattccctggagctccctaaataaaactttttttaacgtgaaaaaaaaaaa

SEQ ID NO: 330562 - DNA, 416 bp, Homo sapiens
  misc_feature (50)..(50): n is a, c, g, or t
  misc_feature (210)..(210): n is a, c, g, or t
  misc_feature (212)..(212): n is a, c, g, or t
cgtcaaagacacagcactctgtgggtactcaaatttaatcaatagttcancttatttacaaactctcaagcagctcattttatgttagttgcacaatctggaggtctggagttcttcacatgaaatttaataaattatcatgcaagctcatttttattcccattttttttacccagggagaatcagtctaccagggcaaataactggctntncgaattcggcactttgctgttccagccaacatgcgctgtggggtgcagacacccactgcctgatctcacttctgtcagatgctcccatccactattaatgcactaggtgggaggagagggcggcaatgacactgcacctctcctttcccaccgcattccctggagctccctaaataaaactttttttaacgtgaaaaaaaaaaa

SEQ ID NO: 330563 - DNA, 834 bp, Homo sapiens
tcccggggtcagtgccgtagcgcccggctcctgcaggcgctcggcctccgctcattcctgaccccgcagtgggcgcgatggcggaggctgtactgagggtcgcccggcggcagctgagccagcgcggcgggtctggagcccccatcctcctgcggcagatgttcgagcctgtgagctgcaccttcacgtacctgctgggtgacagagagtcccgggaggccgttctgatcgacccagtcctggaaacagcgcctcgggatgcccagctgatcaaggagctggggctgcggctgctctatgctggcgttggagaccagggccagccctggccacaccccaggctgtgtcaccttcgtcctgaatgaccacagcatggccttcactggagatgccctgttgatccgtgggtgtgggcggacagacttccagcaaggctgtgccaagaccttgtaccactcggtccatgaaaagatcttcacacttccaggagactgtctgatctaccctgctcacgattaccatgggttcacagtgtccaccgtggaggaggagaggactctgaaccctcggctcaccctcagctgtgaggagtttgtcaaaatcatgggcaacctgaacttgcctaaacctcagcagatagactttgctgttccagccaacatgcgctgtggggtgcagacacccactgcctgatctcacttctgtcagatgctcccatccactattaatgcactaggtgggaggagagggcggcaatgacactgcacctctcctttcccaccgcattccctggagctccctaaataaaactttttttaacgtgaaaaaaaaaaa

SEQ ID NO: 330564 - DNA, 983 bp, Homo sapiens
tcccggggtcagtgccgtagcgcccggctcctgcaggcgctcggcctccgctcattcctgaccccgcagtgggcgcgatggcggaggctgtactgagggtcgcccggcggcagctgagccagcgcggcgggtctggagcccccatcctcctgcggcagatgttcgagcctgtgagctgcaccttcacgtacctgctgggtgacagagagtcccgggaggccgttctgatcgacccagtcctggaaacagcgcctcgggatgcccagctgatcaaggagctggggctgcggctgctctatgctgtgaatacccactgccacgcggaccacattacaggctcggggctgctccgttccctcctccctggctgccagtctgtcatctcccgccttagtggggcccaggctgacttacacattgaggatggagactccatccgcttcgggcgcttcgcgttggagaccagggccagccctggccacaccccaggctgtgtcaccttcgtcctgaatgaccacagcatggccttcactggagatgccctgttgatccgtgggtgtgggcggacagacttccagcaaggctgtgccaagaccttgtaccactcggtccatgaaaagatcttcacacttccaggagactgtctgatctaccctgctcacgattaccatgggttcacagtgtccaccgtggaggaggagaggactctgaaccctcggctcaccctcagctgtgaggagtttgtcaaaatcatgggcaacctgaacttgcctaaacctcagcagatagactttgctgttccagccaacatgcgctgtggggtgcagacacccactgcctgatctcacttctgtcagatgctcccatccactattaatgcactaggtgggaggagagggcggcaatgacactgcacctctcctttcccaccgcattccctggagctccctaaataaaactttttttaacgtgaaaaaaaaaaa

SEQ ID NO: 330565 - DNA, 492 bp, Homo sapiens
ctaggagcaacaggctacagcataagtgtgcagtaggctatacctaggtttgtgtgagatgttcatacaactacaagatcacctaacgacatacttctcagaatgtatctccattgctaagcaacacatgaccgtacaaccagcataaacaaattcaagatgtatctactaatccttggtaagcacacaatggaactgaaggaacagaacggcatgggtagtaaatgctcggcagggaccaggcgcagtggctcacccctgtaatcccagcactttgggaggcggaggtggcaagatcatttgaggtcaggagtctgagaccagcctgaccgacatggtgaaatcccatctctactaaaaatagtaagaagtagctgggtgtatggtggcaaacgcctgtgatcccaaccactcgggaggctgatgcagaacaatcgcttgaacctgggaggcggaggttgcaatgagctgagacggcgccactgcactcca

SEQ ID NO: 330566 - DNA, 573 bp, Homo sapiens
gtgccatttgtgtctaacctcgcacctatggtagcactttatatgcctggcatgagggtagtgggctggtagtagccttgacctttgtgattcttgaaggccaggccacggagttctcacttccaagccagcatcaacaaaaagtcacacgcaacgaaaaaaattctctaatgaccaaagtaaaattgaaaagcttgatgccactgctaaatgaaaaatacattatctctctcttccctccttatcccttttctcctcctcaacccagaatcttatccatgcttagctaaatccactttcccttcctgcaagggaaaagacaggaatgctctttgtttcaaaggtctagagaaaggcgcaataaatttcactcctagaggccctgatgtgctgctggagacgagaatagggacaaagcaggccagcagcaatggagaccaggcccagaacagccgatgggagagaaactgggaggtgagcatttggcggaaggctacaaggaggacaaggacaagtgagattccaaaaacaatccatcagagatgcaatagaggatgaggtcatttgtatgac

SEQ ID NO: 330567 - DNA, 1031 bp, Homo sapiens
cttttccacaggggaaattatttcataataaaaagaaagcaagctggacaggtaggcaagcttgaggtccaatcataggacgcttaagttagtaaatttgaaatcctgaggtccttgaccagtggatggtgggtactgaaggagggtatgggaaatgctggtatagcaaatagtatgcatcccattttcctctgcctgccttttagctcctcaacactgagttatgttccagtgatccttttctccctaatttctcccatgagagccagtctgtagttggtttttcaacaaacatctgtgaaagaaaaccgaagttttaaatgacttctcatggttattttttttcctttctcttgcaggacattggggacacattgagcaggtatagttttctgtttccctagtgttaaatcaaatatgagaagactgtctccttcacatttgtaaatcctgaaaggagccctgagcctgaggatggacatcttatcaaattgacacatatccctgaagagagtcactagtatacaaagaattagatgaaccacagctctactcagtaaaattcaggaagtagggggttcatgtgggaggctgccggtggattaggggtatgaggacacttccatggagagggtgtggccttacagggacctgggctgaatataagggtagtttatgtctattgcttcctatacatttcagaatcctttcccccttcattatctcattttttttttttctgtaatgggggaaataaagcctaagaaaggtgtgactggcctgcatttacataattactgatgagccacctggattctggctcttattcttactcttgctatttctctatgttccatcaaaaaaaaaaaagtgaggaagaactccctggcagctggaacacgatcaaagagggagagcttggagggggcagtaagccagggcaaagttgttttgcaggatggatgacgaggcaagtgggatgggccttgggaagctcatgtttggtgtaagaatgccttcaggggtggaaa

SEQ ID NO: 330568 - DNA, 828 bp, Homo sapiens
gggtttacgctgccgccggcatccgctcggacgcggccacgttgtcttgcgcgctttgcccgcctggccctgggactctgaccctcggctaccctttcctgccccactagcgtggccgcgagcctcggtgagccggccgtattcccgctctcgcttagggggcacaggcgcaggcatcggcccggccactccaagccttcggtgtgctgctgtggctgctgtcttgggatactggtgccctgtgtgatggctgccatgccctcctgtcctgccctgtgtgcactctcatgtgaagcagctgaagcctgtgagatgatgctgcctggatgatgtttggtgctcatgttgcatgatgcttctgtgcatgccgtgtgtgtccctatgaccctgttgctgctccctctgcatgtgcctgtgctgctcattgtgcctctctgtgtgatgttgttgggccagatggtgctcttgcatgtcatggatgaaccatccttagccgcctgttgttgctcttgcaatggtatctttctgtcgagatgtcccattgtattgtctctgtactagctgtgccgagtatacgagtactggtatgctggctgtagcgctctgtccctgcttagctaggtgtgcaactgtgccatgatgatcgtagatctgttgttctgattgccctgtcatgttgccctgtgtgattgagccttatcctcttgtatgtatgtgtcacatttgcgtgcctcatgtctgtgcaccgtgtgtctcaatcttgtgactccaatcttgtgtaatacgctgcttgctgcacctgatgctgtgtctgtctgggtgcccctg

SEQ ID NO: 330569 - DNA, 569 bp, Homo sapiens
aaaggaagaaagaaaccatgtactgatcagcaatgtgcggttcctgagaaggcaggtggaaatgagaactaaagtacatatgccaggaattagtgtcagagagtcttctgttgtatgggaagaaatgattgtttcagagtatgggaaagacagttggtttgcgagaactagtaggagtatttggtcagtgaacatctatttatagtgtaaccattctgccctgggcaacaagcgaaactccatctcaaaaaaaaaaaaaatttactcatgttttttaaatttagggctgaaagaatcaggattcctgaaccttggatcacacctccagatttgcaagagaaaatccacatttttgcccaaaaatgtctattcttgacggagagtctaaagcagttcacagaaaaaatgcagacaacgctaaaccaacatacacgggcatgccaccagggtgtgtcatcgtcaccatgggtcggagcacacgaagtacaagaggaccatcctaccagtggggccacgtctcaacggtttatcctaccatttttctgcacgccatcctgaagacagcaggg

SEQ ID NO: 330570 - DNA, 3325 bp, Homo sapiens
gggtttacgctgccgccggcatccgctcggacgcggccacgttgtcttgcgcgctttgcccgcctggccctgggactctgaccctcggctaccctttcctgccccactagcgtggccgcgagcctcggtgagccggccgtattcccgctctcgcttagggggcacaggcgcaggcatcggcccggccactccaagccttcggtgcgcgggcgcgtctgggatacgggcccgggaggcgccgccctccgtccgcccggtgcctctcaggaacagcgaaccggagagagcgccggagagttgggctcagtgcggagctcggcgccggggcccatgcccgtgcgcccccgcaggccggcgccatggcctccgggagtgtggccgagtgcctgcagcaggagaccacctgccccgtgtgcctgcagtacttcgcagagcccatgatgctcgactgcggccataacatctgttgcgcgtgcctcgcccgctgctggggcacggcagagactaacgtgtcgtgcccgcagtgccgggagaccttcccgcagaggcacatgcggcccaaccggcacctggccaacgtgacccaactggtaaagcagctgcgcaccgagcggccgtcggggcccggcggcgagatgggcgtgtgcgagaagcaccgcgagcccctgaagctgtactgcgaggaggaccagatgcccatctgcgtggtgtgcgaccgctcccgcgagcaccgcggccacagcgtgctgccgctcgaggaggcggtggagggcttcaaggagcaaatccagaaccagctcgaccatttaaaaagagtgaaagatttaaagaagagacgtcgggcccagggggaacaggcacgagctgaactcttgagcctaacccagatggagagggagaagattgtttgggagtttgagcagctgtatcactccttaaaggagcatgagtatcgcctcctggcccgccttgaggagctagacttggccatctacaatagcatcaatggtgccatcacccagttctcttgcaacatctcccacctcagcagcctgatcgctcagctagaagagaagcagcagcagcccaccagggagctcctgcaggacattggggacacattgagcagggctgaaagaatcaggattcctgaaccttggatcacacctccagatttgcaagagaaaatccacatttttgcccaaaaatgtctattcttgacggagagtctaaagcagttcacagaaaaaatgcagtcagatatggagaaaatccaagaattaagagaggctcagttatactcagtggacgtgactctggacccagacacggcctaccccagcctgatcctctctgataatctgcggcaagtgcggtacagttacctccaacaggacctgcctgacaaccccgagaggttcaatctgtttccctgtgtcttgggctctccatgcttcatcgccgggagacattattgggaggtagaggtgggagataaagccaagtggaccataggtgtctgtgaagactcagtgtgcagaaaaggtggagtaacctcagccccccagaatggattctgggcagtgtctttgtggtatgggaaagaatattgggctcttacctccccaatgactgccctacccctgcggaccccgctccagcgggtggggattttcttggactatgatgctggtgaggtctccttctacaacgtgacagagaggtgtcacaccttcactttctctcatgctaccttttgtgggcctgtccggccctacttcagtctgagttactcgggagggaaaagtgcagctcctctgatcatctgccccatgagtgggatagatgggttttctggccatgttgggaatcatggtcattccatggagacctccccttgaggaggtgaattcaggccaaaagggctgttggctgtaatcctacgccaggcacaaggcatcttgttgccttgccacgtcctgtcacagctgggtatccttaccatgttccacgcccttgcagtgggagacaggatgtccatgttctctaccatccttttccttcccatgcagattgtgaaatgtaatgagatgtatcaagatatcctagaaataaaaaccagatgtccacctccagtgtttcatactttctggttttacacatcgctggagggataaagagtatggataatctttggatttggagagccgttcaagatacttccagcttcttggctcagcctggcttcctctggttcagccccacataatgattatggctatttgctgtcatttctgggctagggctcctttctaacaacctagactggaataaggccctgtcagcatggctccctttatcccagttttccgtctgggaacagtacctctgcccctgattcccaatgtgccatagttttattaactccattaaagaagcctgtatgtgttttggttagttacagttattttacaataatggtgggtaatggccccacctctgttatgagataatgttctaatcaatgtctctgcctttgtatcttttctgagggctttgtctgttctcttcattctaatgaaaggtgtattctagtgctgggtgcatatcatccaggataatattctgcccaactccatcctctgttactagatcccttaccagtcacatttgtggactggtggccagtcgtataccatccctggaaggattctgggacaatattccagggattcattgacttcttggctccttttctccatttcctttgggggaagggggaattgaccatgcttaagtgcatcctatcaaggggcagctccgtccccatggccattggatcatgagacactctgaagtcagaaggctggggcagatcacttcaagcaagcccccatgatggttctcagtcctgcttctctgtgggtacgtgcccctctgtttaaaaataaactgaatatggatgtttaaaaaaaaaaaaaaaaaaaaaaaaaaaaaccgcgggggcgccctatgggcgggggggggaaaaagaggggaaaggaaaggggcccggggggcacacagacgggattccacgaggacaccacagatttttctggtggacaacaaggggggggaaacatcgcggggggggccacacatagaggggagaggaggagaatacaatatcgcggaacaccgccgggggagacacccggggtgtaaggatcctcgggagaaaaacacaaaacaaacaaaacaacacagcaacaaacaacgagcacacacacaaccaagagacagacaagaacaacaacacacaacaaaaacacgacacaaacaa

SEQ ID NO: 330571 - DNA, 2491 bp, Homo sapiens
gggtttacgctgccgccggcatccgctcggacgcggccacgttgtcttgcgcgctttgcccgcctggccctgggactctgaccctcggctaccctttcctgccccactagcgtggccgcgagcctcggtgagccggccgtattcccgctctcgcttagggggcacaggcgcaggcatcggcccggccactccaagccttcggtgcgcgggcgcgtctgggatacgggcccgggaggcgccgccctccgtccgcccggtgcctctcaggaacagcgaaccggagagagcgccggagagttgggctcagtgcggagctcggcgccggggcccatgcccgtgcgcccccgcaggccggcgccatggcctccgggagtgtggccgagtgcctgcagcaggagaccacctgccccgtgtgcctgcagtacttcgcagagcccatgatgctcgactgcggccataacatctgttgcgcgtgcctcgcccgctgctggggcacggcagagactaacgtgtcgtgcccgcagtgccgggagaccttcccgcagaggcacatgcggcccaaccggcacctggccaacgtgacccaactggtaaagcagctgcgcaccgagcggccgtcggggcccggcggcgagatgggcgtgtgcgagaagcaccgcgagcccctgaagctgtactgcgaggaggaccagatgcccatctgcgtggtgtgcgaccgctcccgcgagcaccgcggccacagcgtgctgccgctcgaggaggcggtggagggcttcaaggagcaaatccagaaccagctcgaccatttaaaaagagtgaaagatttaaagaagagacgtcgggcccagggggaacaggcacgagctgaactcttgagcctaacccagatggagagggagaagattgtttgggagtttgagcagctgtatcactccttaaaggagcatgagtatcgcctcctggcccgccttgaggagctagacttggccatctacaatagcatcaatggtgccatcacccagttctcttgcaacatctcccacctcagcagcctgatcgctcagctagaagagaagcagcagcagcccaccagggagctcctgcaggacattggggacacattgagcagggctgaaagaatcaggattcctgaaccttggatcacacctccagatttgcaagagaaaatccacatttttgcccaaaaatgtctattcttgacggagagtctaaagcagttcacagaaaaaatgcagtcagatatggagaaaatccaagaattaagagaggctcagttatactcagtggacgtgactctggacccagacacggcctaccccagcctgatcctctctgataatctgcggcaagtgcggtacagttacctccaacaggacctgcctgacaaccccgagaggttcaatctgtttccctgtgtcttgggctctccatgcttcatcgccgggagacattattgggaggtagaggtgggagataaagccaagtggaccataggtgtctgtgaagactcagtgtgcagaaaaggtggagtaacctcagccccccagaatggattctgggcagtgtctttgtggtatgggaaagaatattgggctcttacctccccaatgactgccctacccctgcggaccccgctccagcgggtggggattttcttggactatgatgctggtgaggtctccttctacaacgtgacagagaggtgtcacaccttcactttctctcatgctaccttttgtgggcctgtccggccctacttcagtctgagttactcgggagggaaaagtgcagctcctctgatcatctgccccatgagtgggatagatgggttttctggccatgttgggaatcatggtcattccatggagacctccccttgaggaggtgaattcaggccaaaagggctgttggctgtaatcctacgccaggcacaaggcatcttgttgccttgccacgtcctgtcacagctgggtatccttaccatgttccacgcccttgcagtgggagacaggatgtccatgttctctaccatccttttccttcccatgcagattgtgaaatgtaatgagatgtatcaagatatcctagaaataaaaaccagatgtccacctccaaaaaaaaaaaaaaaaaaaaaaaaaaaaaccgcgggggcgccctatgggcgggggggggaaaaagaggggaaaggaaaggggcccggggggcacacagacgggattccacgaggacaccacagatttttctggtggacaacaaggggggggaaacatcgcggggggggccacacatagaggggagaggaggagaatacaatatcgcggaacaccgccgggggagacacccggggtgtaaggatcctcgggagaaaaacacaaaacaaacaaaacaacacagcaacaaacaacgagcacacacacaaccaagagacagacaagaacaacaacacacaacaaaaacacgacacaaacaa

SEQ ID NO: 330572 - DNA, 2689 bp, Homo sapiens
gggtttacgctgccgccggcatccgctcggacgcggccacgttgtcttgcgcgctttgcccgcctggccctgggactctgaccctcggctaccctttcctgccccactagcgtggccgcgagcctcggtgagccggccgtattcccgctctcgcttagggggcacaggcgcaggcatcggcccggccactccaagccttcggtgcgcgggcgcgtctgggatacgggcccgggaggcgccgccctccgtccgcccggtgcctctcaggaacagcgaaccggagagagcgccggagagttgggctcagtgcggagctcggcgccggggcccatgcccgtgcgcccccgcaggccggcgccatggcctccgggagtgtggccgagtgcctgcagcaggagaccacctgccccgtgtgcctgcagtacttcgcagagcccatgatgctcgactgcggccataacatctgttgcgcgtgcctcgcccgctgctggggcacggcagagactaacgtgtcgtgcccgcagtgccgggagaccttcccgcagaggcacatgcggcccaaccggcacctggccaacgtgacccaactggtaaagcagctgcgcaccgagcggccgtcggggcccggcggcgagatgggcgtgtgcgagaagcaccgcgagcccctgaagctgtactgcgaggaggaccagatgcccatctgcgtggtgtgcgaccgctcccgcgagcaccgcggccacagcgtgctgccgctcgaggaggcggtggagggcttcaaggagcaaatccagaaccagctcgaccatttaaaaagagtgaaagatttaaagaagagacgtcgggcccagggggaacaggcacgagctgaactcttgagcctaacccagatggagagggagaagattgtttgggagtttgagcagctgtatcactccttaaaggagcatgagtatcgcctcctggcccgccttgaggagctagacttggccatctacaatagcatcaatggtgccatcacccagttctcttgcaacatctcccacctcagcagcctgatcgctcagctagaagagaagcagcagcagcccaccagggagctcctgcaggacattggggacacattgagcagggctgaaagaatcaggattcctgaaccttggatcacacctccagatttgcaagagaaaatccacatttttgcccaaaaatgtctattcttgacggagagtctaaagcagttcacagaaaaaatgcagtcagatatggagaaaatccaagaattaagagaggctcagttatactcagtggacgtgactctggacccagacacggcctaccccagcctgatcctctctgataatctgcggcaagtgcggtacagttacctccaacaggacctgcctgacaaccccgagaggtctccttctacaacgtgacagagaggtgtcacaccttcactttctctcatgctaccttttgtgggcctgtccggccctacttcagtctgagttactcgggagggaaaagtgcagctcctctgatcatctgccccatgagtgggatagatgggttttctggccatgttgggaatcatggtcattccatggagacctccccttgaggaggtgaattcaggccaaaagggctgttggctgtaatcctacgccaggcacaaggcatcttgttgccttgccacgtcctgtcacagctgggtatccttaccatgttccacgcccttgcagtgggagacaggatgtccatgttctctaccatccttttccttcccatgcagattgtgaaatgtaatgagatgtatcaagatatcctagaaataaaaaccagatgtccacctccagtgtttcatactttctggttttacacatcgctggagggataaagagtatggataatctttggatttggagagccgttcaagatacttccagcttcttggctcagcctggcttcctctggttcagccccacataatgattatggctatttgctgtcatttctgggctagggctcctttctaacaacctagactggaataaggccctgtcagcatggctccctttatcccagttttccgtctgggaacagtacctctgcccctgattcccaatgtgccatagttttattaactccattaaagaagcctgtatgtgttttggttagttacagttattttacaataatggtgggtaatggccccacctctgttatgagataatgttctaatcaatgtctctgcctttgtatcttttctgagggctttgtctgttctcttcattctaatgaaaggtgtattctagtgctgggtgcatatcatccaggataatattctgcccaactccatcctctgttactagatcccttaccagtcacatttgtggactggtggccagtcgtataccatccctggaaggattctgggacaatattccagggattcattgacttcttggctccttttctccatttcctttgggggaagggggaattgaccatgcttaagtgcatcctatcaaggggcagctccgtccccatggccattggatcatgagacactctgaagtcagaaggctggggcagatcacttcaagcaagcccccatgatggttctcagtcctgcttctctgtgggtacgtgcccctctgtttaaaaataaactgaatatggatgttta

SEQ ID NO: 330573 - DNA, 2382 bp, Homo sapiens
tttttgagtacttagtatttgaaaagctgtgagctaggtgctttggggggtatgagaatgagtacagtatcctattttggtctagaggatcatagctcaggaagagaaggtgggaaaagctgtagtggctgattttaaagactgtccgtgtacgctagacagtttaacttagcccctgtcctagttcctggaaggtcatggaattgggaaaaagaatttacttgggccggacgtggtggctcacgcctgtaatcccagcactttgggaggccgaggcgggaggatcacctgaggtcaggagttcgagaccagcctgaccagtatggagaaaccccatctctactaaaaacacaaaattagctgggtatggtggcgcatgcctgtaatcccagctactcaggaggctgaggcaggagaatcgcttgaacctgggaggcagaggttgcggtgggccgagatggcgccattgcactccagcctgggcaacaagcgaaactccatctcaaaaaaaaaaaaaatttactcatgttttttaaatttagggctgaaagaatcaggattcctgaaccttggatcacacctccagatttgcaagagaaaatccacatttttgcccaaaaatgtctattcttgacggagagtctaaagcagttcacagaaaaaatgcagtcagatatggagaaaatccaagaattaagagaggctcagttatactcagtggacgtgactctggacccagacacggcctaccccagcctgatcctctctgataatctgcggcaagtgcggtacagttacctccaacaggacctgcctgacaaccccgagaggttcaatctgtttccctgtgtcttgggctctccatgcttcatcgccgggagacattattgggaggtagaggtgggagataaagccaagtggaccataggtgtctgtgaagactcagtgtgcagaaaaggtggagtaacctcagccccccagaatggattctgggcagtgtctttgtggtatgggaaagaatattgggctcttacctccccaatgactgccctacccctgcggaccccgctccagcgggtggggattttcttggactatgatgctggtgaggtctccttctacaacgtgacagagaggtgtcacaccttcactttctctcatgctaccttttgtgggcctgtccggccctacttcagtctgagttactcgggagggaaaagtgcagctcctctgatcatctgccccatgagtgggatagatgggttttctggccatgttgggaatcatggtcattccatggagacctccccttgaggaggtgaattcaggccaaaagggctgttggctgtaatcctacgccaggcacaaggcatcttgttgccttgccacgtcctgtcacagctgggtatccttaccatgttccacgcccttgcagtgggagacaggatgtccatgttctctaccatccttttccttcccatgcagattgtgaaatgtaatgagatgtatcaagatatcctagaaataaaaaccagatgtccacctccagtgtttcatactttctggttttacacatcgctggagggataaagagtatggataatctttggatttggagagccgttcaagatacttccagcttcttggctcagcctggcttcctctggttcagccccacataatgattatggctatttgctgtcatttctgggctagggctcctttctaacaacctagactggaataaggccctgtcagcatggctccctttatcccagttttccgtctgggaacagtacctctgcccctgattcccaatgtgccatagttttattaactccattaaagaagcctgtatgtgttttggttagttacagttattttacaataatggtgggtaatggccccacctctgttatgagataatgttctaatcaatgtctctgcctttgtatcttttctgagggctttgtctgttctcttcattctaatgaaaggtgtattctagtgctgggtgcatatcatccaggataatattctgcccaactccatcctctgttactagatcccttaccagtcacatttgtggactggtggccagtcgtataccatccctggaaggattctgggacaatattccagggattcattgacttcttggctccttttctccatttcctttgggggaagggggaattgaccatgcttaagtgcatcctatcaaggggcagctccgtccccatggccattggatcatgagacactctgaagtcagaaggctggggcagatcacttcaagcaagcccccatgatggttctcagtcctgcttctctgtgggtacgtgcccctctgtttaaaaataaactgaatatggatgttta

SEQ ID NO: 330574 - DNA, 2235 bp, Homo sapiens
gattgaatttggctatataagataggaaacccaaaattttattggcttaaggcttaaacataataaaagaaatgtgcaggttgggtgcggtggtcacgcctgtaatcccagcactttgggaggccgaggcgggaggatcacctgaggtcaggagttcgagaccagcctgaccagtatggagaaaccccatctctactaaaaacacaaaattagctgggtatggtggcgcatgcctgtaatcccagctactcaggaggctgaggcaggagaatcgcttgaacctgggaggcagaggttgcggtgggccgagatggcgccattgcactccagcctgggcaacaagcgaaactccatctcaaaaaaaaaaaaaatttactcatgttttttaaatttagggctgaaagaatcaggattcctgaaccttggatcacacctccagatttgcaagagaaaatccacatttttgcccaaaaatgtctattcttgacggagagtctaaagcagttcacagaaaaaatgcagtcagatatggagaaaatccaagaattaagagaggctcagttatactcagtggacgtgactctggacccagacacggcctaccccagcctgatcctctctgataatctgcggcaagtgcggtacagttacctccaacaggacctgcctgacaaccccgagaggttcaatctgtttccctgtgtcttgggctctccatgcttcatcgccgggagacattattgggaggtagaggtgggagataaagccaagtggaccataggtgtctgtgaagactcagtgtgcagaaaaggtggagtaacctcagccccccagaatggattctgggcagtgtctttgtggtatgggaaagaatattgggctcttacctccccaatgactgccctacccctgcggaccccgctccagcgggtggggattttcttggactatgatgctggtgaggtctccttctacaacgtgacagagaggtgtcacaccttcactttctctcatgctaccttttgtgggcctgtccggccctacttcagtctgagttactcgggagggaaaagtgcagctcctctgatcatctgccccatgagtgggatagatgggttttctggccatgttgggaatcatggtcattccatggagacctccccttgaggaggtgaattcaggccaaaagggctgttggctgtaatcctacgccaggcacaaggcatcttgttgccttgccacgtcctgtcacagctgggtatccttaccatgttccacgcccttgcagtgggagacaggatgtccatgttctctaccatccttttccttcccatgcagattgtgaaatgtaatgagatgtatcaagatatcctagaaataaaaaccagatgtccacctccagtgtttcatactttctggttttacacatcgctggagggataaagagtatggataatctttggatttggagagccgttcaagatacttccagcttcttggctcagcctggcttcctctggttcagccccacataatgattatggctatttgctgtcatttctgggctagggctcctttctaacaacctagactggaataaggccctgtcagcatggctccctttatcccagttttccgtctgggaacagtacctctgcccctgattcccaatgtgccatagttttattaactccattaaagaagcctgtatgtgttttggttagttacagttattttacaataatggtgggtaatggccccacctctgttatgagataatgttctaatcaatgtctctgcctttgtatcttttctgagggctttgtctgttctcttcattctaatgaaaggtgtattctagtgctgggtgcatatcatccaggataatattctgcccaactccatcctctgttactagatcccttaccagtcacatttgtggactggtggccagtcgtataccatccctggaaggattctgggacaatattccagggattcattgacttcttggctccttttctccatttcctttgggggaagggggaattgaccatgcttaagtgcatcctatcaaggggcagctccgtccccatggccattggatcatgagacactctgaagtcagaaggctggggcagatcacttcaagcaagcccccatgatggttctcagtcctgcttctctgtgggtacgtgcccctctgtttaaaaataaactgaatatggatgttta

SEQ ID NO: 330575 - DNA, 2222 bp, Homo sapiens
cttttccacaggggaaattatttcataataaaaagaaagcaagctggacaggtaggcaagcttgaggtccaatcataggacgcttaagttagtaaatttgaaatcctgaggtccttgaccagtggatggtgggtactgaaggagggtatgggaaatgctggtatagcaaatagtatgcatcccattttcctctgcctgccttttagctcctcaacactgagttatgttccagtgatccttttctccctaatttctcccatgagagccagtctgtagttggtttttcaacaaacatctgtgaaagaaaaccgaagttttaaatgacttctcatggttattttttttcctttctcttgcaggacattggggacacattgagcagggctgaaagaatcaggattcctgaaccttggatcacacctccagatttgcaagagaaaatccacatttttgcccaaaaatgtctattcttgacggagagtctaaagcagttcacagaaaaaatgcagtcagatatggagaaaatccaagaattaagagaggctcagttatactcagtggacgtgactctggacccagacacggcctaccccagcctgatcctctctgataatctgcggcaagtgcggtacagttacctccaacaggacctgcctgacaaccccgagaggttcaatctgtttccctgtgtcttgggctctccatgcttcatcgccgggagacattattgggaggtagaggtgggagataaagccaagtggaccataggtgtctgtgaagactcagtgtgcagaaaaggtggagtaacctcagccccccagaatggattctgggcagtgtctttgtggtatgggaaagaatattgggctcttacctccccaatgactgccctacccctgcggaccccgctccagcgggtggggattttcttggactatgatgctggtgaggtctccttctacaacgtgacagagaggtgtcacaccttcactttctctcatgctaccttttgtgggcctgtccggccctacttcagtctgagttactcgggagggaaaagtgcagctcctctgatcatctgccccatgagtgggatagatgggttttctggccatgttgggaatcatggtcattccatggagacctccccttgaggaggtgaattcaggccaaaagggctgttggctgtaatcctacgccaggcacaaggcatcttgttgccttgccacgtcctgtcacagctgggtatccttaccatgttccacgcccttgcagtgggagacaggatgtccatgttctctaccatccttttccttcccatgcagattgtgaaatgtaatgagatgtatcaagatatcctagaaataaaaaccagatgtccacctccagtgtttcatactttctggttttacacatcgctggagggataaagagtatggataatctttggatttggagagccgttcaagatacttccagcttcttggctcagcctggcttcctctggttcagccccacataatgattatggctatttgctgtcatttctgggctagggctcctttctaacaacctagactggaataaggccctgtcagcatggctccctttatcccagttttccgtctgggaacagtacctctgcccctgattcccaatgtgccatagttttattaactccattaaagaagcctgtatgtgttttggttagttacagttattttacaataatggtgggtaatggccccacctctgttatgagataatgttctaatcaatgtctctgcctttgtatcttttctgagggctttgtctgttctcttcattctaatgaaaggtgtattctagtgctgggtgcatatcatccaggataatattctgcccaactccatcctctgttactagatcccttaccagtcacatttgtggactggtggccagtcgtataccatccctggaaggattctgggacaatattccagggattcattgacttcttggctccttttctccatttcctttgggggaagggggaattgaccatgcttaagtgcatcctatcaaggggcagctccgtccccatggccattggatcatgagacactctgaagtcagaaggctggggcagatcacttcaagcaagcccccatgatggttctcagtcctgcttctctgtgggtacgtgcccctctgtttaaaaataaactgaatatggatgttta

SEQ ID NO: 330576 - DNA, 3220 bp, Homo sapiens
ttttttttattttttgggaaattaattatagcatcaaaacctgaatttatgtggtactgtttagagcctttatccttcattatgtaaacattcatgaatctcacagcagatctattaatacttcattatagaatgctgcctgtctaaaacctgtaatattctgaattctgtgaaacttggggcccctggaattttcagaataagggatgatgagcgtgtaagcaatcctcttgcctcagcttcccaaagtgctgagattacaggcatgagccacatatccagcccattatcagtgtttttgaagcaggaaaacacttgatgatagcaagatgctgtaatactaaatgccagaggagatgacatgggtcatacacagttttagatttcagaacagtaagtgtaatggcctgggcagattaagaaaaacttggaggatgtgtgttttggactggacattagaagaagatgaatagagcttcgatgtgcagagtaaagatcttatagaatggataaaagagtgatttgggctgggtgtagtggctcacacctgtagtcctaacactttggaaggctgaaatgggaagtctgcagtgagccatgattatgccactgtactacagtctgggtgacagagtgagacctcatctcaaaaaataaaaaaaagtaaaaaataattttaaaagagtgatttaaaaagtaagcatactgatacaggttcccagtcccttacccacagttctaaaatcccaaatctctgaaagccaaaacctttttcattattttgtgggaaattaattatagcatcaaaacctgaatttatgtggtactgtttagagcctttatccttcattatgtaaacattcatgaatctcacagcagatctattaatacttcattatagaatgctgcctgtctaaaacctgtaatattctgaattctgtgaaacttggggcccctggaattttcagaataagggatgatgagcgtgtaagaaaacctcaattcagcgtatctgccaggcacagtggctcatgcctgaaatcccattgctttgggaagttgaggtgggaggattgcttgaggccaagagttcgagaccatcctgagcaacatagtaagacctcatctctacaaaaaattttttaaaattagggtggtagtgcacacctatggtcccagctacttgggtgtcttaggcgggagaatcacctgagcccaggagtttggggttacaatgaactatgaccacaccactgcactccagcctaggcaacagagcaagaccctatctcttaaaatcagttcatgatggatattgtggcttcagatgtgaaagaaaagatacggggctaaaattctgtattttcagagtattctggtaaccagctaatccaagcagtaatttttgaaatgtgaagtttagaatatattctaaataaaatacgtgcaacctccagtgggaacctcttattattggggaggtagtagaaaggcgctgggtgttctaaaataggctctcctggcccacggctgactgtcttccttgtgtctctacatggacgtgactctggacccagacacggcctaccccagcctgatcctctctgataatctgcggcaagtgcggtacagttacctccaacaggacctgcctgacaaccccgagaggttcaatctgtttccctgtgtcttgggctctccatgcttcatcgccgggagacattattgggaggtagaggtgggagataaagccaagtggaccataggtgtctgtgaagactcagtgtgcagaaaaggtggagtaacctcagccccccagaatggattctgggcagtgtctttgtggtatgggaaagaatattgggctcttacctccccaatgactgccctacccctgcggaccccgctccagcgggtggggattttcttggactatgatgctggtgaggtctccttctacaacgtgacagagaggtgtcacaccttcactttctctcatgctaccttttgtgggcctgtccggccctacttcagtctgagttactcgggagggaaaagtgcagctcctctgatcatctgccccatgagtgggatagatgggttttctggccatgttgggaatcatggtcattccatggagacctccccttgaggaggtgaattcaggccaaaagggctgttggctgtaatcctacgccaggcacaaggcatcttgttgccttgccacgtcctgtcacagctgggtatccttaccatgttccacgcccttgcagtgggagacaggatgtccatgttctctaccatccttttccttcccatgcagattgtgaaatgtaatgagatgtatcaagatatcctagaaataaaaaccagatgtccacctccagtgtttcatactttctggttttacacatcgctggagggataaagagtatggataatctttggatttggagagccgttcaagatacttccagcttcttggctcagcctggcttcctctggttcagccccacataatgattatggctatttgctgtcatttctgggctagggctcctttctaacaacctagactggaataaggccctgtcagcatggctccctttatcccagttttccgtctgggaacagtacctctgcccctgattcccaatgtgccatagttttattaactccattaaagaagcctgtatgtgttttggttagttacagttattttacaataatggtgggtaatggccccacctctgttatgagataatgttctaatcaatgtctctgcctttgtatcttttctgagggctttgtctgttctcttcattctaatgaaaggtgtattctagtgctgggtgcatatcatccaggataatattctgcccaactccatcctctgttactagatcccttaccagtcacatttgtggactggtggccagtcgtataccatccctggaaggattctgggacaatattccagggattcattgacttcttggctccttttctccatttcctttgggggaagggggaattgaccatgcttaagtgcatcctatcaaggggcagctccgtccccatggccattggatcatgagacactctgaagtcagaaggctggggcagatcacttcaagcaagcccccatgatggttctcagtcctgcttctctgtgggtacgtgcccctctgtttaaaaataaactgaatatggatgttta

SEQ ID NO: 330577 - DNA, 2260 bp, Homo sapiens
gggtttacgctgccgccggcatccgctcggacgcggccacgttgtcttgcgcgctttgcccgcctggccctgggactctgaccctcggctaccctttcctgccccactagcgtggccgcgagcctcggtgagccggccgtattcccgctctcgcttagggggcacaggcgcaggcatcggcccggccactccaagccttcggtgcgcgggcgcgtctgggatacgggcccgggaggcgccgccctccgtccgcccggtgcctctcaggaacagcgaaccggagagagcgccggagagttgggctcagtgcggagctcggcgccggggcccatgcccgtgcgcccccgcaggccggcgccatggcctccgggagtgtggccgagtgcctgcagcaggagaccacctgccccgtgtgcctgcagtacttcgcagagcccatgatgctcgactgcggccataacatctgttgcgcgtgcctcgcccgctgctggggcacggcagagactaacgtgtcgtgcccgcagtgccgggagaccttcccgcagaggcacatgcggcccaaccggcacctggccaacgtgacccaactggtaaagcagctgcgcaccgagcggccgtcggggcccggcggcgagatgggcgtgtgcgagaagcaccgcgagcccctgaagctgtactgcgaggaggaccagatgcccatctgcgtggtgtgcgaccgctcccgcgagcaccgcggccacagcgtgctgccgctcgaggaggcggtggagggcttcaaggagcaaatccagaaccagctcgaccatttaaaaagagtgaaagatttaaagaagagacgtcgggcccagggggaacaggcacgagctgaactcttgagcctaacccagatggagagggagaagattgtttgggagtttgagcagctgtatcactccttaaaggagcatgagtatcgcctcctggcccgccttgaggagctagacttggccatctacaatagcatcaatggtgccatcacccagttctcttgcaacatctcccacctcagcagcctgatcgctcagctagaagagaagcagcagcagcccaccagggagctcctgcaggacattggggacacattgagcagggctgaaagaatcaggattcctgaaccttggatcacacctccagatttgcaagagaaaatccacatttttgcccaaaaatgtctattcttgacggagagtctaaagcagttcacagaaaaaatgcagtcagatatggagaaaatccaagaattaagagaggctcagttatactcagtggacgtgactctggacccagacacggcctaccccagcctgatcctctctgataatctgcggcaagtgcggtacagttacctccaacaggacctgcctgacaaccccgagagattgtgaaatgtaatgagatgtatcaagatatcctagaaatagagggataaagagtatggataatctttggatttggagagccgttcaagatacttccagcttcttggctcagcctggcttcctctggttcagccccacataatgattatggctatttgctgtcatttctgggctagggctcctttctaacaacctagactggaataaggccctgtcagcatggctccctttatcccagttttccgtctgggaacagtacctctgcccctgattcccaatgtgccatagttttattaactccattaaagaagcctgtatgtgttttggttagttacagttattttacaataatggtgggtaatggccccacctctgttatgagataatgttctaatcaatgtctctgcctttgtatcttttctgagggctttgtctgttctcttcattctaatgaaaggtgtattctagtgctgggtgcatatcatccaggataatattctgcccaactccatcctctgttactagatcccttaccagtcacatttgtggactggtggccagtcgtataccatccctggaaggattctgggacaatattccagggattcattgacttcttggctccttttctccatttcctttgggggaagggggaattgaccatgcttaagtgcatcctatcaaggggcagctccgtccccatggccattggatcatgagacactctgaagtcagaaggctggggcagatcacttcaagcaagcccccatgatggttctcagtcctgcttctctgtgggtacgtgcccctctgtttaaaaataaactgaatatggatgttta

SEQ ID NO: 330578 - DNA, 1778 bp, Homo sapiens
gggtttacgctgccgccggcatccgctcggacgcggccacgttgtcttgcgcgctttgcccgcctggccctgggactctgaccctcggctaccctttcctgccccactagcgtggccgcgagcctcggtgagccggccgtattcccgctctcgcttagggggcacaggcgcaggcatcggcccggccactccaagccttcggtgcgcgggcgcgtctgggatacgggcccgggaggcgccgccctccgtccgcccggtgcctctcaggaacagcgaaccggagagagcgccggagagttgggctcagtgcggagctcggcgccggggcccatgcccgtgcgcccccgcaggccggcgccatggcctccgggagtgtggccgagtgcctgcagcaggagaccacctgccccgtgtgcctgcagtacttcgcagagcccatgatgctcgactgcggccataacatctgttgcgcgtgcctcgcccgctgctggggcacggcagagactaacgtgtcgtgcccgcagtgccgggagaccttcccgcagaggcacatgcggcccaaccggcacctggccaacgtgacccaactggtaaagcagctgcgcaccgagcggccgtcggggcccggcggcgagatgggcgtgtgcgagaagcaccgcgagcccctgaagctgtactgcgaggaggaccagatgcccatctgcgtggtgtgcgaccgctcccgcgagcaccgcggccacagcgtgctgccgctcgaggaggcggtggagggcttcaaggagcaaatccagaaccagctcgaccatttaaaaagagtgaaagatttaaagaagagacgtcgggcccagggggaacaggcacgagctgaactcttgagcctaacccagatggagagggagaagattgtttgggagtttgagcagctgtatcactccttaaaggagcatgagtatcgcctcctggcccgccttgaggagctagacttggccatctacaatagcatcaatggtgccatcacccagttctcttgcaacatctcccacctcagcagcctgatcgctcagctagaagagaagcagcagcagcccaccagggagctcctgcaggacattggggacacattgagcaggtatagttttctgtttccctagtgttaaatcaaatatgagaagactgtctccttcacatttgtaaatcctgaaaggagccctgagcctgaggatggacatcttatcaaattgacacatatccctgaagagagtcactagtatacaaagaattagatgaaccacagctctactcagtaaaattcaggaagtagggggttcatgtgggaggctgccggtggattaggggtatgaggacacttccatggagagggtgtggccttacagggacctgggctgaatataagggtagtttatgtctattgcttcctatacatttcagaatcctttcccccttcattatctcattttttttttttctgtaatgggggaaataaagcctaagaaaggtgtgactggcctgcatttacataattactgatgagccacctggattctggctcttattcttactcttgctatttctctatgttccatcaaaaaaaaaaaagtgaggaagaactccctggcagctggaacacgatcaaagagggagagcttggagggggcagtaagccagggcaaagttgttttgcaggatggatgacgaggcaagtgggatgggccttgggaagctcatgtttggtgtaagaatgccttcaggggtggaaa

SEQ ID NO: 330579 - DNA, 672 bp, Homo sapiens
aaattttttattattcattttagaggcaggttctctgttgcccaggctggtgtgcagtggcatggtgatagcttgctgcagcctcatactcctgggctcaagtgatcctcctgcctcagcctcctgagtagctggaattacaggcatgcaccaccatgcttgcctaatttttttacttttattttttgtagagacagggtctcaaactcctgtatgcaagcaatcctcttgcctcagcttcccaaagtgctgagattacaggcatgagccacatatccagcccattatcagtgtttttgaagcaggaaaacacttgatgatagcaagatgctgtaatactaaatgccagaggagatgacatgggtcatacacagttttagatttcagaacagtaagtgtaatggcctgggcagattaagaaaaacttggaggatgtgtgttttggactggacattagaagaagatgaatagagcttcgatgtgcagagtaaagatcttatagaatggataaaagagtgatttgggctgggtgtagtggctcacacctgtagtcctaacactttggaaggctgaaatgggaagtctgcagtgagccatgattatgccactgtactacagtctgggtgacagagtgagacctcatctcaaaaaataaaaaaaagtaaaaaataa

SEQ ID NO: 330580 - DNA, 662 bp, Homo sapiens
aaaattcctgggcagtctggtggattctgaaatccttatatgtaggtaaacccttctcttaattattagaaattacaaacccccacaatctttgataattttctattttgtatatgctgggttcatatatgcattgcatctattcagatatatactttttggggcatctagcaacatagagctagcagatacatgtcctctacaagcaagacaaatggggagaaactccactcaatacagtggataataccagaagtggttagttcaggcatgactttccttgatctggctcttcttttcttgccacttaaaagtcttagtgggataatgtgtgagaaattctgtttcaactataaagtgccttataaatgaatggtcatgtttaccccagagtgtcagtgagtgtcacttgagccattcagctcttgtacacagatgacttatgcaactcaaaagttatgtatgacgtggggttggaaccgcgtttccctctgcagaatcagctgactcactggaaggtggaattcttgatcttggctcagttttatcccatattctaccagtctcaggcatgtggttatccctgtacttaagattcccaatccctctccccttaaagcttttggttggatgatagagccatacatcatatgaaaaaatta

SEQ ID NO: 330581 - DNA, 2969 bp, Homo sapiens
gggtttacgctgccgccggcatccgctcggacgcggccacgttgtcttgcgcgctttgcccgcctggccctgggactctgaccctcggctaccctttcctgccccactagcgtggccgcgagcctcggtgagccggccgtattcccgctctcgcttagggggcacaggcgcaggcatcggcccggccactccaagccttcggtgcgcgggcgcgtctgggatacgggcccgggaggcgccgccctccgtccgcccggtgcctctcaggaacagcgaaccggagagagcgccggagagttgggctcagtgcggagctcggcgccggggcccatgcccgtgcgcccccgcaggccggcgccatggcctccgggagtgtggccgagtgcctgcagcaggagaccacctgccccgtgtgcctgcagtacttcgcagagcccatgatgctcgactgcggccataacatctgttgcgcgtgcctcgcccgctgctggggcacggcagagactaacgtgtcgtgcccgcagtgccgggagaccttcccgcagaggcacatgcggcccaaccggcacctggccaacgtgacccaactggtaaagcagctgcgcaccgagcggccgtcggggcccggcggcgagatgggcgtgtgcgagaagcaccgcgagcccctgaagctgtactgcgaggaggaccagatgcccatctgcgtggtgtgcgaccgctcccgcgagcaccgcggccacagcgtgctgccgctcgaggaggcggtggagggcttcaaggagcaaatccagaaccagctcgaccatttaaaaagagtgaaagatttaaagaagagacgtcgggcccagggggaacaggcacgagctgaactcttgagcctaacccagatggagagggagaagattgtttgggagtttgagcagctgtatcactccttaaaggagcatgagtatcgcctcctggcccgccttgaggagctagacttggccatctacaatagcatcaatggtgccatcacccagttctcttgcaacatctcccacctcagcagcctgatcgctcagctagaagagaagcagcagcagcccaccagggagctcctgcaggacattggggacacattgagcagggctgaaagaatcaggattcctgaaccttggatcacacctccagatttgcaagagaaaatccacatttttgcccaaaaatgtctattcttgacggagagtctaaagcagttcacagaaaaaatgcagtcagatatggagaaaatccaagaattaagagaggctcagttatactcagtggacgtgactctggacccagacacggcctaccccagcctgatcctctctgataatctgcggcaagtgcggtacagttacctccaacaggacctgcctgacaaccccgagaggttcaatctgtttccctgtgtcttgggctctccatgcttcatcgccgggagacattattgggaggtagaggtgggagataaagccaagtggaccataggtgtctgtgaagactcagtgtgcagaaaaggtggagtaacctcagccccccagaatggattctgggcagtgtctttgtggtatgggaaagaatattgggctcttacctccccaatgactgccctacccctgcggaccccgctccagcgggtggggattttcttggactatgatgctggtgaggtctccttctacaacgtgacagagaggtgtcacaccttcactttctctcatgctaccttttgtgggcctgtccggccctacttcagtctgagttactcgggagggaaaagtgcagctcctctgatcatctgccccatgagtgggatagatgggttttctggccatgttgggaatcatggtcattccatggagacctccccttgaggaggtgaattcaggccaaaagggctgttggctgtaatcctacgccaggcacaaggcatcttgttgccttgccacgtcctgtcacagctgggtatccttaccatgttccacgcccttgcagtgggagacaggatgtccatgttctctaccatccttttccttcccatgcagattgtgaaatgtaatgagatgtatcaagatatcctagaaataaaaaccagatgtccacctccagtgtttcatactttctggttttacacatcgctggagggataaagagtatggataatctttggatttggagagccgttcaagatacttccagcttcttggctcagcctggcttcctctggttcagccccacataatgattatggctatttgctgtcatttctgggctagggctcctttctaacaacctagactggaataaggccctgtcagcatggctccctttatcccagttttccgtctgggaacagtacctctgcccctgattcccaatgtgccatagttttattaactccattaaagaagcctgtatgtgttttggttagttacagttattttacaataatggtgggtaatggccccacctctgttatgagataatgttctaatcaatgtctctgcctttgtatcttttctgagggctttgtctgttctcttcattctaatgaaaggtgtattctagtgctgggtgcatatcatccaggataatattctgcccaactccatcctctgttactagatcccttaccagtcacatttgtggactggtggccagtcgtataccatccctggaaggattctgggacaatattccagggattcattgacttcttggctccttttctccatttcctttgggggaagggggaattgaccatgcttaagtgcatcctatcaaggggcagctccgtccccatggccattggatcatgagacactctgaagtcagaaggctggggcagatcacttcaagcaagcccccatgatggttctcagtcctgcttctctgtgggtacgtgcccctctgtttaaaaataaactgaatatggatgttta

SEQ ID NO: 330582 - DNA, 2915 bp, Homo sapiens
gggtttacgctgccgccggcatccgctcggacgcggccacgttgtcttgcgcgctttgcccgcctggccctgggactctgaccctcggctaccctttcctgccccactagcgtggccgcgagcctcggtgagccggccgtattcccgctctcgcttagggggcacaggcgcaggcatcggcccggccactccaagccttcggtgcgcgggcgcgtctgggatacgggcccgggaggcgccgccctccgtccgcccggtgcctctcaggaacagcgaaccggagagagcgccggagagttgggctcagtgcggagctcggcgccggggcccatgcccgtgcgcccccgcaggccggcgccatggcctccgggagtgtggccgagtgcctgcagcaggagaccacctgccccgtgtgcctgcagtacttcgcagagcccatgatgctcgactgcggccataacatctgttgcgcgtgcctcgcccgctgctggggcacggcagagactaacgtgtcgtgcccgcagtgccgggagaccttcccgcagaggcacatgcggcccaaccggcacctggccaacgtgacccaactggtaaagcagctgcgcaccgagcggccgtcggggcccggcggcgagatgggcgtgtgcgagaagcaccgcgagcccctgaagctgtactgcgaggaggaccagatgcccatctgcgtggtgtgcgaccgctcccgcgagcaccgcggccacagcgtgctgccgctcgaggaggcggtggagggcttcaaggagcaaatccagaaccagctcgaccatttaaaaagagtgaaagatttaaagaagagacgtcgggcccagggggaacaggcacgagctgaactcttgagcctaacccagatggagagggagaagattgtttgggagtttgagcagctgtatcactccttaaaggagcatgagtatcgcctcctggcccgccttgaggagctagacttggccatctacaatagcatcaatggtgccatcacccagttctcttgcaacatctcccacctcagcagcctgatcgctcagctagaagagaagcagcagcagcccaccagggagctcctgcaggacattggggacacattgagcagggctgaaagaatcaggattcctgaaccttggatcacacctccagatttgcaagagaaaatccacatttttgcccaaaaatgtctattcttgacggagagtctaaagcagttcacagaaaaaatgcagtcagatatggagaaaatccaagaattaagagaggctcagttatactcagtggacgtgactctggacccagacacggcctaccccagcctgatcctctctgataatctgcggcaagtgcggtacagttacctccaacaggacctgcctgacaaccccgagaggttcaatctgtttccctgtgtcttgggctctccatgcttcatcgccgggagacattattgggaggtagaggtgggagataaagccaagtggaccataggtgtctgtgaagactcagtgtgcagaaaaggtggagtaacctcagccccccagaatggattctgggcagtgtctttgtggtatgggaaagaatattgggctcttacctccccaatgactgccctacccctgcggaccccgctccagcgggtggggattttcttggactatgatgctggtgaggtctccttctacaacgtgacagagaggtgtcacaccttcactttctctcatgctaccttttgtgggcctgtccggccctacttcagtctgagttactcgggagggaaaagtgcagctcctctgatcatctgccccatgagtgggatagatgggttttctggccatgttgggaatcatggtcattccatggagacctccccttgaggaggtgaattcaggccaaaagggctgttggctgtaatcctacgccaggcacaaggcatcttgttgccttgccacgtcctgtcacagctgggtatccttaccatgttccacgcccttgcagtgggagacaggatgtccatgttctctaccatccttttccttcccatgcagattgtgaaatgtaatgagatgtatcaagatatcctagaaatagagggataaagagtatggataatctttggatttggagagccgttcaagatacttccagcttcttggctcagcctggcttcctctggttcagccccacataatgattatggctatttgctgtcatttctgggctagggctcctttctaacaacctagactggaataaggccctgtcagcatggctccctttatcccagttttccgtctgggaacagtacctctgcccctgattcccaatgtgccatagttttattaactccattaaagaagcctgtatgtgttttggttagttacagttattttacaataatggtgggtaatggccccacctctgttatgagataatgttctaatcaatgtctctgcctttgtatcttttctgagggctttgtctgttctcttcattctaatgaaaggtgtattctagtgctgggtgcatatcatccaggataatattctgcccaactccatcctctgttactagatcccttaccagtcacatttgtggactggtggccagtcgtataccatccctggaaggattctgggacaatattccagggattcattgacttcttggctccttttctccatttcctttgggggaagggggaattgaccatgcttaagtgcatcctatcaaggggcagctccgtccccatggccattggatcatgagacactctgaagtcagaaggctggggcagatcacttcaagcaagcccccatgatggttctcagtcctgcttctctgtgggtacgtgcccctctgtttaaaaataaactgaatatggatgttta

SEQ ID NO: 330583 - DNA, 3041 bp, Homo sapiens
gggtttacgctgccgccggcatccgctcggacgcggccacgttgtcttgcgcgctttgcccgcctggccctgggactctgaccctcggctaccctttcctgccccactagcgtggccgcgagcctcggtgagccggccgtattcccgctctcgcttagggggcacaggcgcaggcatcggcccggccactccaagccttcggtgcgcgggcgcgtctgggatacgggcccgggaggcgccgccctccgtccgcccggtgcctctcaggaacagcgaaccggagagagcgccggagagttgggctcagtgcggagctcggcgccggggcccatgcccgtgcgcccccgcaggccggcgccatggcctccgggagtgtggccgagtgcctgcagcaggagaccacctgccccgtgtgcctgcagtacttcgcagagcccatgatgctcgactgcggccataacatctgttgcgcgtgcctcgcccgctgctggggcacggcagagactaacgtgtcgtgcccgcagtgccgggagaccttcccgcagaggcacatgcggcccaaccggcacctggccaacgtgacccaactggtaaagcagctgcgcaccgagcggccgtcggggcccggcggcgagatgggcgtgtgcgagaagcaccgcgagcccctgaagctgtactgcgaggaggaccagatgcccatctgcgtggtgtgcgaccgctcccgcgagcaccgcggccacagcgtgctgccgctcgaggaggcggtggagggcttcaaggagcaaatccagaaccagctcgaccatttaaaaagagtgaaagatttaaagaagagacgtcgggcccagggggaacaggcacgagctgaactcttgagcctaacccagatggagagggagaagattgtttgggagtttgagcagctgtatcactccttaaaggagcatgagtatcgcctcctggcccgccttgaggagctagacttggccatctacaatagcatcaatggtgccatcacccagttctcttgcaacatctcccacctcagcagcctgatcgctcagctagaagagaagcagcagcagcccaccagggagctcctgcaggacattggggacacattgagcagggctgaaagaatcaggattcctgaaccttggatcacacctccagatttgcaagagaaaatccacatttttgcccaaaaatgtctattcttgacggagagtctaaagcagttcacagaaaaaatgcagtcagatatggagaaaatccaagaatcagctgactcactggaaggtggaattcttgatcttggctcagttttatcccatattctaccagtctcagaattaagagaggctcagttatactcagtggacgtgactctggacccagacacggcctaccccagcctgatcctctctgataatctgcggcaagtgcggtacagttacctccaacaggacctgcctgacaaccccgagaggttcaatctgtttccctgtgtcttgggctctccatgcttcatcgccgggagacattattgggaggtagaggtgggagataaagccaagtggaccataggtgtctgtgaagactcagtgtgcagaaaaggtggagtaacctcagccccccagaatggattctgggcagtgtctttgtggtatgggaaagaatattgggctcttacctccccaatgactgccctacccctgcggaccccgctccagcgggtggggattttcttggactatgatgctggtgaggtctccttctacaacgtgacagagaggtgtcacaccttcactttctctcatgctaccttttgtgggcctgtccggccctacttcagtctgagttactcgggagggaaaagtgcagctcctctgatcatctgccccatgagtgggatagatgggttttctggccatgttgggaatcatggtcattccatggagacctccccttgaggaggtgaattcaggccaaaagggctgttggctgtaatcctacgccaggcacaaggcatcttgttgccttgccacgtcctgtcacagctgggtatccttaccatgttccacgcccttgcagtgggagacaggatgtccatgttctctaccatccttttccttcccatgcagattgtgaaatgtaatgagatgtatcaagatatcctagaaataaaaaccagatgtccacctccagtgtttcatactttctggttttacacatcgctggagggataaagagtatggataatctttggatttggagagccgttcaagatacttccagcttcttggctcagcctggcttcctctggttcagccccacataatgattatggctatttgctgtcatttctgggctagggctcctttctaacaacctagactggaataaggccctgtcagcatggctccctttatcccagttttccgtctgggaacagtacctctgcccctgattcccaatgtgccatagttttattaactccattaaagaagcctgtatgtgttttggttagttacagttattttacaataatggtgggtaatggccccacctctgttatgagataatgttctaatcaatgtctctgcctttgtatcttttctgagggctttgtctgttctcttcattctaatgaaaggtgtattctagtgctgggtgcatatcatccaggataatattctgcccaactccatcctctgttactagatcccttaccagtcacatttgtggactggtggccagtcgtataccatccctggaaggattctgggacaatattccagggattcattgacttcttggctccttttctccatttcctttgggggaagggggaattgaccatgcttaagtgcatcctatcaaggggcagctccgtccccatggccattggatcatgagacactctgaagtcagaaggctggggcagatcacttcaagcaagcccccatgatggttctcagtcctgcttctctgtgggtacgtgcccctctgtttaaaaataaactgaatatggatgttta

SEQ ID NO: 330584 - DNA, 2422 bp, Homo sapiens
gaagtcgctcagaggatcccgccaaagcgtagtgacccaactggtaaagcagctgcgcaccgagcggccgtcggggcccggcggcgagatgggcgtgtgcgagaagcaccgcgagcccctgaagctgtactgcgaggaggaccagatgcccatctgcgtggtgtgcgaccgctcccgcgagcaccgcggccacagcgtgctgccgctcgaggaggcggtggagggcttcaaggagcaaatccagaaccagctcgaccatttaaaaagagtgaaagatttaaagaagagacgtcgggcccagggggaacaggcacgagctgaactcttgagcctaacccagatggagagggagaagattgtttgggagtttgagcagctgtatcactccttaaaggagcatgagtatcgcctcctggcccgccttgaggagctagacttggccatctacaatagcatcaatggtgccatcacccagttctcttgcaacatctcccacctcagcagcctgatcgctcagctagaagagaagcagcagcagcccaccagggagctcctgcaggacattggggacacattgagcagggctgaaagaatcaggattcctgaaccttggatcacacctccagatttgcaagagaaaatccacatttttgcccaaaaatgtctattcttgacggagagtctaaagcagttcacagaaaaaatgcagtcagatatggagaaaatccaagaattaagagaggctcagttatactcagtggacgtgactctggacccagacacggcctaccccagcctgatcctctctgataatctgcggcaagtgcggtacagttacctccaacaggacctgcctgacaaccccgagaggttcaatctgtttccctgtgtcttgggctctccatgcttcatcgccgggagacattattgggaggtagaggtgggagataaagccaagtggaccataggtgtctgtgaagactcagtgtgcagaaaaggtggagtaacctcagccccccagaatggattctgggcagtgtctttgtggtatgggaaagaatattgggctcttacctccccaatgactgccctacccctgcggaccccgctccagcgggtggggattttcttggactatgatgctggtgaggtctccttctacaacgtgacagagaggtgtcacaccttcactttctctcatgctaccttttgtgggcctgtccggccctacttcagtctgagttactcgggagggaaaagtgcagctcctctgatcatctgccccatgagtgggatagatgggttttctggccatgttgggaatcatggtcattccatggagacctccccttgaggaggtgaattcaggccaaaagggctgttggctgtaatcctacgccaggcacaaggcatcttgttgccttgccacgtcctgtcacagctgggtatccttaccatgttccacgcccttgcagtgggagacaggatgtccatgttctctaccatccttttccttcccatgcagattgtgaaatgtaatgagatgtatcaagatatcctagaaataaaaaccagatgtccacctccagtgtttcatactttctggttttacacatcgctggagggataaagagtatggataatctttggatttggagagccgttcaagatacttccagcttcttggctcagcctggcttcctctggttcagccccacataatgattatggctatttgctgtcatttctgggctagggctcctttctaacaacctagactggaataaggccctgtcagcatggctccctttatcccagttttccgtctgggaacagtacctctgcccctgattcccaatgtgccatagttttattaactccattaaagaagcctgtatgtgttttggttagttacagttattttacaataatggtgggtaatggccccacctctgttatgagataatgttctaatcaatgtctctgcctttgtatcttttctgagggctttgtctgttctcttcattctaatgaaaggtgtattctagtgctgggtgcatatcatccaggataatattctgcccaactccatcctctgttactagatcccttaccagtcacatttgtggactggtggccagtcgtataccatccctggaaggattctgggacaatattccagggattcattgacttcttggctccttttctccatttcctttgggggaagggggaattgaccatgcttaagtgcatcctatcaaggggcagctccgtccccatggccattggatcatgagacactctgaagtcagaaggctggggcagatcacttcaagcaagcccccatgatggttctcagtcctgcttctctgtgggtacgtgcccctctgtttaaaaataaactgaatatggatgttta

SEQ ID NO: 330585 - DNA, 2124 bp, Homo sapiens
aaaggaagaaagaaaccatgtactgatcagcaatgtgcggttcctgagaaggcaggtggaaatgagaactaaagtacatatgccaggaattagtgtcagagagtcttctgttgtatgggaagaaatgattgtttcagagtatgggaaagacagttggtttgcgagaactagtaggagtatttggtcagtgaacatctatttatagtgtaaccattctgccctgggcaacaagcgaaactccatctcaaaaaaaaaaaaaatttactcatgttttttaaatttagggctgaaagaatcaggattcctgaaccttggatcacacctccagatttgcaagagaaaatccacatttttgcccaaaaatgtctattcttgacggagagtctaaagcagttcacagaaaaaatgcagtcagatatggagaaaatccaagaattaagagaggctcagttatactcagtggacgtgactctggacccagacacggcctaccccagcctgatcctctctgataatctgcggcaagtgcggtacagttacctccaacaggacctgcctgacaaccccgagaggttcaatctgtttccctgtgtcttgggctctccatgcttcatcgccgggagacattattgggaggtagaggtgggagataaagccaagtggaccataggtgtctgtgaagactcagtgtgcagaaaaggtggagtaacctcagccccccagaatggattctgggcagtgtctttgtggtatgggaaagaatattgggctcttacctccccaatgactgccctacccctgcggaccccgctccagcgggtggggattttcttggactatgatgctggtgaggtctccttctacaacgtgacagagaggtgtcacaccttcactttctctcatgctaccttttgtgggcctgtccggccctacttcagtctgagttactcgggagggaaaagtgcagctcctctgatcatctgccccatgagtgggatagatgggttttctggccatgttgggaatcatggtcattccatggagacctccccttgaggaggtgaattcaggccaaaagggctgttggctgtaatcctacgccaggcacaaggcatcttgttgccttgccacgtcctgtcacagctgggtatccttaccatgttccacgcccttgcagtgggagacaggatgtccatgttctctaccatccttttccttcccatgcagattgtgaaatgtaatgagatgtatcaagatatcctagaaataaaaaccagatgtccacctccagtgtttcatactttctggttttacacatcgctggagggataaagagtatggataatctttggatttggagagccgttcaagatacttccagcttcttggctcagcctggcttcctctggttcagccccacataatgattatggctatttgctgtcatttctgggctagggctcctttctaacaacctagactggaataaggccctgtcagcatggctccctttatcccagttttccgtctgggaacagtacctctgcccctgattcccaatgtgccatagttttattaactccattaaagaagcctgtatgtgttttggttagttacagttattttacaataatggtgggtaatggccccacctctgttatgagataatgttctaatcaatgtctctgcctttgtatcttttctgagggctttgtctgttctcttcattctaatgaaaggtgtattctagtgctgggtgcatatcatccaggataatattctgcccaactccatcctctgttactagatcccttaccagtcacatttgtggactggtggccagtcgtataccatccctggaaggattctgggacaatattccagggattcattgacttcttggctccttttctccatttcctttgggggaagggggaattgaccatgcttaagtgcatcctatcaaggggcagctccgtccccatggccattggatcatgagacactctgaagtcagaaggctggggcagatcacttcaagcaagcccccatgatggttctcagtcctgcttctctgtgggtacgtgcccctctgtttaaaaataaactgaatatggatgttta

SEQ ID NO: 330586 - DNA, 2322 bp, Homo sapiens
tttttgagtacttagtatttgaaaagctgtgagctaggtgctttggggggtatgagaatgagtacagtatcctattttggtctagaggatcatagctcaggaagagaaggtgggaaaagctgtagtggctgattttaaagactgtccgtgtacgctagacagtttaacttagcccctgtcctagttcctggaaggtcatggaattgggaaaaagaatttacttgggccggacgtggtggctcacgcctgtaatcccagcactttgggaggccgaggcgggaggatcacctgaggtcaggagttcgagaccagcctgaccagtatggagaaaccccatctctactaaaaacacaaaattagctgggtatggtggcgcatgcctgtaatcccagctactcaggaggctgaggcaggagaatcgcttgaacctgggaggcagaggttgcggtgggccgagatggcgccattgcactccagcctgggcaacaagcgaaactccatctcaaaaaaaaaaaaaatttactcatgttttttaaatttagggctgaaagaatcaggattcctgaaccttggatcacacctccagatttgcaagagaaaatccacatttttgcccaaaaatgtctattcttgacggagagtctaaagcagttcacagtggacgtgactctggacccagacacggcctaccccagcctgatcctctctgataatctgcggcaagtgcggtacagttacctccaacaggacctgcctgacaaccccgagaggttcaatctgtttccctgtgtcttgggctctccatgcttcatcgccgggagacattattgggaggtagaggtgggagataaagccaagtggaccataggtgtctgtgaagactcagtgtgcagaaaaggtggagtaacctcagccccccagaatggattctgggcagtgtctttgtggtatgggaaagaatattgggctcttacctccccaatgactgccctacccctgcggaccccgctccagcgggtggggattttcttggactatgatgctggtgaggtctccttctacaacgtgacagagaggtgtcacaccttcactttctctcatgctaccttttgtgggcctgtccggccctacttcagtctgagttactcgggagggaaaagtgcagctcctctgatcatctgccccatgagtgggatagatgggttttctggccatgttgggaatcatggtcattccatggagacctccccttgaggaggtgaattcaggccaaaagggctgttggctgtaatcctacgccaggcacaaggcatcttgttgccttgccacgtcctgtcacagctgggtatccttaccatgttccacgcccttgcagtgggagacaggatgtccatgttctctaccatccttttccttcccatgcagattgtgaaatgtaatgagatgtatcaagatatcctagaaataaaaaccagatgtccacctccagtgtttcatactttctggttttacacatcgctggagggataaagagtatggataatctttggatttggagagccgttcaagatacttccagcttcttggctcagcctggcttcctctggttcagccccacataatgattatggctatttgctgtcatttctgggctagggctcctttctaacaacctagactggaataaggccctgtcagcatggctccctttatcccagttttccgtctgggaacagtacctctgcccctgattcccaatgtgccatagttttattaactccattaaagaagcctgtatgtgttttggttagttacagttattttacaataatggtgggtaatggccccacctctgttatgagataatgttctaatcaatgtctctgcctttgtatcttttctgagggctttgtctgttctcttcattctaatgaaaggtgtattctagtgctgggtgcatatcatccaggataatattctgcccaactccatcctctgttactagatcccttaccagtcacatttgtggactggtggccagtcgtataccatccctggaaggattctgggacaatattccagggattcattgacttcttggctccttttctccatttcctttgggggaagggggaattgaccatgcttaagtgcatcctatcaaggggcagctccgtccccatggccattggatcatgagacactctgaagtcagaaggctggggcagatcacttcaagcaagcccccatgatggttctcagtcctgcttctctgtgggtacgtgcccctctgtttaaaaataaactgaatatggatgttta

SEQ ID NO: 330587 - DNA, 1591 bp, Homo sapiens
  misc_feature (82)..(82): n is a, c, g, or t
  misc_feature (90)..(90): n is a, c, g, or t
tcacaatcatggtttttcccacggtgttttgattcctataggtggactcctacacaaatgcttatcaattctgccccggggnaatggaanccattattgggaggtagaggtgggagataaagccaagtggaccataggtgtctgtgaagactcagtgtgcagaaaaggtggagtaacctcagccccccagaatggattctgggcagtgtctttgtggtatgggaaagaatattgggctcttacctccccaatgactgccctacccctgcggaccccgctccagcgggtggggattttcttggactatgatgctggtgaggtctccttctacaacgtgacagagaggtgtcacaccttcactttctctcatgctaccttttgtgggcctgtccggccctacttcagtctgagttactcgggagggaaaagtgcagctcctctgatcatctgccccatgagtgggatagatgggttttctggccatgttgggaatcatggtcattccatggagacctccccttgaggaggtgaattcaggccaaaagggctgttggctgtaatcctacgccaggcacaaggcatcttgttgccttgccacgtcctgtcacagctgggtatccttaccatgttccacgcccttgcagtgggagacaggatgtccatgttctctaccatccttttccttcccatgcagattgtgaaatgtaatgagatgtatcaagatatcctagaaataaaaaccagatgtccacctccagtgtttcatactttctggttttacacatcgctggagggataaagagtatggataatctttggatttggagagccgttcaagatacttccagcttcttggctcagcctggcttcctctggttcagccccacataatgattatggctatttgctgtcatttctgggctagggctcctttctaacaacctagactggaataaggccctgtcagcatggctccctttatcccagttttccgtctgggaacagtacctctgcccctgattcccaatgtgccatagttttattaactccattaaagaagcctgtatgtgttttggttagttacagttattttacaataatggtgggtaatggccccacctctgttatgagataatgttctaatcaatgtctctgcctttgtatcttttctgagggctttgtctgttctcttcattctaatgaaaggtgtattctagtgctgggtgcatatcatccaggataatattctgcccaactccatcctctgttactagatcccttaccagtcacatttgtggactggtggccagtcgtataccatccctggaaggattctgggacaatattccagggattcattgacttcttggctccttttctccatttcctttgggggaagggggaattgaccatgcttaagtgcatcctatcaaggggcagctccgtccccatggccattggatcatgagacactctgaagtcagaaggctggggcagatcacttcaagcaagcccccatgatggttctcagtcctgcttctctgtgggtacgtgcccctctgtttaaaaataaactgaatatggatgttta

SEQ ID NO: 330588 - DNA, 1217 bp, Homo sapiens
gtgggagcactaccacacccacgtgctgcccagccaccagagcctgctgctgcggcacccctacggctacactgggcctaggtgatggcagtccatgtggctgccaggccaaggcagtcacaggggccctgaccccaggccacacagacggacatgggcccacatgggagggtgagcaggagcaaggctgtgcttgcctagggcctctgtgatggacatctcgtaggacccagccagtctcatccagcaggttgggttctagggctgaaccaggcgccaggctccagaggacgaagggactctgttgccccacactaacttgccctgtcccaatcccagaaacccaggaccaagctgtgcctgggctccaaggacaggaacactggtccccccatcacactcacccctaagtgggctgggagccaggcagggccagggcagctgggtgggggccggggctggccctgggacccccaggaacgctaagacacaggctccagtaggggctgttgcctccaataaagcagcagtgagctttgccttggtggctggggcttgattgggaaggaggggattaccagcttactgggtgcccatgctgatgtctaagtggtgaccgcagcagtacccgggaaccccaacagttggttgtcttgtcttccagggtgcaggtcactgagtgacttccccagggtgcacagcgagtaacagatcaggacccaaacttgggcagtctgggctgggagcccacaccccactcaccagttctgctgcctcaggtcaggccagggcagtgctgctgcagagctagaaggccctgcagctacagctgcttcattccctgcattagtgcctggttactgggtacctcctgagtggctgtccccgttccagaacttgcatacactgagcgggctacagagctagaaggccctgcagctacagctgcttcattccctgcattagcgagcagttattgggtacctcctgcatgcctggtcccattccagacaggggcctctggcctggctgagttcacagcccagtctggggacagctgggtatgaggtgcttacggcacagtgtccagggcagctgggtgtgcagggactgggggctcccggaagattttttggaggaagtaacagctatgatgggatgggaacagtggaccctaagcaggccaagggtgcgtagggacggtggtacccagatgc

SEQ ID NO: 330589 - DNA, 540 bp, Homo sapiens
gtgggagcactaccacacccacgtgctgcccagccaccagagcctgctgctgcggcacccctacggctacactgggcctaggtgatggcagtccatgtggctgccaggccaaggcagtcacaggggccctgaccccaggccacacagacggacatgggcccacatgggagggtgagcaggagcaaggctgtgcttgcctagggcctctgtgatggacatctcgtaggacccagccagtctcatccagcaggttgggttctagggctgaaccaggcgccaggctccagaggacgaagggactctgttgccccacactaacttgccctgtcccaatcccagaaacccaggaccaagctgtgcctgggctccaaggacaggaacactggtccccccatcacactcacccctaagtgggctgggagccaggcagggccagggcagctgggtgggggccggggctggccctgggacccccaggaacgctaagacacaggctccagtaggggctgttgcctccaataaagcagcagtgagctttgc

SEQ ID NO: 330590 - DNA, 842 bp, Homo sapiens
attaagttctacaaattttgttcccatttacaacaatttcattaacacataatgagttaaatagagacacaatgtatccaataccctcattatgtgttaatgaaattgttgtaaatgggaaccaaatttgtagaacttaatttctactttttagagtgcttaatttcatttttgccttactaaatagtcaaagacttataaaacatttttaacaagttagaacttttttgttattcagtcatataaaatagcagaaaactaacatcaagtgacactgcactaaatactttttttgtattttactgctatcaaatcagaatgaaatatactttaccatagatatttttcttctatttttggttttccaaagctatatgaaagacaaatttttaaaggtacagcgttcaaaaagtgcttaatgaactccaacagctgcctcaaataaaaatctgtatatgaatacattttccctaagcggtgatacattatccaaagatgaagagtgctcctatttttaataggtagaatgtacctttgtcagtcttgcagaaactttaatggagaagaaatggactttatttttgaaaggtgaaatgaacaggcatttatattattagagaatggtagtcttattttggtggaacataatgtaacaaccttgaatttcagaggactctgagtgcttctatgtccactacctattgttctattcttcaataatgaaaaagaattcaacgagccgaccgtgattccctctactacaaatattatgtcttgtaagttagcatttttagcacacaggagaaattttatgtaataaaattactgtatcttttggattt

SEQ ID NO: 330591 - DNA, 1353 bp, Homo sapiens
attaagttctacaaattttgttcccatttacaacaatttcattaacacataatgagttaaatagagacacaatgtatccaataccctcattatgtgttaatgaaattgttgtaaatgggaaccaaatttgtagaacttaatttctactttttagagtgcttaatttcatttttgccttactaaatagtcaaagacttataaaacatttttaacaagttagaacttttttgttattcagtcatataaaatagcagaaaactaacatcaagtgacactgcactaaatactttttttgtattttactgctatcaaatcagaatgaaatatactttaccatagatatttttcttctatttttggttttccaaagctatatgaaagacaaatttttaaaggtacagcgttcaaaaagtgcttaatgaactccaacagctgcctcaaataaaaatctgtatatgaatacattttccctaagcggtgatacattatccaaagatgaagagtgctcctatttttaataggtagaatgtacctttgtcagtcttgcagaaactttaatggagaagaaatggactttatttttgaaaggtgaaatgaacaggcatttatattattagagaatggtagtcttattttggtggaacataatgtaacaaccttgaatttcagaggactctgagtgcttctatgtccactacctattgttctattcttcaataatgaaaaagaattcaacgagccgaccgtgattccctctactacaaatattatgtcttgtaagttagcatttttagcacacaggagaaattttatgtaataaaattactgtatcttttggatttaacaaatttgtatttgaaacacattctatgtctgataattcttaatggcacttttactaatttatttggggatcttgggtacattcttaatttgtgtttattcttcacgcttgacttgcaagtgggatattcccctgccacaagtgtcaaacagtgatattcttcctgtgttgtgactggacagttttccagatcttttttgggagattttcctacagcttggttgtatgtcttgagataacaccaccaaacagctctcagaaattcttttttgattgatcagtagctatgatgattctcctccatgacactaaggattagtttatatatttaagagaaataattgctaaaattaaaatgcctctatcaaggaatgctattataaattattgttaacattctcaagtattaattttttaatttcattggtgtagcaaactctaagcccagccactcattttacatggccatggttaatctttttattaataaaaattatacttagaataaa

SEQ ID NO: 330592 - DNA, 1308 bp, Homo sapiens
accatcatgagggtattggatacattgtgtctctatttaactcattatgtgttaatgaaattgttgtaaatgggaaccaaatttgtagaacttaatttctactttttagagtgcttaatttcatttttgccttactaaatagtcaaagacttataaaacatttttaacaagttagaacttttttgttattcagtcatataaaatagcagaaaactaacatcaagtgacactgcactaaatactttttttgtattttactgctatcaaatcagaatgaaatatactttaccatagatatttttcttctatttttggttttccaaagctatatgaaagacaaatttttaaaggtacagcgttcaaaaagtgcttaatgaactccaacagctgcctcaaataaaaatctgtatatgaatacattttccctaagcggtgatacattatccaaagatgaagagtgctcctatttttaataggtagaatgtacctttgtcagtcttgcagaaactttaatggagaagaaatggactttatttttgaaaggtgaaatgaacaggcatttatattattagagaatggtagtcttattttggtggaacataatgtaacaaccttgaatttcagaggactctgagtgcttctatgtccactacctattgttctattcttcaataatgaaaaagaattcaacgagccgaccgtgattccctctactacaaatattatgtcttgtaagttagcatttttagcacacaggagaaattttatgtaataaaattactgtatcttttggatttaacaaatttgtatttgaaacacattctatgtctgataattcttaatggcacttttactaatttatttggggatcttgggtacattcttaatttgtgtttattcttcacgcttgacttgcaagtgggatattcccctgccacaagtgtcaaacagtgatattcttcctgtgttgtgactggacagttttccagatcttttttgggagattttcctacagcttggttgtatgtcttgagataacaccaccaaacagctctcagaaattcttttttgattgatcagtagctatgatgattctcctccatgacactaaggattagtttatatatttaagagaaataattgctaaaattaaaatgcctctatcaaggaatgctattataaattattgttaacattctcaagtattaattttttaatttcattggtgtagcaaactctaagcccagccactcattttacatggccatggttaatctttttattaataaaaattatacttagaataaa

SEQ ID NO: 330593 - DNA, 1254 bp, Homo sapiens
accatcatgagggtattggatacattgtgtctctatttaactcattatgtgttaatgaaattgttgtaaatgggaaccaaatttgtagaacttaatttctactttttagagtgcttaatttcatttttgccttactaaatagtcaaagacttataaaacatttttaacaagttagaacttttttgttattcagtcatataaaatagcagaaaactaacatcaagtgacactgcactaaatactttttttgtattttactgctatcaaatcagaatgaaatatactttaccatagatatttttcttctatttttggttttccaaagctatatgaaagacaaatttttaaaggtacagcgttcaaaaagtgcttaatgaactccaacagctgcctcaaataaaaattgctcctatttttaataggtagaatgtacctttgtcagtcttgcagaaactttaatggagaagaaatggactttatttttgaaaggtgaaatgaacaggcatttatattattagagaatggtagtcttattttggtggaacataatgtaacaaccttgaatttcagaggactctgagtgcttctatgtccactacctattgttctattcttcaataatgaaaaagaattcaacgagccgaccgtgattccctctactacaaatattatgtcttgtaagttagcatttttagcacacaggagaaattttatgtaataaaattactgtatcttttggatttaacaaatttgtatttgaaacacattctatgtctgataattcttaatggcacttttactaatttatttggggatcttgggtacattcttaatttgtgtttattcttcacgcttgacttgcaagtgggatattcccctgccacaagtgtcaaacagtgatattcttcctgtgttgtgactggacagttttccagatcttttttgggagattttcctacagcttggttgtatgtcttgagataacaccaccaaacagctctcagaaattcttttttgattgatcagtagctatgatgattctcctccatgacactaaggattagtttatatatttaagagaaataattgctaaaattaaaatgcctctatcaaggaatgctattataaattattgttaacattctcaagtattaattttttaatttcattggtgtagcaaactctaagcccagccactcattttacatggccatggttaatctttttattaataaaaattatacttagaataaa

SEQ ID NO: 330594 - DNA, 348 bp, Homo sapiens
aaaactgtctgtttccattaaactggaatattcatcattgtccaaatttgcatcacacattgtgcttctgaatcttgattcacactatttctcatgcccgctattctcttgcttcaatccaacaatgctcacatctccctccctgcaagaagtattcctcatcaagaggctttgaagactgccatctttggtgattactatcatttataattttcacttgctaagatttttaaaagtctactctataccctccttcttcaatgagatctagtcaccagttctaaactgtacatttgattgtctccttgacattttcccttgaacatctcaaagtcaccctaatgtcaa

SEQ ID NO: 330595 - DNA, 727 bp, Homo sapiens
tatcactttttttctttcacatatttagatgtagtctgtcagcaataaaattaaggcaaatatatcagctgggttcacttaaatttttaaaattgtaccgggtaccctttaccaatcttcattaacatcaagaaaacataagtacactagttgtgctggagagaaggaaattacaaggaagacattgggttaaatctaacaacttattagtaaatgagttgaagatgtaaagtataatatataggcaaataagagttttcaggaggacagtacattcttgagaaaaccctaatgcatgaaaatttaagaaaaagttctaagatgaaatgggattaatagttgtctttgggccgggcatggtggctcacgcctgtaatcccagcactttggaaggctgaggcagatggatcacgaggccaggagttcaagaccagcctggccaacatagtgaaaccccgtctctactaaaaatataaacatttgctgggcatggtggcacacgcctgtagttccagttactcaggaggctgagggaggagaattgcttgaatccaggaggtgggaaatcacagtgagctgagatcacaccactggcactccagcctgggtgaacagagtgagactccatctcaaaaataatagatcgattgattcgctgttgttgttctatttgatgatgattggccggtcgggtccctccttgttccaccttgggggtcgggggtgc

SEQ ID NO: 330596 - DNA, 2095 bp, Homo sapiens
gtcttccgtcacgccccgcttcccgcaaacaaatcaccgccaccacttaggaaaccacgggaaagctgtgattgcagcgccacggtcgccagatttctgctcctgggcacattacccccaactccgaggccccctttttggcagggctagtctggactggccaatccaggtccctgcacgcctctcaccgcaacatccccgcagggcgctgcgcgcggggtactagccaggcggcgcggcccgatgacgcattgcgcctgcgcgcgcgaccgagccgggaggggtggggcgccaggtgcttgggggccggcggccgccgaggccggctaaacgcagaatggggaagaatcctgtgcgtcctccacgagctcttccacctgtgccaagtcaagatgatattccacttagtcgtcctaagaaaaagaagcccagaacaaaaaacacaccagcaagtgcttctttggaaggccttgctcagactgctggtcgaaggccctctgagggcaatgagccatcaactaaagaactcaaagagcacccagaggctcctgttcaaagaagacagaaaaagacaaggctacctcttgaattggagacttcctccacccaaaagaagtcatctagttcatctttattacgaaatgaaaatggtattgatgcggagccagctgaggaggcagttattcaaaaacctcggaggaagacaaagaaaacccagccagcagaattacagtatgccaatgagctaggagtagaagatgaagacataatcactgatgagcaaactactgtggaacagcagtctgtattcactgcacccactggcattagccagcctgtaggcaaagtatttgtggaaaaaagccggagattccaggctgctgatcgttcagagttgataaagaccacagaaaacatagatgtgtcaatggacgtgaagccttcctggaccaccagagatgtggcacttacagtgcaccgggctttcaggatgattggtctcttttctcatggattcttggctggctgtgctgtgtggaatattgttgtgatatatgttctagcaggagatcagctatccaacctctcaaaccttctgcaacaatacaagaccctagcgtatccattccagagtcttctgtacttgcttttggctctgagtacaatttcagcttttgacaggattgactttgctaaaatatcagtagcaatccgaaattttttggccctggatcctacagctttagcatctttcttgtactttactgctcttatactatctctgagtcagcaaatgacaagtgacagaatccacctttacacaccttcttctgttaatggtagcctctgggaagcaggaattgaggaacagattctccagccatggattgtggtgaatctcgtggtggctcttctggttggattatcttggctatttttgtcttataggccaggcatggatcttagtgaagagttaatgttctcctcagaggtggaagaatatcctgataaagagaaagaaatcaaagcctcttcataataccagctcacctttggaggaataatgacccagtatttgtcccatttttgtttttaaatgtatttttataagatgtatacatgtgtatttgtaatagattttttgattatataatactgaaacatctctcaatattatgaaaaatgttaaaattgtgtttgctgtttatgtctaaacattaatttgtctagcattatcatcttaatgacaaagggaataatgaactagaaaccagcaagtgaaagtgtttatttcctattttctcaaaacagttgtatttataactattaccttaaaaagcactggtttagaaaaagccataacttaaatagtgttataaaatatatatcaggtttaaacataaatttagcgaatatggtagaagggaaaaaagccttcatttttgacctccccttactgaataaattgaaatatgaagtttgtcttttctgaaactggcttagtgattgagtatcatgtaataattataatataatttagcttgaaagatgctctacattatgaccaataaaaagggaatgtatgttttgtttg

SEQ ID NO: 330597 - DNA, 987 bp, Homo sapiens
gtcttccgtcacgccccgcttcccgcaaacaaatcaccgccaccacttaggaaaccacgggaaagctgtgattgcagcgccacggtcgccagatttctgctcctgggcacattacccccaactccgaggccccctttttggcagggctagtctggactggccaatccaggtccctgcacgcctctcaccgcaacatccccgcagggcgctgcgcgcggggtactagccaggcggcgcggcccgatgacgcattgcgcctgcgcgcgcgaccgagccgggaggggtggggcgccaggtgcttgggggccggcggccgccgaggccggctaaacgcagaatggggaagaatcctgtgcgtcctccacgagctcttccacctgtgccaagtcaagatgatattccacttagtcgtcctaagaaaaagaagcccagaacaaaaaacacaccaggtaagacgttattctttgttgtgtgggatcacaagttttcccaggacctcaggcgtagtaaacatcacagataagggagaattaaggccccagcagccccgaatctccacttcattgaggatagaattaaggccagtttgaagcagtggaattcctggtggtggtgaggtacagggcagtgggcagcctgaggagtatctggacgcattcatggaatagaaggtggtgccatctaagctcctatttccatgatattcctggactctttaaggtcttttatccccagacaacatacatggttttaagctatgattgattccagacccttgaacaagatactgaatttagaaacacagagttcttaaatctcacttcaatcagaatatctctacattacagcatgagtctgaaggcatggccacatcatcatttaaatagtaaagcttcagtcatgagcagaactcgtttttgtcttagtcatccactgataatcctggaagttgcatccgtaactctaaactcagcacatctagaatcc

SEQ ID NO: 330598 - DNA, 1879 bp, Homo sapiens
ccccggcgtcccacaggtcccggaggccgctgcgtcgcggggagctgggctcgggccgccggcggttgcgccggggcagccccgcggggagagcaccatgaggactgactcgggggctcggctggaggagggccacctgcgtcctccacgagctcttccacctgtgccaagtcaagatgatattccacttagtcgtcctaagaaaaagaagcccagaacaaaaaacacaccagcaagtgcttctttggaaggccttgctcagactgctggtcgaaggccctctgagggcaatgagccatcaactaaagaactcaaagagcacccagaggctcctgttcaaagaagacagaaaaagacaaggctacctcttgaattggagacttcctccacccaaaagaagtcatctagttcatctttattacgaaatgaaaatggtattgatgcggagccagctgaggaggcagttattcaaaaacctcggaggaagacaaagaaaacccagccagcagaattacagtatgccaatgagctaggagtagaagatgaagacataatcactgatgagcaaactactgtggaacagcagtctgtattcactgcacccactggcattagccagcctgtaggcaaagtatttgtggaaaaaagccggagattccaggctgctgatcgttcagagttgataaagaccacagaaaacatagatgtgtcaatggacgtgaagccttcctggaccaccagagatgtggcacttacagtgcaccgggctttcaggatgattggtctcttttctcatggattcttggctggctgtgctgtgtggaatattgttgtgatatatgttctagcaggagatcagctatccaacctctcaaaccttctgcaacaatacaagaccctagcgtatccattccagagtcttctgtacttgcttttggctctgagtacaatttcagcttttgacaggattgactttgctaaaatatcagtagcaatccgaaattttttggccctggatcctacagctttagcatctttcttgtactttactgctcttatactatctctgagtcagcaaatgacaagtgacagaatccacctttacacaccttcttctgttaatggtagcctctgggaagcaggaattgaggaacagattctccagccatggattgtggtgaatctcgtggtggctcttctggttggattatcttggctatttttgtcttataggccaggcatggatcttagtgaagagttaatgttctcctcagaggtggaagaatatcctgataaagagaaagaaatcaaagcctcttcataataccagctcacctttggaggaataatgacccagtatttgtcccatttttgtttttaaatgtatttttataagatgtatacatgtgtatttgtaatagattttttgattatataatactgaaacatctctcaatattatgaaaaatgttaaaattgtgtttgctgtttatgtctaaacattaatttgtctagcattatcatcttaatgacaaagggaataatgaactagaaaccagcaagtgaaagtgtttatttcctattttctcaaaacagttgtatttataactattaccttaaaaagcactggtttagaaaaagccataacttaaatagtgttataaaatatatatcaggtttaaacataaatttagcgaatatggtagaagggaaaaaagccttcatttttgacctccccttactgaataaattgaaatatgaagtttgtcttttctgaaactggcttagtgattgagtatcatgtaataattataatataatttagcttgaaagatgctctacattatgaccaataaaaagggaatgtatgttttgtttg

SEQ ID NO: 330599 - DNA, 2026 bp, Homo sapiens
gtcttccgtcacgccccgcttcccgcaaacaaatcaccgccaccacttaggaaaccacgggaaagctgtgattgcagcgccacggtcgccagatttctgctcctgggcacattacccccaactccgaggccccctttttggcagggctagtctggactggccaatccaggtccctgcacgcctctcaccgcaacatccccgcagggcgctgcgcgcggggtactagccaggcggcgcggcccgatgacgcattgcgcctgcgcgcgcgaccgagccgggaggggtggggcgccaggtgcttgggggccggcggccgccgaggccggctaaacgcagaatggggaagaatcctgtgcgtcctccacgagctcttccacctgtgccaagtcaagatgatattccacttagtcgtcctaagaaaaagaagcccagaacaaaaaacacaccagcaagtgcttctttggaaggccttgctcagactgctggtcgaaggccctctgagggcaatgagccatcaactaaagaactcaaagagcacccagaggctcctgttcaaagaagacagaaaaagacaaggctacctcttgaattggagacttcctccacccaaaagaagtcatctagttcatctttattacgaaatgaaaatggtattgatgcggagccagctgaggaggcagttattcaaaaacctcggaggaagacaaagaaaacccagccagcagaattacagtatgccaatgagctaggagtagaagatgaagacataatcactgatgagcaaactactgtggaacagcagtctgtattcactgcacccactggcattagccagcctgtaggcaaagtatttgtggaaaaaagccggagattccaggctgctgatcgttcagagttgataaagaccacagaaaacatagatgtgtcaatggacgtgaagccttcctggaccaccagagatgtggcacttacagtgcaccgggctttcaggatgattggtctcttttctcatggattcttggctggctgtgctgtgtggaatattgttgtgatatatgttctagcaggagatcagctatccaacctctcaaaccttctgcaacaatacaagaccctagcgtatccattccagagtcttctgtacttgcttttggctctgagtacaatttcagcttttgacaggattgactttgctaaaatatcagtagcaatccgaaattttttggccctggatcctacagctttagcatctttcttgtactttactgctcttatactatctctgagtcagcaaatgacaagtgacagaatccacctttacacaccttcttctgttaatggtagcctctgggaagcaggaattgaggaacagattctccagccatggattgtggtgaatctcgtggtggctcttctggttggattatcttggctatttttgtcttataggccaggcatggatcttagtgaagagttaatgttctcctcagaggtggaagaatatcctgataaagagaaagaaatcaaagcctcttcataataccagctcacctttggaggaataatgacccagtatttgtcccatttttgtttttaaatgtatttttataagatgtatacatgtgtatttgtaatagattttttgattatataatactgaaacatctctcaatattatgaaaaatgttaaaattgtgtttgctgtttatgtctaaacattaatttgtctagcattatcatcttaatgacaaagggaataatgaactagaaaccagcaagtgaaagtgtttatttcctattttctcaaaacagttgtatttataactattaccttaaaaagcactggtttagaaaaagccataacttaaatagtgttataaaatatatatcaggtttaaacataaatttagcgaatatggtagaagggaaaaaagccttcatttttgacctccccttactgaataaataatgatgcagacaaggcccctttttttttatatttagtgtaggtgtatattacaacgaa

SEQ ID NO: 330600 - DNA, 1973 bp, Homo sapiens
ccccggcgtcccacaggtcccggaggccgctgcgtcgcggggagctgggctcgggccgccggcggttgcgccggggcagccccgcggggagagcaccatgaggactgactcgggggctcggctggaggagggccacctgcgtcctccacgagctcttccacctgtgccaagtcaagatgatattccacttagtcgtcctaagaaaaagaagcccagaacaaaaaacacaccagcaagtgcttctttggaaggccttgctcagactgctggtcgaaggccctctgagggcaatgagccatcaactaaagaactcaaagagcacccagaggctcctgttcaaagaagacagaaaaagacaaggctacctcttgaaaacggcgtgtcttgattggatggaagaattataggagtagaagggcaggaactagaaaagtcaggagaatggagcataattttggaaggcaaaattggagacttcctccacccaaaagaagtcatctagttcatctttattacgaaatgaaaatggtattgatgcggagccagctgaggaggcagttattcaaaaacctcggaggaagacaaagaaaacccagccagcagaattacagtatgccaatgagctaggagtagaagatgaagacataatcactgatgagcaaactactgtggaacagcagtctgtattcactgcacccactggcattagccagcctgtaggcaaagtatttgtggaaaaaagccggagattccaggctgctgatcgttcagagttgataaagaccacagaaaacatagatgtgtcaatggacgtgaagccttcctggaccaccagagatgtggcacttacagtgcaccgggctttcaggatgattggtctcttttctcatggattcttggctggctgtgctgtgtggaatattgttgtgatatatgttctagcaggagatcagctatccaacctctcaaaccttctgcaacaatacaagaccctagcgtatccattccagagtcttctgtacttgcttttggctctgagtacaatttcagcttttgacaggattgactttgctaaaatatcagtagcaatccgaaattttttggccctggatcctacagctttagcatctttcttgtactttactgctcttatactatctctgagtcagcaaatgacaagtgacagaatccacctttacacaccttcttctgttaatggtagcctctgggaagcaggaattgaggaacagattctccagccatggattgtggtgaatctcgtggtggctcttctggttggattatcttggctatttttgtcttataggccaggcatggatcttagtgaagagttaatgttctcctcagaggtggaagaatatcctgataaagagaaagaaatcaaagcctcttcataataccagctcacctttggaggaataatgacccagtatttgtcccatttttgtttttaaatgtatttttataagatgtatacatgtgtatttgtaatagattttttgattatataatactgaaacatctctcaatattatgaaaaatgttaaaattgtgtttgctgtttatgtctaaacattaatttgtctagcattatcatcttaatgacaaagggaataatgaactagaaaccagcaagtgaaagtgtttatttcctattttctcaaaacagttgtatttataactattaccttaaaaagcactggtttagaaaaagccataacttaaatagtgttataaaatatatatcaggtttaaacataaatttagcgaatatggtagaagggaaaaaagccttcatttttgacctccccttactgaataaattgaaatatgaagtttgtcttttctgaaactggcttagtgattgagtatcatgtaataattataatataatttagcttgaaagatgctctacattatgaccaataaaaagggaatgtatgttttgtttg

SEQ ID NO: 330601 - DNA, 1883 bp, Homo sapiens
gtgttctttatttttaactgctggaagtgttaaaacacacacacacacacacacacattttttttttgagaactccaaagtcctgaaaattttggtggacaatgatttttaaaaaactaactttgtataacctaatatttgtattctctcatctatatttttttattcactataatcatgatactcttctaatagacttaaaagttaatcattgacaacgaaaaataaaatgttattttaaaagaaaaaaaaagttttttttttttttttttgaacaggagccctctgagggcaatgagccatcaactaaagaactcaaagagcacccagaggctcctgttcaaagaagacagaaaaagacaaggctacctcttgaattggagacttcctccacccaaaagaagtcatctagttcatctttattacgaaatgaaaatggtattgatgcggagccagctgaggaggcagttattcaaaaacctcggaggaagacaaagaaaacccagccagcagaattacagtatgccaatgagctaggagtagaagatgaagacataatcactgatgagcaaactactgtggaacagcagtctgtattcactgcacccactggcattagccagcctgtaggcaaagtatttgtggaaaaaagccggagattccaggctgctgatcgttcagagttgataaagaccacagaaaacatagatgtgtcaatggacgtgaagccttcctggaccaccagagatgtggcacttacagtgcaccgggctttcaggatgattggtctcttttctcatggattcttggctggctgtgctgtgtggaatattgttgtgatatatgttctagcaggagatcagctatccaacctctcaaaccttctgcaacaatacaagaccctagcgtatccattccagagtcttctgtacttgcttttggctctgagtacaatttcagcttttgacaggattgactttgctaaaatatcagtagcaatccgaaattttttggccctggatcctacagctttagcatctttcttgtactttactgctcttatactatctctgagtcagcaaatgacaagtgacagaatccacctttacacaccttcttctgttaatggtagcctctgggaagcaggaattgaggaacagattctccagccatggattgtggtgaatctcgtggtggctcttctggttggattatcttggctatttttgtcttataggccaggcatggatcttagtgaagagttaatgttctcctcagaggtggaagaatatcctgataaagagaaagaaatcaaagcctcttcataataccagctcacctttggaggaataatgacccagtatttgtcccatttttgtttttaaatgtatttttataagatgtatacatgtgtatttgtaatagattttttgattatataatactgaaacatctctcaatattatgaaaaatgttaaaattgtgtttgctgtttatgtctaaacattaatttgtctagcattatcatcttaatgacaaagggaataatgaactagaaaccagcaagtgaaagtgtttatttcctattttctcaaaacagttgtatttataactattaccttaaaaagcactggtttagaaaaagccataacttaaatagtgttataaaatatatatcaggtttaaacataaatttagcgaatatggtagaagggaaaaaagccttcatttttgacctccccttactgaataaattgaaatatgaagtttgtcttttctgaaactggcttagtgattgagtatcatgtaataattataatataatttagcttgaaagatgctctacattatgaccaataaaaagggaatgtatgttttgtttg

SEQ ID NO: 330602 - DNA, 740 bp, Homo sapiens
atttgaccaactatttacaacctatctgcctcagaagccttagcatgcagaatttcgccaacatctatgctaagtaatagtttaaatgtagaaaatgtcagctaataacattctacattgtggctgggatcaaaactgcatctggattgtgcagtattcagtctaaatatttccagaatcctgttcttttaaggccatgttagtcatacaacatgtggatttaaaaagtaagtataaaatgagatgataatacctggcttcttgcgttgttttgatgattaaatgggatgacccatttaaaatatcctggcacacatctcttgttagttccaagtccttcctctgtatctgtcccctatgtttcagatgatctgatcactgtagaattagacattttagctgtttaatgatctttgattctctaagtgacttaaatttccaggtaggattgtgtatattgtctctattacattttacttttaaggggtctataatttaaaatttaaatattttaaaatgtaaaacttgtacatttgttatcagcttaccttttaaatcatatttcactgtcaagaaatcttacttgagggctttctattagtatatattatgtcaattttttaaaggactatttataaataagctatacaactctgttggaggtactgggaaacaattttaagtatgatctgttcattttcttctccagagttaatgttctcctcagaggtggaagaata

SEQ ID NO: 330603 - DNA, 1918 bp, Homo sapiens
ccccggcgtcccacaggtcccggaggccgctgcgtcgcggggagctgggctcgggccgccggcggttgcgccggggcagccccgcggggagagcaccatgaggactgactcgggggctcggctggaggagggccacctggtgagcggcgaggggcgcgtcggcctcgagaggtggcggcgtcctccacgagctcttccacctgtgccaagtcaagatgatattccacttagtcgtcctaagaaaaagaagcccagaacaaaaaacacaccagcaagtgcttctttggaaggccttgctcagactgctggtcgaaggccctctgagggcaatgagccatcaactaaagaactcaaagagcacccagaggctcctgttcaaagaagacagaaaaagacaaggctacctcttgaattggagacttcctccacccaaaagaagtcatctagttcatctttattacgaaatgaaaatggtattgatgcggagccagctgaggaggcagttattcaaaaacctcggaggaagacaaagaaaacccagccagcagaattacagtatgccaatgagctaggagtagaagatgaagacataatcactgatgagcaaactactgtggaacagcagtctgtattcactgcacccactggcattagccagcctgtaggcaaagtatttgtggaaaaaagccggagattccaggctgctgatcgttcagagttgataaagaccacagaaaacatagatgtgtcaatggacgtgaagccttcctggaccaccagagatgtggcacttacagtgcaccgggctttcaggatgattggtctcttttctcatggattcttggctggctgtgctgtgtggaatattgttgtgatatatgttctagcaggagatcagctatccaacctctcaaaccttctgcaacaatacaagaccctagcgtatccattccagagtcttctgtacttgcttttggctctgagtacaatttcagcttttgacaggattgactttgctaaaatatcagtagcaatccgaaattttttggccctggatcctacagctttagcatctttcttgtactttactgctcttatactatctctgagtcagcaaatgacaagtgacagaatccacctttacacaccttcttctgttaatggtagcctctgggaagcaggaattgaggaacagattctccagccatggattgtggtgaatctcgtggtggctcttctggttggattatcttggctatttttgtcttataggccaggcatggatcttagtgaagagttaatgttctcctcagaggtggaagaatatcctgataaagagaaagaaatcaaagcctcttcataataccagctcacctttggaggaataatgacccagtatttgtcccatttttgtttttaaatgtatttttataagatgtatacatgtgtatttgtaatagattttttgattatataatactgaaacatctctcaatattatgaaaaatgttaaaattgtgtttgctgtttatgtctaaacattaatttgtctagcattatcatcttaatgacaaagggaataatgaactagaaaccagcaagtgaaagtgtttatttcctattttctcaaaacagttgtatttataactattaccttaaaaagcactggtttagaaaaagccataacttaaatagtgttataaaatatatatcaggtttaaacataaatttagcgaatatggtagaagggaaaaaagccttcatttttgacctccccttactgaataaattgaaatatgaagtttgtcttttctgaaactggcttagtgattgagtatcatgtaataattataatataatttagcttgaaagatgctctacattatgaccaataaaaagggaatgtatgttttgtttg

SEQ ID NO: 330604 - DNA, 1785 bp, Homo sapiens
  misc_feature (15)..(15): n is a, c, g, or t
  misc_feature (17)..(17): n is a, c, g, or t
  misc_feature (19)..(19): n is a, c, g, or t
gcgaccgccgagccntnantacgcagaatggggaagaatcctgtgcgtcctccacgagctcttccacctgtgccaagtcaagatgatattccacttagtcgtcctaagaaaaagaagcccagaacaaaaaacacaccagcaagtgcttctttggaaggccttgctcagactgctggtcgaaggccctctgagggcaatgagccatcaactaaagaactcaaagagcacccagaggctcctgttcaaagaagacagaaaaagacaaggctacctcttgaattggagacttcctccacccaaaagaagtcatctagttcatctttattacgaaatgaaaatggtattgatgcggagccagctgaggaggcagttattcaaaaacctcggaggaagacaaagaaaacccagccagcagaattacagtatgccaatgagctaggagtagaagatgaagacataatcactgatgagcaaactactgtggaacagcagtctgtattcactgcacccactggcattagccagcctgtaggcaaagtatttgtggaaaaaagccggagattccaggctgctgatcgttcagagttgataaagaccacagaaaacatagatgtgtcaatggacgtgaagccttcctggaccaccagagatgtggcacttacagtgcaccgggctttcaggatgattggtctcttttctcatggattcttggctggctgtgctgtgtggaatattgttgtgatatatgttctagcaggagatcagctatccaacctctcaaaccttctgcaacaatacaagaccctagcgtatccattccagagtcttctgtacttgcttttggctctgagtacaatttcagcttttgacaggattgactttgctaaaatatcagtagcaatccgaaattttttggccctggatcctacagctttagcatctttcttgtactttactgctcttatactatctctgagtcagcaaatgacaagtgacagaatccacctttacacaccttcttctgttaatggtagcctctgggaagcaggaattgaggaacagattctccagccatggattgtggtgaatctcgtggtggctcttctggttggattatcttggctatttttgtcttataggccaggcatggatcttagtgaagagttaatgttctcctcagaggtggaagaatatcctgataaagagaaagaaatcaaagcctcttcataataccagctcacctttggaggaataatgacccagtatttgtcccatttttgtttttaaatgtatttttataagatgtatacatgtgtatttgtaatagattttttgattatataatactgaaacatctctcaatattatgaaaaatgttaaaattgtgtttgctgtttatgtctaaacattaatttgtctagcattatcatcttaatgacaaagggaataatgaactagaaaccagcaagtgaaagtgtttatttcctattttctcaaaacagttgtatttataactattaccttaaaaagcactggtttagaaaaagccataacttaaatagtgttataaaatatatatcaggtttaaacataaatttagcgaatatggtagaagggaaaaaagccttcatttttgacctccccttactgaataaattgaaatatgaagtttgtcttttctgaaactggcttagtgattgagtatcatgtaataattataatataatttagcttgaaagatgctctacattatgaccaataaaaagggaatgtatgttttgtttg

SEQ ID NO: 330605 - DNA, 2189 bp, Homo sapiens
gtcttccgtcacgccccgcttcccgcaaacaaatcaccgccaccacttaggaaaccacgggaaagctgtgattgcagcgccacggtcgccagatttctgctcctgggcacattacccccaactccgaggccccctttttggcagggctagtctggactggccaatccaggtccctgcacgcctctcaccgcaacatccccgcagggcgctgcgcgcggggtactagccaggcggcgcggcccgatgacgcattgcgcctgcgcgcgcgaccgagccgggaggggtggggcgccaggtgcttgggggccggcggccgccgaggccggctaaacgcagaatggggaagaatcctgtgcgtcctccacgagctcttccacctgtgccaagtcaagatgatattccacttagtcgtcctaagaaaaagaagcccagaacaaaaaacacaccagcaagtgcttctttggaaggccttgctcagactgctggtcgaaggccctctgagggcaatgagccatcaactaaagaactcaaagagcacccagaggctcctgttcaaagaagacagaaaaagacaaggctacctcttgaaaacggcgtgtcttgattggatggaagaattataggagtagaagggcaggaactagaaaagtcaggagaatggagcataattttggaaggcaaaattggagacttcctccacccaaaagaagtcatctagttcatctttattacgaaatgaaaatggtattgatgcggagccagctgaggaggcagttattcaaaaacctcggaggaagacaaagaaaacccagccagcagaattacagtatgccaatgagctaggagtagaagatgaagacataatcactgatgagcaaactactgtggaacagcagtctgtattcactgcacccactggcattagccagcctgtaggcaaagtatttgtggaaaaaagccggagattccaggctgctgatcgttcagagttgataaagaccacagaaaacatagatgtgtcaatggacgtgaagccttcctggaccaccagagatgtggcacttacagtgcaccgggctttcaggatgattggtctcttttctcatggattcttggctggctgtgctgtgtggaatattgttgtgatatatgttctagcaggagatcagctatccaacctctcaaaccttctgcaacaatacaagaccctagcgtatccattccagagtcttctgtacttgcttttggctctgagtacaatttcagcttttgacaggattgactttgctaaaatatcagtagcaatccgaaattttttggccctggatcctacagctttagcatctttcttgtactttactgctcttatactatctctgagtcagcaaatgacaagtgacagaatccacctttacacaccttcttctgttaatggtagcctctgggaagcaggaattgaggaacagattctccagccatggattgtggtgaatctcgtggtggctcttctggttggattatcttggctatttttgtcttataggccaggcatggatcttagtgaagagttaatgttctcctcagaggtggaagaatatcctgataaagagaaagaaatcaaagcctcttcataataccagctcacctttggaggaataatgacccagtatttgtcccatttttgtttttaaatgtatttttataagatgtatacatgtgtatttgtaatagattttttgattatataatactgaaacatctctcaatattatgaaaaatgttaaaattgtgtttgctgtttatgtctaaacattaatttgtctagcattatcatcttaatgacaaagggaataatgaactagaaaccagcaagtgaaagtgtttatttcctattttctcaaaacagttgtatttataactattaccttaaaaagcactggtttagaaaaagccataacttaaatagtgttataaaatatatatcaggtttaaacataaatttagcgaatatggtagaagggaaaaaagccttcatttttgacctccccttactgaataaattgaaatatgaagtttgtcttttctgaaactggcttagtgattgagtatcatgtaataattataatataatttagcttgaaagatgctctacattatgaccaataaaaagggaatgtatgttttgtttg

SEQ ID NO: 330606 - DNA, 2001 bp, Homo sapiens
gtcttccgtcacgccccgcttcccgcaaacaaatcaccgccaccacttaggaaaccacgggaaagctgtgattgcagcgccacggtcgccagatttctgctcctgggcacattacccccaactccgaggccccctttttggcagggctagtctggactggccaatccaggtccctgcacgcctctcaccgcaacatccccgcagggcgctgcgcgcggggtactagccaggcggcgcggcccgatgacgcattgcgcctgcgcgcgcgaccgagccgggaggggtggggcgccaggtgcttgggggccggcggccgccgaggccggctaaacgcagaatggggaagaatcctgtgcgtcctccacgagctcttccacctgtgccaagtcaagatgatattccacttagtcgtcctaagaaaaagaagcccagaacaaaaaacacaccagcaagtgcttctttggaaggccttgctcagactgctggtcgaaggccctctgagggcaatgagccatcaactaaagaactcaaagagcacccagaggctcctgttcaaagaagacagaaaaagacaaggctacctcttgaattggagacttcctccacccaaaagaagtcatctagttcatctttattacgaaatgaaaatggtattgatgcggagccagctgaggaggcagttattcaaaaacctcggaggaagacaaagaaaacccagccagcagaattacagtatgccaatgagctaggagtagaagatgaagacataatcactgatgagcaaactactgtggaacagcagtctgtattcactgcacccactggcattagccagcctgtaggcaaagtatttgtggaaaaaagccggagattccaggctgctgatcgttcagagttgataaagaccacagaaaacatagatgtgtcaatggacgtgaagccttcctggaccaccagagatgtggcacttacagtgcaccgggctttcaggatgattggtctcttttctcatggattcttggctggctgtgctgtgtggaatattgttgtgatatatgttctagcaggagatcagctatccaacctctcaaaccttctgcaacaatacaagaccctagcgtatccattccagagtcttctgtacttgcttttggctctgagtacaatttcagcttttgacaggattgactttgctaaaatatcagtagcaatccgaaattttttggccctggatcctacagctttagcatctttctggaagcaggaattgaggaacagattctccagccatggattgtggtgaatctcgtggtggctcttctggttggattatcttggctatttttgtcttataggccaggcatggatcttagtgaagagttaatgttctcctcagaggtggaagaatatcctgataaagagaaagaaatcaaagcctcttcataataccagctcacctttggaggaataatgacccagtatttgtcccatttttgtttttaaatgtatttttataagatgtatacatgtgtatttgtaatagattttttgattatataatactgaaacatctctcaatattatgaaaaatgttaaaattgtgtttgctgtttatgtctaaacattaatttgtctagcattatcatcttaatgacaaagggaataatgaactagaaaccagcaagtgaaagtgtttatttcctattttctcaaaacagttgtatttataactattaccttaaaaagcactggtttagaaaaagccataacttaaatagtgttataaaatatatatcaggtttaaacataaatttagcgaatatggtagaagggaaaaaagccttcatttttgacctccccttactgaataaattgaaatatgaagtttgtcttttctgaaactggcttagtgattgagtatcatgtaataattataatataatttagcttgaaagatgctctacattatgaccaataaaaagggaatgtatgttttgtttg

SEQ ID NO: 330607 - DNA, 201 bp, Homo sapiens
aaatccagagcaatattctctctacctctgtagttgacttcaacctggcaacagatggccttggaagtcagccggatgccagtatgaatccagttattactagatttccaagcttgagcaagttacttaactcgtcgaacctcactgatgccccttcttctccctggaccaattggctaggggtattaaaggaggctggct

SEQ ID NO: 330608 - DNA, 161 bp, Homo sapiens
gtttatttgttaatcttgataacctgcaatagtttacagccagaatggcagcttttatatatgtacactcatttaaatacagtttcataccgtaaatagccatggggcaaaatatctgcctctaggcacaaaaaaaaaatctttgccgctaaataaacacc

SEQ ID NO: 330609 - DNA, 289 bp, Homo sapiens
cccactagaccatagccagaggagacagagccttatttaaggctttatcctcaggctggtgcccaacaagcttaggaggtgcttgttgaactaacttgaaatgactccatcactgtcagccaagtcatcctccactatccttgggcctcagttttcccctctggataagccagacttagacggggtcatttccaaagacattctgcatctcctattctgggattctgtgatatgccccactccttatccatctctaatcttcaagtctccttccctaagctgcaagcct

SEQ ID NO: 330610 - DNA, 317 bp, Homo sapiens
ttttcagaaggctaattaaagctttgtacagagtctttgttttttgttaacttcttatccttgattttccaaagggtaaaattagcagtgttttttggtgttgtggtttggactgcaatccagtagatgatgcttgagagcaatgggtggtacataggctcatattcagtcatgtgactcctttgttcctctttgcatttgaagctgtgctctatgggacagggaggtgatctactcaccaggtccacttctgagctttcagggagccacctcagatcactagcactgggccctcaatttttttgttgctgttaaga

SEQ ID NO: 330611 - DNA, 170 bp, Homo sapiens
aatttaacttgaatggctaagattcgtgctttgggaaagttttttgttgtttaatctgttggttttcattgaaaaactgctgctagaaacaatgtgaattttggaatccaactcgcttggtttagaatactgggtctcgacttctcactgctctatgactttgagcaaat

SEQ ID NO: 330612 - DNA, 1591 bp, Homo sapiens
tgcgggtacggacagcgcatgagcttatgttgagggcggagcccagaccagcccttcgtcctatcctgcccttccagcacctctcagccgtaacttaaactacacttcccagaagcctcctcagccagggacttccgttgtcgtcagcggaagcggtgacagatcatcccaggccacacagaggccggcttggtcactatggaggagataggcatcttggtggagaaggctcaggatgagatcccagcactgtccgtgtcccggccccagaccggcctgtccttcctgggccctgagcctgaggacctggaggacctgtacagccgctacaagaagctgcagcaagagctggagttcctggaggtgcaggaggaatacatcaaagatgagcaaaagaacctgaaaaaggaatttctccatgcccaggaggaggtgaagcgaatccaaagcatcccgctggtcatcggacaatttctggaggctgtggatcagaatacagccatcgtgggctctaccacaggctccaactattatgtgcgcatcctgagcaccatcgatcgggagctgctcaagcccaacgcctcagtggccctccacaagcacagcaatgcactggtggacgtgctgccccccgaagccgacagcagcatcatgatgctcacctcagaccagaagccagatgtgatgtacgcggacatcggaggcatggacatccagaagcaggaggtgcgggaggccgtggagctcccgctcacgcatttcgagctctacaagcagatcggcatcgatcccccccgaggcgtcctcatgtatggcccacctggctgtgggaagaccatgttggcaaaggcggtggcacatcacacaacagctgcattcatccgggtcgtgggctcggagtttgtacagaagtatctgggtgagggcccccgcatggtccgggatgtgttccgcctggccaaggagaatgcacctgccatcatcttcatagacgagattgatgccatcgccaccaagagattcgatgctcagacaggggccgacagggaggttcagaggatcctgctggagctgctgaatcagatggatggatttgatcagaatgtcaatgtcaaggtaatcatggccacaaacagagcagacaccctggatccggccctgctacggccaggacggctggaccgtaaaattgaatttccacttcctgaccgccgccagaagagattgattttctccactatcactagcaagatgaacctctctgaggaggttgacttggaagactatgtggcccggccagataagatttcaggagctgatattaactccatctgtcaggagagtggaatgttggctgtccgtgaaaaccgctacattgtcctggccaaggacttcgagaaagcatacaagactgtcatcaagaaggacgagcaggagcatgagttttacaagtgacccttcccttccctccaccacaccactcaggggctggggcttctctcgcacccccagcacctctgtcccaaaacctcattcccttttttctttacccaggattggtttcttcaataaatagataagatcgaatcca

SEQ ID NO: 330613 - DNA, 178 bp, Homo sapiens
agggtggggacgcagcaccttggtcgccatcacccccatctgggccaccctgacccccgtctcaccactcaggggctggggcttctctcgcacccccagcacctctgtcccaaaacctcattcccttttttctttacccaggattggtttcttcaataaatagataagatcgaatcca

SEQ ID NO: 330614 - DNA, 1454 bp, Homo sapiens
  misc_feature (26)..(26): n is a, c, g, or t
aatgtcgctaggtacgaggctggtgntaatcggccgaggcacagaggccggcttggtcactatggaggagataggcatcttggtggagaaggctcaggatgagatcccagcactgtccgtgtcccggccccagaccggcctgtccttcctgggccctgagcctgaggacctggaggacctgtacagccgctacaagaagctgcagcaagagctggagttcctggaggtgcaggaggaatacatcaaagatgagcaaaagaacctgaaaaaggaatttctccatgcccaggaggaggtgaagcgaatccaaagcatcccgctggtcatcggacaatttctggaggctgtggatcagaatacagccatcgtgggctctaccacaggctccaactattatgtgcgcatcctgagcaccatcgatcgggagctgctcaagcccaacgcctcagtggccctccacaagcacagcaatgcactggtggacgtgctgccccccgaagccgacagcagcatcatgatgctcacctcagaccagaagccagatgtgatgtacgcggacatcggaggcatggacatccagaagcaggaggtgcgggaggccgtggagctcccgctcacgcatttcgagctctacaagcagatcggcatcgatcccccccgaggcgtcctcatgtatggcccacctggctgtgggaagaccatgttggcaaaggcggtggcacatcacacaacagctgcattcatccgggtcgtgggctcggagtttgtacagaagtatctgggtgagggcccccgcatggtccgggatgtgttccgcctggccaaggagaatgcacctgccatcatcttcatagacgagattgatgccatcgccaccaagagattcgatgctcagacaggggccgacagggaggttcagaggatcctgctggagctgctgaatcagatggatggatttgatcagaatgtcaatgtcaaggtaatcatggccacaaacagagcagacaccctggatccggccctgctacggccaggacggctggaccgtaaaattgaatttccacttcctgaccgccgccagaagagattgattttctccactatcactagcaagatgaacctctctgaggaggttgacttggaagactatgtggcccggccagataagatttcaggagctgatattaactccatctgtcaggagagtggaatgttggctgtccgtgaaaaccgctacattgtcctggccaaggacttcgagaaagcatacaagactgtcatcaagaaggacgagcaggagcatgagttttacaagtgacccttcccttccctccaccacaccactcaggggctggggcttctctcgcacccccagcacctctgtcccaaaacctcattcccttttttctttacccaggattggtttcttcaataaatagataagatcgaatcca

SEQ ID NO: 330615 - DNA, 2280 bp, Homo sapiens
  misc_feature (1607)..(1608): n is a, c, g, or t
tgcgggtacggacagcgcatgagcttatgttgagggcggagcccagaccagcccttcgtcctatcctgcccttccagcacctctcagccgtaacttaaactacacttcccagaagcctcctcagccagggacttccgttgtcgtcagcggaagcggtgacagatcatcccaggccacacagaggccggcttggtcactatggaggagataggcatcttggtggagaaggctcaggatgagatcccagcactgtccgtgtcccggccccagaccggcctgtccttcctgggccctgagcctgaggacctggaggacctgtacagccgctacaagaagctgcagcaagagctggagttcctggaggtgcaggaggaatacatcaaagatgagcaaaagaacctgaaaaaggaatttctccatgcccaggaggaggtgaagcgaatccaaagcatcccgctggtcatcggacaatttctggaggctgtggatcagaatacagccatcgtgggctctaccacaggctccaactattatgtgcgcatcctgagcaccatcgatcgggagctgctcaagcccaacgcctcagtggccctccacaagcacagcaatgcactggtggacgtgctgccccccgaagccgacagcagcatcatgatgctcacctcagaccagaagccagatgtgatgtacgcggacatcggaggcatggacatccagaagcaggaggtgcgggaggccgtggagctcccgctcacgcatttcgagctctacaagcagatcggcatcgatcccccccgaggcgtcctcatgtatggcccacctggctgtgggaagaccatgttggcaaaggcggtggcacatcacacaacagctgcattcatccgggtcgtgggctcggagtttgtacagaagtatctgggtgagggcccccgcatggtccgggatgtgttccgcctggccaaggagaatgcacctgccatcatcttcatagacgagattgatgccatcgccaccaagagattcgatgctcagacaggggccgacagggaggttcagaggatcctgctggagctgctgaatcagatggatggatttgatcagaatgtcaatgtcaaggtaatcatggccacaaacagagcagacaccctggatccggccctgctacggccaggacggctggaccgtaaaattgaatttccacttcctgaccgccgccagaagagattgattttctccactatcactagcaagatgaacctctctgaggaggttgacttggaagactatgtggcccggccagataagatttcaggagctgatattaactccatctgtcaggagagtggaatgttggctgtccgtgaaaaccgctacattgtcctggccaaggacttcgagaaagcatacaagactgtcatcaagaaggacgagcaggagcatgagttttacaagtgacccttcccttccctccaccacaccactcaggggctggggcttctctcgcacccccagcacctctgtcccaaaacctcattcccttttttctttacccaggattggtttcttcaataaatagataagatcgaatccaaaaaaaaaaaaaaaannaaaaaaaaaaaaaaaaaaaaaaaaaaaaaaaaaaaaaaaaaaaaaaaaaaaaaaaaaaaaaaaaaaaaaaaaaaaaaaaaaaaggagggggggcgcggcgcgaaacatatctctctctcccggggggcgcaccaacagcgccccccacattttgaggagaaacaaagggggcggccagccacagaagggcgggcgaagaataacaaaaacacacgccgagcgaggcggcgcgcgacggccgacaaacacaaagagagcgaggagggagagaaaacaagcggcgcacacgaggagaaaacacagcggcggagagcgaaccaccatcaccgagggggcggagggagcgaaaccacaacgcggagggaccaacaccacaccccacgccaaggagattaccaaacagcacgcacccaccgcgacgagcaacacaaaaaaaaacacaccccagagacaggacgataaacacaggcgcccgcagcacccacaaacacagcgacgcagataataccagagacggcggaacacggagacccagaaaggtcaaggcgaccacacggagaagaaacaaacaaaaacagtagcacgaaacacatccatttacccaccagcgaggcgccgaccgcaaccaaccacaaaaaccacgccgcgacaccaacaacgacgccacacccc

SEQ ID NO: 330616 - DNA, 1424 bp, Homo sapiens
  misc_feature (11)..(12): n is a, c, g, or t
  misc_feature (22)..(22): n is a, c, g, or t
catacgctagnncgagcctggntgaaatcggccgagggagataggcatcttggtggagaaggctcaggatgagatcccagcactgtccgtgtcccggccccagaccggcctgtccttcctgggccctgagcctgaggacctggaggacctgtacagccgctacaagaagctgcagcaagagctggagttcctggaggtgcaggaggaatacatcaaagatgagcaaaagaacctgaaaaaggaatttctccatgcccaggaggaggtgaagcgaatccaaagcatcccgctggtcatcggacaatttctggaggctgtggatcagaatacagccatcgtgggctctaccacaggctccaactattatgtgcgcatcctgagcaccatcgatcgggagctgctcaagcccaacgcctcagtggccctccacaagcacagcaatgcactggtggacgtgctgccccccgaagccgacagcagcatcatgatgctcacctcagaccagaagccagatgtgatgtacgcggacatcggaggcatggacatccagaagcaggaggtgcgggaggccgtggagctcccgctcacgcatttcgagctctacaagcagatcggcatcgatcccccccgaggcgtcctcatgtatggcccacctggctgtgggaagaccatgttggcaaaggcggtggcacatcacacaacagctgcattcatccgggtcgtgggctcggagtttgtacagaagtatctgggtgagggcccccgcatggtccgggatgtgttccgcctggccaaggagaatgcacctgccatcatcttcatagacgagattgatgccatcgccaccaagagattcgatgctcagacaggggccgacagggaggttcagaggatcctgctggagctgctgaatcagatggatggatttgatcagaatgtcaatgtcaaggtaatcatggccacaaacagagcagacaccctggatccggccctgctacggccaggacggctggaccgtaaaattgaatttccacttcctgaccgccgccagaagagattgattttctccactatcactagcaagatgaacctctctgaggaggttgacttggaagactatgtggcccggccagataagatttcaggagctgatattaactccatctgtcaggagagtggaatgttggctgtccgtgaaaaccgctacattgtcctggccaaggacttcgagaaagcatacaagactgtcatcaagaaggacgagcaggagcatgagttttacaagtgacccttcccttccctccaccacaccactcaggggctggggcttctctcgcacccccagcacctctgtcccaaaacctcattcccttttttctttacccaggattggtttcttcaataaatagataagatcgaatcca

SEQ ID NO: 330617 - DNA, 1592 bp, Homo sapiens
tgcgggtacggacagcgcatgagcttatgttgagggcggagcccagaccagcccttcgtcctatcctgcccttccagcacctctcagccgtaacttaaactacacttcccagaagcctcctcagccagggacttccgttgtcgtcagcggaagcggtgacagatcatcccaggccacacagaggccggcttggtcactatggaggagataggcatcttggtggagaaggctcaggatgagatcccagcactgtccgtgtcccggccccagaccggcctgtccttcctgggccctgagcctgaggacctggaggacctgtacagccgctacaagaagctgcagcaagagctggagttcctggaggtgcaggaggaatacatcaaagatgagcaaaagaacctgaaaaaggaatttctccatgcccaggaggaggtgaagcgaatccaaagcatcccgctggtcatcggacaatttctggaggctgtggatcagaatacagccatcgtgggctctaccacaggctccaactattatgtgcgcatcctgagcaccatcgatcgggagctgctcaagcccaacgcctcagtggccctccacaagcacagcaatgcactggtggacgtgctgccccccgaagccgacagcagcatcatgatgctcacctcagaccagaagccagatgtgatgtacgcggacatcggaggcatggacatccagaagcaggaggtgcgggaggccgtggagctcccgctcacgcatttcgagctctacaagcagatcggcatcgatcccccccgaggcgtcctcatgtatggcccacctggctgtgggaagaccatgttggcaaaggcggtggcacatcacacaacagctgcattcatccgggtcgtgggctcggagtttgtacagaagtatctgggtgagggcccccgcatggtccgggatgtgttccgcctggccaaggagaatgcacctgccatcatcttcatagacgagattgatgccatcgccaccaagagattcgatgctcagacaggggccgacagggaggttcagaggatcctgctggagctgctgaatcagatggatggatttgatcagaatgtcaatgtcaaggtaatcatggccacaaacagagcagacaccctggatccggccctgctacggccaggacggctggaccgtaaaattgaatttccacttcctgaccgccgccagaagagattgattttctccactatcactagcaagatgaacctctctgaggaggttgacttggaagactatgtggcccggccagataagatttcaggagctgatattaactccatctgtcaggagagtggaatgttggctgtccgtgaaaaccgctacattgtcctggccaaggacttcgagaaagcatacaagactgtcatcaagaaggacgagcaggagcatgagttttacaagtgacccttcccttccctccaccacaccactcaggggctggggcttctctcgcacccccagcacatcgtctaacactggtgccttttctttaacactctcaccttccggtggcttcaaaaaataagtaaacgtaactgcgt

SEQ ID NO: 330618 - DNA, 1731 bp, Homo sapiens
tgcgggtacggacagcgcatgagcttatgttgagggcggagcccagaccagcccttcgtcctatcctgcccttccagcacctctcagccgtaacttaaactacacttcccagaagcctcctcagccagggacttccgttgtcgtcagcggaagcggtgacagatcatcccaggccacacagaggccggcttggtcactatggaggagataggcatcttggtggagaaggctcaggatgagatcccagcactgtccgtgtcccggccccagaccggcctgtccttcctgggccctgagcctgaggacctggaggacctgtacagccgctacaagaagctgcagcaagagctggagttcctggaggtgcaggaggaatacatcaaagatgagcaaaagaacctgaaaaaggaatttctccatgcccaggaggaggtgaagcgaatccaaagcatcccgctggtcatcggacaatttctggaggctgtggatcagaatacagccatcgtgggctctaccacaggctccaactattatgtgcgcatcctgagcaccatcgatcgggagctgctcaagcccaacgcctcagtggccctccacaagcacagcaatgcactggtggacgtgctgccccccgaagccgacagcagcatcatgatgctcacctcagaccagaagccagatgtgatgtacgcggacatcggaggcatggacatccagaagcaggaggtgcgggaggccgtggagctcccgctcacgcatttcgagctctacaagcagatcggcatcgatcccccccgaggcgtcctcatgtatggcccacctggctgtgggaagaccatgttggcaaaggcggtggcacatcacacaacagctgcattcatccgggtcgtgggctcggagtttgtacagaagtatctgggtgagggcccccgcatggtccgggatgtgttccgcctggccaaggagaatgcacctgccatcatcttcatagacgagattgatgccatcgccaccaagagattcgatgctcagacaggggccgacagggaggttcagaggatcctgctggagctgctgaatcagatggatggatttgatcagaatgtcaatgtcaaggtttggggtttgggatggacaaggggaggtgtggtgtaggaactggggaaagttgggggctggcacctaaggggtggttatcgtgacaggaaggaggtaggagtgcagagatctgagctggcctgccccccaatgtcaaggtaatcatggccacaaacagagcagacaccctggatccggccctgctacggccaggacggctggaccgtaaaattgaatttccacttcctgaccgccgccagaagagattgattttctccactatcactagcaagatgaacctctctgaggaggttgacttggaagactatgtggcccggccagataagatttcaggagctgatattaactccatctgtcaggagagtggaatgttggctgtccgtgaaaaccgctacattgtcctggccaaggacttcgagaaagcatacaagactgtcatcaagaaggacgagcaggagcatgagttttacaagtgacccttcccttccctccaccacaccactcaggggctggggcttctctcgcacccccagcacctctgtcccaaaacctcattcccttttttctttacccaggattggtttcttcaataaatagataagatcgaatcca

SEQ ID NO: 330619 - DNA, 1798 bp, Homo sapiens
tgcgggtacggacagcgcatgagcttatgttgagggcggagcccagaccagcccttcgtcctatcctgcccttccagcacctctcagccgtaacttaaactacacttcccagaagcctcctcagccagggacttccgttgtcgtcagcggaagcggtgacagatcatcccaggccacacagaggccggcttggtcactatggaggagataggcatcttggtggagaaggctcaggatgagatcccagcactgtccgtgtcccggccccagaccggcctgtccttcctgggccctgagcctgaggacctggaggacctgtacagccgctacaagaagctgcagcaagagctggagttcctggaggtgcaggaggaatacatcaaagatgagcaaaagaacctgaaaaaggaatttctccatgcccaggaggaggtgaagcgaatccaaagcatcccgctggtcatcggacaatttctggaggctgtggatcagaatacagccatcgtgggctctaccacaggctccaactattatgtgcgcatcctgagcaccatcgatcgggagctgctcaagcccaacgcctcagtggccctccacaagcacagcaatgcactggtggacgtgctgccccccgaagccgacagcagcatcatgatgctcacctcagaccagaagccagatgtgatgtacgcggacatcggaggcatggacatccagaagcaggaggtgcgggaggccgtggagctcccgctcacgcatttcgagctctacaagcagatcggcatcgatcccccccgaggcgtcctcatgtatggcccacctggctgtgggaagaccatgttggcaaaggcggtggcacatcacacaacagctgcattcatccgggtcgtgggctcggagtttgtacagaagtatctgggtgagggcccccgcatggtccgggatgtgttccgcctggccaaggagaatgcacctgccatcatcttcatagacgagattgatgccatcgccaccaagagattcgatgctcagacaggggccgacagggaggttcagaggatcctgctggagctgctgaatcagatggatggatttgatcagaatgtcaatgtcaaggtaatcatggccacaaacagagcagacaccctggatccggccctgctacggccaggacggctggaccgtaaaattgaatttccacttcctgaccgccgccagaagagattgattttctccactatcactagcaagatgaacctctctgaggaggttgacttggaagactgtatcctgctccagaagtcagggaggggccctagttgggaacggggattagatcttcagctcaacttctgccagcaccacagcccagactgtgcaggtgggaccaaggtccagggaggaggggaggtgacagagatggccaaagatgacttccagccccaggcatttaccccatcacacagggaatagtttccttaactcgctgcagatgtggcccggccagataagatttcaggagctgatattaactccatctgtcaggagagtggaatgttggctgtccgtgaaaaccgctacattgtcctggccaaggacttcgagaaagcatacaagactgtcatcaagaaggacgagcaggagcatgagttttacaagtgacccttcccttccctccaccacaccactcaggggctggggcttctctcgcacccccagcacctctgtcccaaaacctcattcccttttttctttacccaggattggtttcttcaataaatagataagatcgaatcca

SEQ ID NO: 330620 - DNA, 1361 bp, Homo sapiens
  misc_feature (26)..(26): n is a, c, g, or t
aatgtcgctaggtacgaggctggtgntaatcggccgaggcacagaggccggcttggtcactatggaggagataggcatcttggtggagaaggctcaggatgagatcccagcactgtccgtgtcccggccccagaccggcctgtccttcctgggccctgagcctgaggacctggaggacctgtacagccgctacaaggaggaggtgaagcgaatccaaagcatcccgctggtcatcggacaatttctggaggctgtggatcagaatacagccatcgtgggctctaccacaggctccaactattatgtgcgcatcctgagcaccatcgatcgggagctgctcaagcccaacgcctcagtggccctccacaagcacagcaatgcactggtggacgtgctgccccccgaagccgacagcagcatcatgatgctcacctcagaccagaagccagatgtgatgtacgcggacatcggaggcatggacatccagaagcaggaggtgcgggaggccgtggagctcccgctcacgcatttcgagctctacaagcagatcggcatcgatcccccccgaggcgtcctcatgtatggcccacctggctgtgggaagaccatgttggcaaaggcggtggcacatcacacaacagctgcattcatccgggtcgtgggctcggagtttgtacagaagtatctgggtgagggcccccgcatggtccgggatgtgttccgcctggccaaggagaatgcacctgccatcatcttcatagacgagattgatgccatcgccaccaagagattcgatgctcagacaggggccgacagggaggttcagaggatcctgctggagctgctgaatcagatggatggatttgatcagaatgtcaatgtcaaggtaatcatggccacaaacagagcagacaccctggatccggccctgctacggccaggacggctggaccgtaaaattgaatttccacttcctgaccgccgccagaagagattgattttctccactatcactagcaagatgaacctctctgaggaggttgacttggaagactatgtggcccggccagataagatttcaggagctgatattaactccatctgtcaggagagtggaatgttggctgtccgtgaaaaccgctacattgtcctggccaaggacttcgagaaagcatacaagactgtcatcaagaaggacgagcaggagcatgagttttacaagtgacccttcccttccctccaccacaccactcaggggctggggcttctctcgcacccccagcacctctgtcccaaaacctcattcccttttttctttacccaggattggtttcttcaataaatagataagatcgaatcca

SEQ ID NO: 330621 - DNA, 1447 bp, Homo sapiens
tgcgggtacggacagcgcatgagcttatgttgagggcggagcccagaccagcccttcgtcctatcctgcccttccagcacctctcagccgtaacttaaactacacttcccagaagcctcctcagccagggacttccgttgtcgtcagcggaagcggtgacagatcatcccaggccacacagaggccggcttggtcactatggaggagataggcatcttggtggagaaggctcaggatgagatcccagcactgtccgtgtcccggccccagaccggcctgtccttcctgggccctgagcctgaggacctggaggacctgtacagccgctacaagaagctgcagcaagagctggagttcctggaggtgcaggaggaatacatcaaagatgagcaaaagatcctgagcaccatcgatcgggagctgctcaagcccaacgcctcagtggccctccacaagcacagcaatgcactggtggacgtgctgccccccgaagccgacagcagcatcatgatgctcacctcagaccagaagccagatgtgatgtacgcggacatcggaggcatggacatccagaagcaggaggtgcgggaggccgtggagctcccgctcacgcatttcgagctctacaagcagatcggcatcgatcccccccgaggcgtcctcatgtatggcccacctggctgtgggaagaccatgttggcaaaggcggtggcacatcacacaacagctgcattcatccgggtcgtgggctcggagtttgtacagaagtatctgggtgagggcccccgcatggtccgggatgtgttccgcctggccaaggagaatgcacctgccatcatcttcatagacgagattgatgccatcgccaccaagagattcgatgctcagacaggggccgacagggaggttcagaggatcctgctggagctgctgaatcagatggatggatttgatcagaatgtcaatgtcaaggtaatcatggccacaaacagagcagacaccctggatccggccctgctacggccaggacggctggaccgtaaaattgaatttccacttcctgaccgccgccagaagagattgattttctccactatcactagcaagatgaacctctctgaggaggttgacttggaagactatgtggcccggccagataagatttcaggagctgatattaactccatctgtcaggagagtggaatgttggctgtccgtgaaaaccgctacattgtcctggccaaggacttcgagaaagcatacaagactgtcatcaagaaggacgagcaggagcatgagttttacaagtgacccttcccttccctccaccacaccactcaggggctggggcttctctcgcacccccagcacctctgtcccaaaacctcattcccttttttctttacccaggattggtttcttcaataaatagataagatcgaatcca

SEQ ID NO: 330622 - DNA, 1674 bp, Homo sapiens
tgcgggtacggacagcgcatgagcttatgttgagggcggagcccagaccagcccttcgtcctatcctgcccttccagcacctctcagccgtaacttaaactacacttcccagaagcctcctcagccagggacttccgttgtcgtcagcggaagcggtgacagatcatcccaggccacacagaggccggcttggtcactatggaggagataggcatcttggtggagaaggctcaggatgagatcccagcactgtccgtgtcccggccccagaccggcctgtccttcctgggccctgagcctgaggacctggaggacctgtacagccgctacaagaagctgcagcaagagctggagttcctggaggtgcaggaggaatacatcaaagatgagcaaaagaacctgaaaaaggaatttctccatgcccaggaggaggtgaagcgaatccaaagcatcccgctggtcatcggacaatttctggaggctgtggatcagaatacagccatcgtgggctctaccacaggctccaactattatgtgcgcatcctgagcaccatcgatcgggagctgctcaagcccaacgcctcagtggccctccacaagcacagcaatgcactggtggacgtgctgccccccgaagccgacagcagcatcatgatgctcacctcaggtaaagggggagcctgcagctgggagggccccatggggaccttgaggacctggccaggagccccagctctgctctcccaccagaccagaagccagatgtgatgtacgcggacatcggaggcatggacatccagaagcaggaggtgcgggaggccgtggagctcccgctcacgcatttcgagctctacaagcagatcggcatcgatcccccccgaggcgtcctcatgtatggcccacctggctgtgggaagaccatgttggcaaaggcggtggcacatcacacaacagctgcattcatccgggtcgtgggctcggagtttgtacagaagtatctgggtgagggcccccgcatggtccgggatgtgttccgcctggccaaggagaatgcacctgccatcatcttcatagacgagattgatgccatcgccaccaagagattcgatgctcagacaggggccgacagggaggttcagaggatcctgctggagctgctgaatcagatggatggatttgatcagaatgtcaatgtcaaggtaatcatggccacaaacagagcagacaccctggatccggccctgctacggccaggacggctggaccgtaaaattgaatttccacttcctgaccgccgccagaagagattgattttctccactatcactagcaagatgaacctctctgaggaggttgacttggaagactatgtggcccggccagataagatttcaggagctgatattaactccatctgtcaggagagtggaatgttggctgtccgtgaaaaccgctacattgtcctggccaaggacttcgagaaagcatacaagactgtcatcaagaaggacgagcaggagcatgagttttacaagtgacccttcccttccctccaccacaccactcaggggctggggcttctctcgcacccccagcacctctgtcccaaaacctcattcccttttttctttacccaggattggtttcttcaataaatagataagatcgaatcca

SEQ ID NO: 330623 - DNA, 1369 bp, Homo sapiens
catttggttctcaggtttgttataattttttatttttatgggcttggtgagggaggtaggtgatggtttcgataataactagtatggggataaggggtgtaggtgtgccttgtggtaagaagtgggctagggcatttttaatcttagagcgaaagcctataatcactgcgcccgctcataaggggatggccatggctaggtttatagatagttgggtggttggtgtaaatgagtgaggcaggagtccgaggaggttagttgtggcaataaaaatgattaaggatactagtataagagatcaggttcgtcctttagtgttgtgtatggttatcatttgttttgaggttagttgattagtcattgtgggtggtgattagtcggttgttgatgagatatttggaggtggggatcaatagagggggaaatagaatgatcagtactgcggcgggtaggcctaggcacagaggccggcttggtcactatggaggagataggcatcttggtggagaaggctcaggatgagatcccagcactgtccgtgtcccggccccagaccggcctgtccttcctgggccctgagcctgaggacctggaggacctgtacagccgctacaagaagctgcagcaagagctggagttcctggaggtgcaggaggaatacatcaaagatgagcaaaagaacctgaaaaaggaatttctccatgcccaggaggaggtgaagcgaatccaaagcatcccgctggtcatcggacaatttctggaggctgtggatcagaatacagccatcgtgggctctaccacagtccgggatgtgttccgcctggccaaggagaatgcacctgccatcatcttcatagacgagattgatgccatcgccaccaagagattcgatgctcagacaggggccgacagggaggttcagaggatcctgctggagctgctgaatcagatggatggatttgatcagaatgtcaatgtcaaggtaatcatggccacaaacagagcagacaccctggatccggccctgctacggccaggacggctggaccgtaaaattgaatttccacttcctgaccgccgccagaagagattgattttctccactatcactagcaagatgaacctctctgaggaggttgacttggaagactatgtggcccggccagataagatttcaggagctgatattaactccatctgtcaggagagtgggactggtgggtgtccggtgaaaccgtacattgtcctgggcagacttcggaaagccatcagactggctcacgaaggcgcgcacggcctgatttcagtgaccttccctctcccaaacatcgggtgggttttcccccccctttccaaccttccctttttc

SEQ ID NO: 330624 - DNA, 683 bp, Homo sapiens
tgcgggtacggacagcgcatgagcttatgttgagggcggagcccagaccagcccttcgtcctatcctgcccttccagcacctctcagccgtaacttaaactacacttcccagaagcctcctcagccagggacttccgttgtcgtcagcggaagcggtgacagatcatcccaggccacacagaggccggcttggtcactatggaggagataggcatcttggtggagaaggctcaggatgagatcccagcactgtccgtgtcccggccccagaccggcctgtccttcctgggccctgagcctgaggacctggaggacctgtacagccgctacaagaagctgcagcaagagctggagttcctggaggtgcaggaggaatacatcaaagatgagcaaaagaacctgaaaaaggaatttctccatgcccaggaggaggtgaagcgaatccaaagcatcccgctggtcatcggacaatttctggaggctgtggatcagaatacagccatcgtgggctctaccacaggctccaactattatgtgcgcatcctgagcaccatcgatcgggagctgctcaagcccaacgcctcagtggccctcgcacccccagcacctctgtcccaaaacctcattcccttttttctttacccaggattggtttcttcaataaatagataagatcgaatcca

SEQ ID NO: 330625 - DNA, 886 bp, Homo sapiens
catttggttctcaggtttgttataattttttatttttatgggcttggtgagggaggtaggtgatggtttcgataataactagtatggggataaggggtgtaggtgtgccttgtggtaagaagtgggctagggcatttttaatcttagagcgaaagcctataatcactgcgcccgctcataaggggatggccatggctaggtttatagatagttgggtggttggtgtaaatgagtgaggcaggagtccgaggaggttagttgtggcaataaaaatgattaaggatactagtataagagatcaggttcgtcctttagtgttgtgtatggttatcatttgttttgaggttagttgattagtcattgtgggtggtgattagtcggttgttgatgagatatttggaggtggggatcaatagagggggaaatagaatgatcagtactgcggcgggtaggcctaggcacagaggccggcttggtcactatggaggagataggcatcttggtggagaaggctcaggatgagatcccagcactgtccgtgtcccggccccagaccggcctgtccttcctgggccctgagcctgaggacctggaggacctgtacagccgctacaagaagctgcagcaagagctggagttcctggaggtgcaggaggaatacatcaaagatgagcaaaagaacctgaaaaaggaatttctccatgcccaggaggaggtgaagcgaatccaaagcatcccgctggtcatcggacaatttctggaggctgtggatcagaatacagccatcgtgggctctaccacaggtgtgctaaggacacctcattcattcatctgtccacttaacaactatttcctaccatgtgctaggcagcagcaaacaaggcag

SEQ ID NO: 330626 - DNA, 649 bp, Homo sapiens
  misc_feature (16)..(16): n is a, c, g, or t
  misc_feature (24)..(24): n is a, c, g, or t
  misc_feature (94)..(94): n is a, c, g, or t
  misc_feature (117)..(117): n is a, c, g, or t
tggtgggcccccttgncgggtttnccccggccaagagatccctccttatcttaaagcggagttgttccttcccccccaagaaatcgtttctaanaaagggcccgcaggaggttaagngatcctcctggaccttttgaataagatggtggatttgatcaggatttcaatttcaaggtaatcatggccacaaacagagcagacaccctggatccggccctgctacggccaggacggctggaccgtaaaattgaatttccacttcctgaccgccgccagaagagattgattttctccactatcactagcaagatgaacctctctgaggaggttgacttggaagactatgtggcccggccagataagatttcaggagctgatattaactccatctgtcaggagagtggaatgttggctgtccgtgaaaaccgctacattgtcctggccaaggacttcgagaaagcatacaagactgtcatcaagaaggacgagcaggagcatgagttttacaagtgacccttcccttccctccaccacaccactcaggggctggggcttctctcgcacccccagcacctctgtcccaaaacctcattcccttttttctttacccaggattggtttcttcaataaatagataagatcgaatcca

SEQ ID NO: 330627 - DNA, 1874 bp, Homo sapiens
catttggttctcaggtttgttataattttttatttttatgggcttggtgagggaggtaggtgatggtttcgataataactagtatggggataaggggtgtaggtgtgccttgtggtaagaagtgggctagggcatttttaatcttagagcgaaagcctataatcactgcgcccgctcataaggggatggccatggctaggtttatagatagttgggtggttggtgtaaatgagtgaggcaggagtccgaggaggttagttgtggcaataaaaatgattaaggatactagtataagagatcaggttcgtcctttagtgttgtgtatggttatcatttgttttgaggttagttgattagtcattgtgggtggtgattagtcggttgttgatgagatatttggaggtggggatcaatagagggggaaatagaatgatcagtactgcggcgggtaggcctaggcacagaggccggcttggtcactatggaggagataggcatcttggtggagaaggctcaggatgagatcccagcactgtccgtgtcccggccccagaccggcctgtccttcctgggccctgagcctgaggacctggaggacctgtacagccgctacaagaagctgcagcaagagctggagttcctggaggtgcaggaggaatacatcaaagatgagcaaaagaacctgaaaaaggaatttctccatgcccaggaggaggtgaagcgaatccaaagcatcccgctggtcatcggacaatttctggaggctgtggatcagaatacagccatcgtgggctctaccacaggctccaactattatgtgcgcatcctgagcaccatcgatcgggagctgctcaagcccaacgcctcagtggccctccacaagcacagcaatgcactggtggacgtgctgccccccgaagccgacagcagcatcatgatgctcacctcagaccagaagccagatgtgatgtacgcggacatcggaggcatggacatccagaagcaggaggtgcgggaggccgtggagctcccgctcacgcatttcgagctctacaagcagatcggcatcgatcccccccgaggcgtcctcatgtatggcccacctggctgtgggaagaccatgttggcaaaggcggtggcacatcacacaacagctgcattcatccgggtcgtgggctcggagtttgtacagaagtatctgggtgagggcccccgcatggtccgggatgtgttccgcctggccaaggagaatgcacctgccatcatcttcatagacgagattgatgccatcgccaccaagagattcgatgctcagacaggggccgacagggaggttcagaggatcctgctggagctgctgaatcagatggatggatttgatcagaatgtcaatgtcaaggtaatcatggccacaaacagagcagacaccctggatccggccctgctacggccaggacggctggaccgtaaaattgaatttccacttcctgaccgccgccagaagagattgattttctccactatcactagcaagatgaacctctctgaggaggttgacttggaagactatgtggcccggccagataagatttcaggagctgatattaactccatctgtcaggagagtggaatgttggctgtccgtgaaaaccgctacattgtcctggccaaggacttcgagaaagcatacaagactgtcatcaagaaggacgagcaggagcatgagttttacaagtgacccttcccttccctccaccacaccactcaggggctggggcttctctcgcacccccagcacctctgtcccaaaacctcattcccttttttctttacccaggattggtttcttcaataaatagataagatcgaatcca

SEQ ID NO: 330628 - DNA, 2045 bp, Homo sapiens
  misc_feature (1598)..(1598): n is a, c, g, or t
  misc_feature (1601)..(1601): n is a, c, g, or t
tgcgggtacggacagcgcatgagcttatgttgagggcggagcccagaccagcccttcgtcctatcctgcccttccagcacctctcagccgtaacttaaactacacttcccagaagcctcctcagccagggacttccgttgtcgtcagcggaagcggtgacagatcatcccaggccacacagaggccggcttggtcactatggaggagataggcatcttggtggagaaggctcaggatgagatcccagcactgtccgtgtcccggccccagaccggcctgtccttcctgggccctgagcctgaggacctggaggacctgtacagccgctacaagaagctgcagcaagagctggagttcctggaggtgcaggaggaatacatcaaagatgagcaaaagaacctgaaaaaggaatttctccatgcccaggaggaggtgaagcgaatccaaagcatcccgctggtcatcggacaatttctggaggctgtggatcagaatacagccatcgtgggctctaccacaggctccaactattatgtgcgcatcctgagcaccatcgatcgggagctgctcaagcccaacgcctcagtggccctccacaagcacagcaatgcactggtggacgtgctgccccccgaagccgacagcagcatcatgatgctcacctcagaccagaagccagatgtgatgtacgcggacatcggaggcatggacatccagaagcaggaggtgcgggaggccgtggagctcccgctcacgcatttcgagctctacaagcagatcggcatcgatcccccccgaggcgtcctcatgtatggcccacctggctgtgggaagaccatgttggcaaaggcggtggcacatcacacaacagctgcattcatccgggtcgtgggctcggagtttgtacagaagtatctgggtgagggcccccgcatggtccgggatgtgttccgcctggccaaggagaatgcacctgccatcatcttcatagacgagattgatgccatcgccaccaagagattcgatgctcagacaggggccgacagggaggttcagaggatcctgctggagctgctgaatcagatggatggatttgatcagaatgtcaatgtcaaggtaatcatggccacaaacagagcagacaccctggatccggccctgctacggccaggacggctggaccgtaaaattgaatttccacttcctgaccgccgccagaagagattgattttctccactatcactagcaagatgaacctctctgaggaggttgacttggaagactatgtggcccggccagataagatttcaggagctgatattaactccatctgtcaggagagtggaatgttggctgtccgtgaaaaccgctacattgtcctggccaaggacttcgagaaagcatacaagactgtcatcaagaaggacgagcaggagcatgagttttacaagtgacccttcccttccctccaccacaccactcaggggctggggcttctctcgcacccccagcacctctgtcccaaaacctcattcccttttttctttacccaggattggtttcttcaataaatagataagatcgaatccaagaaaanganaaaaaaaagggagaaacaaacaaagggaaaaaaaacacctacaagaaacatgcgagagaccccaaaaggaaaacagggaagcacaaagcaaaaaaccgacaaactactgactatgcgcagtagggaaccacgcaacaaaagcacgacacggagaaaaccagtaaaggggactcaggcccgcacagactaccagtccctgtttgttttgaagggtagaaatagaataaggcttatcaccctcaaatgtgtgttgaggaagaagtaaagtgggagatagcggatgataatatggagagaaatatcagaatgcagataatgctaattgtagatgtaagatcaatgaaacagtagaaagaagagaaagttaggaacaagtgtataaatgataaaatgtgtgacaggaattattcagaatatatagaagaagtaagattggagaaacat

SEQ ID NO: 330629 - DNA, 2326 bp, Homo sapiens
tgcgggtacggacagcgcatgagcttatgttgagggcggagcccagaccagcccttcgtcctatcctgcccttccagcacctctcagccgtaacttaaactacacttcccagaagcctcctcagccagggacttccgttgtcgtcagcggaagcggtgacagatcatcccaggccacacagaggccggcttggtcactatggaggagataggcatcttggtggagaaggctcaggatgagatcccagcactgtccgtgtcccggccccagaccggcctgtccttcctgggccctgagcctgaggacctggaggacctgtacagccgctacaagaagctgcagcaagagctggagttcctggaggtgcaggaggaatacatcaaagatgagcaaaagaacctgaaaaaggaatttctccatgcccaggaggaggtgaagcgaatccaaagcatcccgctggtcatcggacaatttctggaggctgtggatcagaatacagccatcgtgggctctaccacaggctccaactattatgtgcgcatcctgagcaccatcgatcgggagctgctcaagcccaacgcctcagtggccctccacaagcacagcaatgcactggtggacgtgctgccccccgaagccgacagcagcatcatgatgctcacctcagaccagaagccagatgtgatgtacgcggacatcggaggcatggacatccagaagcaggaggtgcgggaggccgtggagctcccgctcacgcatttcgagctctacaagcagatcggcatcgatcccccccgaggcgtcctcatgtatggcccacctggctgtgggaagaccatgttggcaaaggcggtggcacatcacacaacagctgcattcatccgggtcgtgggctcggagtttgtacagaagtatctgggtgagggcccccgcatggtccgggatgtgttccgcctggccaaggagaatgcacctgccatcatcttcatagacgagattgatgccatcgccaccaagagattcgatgctcagacaggggccgacagggaggttcagaggatcctgctggagctgctgaatcagatggatggatttgatcagaatgtcaatgtcaaggtaatcatggccacaaacagagcagacaccctggatccggccctgctacggccaggacggctggaccgtaaaattgaatttccacttcctgaccgccgccagaagagattgattttctccactatcactagcaagatgaacctctctgaggaggttgacttggaagactatgtggcccggccagataagatttcaggagctgatattaactccatctgtcaggagagtggaatgttggctgtccgtgaaaaccgctacattgtcctggccaaggacttcgagaaagcatacaagactgtcatcaagaaggacgagcaggagcatgagttttacaagtgacccttcccttccctccaccacaccactcaggggctggggcttctctcgcacccccagcacctctgtcccaaaacctcattcccttttttctttacccaggattggtttcttcaataaatagataagatcgaatccaccatttaatttcttcttagaagtttaactcctttggagaatgtgggccttgaataggatcctctgggtccctcttaatctgacagatgagcagacgaggtgcatggcctgggttgcagcttgagagaaccaaaatattcaaaccagatgacttccaaaatgtggggaaagggatggaaaatgaacctgagatggagtccttaatcacgggataaagccctgtgcatctccctcatttcctacaggtaaaagacagtaaagaaattcaggtcacaggccttgggagttcataggaaggagatgtccagtgctgtccagtagaactttgcacaatgatggatatgttctgtgttctccagtatggtagctgctcgccacatgtggctaataagtacctgaaatatggctagcatgactgagaaactgaactttttttttttttttttttttttttttttttttttttttttttttttttttttttttttttttttttttaggggttttccccattttattttggcccccaagaaaaagggggggccccttttttttctttaaccaaaaaatttttaaaacctccccctttttccatttgggaaaaagtactttttgcccaaaacttgcatttgttggaaaattaccctgttcataaaccccggttttttttccaaaaatgggaaaagttttttttttttaagaaacccctctttttttcaaaaaccaattccccggg

SEQ ID NO: 330630 - DNA, 1753 bp, Homo sapiens
tgcgggtacggacagcgcatgagcttatgttgagggcggagcccagaccagcccttcgtcctatcctgcccttccagcacctctcagccgtaacttaaactacacttcccagaagcctcctcagccagggacttccgttgtcgtcagcggaagcggtgacagatcatcccaggccacacagaggccggcttggtcactatggaggagataggcatcttggtggagaaggctcaggatgagatcccagcactgtccgtgtcccggccccagaccggcctgtccttcctgggccctgagcctgaggacctggaggacctgtacagccgctacaagaagctgcagcaagagctggagttcctggaggtgcaggaggaatacatcaaagatgagcaaaagaacctgaaaaaggaatttctccatgcccaggaggaggtgaagcgaatccaaagcatcccgctggtcatcggacaatttctggaggctgtggatcagaatacagccatcgtgggctctaccacaggctccaactattatgtgcgcatcctgagcaccatcgatcgggagctgctcaagcccaacgcctcagtggccctccacaagcacagcaatgcactggtggacgtgctgccccccgaagccgacagcagcatcatgatgctcacctcagaccagaagccagatgtgatgtacgcggacatcggaggcatggacatccagaagcaggaggtgcgggaggccgtggagctcccgctcacgcatttcgagctctacaagcagatcggcatcgatcccccccgaggcgtcctcatgtatggcccacctggctgtgggaagaccatgttggcaaaggcggtggcacatcacacaacagctgcattcatccgggtcgtgggctcggagtttgtacagaagtatctgggtgagggcccccgcatggtccgggatgtgttccgcctggccaaggagaatgcacctgccatcatcttcatagacgagattgatgccatcgccaccaagagattcgatgctcagacaggggccgacagggaggttcagaggatcctgctggagctgctgaatcagatggatggatttgatcagaatgtcaatgtcaaggtaatcatggccacaaacagagcagacaccctggatccggccctgctacggccaggacggctggaccgtaaaattgaatttccacttcctgaccgccgccagaagagattgattttctccactatcactagcaagatgaacctctctgaggaggttgacttggaagactatgtggcccggccagataagatttcaggagctgatattaactccatctgtcaggagagtggaatgttggctgtccgtgaaaaccgctacattgtcctggccaaggacttcgagaaagcatacaagactgtcatcaagaaggacgagcaggagcatgagttttacaagtgacccttcccttccctccaccacaccactcaggggctggggcttctctcgcacccccagcacctctgtcccaaaacctcattcccttttttctttacccaggattggtttcttcaataaatagataagatcgaatccaaaaacagacgacacaacacaaagaaactcgggcatcattctcggggggcgcacacagttatggatggcaacaggcaaagatgtgtccgacgcacggtttcggtgacagaagtgaacatgacggcccaatacggcgtggaaacgagacccgtcgcgcaagcct

SEQ ID NO: 330631 - DNA, 1624 bp, Homo sapiens
tgcgggtacggacagcgcatgagcttatgttgagggcggagcccagaccagcccttcgtcctatcctgcccttccagcacctctcagccgtaacttaaactacacttcccagaagcctcctcagccagggacttccgttgtcgtcagcggaagcggtgacagatcatcccaggccacacagaggccggcttggtcactatggaggagataggcatcttggtggagaaggctcaggatgagatcccagcactgtccgtgtcccggccccagaccggcctgtccttcctgggccctgagcctgaggacctggaggacctgtacagccgctacaagaagctgcagcaagagctggagttcctggaggtgcaggaggaatacatcaaagatgagcaaaagaacctgaaaaaggaatttctccatgcccaggaggaggtgaagcgaatccaaagcatcccgctggtcatcggacaatttctggaggctgtggatcagaatacagccatcgtgggctctaccacaggctccaactattatgtgcgcatcctgagcaccatcgatcgggagctgctcaagcccaacgcctcagtggccctccacaagcacagcaatgcactggtggacgtgctgccccccgaagccgacagcagcatcatgatgctcacctcagaccagaagccagatgtgatgtacgcggacatcggaggcatggacatccagaagcaggaggtgcgggaggccgtggagctcccgctcacgcatttcgagctctacaagcagatcggcatcgatcccccccgaggcgtcctcatgtatggcccacctggctgtgggaagaccatgttggcaaaggcggtggcacatcacacaacagctgcattcatccgggtcgtgggctcggagtttgtacagaagtatctgggtgagggcccccgcatggtccgggatgtgttccgcctggccaaggagaatgcacctgccatcatcttcatagacgagattgatgccatcgccaccaagagattcgatgctcagacaggggccgacagggaggttcagaggatcctgctggagctgctgaatcagatggatggatttgatcagaatgtcaatgtcaaggtaatcatggccacaaacagagcagacaccctggatccggccctgctacggccaggacggctggaccgtaaaattgaatttccacttcctgaccgccgccagaagagattgattttctccactatcactagcaagatgaacctctctgaggaggttgacttggaagactatgtggcccggccagataagatttcaggagctgatattaactccatctgtcaggagagtggaatgttggctgtccgtgaaaaccgctacattgtcctggccaaggacttcgagaaagcatacaagactgtcatcaagaaggacgagcaggagcatgagttttacaagtgacccttcccttccctccaccacaccactcaggggctggggcttctctcgcacccccagcacctctgtcccaaaacctcattcccttttttctttacccaggaccatcatcgatagacggaaaaagtaaaaaaaaccggagggctcaattcgggcggaaaaagggacggaa

SEQ ID NO: 330632 - DNA, 1613 bp, Homo sapiens
  misc_feature (1585)..(1585): n is a, c, g, or t
tgcgggtacggacagcgcatgagcttatgttgagggcggagcccagaccagcccttcgtcctatcctgcccttccagcacctctcagccgtaacttaaactacacttcccagaagcctcctcagccagggacttccgttgtcgtcagcggaagcggtgacagatcatcccaggccacacagaggccggcttggtcactatggaggagataggcatcttggtggagaaggctcaggatgagatcccagcactgtccgtgtcccggccccagaccggcctgtccttcctgggccctgagcctgaggacctggaggacctgtacagccgctacaagaagctgcagcaagagctggagttcctggaggtgcaggaggaatacatcaaagatgagcaaaagaacctgaaaaaggaatttctccatgcccaggaggaggtgaagcgaatccaaagcatcccgctggtcatcggacaatttctggaggctgtggatcagaatacagccatcgtgggctctaccacaggctccaactattatgtgcgcatcctgagcaccatcgatcgggagctgctcaagcccaacgcctcagtggccctccacaagcacagcaatgcactggtggacgtgctgccccccgaagccgacagcagcatcatgatgctcacctcagaccagaagccagatgtgatgtacgcggacatcggaggcatggacatccagaagcaggaggtgcgggaggccgtggagctcccgctcacgcatttcgagctctacaagcagatcggcatcgatcccccccgaggcgtcctcatgtatggcccacctggctgtgggaagaccatgttggcaaaggcggtggcacatcacacaacagctgcattcatccgggtcgtgggctcggagtttgtacagaagtatctgggtgagggcccccgcatggtccgggatgtgttccgcctggccaaggagaatgcacctgccatcatcttcatagacgagattgatgccatcgccaccaagagattcgatgctcagacaggggccgacagggaggttcagaggatcctgctggagctgctgaatcagatggatggatttgatcagaatgtcaatgtcaaggtaatcatggccacaaacagagcagacaccctggatccggccctgctacggccaggacggctggaccgtaaaattgaatttccacttcctgaccgccgccagaagagattgattttctccactatcactagcaagatgaacctctctgaggaggttgacttggaagactatgtggcccggccagataagatttcaggagctgatattaactccatctgtcaggagagtggaatgttggctgtccgtgaaaaccgctacattgtcctggccaaggacttcgagaaagcatacaagactgtcatcaagaaggacgagcaggagcatgagttttacaagtgacccttcccttccctccaccacaccactcaggggctggggcttctctcgcacccccagcacctctgtcccaaaacctcattcccttttttctttacccaggacttttagcaataaccgcccttggtcttcntgtcaacatatattagttaaggtgacgc

SEQ ID NO: 330633 - DNA, 1128 bp, Homo sapiens
  misc_feature (1078)..(1078): n is a, c, g, or t
tgcgggtacggacagcgcatgagcttatgttgagggcggagcccagaccagcccttcgtcctatcctgcccttccagcacctctcagccgtaacttaaactacacttcccagaagcctcctcagccagggacttccgttgtcgtcagcggaagcggtgacagatcatcccaggccacacagaggccggcttggtcactatggaggagataggcatcttggtggagaaggctcaggatgagatcccagcactgtccgtgtcccggccccagaccggcctgtccttcctgggccctgagcctgaggacctggaggacctgtacagccgctacaagaagctgcagcaagagctggagttcctggaggtgcaggaggaatacatcaaagatgagcaaaagaacctgaaaaaggaatttctccatgcccaggaggaggtgaagcgaatccaaagcatcccgctggtcatcggacaatttctggaggctgtggatcagaatacagccatcgtgggctctaccacaggctccaactattatgtgcgcatcctgagcaccatcgatcgggagctgctcaagcccaacgcctcagtggccctccacaagcacagcaatgcactggtggacgtgctgccccccgaagccgacagcagcatcatgatgctcacctcagaccagaagccagatgtgatgtacgcggacatcggaggcatggacatccagaagcaggaggtgcgggaggccgtggagctcccgctcacgcatttcgagctctacaagcagatcggcatcgatcccccccgaggcgtcctcatgtatggcccacctggctgtgggaagaccatgttggcaaaggcggtggcacatcacacaacagctgcattcatccgggtcgtgggctcggagtttgtacagaagtatctgggtgagggcccccgcatggtccgggatgtgttccgcctggccaaggagaatgcacctgccatcatcttcatagacgagattgatgccatcgccaccaagagattcgatgctcagacaggggcgacggaggtccaaggaccgcggagtggaccatgggggnttgccagccgcggtactggcaaaaaaaccgattgcctggcgagggccata

SEQ ID NO: 330634 - DNA, 1530 bp, Homo sapiens
tgcgggtacggacagcgcatgagcttatgttgagggcggagcccagaccagcccttcgtcctatcctgcccttccagcacctctcagccgtaacttaaactacacttcccagaagcctcctcagccagggacttccgttgtcgtcagcggaagcggtgacagatcatcccaggccacacagaggccggcttggtcactatggaggagataggcatcttggtggagaaggctcaggatgagatcccagcactgtccgtgtcccggccccagaccggcctgtccttcctgggccctgagcctgaggacctggaggacctgtacagccgctacaagaagctgcagcaagagctggagttcctggaggtgcaggaggaatacatcaaagatgagcaaaagtggtcatcggacaatttctggaggctgtggatcagaatacagccatcgtgggctctaccacaggctccaactattatgtgcgcatcctgagcaccatcgatcgggagctgctcaagcccaacgcctcagtggccctccacaagcacagcaatgcactggtggacgtgctgccccccgaagccgacagcagcatcatgatgctcacctcagaccagaagccagatgtgatgtacgcggacatcggaggcatggacatccagaagcaggaggtgcgggaggccgtggagctcccgctcacgcatttcgagctctacaagcagatcggcatcgatcccccccgaggcgtcctcatgtatggcccacctggctgtgggaagaccatgttggcaaaggcggtggcacatcacacaacagctgcattcatccgggtcgtgggctcggagtttgtacagaagtatctgggtgagggcccccgcatggtccgggatgtgttccgcctggccaaggagaatgcacctgccatcatcttcatagacgagattgatgccatcgccaccaagagattcgatgctcagacaggggccgacagggaggttcagaggatcctgctggagctgctgaatcagatggatggatttgatcagaatgtcaatgtcaaggtaatcatggccacaaacagagcagacaccctggatccggccctgctacggccaggacggctggaccgtaaaattgaatttccacttcctgaccgccgccagaagagattgattttctccactatcactagcaagatgaacctctctgaggaggttgacttggaagactatgtggcccggccagataagatttcaggagctgatattaactccatctgtcaggagagtggaatgttggctgtccgtgaaaaccgctacattgtcctggccaaggacttcgagaaagcatacaagactgtcatcaagaaggacgagcaggagcatgagttttacaagtgacccttcccttccctccaccacaccactcaggggctggggcttctctcgcacccccagcacctctgtcccaaaacctcattcccttttttctttacccaggattggtttcttcaataaatagataagatcgaatcca

SEQ ID NO: 330635 - DNA, 1133 bp, Homo sapiens
aaggcagggagacggggtaaatcggacgaggcagaaccagccatttgtgggctctaccacaggctccaactattatgtgcgcatcctgagcaccatcgatcgggagctgctcaagcccaacgcctcagtggccctccacaagcacagcaatgcactggtggacgtgctgccccccgaagccgacagcagcatcatgatgctcacctcagaccagaagccagatgtgatgtacgcggacatcggaggcatggacatccagaagcaggaggtgcgggaggccgtggagctcccgctcacgcatttcgagctctacaagcagatcggcatcgatcccccccgaggcgtcctcatgtatggcccacctggctgtgggaagaccatgttggcaaaggcggtggcacatcacacaacagctgcattcatccgggtcgtgggctcggagtttgtacagaagtatctgggtgagggcccccgcatggtccgggatgtgttccgcctggccaaggagaatgcacctgccatcatcttcatagacgagattgatgccatcgccaccaagagattcgatgctcagacaggggccgacagggaggttcagaggatcctgctggagctgctgaatcagatggatggatttgatcagaatgtcaatgtcaaggtaatcatggccacaaacagagcagacaccctggatccggccctgctacggccaggacggctggaccgtaaaattgaatttccacttcctgaccgccgccagaagagattgattttctccactatcactagcaagatgaacctctctgaggaggttgacttggaagactatgtggcccggccagataagatttcaggagctgatattaactccatctgtcaggagagtggaatgttggctgtccgtgaaaaccgctacattgtcctggccaaggacttcgagaaagcatacaagactgtcatcaagaaggacgagcaggagcatgagttttacaagtgacccttcccttccctccaccacaccactcaggggctggggcttctctcgcacccccagcacctctgtcccaaaacctcattcccttttttctttacccaggattggtttcttcaataaatagataagatcgaatcca

SEQ ID NO: 330636 - DNA, 3330 bp, Homo sapiens
gcggccgctggaggcgttgccgccgcccgcccgaggagcccccggtggccgcccaggtcgcagcccaagtcgcggcgccggtcgctctcccgtccccgccgactccctccgatggcggcaccaagaggcccgggctgcgggcgctgaagaagatgggcctgacggaggacgaggacgtgcgcgccatgctgcggggctcccggctccgcaagatccgctcgcgcacgtggcacaaggagcggctgtaccggctgcaggaggacggcctgagcgtgtggttccagcggcgcatcccgcgtgcgccatcgcagcacatcttcttcgtgcagcacatcgaggcggtccgcgagggccaccagtccgagggcctgcggcgcttcgggggtgccttcgcgccagcgcgctgcctcaccatcgccttcaagggccgccgcaagaacctggacctggcggcgcccacggctgaggaagcgcagcgctgggtgcgcggtctgaccaagctccgcgcgcgcctggacgccatgagccagcgcgagcggctagaccactggatccactcctatctgcaccgggctgactccaaccaggacagcaagatgagcttcaaggagatcaagagcctgctgagaatggtcaacgtggacatgaacgacatgtacgcctacctcctcttcaaggagtgtgaccactccaacaacgaccgtctagagggggctgagatcgaggagttcctgcggcggctgctgaagcggccggagctggaggagatcttccatcagtactcgggcgaggaccgcgtgctgagtgcccctgagctgctggagttcctggaggaccagggcgaggagggcgccacactggcccgcgcccagcagctcattcagacctatgagctcaacgagacagccaagcagcatgagctgatgacactggatggcttcatgatgtacctgttgtcgccggagggggctgccttggacaacacccacacgtgtgtgttccaggacatgaaccagccccttgcccactacttcatctcttcctcccacaacacctatctgactgactcccagatcggggggcccagcagcaccgaggcctatgttagggcctttgcccagggatgccgctgcgtggagctggactgctgggaggggccaggaggggagcccgtcatctatcatggccataccctcacctccaagattctcttccgggacgtggtccaagccgtgcgcgaccatgccttcacgctgtccccttaccctgtcatcctatccctggagaaccactgcgggctggagcagcaggctgccatggcccgccacctctgcaccatcctgggggacatgctggtgacacaggcgctggactccccaaatcccgaggagctgccatccccagagcagctgaagggccgggtcctggtgaagggaaagaagttgcccgctgctcggagcgaggatggccgggctctgtcggatcgggaggaggaggaggaggatgacgaggaggaagaagaggaggtggaggctgcagcgcagaggcggctggccaagcagatctccccggagctgtcggccctggctgtgtactgccacgccacccgcctgcggaccctgcaccctgcccccaacgccccacaaccctgccaggtcagctccctcagcgagcgcaaagccaagaaactcattcgggaggcagggaacagctttgtcaggcacaatgcccgccagctgacccgcgtgtacccgctggggctgcggatgaactcagccaactacagtccccaggagatgtggaactcgggctgtcagctggtggccttgaacttccagacgccaggctacgagatggacctcaatgccgggcgcttcctagtcaatgggcagtgtggctacgtcctaaaacctgcctgcctgcggcaacctgactcgacctttgaccccgagtacccaggacctcccagaaccactctcagcatccaggtgctgactgcacagcagctgcccaagctgaatgccgagaagccacactccattgtggaccccctggtgcgcattgagatccatggggtgcccgcagactgtgcccggcaggagactgactacgtgctcaacaatggcttcaacccccgctgggggcagaccctgcagttccagctgcgggctccggagctggcactggtccggtttgtggtggaagattatgacgccacctcccccaatgactttgtgggccagtttacactgcctcttagcagcctaaagcaagggtaccgccacatacacctgctttccaaggacggggcctcactgtcaccagccacgctcttcatccaaatccgcatccagcgctcctgagggcccacctcactcgccttggggttctgcgagtgccagtccacatcccctgcagagccctctcctcctctggagtcaggtggtgggagtaccagccccccagcccacccacttggcccactcagcccattcaccaggcgctggtctcacctgggtgctgagggctgcctgggcccctcctgaagaacagaaaggtgttcatgtgacttcagtgagctccaaccctggggccctgagatggccccagctcctcttgtcctcagcccacccctcattgtgacttatgaggagcaagcctgttgctgccaggagacttggggagcaggacacttgtgggccctcagttcccctctgtcctcccgtgggccatcccagcctccttcccccagaggagcgcagtcactccacttggccccgaccccgagcttagcccctaagccctcctttaccccaggccttcctggactcctccctccagctccggaacctgagctccccttcccttctcaaagcaagaagggagcgctgaggcatgaagccctggggaaactggcagtaggttttggtttttattttttgagacagggtctcgctccgtcgcccaggctggagtgcaatgttgcaatcatggctcactgcagctttgaactcccaggctcaagcgatcctcccatctcagcctcctgagtagctgggactacaggcacaggccaccaaacctggctaatgtttaaattttatgtagagatggcggggggggcgggggtctccctatgttgcccaggctggtctcgagctcctgacctcaagtgatcctcctgccccagcattccaaagtgctgggattacaggtgtgagccactgcctggcctggccgtaggtttgtaactgtttcatagaagagccctggagaagacagtagaatgagcctatctagtttaaaaaataaagaagcacgttgatttca

SEQ ID NO: 330637 - DNA, 3281 bp, Homo sapiens
gcggccgctggaggcgttgccgccgcccgcccgaggagcccccggtggccgcccaggtcgcagcccaagtcgcggcgccggtcgctctcccgtccccgccgactccctccgatggcggcaccaagaggcccgggctgcgggcgctgaagaagatgggcctgacggaggacgaggacgtgcgcgccatgctgcggggctcccggctccgcaagatccgctcgcgcacgtggcacaaggagcggctgtaccggctgcaggaggacggcctgagcgtgtggttccagcggcgcatcccgcgtgcgccatcgcagcacatcttcttcgtgcagcacatcgaggcggtccgcgagggccaccagtccgagggcctgcggcgcttcgggggtgccttcgcgccagcgcgctgcctcaccatcgccttcaagggccgccgcaagaacctggacctggcggcgcccacggctgaggaagcgcagcgctgggtgcgcggtctgaccaagctccgcgcgcgcctggacgccatgagccagcgcgagcggctagaccactggatccactcctatctgcaccgggctgactccaaccaggacagcaagatgagcttcaaggagatcaagagcctgctgagaatggtcaacgtggacatgaacgacatgtacgcctacctcctcttcaaggagtgtgaccactccaacaacgaccgtctagagggggctgagatcgaggagttcctgcggcggctgctgaagcggccggagctggaggagatcttccatcagtactcgggcgaggaccgcgtgctgagtgcccctgagctgctggagttcctggaggaccagggcgaggagggcgccacactggcccgcgcccagcagctcattcagacctatgagctcaacgagacagccaagcagcatgagctgatgacactggatggcttcatgatgtacctgttgtcgccggagggggctgccttggacaacacccacacgtgtgtgttccaggacatgaaccagccccttgcccactacttcatctcttcctcccacaacacctatctgactgactcccagatcggggggcccagcagcaccgaggcctatgttagggcctttgcccagggatgccgctgcgtggagctggactgctgggaggggccaggaggggagcccgtcatctatcatggccataccctcacctccaagattctcttccgggacgtggtccaagccgtgcgcgaccatgccttcacgctgtccccttaccctgtcatcctatccctggagaaccactgcgggctggagcagcaggctgccatggcccgccacctctgcaccatcctgggggacatgctggtgacacaggcgctggactccccaaatcccgaggagctgccatccccagagcagctgaagggccgggtcctggtgaagggaaagaagttgcccgctgctcggagcgaggatggccgggctctgtcggatcgggaggaggaggaggaggatgacgaggaggaagaagaggaggtggaggctgcagcgcagaggcggctggccaagcagatctccccggagctgtcggccctggctgtgtactgccacgccacccgcctgcggaccctgcaccctgcccccaacgccccacaaccctgccagggaacagctttgtcaggcacaatgcccgccagctgacccgcgtgtacccgctggggctgcggatgaactcagccaactacagtccccaggagatgtggaactcgggctgtcagctggtggccttgaacttccagacgccaggctacgagatggacctcaatgccgggcgcttcctagtcaatgggcagtgtggctacgtcctaaaacctgcctgcctgcggcaacctgactcgacctttgaccccgagtacccaggacctcccagaaccactctcagcatccaggtgctgactgcacagcagctgcccaagctgaatgccgagaagccacactccattgtggaccccctggtgcgcattgagatccatggggtgcccgcagactgtgcccggcaggagactgactacgtgctcaacaatggcttcaacccccgctgggggcagaccctgcagttccagctgcgggctccggagctggcactggtccggtttgtggtggaagattatgacgccacctcccccaatgactttgtgggccagtttacactgcctcttagcagcctaaagcaagggtaccgccacatacacctgctttccaaggacggggcctcactgtcaccagccacgctcttcatccaaatccgcatccagcgctcctgagggcccacctcactcgccttggggttctgcgagtgccagtccacatcccctgcagagccctctcctcctctggagtcaggtggtgggagtaccagccccccagcccacccacttggcccactcagcccattcaccaggcgctggtctcacctgggtgctgagggctgcctgggcccctcctgaagaacagaaaggtgttcatgtgacttcagtgagctccaaccctggggccctgagatggccccagctcctcttgtcctcagcccacccctcattgtgacttatgaggagcaagcctgttgctgccaggagacttggggagcaggacacttgtgggccctcagttcccctctgtcctcccgtgggccatcccagcctccttcccccagaggagcgcagtcactccacttggccccgaccccgagcttagcccctaagccctcctttaccccaggccttcctggactcctccctccagctccggaacctgagctccccttcccttctcaaagcaagaagggagcgctgaggcatgaagccctggggaaactggcagtaggttttggtttttattttttgagacagggtctcgctccgtcgcccaggctggagtgcaatgttgcaatcatggctcactgcagctttgaactcccaggctcaagcgatcctcccatctcagcctcctgagtagctgggactacaggcacaggccaccaaacctggctaatgtttaaattttatgtagagatggcggggggggcgggggtctccctatgttgcccaggctggtctcgagctcctgacctcaagtgatcctcctgccccagcattccaaagtgctgggattacaggtgtgagccactgcctggcctggccgtaggtttgtaactgtttcatagaagagccctggagaagacagtagaatgagcctatctagtttaaaaaataaagaagcacgttgatttca

SEQ ID NO: 330638 - DNA, 3754 bp, Homo sapiens
gcggccgctggaggcgttgccgccgcccgcccgaggagcccccggtggccgcccaggtcgcagcccaagtcgcggcgccggtcgctctcccgtccccgccgactccctccgatggcggcaccaagaggcccgggctgcgggcgctgaagaagatgggcctgacggaggacgaggacgtgcgcgccatgctgcggggctcccggctccgcaagatccgctcgcgcacgtggcacaaggagcggctgtaccggctgcaggaggacggcctgagcgtgtggttccagcggcgcatcccgcgtgcgccatcgcagcacatcttcttcgtgcagcacatcgaggcggtccgcgagggccaccagtccgagggcctgcggcgcttcgggggtgccttcgcgccagcgcgctgcctcaccatcgccttcaagggccgccgcaagaacctggacctggcggcgcccacggctgaggaagcgcagcgctgggtgcgcggtctgaccaagctccgcgcgcgcctggacgccatgagccagcgcgagcggctagaccactggatccactcctatctgcaccgggctgactccaaccaggacagcaagatgagcttcaaggagatcaagagcctgctgagaatggtcaacgtggacatgaacgacatgtacgcctacctcctcttcaaggagtgtgaccactccaacaacgaccgtctagagggggctgagatcgaggagttcctgcggcggctgctgaagcggccggagctggaggagatcttccatcagtactcgggcgaggaccgcgtgctgagtgcccctgagctgctggagttcctggaggaccagggcgaggagggcgccacactggcccgcgcccagcagctcattcagacctatgagctcaacgagacagccaagcagcatgagctgatgacactggatggcttcatgatgtacctgttgtcgccggagggggctgccttggacaacacccacacgtgtgtgttccaggacatgaaccagccccttgcccactacttcatctcttcctcccacaacacctatctgactgactcccagatcggggggcccagcagcaccgaggcctatgttagggcctttgcccagggatgccgctgcgtggagctggactgctgggaggggccaggaggggagcccgtcatctatcatggccataccctcacctccaagattctcttccgggacgtggtccaagccgtgcgcgaccatgccttcacgctgtccccttaccctgtcatcctatccctggagaaccactgcgggctggagcagcaggctgccatggcccgccacctctgcaccatcctgggggacatgctggtgacacaggcgctggactccccaaatcccgaggagctgccatccccagagcagctgaagggccgggtcctggtgaagggaaagaagttgcccgctgctcggagcgaggatggccgggctctgtcggatcgggaggaggaggaggaggatgacgaggaggaagaagaggaggtggaggctgcagcgcagaggcggctggccaagcagatctccccggagctgtcggccctggctgtgtactgccacgccacccgcctgcggaccctgcaccctgcccccaacgccccacaaccctgccaggtcagctccctcagcgagcgcaaagccaagaaactcattcgggaggcagggaacagctttgtcaggcacaatgcccgccagctgacccgcgtgtacccgctggggctgcggatgaactcagccaactacagtccccaggagatgtggaactcgggctgtcagctggtggccttgaacttccagacgccaggctacgagatggacctcaatgccgggcgcttcctagtcaatgggcagtgtggctacgtcctaaaacctgcctgcctgcggcaacctgactcgacctttgaccccgagtacccaggacctcccagaaccactctcagcatccaggtgctgactgcacagcagctgcccaagctgaatgccgagaagccacactccattgtggaccccctggtgcgcattgagatccatggggtgcccgcagactgtgcccggcaggagactgactacgtgctcaacaatggcttcaacccccgctgggggcagaccctgcagttccagctgcgggctccggagctggcactggtccggtttgtggtggaagattatgacgccacctcccccaatgactttgtgggccagtttacactgcctcttagcagcctaaagcaagggtaccgccacatacacctgctttccaaggacggggcctcactgtcaccagccacgctcttcatccaaatccgcatccagcgctcctgagggcccacctcactcgccttggggttctgcgagtgccagtccacatcccctgcagagccctctcctcctctggagtcaggtggtgggagtaccagccccccagcccacccacttggcccactcagcccattcaccaggcgctggtctcacctgggtgctgagggctgcctgggcccctcctgaagaacagaaaggtgttcatgtgacttcagtgagctccaaccctggggccctgagatggccccagctcctcttgtcctcagcccacccctcattgtgacttatgaggagcaagcctgttgctgccaggagacttggggagcaggacacttgtgggccctcagttcccctctgtcctcccgtgggccatcccagcctccttcccccagaggagcgcagtcactccacttggccccgaccccgagcttagcccctaagccctcctttaccccaggccttcctggactcctccctccagctccggaacctgagctccccttcccttctcaaagcaagaagggagcgctgaggcatgaagccctggggaaactggcagtaggttttggtttttattttttgagacagggtctcgctccgtcgcccaggctggagtgcaatgttgcaatcatggctcactgcagctttgaactcccaggctcaagcgatcctcccatctcagcctcctgagtagctgggactacaggcacaggccaccaaacctggctaatgtttaaattttatgtagagatggcggggggggcgggggtctccctatgttgcccaggctggtctcgagctcctgacctcaagtgatcctcctgccccagcattccaaagtgctgggattacaggtgtgagccactgcctggcctggccgtaggtttgtaactgtttcatagaagagccctggagaagacagtagaatgagcctatctagtttaaaaaataaagaagcacgttgatttcaaacaaaaaaaaaaaaaactctcgagaatagttctctctctccccggaagagacctttgggcccggacattagcgggcgccccctctttcttcacccgggccacgtctccttgctggggagccccatccgcctggcccgggtggccctcgcgtggggtctcgggggaacgcaaagacttgtcatccctgtggcgaaaagccggagatgggccctaaacaccaagatcggcggccaggtccgagccggaaccgccgggtgacaggtgccaggccaagctcggggagcttggtgcacagccttgcggagcggagaagaaggaaagtcccctggcaaagaggccgcatcggacccaaactggtagatgtcaccacctcgggtgggtgaatacacagcaacaggggcgggcgaaatgtctcccggtagg

SEQ ID NO: 330639 - DNA, 3680 bp, Homo sapiens
gcggccgctggaggcgttgccgccgcccgcccgaggagcccccggtggccgcccaggtcgcagcccaagtcgcggcgccggtcgctctcccgtccccgccgactccctccgatggcggcaccaagaggcccgggctgcgggcgctgaagaagatgggcctgacggaggacgaggacgtgcgcgccatgctgcggggctcccggctccgcaagatccgctcgcgcacgtggcacaaggagcggctgtaccggctgcaggaggacggcctgagcgtgtggttccagcggcgcatcccgcgtgcgccatcgcagcacatcttcttcgtgcagcacatcgaggcggtccgcgagggccaccagtccgagggcctgcggcgcttcgggggtgccttcgcgccagcgcgctgcctcaccatcgccttcaagggccgccgcaagaacctggacctggcggcgcccacggctgaggaagcgcagcgctgggtgcgcggtctgaccaagctccgcgcgcgcctggacgccatgagccagcgcgagcggctagaccactggatccactcctatctgcaccgggctgactccaaccaggacagcaagatgagcttcaaggagatcaagagcctgctgagaatggtcaacgtggacatgaacgacatgtacgcctacctcctcttcaaggagtgtgaccactccaacaacgaccgtctagagggggctgagatcgaggagttcctgcggcggctgctgaagcggccggagctggaggagatcttccatcagtactcgggcgaggaccgcgtgctgagtgcccctgagctgctggagttcctggaggaccagggcgaggagggcgccacactggcccgcgcccagcagctcattcagacctatgagctcaacgagacagccaagcagcatgagctgatgacactggatggcttcatgatgtacctgttgtcgccggagggggctgccttggacaacacccacacgtgtgtgttccaggacatgaaccagccccttgcccactacttcatctcttcctcccacaacacctatctgactgactcccagatcggggggcccagcagcaccgaggcctatgttagggcctttgcccagggatgccgctgcgtggagctggactgctgggaggggccaggaggggagcccgtcatctatcatggccataccctcacctccaagattctcttccgggacgtggtccaagccgtgcgcgaccatgccttcacgctgtccccttaccctgtcatcctatccctggagaaccactgcgggctggagcagcaggctgccatggcccgccacctctgcaccatcctgggggacatgctggtgacacaggcgctggactccccaaatcccgaggagctgccatccccagagcagctgaagggccgggtcctggtgaagggaaagaagttgcccgctgctcggagcgaggatggccgggctctgtcggatcgggaggaggaggaggaggatgacgaggaggaagaagaggaggtggaggctgcagcgcagaggcggctggccaagcagatctccccggagctgtcggccctggctgtgtactgccacgccacccgcctgcggaccctgcaccctgcccccaacgccccacaaccctgccaggtcagctccctcagcgagcgcaaagccaagaaactcattcgggaggcagggaacagctttgtcaggcacaatgcccgccagctgacccgcgtgtacccgctggggctgcggatgaactcagccaactacagtccccaggagatgtggaactcgggctgtcagctggtggccttgaacttccagacgccaggctacgagatggacctcaatgccgggcgcttcctagtcaatgggcagtgtggctacgtcctaaaacctgcctgcctgcggcaacctgactcgacctttgaccccgagtacccaggacctcccagaaccactctcagcatccaggtgctgactgcacagcagctgcccaagctgaatgccgagaagccacactccattgtggaccccctggtgcgcattgagatccatggggtgcccgcagactgtgcccggcaggagactgactacgtgctcaacaatggcttcaacccccgctgggggcagaccctgcagttccagctgcgggctccggagctggcactggtccggtttgtggtggaagattatgacgccacctcccccaatgactttgtgggccagtttacactgcctcttagcagcctaaagcaagggtaccgccacatacacctgctttccaaggacggggcctcactgtcaccagccacgctcttcatccaaatccgcatccagcgctcctgagggcccacctcactcgccttggggttctgcgagtgccagtccacatcccctgcagagccctctcctcctctggagtcaggtggtgggagtaccagccccccagcccacccacttggcccactcagcccattcaccaggcgctggtctcacctgggtgctgagggctgcctgggcccctcctgaagaacagaaaggtgttcatgtgacttcagtgagctccaaccctggggccctgagatggccccagctcctcttgtcctcagcccacccctcattgtgacttatgaggagcaagcctgttgctgccaggagacttggggagcaggacacttgtgggccctcagttcccctctgtcctcccgtgggccatcccagcctccttcccccagaggagcgcagtcactccacttggccccgaccccgagcttagcccctaagccctcctttaccccaggccttcctggactcctccctccagctccggaacctgagctccccttcccttctcaaagcaagaagggagcgctgaggcatgaagccctggggaaactggcagtaggttttggtttttattttttgagacagggtctcgctccgtcgcccaggctggagtgcaatgttgcaatcatggctcactgcagctttgaactcccaggctcaagcgatcctcccatctcagcctcctgagtagctgggactacaggcacaggccaccaaacctggctaatgtttaaattttatgtagagatggcggggggggcgggggtctccctatgttgcccaggctggtctcgagctcctgacctcaagtgatcctcctgccccagcattccaaagtgctgggattacaggtgtgagccactgcctggcctggccgtaggtttgtaactgtttcatagaagagccctggagaagacagtagaatgagcctatctagtttaaaaaataaagaagcacgttgatttcaccaccgccactccctgagcacctctatgctgccacccccacaggcccatgaggagggacagggctggatgagtttcttgggcctctcccctcaacagggcatggacttggctaagacagccagggggtggcagcaggagatgccacagctctaaatagcccgatccctgctcctggcttaaagctgctgcgagtatcacaagactgtctgaggatgccaattcagcaggtcagcgcctccccacaacacacacacacacacacacacacacacactcacacatacacagaggggccttgaatgaggaggagacaggagtctgagggaccctcagactgccactctccagg

SEQ ID NO: 330640 - DNA, 3180 bp, Homo sapiens
gcggccgctggaggcgttgccgccgcccgcccgaggagcccccggtggccgcccaggtcgcagcccaagtcgcggcgccggtcgctctcccgtccccgccgactccctccgatggcggcaccaagaggcccgggctgcgggcgctgaagaagatgggcctgacggaggacgaggacgtgcgcgccatgctgcggggctcccggctccgcaagatccgctcgcgcacgtggcacaaggagcggctgtaccggctgcaggaggacggcctgagcgtgtggttccagcggcgcatcccgcgtgcgccatcgcagcacatcttcttcgtgcagcacatcgaggcggtccgcgagggccaccagtccgagggcctgcggcgcttcgggggtgccttcgcgccagcgcgctgcctcaccatcgccttcaagggccgccgcaagaacctggacctggcggcgcccacggctgaggaagcgcagcgctgggtgcgcggtctgaccaagctccgcgcgcgcctggacgccatgagccagcgcgagcggctagaccactggatccactcctatctgcaccgggctgactccaaccaggacagcaagatgagcttcaaggagatcaagagcctgctgagaatggtcaacgtggacatgaacgacatgtacgcctacctcctcttcaaggagtgtgaccactccaacaacgaccgtctagagggggctgagatcgaggagttcctgcggcggctgctgaagcggccggagctggaggagatcttccatcagtactcgggcgaggaccgcgtgctgagtgcccctgagctgctggagttcctggaggaccagggcgaggagggcgccacactggcccgcgcccagcagctcattcagacctatgagctcaacgagacagccaagcagcatgagctgatgacactggatggcttcatgatgtacctgttgtcgccggagggggctgccttggacaacacccacacgtgtgtgttccaggacatgaaccagccccttgcccactacttcatctcttcctcccacaacacctatctgactgactcccagatcggggggcccagcagcaccgaggcctatgttagggcctttgcccagggatgccgctgcgtggagctggactgctgggaggggccaggaggggagcccgtcatctatcatggccataccctcacctccaagattctcttccgggacgtggtccaagccgtgcgcgaccatgccttcacgctgtccccttaccctgtcatcctatccctggagaaccactgcgggctggagcagcaggctgccatggcccgccacctctgcaccatcctgggggacatgctggtgacacaggcgctggactccccaaatcccgaggagctgccatccccagagcagctgaagggccgggtcctggtgaagggaaagaagttgcccgctgctcggagcgaggatggccgggctctgtcggatcgggaggaggaggaggaggatgacgaggaggaagaagaggaggtggaggctgcagcgcagaggcggctggccaagcagatctccccggagctgtcggccctggctgtgtactgccacgccacccgcctgcggaccctgcaccctgcccccaacgccccacaaccctgccaggtcagctccctcagcgagcgcaaagccaagaaactcattcgggaggcagggaacagctttgtcaggcacaatgcccgccagctgacccgcgtgtacccgctggggctgcggatgaactcagccaactacagtccccaggagatgtggaactcgggctgtcagctggtggccttgaacttccagacgccaggctacgagatggacctcaatgccgggcgcttcctagtcaatgggcagtgtggctacgtcctaaaacctgcctgcctgcggcaacctgactcgacctttgaccccgagtacccaggacctcccagaaccactctcagcatccaggtgctgactgcacagcagctgcccaagctgaatgccgagaagccacactccattgtggaccccctggtgcgcattgagatccatggggtgcccgcagactgtgcccggcaggagactgactacgtgctcaacaatgggtaccgccacatacacctgctttccaaggacggggcctcactgtcaccagccacgctcttcatccaaatccgcatccagcgctcctgagggcccacctcactcgccttggggttctgcgagtgccagtccacatcccctgcagagccctctcctcctctggagtcaggtggtgggagtaccagccccccagcccacccacttggcccactcagcccattcaccaggcgctggtctcacctgggtgctgagggctgcctgggcccctcctgaagaacagaaaggtgttcatgtgacttcagtgagctccaaccctggggccctgagatggccccagctcctcttgtcctcagcccacccctcattgtgacttatgaggagcaagcctgttgctgccaggagacttggggagcaggacacttgtgggccctcagttcccctctgtcctcccgtgggccatcccagcctccttcccccagaggagcgcagtcactccacttggccccgaccccgagcttagcccctaagccctcctttaccccaggccttcctggactcctccctccagctccggaacctgagctccccttcccttctcaaagcaagaagggagcgctgaggcatgaagccctggggaaactggcagtaggttttggtttttattttttgagacagggtctcgctccgtcgcccaggctggagtgcaatgttgcaatcatggctcactgcagctttgaactcccaggctcaagcgatcctcccatctcagcctcctgagtagctgggactacaggcacaggccaccaaacctggctaatgtttaaattttatgtagagatggcggggggggcgggggtctccctatgttgcccaggctggtctcgagctcctgacctcaagtgatcctcctgccccagcattccaaagtgctgggattacaggtgtgagccactgcctggcctggccgtaggtttgtaactgtttcatagaagagccctggagaagacagtagaatgagcctatctagtttaaaaaataaagaagcacgttgatttca

SEQ ID NO: 330641 - DNA, 2988 bp, Homo sapiens
gcggccgctggaggcgttgccgccgcccgcccgaggagcccccggtggccgcccaggtcgcagcccaagtcgcggcgccggtcgctctcccgtccccgccgactccctccgatggcggcaccaagaggcccgggctgcgggcgctgaagaagatgggcctgacggaggacgaggacgtgcgcgccatgctgcggggctcccggctccgcaagatccgctcgcgcacgtggcacaaggagcggctgtaccggctgcaggaggacggcctgagcgtgtggttccagcggcgcatcccgcgtgcgccatcgcagcacatcttcttcgtgcagcacatcgaggcggtccgcgagggccaccagtccgagggcctgcggcgcttcgggggtgccttcgcgccagcgcgctgcctcaccatcgccttcaagggccgccgcaagaacctggacctggcggcgcccacggctgaggaagcgcagcgctgggtgcgcggtctgaccaagctccgcgcgcgcctggacgccatgagccagcgcgagcggctagaccactggatccactcctatctgcaccgggctgactccaaccaggacagcaagatgagcttcaaggagatcaagagcctgctgagaatggtcaacgtggacatgaacgacatgtacgcctacctcctcttcaaggagtgtgaccactccaacaacgaccgtctagagggggctgagatcgaggagttcctgcggcggctgctgaagcggccggagctggaggagatcttccatcagtactcgggcgaggaccgcgtgctgagtgcccctgagctgctggagttcctggaggaccagggcgaggagggcgccacactggcccgcgcccagcagctcattcagacctatgagctcaacgagacagccaagcagcatgagctgatgacactggatggcttcatgatgtacctgttgtcgccggagggggctgccttggacaacacccacacgtgtgtgttccaggacatgaaccagccccttgcccactacttcatctcttcctcccacaacacctatctgactgactcccagatcggggggcccagcagcaccgaggcctatgttagggcctttgcccagggatgccgctgcgtggagctggactgctgggaggggccaggaggggagcccgtcatctatcatggccataccctcacctccaagattctcttccgggacgtggtccaagccgtgcgcgaccatgccttcacgctgtccccttaccctgtcatcctatccctggagaaccactgcgggctggagcagcaggctgccatggcccgccacctctgcaccatcctgggggacatgctggtgacacaggcgctggactccccaaatcccgaggagctgccatccccagagcagctgaagggccgggtcctggtgaagggaaagaagttgcccgctgctcggagcgaggatggccgggctctgtcggatcgggaggaggaggaggaggatgacgaggaggaagaagaggaggtggaggctgcagcgcagaggcggctggccaagcagatctccccggagctgtcggccctggctgtgtactgccacgccacccgcctgcggaccctgcaccctgcccccaacgccccacaaccctgccaggtcagctccctcagcgagcgcaaagccaagaaactcattcgggaggcagggaacagctttgtcaggcacaatgcccgccagctgacccgcgtgtacccgctggggctgcggatgaactcagccaactacagtccccaggagatgtggaactcgggctgtcagctggtggccttgaacttccagacgccaggctacgagatggacctcaatgccgggcgcttcctagtcaatgggcagtgtggctacgtcctaaaacctgcctgcctgcggcaacctgactcgacctttgaccccgagtacccaggacctcccagaaccactctcagcatccaggtgctgactgcacagcagctgcccaagctgaatgccgagaagccacactccattgtggaccccctggtgcgcattgagatccatggggtgcccgcagactgtgcccggcaggagactgactacgtgctcaacaatggcttcaacccccgctgggggcagaccctgcagttccagctgcgggctccggagctggcactggtccggtttgtggtggaagattatgacgccacctcccccaatgactttgtgggccagtttacactgcctcttagcagcctaaagcaagggtaccgccacatacacctgctttccaaggacggggcctcactgtcaccagccacgctcttcatccaaatccgcatccagcgctccctcagttcccctctgtcctcccgtgggccatcccagcctccttcccccagaggagcgcagtcactccacttggccccgaccccgagcttagcccctaagccctcctttaccccaggccttcctggactcctccctccagctccggaacctgagctccccttcccttctcaaagcaagaagggagcgctgaggcatgaagccctggggaaactggcagtaggttttggtttttattttttgagacagggtctcgctccgtcgcccaggctggagtgcaatgttgcaatcatggctcactgcagctttgaactcccaggctcaagcgatcctcccatctcagcctcctgagtagctgggactacaggcacaggccaccaaacctggctaatgtttaaattttatgtagagatggcggggggggcgggggtctccctatgttgcccaggctggtctcgagctcctgacctcaagtgatcctcctgccccagcattccaaagtgctgggattacaggtgtgagccactgcctggcctggccgtaggtttgtaactgtttcatagaagagccctggagaagacagtagaatgagcctatctagtttaaaaaataaagaagcacgttgatttca

SEQ ID NO: 330642 - DNA, 1145 bp, Homo sapiens
gcggccgctggaggcgttgccgccgcccgcccgaggagcccccggtggccgcccaggtcgcagcccaagtcgcggcgccggtcgctctcccgtccccgccgactccctccgatggcggcaccaagaggcccgggctgcgggcgctgaagaagatgggcctgacggaggacgaggacgtgcgcgccatgctgcggggctcccggctccgcaagatccgctcgcgcacgtggcacaaggagcggctgtaccggctgcaggaggacggcctgagcgtgtggttccagcggcgcatcccgcgtgcgccatcgcagcacatcttcttcgtgcagcacatcgaggcggtccgcgagggccaccagtccgagggcctgcggcgcttcgggggtgccttcgcgccagcgcgctgcctcaccatcgccttcaagggccgccgcaagaacctggacctggcggcgcccacggctgaggaagcgcagcgctgggtgcgcggtctgaccaagctccgcgcgcgcctggacgccatgagccagcgcgagcggctagaccactggatccactcctatctgcaccgggctgactccaaccaggacagcaagatgagcttcaaggagatcaagagcctgctgagaatggtcaacgtggacatgaacgacatgtacgcctacctcctcttcaaggagtgtgaccactccaacaacgaccgtctagagggggctgagatcgaggagttcctgcggcggctgctgaagcggccggagctggaggagatcttccatcagtactcgggcgaggaccgcgtgctgagtgcccctgagctgctggagttcctggaggaccagggcgaggagggcgccacactggcccgcgcccagcagctcattcagacctatgagctcaacgagacagccaagcagcatgagctgatgacactggatggcttcatgatgtacctgttgtcgccggagggggctgccttggacaacacccacacgtgtgtgttccaggacatgaaccagccccttgcccactacttcatctcttcctcccacaacacctatctgactgactcccagatcggggggcccagcagcaccgaggcctatgttaggtactgtagcagggggtgaatgtttccgggagcccca

SEQ ID NO: 330643 - DNA, 132 bp, Homo sapiens
cctgcctttgcctgcctgtcctgaagggtctgggagccagatgttgggagatactggcagagggaggggagtggctctgagctgctgcccttccccccacagctgtccccttaccctgtcatcctatccctg

SEQ ID NO: 330644 - DNA, 3426 bp, Homo sapiens
gcggccgctggaggcgttgccgccgcccgcccgaggagcccccggtggccgcccaggtcgcagcccaagtcgcggcgccggtcgctctcccgtccccgccgactccctccgatggcggcaccaagaggcccgggctgcgggcgctgaagaagatgggcctgacggaggacgaggacgtgcgcgccatgctgcggggctcccggctccgcaagatccgctcgcgcacgtggcacaaggagcggctgtaccggctgcaggaggacggcctgagcgtgtggttccagcggcgcatcccgcgtgcgccatcgcagcacatcttcttcgtgcagcacatcgaggcggtccgcgagggccaccagtccgagggcctgcggcgcttcgggggtgccttcgcgccagcgcgctgcctcaccatcgccttcaagggccgccgcaagaacctggacctggcggcgcccacggctgaggaagcgcagcgctgggtgcgcggtctgaccaagctccgcgcgcgcctggacgccatgagccagcgcgagcggctagaccactggatccactcctatctgcaccgggctgactccaaccaggacagcaagatgagcttcaaggagatcaagagcctgctgagaatggtcaacgtggacatgaacgacatgtacgcctacctcctcttcaaggagtgtgaccactccaacaacgaccgtctagagggggctgagatcgaggagttcctgcggcggctgctgaagcggccggagctggaggagatcttccatcagtactcgggcgaggaccgcgtgctgagtgcccctgagctgctggagttcctggaggaccagggcgaggagggcgccacactggcccgcgcccagcagctcattcagacctatgagctcaacgagacagccaagcagcatgagctgatgacactggatggcttcatgatgtacctgttgtcgccggagggggctgccttggacaacacccacacgtgtgtgttccaggacatgaaccagccccttgcccactacttcatctcttcctcccacaacacctatctgactgactcccagatcggggggcccagcagcaccgaggcctatgttagggcctttgcccagggatgccgctgcgtggagctggactgctgggaggggccaggaggggagcccgtcatctatcatggccataccctcacctccaagattctcttccgggacgtggtccaagccgtgcgcgaccatgccttcacgctgtccccttaccctgtcatcctatccctggagaaccactgcgggctggagcagcaggctgccatggcccgccacctctgcaccatcctgggggacatgctggtgacacaggcgctggactccccaaatcccgaggagctgccatccccagagccagcccctcacaaggcggtggttgaataactgactgactggctgccacaggggcgagaaggcctaacccttcatcctccacgttggcccccacagcagctgaagggccgggtcctggtgaagggaaagaagttgcccgctgctcggagcgaggatggccgggctctgtcggatcgggaggaggaggaggaggatgacgaggaggaagaagaggaggtggaggctgcagcgcagaggcggctggccaagcagatctccccggagctgtcggccctggctgtgtactgccacgccacccgcctgcggaccctgcaccctgcccccaacgccccacaaccctgccaggtcagctccctcagcgagcgcaaagccaagaaactcattcgggaggcagggaacagctttgtcaggcacaatgcccgccagctgacccgcgtgtacccgctggggctgcggatgaactcagccaactacagtccccaggagatgtggaactcgggctgtcagctggtggccttgaacttccagacgccaggctacgagatggacctcaatgccgggcgcttcctagtcaatgggcagtgtggctacgtcctaaaacctgcctgcctgcggcaacctgactcgacctttgaccccgagtacccaggacctcccagaaccactctcagcatccaggtgctgactgcacagcagctgcccaagctgaatgccgagaagccacactccattgtggaccccctggtgcgcattgagatccatggggtgcccgcagactgtgcccggcaggagactgactacgtgctcaacaatggcttcaacccccgctgggggcagaccctgcagttccagctgcgggctccggagctggcactggtccggtttgtggtggaagattatgacgccacctcccccaatgactttgtgggccagtttacactgcctcttagcagcctaaagcaagggtaccgccacatacacctgctttccaaggacggggcctcactgtcaccagccacgctcttcatccaaatccgcatccagcgctcctgagggcccacctcactcgccttggggttctgcgagtgccagtccacatcccctgcagagccctctcctcctctggagtcaggtggtgggagtaccagccccccagcccacccacttggcccactcagcccattcaccaggcgctggtctcacctgggtgctgagggctgcctgggcccctcctgaagaacagaaaggtgttcatgtgacttcagtgagctccaaccctggggccctgagatggccccagctcctcttgtcctcagcccacccctcattgtgacttatgaggagcaagcctgttgctgccaggagacttggggagcaggacacttgtgggccctcagttcccctctgtcctcccgtgggccatcccagcctccttcccccagaggagcgcagtcactccacttggccccgaccccgagcttagcccctaagccctcctttaccccaggccttcctggactcctccctccagctccggaacctgagctccccttcccttctcaaagcaagaagggagcgctgaggcatgaagccctggggaaactggcagtaggttttggtttttattttttgagacagggtctcgctccgtcgcccaggctggagtgcaatgttgcaatcatggctcactgcagctttgaactcccaggctcaagcgatcctcccatctcagcctcctgagtagctgggactacaggcacaggccaccaaacctggctaatgtttaaattttatgtagagatggcggggggggcgggggtctccctatgttgcccaggctggtctcgagctcctgacctcaagtgatcctcctgccccagcattccaaagtgctgggattacaggtgtgagccactgcctggcctggccgtaggtttgtaactgtttcatagaagagccctggagaagacagtagaatgagcctatctagtttaaaaaataaagaagcacgttgatttca

SEQ ID NO: 330645 - DNA, 3232 bp, Homo sapiens
gcggccgctggaggcgttgccgccgcccgcccgaggagcccccggtggccgcccaggtcgcagcccaagtcgcggcgccggtcgctctcccgtccccgccgactccctccgatggcggcaccaagaggcccgggctgcgggcgctgaagaagatgggcctgacggaggacgaggacgtgcgcgccatgctgcggggctcccggctccgcaagatccgctcgcgcacgtggcacaaggagcggctgtaccggctgcaggaggacggcctgagcgtgtggttccagcggcgcatcccgcgtgcgccatcgcagcacatcttcttcgtgcagcacatcgaggcggtccgcgagggccaccagtccgagggcctgcggcgcttcgggggtgccttcgcgccagcgcgctgcctcaccatcgccttcaagggccgccgcaagaacctggacctggcggcgcccacggctgaggaagcgcagcgctgggtgcgcggtctgaccaagctccgcgcgcgcctggacgccatgagccagcgcgagcggctagaccactggatccactcctatctgcaccgggctgactccaaccaggacagcaagatgagcttcaaggagatcaagagcctgctgagaatggtcaacgtggacatgaacgacatgtacgcctacctcctcttcaaggagtgtgaccactccaacaacgaccgtctagagggggctgagatcgaggagttcctgcggcggctgctgaagcggccggagctggaggagatcttccatcagtactcgggcgaggaccgcgtgctgagtgcccctgagctgctggagttcctggaggaccagggcgaggagggcgccacactggcccgcgcccagcagctcattcagacctatgagctcaacgagacaggacatgaaccagccccttgcccactacttcatctcttcctcccacaacacctatctgactgactcccagatcggggggcccagcagcaccgaggcctatgttagggcctttgcccagggatgccgctgcgtggagctggactgctgggaggggccaggaggggagcccgtcatctatcatggccataccctcacctccaagattctcttccgggacgtggtccaagccgtgcgcgaccatgccttcacgctgtccccttaccctgtcatcctatccctggagaaccactgcgggctggagcagcaggctgccatggcccgccacctctgcaccatcctgggggacatgctggtgacacaggcgctggactccccaaatcccgaggagctgccatccccagagcagctgaagggccgggtcctggtgaagggaaagaagttgcccgctgctcggagcgaggatggccgggctctgtcggatcgggaggaggaggaggaggatgacgaggaggaagaagaggaggtggaggctgcagcgcagaggcggctggccaagcagatctccccggagctgtcggccctggctgtgtactgccacgccacccgcctgcggaccctgcaccctgcccccaacgccccacaaccctgccaggtcagctccctcagcgagcgcaaagccaagaaactcattcgggaggcagggaacagctttgtcaggcacaatgcccgccagctgacccgcgtgtacccgctggggctgcggatgaactcagccaactacagtccccaggagatgtggaactcgggctgtcagctggtggccttgaacttccagacgccaggctacgagatggacctcaatgccgggcgcttcctagtcaatgggcagtgtggctacgtcctaaaacctgcctgcctgcggcaacctgactcgacctttgaccccgagtacccaggacctcccagaaccactctcagcatccaggtgctgactgcacagcagctgcccaagctgaatgccgagaagccacactccattgtggaccccctggtgcgcattgagatccatggggtgcccgcagactgtgcccggcaggagactgactacgtgctcaacaatggcttcaacccccgctgggggcagaccctgcagttccagctgcgggctccggagctggcactggtccggtttgtggtggaagattatgacgccacctcccccaatgactttgtgggccagtttacactgcctcttagcagcctaaagcaagggtaccgccacatacacctgctttccaaggacggggcctcactgtcaccagccacgctcttcatccaaatccgcatccagcgctcctgagggcccacctcactcgccttggggttctgcgagtgccagtccacatcccctgcagagccctctcctcctctggagtcaggtggtgggagtaccagccccccagcccacccacttggcccactcagcccattcaccaggcgctggtctcacctgggtgctgagggctgcctgggcccctcctgaagaacagaaaggtgttcatgtgacttcagtgagctccaaccctggggccctgagatggccccagctcctcttgtcctcagcccacccctcattgtgacttatgaggagcaagcctgttgctgccaggagacttggggagcaggacacttgtgggccctcagttcccctctgtcctcccgtgggccatcccagcctccttcccccagaggagcgcagtcactccacttggccccgaccccgagcttagcccctaagccctcctttaccccaggccttcctggactcctccctccagctccggaacctgagctccccttcccttctcaaagcaagaagggagcgctgaggcatgaagccctggggaaactggcagtaggttttggtttttattttttgagacagggtctcgctccgtcgcccaggctggagtgcaatgttgcaatcatggctcactgcagctttgaactcccaggctcaagcgatcctcccatctcagcctcctgagtagctgggactacaggcacaggccaccaaacctggctaatgtttaaattttatgtagagatggcggggggggcgggggtctccctatgttgcccaggctggtctcgagctcctgacctcaagtgatcctcctgccccagcattccaaagtgctgggattacaggtgtgagccactgcctggcctggccgtaggtttgtaactgtttcatagaagagccctggagaagacagtagaatgagcctatctagtttaaaaaataaagaagcacgttgatttca

SEQ ID NO: 330646 - DNA, 1635 bp, Homo sapiens
tagcttagtagaaggcgcgtggttattggcgaggccgccagctgacccgcgtgtacccgctggggctgcggatgaactcagccaactacagtccccaggagatgtggaactcgggctgtcagctggtggccttgaacttccagacgccaggctacgagatggacctcaatgccgggcgcttcctagtcaatgggcagtgtggctacgtcctaaaacctgcctgcctgcggcaacctgactcgacctttgaccccgagtacccaggacctcccagaaccactctcagcatccaggtgctgactgcacagcagctgcccaagctgaatgccgagaagccacactccattgtggaccccctggtgcgcattgagatccatggggtgcccgcagactgtgcccggcaggagactgactacgtgctcaacaatggcttcaacccccgctgggggcagaccctgcagttccagctgcgggctccggagctggcactggtccggtttgtggtggaagattatgacgccacctcccccaatgactttgtgggccagtttacactgcctcttagcagcctaaagcaagggtaccgccacatacacctgctttccaaggacggggcctcactgtcaccagccacgctcttcatccaaatccgcatccagcgctcctgagggcccacctcactcgccttggggttctgcgagtgccagtccacatcccctgcagagccctctcctcctctggagtcaggtggtgggagtaccagccccccagcccacccacttggcccactcagcccattcaccaggcgctggtctcacctgggtgctgagggctgcctgggcccctcctgaagaacagaaaggtgttcatgtgacttcagtgagctccaaccctggggccctgagatggccccagctcctcttgtcctcagcccacccctcattgtgacttatgaggagcaagcctgttgctgccaggagacttggggagcaggacacttgtgggccctcagttcccctctgtcctcccgtgggccatcccagcctccttcccccagaggagcgcagtcactccacttggccccgaccccgagcttagcccctaagccctcctttaccccaggccttcctggactcctccctccagctccggaacctgagctccccttcccttctcaaagcaagaagggagcgctgaggcatgaagccctggggaaactggcagtaggttttggtttttattttttgagacagggtctcgctccgtcgcccaggctggagtgcaatgttgcaatcatggctcactgcagctttgaactcccaggctcaagcgatcctcccatctcagcctcctgagtagctgggactacaggcacaggccaccaaacctggctaatgtttaaattttatgtagagatggcggggggggcgggggtctccctatgttgcccaggctggtctcgagctcctgacctcaagtgatcctcctgccccagcattccaaagtgctgggattacaggtgtgagccactgcctggcctggccgtaggtttgtaactgtttcatagaagagccctggagaagacagtagaatgagcctatctagtttaaaaaataaagaagcacgttgatttca

SEQ ID NO: 330647 - DNA, 1158 bp, Homo sapiens
ttaggctaggtagaggcgggtggtgaatcggccgaggtgacgccacctcccccaatgactttgtgggccagtttacactgcctcttagcagcctaaagcaagggtaccgccacatacacctgctttccaaggacggggcctcactgtcaccagccacgctcttcatccaaatccgcatccagcgctcctgagggcccacctcactcgccttggggttctgcgagtgccagtccacatcccctgcagagccctctcctcctctggagtcaggtggtgggagtaccagccccccagcccacccacttggcccactcagcccattcaccaggcgctggtctcacctgggtgctgagggctgcctgggcccctcctgaagaacagaaaggtgttcatgtgacttcagtgagctccaaccctggggccctgagatggccccagctcctcttgtcctcagcccacccctcattgtgacttatgaggagcaagcctgttgctgccaggagacttggggagcaggacacttgtgggccctcagttcccctctgtcctcccgtgggccatcccagcctccttcccccagaggagcgcagtcactccacttggccccgaccccgagcttagcccctaagccctcctttaccccaggccttcctggactcctccctccagctccggaacctgagctccccttcccttctcaaagcaagaagggagcgctgaggcatgaagccctggggaaactggcagtaggttttggtttttattttttgagacagggtctcgctccgtcgcccaggctggagtgcaatgttgcaatcatggctcactgcagctttgaactcccaggctcaagcgatcctcccatctcagcctcctgagtagctgggactacaggcacaggccaccaaacctggctaatgtttaaattttatgtagagatggcggggggggcgggggtctccctatgttgcccaggctggtctcgagctcctgacctcaagtgatcctcctgccccagcattccaaagtgctgggattacaggtgtgagccactgcctggcctggccgtaggtttgtaactgtttcatagaagagccctggagaagacagtagaatgagcctatctagtttaaaaaataaagaagcacgttgatttca

SEQ ID NO: 330648 - DNA, 410 bp, Homo sapiens
ggaccccacttcaagtctaacgcttgcctgtggcccacagtgacggaaatactgagctttggaatgggcgagaccgaggccaaataatagatctttccacttatcattgtgtgaagttaggcaagatacctagcttctctcagcaccaatttcctcatctgtaaaatgaagaaacagcacccacttctcaatgttaccatcaggaataaatcagctaaaaaaaatagaaactgcttggctcagtgcctgacactgatcagttactacataaatgttagtttcctgcctttttgccaaaatgacattgaacagacagttctaatgatatttacagacacatacatctgtgttttcttttcagttctttacctgtattctactcttagacctaataaacttctttcatgttc

SEQ ID NO: 330649 - DNA, 530 bp, Homo sapiens
cttaacagagaggctttccctaaccaccttaaacaaaacagcaccctacaccccttctatgactctctctctctccttatcctgccttatttttctgcatagcacttatgactgacatatttttattaacttattagtttatcatctgtctttcctcacagaacgtaaacttcgtgagagtagggataaagatccaggcactcatatatgtattaaaaagaataagttttatgtatataggtgttatgttatatgcaataacataattgttagaatctttccaaatcagggaaatggaactcaaaattatcacatactaattgtgatggctaattttatatgtcaactttaataggccacgatactcaggtatctcatcaaatattattctagatgtttctgggaaggtattttttagaagagactaatatttaaattagtagactgagtacagcagatgaccctccacaatgggagtaggccccatcaaatcaggtgaatgaagaccttaacagaaaaagacagaagtg

SEQ ID NO: 330650 - DNA, 510 bp, Homo sapiens
cgcggctccagttcgtccctttccagttttacagtgaattgctcgatctgactacgcggctcgatctgactacgcggctcgatctgactacgcggctcgatctgactacgcggctcgatctgactacgcggctcgatctgactacgcggctcgatctgactacgcggctcatccctcacacatcatcaaaggattcatactgggagaaaccctaccattgtaacagatgtgggaagaccttttatgactgcacagacttcagtcaacatccaggaacttttattagggaaagagtttttgaatatcaccactgaagaaaatctgtggtgaaagggaacatcttaccatctggccattcacactgaagagaaacttcataagcatcctctctttgagaaaacgtgtaatagatgatcatttgtcgtctaaacaatcaagttagaaattgaaccagcctggagtcttattctccacctgagaattcacccatgagagagacccagtggttgc

SEQ ID NO: 330651 - DNA, 1485 bp, Homo sapiens
attacacagaaacaagtttcaacagaaggtgatctctatgaatgtgattcacatggaccagttacagatgccttgattcgcgaagagaaaaattcctataaatgtgaggaatgcgggaaagtgtttaaaaagaatgccctccttgttcagcatgaacggattcacactcaagtgaagccctatgaatgcacagagtgtgggaaaacctttagcaagagcactcatcttcttcagcacctcatcatccacactggggagaagccctataagtgcatggagtgtgggaaggcttttaaccgcaggtcacacctcacacggcaccagcggattcacagtggagagaagccttataagtgcagtgaatgtggaaaggccttcacccaccgctccacttttgtcttgcatcacaggagccacactggagaaaaaccctttgtgtgcaaagagtgtggcaaagcctttcgagataggccaggtttcattcgacactacatcatccacacgggagagaagccctatgagtgcattgagtgtgggaaggccttcaaccgccggtcatacctcacgtggcaccaacagattcacactggagtgaaaccctttgaatgcaacgagtgtggaaaagctttttgcgagagtgcagacctcattcaacactacattatccacactggggagaagccctataagtgcatggagtgtgggaaggcgttcaaccgtaggtcacacctcaagcagcatcaacggattcacactggggagaagccttatgaatgcagtgaatgtggaaaggccttcacccactgctccacttttgtcttgcataaaaggacccacacaggagaaaaaccctatgaatgcaaagaatgtggaaaagcctttagtgatagggcagacctcattcgccacttcagcatccacactggagagaaaccctatgagtgcgtggagtgtggaaaggccttcaaccgcagctcacacctcacgaggcaccaacagattcacactggagagaaaccctatgaatgcatccagtgtgggaaagccttttgccggagcgcaaaccttattcgacactccatcattcacactggagagaagccgtatgaatgcagtgagtgtggaaaggcttttaatcgcggctcatccctcacacatcatcaaaggattcatactgggagaaaccctaccattgtaacagatgtgggaagaccttttatgactgcacagacttcagtcaacatccaggaacttttattagggaaagagtttttgaatatcaccactgaagaaaatctgtggtgaaagggaacatcttaccatctggccattcacactgaagagaaacttcataagcatcctctctttgagaaaacgtgtaatagatgatcatttgtcgtctaaacaatcaagttagaaattgaaccagcctggagtcttattctccacctgagaattcacccatgagagagacccagtggttgc

SEQ ID NO: 330652 - DNA, 976 bp, Homo sapiens
cgctcgcctccctcgctccacgcgcgcccggactcggcggccaggcttgcgcgcggttcccctcccggtgggcggattcctgggcaagatgaagtgggtgtgggcgctcttgctgttggcggcgctgggcagcggccgcgcggagcgcgactgccgagtgagcagcttccgagtcaaggagaacttcgacaaggctcgcttctctgggacctggtacgccatggccaagaaggaccccgagggcctctttctgcaggacaacatcgtcgcggagttctccgtggacgagaccggccagatgagcgccacagccaagggccgagtccgtcttttgaataactgggacgtgtgcgcagacatggtgggcaccttcacagacaccgaggaccctgccaagttcaagatgaagtactggggcgtagcctcctttctccagaaaggaaatgatgaccactggatcgtcgacacagactacgacacgtatgccgtgcagtactcctgccgcctcctgaacctcgatggcacctgtgctgacagctactccttcgtgttttcccgggaccccaacggcctgcccccagaagcgcagaagattgtaaggcagcggcaggaggagctgtgcctggccaggcagtacaggctgatcgtccacaacggttactgcgatggcagatcagaaagaaaccttttgtagcaatatcaagaatctagtttcatctgagaacttctgattagctctcagtcttcagctctatttatcttaggagtttaatttgcccttctctccccatcttccctcagttcccataaaaccttcattacacataaagatacacgtgggggtcagtgaatctgcttgcctttcctgaaagtttctggggcttaagattccagactctgattcattaaactatagtcacccgtgaaaaaaaactcactttcgaacaatagagataaagaacgaagctcagtacac

SEQ ID NO: 330653 - DNA, 1290 bp, Homo sapiens
catcctttataaaatgaaaaactacttggatgaattattccaaaattcctgcacaagtggacctcagaaggcaggcggaggcgccaatttggcatggccagggcctgggcactcacgcaccagggagcctcgcgggtccgctctcgctctgtgaggccacggtcttcccgccaggttgactcgagcctcctgccagagccactggccccggaggccaccctagaccgcagctggcggccgctggcacgagtgcagggtaactgagccagggccgctggcgcatttggcctggccgaggccaccccgcgcggccgctccactgtgcccgaggctgtcctggaggtgaggccggcccacagggaccctgcccgtgcccgggctccgggcggattcctgggcaagatgaagtgggtgtgggcgctcttgctgttggcggcgctgggcagcggccgcgcggagcgcgactgccgagtgagcagcttccgagtcaaggagaacttcgacaaggctcgcttctctgggacctggtacgccatggccaagaaggaccccgagggcctctttctgcaggacaacatcgtcgcggagttctccgtggacgagaccggccagatgagcgccacagccaagggccgagtccgtcttttgaataactgggacgtgtgcgcagacatggtgggcaccttcacagacaccgaggaccctgccaagttcaagatgaagtactggggcgtagcctcctttctccagaaaggaaatgatgaccactggatcgtcgacacagactacgacacgtatgccgtgcagtactcctgccgcctcctgaacctcgatggcacctgtgctgacagctactccttcgtgttttcccgggaccccaacggcctgcccccagaagcgcagaagattgtaaggcagcggcaggaggagctgtgcctggccaggcagtacaggctgatcgtccacaacggttactgcgatggcagatcagaaagaaaccttttgtagcaatatcaagaatctagtttcatctgagaacttctgattagctctcagtcttcagctctatttatcttaggagtttaatttgcccttctctccccatcttccctcagttcccataaaaccttcattacacataaagatacacgtgggggtcagtgaatctgcttgcctttcctgaaagtttctggggcttaagattccagactctgattcattaaactatagtcacccgtgaaaaaaaactcactttcgaacaatagagataaagaacgaagctcagtacac

SEQ ID NO: 330654 - DNA, 906 bp, Homo sapiens
ttattcttttgcgttctctcatgccttctctttactgcttcttgttcactcatgctgggcagcggccgcgcggagcgcgactgccgagtgagcagcttccgagtcaaggagaacttcgacaaggctcgcttctctgggacctggtacgccatggccaagaaggaccccgagggcctctttctgcaggacaacatcgtcgcggagttctccgtggacgagaccggccagatgagcgccacagccaagggccgagtccgtcttttgaataactgggacgtgtgcgcagacatggtgggcaccttcacagacaccgaggaccctgccaagttcaagatgaagtactggggcgtagcctcctttctccagaaaggaaatgatgaccactggatcgtcgacacagactacgacacgtatgccgtgcagtactcctgccgcctcctgaacctcgatggcacctgtgctgacagctactccttcgtgttttcccgggaccccaacggcctgcccccagaagcgcagaagattgtaaggcagcggcaggaggagctgtgcctggccaggcagtacaggctgatcgtccacaacggttactgcgatggcagatcagaaagaaaccttttgtagcaatatcaagaatctagtttcatctgagaacttctgattagctctcagtcttcagctctatttatcttaggagtttaatttgcccttctctccccatcttccctcagttcccataaaaccttcattacacataaagatacacgtgggggtcagtgaatctgcttgcctttcctgaaagtttctggggcttaagattccagactctgattcattaaactatagtcacccgtgaaaaaaaactcactttcgaacaatagagataaagaacgaagctcagtacac

SEQ ID NO: 330655 - DNA, 911 bp, Homo sapiens
catcctttataaaatgaaaaactacttggatgaattattccaaaattcctgcacaagtggacctcagaaggcaggcggagcgcgactgccgagtgagcagcttccgagtcaaggagaacttcgacaaggctcgcttctctgggacctggtacgccatggccaagaaggaccccgagggcctctttctgcaggacaacatcgtcgcggagttctccgtggacgagaccggccagatgagcgccacagccaagggccgagtccgtcttttgaataactgggacgtgtgcgcagacatggtgggcaccttcacagacaccgaggaccctgccaagttcaagatgaagtactggggcgtagcctcctttctccagaaaggaaatgatgaccactggatcgtcgacacagactacgacacgtatgccgtgcagtactcctgccgcctcctgaacctcgatggcacctgtgctgacagctactccttcgtgttttcccgggaccccaacggcctgcccccagaagcgcagaagattgtaaggcagcggcaggaggagctgtgcctggccaggcagtacaggctgatcgtccacaacggttactgcgatggcagatcagaaagaaaccttttgtagcaatatcaagaatctagtttcatctgagaacttctgattagctctcagtcttcagctctatttatcttaggagtttaatttgcccttctctccccatcttccctcagttcccataaaaccttcattacacataaagatacacgtgggggtcagtgaatctgcttgcctttcctgaaagtttctggggcttaagattccagactctgattcattaaactatagtcacccgtgaaaaaaaactcactttcgaacaatagagataaagaacgaagctcagtacac

SEQ ID NO: 330656 - DNA, 912 bp, Homo sapiens
  misc_feature (35)..(35): n is a, c, g, or t
  misc_feature (40)..(40): n is a, c, g, or t
  misc_feature (64)..(64): n is a, c, g, or t
cccgggctgcaggattcggcacgagcccggactcngcggncagacttgcgcgcgggtcccctcncggggggcggattcctgggcaagatgaagtgggtgtgggcgctcttgctgttggcggcgctgggcagcggccgcgcggagcgcgactgccgagtgagcagcttccgagtcaaggagaacttcgacaaggctcgcttctctgggacctggtacgccatggccaagaaggaccccgagggcctctttctgcaggacaacatcgtcgcggataactgggacgtgtgcgcagacatggtgggcaccttcacagacaccgaggaccctgccaagttcaagatgaagtactggggcgtagcctcctttctccagaaaggaaatgatgaccactggatcgtcgacacagactacgacacgtatgccgtgcagtactcctgccgcctcctgaacctcgatggcacctgtgctgacagctactccttcgtgttttcccgggaccccaacggcctgcccccagaagcgcagaagattgtaaggcagcggcaggaggagctgtgcctggccaggcagtacaggctgatcgtccacaacggttactgcgatggcagatcagaaagaaaccttttgtagcaatatcaagaatctagtttcatctgagaacttctgattagctctcagtcttcagctctatttatcttaggagtttaatttgcccttctctccccatcttccctcagttcccataaaaccttcattacacataaagatacacgtgggggtcagtgaatctgcttgcctttcctgaaagtttctggggcttaagattccagactctgattcattaaactatagtcacccgtgaaaaaaaactcactttcgaacaatagagataaagaacgaagctcagtacac

SEQ ID NO: 330657 - DNA, 1245 bp, Homo sapiens
  misc_feature (885)..(885): n is a, c, g, or t
cgctcgcctccctcgctccacgcgcgcccggactcggcggccaggcttgcgcgcggttcccctcccggtgggcggattcctgggcaagatgaagtgggtgtgggcgctcttgctgttggcggcgctgggcagcggccgcgcggagcgcgactgccgagtgagcagcttccgagtcaaggagaacttcgacaaggctcgcttctctgggacctggtacgccatggccaagaaggaccccgagggcctctttctgcaggacaacatcgtcgcggagttctccgtggacgagaccggccagatgagcgccacagccaagggccgagtccgtcttttgaataactgggacgtgtgcgcagacatggtgggcaccttcacagacaccgaggaccctgccaagttcaagatgaagtactggggcgtagcctcctttctccagaaaggaaatgatgaccactggatcgtcgacacagactacgacacgtatgccgtgcagtactcctgccgcctcctgaacctcgatggcacctgtgctgacaagcgcagaagattgtaaggcagcggcaggaggagctgtgcctggccaggcagtacaggctgatcgtccacaacggttactgcgatggcagatcagaaagaaaccttttgtagcaatatcaagaatctagtttcatctgagaacttctgattagctctcagtcttcagctctatttatcttaggagtttaatttgcccttctctccccatcttccctcagttcccataaaaccttcattacacataaagatacacgtgggggtcagtgaatctgcttgcctttcctgaaagtttctggggcttaagattccagactctgattcattaaactatagtcacccgtgaaaaanaaaaaaggaaaaaaaaaaaaactcgagtttttttttttttttttttactttattaaaatactgagttttatttcacatgtatatttttgtctccccaccatttccatgtctgaccaccgctactactatgtcctatcataacattccatacatacttaaaaccaagcaaagggtggagttccatctttaaaaactaaacggcattttggacaacacattcttggcaatagaacctggacaacatttatcaaacacggtagggaaagttctcactctgcattataaaaaggacagccagatatcaactgttacagaaatgaaataagacggccagagatcttgaatagcctcttggtcagg

SEQ ID NO: 330658 - DNA, 1933 bp, Homo sapiens
  misc_feature (1573)..(1573): n is a, c, g, or t
caatgtagtaagctccaaagagaatgatttcaacgcaccttcttttttctatatgaaaccaaatagccatgacattgtctagctgggtttcctcagttgggggttttgagattctctggaacaaccataggatcttttaggagatattacccttgtctgatcttgattttaaagccaggaacattgtgcaggaaagagctccatttagtttgagtggacactcactcattgctatgggatactgggtttcaaaatccaaatacagtaatgctaaaatgtagagaaacaaaatgggccaggcatggtggctcacacctgaaatcccagcacttttggaggccgaggtgggctgatcacatgaggtcaggagttcaagattggcctggccaacatggcaaaaccccatctctactaaaaatacaaaaattagccaggcgtggtggcatgcgcctgtaatcccagctgctcacgaggttgaggcaggagaattacttgagcccgggaggcggaggctgcagtgagttgaggttgcaccactgcattccagcctgggcaacagagcaagattctgcctcaaaaaaataataataataataatcaaacaaaatggagcatttctgttggtcacgaactgacccactacaccaaacagatgggaacttagaccaaaatcaaattgattttgaagcttcacccttcaaaattaaatgtagggccagcaaggattccaccacagcagggcaccgtaggaagcagattatgcacattgtacagatgagaaaacagaggctgacaatgaggaagaaagttgccctaaatctttaataggtagctgagttggatgcaaacctagagttttgtgactctgaagtcccttgtgccacaccatctggtgacacatgacatgagacatagaagcactttataaaaccatcaccagtgtgtcccaggtcaggctgccttggctcccacttcctgaaagctgagggtggcccccgacactttgaaatgcaataaggcagacttaagagaaatcaaaggaagccctgttcatccagcaagtcatattctctccacccccattacgtccagagaaaattcagtgggtttcagaaacagccttgaaggtgtttatgaattacagccacctgtatccgtaagggttgcaatctgctgtgatgcatttgaattaagaagcatttgaatgaagccagctctaaggccatcatgatgttcattatctacataaaaactgggtccactttctgtcgttaatggctttgttttgtattttccaggttactgcgatggcagatcagaaagaaaccttttgtagcaatatcaagaatctagtttcatctgagaacttctgattagctctcagtcttcagctctatttatcttaggagtttaatttgcccttctctccccatcttccctcagttcccataaaaccttcattacacataaagatacacgtgggggtcagtgaatctgcttgcctttcctgaaagtttctggggcttaagattccagactctgattcattaaactatagtcacccgtgaaaaanaaaaaaggaaaaaaaaaaaaactcgagtttttttttttttttttttactttattaaaatactgagttttatttcacatgtatatttttgtctccccaccatttccatgtctgaccaccgctactactatgtcctatcataacattccatacatacttaaaaccaagcaaagggtggagttccatctttaaaaactaaacggcattttggacaacacattcttggcaatagaacctggacaacatttatcaaacacggtagggaaagttctcactctgcattataaaaaggacagccagatatcaactgttacagaaatgaaataagacggccagagatcttgaatagcctcttggtcagg

SEQ ID NO: 330659 - DNA, 1878 bp, Homo sapiens
  misc_feature (1518)..(1518): n is a, c, g, or t
caatgtagtaagctccaaagagaatgatttcaacgcaccttcttttttctatatgaaaccaaatagccatgacattgtctagctgggtttcctcagttgggggttttgagattctctggaacaaccataggatcttttaggagatattacccttgtctgatcttgattttaaagccaggaacattgtgcaggaaagagctccatttagtttgagtggacactcactcattgctatgggatactgggtttcaaaatccaaatacagtaatgctaaaatgtagagaaacaaaatgggccaggcatggtggctcacacctgaaatcccagcacttttggaggccgaggtgggctgatcacatgaggtcaggagttcaagattggcctggccaacatggcaaaaccccatctctactaaaaatacaaaaattagccaggcgtggtggcatgcgcctgtaatcccagctgctcacgaggttgaggcaggagaattacttgagcccgggaggcggaggctgcagtgagttgaggttgcaccactgcattccagcctgggcaacagagcaagattctgcctcaaaaaaataataataataataatcaaacaaaatggagcatttctgttggtcacgaactgacccactacaccaaacagatgggaacttagaccaaaatcaaattgattttgaagcttcacccttcaaaattaaatgtagggccagcaaggattccaccacagcagggcaccgtaggaagcagattatgcacattgtacagatgagaaaacagaggctgacaatgaggaagaaagttgccctaaatctttaataggtagctgagttggatgcaaacctagagttttgtgactctgaagtcccttgtgccacaccatctggtgacacatgacatgagacatagaagcactttatactgagggtggcccccgacactttgaaatgcaataaggcagacttaagagaaatcaaaggaagccctgttcatccagcaagtcatattctctccacccccattacgtccagagaaaattcagtgggtttcagaaacagccttgaaggtgtttatgaattacagccacctgtatccgtaagggttgcaatctgctgtgatgcatttgaattaagaagcatttgaatgaagccagctctaaggccatcatgatgttcattatctacataaaaactgggtccactttctgtcgttaatggctttgttttgtattttccaggttactgcgatggcagatcagaaagaaaccttttgtagcaatatcaagaatctagtttcatctgagaacttctgattagctctcagtcttcagctctatttatcttaggagtttaatttgcccttctctccccatcttccctcagttcccataaaaccttcattacacataaagatacacgtgggggtcagtgaatctgcttgcctttcctgaaagtttctggggcttaagattccagactctgattcattaaactatagtcacccgtgaaaaanaaaaaaggaaaaaaaaaaaaactcgagtttttttttttttttttttactttattaaaatactgagttttatttcacatgtatatttttgtctccccaccatttccatgtctgaccaccgctactactatgtcctatcataacattccatacatacttaaaaccaagcaaagggtggagttccatctttaaaaactaaacggcattttggacaacacattcttggcaatagaacctggacaacatttatcaaacacggtagggaaagttctcactctgcattataaaaaggacagccagatatcaactgttacagaaatgaaataagacggccagagatcttgaatagcctcttggtcagg

SEQ ID NO: 330660 - DNA, 1082 bp, Homo sapiens
cgctcgcctccctcgctccacgcgcgcccggactcggcggccaggcttgcgcgcggttcccctcccggtgggcggattcctgggcaagatgaagtgggtgtgggcgctcttgctgttggcggcgctgggcagcggccgcgcggagcgcgactgccgagtgagcagcttccgagtcaaggagaacttcgacaaggctcgcttctctgggacctggtacgccatggccaagaaggaccccgagggcctctttctgcaggacaacatcgtcgcggagttctccgtggacgagaccggccagatgagcgccacagccaagggccgagtccgtcttttgaataactgggacgtgtgcgcagacatggtgggcaccttcacagacaccgaggaccctgccaagttcaagatgaagtactggggcgtagcctcctttctccagaaaggaaatgatgaccactggatcgtcgacacagactacgacacgtatgccgtgcagtactcctgccgcctcctgaacctcgatggcacctgtgctgacagctactccttcgtgttttcccgggaccccaacggcctgcccccagaagcgcagaagattgtaaggcagcggcaggaggagctgtgcctggccaggcagtacaggctgatcgtccacaacggttactgcgatggcagatcagaaagaaaccttttgtagcaatatcaagaatctagtttcatctgagaacttctgattagctctcagtcttcagctctatttatcttaggagtttaatttgcccttctctccccatcttccctcagttcccataaaaccttcattacacataaagatacacgtgggggtcagtgaatctgcttgcctttcctgaaagtttctggggcttaagattccagactctgattcattaaactatagtcacccgtgtcctgtgattttagttttcatttgtgtttatgtctgtgctgcagacggatgggtggggtgcgcttctttataccaggagcacgtggctctttctgacctttggcctgttctagtgcctaatctccattattaaatactggcttctcccaactttctg

SEQ ID NO: 330661 - DNA, 1291 bp, Homo sapiens
  misc_feature (931)..(931): n is a, c, g, or t
cgctcgcctccctcgctccacgcgcgcccggactcggcggccaggcttgcgcgcggttcccctcccggtgggcggattcctgggcaagatgaagtgggtgtgggcgctcttgctgttggcggcgctgggcagcggccgcgcggagcgcgactgccgagtgagcagcttccgagtcaaggagaacttcgacaaggctcgcttctctgggacctggtacgccatggccaagaaggaccccgagggcctctttctgcaggacaacatcgtcgcggagttctccgtggacgagaccggccagatgagcgccacagccaagggccgagtccgtcttttgaataactgggacgtgtgcgcagacatggtgggcaccttcacagacaccgaggaccctgccaagttcaagatgaagtactggggcgtagcctcctttctccagaaaggaaatgatgaccactggatcgtcgacacagactacgacacgtatgccgtgcagtactcctgccgcctcctgaacctcgatggcacctgtgctgacagctactccttcgtgttttcccgggaccccaacggcctgcccccagaagcgcagaagattgtaaggcagcggcaggaggagctgtgcctggccaggcagtacaggctgatcgtccacaacggttactgcgatggcagatcagaaagaaaccttttgtagcaatatcaagaatctagtttcatctgagaacttctgattagctctcagtcttcagctctatttatcttaggagtttaatttgcccttctctccccatcttccctcagttcccataaaaccttcattacacataaagatacacgtgggggtcagtgaatctgcttgcctttcctgaaagtttctggggcttaagattccagactctgattcattaaactatagtcacccgtgaaaaanaaaaaaggaaaaaaaaaaaaactcgagtttttttttttttttttttactttattaaaatactgagttttatttcacatgtatatttttgtctccccaccatttccatgtctgaccaccgctactactatgtcctatcataacattccatacatacttaaaaccaagcaaagggtggagttccatctttaaaaactaaacggcattttggacaacacattcttggcaatagaacctggacaacatttatcaaacacggtagggaaagttctcactctgcattataaaaaggacagccagatatcaactgttacagaaatgaaataagacggccagagatcttgaatagcctcttggtcagg

SEQ ID NO: 330662 - DNA, 975 bp, Homo sapiens
  misc_feature (35)..(35): n is a, c, g, or t
  misc_feature (40)..(40): n is a, c, g, or t
  misc_feature (64)..(64): n is a, c, g, or t
cccgggctgcaggattcggcacgagcccggactcngcggncagacttgcgcgcgggtcccctcncggggggcggattcctgggcaagatgaagtgggtgtgggcgctcttgctgttggcggcgctgggcagcggccgcgcggagcgcgactgccgagtgagcagcttccgagtcaaggagaacttcgacaaggctcgcttctctgggacctggtacgccatggccaagaaggaccccgagggcctctttctgcaggacaacatcgtcgcggagttctccgtggacgagaccggccagatgagcgccacagccaagggccgagtccgtcttttgaataactgggacgtgtgcgcagacatggtgggcaccttcacagacaccgaggaccctgccaagttcaagatgaagtactggggcgtagcctcctttctccagaaaggaaatgatgaccactggatcgtcgacacagactacgacacgtatgccgtgcagtactcctgccgcctcctgaacctcgatggcacctgtgctgacagctactccttcgtgttttcccgggaccccaacggcctgcccccagaagcgcagaagattgtaaggcagcggcaggaggagctgtgcctggccaggcagtacaggctgatcgtccacaacggttactgcgatggcagatcagaaagaaaccttttgtagcaatatcaagaatctagtttcatctgagaacttctgattagctctcagtcttcagctctatttatcttaggagtttaatttgcccttctctccccatcttccctcagttcccataaaaccttcattacacataaagatacacgtgggggtcagtgaatctgcttgcctttcctgaaagtttctggggcttaagattccagactctgattcattaaactatagtcacccgtgaaaaaaaactcactttcgaacaatagagataaagaacgaagctcagtacac

SEQ ID NO: 330663 - DNA, 2281 bp, Homo sapiens
cgctcgcctccctcgctccacgcgcgcccggactcggcggccaggcttgcgcgcggttcccctcccggtgggcggattcctgggcaagatgaagtgggtgtgggcgctcttgctgttggcggcgctgggcagcggccgcgcggagcgcgactgccgagtgagcagcttccgagtcaaggagaacttcgacaaggctcgcttctctgggacctggtacgccatggccaagaaggaccccgagggcctctttctgcaggacaacatcgtcgcggagttctccgtggacgagaccggccagatgagcgccacagccaagggccgagtccgtcttttgaataactgggacgtgtgcgcagacatggtgggcaccttcacagacaccgaggaccctgccaagttcaagatgaagtactggggcgtagcctcctttctccagaaaggaaatgatgaccactggatcgtcgacacagactacgacacgtatgccgtgcagtactcctgccgcctcctgaacctcgatggcacctgtgctgacagctactccttcgtgttttcccgggaccccaacggcctgcccccagaagcgcagaagattgtaaggcagcggcaggaggagctgtgcctggccaggcagtacaggctgatcgtccacaacggttactgcgatggcagatcagaaagaaaccttttgtagcaatatcaagaatctagtttcatctgagaacttctgattagctctcagtcttcagctctatttatcttaggagtttaatttgcccttctctccccatcttccctcagttcccataaaaccttcattacacataaagatacacgtgggggtcagtgaatctgcttgcctttcctgaaagtttctggggcttaagattccagactctgatgtcccagctcaaagacagtggagcagaaacctttcttaacccatcatcttattcaagccgtccatgggttggatgaggcccacccacactcgggagggcaatctgcttcactcagtttactgattcaaatgtcaatctcttccagaaacaccctcaaagacacagtgagaaataatgtctaaccaaatgtctgggcacccccgacccaggcaaattgacacaaaaattaattttcacaaatactatcaatagaagtgactaataaatgtggcatcatgtcctgcctgtttatcccatgacaattagtatagtcgagcgtaacattggcttccgttcccttatagtagcaacatgtaggagtttcatttaaagtgaggataattttgaccttacagagtttctccctacccctatctaccattgccacttgtggattgtcattttgccatgactttcttttaaaaaatatcaataagctctatacttcagtaatgtaagtttgaatttcatcctggctgcataagtcactttccattttgacaaagtctagaaatatttttctccatctccttgaatatgggtaatggatacctattgtggggcccactctcaatctcatggttttattttaatttagttctcaatagatatgcctcagctgcttaaaaaccattgaaaatggcccatggccttgtccatctaacagagtccagtaaaatcctgacaatggaatggggagagagaaagtgagaaccaccaaactcagcacaaaacgactgagtttaaacctctgtgctaagagatgatcagagtctatcatggcttctagtagcatgagaccatgtctcacgaatgaccctaggctcccatgacaatgcctacctaagaaagctcaaggctgccaggggaacttactttagtctagccaatacttgatgatggcagtttcaggatctttctttcttatagcacttactaagaagggaatccttcctccatccctttgatatatgtgtgtatctcctagggacttcaatgtatctttgcccaggatctgaaaggcaatacttttgaggtgtagttctcaggaaggactgagcctctgtcttccagtctctgtgggaggttagaatcctaacttctaatattgccagctggcagacacagctgtcctgatgaggcagacatttaaaatgaccaatcttttgtaatgtttcacttgtgccctgccccctgccctctcccctgcctctctctcccattagaatgccatcacctctgcacaaatgcgaacagaaccagccccttcctctacggtcagtagttactgaataaaattggttttcatcgatttgactaatgtctgatatatctttgac

SEQ ID NO: 330664 - DNA, 1072 bp, Homo sapiens
cgctcgcctccctcgctccacgcgcgcccggactcggcggccaggcttgcgcgcggttcccctcccggtgggcggattcctgggcaagatgaagtgggtgtgggcgctcttgctgttggcggcgctgggcagcggccgcgcggagcgcgactgccgagtgagcagcttccgagtcaaggagaacttcgacaaggctcgcttctctgggacctggtacgccatggccaagaaggaccccgagggcctctttctgcaggacaacatcgtcgcggagttctccgtggacgagaccggccagatgagcgccacagccaagggccgagtccgtcttttgaataactgggacgtgtgcgcagacatggtgggcaccttcacagacaccgaggaccctgccaagttcaagatgaagtactggggcgtagcctcctttctccagaaaggaaccttgaggaatacatataatctaaattcagtggctcagctctgcctctgtgagttgtgaagaggacaaggtctgagaaggaatatctgatgccagatggtgggcctcttgtgtcctcaaggcaactacgacacgtatgccgtgcagtactcctgccgcctcctgaacctcgatggcacctgtgctgacagctactccttcgtgttttcccgggaccccaacggcctgcccccagaagcgcagaagattgtaaggcagcggcaggaggagctgtgcctggccaggcagtacaggctgatcgtccacaacggttactgcgatggcagatcagaaagaaaccttttgtagcaatatcaagaatctagtttcatctgagaacttctgattagctctcagtcttcagctctatttatcttaggagtttaatttgcccttctctccccatcttccctcagttcccataaaaccttcattacacataaagatacacgtgggggtcagtgaatctgcttgcctttcctgaaagtttctggggcttaagattccagactctgattcattaaactatagtcacccgtgaaaaaaaactcactttcgaacaatagagataaagaacgaagctcagtacac

SEQ ID NO: 330665 - DNA, 135 bp, Homo sapiens
cttcctggacatctgttggtaaagtctgagagttcactctgctccatcagtggtcagccagcataaacagccaggctccaggtttctttatttatggaggacttggatcagagattttgtcttggactctgggac

SEQ ID NO: 330666 - DNA, 397 bp, Homo sapiens
gctttgagtgccaagggcagagaccaagtcctccagtcttcgtgtcttcccacagctcgtcatgaaagtgggctctggtgggtgtttattgacttgaattgaccccaagtggacgttgctgagaactgtcatgcgatttgtccctacagcaacctaacatcaaacagaagtttgtggccctcctgaagcggtttaaagtttcagatgaggtatggcctcttactcccaaggttaatggtgagtagaattccccgggtttcacccagcatccctggagtacactctgtattgccactgagagtcaggattctaggattaatattcctgctccccgtggcatacctggtagagccctaagggagagggtggctaagaaggacttaagcaagcagaggag

SEQ ID NO: 330667 - DNA, 407 bp, Homo sapiens
cttatgttctgacccacccttatgttctgacactgagctccatcctcaggttctttgtcaagtccctggccaacaagacctccgactggcttggctacatgcgcttcctcatcatccccctcggttctcaccctgtggccaaatacttggggtcagtcgacagtaaatacagtagttccttcctggattctggttggagagatctgttcagtcgctcggagccaccagtgtcagagcaactggacgtggcagggcgggtgatgcagtacgtcaacggggcagccacgacacaccagcttcccgtggccgaagccatgctgacttgccggcataagttccctgatgaagactcctatcagaagtttattcccttcattggcgtgagtactgactccctctgcttggca

SEQ ID NO: 330668 - DNA, 4498 bp, Homo sapiens
cgccgccgccgccgcgggggaagcctgggagccagatcggcgtcgcctcggcctccgtaacccccgcctagccgggccatggcggaacgcggaggggcgggcggtggtcccggaggcgccgggggcggcagcggccagcggggatccggggtcgcccagtcccctcagcagccgccgccgcagcagcagcagcagcagccgccgcagcagccgacgccccccaagctggcccaggccacctcgtcgtcctcgtccacctcggcggcggctgcctcctcctcgtcctcgtctacctccacctccatggccgtggcggtggcctcgggctccgcgcctcccggtgtgtgcccggtgggtgcccagtgccggaactcccctgccaccggtgtgcatgatgcaaccttgtaccgccgaccctgtggaagtgtggcaccgggaagcctcgatcccagcgtgcggtgcactaggtgctaattcaggctattggacccgctgagaggaaacctctgtcgattgctaaagaagacaagtgtgacaagagattcttaaactcagcgtggtcatcggcttagtgaaggctaggaggggttcaaaaagaattcttcgctccaacgagatcgtccttccagctagtggactggtggaaacagagctccaattaaccttctcccttcagtaccctcatttccttaagcgagatgccaacaagctgcagatcatgctgcaaaggagaaaacgttacaagaatcggaccatcttgggctataagaccttggccgtgggactcatcaacatggcagaggtgatgcagcatcctaatgaaggcgcactggtgcttggcctacacagcaacgtgaaggatgtctctgtgcctgtggcagaaataaagatctactccctgtccagccaacccattgaccatgaaggaatcaaatccaagctttctgatcgttctcctgatattgacaattattctgaggaagaggaagagagtttctcatcagaacaggaaggcagtgatgatccattgcatgggcaggacttgttctacgaagacgaagatctccggaaagtgaagaagacccggaggaaactaacctcaacctctgccatcacaaggcaacctaacatcaaacagaagtttgtggccctcctgaagcggtttaaagtttcagatgaggtgggctttgggctggagcatgtgtcccgcgagcagatccgggaagtggaagaggacttggatgaattgtatgacagtctggagatgtacaaccccagcgacagtggccctgagatggaggagacagaaagcatcctcagcacgccaaagcccaagctcaagcctttctttgaggggatgtcgcagtccagctcccagacggagattggcagcctcaacagcaaaggcagcctcggaaaagacaccaccagccctatggaattggctgctctagaaaaaattaaatctacttggattaaaaaccaagatgacagcttgactgaaacagacactctggaaatcactgaccaggacatgtttggagatgccagcacgagtctggttgtgccggagaaagtcaaaactcccatgaagtccagtaaaacggatctccagggctctgcctcccccagcaaagtggagggggtgcacacaccccggcagaagaggagcacgcccctgaaggagcggcagctctccaagcccctaagtgagaggaccaacagttccgacagcgagcgctccccagatctgggccacagcacgcagattccaagaaaggtggtgtatgaccagctcaatcagatcctggtgtcagatgcagccctcccagaaaatgtcattctggtgaacaccactgactggcagggccagtatgtggctgagctgctccaggaccagcggaagcctgtggtgtgcacctgctccaccgtggaggtccaggccgtgctgtccgccctgctcacccggatccagcgctactgcaactgcaactcttccatgccgaggccagtgaaggtggctgctgtgggaggccagagctacctgagctccatcctcaggttctttgtcaagtccctggccaacaagacctccgactggcttggctacatgcgcttcctcatcatccccctcggttctcaccctgtggccaaatacttggggtcagtcgacagtaaatacagtagttccttcctggattctggttggagagatctgttcagtcgctcggagccaccagtgtcagagcaactggacgtggcagggcgggtgatgcagtacgtcaacggggcagccacgacacaccagcttcccgtggccgaagccatgctgacttgccggcataagttccctgatgaagactcctatcagaagtttattcccttcattggcgtggtgaaggtgggtctggttgaagactctccctccacagcaggcgatggggacgattctcctgtggtcagccttactgtgccctccacatcaccaccctccagctcgggcctgagccgagacgccacggccacccctccctcctccccatctatgagcagcgccctggccatcgtggggagccctaatagcccatatggggacgtgattggcctccaggtggactactggctgggccaccccggggagcggaggagggaaggcgacaagagggacgccagctcgaagaacaccctcaagagtgtcttccgctcagtgcaggtgtcccgcctgccccatagtggggaggcccagctttctggcaccatggccatgactgtggtcaccaaagaaaagaacaagaaagttcccaccatcttcctgagcaagaaaccccgagaaaaggaggtggattctaagagccaggtcattgaaggcatcagccgcctcatctgctcagccaagcagcagcagactatgctgagagtgtccatcgatggggtcgagtggagtgacatcaagttcttccagctggcagcccagtggcccacccatgtcaagcactttccagtgggactcttcagtggcagcaaggccacctgaggccctgtctcccagccactttccctcctggcactgccaccagcctcaccgcctgcgggcagggggaggccagcaggcccgggcccagcaccccttccctggcaccagggtctgcctctcactcgcccaggtcccgaaggacactgccacagggacgccttccctcccctcccctccagcccacccctgcacagcccctcctccttcccgcttttccccttctccctcctgctccaggcccaaggcgtgttggttttgccttctggtgcccatagtcccctggactgagtcccccaggccttccttcacccgacttccaaactcttccttgtggtatcagtttccttctcggaaatgagaaagctggaatcctggtccccagcaggagagcctagtcctcccccagcccctccagccaccagggtgtcctctaggatgcagctgccagatccactcactctgctgcctccagcaggacccaaggccactttcaactcttatggggttctccacctgccccagagcttctcaagggagggtaagggggcaccctgagcccacaggacccctacttcacagctcacaggggcaggaggcagctcccctgcctccaggaccctgttgctatggtgacacagcgtttctaggacagaggggcctcccagtctccccccaccacccgtgcacgacttcctcaccacccccaggttccctgcagatgtcgtgtgtgtcctgagtgtttctttggttctttgcacgccaagtctcttggttgtaccatgtgacacaccctgtgcactggtcgctgtcttcgtggcttccacccttgttaatgatgctcctgcctctgcctcccagcccctcacccagcacagctctgcctggacttggagagatgggaggcagacccccaccaccatacatgctgtctgtggcccctcagacattctgtttcatctcccattcatctccctcctcccaccgtgtcagtttttctgcctttccctgctctgttcttccccctccttaggccccagcctgggcccagacccatcctcccagccaggtttccctccagcaggctccttccctccctgtcacctccctctcaccaacccggggtctgagcccctcattcctgaccgtccgtgttctcaggagtggttgaggacacagggccccagcccagccctctgcaccccccagcccggccatctgcgccccacagcccctttggagcttttctcttgtcctctcactccttcccagaagtttttgcacagaacttcattttgaaagtgtttttctcattctccatacctcccccaagctctcctccagcccttcccagggctcagccctgctgtcctgagcgtctcctgggccagagagaggagatgggggtgggagggactgagttgatgttgggtttttcattcaataaattggtgatttcttaccgac

SEQ ID NO: 330669 - DNA, 4474 bp, Homo sapiens
cgccgccgccgccgcgggggaagcctgggagccagatcggcgtcgcctcggcctccgtaacccccgcctagccgggccatggcggaacgcggaggggcgggcggtggtcccggaggcgccgggggcggcagcggccagcggggatccggggtcgcccagtcccctcagcagccgccgccgcagcagcagcagcagcagccgccgcagcagccgacgccccccaagctggcccaggccacctcgtcgtcctcgtccacctcggcggcggctgcctcctcctcgtcctcgtctacctccacctccatggccgtggcggtggcctcgggctccgcgcctcccggtggcccggggccaggccgcacccccgccccggtgcagatgaacctgtacgccacctgggaggtggaccggagctcgtccagctgcgtgcctaggctattcagcttgaccctgaagaaactcgtcatgctaaaagaaatggacaaagatcttaactcagtggtcatcgctgtgaagctgcagggttcaaaaagaattcttcgctccaacgagatcgtccttccagctagtggactggtggaaacagagctccaattaaccttctcccttcagtaccctcatttccttaagcgagatgccaacaagctgcagatcatgctgcaaaggagaaaacgttacaagaatcggaccatcttgggctataagaccttggccgtgggactcatcaacatggcagaggtgatgcagcatcctaatgaaggcgcactggtgcttggcctacacagcaacgtgaaggatgtctctgtgcctgtggcagaaataaagatctactccctgtccagccaacccattgaccatgaaggaatcaaatccaagccaacccattgaccatgaaggaatcaaatccaagctttctgtttctgatcgttctcctgatattgacaattattctgaggaagaggaagagagtttctcatcagaacaggaaggcagtgatgatccattgcatgggcaggacttgttctacgaagacgaagatctccggaaagtgaagaagacccggaggaaactaacctcaacctctgccatcacaaggcaacctaacatcaaacagaagtttgtggccctcctgaagcggtttaaagtttcagatgaggtgggctttgggctggagcatgtgtcccgcgagcagatccgggaagtggaagaggacttggatgaattgtatgacagtctggagatgtacaaccccagcgacagtggccctgagatggaggagacagaaagcatcctcagcacgccaaagcccaagctcaagcctttctttgaggggatgtcgcagtccagctcccagacggagattggcagcctcaacagcaaaggcagcctcggaaaagacaccaccagccctatggaattggctgctctagaaaaaattaaatctacttggattaaaaaccaagatgacagcttgactgaaacagacactctggaaatcactgaccaggacatgtttggagatgccagcacgagtctggttgtgccggagaaagtcaaaactcccatgaagtccagtaaaacggatctccagggctctgcctcccccagcaaagtggagggggtgcacacaccccggcagaagaggagcacgcccctgaaggagcggcagctctccaagcccctaagtgagaggaccaacagttccgacagcgagcgctccccagatctgggccacagcacgcagattccaagaaaggtggtgtatgaccagctcaatcagatcctggtgtcagatgcagccctcccagaaaatgtcattctggtgaacaccactgactggcagggccagtatgtggctgagctgctccaggaccagcggaagcctgtggtgtgcacctgctccaccgtggaggtccaggccgtgctgtccgccctgctcacccggatccagcgctactgcaactgcaactcttccatgccgaggccagtgaaggtggctgctgtgggaggccagagctacctgagctccatcctcaggttctttgtcaagtccctggccaacaagacctccgactggcttggctacatgcgcttcctcatcatccccctcggttctcaccctgtggccaaatacttggggtcagtcgacagtaaatacagtagttccttcctggattctggttggagagatctgttcagtcgctcggagccaccagtgtcagagcaactggacgtggcagggcgggtgatgcagtacgtcaacggggcagccacgacacaccagcttcccgtggccgaagccatgctgacttgccggcataagttccctgatgaagactcctatcagaagtttattcccttcattggcgtggtgaaggtgggtctggttgaagactctccctccacagcaggcgatggggacgattctcctgtggtcagccttactgtgccctccacatcaccaccctccagctcgggcctgagccgagacgccacggccacccctccctcctccccatctatgagcagcgccctggccatcgtggggagccctaatagcccatatggggacgtgattggcctccaggtggactactggctgggccaccccggggagcggaggagggaaggcgacaagagggacgccagctcgaagaacaccctcaagagtgtcttccgctcagtgcaggtgtcccgcctgccccatagtggggaggcccagctttctggcaccatggccatgactgtggtcaccaaagaaaagaacaagaaagttcccaccatcttcctgagcaagaaaccccgagaaaaggaggtggattctaagagccaggtcattgaaggcatcagccgcctcatctgctcagccaagcagcagcagactatgctgagagtgtccatcgatggggtcgagtggagtgacatcaagttcttccagctggcagcccagtggcccacccatgtcaagcactttccagtgggactcttcagtggcagcaaggccacctgaggccctgtctcccagccactttccctcctggcactgccaccagcctcaccgcctgcgggcagggggaggccagcaggcccgggcccagcaccccttccctggcaccagggtctgcctctcactcgcccaggtcccgaaggacactgccacagggacgccttccctcccctcccctccagcccacccctgcacagcccctcctccttcccgcttttccccttctccctcctgctccaggcccaaggcgtgttggttttgccttctggtgcccatagtcccctggactgagtcccccaggccttccttcacccgacttccaaactcttccttgtggtatcagtttccttctcggaaatgagaaagctggaatcctggtccccagcaggagagcctagtcctcccccagcccctccagccaccagggtgtcctctaggatgcagctgccagatccactcactctgctgcctccagcaggacccaaggccactttcaactcttatggggttctccacctgccccagagcttctcaagggagggtaagggggcaccctgagcccacaggacccctacttcacagctcacaggggcaggaggcagctcccctgcctccaggaccctgttgctatggtgacacagcgtttctaggacagaggggcctcccagtctccccccaccacccgtgcacgacttcctcaccacccccaggttccctgcagatgtcgtgtgtgtcctgagtgtttctttggttctttgcacgccaagtctcttggttgtaccatgtgacacaccctgtgcactggtcgctgtcttcgtggcttccacccttgttaatgatgctcctgcctctgcctcccagcccctcacccagcacagctctgcctggacttggagagatgggaggcagacccccaccaccatacatgctgtctgtggcccctcagacattctgtttcatctcccattcatctccctcctcccaccgtgtcagtttttctgcctttccctgctctgttcttccccctccttaggccccagcctgggcccagacccatcctcccagccaggtttccctccagcaggctccttccctccctgtcacctccctctcaccaacccggggtctgagcccctcattcctgaccgtccgtgttctcaggagtggttgaggacacagggccccagcccagccctctgcaccccccagcccggccatctgcgccccacagcccctttggagcttttctcttgtcctctcactccttcccagaagtttttgcacagaacttcattttgaaagtgtttttctcattctccatacctcccccaagctctcctccagcccttcccagggctcagccctgctgtcctgagcgtctcctgggccagagagaggagatgggggtgggagggactgagttgatgttgggtttttcattcaataaattggtgatttcttaccgac

SEQ ID NO: 330670 - DNA, 3698 bp, Homo sapiens
agctgctctagagtatccctccggtcgcgagactgcttgcgatacacagcaacgtgaaggatgtctctgtgcctgtggcagaaataaagatctactccctgtccagccaacccattgaccatgaaggaatcaaatccaagctttctgatcgttctcctgatattgacaattattctgaggaagaggaagagagtttctcatcagaacaggaaggcagtgatgatccattgcatgggcaggacttgttctacgaagacgaagatctccggaaagtgaagaagacccggaggaaactaacctcaacctctgccatcacaaggcaacctaacatcaaacagaagtttgtggccctcctgaagcggtttaaagtttcagatgaggtgggctttgggctggagcatgtgtcccgcgagcagatccgggaagtggaagaggacttggatgaattgtatgacagtctggagatgtacaaccccagcgacagtggccctgagatggaggagacagaaagcatcctcagcacgccaaagcccaagctcaagcctttctttgaggggatgtcgcagtccagctcccagacggagattggcagcctcaacagcaaaggcagcctcggaaaagacaccaccagccctatggaattggctgctctagaaaaaattaaatctacttggattaaaaaccaagatgacagcttgactgaaacagacactctggaaatcactgaccaggacatgtttggagatgccagcacgagtctggttgtgccggagaaagtcaaaactcccatgaagtccagtaaaacggatctccagggctctgcctcccccagcaaagtggagggggtgcacacaccccggcagaagaggagcacgcccctgaaggagcggcagctctccaagcccctaagtgagaggaccaacagttccgacagcgagcgctccccagatctgggccacagcacgcagattccaagaaaggtggtgtatgaccagctcaatcagatcctggtgtcagatgcagccctcccagaaaatgtcattctggtgaacaccactgactggcagggccagtatgtggctgagctgctccaggaccagcggaagcctgtggtgtgcacctgctccaccgtggaggtccaggccgtgctgtccgccctgctcacccggatccagcgctactgcaactgcaactcttccatgccgaggccagtgaaggtggctgctgtgggaggccagagctacctgagctccatcctcaggttctttgtcaagtccctggccaacaagacctccgactggcttggctacatgcgcttcctcatcatccccctcggttctcaccctgtggccaaatacttggggtcagtcgacagtaaatacagtagttccttcctggattctggttggagagatctgttcagtcgctcggagccaccagtgtcagagcaactggacgtggcagggcgggtgatgcagtacgtcaacggggcagccacgacacaccagcttcccgtggccgaagccatgctgacttgccggcataagttccctgatgaagactcctatcagaagtttattcccttcattggcgtggtgaaggtgggtctggttgaagactctccctccacagcaggcgatggggacgattctcctgtggtcagccttactgtgccctccacatcaccaccctccagctcgggcctgagccgagacgccacggccacccctccctcctccccatctatgagcagcgccctggccatcgtggggagccctaatagcccatatggggacgtgattggcctccaggtggactactggctgggccaccccggggagcggaggagggaaggcgacaagagggacgccagctcgaagaacaccctcaagagtgtcttccgctcagtgcaggtgtcccgcctgccccatagtggggaggcccagctttctggcaccatggccatgactgtggtcaccaaagaaaagaacaagaaagttcccaccatcttcctgagcaagaaaccccgagaaaaggaggtggattctaagagccaggtcattgaaggcatcagccgcctcatctgctcagccaagcagcagcagactatgctgagagtgtccatcgatggggtcgagtggagtgacatcaagttcttccagctggcagcccagtggcccacccatgtcaagcactttccagtgggactcttcagtggcagcaaggccacctgaggccctgtctcccagccactttccctcctggcactgccaccagcctcaccgcctgcgggcagggggaggccagcaggcccgggcccagcaccccttccctggcaccagggtctgcctctcactcgcccaggtcccgaaggacactgccacagggacgccttccctcccctcccctccagcccacccctgcacagcccctcctccttcccgcttttccccttctccctcctgctccaggcccaaggcgtgttggttttgccttctggtgcccatagtcccctggactgagtcccccaggccttccttcacccgacttccaaactcttccttgtggtatcagtttccttctcggaaatgagaaagctggaatcctggtccccagcaggagagcctagtcctcccccagcccctccagccaccagggtgtcctctaggatgcagctgccagatccactcactctgctgcctccagcaggacccaaggccactttcaactcttatggggttctccacctgccccagagcttctcaagggagggtaagggggcaccctgagcccacaggacccctacttcacagctcacaggggcaggaggcagctcccctgcctccaggaccctgttgctatggtgacacagcgtttctaggacagaggggcctcccagtctccccccaccacccgtgcacgacttcctcaccacccccaggttccctgcagatgtcgtgtgtgtcctgagtgtttctttggttctttgcacgccaagtctcttggttgtaccatgtgacacaccctgtgcactggtcgctgtcttcgtggcttccacccttgttaatgatgctcctgcctctgcctcccagcccctcacccagcacagctctgcctggacttggagagatgggaggcagacccccaccaccatacatgctgtctgtggcccctcagacattctgtttcatctcccattcatctccctcctcccaccgtgtcagtttttctgcctttccctgctctgttcttccccctccttaggccccagcctgggcccagacccatcctcccagccaggtttccctccagcaggctccttccctccctgtcacctccctctcaccaacccggggtctgagcccctcattcctgaccgtccgtgttctcaggagtggttgaggacacagggccccagcccagccctctgcaccccccagcccggccatctgcgccccacagcccctttggagcttttctcttgtcctctcactccttcccagaagtttttgcacagaacttcattttgaaagtgtttttctcattctccatacctcccccaagctctcctccagcccttcccagggctcagccctgctgtcctgagcgtctcctgggccagagagaggagatgggggtgggagggactgagttgatgttgggtttttcattcaataaattggtgatttcttaccgac

SEQ ID NO: 330671 - DNA, 4182 bp, Homo sapiens
cgccgccgccgccgcgggggaagcctgggagccagatcggcgtcgcctcggcctccgtaacccccgcctagccgggccatggcggaacgcggaggggcgggcggtggtcccggaggcgccgggggcggcagcggccagcggggatccggggtcgcccagtcccctcagcagccgccgccgcagcagcagcagcagcagccgccgcagcagccgacgccccccaagctggcccaggccacctcgtcgtcctcgtccacctcggcggcggctgcctcctcctcgtcctcgtctacctccacctccatggccgtggcggtggcctcgggctccgcgcctcccggtggcccggggccaggccgcacccccgccccggtgcagatgaacctgtacgccacctgggaggtggaccggagctcgtccagctgcgtgcctaggctattcagcttgaccctgaagaaactcgtcatgctaaaagaaatggacaaagatcttaactcagtggtcatcgctgtgaagctgcagggttcaaaaagaattcttcgctccaacgagatcgtccttccagctagtggactggtggaaacagagctccaattaaccttctcccttcagtaccctcatttccttaagcgagatgccaacaagctgcagatcatgctgcaaaggagaaaacgttacaagaatcggaccatcttgggctataagaccttggccgtgggactcatcaacatggcagaggtgatgcagcatcctaatgaaggcgcactggtgcttggcctacacagcaacgtgaaggatgtctctgtgcctgtggcagaaataaagatctactccctgtccagccaacccattgaccatgaaggaatcaaatccaagctttctgatcgttctcctgatattgacaattattctgaggaagaggaagagagtttctcatcagaacaggaaggcagtgatgatccattgcatgggcaggacttgttctacgaagacgaagatctccggaaagtgaagaagacccggaggaaactaacctcaacctctgccatcacaaggcaacctaacatcaaacagaagtttgtggccctcctgaagcggtttaaagtttcagatgaggtgggctttgggctggagcatgtgtcccgcgagcagatccgggaagtggaagaggacttggatgaattgtatgacagtctggagatgtacaaccccagcgacagtggccctgagatggaggagacagaaagcatcctcagcacgccaaagcccaagctcaagcctttctttgaggggatgtcgcagtccagctcccagacggagattggcagcctcaacagcaaaggcagcctcggaaaagacaccaccagccctatggaattggctgctctagaaaaaattaaatctacttggattaaaaaccaagatgacagcttgactgaaacagacactctgattccaagaaaggtggtgtatgaccagctcaatcagatcctggtgtcagatgcagccctcccagaaaatgtcattctggtgaacaccactgactggcagggccagtatgtggctgagctgctccaggaccagcggaagcctgtggtgtgcacctgctccaccgtggaggtccaggccgtgctgtccgccctgctcacccggatccagcgctactgcaactgcaactcttccatgccgaggccagtgaaggtggctgctgtgggaggccagagctacctgagctccatcctcaggttctttgtcaagtccctggccaacaagacctccgactggcttggctacatgcgcttcctcatcatccccctcggttctcaccctgtggccaaatacttggggtcagtcgacagtaaatacagtagttccttcctggattctggttggagagatctgttcagtcgctcggagccaccagtgtcagagcaactggacgtggcagggcgggtgatgcagtacgtcaacggggcagccacgacacaccagcttcccgtggccgaagccatgctgacttgccggcataagttccctgatgaagactcctatcagaagtttattcccttcattggcgtggtgaaggtgggtctggttgaagactctccctccacagcaggcgatggggacgattctcctgtggtcagccttactgtgccctccacatcaccaccctccagctcgggcctgagccgagacgccacggccacccctccctcctccccatctatgagcagcgccctggccatcgtggggagccctaatagcccatatggggacgtgattggcctccaggtggactactggctgggccaccccggggagcggaggagggaaggcgacaagagggacgccagctcgaagaacaccctcaagagtgtcttccgctcagtgcaggtgtcccgcctgccccatagtggggaggcccagctttctggcaccatggccatgactgtggtcaccaaagaaaagaacaagaaagttcccaccatcttcctgagcaagaaaccccgagaaaaggaggtggattctaagagccaggtcattgaaggcatcagccgcctcatctgctcagccaagcagcagcagactatgctgagagtgtccatcgatggggtcgagtggagtgacatcaagttcttccagctggcagcccagtggcccacccatgtcaagcactttccagtgggactcttcagtggcagcaaggccacctgaggccctgtctcccagccactttccctcctggcactgccaccagcctcaccgcctgcgggcagggggaggccagcaggcccgggcccagcaccccttccctggcaccagggtctgcctctcactcgcccaggtcccgaaggacactgccacagggacgccttccctcccctcccctccagcccacccctgcacagcccctcctccttcccgcttttccccttctccctcctgctccaggcccaaggcgtgttggttttgccttctggtgcccatagtcccctggactgagtcccccaggccttccttcacccgacttccaaactcttccttgtggtatcagtttccttctcggaaatgagaaagctggaatcctggtccccagcaggagagcctagtcctcccccagcccctccagccaccagggtgtcctctaggatgcagctgccagatccactcactctgctgcctccagcaggacccaaggccactttcaactcttatggggttctccacctgccccagagcttctcaagggagggtaagggggcaccctgagcccacaggacccctacttcacagctcacaggggcaggaggcagctcccctgcctccaggaccctgttgctatggtgacacagcgtttctaggacagaggggcctcccagtctccccccaccacccgtgcacgacttcctcaccacccccaggttccctgcagatgtcgtgtgtgtcctgagtgtttctttggttctttgcacgccaagtctcttggttgtaccatgtgacacaccctgtgcactggtcgctgtcttcgtggcttccacccttgttaatgatgctcctgcctctgcctcccagcccctcacccagcacagctctgcctggacttggagagatgggaggcagacccccaccaccatacatgctgtctgtggcccctcagacattctgtttcatctcccattcatctccctcctcccaccgtgtcagtttttctgcctttccctgctctgttcttccccctccttaggccccagcctgggcccagacccatcctcccagccaggtttccctccagcaggctccttccctccctgtcacctccctctcaccaacccggggtctgagcccctcattcctgaccgtccgtgttctcaggagtggttgaggacacagggccccagcccagccctctgcaccccccagcccggccatctgcgccccacagcccctttggagcttttctcttgtcctctcactccttcccagaagtttttgcacagaacttcattttgaaagtgtttttctcattctccatacctcccccaagctctcctccagcccttcccagggctcagccctgctgtcctgagcgtctcctgggccagagagaggagatgggggtgggagggactgagttgatgttgggtttttcattcaataaattggtgatttcttaccgac

SEQ ID NO: 330672 - DNA, 3548 bp, Homo sapiens
cagcttcacagtgtggagcggtggcaggaactggggggaaggtggcctcaccatgtccccgccctcaggctggatcatggaaatgacgtgaaggttactccagccagtgtgaagctctggcatgtcccttaagcaggactataagggcagcccaggagaaaggagctgctcatcaaccaaaattgttaatagggatgaccctaaattcagagactcctttttccctgcaggtgggctttgggctggagcatgtgtcccgcgagcagatccgggaagtggaagaggacttggatgaattgtatgacagtctggagatgtacaaccccagcgacagtggccctgagatggaggagacagaaagcatcctcagcacgccaaagcccaagctcaagcctttctttgaggggatgtcgcagtccagctcccagacggagattggcagcctcaacagcaaaggcagcctcggaaaagacaccaccagccctatggaattggctgctctagaaaaaattaaatctacttggattaaaaaccaagatgacagcttgactgaaacagacactctggaaatcactgaccaggacatgtttggagatgccagcacgagtctggttgtgccggagaaagtcaaaactcccatgaagtccagtaaaacggatctccagggctctgcctcccccagcaaagtggagggggtgcacacaccccggcagaagaggagcacgcccctgaaggagcggcagctctccaagcccctaagtgagaggaccaacagttccgacagcgagcgctccccagatctgggccacagcacgcagattccaagaaaggtggtgtatgaccagctcaatcagatcctggtgtcagatgcagccctcccagaaaatgtcattctggtgaacaccactgactggcagggccagtatgtggctgagctgctccaggaccagcggaagcctgtggtgtgcacctgctccaccgtggaggtccaggccgtgctgtccgccctgctcacccggatccagcgctactgcaactgcaactcttccatgccgaggccagtgaaggtggctgctgtgggaggccagagctacctgagctccatcctcaggttctttgtcaagtccctggccaacaagacctccgactggcttggctacatgcgcttcctcatcatccccctcggttctcaccctgtggccaaatacttggggtcagtcgacagtaaatacagtagttccttcctggattctggttggagagatctgttcagtcgctcggagccaccagtgtcagagcaactggacgtggcagggcgggtgatgcagtacgtcaacggggcagccacgacacaccagcttcccgtggccgaagccatgctgacttgccggcataagttccctgatgaagactcctatcagaagtttattcccttcattggcgtggtgaaggtgggtctggttgaagactctccctccacagcaggcgatggggacgattctcctgtggtcagccttactgtgccctccacatcaccaccctccagctcgggcctgagccgagacgccacggccacccctccctcctccccatctatgagcagcgccctggccatcgtggggagccctaatagcccatatggggacgtgattggcctccaggtggactactggctgggccaccccggggagcggaggagggaaggcgacaagagggacgccagctcgaagaacaccctcaagagtgtcttccgctcagtgcaggtgtcccgcctgccccatagtggggaggcccagctttctggcaccatggccatgactgtggtcaccaaagaaaagaacaagaaagttcccaccatcttcctgagcaagaaaccccgagaaaaggaggtggattctaagagccaggtcattgaaggcatcagccgcctcatctgctcagccaagcagcagcagactatgctgagagtgtccatcgatggggtcgagtggagtgacatcaagttcttccagctggcagcccagtggcccacccatgtcaagcactttccagtgggactcttcagtggcagcaaggccacctgaggccctgtctcccagccactttccctcctggcactgccaccagcctcaccgcctgcgggcagggggaggccagcaggcccgggcccagcaccccttccctggcaccagggtctgcctctcactcgcccaggtcccgaaggacactgccacagggacgccttccctcccctcccctccagcccacccctgcacagcccctcctccttcccgcttttccccttctccctcctgctccaggcccaaggcgtgttggttttgccttctggtgcccatagtcccctggactgagtcccccaggccttccttcacccgacttccaaactcttccttgtggtatcagtttccttctcggaaatgagaaagctggaatcctggtccccagcaggagagcctagtcctcccccagcccctccagccaccagggtgtcctctaggatgcagctgccagatccactcactctgctgcctccagcaggacccaaggccactttcaactcttatggggttctccacctgccccagagcttctcaagggagggtaagggggcaccctgagcccacaggacccctacttcacagctcacaggggcaggaggcagctcccctgcctccaggaccctgttgctatggtgacacagcgtttctaggacagaggggcctcccagtctccccccaccacccgtgcacgacttcctcaccacccccaggttccctgcagatgtcgtgtgtgtcctgagtgtttctttggttctttgcacgccaagtctcttggttgtaccatgtgacacaccctgtgcactggtcgctgtcttcgtggcttccacccttgttaatgatgctcctgcctctgcctcccagcccctcacccagcacagctctgcctggacttggagagatgggaggcagacccccaccaccatacatgctgtctgtggcccctcagacattctgtttcatctcccattcatctccctcctcccaccgtgtcagtttttctgcctttccctgctctgttcttccccctccttaggccccagcctgggcccagacccatcctcccagccaggtttccctccagcaggctccttccctccctgtcacctccctctcaccaacccggggtctgagcccctcattcctgaccgtccgtgttctcaggagtggttgaggacacagggccccagcccagccctctgcaccccccagcccggccatctgcgccccacagcccctttggagcttttctcttgtcctctcactccttcccagaagtttttgcacagaacttcattttgaaagtgtttttctcattctccatacctcccccaagctctcctccagcccttcccagggctcagccctgctgtcctgagcgtctcctgggccagagagaggagatgggggtgggagggactgagttgatgttgggtttttcattcaataaattggtgatttcttaccgac

SEQ ID NO: 330673 - DNA, 2504 bp, Homo sapiens
taaaaaaaaaaaaaaaactcaacgctgagccgcctgtatcggcacgagggctgagctccatcctcaggttctttgtcaagtccctggccaacaagacctccgactggcttggctacatgcgcttcctcatcatccccctcggttctcaccctgtggccaaatacttggggtcagtcgacagtaaatacagtagttccttcctggattctggttggagagatctgttcagtcgctcggagccaccagtgtcagagcaactggacgtggcagggcgggtgatgcagtacgtcaacggggcagccacgacacaccagcttcccgtggccgaagccatgctgacttgccggcataagttccctgatgaagactcctatcagaagtttattcccttcattggcgtggtgaaggtgggtctggttgaagactctccctccacagcaggcgatggggacgattctcctgtggtcagccttactgtgccctccacatcaccaccctccagctcgggcctgagccgagacgccacggccacccctccctcctccccatctatgagcagcgccctggccatcgtggggagccctaatagcccatatggggacgtgattggcctccaggtggactactggctgggccaccccggggagcggaggagggaaggcgacaagagggacgccagctcgaagaacaccctcaagagtgtcttccgctcagtgcaggtgtcccgcctgccccatagtggggaggcccagctttctggcaccatggccatgactgtggtcaccaaagaaaagaacaagaaagttcccaccatcttcctgagcaagaaaccccgagaaaaggaggtggattctaagagccaggtcattgaaggcatcagccgcctcatctgctcagccaagcagcagcagactatgctgagagtgtccatcgatggggtcgagtggagtgacatcaagttcttccagctggcagcccagtggcccacccatgtcaagcactttccagtgggactcttcagtggcagcaaggccacctgaggccctgtctcccagccactttccctcctggcactgccaccagcctcaccgcctgcgggcagggggaggccagcaggcccgggcccagcaccccttccctggcaccagggtctgcctctcactcgcccaggtcccgaaggacactgccacagggacgccttccctcccctcccctccagcccacccctgcacagcccctcctccttcccgcttttccccttctccctcctgctccaggcccaaggcgtgttggttttgccttctggtgcccatagtcccctggactgagtcccccaggccttccttcacccgacttccaaactcttccttgtggtatcagtttccttctcggaaatgagaaagctggaatcctggtccccagcaggagagcctagtcctcccccagcccctccagccaccagggtgtcctctaggatgcagctgccagatccactcactctgctgcctccagcaggacccaaggccactttcaactcttatggggttctccacctgccccagagcttctcaagggagggtaagggggcaccctgagcccacaggacccctacttcacagctcacaggggcaggaggcagctcccctgcctccaggaccctgttgctatggtgacacagcgtttctaggacagaggggcctcccagtctccccccaccacccgtgcacgacttcctcaccacccccaggttccctgcagatgtcgtgtgtgtcctgagtgtttctttggttctttgcacgccaagtctcttggttgtaccatgtgacacaccctgtgcactggtcgctgtcttcgtggcttccacccttgttaatgatgctcctgcctctgcctcccagcccctcacccagcacagctctgcctggacttggagagatgggaggcagacccccaccaccatacatgctgtctgtggcccctcagacattctgtttcatctcccattcatctccctcctcccaccgtgtcagtttttctgcctttccctgctctgttcttccccctccttaggccccagcctgggcccagacccatcctcccagccaggtttccctccagcaggctccttccctccctgtcacctccctctcaccaacccggggtctgagcccctcattcctgaccgtccgtgttctcaggagtggttgaggacacagggccccagcccagccctctgcaccccccagcccggccatctgcgccccacagcccctttggagcttttctcttgtcctctcactccttcccagaagtttttgcacagaacttcattttgaaagtgtttttctcattctccatacctcccccaagctctcctccagcccttcccagggctcagccctgctgtcctgagcgtctcctgggccagagagaggagatgggggtgggagggactgagttgatgttgggtttttcattcaataaattggtgatttcttaccgac

SEQ ID NO: 330674 - DNA, 6060 bp, Homo sapiens
cgccgccgccgccgcgggggaagcctgggagccagatcggcgtcgcctcggcctccgtaacccccgcctagccgggccatggcggaacgcggaggggcgggcggtggtcccggaggcgccgggggcggcagcggccagcggggatccggggtcgcccagtcccctcagcagccgccgccgcagcagcagcagcagcagccgccgcagcagccgacgccccccaagctggcccaggccacctcgtcgtcctcgtccacctcggcggcggctgcctcctcctcgtcctcgtctacctccacctccatggccgtggcggtggcctcgggctccgcgcctcccggtggcccggggccaggccgcacccccgccccggtgcagatgaacctgtacgccacctgggaggtggaccggagctcgtccagctgcgtgcctaggctattcagcttgaccctgaagaaactcgtcatgctaaaagaaatggacaaagatcttaactcagtggtcatcgctgtgaagctgcagggttcaaaaagaattcttcgctccaacgagatcgtccttccagctagtggactggtggaaacagagctccaattaaccttctcccttcagtaccctcatttccttaagcgagatgccaacaagctgcagatcatgctgcaaaggagaaaacgttacaagaatcggaccatcttgggctataagaccttggccgtgggactcatcaacatggcagaggtgatgcagcatcctaatgaaggcgcactggtgcttggcctacacagcaacgtgaaggatgtctctgtgcctgtggcagaaataaagatctactccctgtccagccaacccattgaccatgaaggaatcaaatccaagctttctgatcgttctcctgatattgacaattattctgaggaagaggaagagagtttctcatcagaacaggaaggcagtgatgatccattgcatgggcaggacttgttctacgaagacgaagatctccggaaagtgaagaagacccggaggaaactaacctcaacctctgccatcacaaggcaacctaacatcaaacagaagtttgtggccctcctgaagcggtttaaagtttcagatgaggtgggctttgggctggagcatgtgtcccgcgagcagatccgggaagtggaagaggacttggatgaattgtatgacagtctggagatgtacaaccccagcgacagtggccctgagatggaggagacagaaagcatcctcagcacgccaaagcccaagctcaagcctttctttgaggggatgtcgcagtccagctcccagacggagattggcagcctcaacagcaaaggcagcctcggaaaagacaccaccagccctatggaattggctgctctagaaaaaattaaatctacttggattaaaaaccaagatgacagcttgactgaaacagacactctggaaatcactgaccaggacatgtttggagatgccagcacgagtctggttgtgccggagaaagtcaaaactcccatgaagtccagtaaaacggatctccagggctctgcctcccccagcaaagtggagggggtgcacacaccccggcagaagaggagcacgcccctgaaggagcggcagctctccaagcccctaagtgagaggaccaacagttccgacagcgagcgctccccagatctgggccacagcacgcagattccaagaaaggtggtgtatgaccagctcaatcagatcctggtgtcagatgcagccctcccagaaaatgtcattctggtgaacaccactgactggcagggccagtatgtggctgagctgctccaggaccagcggaagcctgtggtgtgcacctgctccaccgtggaggtccaggccgtgctgtccgccctgctcacccggatccagcgctactgcaactgcaactcttccatgccgaggccagtgaaggtggctgctgtgggaggccagagctacctgagctccatcctcaggttctttgtcaagtccctggccaacaagacctccgactggcttggctacatgcgcttcctcatcatccccctcggttctcaccctgtggccaaatacttggggtcagtcgacagtaaatacagtagttccttcctggattctggttggagagatctgttcagtcgctcggagccaccagtgtcagagcaactggacgtggcagggcgggtgatgcagtacgtcaacggggcagccacgacacaccagcttcccgtggccgaagccatgctgacttgccggcataagttccctgatgaagactcctatcagaagtttattcccttcattggcgtggtgaaggtgggtctggttgaagactctccctccacagcaggcgatggggacgattctcctgtggtcagccttactgtgccctccacatcaccaccctccagctcgggcctgagccgagacgccacggccacccctccctcctccccatctatgagcagcgccctggccatcgtggggagccctaatagcccatatggggacgtgattggcctccaggtggactactggctgggccaccccggggagcggaggagggaaggcgacaagagggacgccagctcgaagaacaccctcaagagtgtcttccgctcagtgcaggtgtcccgcctgccccatagtggggaggcccagctttctggcaccatggccatgactgtggtcaccaaagaaaagaacaagaaagttcccaccatcttcctgagcaagaaaccccgagaaaaggaggtggattctaagagccaggtcattgaaggcatcagccgcctcatctgctcagccaagcagcagcagactatgctgagagtgtccatcgatggggtcgagtggagtgacatcaagttcttccagctggcagcccagtggcccacccatgtcaagcactttccagtgggactcttcagtggcagcaaggccacctgaggccctgtctcccagccactttccctcctggcactgccaccagcctcaccgcctgcgggcagggggaggccagcaggcccgggcccagcaccccttccctggcaccagggtctgcctctcactcgcccaggtcccgaaggacactgccacagggacgccttccctcccctcccctccagcccacccctgcacagcccctcctccttcccgcttttccccttctccctcctgctccaggcccaaggcgtgttggttttgccttctggtgcccatagtcccctggactgagtcccccaggccttccttcacccgacttccaaactcttccttgtggtatcagtttccttctcggaaatgagaaagctggaatcctggtccccagcaggagagcctagtcctcccccagcccctccagccaccagggtgtcctctaggatgcagctgccagatccactcactctgctgcctccagcaggacccaaggccactttcaactcttatggggttctccacctgccccagagcttctcaagggagggtaagggggcaccctgagcccacaggacccctacttcacagctcacaggggcaggaggcagctcccctgcctccaggaccctgttgctatggtgacacagcgtttctaggacagaggggcctcccagtctccccccaccacccgtgcacgacttcctcaccacccccaggttccctgcagatgtcgtgtgtgtcctgagtgtttctttggttctttgcacgccaagtctcttggttgtaccatgtgacacaccctgtgcactggtcgctgtcttcgtggcttccacccttgttaatgatgctcctgcctctgcctcccagcccctcacccagcacagctctgcctggacttggagagatgggaggcagacccccaccaccatacatgctgtctgtggcccctcagacattctgtttcatctcccattcatctccctcctcccaccgtgtcagtttttctgcctttccctgctctgttcttccccctccttaggccccagcctgggcccagacccatcctcccagccaggtttccctccagcaggctccttccctccctgtcacctccctctcaccaacccggggtctgagcccctcattcctgaccgtccgtgttctcaggagtggttgaggacacagggccccagcccagccctctgcaccccccagcccggccatctgcgccccacagcccctttggagcttttctcttgtcctctcactccttcccagaagtttttgcacagaacttcattttgaaagtgtttttctcattctccatacctcccccaagctctcctccagcccttcccagggctcagccctgctgtcctgagcgtctcctgggccagagagaggagatgggggtgggagggactgagttgatgttgggtttttcattcaataaattggtgatttcttaccgactgccttgggcttctatgccccctcactgtgccacaggagctgcccaaccccttttccacagtgcagcccaactccagtgaaaatccaccaggaacgtaggtggaaagaagcgtactcccatgttctcaatcatggaaacaggcatgaaggtgtctcacctggcatgaggcaggcagaggtcggaaacaggaaagatgtcttttccacaccaaaagcccgtttttccccaggacccaccatccccaaatccacctcccaaggcagtgacgtgttgagtgtggcttccccatcttctgatcaaaggtcagaacttagcttctctcccctgctccaggttggtgaagtccgagccagtggggtctttgcctcttctaaatgaggtgatagcggggctggtgagaggaaaggccaggagaagcaaatcatacctagtgtgacctggatctagggtgtgagtgtggctgcagagcagggtgaagtgcccacgaggacttcccggagcacagccaggcgagggctgcagggcaggagctgtgcagagctgggggccagggagttccagtggagggggtgggacaagtagacttggatcccagcttctggcccccttaggttctggcttagagctaggagagagggtgaagggtgaactctcagcccgtctgcatctgacaccatatcctcagcctccccttctgtggcaataaatgccccaccctgctcccatcctcggggcccatccctcttcactccttgagggcttttctcctacagtcgccctctctcctgcactgcgggttctcccctctgccaggactttccacccacttacatgcatcccaagtgggtatagctcaatatcaaagaccagagacttccagattctcttcagctgccatgccttgtctctgctccccttagagcaaaactcttccaaagagctgtgtgtgttccccgtctccacttctgcccactcccttccagttttttcctcacaatcccaccaaaagtttcctttccacagttgccagtgacctgggttgcccagtcctatcagtagcattggatgcaaataatcacccgcttgagtctttccacctggcctgtggacagctctgtgctctcctctcacctccctggcctctcctttttggcctcccttgctatggtgtcctcagcttcccagcctcaaaaccctggaggactcggggctccagcctctaatatagcctcctctctccccacactcagccctaaagggagctcactcggccccatggtgtgaaatgtgctcccctggggagacttccctcctagtaaatgcaaactcggttcttcagttccgaggccgaaaactggggaatcctcctcgattcctgtttctcttgtacccaccatctaatccatgagcaaatcctccaggcttatcctgacagtgccttgccccttcctctactgcgattatctcttgtctggatattgcaataggctcctaattatccctgctcccaccctcttctccctgtagcctgttctccactcaatagccagagatttttcagagctgagcagatcgtgttggattgctgatccaaactgtgcatgggaccgggtaacggctcgatt

SEQ ID NO: 330675 - DNA, 2249 bp, Homo sapiens
cagcccagatttgcaaagattttaaagtcggcaataaaataatgtgtagtgatggctcttgtgccaccaatgtgtttctggttggatcagaacatgcctgctttaacaggaggatctaatgagtgcctcttctctccttgcaggtggtgaaggtgggtctggttgaagactctccctccacagcaggcgatggggacgattctcctgtggtcagccttactgtgccctccacatcaccaccctccagctcgggcctgagccgagacgccacggccacccctccctcctccccatctatgagcagcgccctggccatcgtggggagccctaatagcccatatggggacgtgattggcctccaggtggactactggctgggccaccccggggagcggaggagggaaggcgacaagagggacgccagctcgaagaacaccctcaagagtgtcttccgctcagtgcaggtgtcccgcctgccccatagtggggaggcccagctttctggcaccatggccatgactgtggtcaccaaagaaaagaacaagaaagttcccaccatcttcctgagcaagaaaccccgagaaaaggaggtggattctaagagccaggtcattgaaggcatcagccgcctcatctgctcagccaagcagcagcagactatgctgagagtgtccatcgatggggtcgagtggagtgacatcaagttcttccagctggcagcccagtggcccacccatgtcaagcactttccagtgggactcttcagtggcagcaaggccacctgaggccctgtctcccagccactttccctcctggcactgccaccagcctcaccgcctgcgggcagggggaggccagcaggcccgggcccagcaccccttccctggcaccagggtctgcctctcactcgcccaggtcccgaaggacactgccacagggacgccttccctcccctcccctccagcccacccctgcacagcccctcctccttcccgcttttccccttctccctcctgctccaggcccaaggcgtgttggttttgccttctggtgcccatagtcccctggactgagtcccccaggccttccttcacccgacttccaaactcttccttgtggtatcagtttccttctcggaaatgagaaagctggaatcctggtccccagcaggagagcctagtcctcccccagcccctccagccaccagggtgtcctctaggatgcagctgccagatccactcactctgctgcctccagcaggacccaaggccactttcaactcttatggggttctccacctgccccagagcttctcaagggagggtaagggggcaccctgagcccacaggacccctacttcacagctcacaggggcaggaggcagctcccctgcctccaggaccctgttgctatggtgacacagcgtttctaggacagaggggcctcccagtctccccccaccacccgtgcacgacttcctcaccacccccaggttccctgcagatgtcgtgtgtgtcctgagtgtttctttggttctttgcacgccaagtctcttggttgtaccatgtgacacaccctgtgcactggtcgctgtcttcgtggcttccacccttgttaatgatgctcctgcctctgcctcccagcccctcacccagcacagctctgcctggacttggagagatgggaggcagacccccaccaccatacatgctgtctgtggcccctcagacattctgtttcatctcccattcatctccctcctcccaccgtgtcagtttttctgcctttccctgctctgttcttccccctccttaggccccagcctgggcccagacccatcctcccagccaggtttccctccagcaggctccttccctccctgtcacctccctctcaccaacccggggtctgagcccctcattcctgaccgtccgtgttctcaggagtggttgaggacacagggccccagcccagccctctgcaccccccagcccggccatctgcgccccacagcccctttggagcttttctcttgtcctctcactccttcccagaagtttttgcacagaacttcattttgaaagtgtttttctcattctccatacctcccccaagctctcctccagcccttcccagggctcagccctgctgtcctgagcgtctcctgggccagagagaggagatgggggtgggagggactgagttgatgttgggtttttcattcaataaattggtgatttcttaccgac

SEQ ID NO: 330676 - DNA, 2054 bp, Homo sapiens
tgcaggtcgggtggcaccagctgctgtcctgaggctgcactggagccgcccgcaggggcttctgccgggctcaggccttctctccagctcgaggctcagtttggcccaggctttgcctgctgggcgtgagccctaatagcccatatggggacgtgattggcctccaggtggactactggctgggccaccccggggagcggaggagggaaggcgacaagagggacgccagctcgaagaacaccctcaagagtgtcttccgctcagtgcaggtgtcccgcctgccccatagtggggaggcccagctttctggcaccatggccatgactgtggtcaccaaagaaaagaacaagaaagttcccaccatcttcctgagcaagaaaccccgagaaaaggaggtggattctaagagccaggtcattgaaggcatcagccgcctcatctgctcagccaagcagcagcagactatgctgagagtgtccatcgatggggtcgagtggagtgacatcaagttcttccagctggcagcccagtggcccacccatgtcaagcactttccagtgggactcttcagtggcagcaaggccacctgaggccctgtctcccagccactttccctcctggcactgccaccagcctcaccgcctgcgggcagggggaggccagcaggcccgggcccagcaccccttccctggcaccagggtctgcctctcactcgcccaggtcccgaaggacactgccacagggacgccttccctcccctcccctccagcccacccctgcacagcccctcctccttcccgcttttccccttctccctcctgctccaggcccaaggcgtgttggttttgccttctggtgcccatagtcccctggactgagtcccccaggccttccttcacccgacttccaaactcttccttgtggtatcagtttccttctcggaaatgagaaagctggaatcctggtccccagcaggagagcctagtcctcccccagcccctccagccaccagggtgtcctctaggatgcagctgccagatccactcactctgctgcctccagcaggacccaaggccactttcaactcttatggggttctccacctgccccagagcttctcaagggagggtaagggggcaccctgagcccacaggacccctacttcacagctcacaggggcaggaggcagctcccctgcctccaggaccctgttgctatggtgacacagcgtttctaggacagaggggcctcccagtctccccccaccacccgtgcacgacttcctcaccacccccaggttccctgcagatgtcgtgtgtgtcctgagtgtttctttggttctttgcacgccaagtctcttggttgtaccatgtgacacaccctgtgcactggtcgctgtcttcgtggcttccacccttgttaatgatgctcctgcctctgcctcccagcccctcacccagcacagctctgcctggacttggagagatgggaggcagacccccaccaccatacatgctgtctgtggcccctcagacattctgtttcatctcccattcatctccctcctcccaccgtgtcagtttttctgcctttccctgctctgttcttccccctccttaggccccagcctgggcccagacccatcctcccagccaggtttccctccagcaggctccttccctccctgtcacctccctctcaccaacccggggtctgagcccctcattcctgaccgtccgtgttctcaggagtggttgaggacacagggccccagcccagccctctgcaccccccagcccggccatctgcgccccacagcccctttggagcttttctcttgtcctctcactccttcccagaagtttttgcacagaacttcattttgaaagtgtttttctcattctccatacctcccccaagctctcctccagcccttcccagggctcagccctgctgtcctgagcgtctcctgggccagagagaggagatgggggtgggagggactgagttgatgttgggtttttcattcaataaattggtgatttcttaccgac

SEQ ID NO: 330677 - DNA, 4218 bp, Homo sapiens
cgccgccgccgccgcgggggaagcctgggagccagatcggcgtcgcctcggcctccgtaacccccgcctagccgggccatggcggaacgcggaggggcgggcggtggtcccggaggcgccgggggcggcagcggccagcggggatccggggtcgcccagtcccctcagcagccgccgccgcagcagcagcagcagcagccgccgcagcagccgacgccccccaagctggcccaggccacctcgtcgtcctcgtccacctcggcggcggctgcctcctcctcgtcctcgtctacctccacctccatggccgtggcggtggcctcgggctccgcgcctcccggtggcccggggccaggccgcacccccgccccggtgcagatgaacctgtacgccacctgggaggtggaccggagctcgtccagctgcgtgcctaggctattcagcttgaccctgaagaaactcgtcatgctaaaagaaatggacaaagatcttaactcagtggtcatcgctgtgaagctgcagggttcaaaaagaattcttcgctccaacgagatcgtccttccagctagtggactggtggaaacagagctccaattaaccttctcccttcagtaccctcatttccttaagcgagatgccaacaagctgcagatcatgctgcaaaggagaaaacgttacaagaatcggaccatcttgggctataagaccttggccgtgggactcatcaacatggcagaggtgatgcagcatcctaatgaaggcgcactggtgcttggcctacacagcaacgtgaaggatgtctctgtgcctgtggcagaaataaagatctactccctgtccagccaacccattgaccatgaaggaatcaaatccaagctttctgatcgttctcctgatattgacaattattctgaggaagaggaagagagtttctcatcagaacaggaaggcagtgatgatccattgcatgggcaggacttgttctacgaagacgaagatctccggaaagtgaagaagacccggaggaaactaacctcaacctctgccatcacaaggcaacctaacatcaaacagaagtttgtggccctcctgaagcggtttaaagtttcagatgaggtgggctttgggctggagcatgtgtcccgcgagcagatccgggaagtggaagaggacttggatgaattgtatgacagtctggagatgtacaaccccagcgacagtggccctgagatggaggagacagaaagcatcctcagcacgccaaagcccaagctcaagcctttctttgaggggatgtcgcagtccagctcccagacggagattggcagcctcaacagcaaaggcagcctcggaaaagacaccaccagccctatggaattggctgctctagaaaaaattaaatctacttggattaaaaaccaagatgacagcttgactgaaacagacactctggaaatcactgaccaggacatgtttggagatgccagcacgagtctggttgtgccggagaaagtcaaaactcccatgaagtccagtaaaacggatctccagggctctgcctcccccagcaaagtggagggggtgcacacaccccggcagaagaggagcacgcccctgaaggagcggcagctctccaagcccctaagtgagaggaccaacagttccgacagcgagcgctccccagatctgggccacagcacgcagattccaagaaaggtggtgtatgaccagctcaatcagatcctggtgtcagatgcagccctcccagaaaatgtcattctggtgaacaccactgactggcagggccagtatgtggctgagctgctccaggaccagcggaagcctgtggtgtgcacctgctccaccgtggaggtccaggccgtgctgtccgccctgctcacccggatccagcgctactgcaactgcaactcttccatgccgaggccagtgaaggtggctgctgtgggaggccagagctacctgagctccatcctcaggttctttgtcaagtccctggccaacaagacctccgactggcttggctacatgcgcttcctcatcatccccctcggttctcaccctgtggccaaatacttggggtcagtcgacagtaaatacagtagttccttcctggattctggttggagagatctgttcagtcgctcggagccaccagtgtcagagcaactggacgtggcagggcgggtgatgcagtacgtcaacggggcagccacgacacaccagcttcccgtggccgaagccatgctgacttgccggcataagttccctgatgaagactcctatcagaagtttattcccttcattggcgtggtgaaggtgggtctggttgaagactctccctccacagcaggcgatggggacgattctcctgtggtcagccttactgtgccctccacatcaccaccctccagctcgggcctgagccgagacgccacggccacccctccctcctccccatctatgagcagcgccctggccatcgtggggagccctaatagcccatatggggacgtgattggcctccaggtggactactggctgggccaccccggggagcggaggagggaaggcgacaagagggacgccagctcgaagaacaccctcaagagtgtcttccgctcagtgcaggtgtcccgcctgccccatagtggggaggcccagctttctggcaccatggccatgactgtggtcaccaaagaaaagaacaagaaagttcccaccatcttcctgagcaagaaaccccgagaaaaggaggtggattctaagagccaggtcattgaaggcatcagccgcctcatctgctcagccaagcagcagcagactatgctgagagtgtccatcgatggggtcgagtggagtgacatcaagttcttccagctggcagcccagtggcccacccatgtcaagcactttccagtgggactcttcagtggcagcaaggccacctgaggccctgtctcccagccactttccctcctggcactgccaccagcctcaccgcctgcgggcagggggaggccagcaggcccgggcccagcaccccttccctggcaccagggtctgcctctcactcgcccaggtcccgaaggacactgccacagggacgccttccctcccctcccctccagcccacccctgcacagcccctcctccttcccgcttttccccttctccctcctgctccaggcccaaggcgtgttggttttgccttctggtgcccatagtcccctggactgagtcccccaggccttccttcacccgacttccaaactcttccttgtggtatcagtttccttctcggaaatgagaaagctggaatcctggtccccagcaggagagcctagtcctcccccagcccctccagccaccagggtgtcctctaggatgcagctgccagatccactcactctgctgcctccagcaggacccaaggccactttcaactcttatggggttctccacctgccccagagcttctcaagggagggtaagggggcaccctgagcccacaggacccctacttcacagctcacaggggcaggaggcagctcccctgcctccaggaccctgttgctatggtgacacagcgtttctaggacagaggggcctcccagtctccccccaccacccgtgcacgacttcctcaccaccatacatgctgtctgtggcccctcagacattctgtttcatctcccattcatctccctcctcccaccgtgtcagtttttctgcctttccctgctctgttcttccccctccttaggccccagcctgggcccagacccatcctcccagccaggtttccctccagcaggctccttccctccctgtcacctccctctcaccaacccggggtctgagcccctcattcctgaccgtccgtgttctcaggagtggttgaggacacagggccccagcccagccctctgcaccccccagcccggccatctgcgccccacagcccctttggagcttttctcttgtcctctcactccttcccagaagtttttgcacagaacttcattttgaaagtgtttttctcattctccatacctcccccaagctctcctccagcccttcccagggctcagccctgctgtcctgagcgtctcctgggccagagagaggagatgggggtgggagggactgagttgatgttgggtttttcattcaataaattggtgatttcttaccgac

SEQ ID NO: 330678 - DNA, 4191 bp, Homo sapiens
cgccgccgccgccgcgggggaagcctgggagccagatcggcgtcgcctcggcctccgtaacccccgcctagccgggccatggcggaacgcggaggggcgggcggtggtcccggaggcgccgggggcggcagcggccagcggggatccggggtcgcccagtcccctcagcagccgccgccgcagcagcagcagcagcagccgccgcagcagccgacgccccccaagctggcccaggccacctcgtcgtcctcgtccacctcggcggcggctgcctcctcctcgtcctcgtctacctccacctccatggccgtggcggtggcctcgggctccgcgcctcccggtggcccggggccaggccgcacccccgccccggtgcagatgaacctgtacgccacctgggaggtggaccggagctcgtccagctgcgtgcctaggctattcagcttgaccctgaagaaactcgtcatgctaaaagaaatggacaaagatcttaactcagtggtcatcgctgtgaagctgcagggttcaaaaagaattcttcgctccaacgagatcgtccttccagctagtggactggtggaaacagagctccaattaaccttctcccttcagtaccctcatttccttaagcgagatgccaacaagctgcagatcatgctgcaaaggagaaaacgttacaagaatcggaccatcttgggctataagaccttggccgtgggactcatcaacatggcagaggtgatgcagcatcctaatgaaggcgcactggtgcttggcctacacagcaacgtgaaggatgtctctgtgcctgtggcagaaataaagatctactccctgtccagccaacccattgaccatgaaggaatcaaatccaagctttctgatcgttctcctgatattgacaattattctgaggaagaggaagagagtttctcatcagaacaggaaggcagtgatgatccattgcatgggcaggacttgttctacgaagacgaagatctccggaaagtgaagaagacccggaggaaactaacctcaacctctgccatcacaaggcaacctaacatcaaacagaagtttgtggccctcctgaagcggtttaaagtttcagatgaggtgggctttgggctggagcatgtgtcccgcgagcagatccgggaagtggaagaggacttggatgaattgtatgacagtctggagatgtacaaccccagcgacagtggccctgagatggaggagacagaaagcatcctcagcacgccaaagcccaagctcaagcctttctttgaggggatgtcgcagtccagctcccagacggagattggcagcctcaacagcaaaggcagcctcggaaaagacaccaccagccctatggaattggctgctctagaaaaaattaaatctacttggattaaaaaccaagatgacagcttgactgaaacagacactctggaaatcactgaccaggacatgtttggagatgccagcacgagtctggttgtgccggagaaagtcaaaactcccatgaagtccagtaaaacggatctccagggctctgcctcccccagcaaagtggagggggtgcacacaccccggcagaagaggagcacgcccctgaaggagcggcagctctccaagcccctaagtgagaggaccaacagttccgacagcgagcgctccccagatctgggccacagcacgcagattccaagaaaggtggtgtatgaccagctcaatcagatcctggtgtcagatgcagccctcccagaaaatgtcattctggtgaacaccactgactggcagggccagtatgtggctgagctgctccaggaccagcggaagcctgtggtgtgcacctgctccaccgtggaggtccaggccgtgctgtccgccctgctcacccggatccagcgctactgcaactgcaactcttccatgccgaggccagtgaaggtggctgctgtgggaggccagagctacctgagctccatcctcaggttctttgtcaagtccctggccaacaagacctccgactggcttggctacatgcgcttcctcatcatccccctcggttctcaccctgtggccaaatacttggggtcagtcgacagtaaatacagtagttccttcctggattctggttggagagatctgttcagtcgctcggagccaccagtgtcagagcaactggacgtggcagggcgggtgatgcagtacgtcaacggggcagccacgacacaccagcttcccgtggccgaagccatgctgacttgccggcataagttccctgatgaagactcctatcagaagtttattcccttcattggcgtggtgaaggtgggtctggttgaagactctccctccacagcaggcgatggggacgattctcctgtggtcagccttactgtgccctccacatcaccaccctccagctcgggcctgagccgagacgccacggccacccctccctcctccccatctatgagcagcgccctggccatcgtggggagccctaatagcccatatggggacgtgattggcctccaggtggactactggctgggccaccccggggagcggaggagggaaggcgacaagagggacgccagctcgaagaacaccctcaagagtgtcttccgctcagtgcaggtgtcccgcctgccccatagtggggaggcccagctttctggcaccatggccatgactgtggtcaccaaagaaaagaacaagaaagttcccaccatcttcctgagcaagaaaccccgagaaaaggaggtggattctaagagccaggtcattgaaggcatcagccgcctcatctgctcagccaagcagcagcagactatgctgagagtgtccatcgatggggtcgagtggagtgacatcaagttcttccagctggcagcccagtggcccacccatgtcaagcactttccagtgggactcttcagtggcagcaaggccacctgaggccctgtctcccagccactttccctcctggcactgccaccagcctcaccgcctgcgggcagggggaggccagcaggcccgggcccagcaccccttccctggcaccagggtctgcctctcactcgcccaggtcccgaaggacactgccacagggacgccttccctcccctcccctccagcccacccctgcacagcccctcctccttcccgcttttccccttctccctcctgctccaggcccaaggcgtgttggttttgccttctggtgcccatagtcccctggactgagtcccccaggccttccttcacccgacttccaaactcttccttgtggtatcagtttccttctcggaaatgagaaagctggaatcctggtccccagcaggagagcctagtcctcccccagcccctccagccaccagggtgtcctctaggatgcagctgccagatccactcactctgctgcctccagcaggacccaaggccactttcaactcttatggggttctccacctgccccagagcttctcaagggagggtaagggggcaccctgagcccacaggacccctacttcacagctcacaggggcaggaggcagctcccctgcctccaggaccctgttgctatggtgacacagcgtttctaggacagaggggcctcccagtctccccccaccacccgtgcacgacttcctcaccacccccaggttccctgcagatgtcgtgtgtgtcctgagtgtttctttggttctttgcacgccaagtctcttggttgtaccatgtgacacaccctgtgcactggtcgctgtcttcgtggcttccacccttgttaatgatgctcctgcctctgcctcccagcccctcacccagcacagctctgcctggacttggagagatgggaggcagacccccaccaccatacatgctgtctgtggcccctcagacattctgtttcatctcccattcatctccctcctcccaccgtgtcagtttttctgcctttccctgctctgttctccttcccagaagtttttgcacagaacttcattttgaaagtgtttttctcattctccatacctcccccaagctctcctccagcccttcccagggctcagccctgctgtcctgagcgtctcctgggccagagagaggagatgggggtgggagggactgagttgatgttgggtttttcattcaataaattggtgatttcttaccgac

SEQ ID NO: 330679 - DNA, 3263 bp, Homo sapiens
  misc_feature (3074)..(3074): n is a, c, g, or t
  misc_feature (3210)..(3210): n is a, c, g, or t
cgccgccgccgccgcgggggaagcctgggagccagatcggcgtcgcctcggcctccgtaacccccgcctagccgggccatggcggaacgcggaggggcgggcggtggtcccggaggcgccgggggcggcagcggccagcggggatccggggtcgcccagtcccctcagcagccgccgccgcagcagcagcagcagcagccgccgcagcagccgacgccccccaagctggcccaggccacctcgtcgtcctcgtccacctcggcggcggctgcctcctcctcgtcctcgtctacctccacctccatggccgtggcggtggcctcgggctccgcgcctcccggtggcccggggccaggccgcacccccgccccggtgcagatgaacctgtacgccacctgggaggtggaccggagctcgtccagctgcgtgcctaggctattcagcttgaccctgaagaaactcgtcatgctaaaagaaatggacaaagatcttaactcagtggtcatcgctgtgaagctgcagggttcaaaaagaattcttcgctccaacgagatcgtccttccagctagtggactggtggaaacagagctccaattaaccttctcccttcagtaccctcatttccttaagcgagatgccaacaagctgcagatcatgctgcaaaggagaaaacgttacaagaatcggaccatcttgggctataagaccttggccgtgggactcatcaacatggcagaggtgatgcagcatcctaatgaaggcgcactggtgcttggcctacacagcaacgtgaaggatgtctctgtgcctgtggcagaaataaagatctactccctgtccagccaacccattgaccatgaaggaatcaaatccaagctttctgatcgttctcctgatattgacaattattctgaggaagaggaagagagtttctcatcagaacaggaaggcagtgatgatccattgcatgggcaggacttgttctacgaagacgaagatctccggaaagtgaagaagacccggaggaaactaacctcaacctctgccatcacaaggcaacctaacatcaaacagaagtttgtggccctcctgaagcggtttaaagtttcagatgaggtgggctttgggctggagcatgtgtcccgcgagcagatccgggaagtggaagaggacttggatgaattgtatgacagtctggagatgtacaaccccagcgacagtggccctgagatggaggagacagaaagcatcctcagcacgccaaagcccaagctcaagcctttctttgaggggatgtcgcagtccagctcccagacggagattggcagcctcaacagcaaaggcagcctcggaaaagacaccaccagccctatggaattggctgctctagaaaaaattaaatctacttggattaaaaaccaagatgacagcttgactgaaacagacactctggaaatcactgaccaggacatgtttggagatgccagcacgagtctggttgtgccggagaaagtcaaaactcccatgaagtccagtaaaacggatctccagggctctgcctcccccagcaaagtggagggggtgcacacaccccggcagaagaggagcacgcccctgaaggagcggcagctctccaagcccctaagtgagaggaccaacagttccgacagcgagcgctccccagatctgggccacagcacgcagattccaagaaaggtggtgtatgaccagctcaatcagatcctggtgtcagatgcagccctcccagaaaatgtcattctggtgaacaccactgactggcagggccagtatgtggctgagctgctccaggaccagcggaagcctgtggtgtgcacctgctccaccgtggaggtccaggccgtgctgtccgccctgctcacccggatccagcgctactgcaactgcaactcttccatgccgaggccagtgaaggtggctgctgtgggaggccagagctacctgagctccatcctcaggttctttgtcaagtccctggccaacaagacctccgactggcttggctacatgcgcttcctcatcatccccctcggttctcaccctgtggccaaatacttggggtcagtcgacagtaaatacagtagttccttcctggattctggttggagagatctgttcagtcgctcggagccaccagtgtcagagcaactggacgtggcagggcgggtgatgcagtacgtcaacggggcagccacgacacaccagcttcccgtggccgaagccatgctgacttgccggcataagttccctgatgaagactcctatcagaagtttattcccttcattggcgtggtgaaggtgggtctggttgaagactctccctccacagcaggcgatggggacgattctcctgtggtcagccttactgtgccctccacatcaccaccctccagctcgggcctgagccgagacgccacggccacccctccctcctccccatctatgagcagcgccctggccatcgtggggagccctaatagcccatatggggacgtgattggcctccaggtggactactggctgggccaccccggggagcggaggagggaaggcgacaagagggacgccagctcgaagaacaccctcaagagtgtcttccgctcagtgcaggtgtcccgcctgccccatagtggggaggcccagctttctggcaccatggccatgactgtggtcaccaaagaaaagaacaagaaagttcccaccatcttcctgagcaagaaaccccgagaaaaggaggtggattctaagagccaggtcattgaaggcatcagccgcctcatctgctcagccaagcagcagcagactatgctgagagtgtccatcgatggggtcgagtggagtgacatcaagttcttccagctggcagcccagtggcccacccatgtcaagcactttccagtgggactcttcagtggcagcaaggccacctgaggccctgtctcccagccactttccctcctggcactgccaccagcctcaccgagtggcgcgatctcggctcactgcagcctctgcctcccgggttcaagcaattntcctgcctcagcctcctgagtagctgggactatagccgcgtgccgccatgcccagctaatttttgtatttttagtagagacaggatttaactatgttggccaggctggtcttgatttcctgacctcgtgatccgtnctcctcaggcttccaaaaatgctgggattataggcatgagccaccacaaccgg

SEQ ID NO: 330680 - DNA, 2437 bp, Homo sapiens
cgccgccgccgccgcgggggaagcctgggagccagatcggcgtcgcctcggcctccgtaacccccgcctagccgggccatggcggaacgcggaggggcgggcggtggtcccggaggcgccgggggcggcagcggccagcggggatccggggtcgcccagtcccctcagcagccgccgccgcagcagcagcagcagcagccgccgcagcagccgacgccccccaagctggcccaggccacctcgtcgtcctcgtccacctcggcggcggctgcctcctcctcgtcctcgtctacctccacctccatggccgtggcggtggcctcgggctccgcgcctcccggtggcccggggccaggccgcacccccgccccggtgcagatgaacctgtacgccacctgggaggtggaccggagctcgtccagctgcgtgcctaggctattcagcttgaccctgaagaaactcgtcatgctaaaagaaatggacaaagatcttaactcagtggtcatcgctgtgaagctgcagggttcaaaaagaattcttcgctccaacgagatcgtccttccagctagtggactggtggaaacagagctccaattaaccttctcccttcagtaccctcatttccttaagcgagatgccaacaagctgcagatcatgctgcaaaggagaaaacgttacaagaatcggaccatcttgggctataagaccttggccgtgggactcatcaacatggcagaggtgatgcagcatcctaatgaaggcgcactggtgcttggcctacacagcaacgtgaaggatgtctctgtgcctgtggcagaaataaagatctactccctgtccagccaacccattgaccatgaaggaatcaaatccaagctttctgatcgttctcctgatattgacaattattctgaggaagaggaagagagtttctcatcagaacaggaaggcagtgatgatccattgcatgggcaggacttgttctacgaagacgaagatctccggaaagtgaagaagacccggaggaaactaacctcaacctctgccatcacaaggcaacctaacatcaaacagaagtttgtggccctcctgaagcggtttaaagtttcagatgaggtgggctttgggctggagcatgtgtcccgcgagcagatccgggaagtggaagaggacttggatgaattgtatgacagtctggagatgtacaaccccagcgacagtggccctgagatggaggagacagaaagcatcctcagcacgccaaagcccaagctcaagcctttctttgaggggatgtcgcagtccagctcccagacggagattggcagcctcaacagcaaaggcagcctcggaaaagacaccaccagccctatggaattggctgctctagaaaaaattaaatctacttggattaaaaaccaagatgacagcttgactgaaacagacactctggaaatcactgaccaggacatgtttggagatgccagcacgagtctggttgtgccggagaaagtcaaaactcccatgaagtccagtaaaacggatctccagggctctgcctcccccagcaaagtggagggggtgcacacaccccggcagaagaggagcacgcccctgaaggagcggcagctctccaagcccctaagtgagaggaccaacagttccgacagcgagcgctccccagatctgggccacagcacgcagattccaagaaaggtggtgtatgaccagctcaatcagatcctggtgtcagatgcagccctcccagaaaatgtcattctggtgaacaccactgactggcagggccagtatgtggctgagctgctccaggaccagcggaagcctgtggtgtgcacctgctccaccgtggaggtccaggccgtgctgtccgccctgctcacccggatccagcgctactgcaactgcaactcttccatgccgaggccagtgaaggtggctgctgtgggaggccagagctacctgagctccatcctcaggttctttgtcaagtccctggccaacaagacctccgactggcttggctacatgcgcttcctcatcatccccctcggttctcaccctgtggccaaatacttggggtcagtcgacagtaaatacagtagttccttcctggattctggttggagagatctgttcagtcgctcggagccaccagtgtcagagcaactggacgtggcagggcgggtgatgcagtacgtcaacggggcagccacgacacttcagaatgaccgggccctgacacacgtgaacgcgtgccagatagagttccacggaagtagactcatatcagaaggttaatacattgagaggcgtgatgaaggtgggtcgcgttgaagactctccctgcacagcaggcgagttgatacgagttgtcacgtgatcagccgatacatcgatgcagatatagtatcacaca

SEQ ID NO: 330681 - DNA, 1767 bp, Homo sapiens
cgccgccgccgccgcgggggaagcctgggagccagatcggcgtcgcctcggcctccgtaacccccgcctagccgggccatggcggaacgcggaggggcgggcggtggtcccggaggcgccgggggcggcagcggccagcggggatccggggtcgcccagtcccctcagcagccgccgccgcagcagcagcagcagcagccgccgcagcagccgacgccccccaagctggcccaggccacctcgtcgtcctcgtccacctcggcggcggctgcctcctcctcgtcctcgtctacctccacctccatggccgtggcggtggcctcgggctccgcgcctcccggtggcccggggccaggccgcacccccgccccggtgcagatgaacctgtacgccacctgggaggtggaccggagctcgtccagctgcgtgcctaggctattcagcttgaccctgaagaaactcgtcatgctaaaagaaatggacaaagatcttaactcagtggtcatcgctgtgaagctgcagggttcaaaaagaattcttcgctccaacgagatcgtccttccagctagtggactggtggaaacagagctccaattaaccttctcccttcagtaccctcatttccttaagcgagatgccaacaagctgcagatcatgctgcaaaggagaaaacgttacaagaatcggaccatcttgggctataagaccttggccgtgggactcatcaacatggcagaggtgatgcagcatcctaatgaaggcgcactggtgcttggcctacacagcaacgtgaaggatgtctctgtgcctgtggcagaaataaagatctactccctgtccagccaacccattgaccatgaaggaatcaaatccaagctttctgatcgttctcctgatattgacaattattctgaggaagaggaagagagtttctcatcagaacaggaaggcagtgatgatccattgcatgggcaggacttgttctacgaagacgaagatctccggaaagtgaagaagacccggaggaaactaacctcaacctctgccatcacaaggcaacctaacatcaaacagaagtttgtggccctcctgaagcggtttaaagtttcagatgaggtgggctttgggctggagcatgtgtcccgcgagcagatccgggaagtggaagaggacttggatgaattgtatgacagtctggagatgtacaaccccagcgacagtggccctgagatggaggagacagaaagcatcctcagcacgccaaagcccaagctcaagcctttctttgaggggatgtcgcagtccagctcccagacggagattggcagcctcaacagcaaaggcagcctcggaaaagacaccaccagccctgtgagcgcaaccgcgactgcggggcggggtgggaccgtggcatgtcagggctcgacgctctggccctctgcatctctgatcagggctcatgttgtgaccttagaaaagtggccccattggctgggcatggtggatcacaactgtaatcctggcactttgggaggtggagtcgggcagatcatgaggtcaagagattgagagcatcctggccaacatggtgacaccccatctctactaaaaatacaaaaattacctgggcgtgatggtgtgcacctgtagtcccagctactcaggaggatgaggcaggagaatcacttgaagccgggaggcggaggttgcagtgagccaagattgagccactgcactccagcctggcgacagagcgagattccctca

SEQ ID NO: 330682 - DNA, 1921 bp, Homo sapiens
agacgtggtattgagtggcatgtgaaggcttgcaggagaggcagcgcttggcatccttgccctacaggtatagccccagaggagtggatggccatccagagcttgctgtcactggcctcagtcttgggttccccaagccctgtgcccagacgacctcacatagagaggcttggggacccagctgtgtggccctgcgcaaactctctgagcctagaaaatgaaaatcatacctgccttctaaatgaggtgatagcggggctggtgagaggaaaggccaggagaagcaaatcatacctagtgtgacctggatctagggtgtgagtgtggctgcagagcagggtgaagtgcccacgaggacttcccggagcacagccaggcgagggctgcagggcaggagctgtgcagagctgggggccagggagttccagtggagggggtgggacaagtagacttggatcccagcttctggcccccttaggttctggcttagagctaggagagagggtgaagggtgaactctcagcccgtctgcatctgacaccatatcctcagcctccccttctgtggcaataaatgccccaccctgctcccatcctcggggcccatccctcttcactccttgagggcttttctcctacagtcgccctctctcctgcactgcgggttctcccctctgccaggactttccacccacttacatgcatcccaagtgggtatagctcaatatcaaagaccagagacttccagattctcttcagctgccatgccttgtctctgctccccttagagcaaaactcttccaaagagctgtgtgtgttccccgtctccacttctgcccactcccttccagttttttcctcacaatcccaccaaaagtttcctttccacagttgccagtgacctgggttgcccagtcctatcagtagcattggatgcaaataatcacccgcttgagtctttccacctggcctgtggacagctctgtgctctcctctcacctccctggcctctcctttttggcctcccttgctatggtgtcctcagcttcccagcctcaaaaccctggaggactcggggctccagcctctaatatagcctcctctctccccacactcagccctaaagggagctcactcggccccatggtgtgaaatgtgctcccctggggagacttccctcctagtaaatgcaaactcggttcttcagttccgaggccgaaaactggggaatcctcctcgattcctgtttctcttgtacccaccatctaatccatgagcaaatcctccaggcttatcctgacagtgccttgccccttcctctactgcgattatctcttgtctggatattgcaataggctcctaattatccctgctcccaccctcttctccctgtagcctgttctccactcaatagccagagatttttcagagctgagcagatcgtgttggattgctgatccaaactgtgcagagtgtcccacctacctaggtgtgtaagctgaagccttacctgtgaggggcccacatggtctgatctcccaggagctgctggatcttaattcctcttacgcttcccctcctcactggcctctcaacattcctcaaacaccactcagcctcagggcctttgcacggacctttggtcctgtccatcctgctgctgccctcaggcccgtgtggcttgctccatcattcaggtcttggctgaaatgtcacctcaggaggccttcccttctccaacccctcttttttttttttcttactcatatttcccactccttggcattaattattcatttgtctctcccacaagaatgcaagctccaagaaaagaggaaatgtttttccctgttgtatccttggcacccaaaatactgcttggcccatcacaggtgcacaataaatactcgtttgcagaatga

SEQ ID NO: 330683 - DNA, 358 bp, Homo sapiens
ggttagaggaatcttgagtcttccttgctttctcacattttccttctccacatgctatattccttcataggaacccaaaaggatatgagtggtttttaccaccacctccccagcactccttccttgcccaaggcctcccacccataggagcctgagttcatcagtttcctttcctgcccttcagtataaagcagcccatcctcatagctggaactcagacgtgggaagcagggagcgtagcttgcatgatcaggtcatttgccctcattttgtgagctccacatgcacagcaagtcccagaccttccccatgccaccccaggatgtgatgggcagaggcagcccagcatcctggactc

SEQ ID NO: 330684 - DNA, 4434 bp, Homo sapiens
cgccgccgccgccgcgggggaagcctgggagccagatcggcgtcgcctcggcctccgtaacccccgcctagccgggccatggcggaacgcggaggggcgggcggtggtcccggaggcgccgggggcggcagcggccagcggggatccggggtcgcccagtcccctcagcagccgccgccgcagcagcagcagcagcagccgccgcagcagccgacgccccccaagctggcccaggccacctcgtcgtcctcgtccacctcggcggcggctgcctcctcctcgtcctcgtctacctccacctccatggccgtggcggtggcctcgggctccgcgcctcccggtggcccggggccaggccgcacccccgccccggtgcagatgaacctgtacgccacctgggaggtggaccggagctcgtccagctgcgtgcctaggctattcagcttgaccctgaagaaactcgtcatgctaaaagaaatggacaaagatcttaactcagtggtcatcgctgtgaagctgcagggttcaaaaagaattcttcgctccaacgagatcgtccttccagctagtggactggtggaaacagagctccaattaaccttctcccttcagtaccctcatttccttaagcgagatgccaacaagctgcagatcatgctgcaaaggagaaaacgttacaagaatcggaccatcttgggctataagaccttggccgtgggactcatcaacatggcagaggtgatgcagcatcctaatgaaggcgcactggtgcttggcctacacagcaacgtgaaggatgtctctgtgcctgtggcagaaataaagatctactccctgtccagccaacccattgaccatgaaggaatcaaatccaagctttctgatcgttctcctgatattgacaattattctgaggaagaggaagagagtttctcatcagaacaggaaggcagtgatgatccattgcatgggcaggacttgttctacgaagacgaagatctccggaaagtgaagaagacccggaggaaactaacctcaacctctgccatcacaaggcaacctaacatcaaacagaagtttgtggccctcctgaagcggtttaaagtttcagatgaggtgggctttgggctggagcatgtgtcccgcgagcagatccgggaagtggaagaggacttggatgaattgtatgacagtctggagatgtacaaccccagcgacagtggccctgagatggaggagacagaaagcatcctcagcacgccaaagcccaagctcaagcctttctttgaggggatgtcgcagtccagctcccagacggagattggcagcctcaacagcaaaggcagcctcggaaaagacaccaccagccctatggaattggctgctctagaaaaaattaaatctacttggattaaaaaccaagatgacagcttgactgaaacagacactctggaaatcactgaccaggacatgtttggagatgccagcacgagtctggttgtgccggagaaagtcaaaactcccatgaagtccagtaaaacggatctccagggctctgcctcccccagcaaagtggagggggtgcacacaccccggcagaagaggagcacgcccctgaaggagcggcagctctccaagcccctaagtgagaggaccaacagttccgacagcgagcgctccccagatctgggccacagcacgcagattccaagaaaggtggtgtatgaccagctcaatcagatcctggtgtcagatgcagccctcccagaaaatgtcattctggtgaacaccactgactggcagggccagtatgtggctgagctgctccaggaccagcggaagcctgtggtgtgcacctgctccaccgtggaggtccaggccgtgctgtccgccctgctcacccggatccagcgctactgcaactgcaactcttccatgccgaggccagtgaaggtggctgctgtgggaggccagagctacctgagctccatcctcaggttctttgtcaagtccctggccaacaagacctccgactggcttggctacatgcgcttcctcatcatccccctcggttctcaccctgtggccaaatacttggggtcagtcgacagtaaatacagtagttccttcctggattctggttggagagatctgttcagtcgctcggagccaccagtgtcagagcaactggacgtggcagggcgggtgatgcagtacgtcaacggggcagccacgacacaccagcttcccgtggccgaagccatgctgacttgccggcataagttccctgatgaagactcctatcagaagtttattcccttcattggcgtggtgaaggtgggtctggttgaagactctccctccacagcaggcgatggggacgattctcctgtggtcagccttactgtgccctccacatcaccaccctccagctcgggcctgagccgagacgccacggccacccctccctcctccccatctatgagcagcgccctggccatcgtggggagccctaatagcccatatggggacgtgattggcctccaggtggactactggctgggccaccccggggagcggaggagggaaggcgacaagagggacgccagctcgaagaacaccctcaagagtgtcttccgctcagtgcaggtgtcccgcctgccccatagtggggaggcccagctttctggcaccatggccatgactgtggtcaccaaagaaaagaacaagaaagttcccaccatcttcctgagcaagaaaccccgagaaaaggaggtggattctaagagccaggtcattgaaggcatcagccgcctcatctgctcagccaagcagcagcagactatgctgagagtgtccatcgatggggtcgagtggagtgacatcaagttcttccagctggcagcccagtggcccacccatgtcaagcactttccagtgggactcttcagtggcagcaaggccacctgaggccctgtctcccagccactttccctcctggcactgccaccagcctcaccgcctgcgggcagggggaggccagcaggcccgggcccagcaccccttccctggcaccagggtctgcctctcactcgcccaggtcccgaaggacactgccacagggacgccttccctcccctcccctccagcccacccctgcacagcccctcctccttcccgcttttccccttctccctcctgctccaggcccaaggcgtgttggttttgccttctggtgcccatagtcccctggactgagtcccccaggccttccttcacccgacttccaaactcttccttgtggtatcagtttccttctcggaaatgagaaagctggaatcctggtccccagcaggagagcctagtcctcccccagcccctccagccaccagggtgtcctctaggatgcagctgccagatccactcactctgctgcctccagcaggacccaaggccactttcaactcttatggggttctccacctgccccagagcttctcaagggagggtaagggggcaccctgagcccacaggacccctacttcacagctcacaggggcaggaggcagctcccctgcctccaggaccctgttgctatggtgacacagcgtttctaggacagaggggcctcccagtctccccccaccacccgtgcacgacttcctcaccacccccaggttccctgcagatgtcgtgtgtgtcctgagtgtttctttggttctttgcacgccaagtctcttggttgtaccatgtgacacaccctgtgcactggtcgctgtcttcgtggcttccacccttgttaatgatgctcctgcctctgcctcccagcccctcacccagcacagctctgcctggacttggagagatgggaggcagacccccaccaccatacatgctgtctgtggcccctcagacattctgtttcatctcccattcatctccctcctcccaccgtgtcagtttttctgcctttccctgctctgttcttccccctccttaggccccagcctgggcccagacccatcctcccagccaggtttccctccagcaggctccttccctccctgtcacctccctctcaccaacccggggtctgagcccctcattcctgaccgtccgtgttctcaggagtggttgaggacacagggccccagcccagccctctgcaccccccagcccggccatctgcgccccacagcccctttggagcttttctcttgtcctctcactccttcccagaagtttttgcacagaacttcattttgaaagtgtttttctcattctccatacctcccccaagctctcctccagcccttcccagggctcagccctgctgtcctgagcgtctcctgggccagagagaggagatgggggtgggagggactgagttgatgttgggtttttcattcaataaattggtgatttcttaccgac

SEQ ID NO: 330685 - DNA, 4471 bp, Homo sapiens
cgccgccgccgccgcgggggaagcctgggagccagatcggcgtcgcctcggcctccgtaacccccgcctagccgggccatggcggaacgcggaggggcgggcggtggtcccggaggcgccgggggcggcagcggccagcggggatccggggtcgcccagtcccctcagcagccgccgccgcagcagcagcagcagcagccgccgcagcagccgacgccccccaagctggcccaggccacctcgtcgtcctcgtccacctcggcggcggctgcctcctcctcgtcctcgtctacctccacctccatggccgtggcggtggcctcgggctccgcgcctcccggtggcccggggccaggccgcacccccgccccggtgcagatgaacctgtacgccacctgggaggtggaccggagctcgtccagctgcgtgcctaggctattcagcttgaccctgaagaaactcgtcatgctaaaagaaatggacaaagatcttaactcagtggtcatcgctgtgaagctgcagggttcaaaaagaattcttcgctccaacgagatcgtccttccagctagtggactggtggaaacagagctccaattaaccttctcccttcagtaccctcatttccttaagcgagatgccaacaagctgcagatcatgctgcaaaggagaaaacgttacaagaatcggaccatcttgggctataagaccttggccgtgggactcatcaacatggcagaggtgatgcagcatcctaatgaaggcgcactggtgcttggcctacacagcaacgtgaaggatgtctctgtgcctgtggcagaaataaagatctactccctgtccagccaacccattgaccatgaaggaatcaaatccaagctttctgatcgttctcctgatattgacaattattctgaggaagaggaagagagtttctcatcagaacaggaaggcagtgatgatccattgcatgggcaggacttgttctacgaagacgaagatctccggaaagtgaagaagacccggaggaaactaacctcaacctctgccatcacaaggcaacctaacatcaaacagaagtttgtggccctcctgaagcggtttaaagtttcagatgaggtgggctttgggctggagcatgtgtcccgcgagcagatccgggaagtggaagaggacttggatgaattgtatgacagtctggagatgtacaaccccagcgacagtggccctgagatggaggagacagaaagcatcctcagcacgccaaagcccaagctcaagcctttctttgaggggatgtcgcagtccagctcccagacggagattggcagcctcaacagcaaaggcagcctcggaaaagacaccaccagccctatggaattggctgctctagaaaaaattaaatctacttggattaaaaaccaagatgacagcttgactgaaacagacactctggaaatcactgaccaggacatgtttggagatgccagcacgagtctggttgtgccggagaaagtcaaaactcccatgaagtccagtaaaacggatctccagggctctgcctcccccagcaaagtggagggggtgcacacaccccggcagaagaggagcacgcccctgaaggagcggcagctctccaagcccctaagtgagaggaccaacagttccgacagcgagcgctccccagatctgggccacagcacgcagattccaagaaaggtggtgtatgaccagctcaatcagatcctggtgtcagatgcagccctcccagaaaatgtcattctggtgaacaccactgactggcagggccagtatgtggctgagctgctccaggaccagcggaagcctgtggtgtgcacctgctccaccgtggaggtccaggccgtgctgtccgccctgctcacccggatccagcgctactgcaactgcaactcttccatgccgaggccagtgaaggtggctgctgtgggaggccagagctacctgagctccatcctcaggttctttgtcaagtccctggccaacaagacctccgactggcttggctacatgcgcttcctcatcatccccctcggttctcaccctgtggccaaatacttggggtcagtcgacagtaaatacagtagttccttcctggattctggttggagagatctgttcagtcgctcggagccaccagtgtcagagcaactggacgtggcagggcgggtgatgcagtacgtcaacggggcagccacgacacaccagcttcccgtggccgaagccatgctgacttgccggcataagttccctgatgaagactcctatcagaagtttattcccttcattggcgtggtgaaggtgggtctggttgaagactctccctccacagcaggcgatggggacgattctcctgtggtcagccttactgtgccctccacatcaccaccctccagctcgggcctgagccgagacgccacggccacccctccctcctccccatctatgagcagcgccctggccatcgtggggagccctaatagcccatatggggacgtgattggcctccaggtggactactggctgggccaccccggggagcggaggagggaaggcgacaagagggacgccagctcgaagaacaccctcaagagtgtcttccgctcagtgcaggtgtcccgcctgccccatagtggggaggcccagctttctggcaccatggccatgactgtggtcaccaaagaaaagaacaagaaagttcccaccatcttcctgagcaagaaaccccgagaaaaggaggtggattctaagagccaggtcattgaaggcatcagccgcctcatctgctcagccaagcagcagcagactatgctgagagtgtccatcgatggggtcgagtggagtgacatcaagttcttccagctggcagcccagtggcccacccatgtcaagcactttccagtgggactcttcagtggcagcaaggccacctgaggccctgtctcccagccactttccctcctggcactgccaccagcctcaccgcctgcgggcagggggaggccagcaggcccgggcccagcaccccttccctggcaccagggtctgcctctcactcgcccaggtcccgaaggacactgccacagggacgccttccctcccctcccctccagcccacccctgcacagcccctcctccttcccgcttttccccttctccctcctgctccaggcccaaggcgtgttggttttgccttctggtgcccatagtcccctggactgagtcccccaggccttccttcacccgacttccaaactcttccttgtggtatcagtttccttctcggaaatgagaaagctggaatcctggtccccagcaggagagcctagtcctcccccagcccctccagccaccagggtgtcctctaggatgcagctgccagatccactcactctgctgcctccagcaggacccaaggccactttcaactcttatggggttctccacctgccccagagcttctcaagggagggtaagggggcaccctgagcccacaggacccctacttcacagctcacaggggcaggaggcagctcccctgcctccaggaccctgttgctatggtgacacagcgtttctaggacagaggggcctcccagtctccccccaccacccgtgcacgacttcctcaccacccccaggttccctgcagatgtcgtgtgtgtcctgagtgtttctttggttctttgcacgccaagtctcttggttgtaccatgtgacacaccctgtgcactggtcgctgtcttcgtggcttccacccttgttaatgatgctcctgcctctgcctcccagcccctcacccagcacagctctgcctggacttggagagatgggaggcagacccccaccaccatacatgctgtctgtggcccctcagacattctgtttcatctcccattcatctccctcctcccaccgtgtcagtttttctgcctttccctgctctgttcttccccctccttaggccccagcctgggcccagacccatcctcccagccaggtttccctccagcaggctccttccctccctgtcacctccctctcaccaacccggggtctgagcccctcattcctgaccgtccgtgttctcaggagtggttgaggacacagggccccagcccagccctctgcaccccccagcccggccatctgcgccccacagcccctttggagcttttctcttgtcctctcactccttcccagaagtttttgcacagaacttcattttgaaagtgtttttctcattctccatacctcccccaagctctcctccagcccttcccagggctcagccctgctgtcctgagcgtctcctgggccagagagaggagatgggggtgggagggactgagttgatgttgggtttttcattcaataaattggtgatttcttaccgacaccaataaaaaagaataactcaagactagttctctcc

SEQ ID NO: 330686 - DNA, 6489 bp, Homo sapiens
cgccgccgccgccgcgggggaagcctgggagccagatcggcgtcgcctcggcctccgtaacccccgcctagccgggccatggcggaacgcggaggggcgggcggtggtcccggaggcgccgggggcggcagcggccagcggggatccggggtcgcccagtcccctcagcagccgccgccgcagcagcagcagcagcagccgccgcagcagccgacgccccccaagctggcccaggccacctcgtcgtcctcgtccacctcggcggcggctgcctcctcctcgtcctcgtctacctccacctccatggccgtggcggtggcctcgggctccgcgcctcccggtggcccggggccaggccgcacccccgccccggtgcagatgaacctgtacgccacctgggaggtggaccggagctcgtccagctgcgtgcctaggctattcagcttgaccctgaagaaactcgtcatgctaaaagaaatggacaaagatcttaactcagtggtcatcgctgtgaagctgcagggttcaaaaagaattcttcgctccaacgagatcgtccttccagctagtggactggtggaaacagagctccaattaaccttctcccttcagtaccctcatttccttaagcgagatgccaacaagctgcagatcatgctgcaaaggagaaaacgttacaagaatcggaccatcttgggctataagaccttggccgtgggactcatcaacatggcagaggtgatgcagcatcctaatgaaggcgcactggtgcttggcctacacagcaacgtgaaggatgtctctgtgcctgtggcagaaataaagatctactccctgtccagccaacccattgaccatgaaggaatcaaatccaagctttctgatcgttctcctgatattgacaattattctgaggaagaggaagagagtttctcatcagaacaggaaggcagtgatgatccattgcatgggcaggacttgttctacgaagacgaagatctccggaaagtgaagaagacccggaggaaactaacctcaacctctgccatcacaaggcaacctaacatcaaacagaagtttgtggccctcctgaagcggtttaaagtttcagatgaggtgggctttgggctggagcatgtgtcccgcgagcagatccgggaagtggaagaggacttggatgaattgtatgacagtctggagatgtacaaccccagcgacagtggccctgagatggaggagacagaaagcatcctcagcacgccaaagcccaagctcaagcctttctttgaggggatgtcgcagtccagctcccagacggagattggcagcctcaacagcaaaggcagcctcggaaaagacaccaccagccctatggaattggctgctctagaaaaaattaaatctacttggattaaaaaccaagatgacagcttgactgaaacagacactctggaaatcactgaccaggacatgtttggagatgccagcacgagtctggttgtgccggagaaagtcaaaactcccatgaagtccagtaaaacggatctccagggctctgcctcccccagcaaagtggagggggtgcacacaccccggcagaagaggagcacgcccctgaaggagcggcagctctccaagcccctaagtgagaggaccaacagttccgacagcgagcgctccccagatctgggccacagcacgcagattccaagaaaggtggtgtatgaccagctcaatcagatcctggtgtcagatgcagccctcccagaaaatgtcattctggtgaacaccactgactggcagggccagtatgtggctgagctgctccaggaccagcggaagcctgtggtgtgcacctgctccaccgtggaggtccaggccgtgctgtccgccctgctcacccggatccagcgctactgcaactgcaactcttccatgccgaggccagtgaaggtggctgctgtgggaggccagagctacctgagctccatcctcaggttctttgtcaagtccctggccaacaagacctccgactggcttggctacatgcgcttcctcatcatccccctcggttctcaccctgtggccaaatacttggggtcagtcgacagtaaatacagtagttccttcctggattctggttggagagatctgttcagtcgctcggagccaccagtgtcagagcaactggacgtggcagggcgggtgatgcagtacgtcaacggggcagccacgacacaccagcttcccgtggccgaagccatgctgacttgccggcataagttccctgatgaagactcctatcagaagtttattcccttcattggcgtggtgaaggtgggtctggttgaagactctccctccacagcaggcgatggggacgattctcctgtggtcagccttactgtgccctccacatcaccaccctccagctcgggcctgagccgagacgccacggccacccctccctcctccccatctatgagcagcgccctggccatcgtggggagccctaatagcccatatggggacgtgattggcctccaggtggactactggctgggccaccccggggagcggaggagggaaggcgacaagagggacgccagctcgaagaacaccctcaagagtgtcttccgctcagtgcaggtgtcccgcctgccccatagtggggaggcccagctttctggcaccatggccatgactgtggtcaccaaagaaaagaacaagaaagttcccaccatcttcctgagcaagaaaccccgagaaaaggaggtggattctaagagccaggtcattgaaggcatcagccgcctcatctgctcagccaagcagcagcagactatgctgagagtgtccatcgatggggtcgagtggagtgacatcaagttcttccagctggcagcccagtggcccacccatgtcaagcactttccagtgggactcttcagtggcagcaaggccacctgaggccctgtctcccagccactttccctcctggcactgccaccagcctcaccgcctgcgggcagggggaggccagcaggcccgggcccagcaccccttccctggcaccagggtctgcctctcactcgcccaggtcccgaaggacactgccacagggacgccttccctcccctcccctccagcccacccctgcacagcccctcctccttcccgcttttccccttctccctcctgctccaggcccaaggcgtgttggttttgccttctggtgcccatagtcccctggactgagtcccccaggccttccttcacccgacttccaaactcttccttgtggtatcagtttccttctcggaaatgagaaagctggaatcctggtccccagcaggagagcctagtcctcccccagcccctccagccaccagggtgtcctctaggatgcagctgccagatccactcactctgctgcctccagcaggacccaaggccactttcaactcttatggggttctccacctgccccagagcttctcaagggagggtaagggggcaccctgagcccacaggacccctacttcacagctcacaggggcaggaggcagctcccctgcctccaggaccctgttgctatggtgacacagcgtttctaggacagaggggcctcccagtctccccccaccacccgtgcacgacttcctcaccacccccaggttccctgcagatgtcgtgtgtgtcctgagtgtttctttggttctttgcacgccaagtctcttggttgtaccatgtgacacaccctgtgcactggtcgctgtcttcgtggcttccacccttgttaatgatgctcctgcctctgcctcccagcccctcacccagcacagctctgcctggacttggagagatgggaggcagacccccaccaccatacatgctgtctgtggcccctcagacattctgtttcatctcccattcatctccctcctcccaccgtgtcagtttttctgcctttccctgctctgttcttccccctccttaggccccagcctgggcccagacccatcctcccagccaggtttccctccagcaggctccttccctccctgtcacctccctctcaccaacccggggtctgagcccctcattcctgaccgtccgtgttctcaggagtggttgaggacacagggccccagcccagccctctgcaccccccagcccggccatctgcgccccacagcccctttggagcttttctcttgtcctctcactccttcccagaagtttttgcacagaacttcattttgaaagtgtttttctcattctccatacctcccccaagctctcctccagcccttcccagggctcagccctgctgtcctgagcgtctcctgggccagagagaggagatgggggtgggagggactgagttgatgttgggtttttcattcaataaattggtgatttcttaccgactgccttgggcttctatgccccctcactgtgccacaggagctgcccaaccccttttccacagtgcagcccaactccagtgaaaatccaccaggaacgtaggtggaaagaagcgtactcccatgttctcaatcatggaaacaggcatgaaggtgtctcacctggcatgaggcaggcagaggtcggaaacaggaaagatgtcttttccacaccaaaagcccgtttttccccaggacccaccatccccaaatccacctcccaaggcagtgacgtgttgagtgtggcttccccatcttctgatcaaaggtcagaacttagcttctctcccctgctccaggttggtgaagtccgagccagtggggtctttgcctcttctaaatgaggtgatagcggggctggtgagaggaaaggccaggagaagcaaatcatacctagtgtgacctggatctagggtgtgagtgtggctgcagagcagggtgaagtgcccacgaggacttcccggagcacagccaggcgagggctgcagggcaggagctgtgcagagctgggggccagggagttccagtggagggggtgggacaagtagacttggatcccagcttctggcccccttaggttctggcttagagctaggagagagggtgaagggtgaactctcagcccgtctgcatctgacaccatatcctcagcctccccttctgtggcaataaatgccccaccctgctcccatcctcggggcccatccctcttcactccttgagggcttttctcctacagtcgccctctctcctgcactgcgggttctcccctctgccaggactttccacccacttacatgcatcccaagtgggtatagctcaatatcaaagaccagagacttccagattctcttcagctgccatgccttgtctctgctccccttagagcaaaactcttccaaagagctgtgtgtgttccccgtctccacttctgcccactcccttccagttttttcctcacaatcccaccaaaagtttcctttccacagttgccagtgacctgggttgcccagtcctatcagtagcattggatgcaaataatcacccgcttgagtctttccacctggcctgtggacagctctgtgctctcctctcacctccctggcctctcctttttggcctcccttgctatggtgtcctcagcttcccagcctcaaaaccctggaggactcggggctccagcctctaatatagcctcctctctccccacactcagccctaaagggagctcactcggccccatggtgtgaaatgtgctcccctggggagacttccctcctagtaaatgcaaactcggttcttcagttccgaggccgaaaactggggaatcctcctcgattcctgtttctcttgtacccaccatctaatccatgagcaaatcctccaggcttatcctgacagtgccttgccccttcctctactgcgattatctcttgtctggatattgcaataggctcctaattatccctgctcccaccctcttctccctgtagcctgttctccactcaatagccagagatttttcagagctgagcagatcgtgttggattgctgatccaaactgtgcagagtgtcccacctacctaggtgtgtaagctgaagccttacctgtgaggggcccacatggtctgatctcccaggagctgctggatcttaattcctcttacgcttcccctcctcactggcctctcaacattcctcaaacaccactcagcctcagggcctttgcacggacctttggtcctgtccatcctgctgctgccctcaggcccgtgtggcttgctccatcattcaggtcttggctgaaatgtcacctcaggaggccttcccttctccaacccctcttttttttttttcttactcatatttcccactccttggcattaattattcatttgtctctcccacaagaatgcaagctccaagaaaagaggaaatgtttttccctgttgtatccttggcacccaaaatactgcttggcccatcacaggtgcacaataaatactcgtttgcagaatga

SEQ ID NO: 330687 - DNA, 4039 bp, Homo sapiens
cgccgccgccgccgcgggggaagcctgggagccagatcggcgtcgcctcggcctccgtaacccccgcctagccgggccatggcggaacgcggaggggcgggcggtggtcccggaggcgccgggggcggcagcggccagcggggatccggggtcgcccagtcccctcagcagccgccgccgcagcagcagcagcagcagccgccgcagcagccgacgccccccaagctggcccaggccacctcgtcgtcctcgtccacctcggcggcggctgcctcctcctcgtcctcgtctacctccacctccatggccgtggcggtggcctcgggctccgcgcctcccggtggcccggggccaggccgcacccccgccccggtgcagatgaacctgtacgccacctgggaggtggaccggagctcgtccagctgcgtgcctaggctattcagcttgaccctgaagaaactcgtcatgctaaaagaaatggacaaagatcttaactcagtggtcatcgctgtgaagctgcagggttcaaaaagaattcttcgctccaacgagatcgtccttccagctagtggactggtggaaacagagctccaattaaccttctcccttcagtaccctcatttccttaagcgagatgccaacaagctgcagatcatgctgcaaaggagaaaacgttacaagaatcggaccatcttgggctataagaccttggccgtgggactcatcaacatggcagaggtgatgcagcatcctaatgaaggcgcactggtgcttggcctacacagcaacgtgaaggatgtctctgtgcctgtggcagaaataaagatctactccctgtccagccaacccattgaccatgaaggaatcaaatccaagctttctgatcgttctcctgatattgacaattattctgaggaagaggaagagagtttctcatcagaacaggaaggcagtgatgatccattgcatgggcaggacttgttctacgaagacgaagatctccggaaagtgaagaagacccggaggaaactaacctcaacctctgccatcacaaggcaacctaacatcaaacagaagtttgtggccctcctgaagcggtttaaagtttcagatgaggtgggctttgggctggagcatgtgtcccgcgagcagatccgggaagtggaagaggacttggatgaattgtatgacagtctggagatgtacaaccccagcgacagtggccctgagatggaggagacagaaagcatcctcagcacgccaaagcccaagctcaagcctttctttgaggggatgtcgcagtccagctcccagacggagattggcagcctcaacagcaaaggcagcctcggaaaagacaccaccagccctatggaattggctgctctagaaaaaattaaatctacttggattaaaaaccaagatgacagcttgactgaaacagacactctggaaatcactgaccaggacatgtttggagatgccagcacgagtctggttgtgccggagaaagtcaaaactcccatgaagtccagtaaaacggatctccagggctctgcctcccccagcaaagtggagggggtgcacacaccccggcagaagaggagcacgcccctgaaggagcggcagctctccaagcccctaagtgagaggaccaacagttccgacagcgagcgctccccagatctgggccacagcacgcagattccaagaaaggtggtgtatgaccagctcaatcagatcctggtgtcagatgcagccctcccagaaaatgtcattctggtgaacaccactgactggcagggccagtatgtggctgagctgctccaggaccagcggaagcctgtggtgtgcacctgctccaccgtggaggtccaggccgtgctgtccgccctgctcacccggatccagcgctactgcaactgcaactcttccatgccgaggccagtgaaggtggctgctgtgggaggccagagctacctgagctccatcctcaggttctttgtcaagtccctggccaacaagacctccgactggcttggctacatgcgcttcctcatcatccccctcggttctcaccctgtggccaaatacttggggtcagtcgacagtaaatacagtagttccttcctggattctggttggagagatctgttcagtcgctcggagccaccagtgtcagagcaactggacgtggcagggcgggtgatgcagtacgtcaacggggcagccacgacacaccagcttcccgtggccgaagccatgctgacttgccggcataagttccctgatgaagactcctatcagaagtttattcccttcattggcgtggtgaaggtgggtctggttgaagactctccctccacagcaggcgatggggacgattctcctgtggtcagccttactgtgccctccacatcaccaccctccagctcgggcctgagccgagacgccacggccacccctccctcctccccatctatgagcagcgccctggccatcgtggggagccctaatagcccatatggggacgtgattggcctccaggtggactactggctgggccaccccggggagcggaggagggaaggcgacaagagggacgccagctcgaagaacaccctcaagagtgtcttccgctcagtgcaggtgtcccgcctgccccatagtggggaggcccagctttctggcaccatggccatgactgtggtcaccaaagaaaagaacaagaaagttccctcccctcccctccagcccacccctgcacagcccctcctccttcccgcttttccccttctccctcctgctccaggcccaaggcgtgttggttttgccttctggtgcccatagtcccctggactgagtcccccaggccttccttcacccgacttccaaactcttccttgtggtatcagtttccttctcggaaatgagaaagctggaatcctggtccccagcaggagagcctagtcctcccccagcccctccagccaccagggtgtcctctaggatgcagctgccagatccactcactctgctgcctccagcaggacccaaggccactttcaactcttatggggttctccacctgccccagagcttctcaagggagggtaagggggcaccctgagcccacaggacccctacttcacagctcacaggggcaggaggcagctcccctgcctccaggaccctgttgctatggtgacacagcgtttctaggacagaggggcctcccagtctccccccaccacccgtgcacgacttcctcaccacccccaggttccctgcagatgtcgtgtgtgtcctgagtgtttctttggttctttgcacgccaagtctcttggttgtaccatgtgacacaccctgtgcactggtcgctgtcttcgtggcttccacccttgttaatgatgctcctgcctctgcctcccagcccctcacccagcacagctctgcctggacttggagagatgggaggcagacccccaccaccatacatgctgtctgtggcccctcagacattctgtttcatctcccattcatctccctcctcccaccgtgtcagtttttctgcctttccctgctctgttcttccccctccttaggccccagcctgggcccagacccatcctcccagccaggtttccctccagcaggctccttccctccctgtcacctccctctcaccaacccggggtctgagcccctcattcctgaccgtccgtgttctcaggagtggttgaggacacagggccccagcccagccctctgcaccccccagcccggccatctgcgccccacagcccctttggagcttttctcttgtcctctcactccttcccagaagtttttgcacagaacttcattttgaaagtgtttttctcattctccatacctcccccaagctctcctccagcccttcccagggctcagccctgctgtcctgagcgtctcctgggccagagagaggagatgggggtgggagggactgagttgatgttgggtttttcattcaataaattggtgatttcttaccgac

SEQ ID NO: 330688 - DNA, 3799 bp, Homo sapiens
cgccgccgccgccgcgggggaagcctgggagccagatcggcgtcgcctcggcctccgtaacccccgcctagccgggccatggcggaacgcggaggggcgggcggtggtcccggaggcgccgggggcggcagcggccagcggggatccggggtcgcccagtcccctcagcagccgccgccgcagcagcagcagcagcagccgccgcagcagccgacgccccccaagctggcccaggccacctcgtcgtcctcgtccacctcggcggcggctgcctcctcctcgtcctcgtctacctccacctccatggccgtggcggtggcctcgggctccgcgcctcccggtggcccggggccaggccgcacccccgccccggtgcagatgaacctgtacgccacctgggaggtggaccggagctcgtccagctgcgtgcctaggctattcagcttgaccctgaagaaactcgtcatgctaaaagaaatggacaaagatcttaactcagtggtcatcgctgtgaagctgcagggttcaaaaagaattcttcgctccaacgagatcgtccttccagctagtggactggtggaaacagagctccaattaaccttctcccttcagtaccctcatttccttaagcgagatgccaacaagctgcagatcatgctgcaaaggagaaaacgttacaagaatcggaccatcttgggctataagaccttggccgtgggactcatcaacatggcagaggtgatgcagcatcctaatgaaggcgcactggtgcttggcctacacagcaacgtgaaggatgtctctgtgcctgtggcagaaataaagatctactccctgtccagccaacccattgaccatgaaggaatcaaatccaagctttctgatcgttctcctgatattgacaattattctgaggaagaggaagagagtttctcatcagaacaggaaggcagtgatgatccattgcatgggcaggacttgttctacgaagacgaagatctccggaaagtgaagaagacccggaggaaactaacctcaacctctgccatcacaaggcaacctaacatcaaacagaagtttgtggccctcctgaagcggtttaaagtttcagatgaggtgggctttgggctggagcatgtgtcccgcgagcagatccgggaagtggaagaggacttggatgaattgtatgacagtctggagatgtacaaccccagcgacagtggccctgagatggaggagacagaaagcatcctcagcacgccaaagcccaagctcaagcctttctttgaggggatgtcgcagtccagctcccagacggagattggcagcctcaacagcaaaggcagcctcggaaaagacaccaccagccctatggaattggctgctctagaaaaaattaaatctacttggattaaaaaccaagatgacagcttgactgaaacagacactctggaaatcactgaccaggacatgtttggagatgccagcacgagtctggttgtgccggagaaagtcaaaactcccatgaagtccagtaaaacggatctccagggctctgcctcccccagcaaagtggagggggtgcacacaccccggcagaagaggagcacgcccctgaaggagcggcagctctccaagcccctaagtgagaggaccaacagttccgacagcgagcgctccccagatctgggccacagcacgcagattccaagaaaggtggtgtatgaccagctcaatcagatcctggtgtcagatgcagccctcccagaaaatgtcattctggtgaacaccactgactggcagggccagtatgtggctgagctgctccaggaccagcggaagcctgtggtgtgcacctgctccaccgtggaggtccaggccgtgctgtccgccctgctcacccggatccagcgctactgcaactgcaactcttccatgccgaggccagtgaaggtggctgctgtgggaggccagagctacctgagctccatcctcaggttctttgtcaagtccctggccaacaagacctccgactggcttggctacatgcgcttcctcatcatccccctcggttctcaccctgtggccaaatacttggggtcagtcgacagtaaatacagtagttccttcctggattctggttggagagatctgttcagtcgctcggagccaccagtgtcagagcaactggacgtggcagggcgggtgatgcagtacgtcaacggggcagccacgacacaccagcttcccgtggccgaagccatgctgacttgccggcataagttccctgatgaagactcctatcagaagtttattcccttcattggcgtggtgaaggtgggtctggttgaagactctccctccacagcaggcgatggggacgattctcctgtggtcagccttactgtgccctccacatcaccacccccttccctggcaccagggtctgcctctcactcgcccaggtcccgaaggacactgccacagggacgccttccctcccctcccctccagcccacccctgcacagcccctcctccttcccgcttttccccttctccctcctgctccaggcccaaggcgtgttggttttgccttctggtgcccatagtcccctggactgagtcccccaggccttccttcacccgacttccaaactcttccttgtggtatcagtttccttctcggaaatgagaaagctggaatcctggtccccagcaggagagcctagtcctcccccagcccctccagccaccagggtgtcctctaggatgcagctgccagatccactcactctgctgcctccagcaggacccaaggccactttcaactcttatggggttctccacctgccccagagcttctcaagggagggtaagggggcaccctgagcccacaggacccctacttcacagctcacaggggcaggaggcagctcccctgcctccaggaccctgttgctatggtgacacagcgtttctaggacagaggggcctcccagtctccccccaccacccgtgcacgacttcctcaccacccccaggttccctgcagatgtcgtgtgtgtcctgagtgtttctttggttctttgcacgccaagtctcttggttgtaccatgtgacacaccctgtgcactggtcgctgtcttcgtggcttccacccttgttaatgatgctcctgcctctgcctcccagcccctcacccagcacagctctgcctggacttggagagatgggaggcagacccccaccaccatacatgctgtctgtggcccctcagacattctgtttcatctcccattcatctccctcctcccaccgtgtcagtttttctgcctttccctgctctgttcttccccctccttaggccccagcctgggcccagacccatcctcccagccaggtttccctccagcaggctccttccctccctgtcacctccctctcaccaacccggggtctgagcccctcattcctgaccgtccgtgttctcaggagtggttgaggacacagggccccagcccagccctctgcaccccccagcccggccatctgcgccccacagcccctttggagcttttctcttgtcctctcactccttcccagaagtttttgcacagaacttcattttgaaagtgtttttctcattctccatacctcccccaagctctcctccagcccttcccagggctcagccctgctgtcctgagcgtctcctgggccagagagaggagatgggggtgggagggactgagttgatgttgggtttttcattcaataaattggtgatttcttaccgac

SEQ ID NO: 330689 - DNA, 3267 bp, Homo sapiens
cgccgccgccgccgcgggggaagcctgggagccagatcggcgtcgcctcggcctccgtaacccccgcctagccgggccatggcggaacgcggaggggcgggcggtggtcccggaggcgccgggggcggcagcggccagcggggatccggggtcgcccagtcccctcagcagccgccgccgcagcagcagcagcagcagccgccgcagcagccgacgccccccaagctggcccaggccacctcgtcgtcctcgtccacctcggcggcggctgcctcctcctcgtcctcgtctacctccacctccatggccgtggcggtggcctcgggctccgcgcctcccggtggcccggggccaggccgcacccccgccccggtgcagatgaacctgtacgccacctgggaggtggaccggagctcgtccagctgcgtgcctaggctattcagcttgaccctgaagaaactcgtcatgctaaaagaaatggacaaagatcttaactcagtggtcatcgctgtgaagctgcagggttcaaaaagaattcttcgctccaacgagatcgtccttccagctagtggactggtggaaacagagctccaattaaccttctcccttcagtaccctcatttccttaagcgagatgccaacaagctgcagatcatgctgcaaaggagaaaacgttacaagaatcggaccatcttgggctataagaccttggccgtgggactcatcaacatggcagaggtgatgcagcatcctaatgaaggcgcactggtgcttggcctacacagcaacgtgaaggatgtctctgtgcctgtggcagaaataaagatctactccctgtccagccaacccattgaccatgaaggaatcaaatccaagctttctgatcgttctcctgatattgacaattattctgaggaagaggaagagagtttctcatcagaacaggaaggcagtgatgatccattgcatgggcaggacttgttctacgaagacgaagatctccggaaagtgaagaagacccggaggaaactaacctcaacctctgccatcacaaggcaacctaacatcaaacagaagtttgtggccctcctgaagcggtttaaagtttcagatgaggtgggctttgggctggagcatgtgtcccgcgagcagatccgggaagtggaagaggacttggatgaattgtatgacagtctggagatgtacaaccccagcgacagtggccctgagatggaggagacagaaagcatcctcagcacgccaaagcccaagctcaagcctttctttgaggggatgtcgcagtccagctcccagacggagattggcagcctcaacagcaaaggcagcctcggaaaagacaccaccagccctatggaattggctgctctagaaaaaattaaatctacttggattaaaaaccaagatgacagcttgactgaaacagacactctggaaatcactgaccaggacatgtttggagatgccagcacgagtctggttgtgccggagaaagtcaaaactcccatgaagtccagtaaaacggatctccagggctctgcctcccccagcaaagtggagggggtgcacacaccccggcagaagaggagcacgcccctgaaggagcggcagctctccaagcccctaagtgagaggaccaacagttccgacagcgagcgctccccagatctgggccacagcacgcagattccaagaaaggtggtgtatgaccagctcaatcagatcctggtgtcagatgcagccctcccagaaaatgtcattctggtgaacaccactgactggcagggccagtatgtggctgagctgctccaggaccagcggaagcctgtggtgtgcacctgctccaccgtggaggtccaggccgtgctgtccgccctgctcacccggatccagcgctactgcaactgcaactcttccatgccgaggccagtgaaggtggctgctgtgggaggccagagctacctgagctccatcctcaggttctttgtcaagtccctggccaacaagacctccgactggcttggctacatgcgcttcctcatcatccccctcggttctcaccctgtggccaaatacttggggtcagtcgacagtaaatacagtagttccttcctggattctggttggagagatctgttcagtcgctcggagccaccagtgtcagagcaactggacgtggcagggcgggtgatgcagtacgtcaacggggcagccacgacacaccagcttcccgtggccgaagccatgctgacttgccggcataagttccctgatgaagactcctatcagaagtttattcccttcattggcgtggtgaaggtgggtctggttgaagactctccctccacagcaggcgatggggacgattctcctgtggtcagccttactgtgccctccacatcaccaccctccagctcgggcctgagccgagacgccacggccacccctccctcctccccatctatgagcagcgccctggccatcgtggggagccctaatagcccatatggggacgtgattggcctccaggtggactactggctgggccaccccggggagcggaggagggaaggcgacaagagggacgccagctcgaagaacaccctcaagagtgtcttccgctcagtgcaggtgtcccgcctgccccatagtggggaggcccagctttctggcaccatggccatgactgtggtcaccaaagaaaagaacaagaaagttcccaccatcttcctgagcaagaaaccccgagaaaaggaggtggattctaagagccaggtcattgaaggcatcagccgcctcatttccccctccttaggccccagcctgggcccagacccatcctcccagccaggtttccctccagcaggctccttccctccctgtcacctccctctcaccaacccggggtctgagcccctcattcctgaccgtccgtgttctcaggagtggttgaggacacagggccccagcccagccctctgcaccccccagcccggccatctgcgccccacagcccctttggagcttttctcttgtcctctcactccttcccagaagtttttgcacagaacttcattttgaaagtgtttttctcattctccatacctcccccaagctctcctccagcccttcccagggctcagccctgctgtcctgagcgtctcctgggccagagagaggagatgggggtgggagggactgagttgatgttgggtttttcattcaataaattggtgatttcttaccgac

SEQ ID NO: 330690 - DNA, 1684 bp, Homo sapiens
  misc_feature (1)..(1): n is a, c, g, or t
ntatctagaggatccctgggaggcaggacactgtgggagccaggtcattgaaggcatcagccgcctcatctgctcagccaagcagcagcagactatgctgagagtgtccatcgatggggtcgagtggagtgacatcaagttcttccagctggcagcccagtggcccacccatgtcaagcactttccagtgggactcttcagtggcagcaaggccacctgaggccctgtctcccagccactttccctcctggcactgccaccagcctcaccgcctgcgggcagggggaggccagcaggcccgggcccagcaccccttccctggcaccagggtctgcctctcactcgcccaggtcccgaaggacactgccacagggacgccttccctcccctcccctccagcccacccctgcacagcccctcctccttcccgcttttccccttctccctcctgctccaggcccaaggcgtgttggttttgccttctggtgcccatagtcccctggactgagtcccccaggccttccttcacccgacttccaaactcttccttgtggtatcagtttccttctcggaaatgagaaagctggaatcctggtccccagcaggagagcctagtcctcccccagcccctccagccaccagggtgtcctctaggatgcagctgccagatccactcactctgctgcctccagcaggacccaaggccactttcaactcttatggggttctccacctgccccagagcttctcaagggagggtaagggggcaccctgagcccacaggacccctacttcacagctcacaggggcaggaggcagctcccctgcctccaggaccctgttgctatggtgacacagcgtttctaggacagaggggcctcccagtctccccccaccacccgtgcacgacttcctcaccacccccaggttccctgcagatgtcgtgtgtgtcctgagtgtttctttggttctttgcacgccaagtctcttggttgtaccatgtgacacaccctgtgcactggtcgctgtcttcgtggcttccacccttgttaatgatgctcctgcctctgcctcccagcccctcacccagcacagctctgcctggacttggagagatgggaggcagacccccaccaccatacatgctgtctgtggcccctcagacattctgtttcatctcccattcatctccctcctcccaccgtgtcagtttttctgcctttccctgctctgttcttccccctccttaggccccagcctgggcccagacccatcctcccagccaggtttccctccagcaggctccttccctccctgtcacctccctctcaccaacccggggtctgagcccctcattcctgaccgtccgtgttctcaggagtggttgaggacacagggccccagcccagccctctgcaccccccagcccggccatctgcgccccacagcccctttggagcttttctcttgtcctctcactccttcccagaagtttttgcacagaacttcattttgaaagtgtttttctcattctccatacctcccccaagctctcctccagcccttcccagggctcagccctgctgtcctgagcgtctcctgggccagagagaggagatgggggtgggagggactgagttgatgttgggtttttcattcaataaattggtgatttcttaccgac

SEQ ID NO: 330691 - DNA, 3998 bp, Homo sapiens
cgccgccgccgccgcgggggaagcctgggagccagatcggcgtcgcctcggcctccgtaacccccgcctagccgggccatggcggaacgcggaggggcgggcggtggtcccggaggcgccgggggcggcagcggccagcggggatccggggtcgcccagtcccctcagcagccgccgccgcagcagcagcagcagcagccgccgcagcagccgacgccccccaagctggcccaggccacctcgtcgtcctcgtccacctcggcggcggctgcctcctcctcgtcctcgtctacctccacctccatggccgtggcggtggcctcgggctccgcgcctcccggtggcccggggccaggccgcacccccgccccggtgcagatgaacctgtacgccacctgggaggtggaccggagctcgtccagctgcgtgcctaggctattcagcttgaccctgaagaaactcgtcatgctaaaagaaatggacaaagatcttaactcagtggtcatcgctgtgaagctgcagggttcaaaaagaattcttcgctccaacgagatcgtccttccagctagtggactggtggaaacagagctccaattaaccttctcccttcagtaccctcatttccttaagcgagatgccaacaagctgcagatcatgctgcaaaggagaaaacgttacaagaatcggaccatcttgggctataagaccttggccgtgggactcatcaacatggcagaggtgatgcagcatcctaatgaaggcgcactggtgcttggcctacacagcaacgtgaaggatgtctctgtgcctgtggcagaaataaagatctactccctgtccagccaacccattgaccatgaaggaatcaaatccaagctttctgatcgttctcctgatattgacaattattctgaggaagaggaagagagtttctcatcagaacaggaaggcagtgatgatccattgcatgggcaggacttgttctacgaagacgaagatctccggaaagtgaagaagacccggaggaaactaacctcaacctctgccatcacaaggcaacctaacatcaaacagaagtttgtggccctcctgaagcggtttaaagtttcagatgaggtgggctttgggctggagcatgtgtcccgcgagcagatccgggaagtggaagaggacttggatgaattgtatgacagtctggagatgtacaaccccagcgacagtggccctgagatggaggagacagaaagcatcctcagcacgccaaagcccaagctcaagcctttctttgaggggatgtcgcagtccagctcccagacggagattggcagcctcaacagcaaaggcagcctcggaaaagacaccaccagccctatggaattggctgctctagaaaaaattaaatctacttggattaaaaaccaagatgacagcttgactgaaacagacactctggaaatcactgaccaggacatgtttggagatgccagcacgagtctggttgtgccggagaaagtcaaaactcccatgaagtccagtaaaacggatctccagggctctgcctcccccagcaaagtggagggggtgcacacaccccggcagaagaggagcacgcccctgaaggagcggcagctctccaagcccctaagtgagaggaccaacagttccgacagcgagcgctccccagatctgggccacagcacgcagattccaagaaaggtggtgtatgaccagctcaatcagatcctggtgtcagatgcagccctcccagaaaatgtcattctggtgaacaccactgactggcagggccagtatgtggctgagctgctccaggaccagcggaagcctgtggtgtgcacctgctccaccgtggaggtccaggccgtgctgtccgccctgctcacccggatccagcgctactgcaactgcaactcttccatgccgaggccagtgaaggtggctgctgtgggaggccagagctacctgagctccatcctcaggttctttgtcaagtccctggccaacaagacctccgactggcttggctacatgcgcttcctcatcatccccctcggttctcaccctgtggccaaatacttggggtcagtcgacagtaaatacagtagttccttcctggattctggttggagagatctgttcagtcgctcggagccaccagtgtcagagcaactggacgtggcagggcgggtgatgcagtacgtcaacggggcagccacgacacaccagcttcccgtggccgaagccatgctgacttgccggcataagttccctgatgaagactcctatcagaagtttattcccttcattggcgtggtgaaggtgggtctggttgaagactctccctccacagcaggcgatggggacgattctcctgtggtcagccttactgtgccctccacatcaccaccctccagctcgggcctgagccgagacgccacggccacccctccctcctccccatctatgagcagcgccctggccatcgtggggagccctaatagcccatatggggacgtgattggcctccaggtggactactggctgggccaccccggggagcggaggagggaaggcgacaagagggacgccagctcgaagaacaccctcaagagtgtcttccgctcagtgcaggtgtcccgcctgccccatagtggggaggcccagctttctggcaccatggccatgactgtggtcaccaaagaaaagaacaagaaagttcccaccatcttcctgagcaagaaaccccgagaaaaggaggtggattctaagagccaggtcattgaaggcatcagccgcctcatctgctcagccaagcagcagcagactatgctgagagtgtccatcgatggggtcgagtggagtgacatcaagttcttccagctggcagcccagtggcccacccatgtcaagcactttccagtgggactcttcagtggcagcaaggccacctgaggccctgtctcccagccactttccctcctggcactgccaccagcctcaccgcctgcgggcagggggaggccagcaggcccgggcccagcaccccttccctggcaccagggtctgcctctcactcgcccaggtcccgaaggacactgccacagggacgccttccctcccctcccctccagcccacccctgcacagcccctcctccttcccgcttttccccttctccctcctgctccaggcccaaggcgtgttggttttgccttctggtgcccatagtcccctggactgagtcccccaggccttccttcacccgacttccaaactcttccttgtggtatcagtttccttctcggaaatgagaaagctggaatcctggtccccagcaggagagcctagtcctcccccagcccctccagccaccagggtgtcctctaggatgcagctgccagatccactcactctgctgcctccagcaggacccaaggccactttcaactcttatggggttctccacctgccccagagcttctcaagggagggtaagggggcaccctgagcccacaggacccctacttcacagctcacaggggcaggaggcagctcccctgcctccaggaccctgttgctatggtgacacagcgtttctaggacagaggggcctcccagtctccccccaccacccgtgcacgacttcctcaccacccccaggttccctgcagatgtcgtgtgtgtcctgagtgtttctttggttctttgcacgccaagtctcttggttgtaccatgtgacacaccctgtgcactggtcgctgtcttcgtggcttccacccttgttaatgatgctcctgcctctgcctcccagcccctcacccagcacagctctgcctggacttggagagatgggaggcagacccccaccaccatacatgctgtctgtggcccctcagacattctgtttcatctcccaatagtattccattgtgtagatgtaccacagtttgtttatccattcctcagatgaaaacctttgga

SEQ ID NO: 330692 - DNA, 743 bp, Homo sapiens
ggtactctagaggacccccccgactagcccgacagcacgcaagtctcttggttgtaccatgtgacacaccctgtgcactggtcgctgtcttcgtggcttccacccttgttaatgatgctcctgcctctgcctcccagcccctcacccagcacagctctgcctggacttggagagatgggaggcagacccccaccaccatacatgctgtctgtggcccctcagacattctgtttcatctcccattcatctccctcctcccaccgtgtcagtttttctgcctttccctgctctgttcttccccctccttaggccccagcctgggcccagacccatcctcccagccaggtttccctccagcaggctccttccctccctgtcacctccctctcaccaacccggggtctgagcccctcattcctgaccgtccgtgttctcaggagtggttgaggacacagggccccagcccagccctctgcaccccccagcccggccatctgcgccccacagcccctttggagcttttctcttgtcctctcactccttcccagaagtttttgcacagaacttcattttgaaagtgtttttctcattctccatacctcccccaagctctcctccagcccttcccagggctcagccctgctgtcctgagcgtctcctgggccagagagaggagatgggggtgggagggactgagttgatgttgggtttttcattcaataaattggtgatttcttaccgac

SEQ ID NO: 330693 - DNA, 672 bp, Homo sapiens
tggtgggggtctgcctcccatctctccaagtccaggcagagctgtgctgggtgaggggctgggaggcagaggcaggagcatcattaacaagggtggaagccacgaagacagcgaccagtgcacagggtgtgtcacatggtacaaccaagagacattctgtttcatctcccattcatctccctcctcccaccgtgtcagtttttctgcctttccctgctctgttcttccccctccttaggccccagcctgggcccagacccatcctcccagccaggtttccctccagcaggctccttccctccctgtcacctccctctcaccaacccggggtctgagcccctcattcctgaccgtccgtgttctcaggagtggttgaggacacagggccccagcccagccctctgcaccccccagcccggccatctgcgccccacagcccctttggagcttttctcttgtcctctcactccttcccagaagtttttgcacagaacttcattttgaaagtgtttttctcattctccatacctcccccaagctctcctccagcccttcccagggctcagccctgctgtcctgagcgtctcctgggccagagagaggagatgggggtgggagggactgagttgatgttgggtttttcattcaataaattggtgatttcttaccgac

SEQ ID NO: 330694 - DNA, 480 bp, Homo sapiens
tctgttttattttgtggattggtttgcttttcccctgtgggttgttgagatcacagaaagtcagctctgggcctcccccgggcaggatcctggcacccctgagcactgctatgacgctccccttcctccccagctgcaactgcaactcttccatgccgaggccagtgaaggtggctgctgtgggaggccagagctacctgagctccatcctcaggttctttgtcaagtccctggccaacaagacctccgactggcttggctacatgcgcttcctcatcatccccctcggtaaagacgggaggcaccaggagggcgtcgggcatgagggttccatagacagatgcctcatctggaacaggacggtggggttggggcctaggaagggacagtcaaggagaccaaggccgtggccagggacagctgctcccacactgtctcatctcctgacgaattcaccacctctggttttccatctaccag

SEQ ID NO: 330695 - DNA, 401 bp, Homo sapiens
gccctgaacacctcctcagccctgagctcccatctccgtgtcctcagcccttaggtctggtccccgcaccctcagccctgagctctgagctcccatctctgcgttctcagccctgagctccgttccccttagctccagttcccgcgccctcagcccttagctctggtccccacaccctcagctctgagctctggtccccgcgccctcagccctgagctctggtccccgcacccttagccctgagctcctgtccccatgtcctcagcctgtggtctgagccctgtctcctcatccttagcctgttgcttttccttccacacctgcagcctccaggacattcttgcttcctgaaggcccgtcctggctgctgctctccctcctcccgaatccctcctgctcct

SEQ ID NO: 330696 - DNA, 152 bp, Homo sapiens
gagcaatggcagtggggacgtctgcaacttcctgtgtggcctgtggacggccctgtgggtgcagcccaggcgccagcagccatcatgtgctccagactcccaggccgaccgggaggggtgcatactgcatgctcctgcctggacccctcccc

SEQ ID NO: 330697 - DNA, 98 bp, Homo sapiens
atctgtgccatcctctaccataaaaccagaattagtttccaaatctgatgctccctcagctgtataatttcacagctccataccactgcatttgctct

SEQ ID NO: 330698 - DNA, 628 bp, Homo sapiens
tggctgtaactgtttgcattttcattagtaatgaatgagagtttctgttgttccacatcctctccagcatttggtgtaagcatttagaattttagacattctactaggtgtatcatggtatctcctcgttgttttaatttataatttcctgatgacaaatgatgttgagcatattttatatcatatatatgtacacacacacacattctttggtcagatgtctgttcaggttttcagcccatattttaattgggttgttgctttgttcagtttaaagagttattcatacattttagagctcagtcctttatcagatatgtattttgcaaagattttcttccaatctgtggcttgtattttcattctcccaacagtgtctttcacagagcagaagtttttatttttaataaagtacacctaatcaatattttctttcatgtattgtgcttctggtgttgcatctagaaagtcatcaccaaacctaaggtcacctagactttctcccatagtatcttctattagttttatagtttttagctttaaatttaggtttatgattcattttaaattaattatttttgaaatgtttaagatctgtgtatagaatcttttttgcatatgaatatcc

SEQ ID NO: 330699 - DNA, 878 bp, Homo sapiens
gacaaaagggaagtcatcttccgttggtctatggggaccctgaggtagtaggagctcggtgataattctagggaccaccctgggttgtcaggtgggggagacagagaagcccacataggaggcaccaaatgcaactcactcgtgcccttttactcatgagagaacacggatccagagatgtcaagtgactcagacacagtctcacagcacacaggcggcagaggcaggtaggggactgggcttccctggcagcagtccccaagcctgcctgagaggcacatcagaatcgctttaggggatttgcaaaaccacacctgcccaggcccaaaccctagagattctgattccgcagtctgaggtaggaatggagaatcctccacagcctgaggtaggaactgggaatccagtgtttaaaactctctaggggcggtgatttcagaaaacctgctggctccatcacactttgctcagggactgagatgggatggcatttggaagacacagctgaaatttagcatcatattccatggcgattttccaccagtggaaatcacaggtgttctctggtatcacagcggggtcagggatgacctgaaatattgttcatgctcatcacaactgcatggcccaccgcggggtcttgtcactcagtgagttcttgaagaggcacagacaaatggagttcaacaaatggaaaacaactgcctttaattagctccgaggactacaaagggaacaacgttataatagcagcaactccaaggaagcagccacagcatctcagctctcagacctggggctgccgctcatcatcagctacagctaggtttgatgggagtgcccccatttcaggggacagcaggcccccttcactcccc

SEQ ID NO: 330700 - DNA, 662 bp, Homo sapiens
tgaaggaaaatttgtattatttcaattatttttatgtacagaaaactcaacagtgtacatttaacccagtttagtggcaagttctttagcctttgccttttcgagcttggcgatacgagccacagacttaggacccaggacattgccaccccagtgacggcggatctcatcgtatctgtcattgtaattggtcctgatagcttccaccagcttagccaaagcgcctttgtcttccgagttcacctgtgtgaaggcgacagtggtgcaggtcttcctgtggactagacgcccctcttccttccagctttcacttctgccggctccgcaactgagtgacacccagcgacaaccgactggggagtggtagaagcaactgaacggatgcgtgcgagctgaggacagggcgggaggagggggcacacatgccccaggggagcgaggagaactcttgaaatctccattttcaatcccttcgaaatcacgtatggtttccacaaagccgagtcgtgtcacgtggcaggtttacgtcaatagtccctctctctgctcctccattcgcaagtgtcttcctgggccagactcccctccacctcatgtacttgctatattgaggatgaagttttctatggtgggacactaaatataaagctatatagagaaag

SEQ ID NO: 330701 - DNA, 657 bp, Homo sapiens
tccgctcctcccccggcccccaccgcgcccgcggccggcccaggcagcactcgcgagcagcggcggccccgccggcggccgagttgggagaatgcggcggcgctcgcggatgctgctctgcttcgccttcctgtgggtgctgggcatcgcctactacatgtactcggggggcggctctgcgctggccgggggcgcgggcggcggcgccggcaggaagctccagactctgtgctctgttctgcagtgttggagctaggaccgcacatcccagctgctttgccagtggcttccgggccacctccatcagcaggaggcggtagaagcaccagcaagatggggctttggtccttcctgttggcttcctgttgccccagctgtagctgttgaattcagtcttcagttatcccagcactggccagccagcctcatcgtccacactccctgcagatcccaccactcctccaaggaagtctctacctcagggccctttggctacgcttctaaggttaagtctaaccggttccctcaggcctaggggtggtggctgcttcctgtcgttgctacttccctgatatctagaattttcctttttctacccagttacctggttactgactttctacccagttaacaatttatattaaagcccttctgttc

SEQ ID NO: 330702 - DNA, 4347 bp, Homo sapiens
gagtgtacacgaacgaaaagcactggctggagatcatctatgtggaatgtggacagggcaaggtgcccgtagcccctatggctgacagagaggactggaatgaaattgaccccattaaaaagaaagaccttcatcacagcaatggagaagagaaagcacaaagcatggagaccctccctccagggaaagtacggtggccagactttaaccaggaagcttatgttggagggacgatggtccgctccgggcaggacccttacgcccgcaacaagttcaaccaggtggagagtgataagcttcgaatggacagagccatccctgacacccggcatgaccagtgtcagcggaagcagtggcgggtggatctgccggccaccagcgtggtgatcacgtttcacaatgaagccaggtcggccctactcaggaccgtggtcagcgtgcttaagaaaagcccgccccatctcataaaagaaatcatcttggtggatgactacagcaatgatcctgaggacggggctctcttggggaaaattgagaaagtgcgagttcttagaaatgatcgacgagaaggcctcatgcgctcacgggttcggggggccgatgctgcccaagccaaggtcctgaccttcctggacagtcactgcgagtgtaatgagcactggctggagcccctcctggaaagggtggcggaggacaggactcgggttgtgtcacccatcatcgatgtcattaatatggacaactttcagtatgtgggggcatctgctgacttgaagggcggttttgattggaacttggtattcaagtgggattacatgacgcctgagcagagaaggtcccggcaggggaacccagtcgcccctataaaaacccccatgattgctggtgggctgtttgtgatggataagttctattttgaagaactggggaagtacgacatgatgatggatgtgtggggaggagagaacctagagatctcgttccgcgtgtggcagtgtggtggcagcctggagatcatcccgtgcagccgtgtgggacacgtgttccggaagcagcacccctacacgttcccgggtggcagtggcactgtctttgcccgaaacacccgccgggcagcagaggtctggatggatgaatacaaaaatttctattatgcagcagtgccttctgctagaaacgttccttatggaaatattcagagcagattggagcttaggaagaaactcagctgcaagcctttcaaatggtaccttgaaaatgtctatccagagttaagggttccagaccatcaggatatagcttttggggccttgcagcagggaactaactgcctcgacactttgggacactttgctgatggtgtggttggagtttatgaatgtcacaatgctgggggaaaccaggaatgggccttgacgaaggagaagtcggtgaagcacatggatttgtgccttactgtggtggaccgggcaccgggctctcttataaagctgcagggctgccgagaaaatgacagcagacagaaatgggaacagatcgagggcaactccaagctgaggcacgtgggcagcaacctgtgcctggacagtcgcacggccaagagcgggggcctaagcgtggaggtgtgtggcccggccctttcgcagcagtggaagttcacgctcaacctgcagcagtaggagggtccgggaggccctgccgtcctgtctcctgcaccattgggtggagtctggtgatcacattattgattatgtttcttaaactttccgcgaaactaatatacctcagtattccatcatggtctgaaagtcaaacttcggcaaggcacggacgactgtgcagacacagcagcggcaagaagcgagaactgccctccccctcctctcggtgcagcccagccgggcccccttccccaggccggagcgcccctcttccttccagctttcacttctgccggctccgcaactgagtgacacccagcgacaaccgactggggagtggtagaagcaactgaacggatgcgtgcgagctgaggacagggcgggaggagggggcacacatgccccaggggagcgaggagaactcttgaaatctccattttcaatcccttcgaaatcacgtatggtttccacaaagccgagtcgtgtcacgtggcaggtttacgtcaatagtccctctctctgctcctccattcgcaagtgtcttcctgggccagactcccctccacctcatgtacttgctatattgaggatgaagttttctatggtgggacactaaatataaagctatatagagaaagaatgtacggtcagttccctatggtttctgtagatcatcgtcatcttgtatattccccacaaagccgttcgcagcttccgggagaaggggccagagcccggtggggccagtttctcacagagggaggaggtggcctttgtcccctggagcccgatcagccagttggtgctactgctgtggccagctggggggcttcctccagaccaccggcctcggccccggcatccctgttgggcgtcagcctgagagtccctactgtgcgtcagaatccaccttgcgtgctgtgcgtatctgtgaacctggagcggttacttattttgacagatatcactttgggtctttttacattaaatttcttttctctaaggaatataagacataccccatagctctgtgtgagccagcaataccgctgccccctggcgacagggcagaccaatgatgccaggcagctgtcacacgctagtattggcttcattgtgatctgagccctgcacgctgggccttcagaattaatggccagcagtgtcagggatgagcccgtcagccagggcacaggcctggctcacagtcctgcacacctgctggcctggggagctccagccaggcagcgagtcctgccccgcccgcagctccctcccacaccccgcctggccaagatgactgcttcagggggctttggggaaagaattaggaagggtcagaaccaaacaatacctgctcatttacactgaggattcagggcgggagacaggagccttggggtcctgttaaaccacagacagttatgaactgaaagtcataacggggagaggtgcctggcttctacctgggtgctcaggaatgttcctcgtcacccctgccactctgtggtcggtgccctgcttcctcctccactcctggccgccttctccagcgccgcacacacagatgctcagtctcagagaggctggcacggcctggcagtctgagaaaagcgtcagttaggcacacctgcaggcccctcggtgggacagcggcggccttggagttaggagccaccctgggaggttgtgccggtgccatgctcctccctgtgtcttgtatgaaaggggccactgtgtgtcttcctccccggcgggagccccacatgtgtgcactgtaggacagcggccccgaggtggaagcctggctggagggctgccctataggtcttctcttcccgcctcccctgccatgcaaccagatgtgttgtgagtgggcagcgtgcccccacgctggagtaactccgcacgcttctgtctttcacggtgggcgctcggggggagcctgaggaaaacccccttaggtacctgtgcgaggctgtggagtgcaggccagagcagggtgtgcgtagcccccagcacccaggttcttctgtcagaccctgtgacctgcgagctgctactactgtaaggagggaaatggatgaatctggctcgttttaaaatcacgttttctgacgaatcctttgccccttcacctttaccccgcccgcacccctaggccctctcagccttcctatcatcccacgtgtctacccagacccttgtgcggcccatgccctgggggcggcgtcctgtccctgagctgggaggcggctttggatggtccgggcgtcaagagcaggggtgggccggggaggggtcctttgcggtgagctatgtttacatgacacagtgtgccaaagtgacttactgcggttgcgttagtttctagtcatcaggactatctcaccctcccactcctgtttttaaaactcagaattctttcctaagagcccttcgagcaaagcgtgccgaagttagttgtcttctctgtgctggtcctttcttatgtcctcataaaagctcagatgatggtatctgtgagtatgttttgcaaattcaaaatatagtttggtaatttttttttccagttgatttttaaaaagaactgctgtacagagcttgtactttgtccattttatagatggaaaccatccttgaaaattgtttaacttaaataaagagaagatactttctagatacc

SEQ ID NO: 330703 - DNA, 4148 bp, Homo sapiens
tccgctcctcccccggcccccaccgcgcccgcggccggcccaggcagcactcgcgagcagcggcggccccgccggcggccgagttgggagaatgcggcggcgctcgcggatgctgctctgcttcgccttcctgtgggtgctgggcatcgcctactacatgtactcggggggcggctctgcgctggccgggggcgcgggcggcggcgccggcaggaaggaggactggaatgaaattgaccccattaaaaagaaagaccttcatcacagcaatggagaagagaaagcacaaagcatggagaccctccctccagggaaagtacggtggccagactttaaccaggaagcttatgttggagggacgatggtccgctccgggcaggacccttacgcccgcaacaagttcaaccaggtggagagtgataagcttcgaatggacagagccatccctgacacccggcatgaccagtgtcagcggaagcagtggcgggtggatctgccggccaccagcgtggtgatcacgtttcacaatgaagccaggtcggccctactcaggaccgtggtcagcgtgcttaagaaaagcccgccccatctcataaaagaaatcatcttggtggatgactacagcaatgatcctgaggacggggctctcttggggaaaattgagaaagtgcgagttcttagaaatgatcgacgagaaggcctcatgcgctcacgggttcggggggccgatgctgcccaagccaaggtcctgaccttcctggacagtcactgcgagtgtaatgagcactggctggagcccctcctggaaagggtggcggaggacaggactcgggttgtgtcacccatcatcgatgtcattaatatggacaactttcagtatgtgggggcatctgctgacttgaagggcggttttgattggaacttggtattcaagtgggattacatgacgcctgagcagagaaggtcccggcaggggaacccagtcgcccctataaaaacccccatgattgctggtgggctgtttgtgatggataagttctattttgaagaactggggaagtacgacatgatgatggatgtgtggggaggagagaacctagagatctcgttccgcgtgtggcagtgtggtggcagcctggagatcatcccgtgcagccgtgtgggacacgtgttccggaagcagcacccctacacgttcccgggtggcagtggcactgtctttgcccgaaacacccgccgggcagcagaggtctggatggatgaatacaaaaatttctattatgcagcagtgccttctgctagaaacgttccttatggaaatattcagagcagattggagcttaggaagaaactcagctgcaagcctttcaaatggtaccttgaaaatgtctatccagagttaagggttccagaccatcaggatatagcttttggggccttgcagcagggaactaactgcctcgacactttgggacactttgctgatggtgtggttggagtttatgaatgtcacaatgctgggggaaaccaggaatgggccttgacgaaggagaagtcggtgaagcacatggatttgtgccttactgtggtggaccgggcaccgggctctcttataaagctgcagggctgccgagaaaatgacagcagacagaaatgggaacagatcgagggcaactccaagctgaggcacgtgggcagcaacctgtgcctggacagtcgcacggccaagagcgggggcctaagcgtggaggtgtgtggcccggccctttcgcagcagtggaagttcacgctcaacctgcagcagtaggagggtccgggaggccctgccgtcctgtctcctgcaccattgggtggagtctggtgatcacattattgattatgtttcttaaactttccgcgaaactaatatacctcagtattccatcatggtctgaaagtcaaacttcggcaaggcacggacgactgtgcagacacagcagcggcaagaagcgagaactgccctccccctcctctcggtgcagcccagccgggcccccttccccaggccggagcgcccctcttccttccagctttcacttctgccggctccgcaactgagtgacacccagcgacaaccgactggggagtggtagaagcaactgaacggatgcgtgcgagctgaggacagggcgggaggagggggcacacatgccccaggggagcgaggagaactcttgaaatctccattttcaatcccttcgaaatcacgtatggtttccacaaagccgagtcgtgtcacgtggcaggtttacgtcaatagtccctctctctgctcctccattcgcaagtgtcttcctgggccagactcccctccacctcatgtacttgctatattgaggatgaagttttctatggtgggacactaaatataaagctatatagagaaagaatgtacggtcagttccctatggtttctgtagatcatcgtcatcttgtatattccccacaaagccgttcgcagcttccgggagaaggggccagagcccggtggggccagtttctcacagagggaggaggtggcctttgtcccctggagcccgatcagccagttggtgctactgctgtggccagctggggggcttcctccagaccaccggcctcggccccggcatccctgttgggcgtcagcctgagagtccctactgtgcgtcagaatccaccttgcgtgctgtgcgtatctgtgaacctggagcggttacttattttgacagatatcactttgggtctttttacattaaatttcttttctctaaggaagggtcagaaccaaacaatacctgctcatttacactgaggattcagggcgggagacaggagccttggggtcctgttaaaccacagacagttatgaactgaaagtcataacggggagaggtgcctggcttctacctgggtgctcaggaatgttcctcgtcacccctgccactctgtggtcggtgccctgcttcctcctccactcctggccgccttctccagcgccgcacacacagatgctcagtctcagagaggctggcacggcctggcagtctgagaaaagcgtcagttaggcacacctgcaggcccctcggtgggacagcggcggccttggagttaggagccaccctgggaggttgtgccggtgccatgctcctccctgtgtcttgtatgaaaggggccactgtgtgtcttcctccccggcgggagccccacatgtgtgcactgtaggacagcggccccgaggtggaagcctggctggagggctgccctataggtcttctcttcccgcctcccctgccatgcaaccagatgtgttgtgagtgggcagcgtgcccccacgctggagtaactccgcacgcttctgtctttcacggtgggcgctcggggggagcctgaggaaaacccccttaggtacctgtgcgaggctgtggagtgcaggccagagcagggtgtgcgtagcccccagcacccaggttcttctgtcagaccctgtgacctgcgagctgctactactgtaaggagggaaatggatgaatctggctcgttttaaaatcacgttttctgacgaatcctttgccccttcacctttaccccgcccgcacccctaggccctctcagccttcctatcatcccacgtgtctacccagacccttgtgcggcccatgccctgggggcggcgtcctgtccctgagctgggaggcggctttggatggtccgggcgtcaagagcaggggtgggccggggaggggtcctttgcggtgagctatgtttacatgacacagtgtgccaaagtgacttactgcggttgcgttagtttctagtcatcaggactatctcaccctcccactcctgtttttaaaactcagaattctttcctaagagcccttcgagcaaagcgtgccgaagttagttgtcttctctgtgctggtcctttcttatgtcctcataaaagctcagatgatggtatctgtgagtatgttttgcaaattcaaaatatagtttggtaatttttttttccagttgatttttaaaaagaactgctgtacagagcttgtactttgtccattttatagatggaaaccatccttgaaaattgtttaacttaaataaagagaagatactttctagatacc

SEQ ID NO: 330704 - DNA, 1748 bp, Homo sapiens
aaggcctgggtgtctaatcggccgaggcactttgggtctttttacattaaatttcttttctctaaggaatataagacataccccatagctctgtgtgagccagcaataccgctgccccctggcgacagggcagaccaatgatgccaggcagctgtcacacgctagtattggcttcattgtgatctgagccctgcacgctgggccttcagaattaatggccagcagtgtcagggatgagcccgtcagccagggcacaggcctggctcacagtcctgcacacctgctggcctggggagctccagccaggcagcgagtcctgccccgcccgcagctccctcccacaccccgcctggccaagatgactgcttcagggggctttggggaaagaattaggaagggtcagaaccaaacaatacctgctcatttacactgaggattcagggcgggagacaggagccttggggtcctgttaaaccacagacagttatgaactgaaagtcataacggggagaggtgcctggcttctacctgggtgctcaggaatgttcctcgtcacccctgccactctgtggtcggtgccctgcttcctcctccactcctggccgccttctccagcgccgcacacacagatgctcagtctcagagaggctggcacggcctggcagtctgagaaaagcgtcagttaggcacacctgcaggcccctcggtgggacagcggcggccttggagttaggagccaccctgggaggttgtgccggtgccatgctcctccctgtgtcttgtatgaaaggggccactgtgtgtcttcctccccggcgggagccccacatgtgtgcactgtaggacagcggccccgaggtggaagcctggctggagggctgccctataggtcttctcttcccgcctcccctgccatgcaaccagatgtgttgtgagtgggcagcgtgcccccacgctggagtaactccgcacgcttctgtctttcacggtgggcgctcggggggagcctgaggaaaacccccttaggtacctgtgcgaggctgtggagtgcaggccagagcagggtgtgcgtagcccccagcacccaggttcttctgtcagaccctgtgacctgcgagctgctactactgtaaggagggaaatggatgaatctggctcgttttaaaatcacgttttctgacgaatcctttgccccttcacctttaccccgcccgcacccctaggccctctcagccttcctatcatcccacgtgtctacccagacccttgtgcggcccatgccctgggggcggcgtcctgtccctgagctgggaggcggctttggatggtccgggcgtcaagagcaggggtgggccggggaggggtcctttgcggtgagctatgtttacatgacacagtgtgccaaagtgacttactgcggttgcgttagtttctagtcatcaggactatctcaccctcccactcctgtttttaaaactcagaattctttcctaagagcccttcgagcaaagcgtgccgaagttagttgtcttctctgtgctggtcctttcttatgtcctcataaaagctcagatgatggtatctgtgagtatgttttgcaaattcaaaatatagtttggtaatttttttttccagttgatttttaaaaagaactgctgtacagagcttgtactttgtccattttatagatggaaaccatccttgaaaattgtttaacttaaataaagagaagatactttctagatacc

SEQ ID NO: 330705 - DNA, 1980 bp, Homo sapiens
  misc_feature (157)..(157): n is a, c, g, or t
cgtacacgttctctagtcccgctctctgcctacctccactatcgcacacgatgtcgttcctggcgcccgagctcccctccatctcatttacgttgctcatattgagagagtgcatctcactaatgtgcatgagagaagcaaacataccataggtcantcacaatgacataatactaaggacgcatacatgaatgtacggtcagttccctatggtttctgtagatcatcgtcatcttgtatattccccacaaagccgttcgcagcttccgggagaaggggccagagcccggtggggccacgatttccttcagcaaggaaggggggcacggccggaacgggggcttgggggggcccccccttttttatttggggtttccccccccccccctttggggaatggccccccgaattccagcccagttggtgctactgctgtggccagctggggggcttcctccagaccaccggcctcggccccggcatccctgttgggcgtcagcctgagagtccctactgtgcgtcagaatccaccttgcgtgctgtgcgtatctgtgaacctggagcggttacttattttgacagatatcactttgggtctttttacattaaatttcttttctctaaggaagggtcagaaccaaacaatacctgctcatttacactgaggattcagggcgggagacaggagccttggggtcctgttaaaccacagacagttatgaactgaaagtcataacggggagaggtgcctggcttctacctgggtgctcaggaatgttcctcgtcacccctgccactctgtggtcggtgccctgcttcctcctccactcctggccgccttctccagcgccgcacacacagatgctcagtctcagagaggctggcacggcctggcagtctgagaaaagcgtcagttaggcacacctgcaggcccctcggtgggacagcggcggccttggagttaggagccaccctgggaggttgtgccggtgccatgctcctccctgtgtcttgtatgaaaggggccactgtgtgtcttcctccccggcgggagccccacatgtgtgcactgtaggacagcggccccgaggtggaagcctggctggagggctgccctataggtcttctcttcccgcctcccctgccatgcaaccagatgtgttgtgagtgggcagcgtgcccccacgctggagtaactccgcacgcttctgtctttcacggtgggcgctcggggggagcctgaggaaaacccccttaggtacctgtgcgaggctgtggagtgcaggccagagcagggtgtgcgtagcccccagcacccaggttcttctgtcagaccctgtgacctgcgagctgctactactgtaaggagggaaatggatgaatctggctcgttttaaaatcacgttttctgacgaatcctttgccccttcacctttaccccgcccgcacccctaggccctctcagccttcctatcatcccacgtgtctacccagacccttgtgcggcccatgccctgggggcggcgtcctgtccctgagctgggaggcggctttggatggtccgggcgtcaagagcaggggtgggccggggaggggtcctttgcggtgagctatgtttacatgacacagtgtgccaaagtgacttactgcggttgcgttagtttctagtcatcaggactatctcaccctcccactcctgtttttaaaactcagaattctttcctaagagcccttcgagcaaagcgtgccgaagttagttgtcttctctgtgctggtcctttcttatgtcctcataaaagctcagatgatggtatctgtgagtatgttttgcaaattcaaaatatagtttggtaatttttttttccagttgatttttaaaaagaactgctgtacagagcttgtactttgtccattttatagatggaaaccatccttgaaaattgtttaacttaaataaagagaagatactttctagatacc

SEQ ID NO: 330706 - DNA, 1376 bp, Homo sapiens
tatgctaggtacaaggccggtggttaatcggccgaggacaatacctgctcatttacactgaggattcagggcgggagacaggagccttggggtcctgttaaaccacagacagttatgaactgaaagtcataacggggagaggtgcctggcttctacctgggtgctcaggaatgttcctcgtcacccctgccactctgtggtcggtgccctgcttcctcctccactcctggccgccttctccagcgccgcacacacagatgctcagtctcagagaggctggcacggcctggcagtctgagaaaagcgtcagttaggcacacctgcaggcccctcggtgggacagcggcggccttggagttaggagccaccctgggaggttgtgccggtgccatgctcctccctgtgtcttgtatgaaaggggccactgtgtgtcttcctccccggcgggagccccacatgtgtgcactgtaggacagcggccccgaggtggaagcctggctggagggctgccctataggtcttctcttcccgcctcccctgccatgcaaccagatgtgttgtgagtgggcagcgtgcccccacgctggagtaactccgcacgcttctgtctttcacggtgggcgctcggggggagcctgaggaaaacccccttaggtacctgtgcgaggctgtggagtgcaggccagagcagggtgtgcgtagcccccagcacccaggttcttctgtcagaccctgtgacctgcgagctgctactactgtaaggagggaaatggatgaatctggctcgttttaaaatcacgttttctgacgaatcctttgccccttcacctttaccccgcccgcacccctaggccctctcagccttcctatcatcccacgtgtctacccagacccttgtgcggcccatgccctgggggcggcgtcctgtccctgagctgggaggcggctttggatggtccgggcgtcaagagcaggggtgggccggggaggggtcctttgcggtgagctatgtttacatgacacagtgtgccaaagtgacttactgcggttgcgttagtttctagtcatcaggactatctcaccctcccactcctgtttttaaaactcagaattctttcctaagagcccttcgagcaaagcgtgccgaagttagttgtcttctctgtgctggtcctttcttatgtcctcataaaagctcagatgatggtatctgtgagtatgttttgcaaattcaaaatatagtttggtaatttttttttccagttgatttttaaaaagaactgctgtacagagcttgtactttgtccattttatagatggaaaccatccttgaaaattgtttaacttaaataaagagaagatactttctagatacc

SEQ ID NO: 330707 - DNA, 928 bp, Homo sapiens
cctgaggatcccttcgactagccgacagcggccccgaggtggaagcctggctggagggctgccctataggtcttctcttcccgcctcccctgccatgcaaccagatgtgttgtgagtgggcagcgtgcccccacgctggagtaactccgcacgcttctgtctttcacggtgggcgctcggggggagcctgaggaaaacccccttaggtacctgtgcgaggctgtggagtgcaggccagagcagggtgtgcgtagcccccagcacccaggttcttctgtcagaccctgtgacctgcgagctgctactactgtaaggagggaaatggatgaatctggctcgttttaaaatcacgttttctgacgaatcctttgccccttcacctttaccccgcccgcacccctaggccctctcagccttcctatcatcccacgtgtctacccagacccttgtgcggcccatgccctgggggcggcgtcctgtccctgagctgggaggcggctttggatggtccgggcgtcaagagcaggggtgggccggggaggggtcctttgcggtgagctatgtttacatgacacagtgtgccaaagtgacttactgcggttgcgttagtttctagtcatcaggactatctcaccctcccactcctgtttttaaaactcagaattctttcctaagagcccttcgagcaaagcgtgccgaagttagttgtcttctctgtgctggtcctttcttatgtcctcataaaagctcagatgatggtatctgtgagtatgttttgcaaattcaaaatatagtttggtaatttttttttccagttgatttttaaaaagaactgctgtacagagcttgtactttgtccattttatagatggaaaccatccttgaaaattgtttaacttaaataaagagaagatactttctagatacc

SEQ ID NO: 330708 - DNA, 410 bp, Homo sapiens
taaggaaatcacacctcaagatttattttctttctagaaacacccgccgggcagcagaggtctggatggatgaatacaaaaatttctattatgcagcagtgccttctgctagaaacgttccttatggaaagtaagtggcagttctgccttctcacaattactggggattcttggggtgtgggggtgggaggtaaggggctgcccccagcgttgaattcagctacccaggtgccaaggcgggaaggggttgtgggcacaggagcatgggcagtccacaccacaccacctgccccaaccctgttctcctcagcagattttcaagtttgatgtagaaagcccatctattcttaaaatttataaaggaatcttatttccctcttctccagtattcagagcagattggagcttag

SEQ ID NO: 330709 - DNA, 340 bp, Homo sapiens
agggacgatggtccgctccgggcaggacccttacgcccgcaacaagttcaaccaggtggagagtgataagcttcgaatggacagagccatccctgacacccggcatgaccagtaagtaccccactaagcacctgctgcagcttcatttgctttcacacaaaccagtacgtcgctttcacctgtgacactagaacttctccattactctgggaaattgaatgtgtgttgtaaaactaggaaaaatcctgaggtatatggcaatggaacttcatccataggcagtggaaggatggttctagattcagctctagtctttaggtgccctgtggcagtgtgcaga

SEQ ID NO: 330710 - DNA, 4602 bp, Homo sapiens
tccgctcctcccccggcccccaccgcgcccgcggccggcccaggcagcactcgcgagcagcggcggccccgccggcggccgagttgggagaatgcggcggcgctcgcggatgctgctctgcttcgccttcctgtgggtgctgggcatcgcctactacatgtactcggggggcggctctgcgctggccgggggcgcgggcggcggcgccggcaggaaggaggactggaatgaaattgaccccattaaaaagaaagaccttcatcacagcaatggagaagagaaagcacaaagcatggagaccctccctccagggaaagtacggtggccagactttaaccaggaagcttatgttggagggacgatggtccgctccgggcaggacccttacgcccgcaacaagttcaaccaggtggagagtgataagcttcgaatggacagagccatccctgacacccggcatgaccagtgtcagcggaagcagtggcgggtggatctgccggccaccagcgtggtgatcacgtttcacaatgaagccaggtcggccctactcaggaccgtggtcagcgtgcttaagaaaagcccgccccatctcataaaagaaatcatcttggtggatgactacagcaatgatcctgaggacggggctctcttggggaaaattgagaaagtgcgagttcttagaaatgatcgacgagaaggcctcatgcgctcacgggttcggggggccgatgctgcccaagccaaggtcctgaccttcctggacagtcactgcgagtgtaatgagcactggctggagcccctcctggaaagggtggcggaggacaggactcgggttgtgtcacccatcatcgatgtcattaatatggacaactttcagtatgtgggggcatctgctgacttgaagggcggttttgattggaacttggtattcaagtgggattacatgacgcctgagcagagaaggtcccggcaggggaacccagtcgcccctataaaaacccccatgattgctggtgggctgtttgtgatggataagttctattttgaagaactggggaagtacgacatgatgatggatgtgtggggaggagagaacctagagatctcgttccgcgtgtggcagtgtggtggcagcctggagatcatcccgtgcagccgtgtgggacacgtgttccggaagcagcacccctacacgttcccgggtggcagtggcactgtctttgcccgaaacacccgccgggcagcagaggtctggatggatgaatacaaaaatttctattatgcagcagtgccttctgctagaaacgttccttatggaaatattcagagcagattggagcttaggaagaaactcagctgcaagcctttcaaatggtaccttgaaaatgtctatccagagttaagggttccagaccatcaggatatagcttttggggccttgcagcagggaactaactgcctcgacactttgggacactttgctgatggtgtggttggagtttatgaatgtcacaatgctgggggaaaccaggaatgggccttgacgaaggagaagtcggtgaagcacatggatttgtgccttactgtggtggaccgggcaccgggctctcttataaagctgcagggctgccgagaaaatgacagcagacagaaatgggaacagatcgagggcaactccaagctgaggcacgtgggcagcaacctgtgcctggacagtcgcacggccaagagcgggggcctaagcgtggaggtgtgtggcccggccctttcgcagcagtggaagttcacgctcaacctgcagcagtaggagggtccgggaggccctgccgtcctgtctcctgcaccattgggtggagtctggtgatcacattattgattatgtttcttaaactttccgcgaaactaatatacctcagtattccatcatggtctgaaagtcaaacttcggcaaggcacggacgactgtgcagacacagcagcggcaagaagcgagaactgccctccccctcctctcggtgcagcccagccgggcccccttccccaggccggagcgcccctcttccttccagctttcacttctgccggctccgcaactgagtgacacccagcgacaaccgactggggagtggtagaagcaactgaacggatgcgtgcgagctgaggacagggcgggaggagggggcacacatgccccaggggagcgaggagaactcttgaaatctccattttcaatcccttcgaaatcacgtatggtttccacaaagccgagtcgtgtcacgtggcaggtttacgtcaatagtccctctctctgctcctccattcgcaagtgtcttcctgggccagactcccctccacctcatgtacttgctatattgaggatgaagttttctatggtgggacactaaatataaagctatatagagaaagaatgtacggtcagttccctatggtttctgtagatcatcgtcatcttgtatattccccacaaagccgttcgcagcttccgggagaaggggccagagcccggtggggccagtttctcacagagggaggaggtggcctttgtcccctggagcccgatcagccagttggtgctactgctgtggccagctggggggcttcctccagaccaccggcctcggccccggcatccctgttgggcgtcagcctgagagtccctactgtgcgtcagaatccaccttgcgtgctgtgcgtatctgtgaacctggagcggttacttattttgacagatatcactttgggtctttttacattaaatttcttttctctaaggaatataagacataccccatagctctgtgtgagccagcaataccgctgccccctggcgacagggcagaccaatgatgccaggcagctgtcacacgctagtattggcttcattgtgatctgagccctgcacgctgggccttcagaattaatggccagcagtgtcagggatgagcccgtcagccagggcacaggcctggctcacagtcctgcacacctgctggcctggggagctccagccaggcagcgagtcctgccccgcccgcagctccctcccacaccccgcctggccaagatgactgcttcagggggctttggggaaagaattaggaagggtcagaaccaaacaatacctgctcatttacactgaggattcagggcgggagacaggagccttggggtcctgttaaaccacagacagttatgaactgaaagtcataacggggagaggtgcctggcttctacctgggtgctcaggaatgttcctcgtcacccctgccactctgtggtcggtgccctgcttcctcctccactcctggccgccttctccagcgccgcacacacagatgctcagtctcagagaggctggcacggcctggcagtctgagaaaagcgtcagttaggcacacctgcaggcccctcggtgggacagcggcggccttggagttaggagccaccctgggaggttgtgccggtgccatgctcctccctgtgtcttgtatgaaaggggccactgtgtgtcttcctccccggcgggagccccacatgtgtgcactgtaggacagcggccccgaggtggaagcctggctggagggctgccctataggtcttctcttcccgcctcccctgccatgcaaccagatgtgttgtgagtgggcagcgtgcccccacgctggagtaactccgcacgcttctgtctttcacggtgggcgctcggggggagcctgaggaaaacccccttaggtacctgtgcgaggctgtggagtgcaggccagagcagggtgtgcgtagcccccagcacccaggttcttctgtcagaccctgtgacctgcgagctgctactactgtaaggagggaaatggatgaatctggctcgttttaaaatcacgttttctgacgaatcctttgccccttcacctttaccccgcccgcacccctaggccctctcagccttcctatcatcccacgtgtctacccagacccttgtgcggcccatgccctgggggcggcgtcctgtccctgagctgggaggcggctttggatggtccgggcgtcaagagcaggggtgggccggggaggggtcctttgcggtgagctatgtttacatgacacagtgtgccaaagtgacttactgcggttgcgttagtttctagtcatcaggactatctcaccctcccactcctgtttttaaaactcagaattctttcctaagagcccttcgagcaaagcgtgccgaagttagttgtcttctctgtgctggtcctttcttatgtcctcataaaagctcagatgatggtatctgtgagtatgttttgcaaattcaaaatatagtttggtaatttttttttccagttgatttttaaaaagaactgctgtacagagcttgtactttgtccattttatagatggaaaccatccttgaaaattgtttaacttaaataaagagaagatactttctagataccgctctttgctggccagagtctgtcctggtgtgtgagggctgggtggggtgggtgtggggactgggattggggtcagccttctgcagctcctgctcagtggctgtttcttatcaccttttgcagatgc

SEQ ID NO: 330711 - DNA, 4475 bp, Homo sapiens
tccgctcctcccccggcccccaccgcgcccgcggccggcccaggcagcactcgcgagcagcggcggccccgccggcggccgagttgggagaatgcggcggcgctcgcggatgctgctctgcttcgccttcctgtgggtgctgggcatcgcctactacatgtactcggggggcggctctgcgctggccgggggcgcgggcggcggcgccggcaggaaggaggactggaatgaaattgaccccattaaaaagaaagaccttcatcacagcaatggagaagagaaagcacaaagcatggagaccctccctccagggaaagtacggtggccagactttaaccaggaagcttatgttggagggacgatggtccgctccgggcaggacccttacgcccgcaacaagttcaaccaggtggagagtgataagcttcgaatggacagagccatccctgacacccggcatgaccagtgtcagcggaagcagtggcgggtggatctgccggccaccagcgtggtgatcacgtttcacaatgaagccaggtcggccctactcaggaccgtggtcagcgtgcttaagaaaagcccgccccatctcataaaagaaatcatcttggtggatgactacagcaatgatcctgaggacggggctctcttggggaaaattgagaaagtgcgagttcttagaaatgatcgacgagaaggcctcatgcgctcacgggttcggggggccgatgctgcccaagccaaggtcctgaccttcctggacagtcactgcgagtgtaatgagcactggctggagcccctcctggaaagggtggcggaggacaggactcgggttgtgtcacccatcatcgatgtcattaatatggacaactttcagtatgtgggggcatctgctgacttgaagggcggttttgattggaacttggtattcaagtgggattacatgacgcctgagcagagaaggtcccggcaggggaacccagtcgcccctataaaaacccccatgattgctggtgggctgtttgtgatggataagttctattttgaagaactggggaagtacgacatgatgatggatgtgtggggaggagagaacctagagatctcgttccgcgtgtggcagtgtggtggcagcctggagatcatcccgtgcagccgtgtgggacacgtgttccggaagcagcacccctacacgttcccgggtggcagtggcactgtctttgcccgaaacacccgccgggcagcagaggtctggatggatgaatacaaaaatttctattatgcagcagtgccttctgctagaaacgttccttatggaaatattcagagcagattggagcttaggaagaaactcagctgcaagcctttcaaatggtaccttgaaaatgtctatccagagttaagggttccagaccatcaggatatagcttttggggccttgcagcagggaactaactgcctcgacactttgggacactttgctgatggtgtggttggagtttatgaatgtcacaatgctgggggaaaccaggaatgggccttgacgaaggagaagtcggtgaagcacatggatttgtgccttactgtggtggaccgggcaccgggctctcttataaagctgcagggctgccgagaaaatgacagcagacagaaatgggaacagatcgagggcaactccaagctgaggcacgtgggcagcaacctgtgcctggacagtcgcacggccaagagcgggggcctaagcgtggaggtgtgtggcccggccctttcgcagcagtggaagttcacgctcaacctgcagcagtaggagggtccgggaggccctgccgtcctgtctcctgcaccattgggtggagtctggtgatcacattattgattatgtttcttaaactttccgcgaaactaatatacctcagtattccatcatggtctgaaagtcaaacttcggcaaggcacggacgactgtgcagacacagcagcggcaagaagcgagaactgccctccccctcctctcggtgcagcccagccgggcccccttccccaggccggagcgcccctcttccttccagctttcacttctgccggctccgcaactgagtgacacccagcgacaaccgactggggagtggtagaagcaactgaacggatgcgtgcgagctgaggacagggcgggaggagggggcacacatgccccaggggagcgaggagaactcttgaaatctccattttcaatcccttcgaaatcacgtatggtttccacaaagccgagtcgtgtcacgtggcaggtttacgtcaatagtccctctctctgctcctccattcgcaagtgtcttcctgggccagactcccctccacctcatgtacttgctatattgaggatgaagttttctatggtgggacactaaatataaagctatatagagaaagaatgtacggtcagttccctatggtttctgtagatcatcgtcatcttgtatattccccacaaagccgttcgcagcttccgggagaaggggccagagcccggtggggccagtttctcacagagggaggaggtggcctttgtcccctggagcccgatcagccagttggtgctactgctgtggccagctggggggcttcctccagaccaccggcctcggccccggcatccctgttgggcgtcagcctgagagtccctactgtgcgtcagaatccaccttgcgtgctgtgcgtatctgtgaacctggagcggttacttattttgacagatatcactttgggtctttttacattaaatttcttttctctaaggaatataagacataccccatagctctgtgtgagccagcaataccgctgccccctggcgacagggcagaccaatgatgccaggcagctgtcacacgctagtattggcttcattgtgatctgagccctgcacgctgggccttcagaattaatggccagcagtgtcagggatgagcccgtcagccagggcacaggcctggctcacagtcctgcacacctgctggcctggggagctccagccaggcagcgagtcctgccccgcccgcagctccctcccacaccccgcctggccaagatgactgcttcagggggctttggggaaagaattaggaagggtcagaaccaaacaatacctgctcatttacactgaggattcagggcgggagacaggagccttggggtcctgttaaaccacagacagttatgaactgaaagtcataacggggagaggtgcctggcttctacctgggtgctcaggaatgttcctcgtcacccctgccactctgtggtcggtgccctgcttcctcctccactcctggccgccttctccagcgccgcacacacagatgctcagtctcagagaggctggcacggcctggcagtctgagaaaagcgtcagttaggcacacctgcaggcccctcggtgggacagcggcggccttggagttaggagccaccctgggaggttgtgccggtgccatgctcctccctgtgtcttgtatgaaaggggccactgtgtgtcttcctccccggcgggagccccacatgtgtgcactgtaggacagcggccccgaggtggaagcctggctggagggctgccctataggtcttctcttcccgcctcccctgccatgcaaccagatgtgttgtgagtgggcagcgtgcccccacgctggagtaactccgcacgcttctgtctttcacggtgggcgctcggggggagcctgaggaaaacccccttaggtacctgtgcgaggctgtggagtgcaggccagagcagggtgtgcgtagcccccagcacccaggttcttctgtcagaccctgtgacctgcgagctgctactactgtaaggagggaaatggatgaatctggctcgttttaaaatcacgttttctgacgaatcctttgccccttcacctttaccccgcccgcacccctaggccctctcagccttcctatcatcccacgtgtctacccagacccttgtgcggcccatgccctgggggcggcgtcctgtccctgagctgggaggcggctttggatggtccgggcgtcaagagcaggggtgggccggggaggggtcctttgcggtgagctatgtttacatgacacagtgtgccaaagtgacttactgcggttgcgttagtttctagtcatcaggactatctcaccctcccactcctgtttttaaaactcagaattctttcctaagagcccttcgagcaaagcgtgccgaagttagttgtcttctctgtgctggtcctttcttatgtcctcataaaagctcagatgatggtatctgtgagtatgttttgcaaattcaaaatatagtttggtaatttttttttccagttgatttttaaaaagaactgctgtacagagcttgtactttgtccattttatagatggaaaccatccttgaaaattgtttaacttaaataaagagaagatactttctagatacc

SEQ ID NO: 330712 - DNA, 3126 bp, Homo sapiens
tctatgttgtcccccgcgtatgggatatcgtcgaccagcgcctcgcagagttaagggttccagaccatcaggatatagcttttggggccttgcagcagggaactaactgcctcgacactttgggacactttgctgatggtgtggttggagtttatgaatgtcacaatgctgggggaaaccaggaatgggccttgacgaaggagaagtcggtgaagcacatggatttgtgccttactgtggtggaccgggcaccgggctctcttataaagctgcagggctgccgagaaaatgacagcagacagaaatgggaacagatcgagggcaactccaagctgaggcacgtgggcagcaacctgtgcctggacagtcgcacggccaagagcgggggcctaagcgtggaggtgtgtggcccggccctttcgcagcagtggaagttcacgctcaacctgcagcagtaggagggtccgggaggccctgccgtcctgtctcctgcaccattgggtggagtctggtgatcacattattgattatgtttcttaaactttccgcgaaactaatatacctcagtattccatcatggtctgaaagtcaaacttcggcaaggcacggacgactgtgcagacacagcagcggcaagaagcgagaactgccctccccctcctctcggtgcagcccagccgggcccccttccccaggccggagcgcccctcttccttccagctttcacttctgccggctccgcaactgagtgacacccagcgacaaccgactggggagtggtagaagcaactgaacggatgcgtgcgagctgaggacagggcgggaggagggggcacacatgccccaggggagcgaggagaactcttgaaatctccattttcaatcccttcgaaatcacgtatggtttccacaaagccgagtcgtgtcacgtggcaggtttacgtcaatagtccctctctctgctcctccattcgcaagtgtcttcctgggccagactcccctccacctcatgtacttgctatattgaggatgaagttttctatggtgggacactaaatataaagctatatagagaaagaatgtacggtcagttccctatggtttctgtagatcatcgtcatcttgtatattccccacaaagccgttcgcagcttccgggagaaggggccagagcccggtggggccagtttctcacagagggaggaggtggcctttgtcccctggagcccgatcagccagttggtgctactgctgtggccagctggggggcttcctccagaccaccggcctcggccccggcatccctgttgggcgtcagcctgagagtccctactgtgcgtcagaatccaccttgcgtgctgtgcgtatctgtgaacctggagcggttacttattttgacagatatcactttgggtctttttacattaaatttcttttctctaaggaatataagacataccccatagctctgtgtgagccagcaataccgctgccccctggcgacagggcagaccaatgatgccaggcagctgtcacacgctagtattggcttcattgtgatctgagccctgcacgctgggccttcagaattaatggccagcagtgtcagggatgagcccgtcagccagggcacaggcctggctcacagtcctgcacacctgctggcctggggagctccagccaggcagcgagtcctgccccgcccgcagctccctcccacaccccgcctggccaagatgactgcttcagggggctttggggaaagaattaggaagggtcagaaccaaacaatacctgctcatttacactgaggattcagggcgggagacaggagccttggggtcctgttaaaccacagacagttatgaactgaaagtcataacggggagaggtgcctggcttctacctgggtgctcaggaatgttcctcgtcacccctgccactctgtggtcggtgccctgcttcctcctccactcctggccgccttctccagcgccgcacacacagatgctcagtctcagagaggctggcacggcctggcagtctgagaaaagcgtcagttaggcacacctgcaggcccctcggtgggacagcggcggccttggagttaggagccaccctgggaggttgtgccggtgccatgctcctccctgtgtcttgtatgaaaggggccactgtgtgtcttcctccccggcgggagccccacatgtgtgcactgtaggacagcggccccgaggtggaagcctggctggagggctgccctataggtcttctcttcccgcctcccctgccatgcaaccagatgtgttgtgagtgggcagcgtgcccccacgctggagtaactccgcacgcttctgtctttcacggtgggcgctcggggggagcctgaggaaaacccccttaggtacctgtgcgaggctgtggagtgcaggccagagcagggtgtgcgtagcccccagcacccaggttcttctgtcagaccctgtgacctgcgagctgctactactgtaaggagggaaatggatgaatctggctcgttttaaaatcacgttttctgacgaatcctttgccccttcacctttaccccgcccgcacccctaggccctctcagccttcctatcatcccacgtgtctacccagacccttgtgcggcccatgccctgggggcggcgtcctgtccctgagctgggaggcggctttggatggtccgggcgtcaagagcaggggtgggccggggaggggtcctttgcggtgagctatgtttacatgacacagtgtgccaaagtgacttactgcggttgcgttagtttctagtcatcaggactatctcaccctcccactcctgtttttaaaactcagaattctttcctaagagcccttcgagcaaagcgtgccgaagttagttgtcttctctgtgctggtcctttcttatgtcctcataaaagctcagatgatggtatctgtgagtatgttttgcaaattcaaaatatagtttggtaatttttttttccagttgatttttaaaaagaactgctgtacagagcttgtactttgtccattttatagatggaaaccatccttgaaaattgtttaacttaaataaagagaagatactttctagatacc

SEQ ID NO: 330713 - DNA, 2551 bp, Homo sapiens
  misc_feature (12)..(12): n is a, c, g, or t
ggcaccgtgagntgtacgtgttgcatgatgcacagcgatgcgtgctaaagaaaagccgaagaaacgtgcgccgttcctccccctcctctcggtgcagcccagccgggcccccttccccaggccggagcgcccctcttccttccagctttcacttctgccggctccgcaactgagtgacacccagcgacaaccgactggggagtggtagaagcaactgaacggatgcgtgcgagctgaggacagggcgggaggagggggcacacatgccccaggggagcgaggagaactcttgaaatctccattttcaatcccttcgaaatcacgtatggtttccacaaagccgagtcgtgtcacgtggcaggtttacgtcaatagtccctctctctgctcctccattcgcaagtgtcttcctgggccagactcccctccacctcatgtacttgctatattgaggatgaagttttctatggtgggacactaaatataaagctatatagagaaagaatgtacggtcagttccctatggtttctgtagatcatcgtcatcttgtatattccccacaaagccgttcgcagcttccgggagaaggggccagagcccggtggggccagtttctcacagagggaggaggtggcctttgtcccctggagcccgatcagccagttggtgctactgctgtggccagctggggggcttcctccagaccaccggcctcggccccggcatccctgttgggcgtcagcctgagagtccctactgtgcgtcagaatccaccttgcgtgctgtgcgtatctgtgaacctggagcggttacttattttgacagatatcactttgggtctttttacattaaatttcttttctctaaggaatataagacataccccatagctctgtgtgagccagcaataccgctgccccctggcgacagggcagaccaatgatgccaggcagctgtcacacgctagtattggcttcattgtgatctgagccctgcacgctgggccttcagaattaatggccagcagtgtcagggatgagcccgtcagccagggcacaggcctggctcacagtcctgcacacctgctggcctggggagctccagccaggcagcgagtcctgccccgcccgcagctccctcccacaccccgcctggccaagatgactgcttcagggggctttggggaaagaattaggaagggtcagaaccaaacaatacctgctcatttacactgaggattcagggcgggagacaggagccttggggtcctgttaaaccacagacagttatgaactgaaagtcataacggggagaggtgcctggcttctacctgggtgctcaggaatgttcctcgtcacccctgccactctgtggtcggtgccctgcttcctcctccactcctggccgccttctccagcgccgcacacacagatgctcagtctcagagaggctggcacggcctggcagtctgagaaaagcgtcagttaggcacacctgcaggcccctcggtgggacagcggcggccttggagttaggagccaccctgggaggttgtgccggtgccatgctcctccctgtgtcttgtatgaaaggggccactgtgtgtcttcctccccggcgggagccccacatgtgtgcactgtaggacagcggccccgaggtggaagcctggctggagggctgccctataggtcttctcttcccgcctcccctgccatgcaaccagatgtgttgtgagtgggcagcgtgcccccacgctggagtaactccgcacgcttctgtctttcacggtgggcgctcggggggagcctgaggaaaacccccttaggtacctgtgcgaggctgtggagtgcaggccagagcagggtgtgcgtagcccccagcacccaggttcttctgtcagaccctgtgacctgcgagctgctactactgtaaggagggaaatggatgaatctggctcgttttaaaatcacgttttctgacgaatcctttgccccttcacctttaccccgcccgcacccctaggccctctcagccttcctatcatcccacgtgtctacccagacccttgtgcggcccatgccctgggggcggcgtcctgtccctgagctgggaggcggctttggatggtccgggcgtcaagagcaggggtgggccggggaggggtcctttgcggtgagctatgtttacatgacacagtgtgccaaagtgacttactgcggttgcgttagtttctagtcatcaggactatctcaccctcccactcctgtttttaaaactcagaattctttcctaagagcccttcgagcaaagcgtgccgaagttagttgtcttctctgtgctggtcctttcttatgtcctcataaaagctcagatgatggtatctgtgagtatgttttgcaaattcaaaatatagtttggtaatttttttttccagttgatttttaaaaagaactgctgtacagagcttgtactttgtccattttatagatggaaaccatccttgaaaattgtttaacttaaataaagagaagatactttctagatacc

SEQ ID NO: 330714 - DNA, 2710 bp, Homo sapiens
tgaaggaaaatttgtattatttcaattatttttatgtacagaaaactcaacagtgtacatttaacccagtttagtggcaagttctttagcctttgccttttcgagcttggcgatacgagccacagacttaggacccaggacattgccaccccagtgacggcggatctcatcgtatctgtcattgtaattggtcctgatagcttccaccagcttagccaaagcgcctttgtcttccgagttcacctgtgtgaaggcgacagtggtgcaggtcttcctgtggactagacgcccctcttccttccagctttcacttctgccggctccgcaactgagtgacacccagcgacaaccgactggggagtggtagaagcaactgaacggatgcgtgcgagctgaggacagggcgggaggagggggcacacatgccccaggggagcgaggagaactcttgaaatctccattttcaatcccttcgaaatcacgtatggtttccacaaagccgagtcgtgtcacgtggcaggtttacgtcaatagtccctctctctgctcctccattcgcaagtgtcttcctgggccagactcccctccacctcatgtacttgctatattgaggatgaagttttctatggtgggacactaaatataaagctatatagagaaagaatgtacggtcagttccctatggtttctgtagatcatcgtcatcttgtatattccccacaaagccgttcgcagcttccgggagaaggggccagagcccggtggggccagtttctcacagagggaggaggtggcctttgtcccctggagcccgatcagccagttggtgctactgctgtggccagctggggggcttcctccagaccaccggcctcggccccggcatccctgttgggcgtcagcctgagagtccctactgtgcgtcagaatccaccttgcgtgctgtgcgtatctgtgaacctggagcggttacttattttgacagatatcactttgggtctttttacattaaatttcttttctctaaggaatataagacataccccatagctctgtgtgagccagcaataccgctgccccctggcgacagggcagaccaatgatgccaggcagctgtcacacgctagtattggcttcattgtgatctgagccctgcacgctgggccttcagaattaatggccagcagtgtcagggatgagcccgtcagccagggcacaggcctggctcacagtcctgcacacctgctggcctggggagctccagccaggcagcgagtcctgccccgcccgcagctccctcccacaccccgcctggccaagatgactgcttcagggggctttggggaaagaattaggaagggtcagaaccaaacaatacctgctcatttacactgaggattcagggcgggagacaggagccttggggtcctgttaaaccacagacagttatgaactgaaagtcataacggggagaggtgcctggcttctacctgggtgctcaggaatgttcctcgtcacccctgccactctgtggtcggtgccctgcttcctcctccactcctggccgccttctccagcgccgcacacacagatgctcagtctcagagaggctggcacggcctggcagtctgagaaaagcgtcagttaggcacacctgcaggcccctcggtgggacagcggcggccttggagttaggagccaccctgggaggttgtgccggtgccatgctcctccctgtgtcttgtatgaaaggggccactgtgtgtcttcctccccggcgggagccccacatgtgtgcactgtaggacagcggccccgaggtggaagcctggctggagggctgccctataggtcttctcttcccgcctcccctgccatgcaaccagatgtgttgtgagtgggcagcgtgcccccacgctggagtaactccgcacgcttctgtctttcacggtgggcgctcggggggagcctgaggaaaacccccttaggtacctgtgcgaggctgtggagtgcaggccagagcagggtgtgcgtagcccccagcacccaggttcttctgtcagaccctgtgacctgcgagctgctactactgtaaggagggaaatggatgaatctggctcgttttaaaatcacgttttctgacgaatcctttgccccttcacctttaccccgcccgcacccctaggccctctcagccttcctatcatcccacgtgtctacccagacccttgtgcggcccatgccctgggggcggcgtcctgtccctgagctgggaggcggctttggatggtccgggcgtcaagagcaggggtgggccggggaggggtcctttgcggtgagctatgtttacatgacacagtgtgccaaagtgacttactgcggttgcgttagtttctagtcatcaggactatctcaccctcccactcctgtttttaaaactcagaattctttcctaagagcccttcgagcaaagcgtgccgaagttagttgtcttctctgtgctggtcctttcttatgtcctcataaaagctcagatgatggtatctgtgagtatgttttgcaaattcaaaatatagtttggtaatttttttttccagttgatttttaaaaagaactgctgtacagagcttgtactttgtccattttatagatggaaaccatccttgaaaattgtttaacttaaataaagagaagatactttctagatacc

SEQ ID NO: 330715 - DNA, 4982 bp, Homo sapiens
tccgctcctcccccggcccccaccgcgcccgcggccggcccaggcagcactcgcgagcagcggcggccccgccggcggccgagttgggagaatgcggcggcgctcgcggatgctgctctgcttcgccttcctgtgggtgctgggcatcgcctactacatgtactcggggggcggctctgcgctggccgggggcgcgggcggcggcgccggcaggaaggaggactggaatgaaattgaccccattaaaaagaaagaccttcatcacagcaatggagaagagaaagcacaaagcatggagaccctccctccagggaaagtacggtggccagactttaaccaggaagcttatgttggagggacgatggtccgctccgggcaggacccttacgcccgcaacaagttcaaccaggtggagagtgataagcttcgaatggacagagccatccctgacacccggcatgaccagtgtcagcggaagcagtggcgggtggatctgccggccaccagcgtggtgatcacgtttcacaatgaagccaggtcggccctactcaggaccgtggtcagcgtgcttaagaaaagcccgccccatctcataaaagaaatcatcttggtggatgactacagcaatgatcctgaggacggggctctcttggggaaaattgagaaagtgcgagttcttagaaatgatcgacgagaaggcctcatgcgctcacgggttcggggggccgatgctgcccaagccaaggtcctgaccttcctggacagtcactgcgagtgtaatgagcactggctggagcccctcctggaaagggtggcggaggacaggactcgggttgtgtcacccatcatcgatgtcattaatatggacaactttcagtatgtgggggcatctgctgacttgaagggcggttttgattggaacttggtattcaagtgggattacatgacgcctgagcagagaaggtcccggcaggggaacccagtcgcccctataaaaacccccatgattgctggtgggctgtttgtgatggataagttctattttgaagaactggggaagtacgacatgatgatggatgtgtggggaggagagaacctagagatctcgttccgcgtgtggcagtgtggtggcagcctggagatcatcccgtgcagccgtgtgggacacgtgttccggaagcagcacccctacacgttcccgggtggcagtggcactgtctttgcccgaaacacccgccgggcagcagaggtctggatggatgaatacaaaaatttctattatgcagcagtgccttctgctagaaacgttccttatggaaatattcagagcagattggagcttaggaagaaactcagctgcaagcctttcaaatggtaccttgaaaatgtctatccagagttaagggttccagaccatcaggatatagcttttggggccttgcagcagggaactaactgcctcgacactttgggacactttgctgatggtgtggttggagtttatgaatgtcacaatgctgggggaaaccaggaatgggccttgacgaaggagaagtcggtgaagcacatggatttgtgccttactgtggtggaccgggcaccgggctctcttataaagctgcagggctgccgagaaaatgacagcagacagaaatgggaacagatcgagggcaactccaagctgaggcacgtgggcagcaacctgtgcctggacagtcgcacggccaagagcgggggcctaagcgtggaggtgtgtggcccggccctttcgcagcagtggaagttcacgctcaacctgcagcagtaggagggtccgggaggccctgccgtcctgtctcctgcaccattgggtggagtctggtgatcacattattgattatgtttcttaaactttccgcgaaactaatatacctcagtattccatcatggtctgaaagtcaaacttcggcaaggcacggacgactgtgcagacacagcagcggcaagaagcgagaactgccctccccctcctctcggtgcagcccagccgggcccccttccccaggccggagcgcccctcttccttccagctttcacttctgccggctccgcaactgagtgacacccagcgacaaccgactggggagtggtagaagcaactgaacggatgcgtgcgagctgaggacagggcgggaggagggggcacacatgccccaggggagcgaggagaactcttgaaatctccattttcaatcccttcgaaatcacgtatggtttccacaaagccgagtcgtgtcacgtggcaggtttacgtcaatagtccctctctctgctcctccattcgcaagtgtcttcctgggccagactcccctccacctcatgtacttgctatattgaggatgaagttttctatggtgggacactaaatataaagctatatagagaaagaatgtacggtcagttccctatggtttctgtagatcatcgtcatcttgtatattccccacaaagccgttcgcagcttccgggagaaggggccagagcccggtggggccagtttctcacagagggaggaggtggcctttgtcccctggagcccgatcagccagttggtgctactgctgtggccagctggggggcttcctccagaccaccggcctcggccccggcatccctgttgggcgtcagcctgagagtccctactgtgcgtcagaatccaccttgcgtgctgtgcgtatctgtgaacctggagcggttacttattttgacagatatcactttgggtctttttacattaaatttcttttctctaaggaatataagacataccccatagctctgtgtgagccagcaataccgctgccccctggcgacagggcagaccaatgatgccaggcagctgtcacacgctagtattggcttcattgtgatctgagccctgcacgctgggccttcagaattaatggccagcagtgtcagggatgagcccgtcagccagggcacaggcctggctcacagtcctgcacacctgctggcctggggagctccagccaggcagcgagtcctgccccgcccgcagctccctcccacaccccgcctggccaagatgactgcttcagggggctttggggaaagaattaggaagggtcagaaccaaacaatacctgctcatttacactgaggattcagggcgggagacaggagccttggggtcctgttaaaccacagacagttatgaactgaaagtcataacggggagaggtgcctggcttctacctgggtgctcaggaatgttcctcgtcacccctgccactctgtggtcggtgccctgcttcctcctccactcctggccgccttctccagcgccgcacacacagatgctcagtctcagagaggctggcacggcctggcagtctgagaaaagcgtcagttaggcacacctgcaggcccctcggtgggacagcggcggccttggagttaggagccaccctgggaggttgtgccggtgccatgctcctccctgtgtcttgtatgaaaggggccactgtgtgtcttcctccccggcgggagccccacatgtgtgcactgtaggacagcggccccgaggtggaagcctggctggagggctgccctataggtcttctcttcccgcctcccctgccatgcaaccagatgtgttgtgagtgggcagcgtgcccccacgctggagtaactccgcacgcttctgtctttcacggtgggcgctcggggggagcctgaggaaaacccccttaggtacctgtgcgaggctgtggagtgcaggccagagcagggtgtgcgtagcccccagcacccaggttcttctgtcagaccctgtgacctgcgagctgctactactgtaaggagggaaatggatgaatctggctcgttttaaaatcacgttttctgacgaatcctttgccccttcacctttaccccgcccgcacccctaggccctctcagccttcctatcatcccacgtgtctacccagacccttgtgcggcccatgccctgggggcggcgtcctgtccctgagctgggaggcggctttggatggtccgggcgtcaagagcaggggtgggccggggaggggtcctttgcggtgagctatgtttacatgacacagtgtgccaaagtgacttactgcggttgcgttagtttctagtcatcaggactatctcaccctcccactcctgtttttaaaactcagaattctttcctaagagcccttcgagcaaagcgtgccgaagttagttgtcttctctgtgctggtcctttcttatgtcctcataaaagctcagatgatggtatctgtgagtatgttttgcaaattcaaaatatagtttggtaatttttttttccagttgatttttaaaaagaactgctgtacagagcttgtactttgtccattttatagatggaaaccatccttgaaaattgtttaacttaaataaagagaagatactttctagataccaaaaaaaaaaaaaaaaaaaaaaaaaaaaaaaaaaaaaaaaaaaaaaaaaaaaaaaaaaaaaaaaaaaaaaagaaaaaaaaaaaaaaaaaaaaaaaaaaaaaagcaaagaaaaagcaaagaaacaaagaggcctggcgtgacagaacgaagacacaacgcggaagccgcgacaagacaagagaagaagacgacgaaagaaggacggagggacaaagacaggtcacgcagtataaggagtacgccgagaagcaagggggggacgagacccagacaaagcaaggacaggaacaaagagacgagaggagaggacggagcggtgaggagacaacaacaccaacgaagcagaccggagaacggcgcgggagaggaaacagaaggaagacaaagagaaaaagaggaaagaggacgagggatagaagagcgaaaaagcacgacagaccgagcaaagcaacgcacggagaaggaaaagaagagaggcagagacagaagcaacacagcgcgcgagag

SEQ ID NO: 330716 - DNA, 2427 bp, Homo sapiens
tccgctcctcccccggcccccaccgcgcccgcggccggcccaggcagcactcgcgagcagcggcggccccgccggcggccgagttgggagaatgcggcggcgctcgcggatgctgctctgcttcgccttcctgtgggtgctgggcatcgcctactacatgtactcggggggcggctctgcgctggccgggggcgcgggcggcggcgccggcaggaaggaggactggaatgaaattgaccccattaaaaagaaagaccttcatcacagcaatggagaagagaaagcacaaagcatggagaccctccctccagggaaagtacggtggccagactttaaccaggaagcttatgttggagggacgatggtccgctccgggcaggacccttacgcccgcaacaagttcaaccaggtggagagtgataagcttcgaatggacagagccatccctgacacccggcatgaccagtgtcagcggaagcagtggcgggtggatctgccggccaccagcgtggtgatcacgtttcacaatgaagccaggtcggccctactcaggaccgtggtcagcgtgcttaagaaaagcccgccccatctcataaaagaaatcatcttggtggatgactacagcaatgatcctgaggacggggctctcttggggaaaattgagaaagtgcgagttcttagaaatgatcgacgagaaggcctcatgcgctcacgggttcggggggccgatgctgcccaagccaaggtcctgaccttcctggacagtcactgcgagtgtaatgagcactggctggagcccctcctggaaagggtggcggaggacaggactcgggttgtgtcacccatcatcgatgtcattaatatggacaactttcagtatgtgggggcatctgctgacttgaagggcggttttgattggaacttggtattcaagtgggattacatgacgcctgagcagagaaggtcccggcaggggaacccagtcgcccctataaaaacccccatgattgctggtgggctgtttgtgatggataagttctattttgaagaactggggaagtacgacatgatgatggatgtgtggggaggagagaacctagagatctcgttccgcgtgtggcagtgtggtggcagcctggagatcatcccgtgcagccgtgtgggacacgtgttccggaagcagcacccctacacgttcccgggtggcagtggcactgtctttgcccgaaacacccgccgggcagcagaggtctggatggatgaatacaaaaatttctattatgcagcagtgccttctgctagaaacgttccttatggaaatattcagagcagattggagcttaggaagaaactcagctgcaagcctttcaaatggtaccttgaaaatgtctatccagagttaagggttccagaccatcaggatatagcttttggggccttgcagcagggaactaactgcctcgacactttgggacactttgctgatggtgtggttggagtttatgaatgtcacaatgctgggggaaaccaggaatgggccttgacgaaggagaagtcggtgaagcacatggatttgtgccttactgtggtggaccgggcaccgggctctcttataaagctgcagggctgccgagaaaatgacagcagacagaaatgggaacagatcgagggcaactccaagctgaggcacgtgggcagcaacctgtgcctggacagtcgcacggccaagagcgggggcctaagcgtggaggtgtgtggcccggccctttcgcagcagtggaagttcacgctcaacctgcagcagtaggagggtccgggaggccctgccgtcctgtctcctgcaccattgggtggagtctggtgatcacattattgattatgtttcttaaactttccgcgaaactaatatacctcagtattccatcatggtctgaaagtcaaacttcggcaaggcacggacgactgtgcagacacagcagcggcaagaagcgagaactgccctccccctcctctcggtgcagcccagccgggcccccttccccaggccggagcgcccctcttccttccagctttcacttctgccggctccgcaactgagtgacacccagcgacaaccgactggggagtggtagaagcaactgaacggatgcgtgcgagctgaggacagggcgggaggagggggcacacatgccccaggggagcgaggagaactcttgaaatctccattttcaatcccttcgaaatcacgtatggtttccacaaagccgagtcgtgtcacgtggcaggtttacgtcaatagtccctctctctgctcctccattcgcaagtgtcttcctgggccagactcccctccacctcatgtacttgctatattgaggatgaagttttctatggtgggacactaaatataaagctatatagagaaag

SEQ ID NO: 330717 - DNA, 2056 bp, Homo sapiens
tccgctcctcccccggcccccaccgcgcccgcggccggcccaggcagcactcgcgagcagcggcggccccgccggcggccgagttgggagaatgcggcggcgctcgcggatgctgctctgcttcgccttcctgtgggtgctgggcatcgcctactacatgtactcggggggcggctctgcgctggccgggggcgcgggcggcggcgccggcaggaaggaggactggaatgaaattgaccccattaaaaagaaagaccttcatcacagcaatggagaagagaaagcacaaagcatggagaccctccctccagggaaagtacggtggccagactttaaccaggaagcttatgttggagggacgatggtccgctccgggcaggacccttacgcccgcaacaagttcaaccaggtggagagtgataagcttcgaatggacagagccatccctgacacccggcatgaccagtgtcagcggaagcagtggcgggtggatctgccggccaccagcgtggtgatcacgtttcacaatgaagccaggtcggccctactcaggaccgtggtcagcgtgcttaagaaaagcccgccccatctcataaaagaaatcatcttggtggatgactacagcaatgatcctgaggacggggctctcttggggaaaattgagaaagtgcgagttcttagaaatgatcgacgagaaggcctcatgcgctcacgggttcggggggccgatgctgcccaagccaaggtcctgaccttcctggacagtcactgcgagtgtaatgagcactggctggagcccctcctggaaagggtggcggaggacaggactcgggttgtgtcacccatcatcgatgtcattaatatggacaactttcagtatgtgggggcatctgctgacttgaagggcggttttgattggaacttggtattcaagtgggattacatgacgcctgagcagagaaggtcccggcaggggaacccagtcgcccctataaaaacccccatgattgctggtgggctgtttgtgatggataagttctattttgaagaactggggaagtacgacatgatgatggatgtgtggggaggagagaacctagagatctcgttccgcgtgtggcagtgtggtggcagcctggagatcatcccgtgcagccgtgtgggacacgtgttccggaagcagcacccctacacgttcccgggtggcagtggcactgtctttgcccgaaacacccgccgggcagcagaggtctggatggatgaatacaaaaatttctattatgcagcagtgccttctgctagaaacgttccttatggaaatattcagagcagattggagcttaggaagaaactcagctgcaagcctttcaaatggtaccttgaaaatgtctatccagagttaagggttccagaccatcaggatatagcttttggggccttgcagcagggaactaactgcctcgacactttgggacactttgctgatggtgtggttggagtttatgaatgtcacaatgctgggggaaaccaggaatgggccttgacgaaggagaagtcggtgaagcacatggatttgtgccttactgtggtggaccgggcaccgggctctcttataaagctgcagggctgccgagaaaatgacagcagacagaaatgggaacagatcgagggcaactccaagctgaggcacgtgggcagcaacctgtgcctggacagtcgcaactgagtgacacccagcgacaaccgactggggagtggtagaagcaactgaacggatgcgtgcgagctgaggacagggcgggaggagggggcacacatgccccaggggagcgaggagaactcttgaaatctccattttcaatcccttcgaaatcacgtatggtttccacaaagccgagtcgtgtcacgtggcaggtttacgtcaatagtccctctctctgctcctccattcgcaagtgtcttcctgggccagactcccctccacctcatgtacttgctatattgaggatgaagttttctatggtgggacactaaatataaagctatatagagaaag

SEQ ID NO: 330718 - DNA, 284 bp, Homo sapiens
ccaaagtgctgggattacaggcatgagccaccgtggccggccactaatttcttattatgttacaactcttcttccttctacttgttattccagttctgccatttcccagcattatagcattgggaaaattacttcccttatttgagttcctcatttgcaaaatatggttaacaatttctaaggctatgttggatattatagtcaatataaataataaaagtgcttggtataggacctggtataaaatatcaggcagtaaatgttaaaggggttattataaaagg

SEQ ID NO: 330719 - DNA, 1426 bp, Homo sapiens
agagatggggtttcaccgtgttggccaggctgctcttgaactcctgacctcaggtgatccccacctcagcctcccaaagtgctgggattacagacatgagccaccgcacccagaacctaaggcccaagttctactttttggtgttcatttctctgcttccttttgatcgtggtgtctgatcatcttggaattcacattactcaaggcaaaataggaagccatctgcgtgatgtcacattccgaagaagtcagaaggttcggcgagttggagctttactcttgttgcccaggctagagtgcagtggtgcgatcttggctcattgcaagctccgcttcctgggtttaagctattctcctgccttggcctcccaagtagctgggattacaggcatgtgccgtcactcctggctaattttgtatttttagtagagatgcaatttcaccatgttggtcaggctggtctcgaactcctgacctcaagtgatctggccgcctcagcctcccaaagtgctgggattacaggcttgagaccccatgtctggccccttctgtggggtcttgattgagccccttcacttggagtctgacttcattacctcgtctgaaacaaggtgcctccaagctttgggttgatttccagaatcttgttgggttaaacataagtagaagtttgatcataaaggatgttattaagccggataggtaagcacggtgacaatggcaatagaaatctaatggaaaacgattgaatgacaactacaccaaagtttcatggatgaaactcaccccagaaacttagtgttcaaatcagagtgatacacaattcaaaatgtgattttaaacttctggaaatatgtgtgtttgtgaagatccaaatccaattcagcaacctccatcaggcagaaaccttctgcaatcctcacatgaggaactggttcacagtgtacacagcatggagccattagtgacgttatccaaaggatgagacaagacaaaagttactgtctaataaaaggaaaattaggaacaggaatgctctttaaactcaggaagatcttttggggtgtcaaactggacagcacagaatcattagaaaaattagcttggcgtgagaagagacattgaggtcttctctgtaaaatttacttagatacttgtgaataggactgaaatttatattttgggcactctttacctcagattcagagttcttaggattatttaaaattcatttgctggatgttttcaagtataaacaataagaaaactgcaacttcaacttaaaaggcactgctgtatttgcaccctatattttgacctgtcgttaggtactgttgaatatttttatctgtaagcatttatgaagtgcaaaataaacatgttattatatagaaagcgtctgctgcttagttttaatcaccagcta

SEQ ID NO: 330720 - DNA, 1391 bp, Homo sapiens
agagatggggtttcaccgtgttggccaggctgctcttgaactcctgacctcaggtgatccccacctcagcctcccaaagtgctgggattacagacatgagccaccgcacccagaacctaaggcccaagttctactttttggtgttcatttctctgcttccttttgatcgtggtgtctgatcatcttggaattcacattactcaaggcaaaataggaagccatctgcgtgatgtcacattccgaagaagtcagaaggttcggcgagttggagctttactcttgttgcccaggctagagtgcagtggtgcgatcttggctcattgcaagctccgcttcctgggtttaagctattctcctgccttggcctcccaagtagctgggattacaggcatgtgccgtcactcctggctaattttgtatttttagtagagatgcaatttcaccatgttggtcaggctggtctcgaactcctgacctcaagtgatctggccgcctcagcctcccaaagtgctgggattacaggcttgagaccccatgtctggccccttctgtggggtcttgattgagccccttcacttggagtctgacttcattacctcgtctgaaacaaggtgcctccaagctttgggttgatttccagaatcttgttgggttaaacataagtagaagtttgatcataaaggatgttattaagccggataggtaagcacggtgacaatggcaatagaaatctaatggaaaacgattgaatgacaactacaccaaagtttcatggatgaaactcaccccagaaacttagtgttcaaatcagagtgatacacaattcaaaatgtgattttaaacttctggaaatatgtgtgtttgtgaagatccaaatccaattcagcaacctccatcaggcagaaaccttctgcaatcctcacatgaggaactggttcacagtgtacacagcatggagccattagtgacgttatccaaaggatgagacaagacaaaagttactgtctaataaaaggaaaattaggaacaggaatgctctttaaactcaggaagatcttttggggtgtcaaactggacagcacagaatcattagaaaaattagcttggcgtgagaagagacattgaggtcttctctgtaaaatttacttagatacttgtgaataggactgaaatttatattttgggcactctttacctcagattcagagttcttaggattatttaaaattcatttgctggatgttttcaagtataaacaataagaaaactgcaacttcaacttaaaaggcactgctgtatttgcaccctatattttgacctgtcgttaggtactgttgaatatttttatctgtaagcatttatgaagtgcaaaataaacatgttattatata

SEQ ID NO: 330721 - DNA, 320 bp, Homo sapiens
ttgtattgagtctagctaagaccagtttttttacttactatgatttttaacttaaacacatttcaaaagaaaactttgtatcattatcaccattatcacttaccatttatggaaagcatcacaaaagataaatatggatctcctaaaactaggggaatcccattgggattctttctgttgtttatttctgttgtcctggtgtaattattaataacattgttttgactcacaaaatgtcccagtctagacaatcaatgatgtgatcaccctacctaaaatgatttgcgtacccccaggggtgcacataccatggggaaaca

SEQ ID NO: 330722 - DNA, 524 bp, Homo sapiens
tgcatgtatgtggatttggaagaatatacagcaaagtataacagcaaataacaatgctttggtgttagaattagtggtgacttttattttcgcctattgcacatctatgttttctaatttttccaattccttcattcatgtttattcattcattcaatagattgtgtgagtgtggctgacactgcctatcccctatagtacaatgggcagtgataacagaaaggtctctgcctttgtggagacaggaccacatcaggccacaaatgtgactctgagactgggagggtccctgcgcaggctccgggggtgctgagctctggagatggtaacctgggtcacgaggaactggaaggaatcccaggtagcagatgcagcacaggccaaggcctgggaggggcagccagggagcctgaggaactggataaggaggccttcccagaaagccactggaaaggtgaaggcatgaagacaggcatgatctgttttatactagacaaagatcacaccacttgccacgtagagaa

SEQ ID NO: 330723 - DNA, 293 bp, Homo sapiens
tcagcatggtgtgactaagcgtgacctgctgtaggtgttcagtactcaaggcttattaaatcctagtgtgtgactgtctgttaagcagggcttgcttgtaaacagttgatactcagttcataggaataagtatctgtaggctttaatttgatgacataaatctcagagggcttgcttggttttgagtttcaaataacaatttaaatgtcaccactaacatgtgagtgtctttgtaactcttgggacagtggaggtgaatttcaacatagctgttgtgtgatggaggaaaaact

SEQ ID NO: 330724 - DNA, 346 bp, Homo sapiens
tccccctgcgctctggtattaggcctggtccctggctctgaacttaggcctggctctgaacttaggcctggctctcctggctctgaacttaggcctggctctgaacttaggcatgggaccgacttacctttactgcagttctctcagcaactggcttttcccatttcctcagaactatccattttcacattttcttttttttgtttttgttttttgtttggttttgttttgtttttgttttttggagacggagttttgctctgtcacccaggctggagtgcagtggcatgatctgggctcactgcaacctccgcctcccgggttcaagcgattctcctgcctcagc

SEQ ID NO: 330725 - DNA, 5472 bp, Homo sapiens
  misc_feature (164)..(164): n is a, c, g, or t
  misc_feature (210)..(210): n is a, c, g, or t
gcggccgcggcgggagcggcggcgcactcggggggaagcaggccccactagacgggccgcgccgacgggctccgcgcactcgcagcccggggcgcccccacccccagcgcccgccgccgcgggcagggccggcccggagcgcggggggcggccggggagcgcgngccgggggcgcccgccgaagctcgctgctccgggtcggggtcgggnccggggccggccgcgcgccgcctttgacgcatcggagcgcggctcctgcaggatggagggctccgcgccgccagcggagttgtttgtgcgcaggcggctcgcggggctgggagcgctcaaggtctgaacttccctccggagccgcagctggaggaggcgagcgcgcgaggaggagaagccgcgcggcgcggaggccaccctcggggcgagaggcgcggaaggcgagcgagcaaagcggtcccggagccacggcggccacgcggcggggacccccgggcgttctaggtactggtgaccccggccggggcaggccccgggactcgacaacatggcttccccgccccaccagcagctgctgcatcaccacagcaccgaggtgagctgcgactccagcggggacagcaacagcgtgcgcgtcaagatcaaccccaagcagctgtcctccaacagccaccccaagcactgcaaatacagcatctcctctagctgcagcagctctggggactccgggggcgtcccccggcgagtgggcggcggaggccggctgcgcaggcagaagaagctgccccagctgttcgagagggcctccagccgctggtgggaccccaagttcgactcggtgaacctggaggaggcctgcctggagcgctgcttcccgcagacccagcgccggttccggtatgcgctcttctacatcggcttcgcctgccttctgtggagcatctattttgcggtccacatgagatccagactgatcgtcatggtcgcccccgcgctgtgcttcctcctggtgtgtgtgggcttctttctgtttaccttcaccaagctgtacgcccggcattacgcgtggacctcgctggctctcaccctgctggtgttcgccctgaccctggctgcgcagttccaggtcttgacgcctgtctcaggacgcggcgacagctccaaccttacggccacagcccggcccacagatacttgcttatctcaagtggggagcttctccatgtgcatcgaagtgctctttttgctctataccgtcatgcacttacctttgtacctgagtttgtgtctgggggtggcctactctgtccttttcgagacctttggctaccatttccgggatgaagcctgcttcccctcgcccggagccggggccctgcactgggagctgctgagcagggggctgctccacggctgcatccacgccatcggggtccacctgttcgtcatgtcccaggtgaggtccaggagcaccttcctcaaggtggggcaatccattatgcacgggaaggacctggaagtggaaaaagccctcaaagagaggatgattcattccgtgatgccaagaatcatagccgatgacttaatgaagcagggagatgaggagagtgagaattctgtcaagaggcatgccacctcgagccccaagaacaggaagaaaaagtcttccatccaaaaagctcctatagccttccgcccttttaagatgcagcagatcgaagaagtcagtattttatttgcagatatcgtgggcttcaccaagatgagtgccaacaagtctgcccacgccctggtgggtctcctgaacgatctgttcggtcgcttcgaccgcctgtgtgaggagaccaagtgtgagaaaatcagcaccctgggagactgttactactgcgtggcgggctgtcccgagccccgggccgaccatgcctactgctgcatcgagatgggcctgggcatgatcaaggccatcgagcagttctgccaggagaagaaggagatggtgaacatgagagtcggggtgcacacgggcaccgtcctttgcggcatcctgggcatgaggaggtttaaatttgacgtgtggtccaacgatgtgaacctggccaatctcatggagcagctgggagtggccggcaaagttcacatttctgaggccaccgcaaaatacttagatgaccggtacgaaatggaagatgggaaagttattgaacggctgggccagagcgtggttgctgaccagttgaaaggtttgaagacatacctgatatcgggtcagagagccaaggagtctcgctgcagctgtgcagaggccttgctttctggctttgaggtcattgacggctcacaggtgtcctcaggccctaggggacaggggacagcgtcatcagggaatgtcagtgacttggcgcagactgtcaaaacctttgataaccttaagacctgcccttcgtgcggaatcacatttgctcccaaatctgaagccggcgccgagggaggagcacctcaaaacggctgccaagacgagcataaaaacagcaccaaggcttctggaggacctaatcccaaaactcagaacgggctcctcagccctccccaagaggagaagctcaccaacagtcagacttctctgtgtgagatcttgcaggagaagggaaggtgggcaggggtgagcctggaccagtcggctctccttccgctgaggttcaagaacatccgggagaaaacggacgcccactttgtggacgttatcaaagaagacagcctgatgaaagattacttttttaagccgcccattaatcagttcagcctgaacttcctggatcaggagctggagcgatcctacaggaccagctatcaggaagaggtcataaagaactcccccgtgaagacgtttgctagtcccaccttcagctccctcctggatgtgtttctgtcgaccacagtgtttctgacgctgtccaccacctgcttcctgaagtacgaggcggccaccgtgcctcccccgcccgccgccctggcggtcttcagtgcagccctgctgctggaggtgctgtccctcgcggtgtccatcaggatggtgttcttcctggaggacgtcatggcctgcaccaagcgcctgctggagtggatcgccggctggctaccacgtcactgcatcggggccatcctggtgtcgcttcccgcactggccgtctactcccatgtcacctccgaatatgagaccaacatacacttcccagtgttcacaggctcggccgcgctgattgccgtcgtgcactactgtaacttctgccagctcagctcctggatgaggtcctccctcgccaccgtcgtgggggccgggccgctgctcctgctctacgtctccctgtgcccagacagttctgtattaacttcgccccttgacgcagtacagaatttcagttccgagaggaacccgtgcaatagttcggtgccgcgtgacctccggcggcccgccagcctcatcggccaggaggtggttctcgtcttctttctcctgctcttgttggtctggttcctgaatcgcgaatttgaagtcagctaccgcctccactaccacggagacgtggaagcggatcttcaccgcaccaagatccagagcatgcgggaccaggcagactggctgctgaggaacatcatcccctaccacgtggctgagcagctgaaggtgtcccagacctactccaagaaccacgacagcggaggggtgatcttcgccagcatcgtcaacttcagcgagttctacgaggagaactacgagggcggcaaggagtgctaccgggtcctcaacgagctcatcggggactttgacgagctcctaagcaagccggactacagcagcatcgagaagatcaagaccatcggagccacgtacatggcggcgtcagggctgaacaccgcgcaggcccaggacggcagccacccgcaggagcacctgcagatcctgttcgagttcgccaaggagatgatgcgcgtggtggacgacttcaacaacaacatgctgtggttcaacttcaagctccgcgtcggcttcaaccatgggcccctcacggccggggtcatcggcaccaccaagctgctgtacgacatctggggagacaccgtcaacatcgccagcaggatggacaccaccggcgtggagtgccgcatccaggtgagcgaagagagctaccgcgtcttgagcaagatgggctatgacttcgactacagagggaccgtgaatgtcaaggggaaaggccagatgaagacctacctgtacccaaagtgcacggatcacagggtcatcccacagcaccagctgtccatctccccagacatccgcgtccaggtggatggcagcatcggacggtctcccacagacgagattgccaacctggtgccttctgtccagtatgtggacaagacatctctgggttctgacagcagcacgcaggccaaggatgcccacctgtcccccaagagaccgtggaaggagcccgtcaaagccgaagaaaggggtcgatttggcaaagccatagagaaagacgactgtgacgaaacaggaatagaagaagccaacgaactcaccaagctcaacgtttcaaagagtgtgtgaggcggcgcccacccgctgcccgaggtgctctgtttgtcgaaacacagtaatatttgtatttggctgttgtgctttccaagcgccacagttgccctccccggacgtggtgttatgtggtcatttcagccctaacttctgtgtggatcacagttattcagggttcattttcatccattcttccctttcgctcccttccctggaaaccccgctgcctctgggtcatccgttcagcacgtggtggagaacaagtgccttcagggctggcctcggcctcgagtctcgggacagaggccgccagtggagatcatggctttgggtattatttgacttttagaacaaaagctgtggttaagatctcatttttattgctttttcccacgtcccacgagacactattttcggttctctggctaataccctgtttttgagtttattttgtttctgtctatgtcacagtgtccccctacgacccgacctctctatgtaagcacacatgcgcacacacacttgcattcatgaatctgatataaagtgccagtaatccgccaagagggggtgcgaagggggcatgtcacgacagctccgccaccccccattgcccacccgcactttcccgagcaccgcgccccgtgggctgtgggtgagccgcgctccctgcactgagcgggtttaggggctcgcccacatgcatgcaggccaagacagcaaatgccagccgggcacgacgcccgtgtgcccaggcctcgggggtctcagagccgcctctcacccccgaccctccacccaggggtctccccgtcgggagtggaggcgttggtcctggaagctgactcatcggagagggaaataccaaataaacatccgaggttgca

SEQ ID NO: 330726 - DNA, 7779 bp, Homo sapiens
  misc_feature (164)..(164): n is a, c, g, or t
  misc_feature (210)..(210): n is a, c, g, or t
gcggccgcggcgggagcggcggcgcactcggggggaagcaggccccactagacgggccgcgccgacgggctccgcgcactcgcagcccggggcgcccccacccccagcgcccgccgccgcgggcagggccggcccggagcgcggggggcggccggggagcgcgngccgggggcgcccgccgaagctcgctgctccgggtcggggtcgggnccggggccggccgcgcgccgcctttgacgcatcggagcgcggctcctgcaggatggagggctccgcgccgccagcggagttgtttgtgcgcaggcggctcgcggggctgggagcgctcaaggtctgaacttccctccggagccgcagctggaggaggcgagcgcgcgaggaggagaagccgcgcggcgcggaggccaccctcggggcgagaggcgcggaaggcgagcgagcaaagcggtcccggagccacggcggccacgcggcggggacccccgggcgttctaggtactggtgaccccggccggggcaggccccgggactcgacaacatggcttccccgccccaccagcagctgctgcatcaccacagcaccgaggtgagctgcgactccagcggggacagcaacagcgtgcgcgtcaagatcaaccccaagcagctgtcctccaacagccaccccaagcactgcaaatacagcatctcctctagctgcagcagctctggggactccgggggcgtcccccggcgagtgggcggcggaggccggctgcgcaggcagaagaagctgccccagctgttcgagagggcctccagccgctggtgggaccccaagttcgactcggtgaacctggaggaggcctgcctggagcgctgcttcccgcagacccagcgccggttccggtatgcgctcttctacatcggcttcgcctgccttctgtggagcatctattttgcggtccacatgagatccagactgatcgtcatggtcgcccccgcgctgtgcttcctcctggtgtgtgtgggcttctttctgtttaccttcaccaagctgtacgcccggcattacgcgtggacctcgctggctctcaccctgctggtgttcgccctgaccctggctgcgcagttccaggtcttgacgcctgtctcaggacgcggcgacagctccaaccttacggccacagcccggcccacagatacttgcttatctcaagtggggagcttctccatgtgcatcgaagtgctctttttgctctataccgtcatgcacttacctttgtacctgagtttgtgtctgggggtggcctactctgtccttttcgagacctttggctaccatttccgggatgaagcctgcttcccctcgcccggagccggggccctgcactgggagctgctgagcagggggctgctccacggctgcatccacgccatcggggtccacctgttcgtcatgtcccaggtgaggtccaggagcaccttcctcaaggtggggcaatccattatgcacgggaaggacctggaagtggaaaaagccctcaaagagaggatgattcattccgtgatgccaagaatcatagccgatgacttaatgaagcagggagatgaggagagtgagaattctgtcaagaggcatgccacctcgagccccaagaacaggaagaaaaagtcttccatccaaaaagctcctatagccttccgcccttttaagatgcagcagatcgaagaagtcagtattttatttgcagatatcgtgggcttcaccaagatgagtgccaacaagtctgcccacgccctggtgggtctcctgaacgatctgttcggtcgcttcgaccgcctgtgtgaggagaccaagtgtgagaaaatcagcaccctgggagactgttactactgcgtggcgggctgtcccgagccccgggccgaccatgcctactgctgcatcgagatgggcctgggcatgatcaaggccatcgagcagttctgccaggagaagaaggagatggtgaacatgagagtcggggtgcacacgggcaccgtcctttgcggcatcctgggcatgaggaggtttaaatttgacgtgtggtccaacgatgtgaacctggccaatctcatggagcagctgggagtggccggcaaagttcacatttctgaggccaccgcaaaatacttagatgaccggtacgaaatggaagatgggaaagttattgaacggctgggccagagcgtggttgctgaccagttgaaaggtttgaagacatacctgatatcgggtcagagagccaaggagtctcgctgcagctgtgcagaggccttgctttctggctttgaggtcattgacggctcacaggtgtcctcaggccctaggggacaggggacagcgtcatcagggaatgtcagtgacttggcgcagactgtcaaaacctttgataaccttaagacctgcccttcgtgcggaatcacatttgctcccaaatctgaagccggcgccgagggaggagcacctcaaaacggctgccaagacgagcataaaaacagcaccaaggtaacaagctcatggctgttgttcctgtcagttcctctcctggcgcatccacccaaggcttctggaggacctaatcccaaaactcagaacgggctcctcagccctccccaagaggagaagctcaccaacagtcagacttctctgtgtgagatcttgcaggagaagggaaggtgggcaggggtgagcctggaccagtcggctctccttccgctgaggttcaagaacatccgggagaaaacggacgcccactttgtggacgttatcaaagaagacagcctgatgaaagattacttttttaagccgcccattaatcagttcagcctgaacttcctggatcaggagctggagcgatcctacaggaccagctatcaggaagaggtcataaagaactcccccgtgaagacgtttgctagtcccaccttcagctccctcctggatgtgtttctgtcgaccacagtgtttctgacgctgtccaccacctgcttcctgaagtacgaggcggccaccgtgcctcccccgcccgccgccctggcggtcttcagtgcagccctgctgctggaggtgctgtccctcgcggtgtccatcaggatggtgttcttcctggaggacgtcatggcctgcaccaagcgcctgctggagtggatcgccggctggctaccacgtcactgcatcggggccatcctggtgtcgcttcccgcactggccgtctactcccatgtcacctccgaatatgagaccaacatacacttcccagtgttcacaggctcggccgcgctgattgccgtcgtgcactactgtaacttctgccagctcagctcctggatgaggtcctccctcgccaccgtcgtgggggccgggccgctgctcctgctctacgtctccctgtgcccagacagttctgtattaacttcgccccttgacgcagtacagaatttcagttccgagaggaacccgtgcaatagttcggtgccgcgtgacctccggcggcccgccagcctcatcggccaggaggtggttctcgtcttctttctcctgctcttgttggtctggttcctgaatcgcgaatttgaagtcagctaccgcctccactaccacggagacgtggaagcggatcttcaccgcaccaagatccagagcatgcgggaccaggcagactggctgctgaggaacatcatcccctaccacgtggctgagcagctgaaggtgtcccagacctactccaagaaccacgacagcggaggggtgatcttcgccagcatcgtcaacttcagcgagttctacgaggagaactacgagggcggcaaggagtgctaccgggtcctcaacgagctcatcggggactttgacgagctcctaagcaagccggactacagcagcatcgagaagatcaagaccatcggagccacgtacatggcggcgtcagggctgaacaccgcgcaggcccaggacggcagccacccgcaggagcacctgcagatcctgttcgagttcgccaaggagatgatgcgcgtggtggacgacttcaacaacaacatgctgtggttcaacttcaagctccgcgtcggcttcaaccatgggcccctcacggccggggtcatcggcaccaccaagctgctgtacgacatctggggagacaccgtcaacatcgccagcaggatggacaccaccggcgtggagtgccgcatccaggtgagcgaagagagctaccgcgtcttgagcaagatgggctatgacttcgactacagagggaccgtgaatgtcaaggggaaaggccagatgaagacctacctgtacccaaagtgcacggatcacagggtcatcccacagcaccagctgtccatctccccagacatccgcgtccaggtggatggcagcatcggacggtctcccacagacgagattgccaacctggtgccttctgtccagtatgtggacaagacatctctgggttctgacagcagcacgcaggccaaggatgcccacctgtcccccaagagaccgtggaaggagcccgtcaaagccgaagaaaggggtcgatttggcaaagccatagagaaagacgactgtgacgaaacaggaatagaagaagccaacgaactcaccaagctcaacgtttcaaagagtgtgtgaggcggcgcccacccgctgcccgaggtgctctgtttgtcgaaacacagtaatatttgtatttggctgttgtgctttccaagcgccacagttgccctccccggacgtggtgttatgtggtcatttcagccctaacttctgtgtggatcacagttattcagggttcattttcatccattcttccctttcgctcccttccctggaaaccccgctgcctctgggtcatccgttcagcacgtggtggagaacaagtgccttcagggctggcctcggcctcgagtctcgggacagaggccgccagtggagatcatggctttgggtattatttgacttttagaacaaaagctgtggttaagatctcatttttattgctttttcccacgtcccacgagacactattttcggttctctggctaataccctgtttttgagtttattttgtttctgtctatgtcacagtgtccccctacgacccgacctctctatgtaagcacacatgcgcacacacacttgcattcatgaatctgatataaagtgccagtaatccgccaagagggggtgcgaagggggcatgtcacgacagctccgccaccccccattgcccacccgcactttcccgagcaccgcgccccgtgggctgtgggtgagccgcgctccctgcactgagcgggtttaggggctcgcccacatgcatgcaggccaagacagcaaatgccagccgggcacgacgcccgtgtgcccaggcctcgggggtctcagagccgcctctcacccccgaccctccacccaggggtctccccgtcgggagtggaggcgttggtcctggaagctgactcatcggagagggaaataccaaataaacatccgaggttgcatttatttatttatttacccggaagcatgtgcgctcccgggaggggtgctgggtcctcagggtggggggtcatagccacaggggagggcagttcccaggaaggtaaccagatgtctcttttgtgttttggccacctggggccgcccccaacctccccaccccaagaggggtctgagtgggacctcaaagcatggccagtgcaattctgaggctaggggaataggagaagcccaccagctgcccctgccacccacgggggctcctccctgccggggtccagctcagaaccacgggggtctgtgccggcagcaccggtgccatcttggcttccacaaattccagaagtttcttggctgcctcccgctctcagatggcacagggcctatcagtggcaggatttaatctggggagcaaattccagctctgaaatggagttctcacaccgtatctagggacagaggcatctggatgcaaacgcggggtttgttaggggcggaatcccgagggtggtgtgggggagctccgtccgggcagttggctgctggtcctgtctgattatgttttgccatattgagtctgaagtttgtgtggaagtgagctcgcccgagttgtccggtcggagttgtagccagtctttcaggggaccccgggacgccgatgaggcccagggtgcactccttgtcagtcttgcccgttgtccctgtgcattttgctttccgctgtcaaatctcactgtctcgttttcacaccgcatcagtccccatcatcactactcctccccaaagacatacagattgccctccccggcatgaagaagtcacaattctgacccgccacctctccaggggcggtgcctgggatggccacccatcaggacagccagagccggggtcccggcgtcctgagagtccagggcacctccccccattagctgtaaggtttcctgtcaggtgtgactgtcagtttgctggtcttccaataccgaagaaagggtggttgtgacaatacctcttgcttctaaagaatgtattataaaacaccgcagatttttttttttccttaaaaaacactacctgatgctttccttgttcgtggggattgtggtcacatgaagctctttctgcatcagtattaaggtgtatatttgaatgtcctcccctcccctttcccctccaggctgtgtagctttgaggggctgggcgtttgctcacgaccttgctgtctcgctcagaacatgctccgcaaagttctccgcacacacttcttccccatcaagcccatttccttccccaaccacaaaggtgtttgtgattcctcaccccgggaaaccaaggagctgcaaagtggagtctggttcagccccgtgcagactcacccagagcttaacgttgtctttcaaacaccctgagccttcctaaacagccagtgcagacgttctctctgggccacgaagcccctcgggtcctccccgtcccctgctccgatgcatacctcagtgcagaaccacagaatctctgcagcggaaacgccgtgcatctcttgtctgttggcagcgagcacatcgtgctggagacacgagtttctaagcagctggcacgagggctgctgacggcatgggtcgtgcttcagggtggcaatacctcttaggaacttagggcaggaagcaatacttcagcattgaatgtgtgtaaatagttgctttgagttgcaattgctattttcttctcagtcccagctcagatcgaattatatatccatatatatatatatatatatatatatatatatatatatatggtaaacaagcacacacaattttatccaatgcaaacaaatgtagagcatcagttacaaaaccctcgaatagcttgagagccccacaggctctgccacacccgtgacttcatccacactgacgtcacccgcgggggctccccctgcacatttgcacacgatccggaggagccgaaggccgcgtgcttcctgtcacatgggctgtaatcatttgtagtttccaaagacacgtctgcatttgaatttctagattttcgaggtaaggagttttttttaattggttgtttggaaaatcacatcatgcctagaatctgaaattgaattagcaagaaccgactgtttgcattttccatatatccttttatctgctctttttaaattgttaattctaataatttcaaaatgcattcactgaagaaatggacattaaaatattctaaaatttaaataaaaaaag
